United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 34

SEQ ID NO: 1216247 - RNA, 17 nt, Mycobacterium bovis subsp bovis AF2122/97
cgccugucccgccggcc

SEQ ID NO: 1216248 - RNA, 14 nt, Mycobacterium bovis subsp bovis AF2122/97
cgccuguaccggcg

SEQ ID NO: 1216249 - RNA, 16 nt, Mycobacterium bovis subsp bovis AF2122/97
cgccugugccgccggc

SEQ ID NO: 1216250 - RNA, 21 nt, Mycobacterium bovis subsp bovis AF2122/97
cgccuucuccggcgucacggc

SEQ ID NO: 1216251 - RNA, 18 nt, Mycobacterium bovis subsp bovis AF2122/97
cgccuucucccgcacggc

SEQ ID NO: 1216252 - RNA, 19 nt, Mycobacterium bovis subsp bovis AF2122/97
cgccuucucccgcacggcc

SEQ ID NO: 1216253 - RNA, 21 nt, Mycobacterium bovis subsp bovis AF2122/97
cgccuguucgggagcugauca

SEQ ID NO: 1216254 - RNA, 20 nt, Mycobacterium bovis subsp bovis AF2122/97
cgccuugacugaacucaaca

SEQ ID NO: 1216255 - RNA, 22 nt, Mycobacterium bovis subsp bovis AF2122/97
cgccuugauggucuccaccagg

SEQ ID NO: 1216256 - RNA, 17 nt, Mycobacterium bovis subsp bovis AF2122/97
cgccuucuuggcggccu

SEQ ID NO: 1216257 - RNA, 21 nt, Mycobacterium bovis subsp bovis AF2122/97
cgccuuggucaccuucuuggc

SEQ ID NO: 1216258 - RNA, 14 nt, Mycobacterium bovis subsp bovis AF2122/97
cgccuuggccacca

SEQ ID NO: 1216259 - RNA, 16 nt, Mycobacterium bovis subsp bovis AF2122/97
cgccuuggccaccauc

SEQ ID NO: 1216260 - RNA, 16 nt, Mycobacterium bovis subsp bovis AF2122/97
cgccuuggucgccgcc

SEQ ID NO: 1216261 - RNA, 17 nt, Mycobacterium bovis subsp bovis AF2122/97
cgccuuggucgccgccu

SEQ ID NO: 1216262 - RNA, 17 nt, Mycobacterium bovis subsp bovis AF2122/97
cgccuuggucgccgcuu

SEQ ID NO: 1216263 - RNA, 21 nt, Mycobacterium bovis subsp bovis AF2122/97
cgccuuggucgccgcuuucuu

SEQ ID NO: 1216264 - RNA, 13 nt, Mycobacterium bovis subsp bovis AF2122/97
cgccuuggcaccc

SEQ ID NO: 1216265 - RNA, 23 nt, Mycobacterium bovis subsp bovis AF2122/97
cgccuugcuuccgggacuaccac

SEQ ID NO: 1216266 - RNA, 17 nt, Mycobacterium bovis subsp bovis AF2122/97
cgccuuggcacccuccg

SEQ ID NO: 1216267 - RNA, 23 nt, Mycobacterium bovis subsp bovis AF2122/97
cgccuugcgggccugguggauga

SEQ ID NO: 1216268 - RNA, 14 nt, Mycobacterium bovis subsp bovis AF2122/97
cgccuugucggcga

SEQ ID NO: 1216269 - RNA, 21 nt, Mycobacterium bovis subsp bovis AF2122/97
cgccuuguggcacacccgcac

SEQ ID NO: 1216270 - RNA, 16 nt, Mycobacterium bovis subsp bovis AF2122/97
cgccuuugcccgccgc

SEQ ID NO: 1216271 - RNA, 13 nt, Mycobacterium bovis subsp bovis AF2122/97
cgcgccgcgcauc

SEQ ID NO: 1216272 - RNA, 19 nt, Mycobacterium bovis subsp bovis AF2122/97
cgcgccgcgcaucgcggcc

SEQ ID NO: 1216273 - RNA, 16 nt, Mycobacterium bovis subsp bovis AF2122/97
cgcgccggguccgcgg

SEQ ID NO: 1216274 - RNA, 15 nt, Mycobacterium bovis subsp bovis AF2122/97
cgcgccgcggcccgc

SEQ ID NO: 1216275 - RNA, 15 nt, Mycobacterium bovis subsp bovis AF2122/97
cgcgccgcgccgccu

SEQ ID NO: 1216276 - RNA, 14 nt, Mycobacterium bovis subsp bovis AF2122/97
cgcgcgccgcagcg

SEQ ID NO: 1216277 - RNA, 13 nt, Mycobacterium bovis subsp bovis AF2122/97
cgcgcgccgcgac

SEQ ID NO: 1216278 - RNA, 15 nt, Mycobacterium bovis subsp bovis AF2122/97
cgcgcgccggcggua

SEQ ID NO: 1216279 - RNA, 17 nt, Mycobacterium bovis subsp bovis AF2122/97
cgcgcgccggcugccac

SEQ ID NO: 1216280 - RNA, 24 nt, Mycobacterium bovis subsp bovis AF2122/97
cgcgccgucggguuccuccucggc

SEQ ID NO: 1216281 - RNA, 21 nt, Mycobacterium bovis subsp bovis AF2122/97
cgcgccgucgucgaccacgac

SEQ ID NO: 1216282 - RNA, 22 nt, Mycobacterium bovis subsp bovis AF2122/97
cgcgccguagaccagcaggccc

SEQ ID NO: 1216283 - RNA, 17 nt, Mycobacterium bovis subsp bovis AF2122/97
cgcgccgguucagacgg

SEQ ID NO: 1216284 - RNA, 20 nt, Mycobacterium bovis subsp bovis AF2122/97
cgcgccaaacaccccggccu

SEQ ID NO: 1216285 - RNA, 13 nt, Mycobacterium bovis subsp bovis AF2122/97
cgcgcccaaccug

SEQ ID NO: 1216286 - RNA, 14 nt, Mycobacterium bovis subsp bovis AF2122/97
cgcgcccuagcugg

SEQ ID NO: 1216287 - RNA, 20 nt, Mycobacterium bovis subsp bovis AF2122/97
cgcgcccuagcuggugcgcc

SEQ ID NO: 1216288 - RNA, 14 nt, Mycobacterium bovis subsp bovis AF2122/97
cgcgcccucagccg

SEQ ID NO: 1216289 - RNA, 19 nt, Mycobacterium bovis subsp bovis AF2122/97
cgcgcccgggcggaacgcc

SEQ ID NO: 1216290 - RNA, 14 nt, Mycobacterium bovis subsp bovis AF2122/97
cgcgcccgcgcgcu

SEQ ID NO: 1216291 - RNA, 19 nt, Mycobacterium bovis subsp bovis AF2122/97
cgcgcccgcggccgccagc

SEQ ID NO: 1216292 - RNA, 20 nt, Mycobacterium bovis subsp bovis AF2122/97
cgcgcccgcggccgccagcg

SEQ ID NO: 1216293 - RNA, 13 nt, Mycobacterium bovis subsp bovis AF2122/97
cgcgcccgcgggc

SEQ ID NO: 1216294 - RNA, 22 nt, Mycobacterium bovis subsp bovis AF2122/97
cgcgcccgccucgaccgccagc

SEQ ID NO: 1216295 - RNA, 19 nt, Mycobacterium bovis subsp bovis AF2122/97
cgcgcccgccucaucggca

SEQ ID NO: 1216296 - RNA, 22 nt, Mycobacterium bovis subsp bovis AF2122/97
cgcgcccgacgagauugccggg

SEQ ID NO: 1216297 - RNA, 21 nt, Mycobacterium bovis subsp bovis AF2122/97
cgcgcccgccaucagcccggc

SEQ ID NO: 1216298 - RNA, 18 nt, Mycobacterium bovis subsp bovis AF2122/97
cgcgcacuugcguggcgu

SEQ ID NO: 1216299 - RNA, 17 nt, Mycobacterium bovis subsp bovis AF2122/97
cgcgcacggcccgagcc

SEQ ID NO: 1216300 - RNA, 19 nt, Mycobacterium bovis subsp bovis AF2122/97
cgcgcacggcccgagccgc

SEQ ID NO: 1216301 - RNA, 18 nt, Mycobacterium bovis subsp bovis AF2122/97
cgcgcaacgccgccagcc

SEQ ID NO: 1216302 - RNA, 19 nt, Mycobacterium bovis subsp bovis AF2122/97
cgcgcaaccgggcggacag

SEQ ID NO: 1216303 - RNA, 17 nt, Mycobacterium bovis subsp bovis AF2122/97
cgcgcaacgccgccagc

SEQ ID NO: 1216304 - RNA, 16 nt, Mycobacterium bovis subsp bovis AF2122/97
cgcgcaccggaucgcc

SEQ ID NO: 1216305 - RNA, 20 nt, Mycobacterium bovis subsp bovis AF2122/97
cgcgcaccggguugagccgc

SEQ ID NO: 1216306 - RNA, 14 nt, Mycobacterium bovis subsp bovis AF2122/97
cgcgcacgcgugcc

SEQ ID NO: 1216307 - RNA, 19 nt, Mycobacterium bovis subsp bovis AF2122/97
cgcgcaggcuuccagccac

SEQ ID NO: 1216308 - RNA, 22 nt, Mycobacterium bovis subsp bovis AF2122/97
cgcgcaggcuuccagccacagc

SEQ ID NO: 1216309 - RNA, 14 nt, Mycobacterium bovis subsp bovis AF2122/97
cgcgcaggccgccg

SEQ ID NO: 1216310 - RNA, 18 nt, Mycobacterium bovis subsp bovis AF2122/97
cgcgcaggccgccgccag

SEQ ID NO: 1216311 - RNA, 14 nt, Mycobacterium bovis subsp bovis AF2122/97
cgcgcaggaccugc

SEQ ID NO: 1216312 - RNA, 20 nt, Mycobacterium bovis subsp bovis AF2122/97
cgcgcauugccgacgcgcgg

SEQ ID NO: 1216313 - RNA, 21 nt, Mycobacterium bovis subsp bovis AF2122/97
cgcgcauugccgacgcgcggc

SEQ ID NO: 1216314 - RNA, 17 nt, Mycobacterium bovis subsp bovis AF2122/97
cgcgcauuucguggcgc

SEQ ID NO: 1216315 - RNA, 16 nt, Mycobacterium bovis subsp bovis AF2122/97
cgcgcauucgccgggc

SEQ ID NO: 1216316 - RNA, 18 nt, Mycobacterium bovis subsp bovis AF2122/97
cgcgccaaacaccccggc

SEQ ID NO: 1216317 - RNA, 15 nt, Mycobacterium bovis subsp bovis AF2122/97
cgcgcaaccgggcgg

SEQ ID NO: 1216318 - RNA, 17 nt, Mycobacterium bovis subsp bovis AF2122/97
cgcgcaaaugccugcug

SEQ ID NO: 1216319 - RNA, 14 nt, Mycobacterium bovis subsp bovis AF2122/97
cgcgcaacccggac

SEQ ID NO: 1216320 - RNA, 17 nt, Mycobacterium bovis subsp bovis AF2122/97
cgcgaugguggccgcca

SEQ ID NO: 1216321 - RNA, 17 nt, Mycobacterium bovis subsp bovis AF2122/97
cgcgauguccagguggc

SEQ ID NO: 1216322 - RNA, 14 nt, Mycobacterium bovis subsp bovis AF2122/97
cgcgauggugcgcc

SEQ ID NO: 1216323 - RNA, 20 nt, Mycobacterium bovis subsp bovis AF2122/97
cgcgauuagcaaaccgaccg

SEQ ID NO: 1216324 - RNA, 17 nt, Mycobacterium bovis subsp bovis AF2122/97
cgcgaugugcgccaccu

SEQ ID NO: 1216325 - RNA, 17 nt, Mycobacterium bovis subsp bovis AF2122/97
cgcgauuccggcggcca

SEQ ID NO: 1216326 - RNA, 14 nt, Mycobacterium bovis subsp bovis AF2122/97
cgcgauggacccaa

SEQ ID NO: 1216327 - RNA, 15 nt, Mycobacterium bovis subsp bovis AF2122/97
cgcgauggcagcgcc

SEQ ID NO: 1216328 - RNA, 19 nt, Mycobacterium bovis subsp bovis AF2122/97
cgcgaugccacccaacagc

SEQ ID NO: 1216329 - RNA, 17 nt, Mycobacterium bovis subsp bovis AF2122/97
cgcgaucgggcccagca

SEQ ID NO: 1216330 - RNA, 13 nt, Mycobacterium bovis subsp bovis AF2122/97
cgcgaucgcgccc

SEQ ID NO: 1216331 - RNA, 16 nt, Mycobacterium bovis subsp bovis AF2122/97
cgcgaucucggagcgc

SEQ ID NO: 1216332 - RNA, 19 nt, Mycobacterium bovis subsp bovis AF2122/97
cgcgaucgggcccagcagc

SEQ ID NO: 1216333 - RNA, 16 nt, Mycobacterium bovis subsp bovis AF2122/97
cgcgaucugcucgccc

SEQ ID NO: 1216334 - RNA, 14 nt, Mycobacterium bovis subsp bovis AF2122/97
cgcgaugaccucgg

SEQ ID NO: 1216335 - RNA, 13 nt, Mycobacterium bovis subsp bovis AF2122/97
cgcgaugagcggc

SEQ ID NO: 1216336 - RNA, 19 nt, Mycobacterium bovis subsp bovis AF2122/97
cgcgaugagcggcgcggca

SEQ ID NO: 1216337 - RNA, 15 nt, Mycobacterium bovis subsp bovis AF2122/97
cgcggugggcacagc

SEQ ID NO: 1216338 - RNA, 20 nt, Mycobacterium bovis subsp bovis AF2122/97
cgcgguggcggucgccacac

SEQ ID NO: 1216339 - RNA, 22 nt, Mycobacterium bovis subsp bovis AF2122/97
cgcgguggcggugucggcgccg

SEQ ID NO: 1216340 - RNA, 20 nt, Mycobacterium bovis subsp bovis AF2122/97
cgcgguguagaagcgggcgu

SEQ ID NO: 1216341 - RNA, 19 nt, Mycobacterium bovis subsp bovis AF2122/97
cgcgguggggucgacgcag

SEQ ID NO: 1216342 - RNA, 16 nt, Mycobacterium bovis subsp bovis AF2122/97
cgcggugugcggcagc

SEQ ID NO: 1216343 - RNA, 19 nt, Mycobacterium bovis subsp bovis AF2122/97
cgcggugucggggcccccg

SEQ ID NO: 1216344 - RNA, 11 nt, Mycobacterium bovis subsp bovis AF2122/97
cgcgguguucg

SEQ ID NO: 1216345 - RNA, 14 nt, Mycobacterium bovis subsp bovis AF2122/97
cgcgguuggcggcg

SEQ ID NO: 1216346 - RNA, 17 nt, Mycobacterium bovis subsp bovis AF2122/97
cgcgguugugacgguga

SEQ ID NO: 1216347 - RNA, 19 nt, Mycobacterium bovis subsp bovis AF2122/97
cgcggugacgagccaccac

SEQ ID NO: 1216348 - RNA, 22 nt, Mycobacterium bovis subsp bovis AF2122/97
cgcggugacucggccuccgccg

SEQ ID NO: 1216349 - RNA, 13 nt, Mycobacterium bovis subsp bovis AF2122/97
cgcggugccgcca

SEQ ID NO: 1216350 - RNA, 16 nt, Mycobacterium bovis subsp bovis AF2122/97
cgcggugccgccaccg

SEQ ID NO: 1216351 - RNA, 13 nt, Mycobacterium bovis subsp bovis AF2122/97
cgcggugcccgcg

SEQ ID NO: 1216352 - RNA, 13 nt, Mycobacterium bovis subsp bovis AF2122/97
cgcggugcgcgca

SEQ ID NO: 1216353 - RNA, 18 nt, Mycobacterium bovis subsp bovis AF2122/97
cgcggugccgccaccggc

SEQ ID NO: 1216354 - RNA, 15 nt, Mycobacterium bovis subsp bovis AF2122/97
cgcggugccggcgga

SEQ ID NO: 1216355 - RNA, 19 nt, Mycobacterium bovis subsp bovis AF2122/97
cgcggucugcgccuucgcc

SEQ ID NO: 1216356 - RNA, 19 nt, Mycobacterium bovis subsp bovis AF2122/97
cgcggucucagugcucgcc

SEQ ID NO: 1216357 - RNA, 22 nt, Mycobacterium bovis subsp bovis AF2122/97
cgcggucgugaucagcaggacg

SEQ ID NO: 1216358 - RNA, 17 nt, Mycobacterium bovis subsp bovis AF2122/97
cgcggucgcagcagacc

SEQ ID NO: 1216359 - RNA, 12 nt, Mycobacterium bovis subsp bovis AF2122/97
cgcggucggcag

SEQ ID NO: 1216360 - RNA, 22 nt, Mycobacterium bovis subsp bovis AF2122/97
cgcggucggagucgagcacacc

SEQ ID NO: 1216361 - RNA, 13 nt, Mycobacterium bovis subsp bovis AF2122/97
cgcggucgcagca

SEQ ID NO: 1216362 - RNA, 19 nt, Mycobacterium bovis subsp bovis AF2122/97
cgcggucaucgagcugacc

SEQ ID NO: 1216363 - RNA, 22 nt, Mycobacterium bovis subsp bovis AF2122/97
cgcggucccacggccggccgcu

SEQ ID NO: 1216364 - RNA, 19 nt, Mycobacterium bovis subsp bovis AF2122/97
cgcggucgagguggcgggc

SEQ ID NO: 1216365 - RNA, 17 nt, Mycobacterium bovis subsp bovis AF2122/97
cgcggucgaucaggccg

SEQ ID NO: 1216366 - RNA, 15 nt, Mycobacterium bovis subsp bovis AF2122/97
cgcggucgagcaggu

SEQ ID NO: 1216367 - RNA, 12 nt, Mycobacterium bovis subsp bovis AF2122/97
cgcggucagcgg

SEQ ID NO: 1216368 - RNA, 21 nt, Mycobacterium bovis subsp bovis AF2122/97
cgcggucagccauguccgcag

SEQ ID NO: 1216369 - RNA, 21 nt, Mycobacterium bovis subsp bovis AF2122/97
cgcggucaccccggcucggcc

SEQ ID NO: 1216370 - RNA, 15 nt, Mycobacterium bovis subsp bovis AF2122/97
cgcgguacugcgcag

SEQ ID NO: 1216371 - RNA, 17 nt, Mycobacterium bovis subsp bovis AF2122/97
cgcgguagccgcggcca

SEQ ID NO: 1216372 - RNA, 13 nt, Mycobacterium bovis subsp bovis AF2122/97
cgcgguagcgccg

SEQ ID NO: 1216373 - RNA, 19 nt, Mycobacterium bovis subsp bovis AF2122/97
cgcgguaccaucaccgcgc

SEQ ID NO: 1216374 - RNA, 21 nt, Mycobacterium bovis subsp bovis AF2122/97
cgcgguaccaucaccgcgcca

SEQ ID NO: 1216375 - RNA, 21 nt, Mycobacterium bovis subsp bovis AF2122/97
cgcgguacccaccucccgcag

SEQ ID NO: 1216376 - RNA, 20 nt, Mycobacterium bovis subsp bovis AF2122/97
cgcgguaccgcucgggcgcg

SEQ ID NO: 1216377 - RNA, 12 nt, Mycobacterium bovis subsp bovis AF2122/97
cgcgggugcgga

SEQ ID NO: 1216378 - RNA, 16 nt, Mycobacterium bovis subsp bovis AF2122/97
cgcgggugcgccggcg

SEQ ID NO: 1216379 - RNA, 17 nt, Mycobacterium bovis subsp bovis AF2122/97
cgcggguuggguguguu

SEQ ID NO: 1216380 - RNA, 14 nt, Mycobacterium bovis subsp bovis AF2122/97
cgcgguaaagcccc

SEQ ID NO: 1216381 - RNA, 13 nt, Mycobacterium bovis subsp bovis AF2122/97
cgcgugaccaggg

SEQ ID NO: 1216382 - RNA, 21 nt, Mycobacterium bovis subsp bovis AF2122/97
cgcgucuuggugcgcgucagc

SEQ ID NO: 1216383 - RNA, 22 nt, Mycobacterium bovis subsp bovis AF2122/97
cgcgucuacgucguccagcacc

SEQ ID NO: 1216384 - RNA, 23 nt, Mycobacterium bovis subsp bovis AF2122/97
cgcgucuacgucguccagcacca

SEQ ID NO: 1216385 - RNA, 15 nt, Mycobacterium bovis subsp bovis AF2122/97
cgcgucugcucgcca

SEQ ID NO: 1216386 - RNA, 17 nt, Mycobacterium bovis subsp bovis AF2122/97
cgcgucugcucgccagc

SEQ ID NO: 1216387 - RNA, 22 nt, Mycobacterium bovis subsp bovis AF2122/97
cgcgucgaacugggcgcccgcg

SEQ ID NO: 1216388 - RNA, 17 nt, Mycobacterium bovis subsp bovis AF2122/97
cgcgucggcggcgaccg

SEQ ID NO: 1216389 - RNA, 14 nt, Mycobacterium bovis subsp bovis AF2122/97
cgcgucgucacgau

SEQ ID NO: 1216390 - RNA, 13 nt, Mycobacterium bovis subsp bovis AF2122/97
cgcgucgggccgc

SEQ ID NO: 1216391 - RNA, 17 nt, Mycobacterium bovis subsp bovis AF2122/97
cgcguuccuccagcagc

SEQ ID NO: 1216392 - RNA, 14 nt, Mycobacterium bovis subsp bovis AF2122/97
cgcguucgagugcg

SEQ ID NO: 1216393 - RNA, 16 nt, Mycobacterium bovis subsp bovis AF2122/97
cgcguucaggaugcca

SEQ ID NO: 1216394 - RNA, 19 nt, Mycobacterium bovis subsp bovis AF2122/97
cgcguuucgucgaccgcgc

SEQ ID NO: 1216395 - RNA, 20 nt, Mycobacterium bovis subsp bovis AF2122/97
cgcguggcuggcggcgaccg

SEQ ID NO: 1216396 - RNA, 14 nt, Mycobacterium bovis subsp bovis AF2122/97
cgcguggcgcacca

SEQ ID NO: 1216397 - RNA, 21 nt, Mycobacterium bovis subsp bovis AF2122/97
cgcguggcgcaccaccgcccc

SEQ ID NO: 1216398 - RNA, 20 nt, Mycobacterium bovis subsp bovis AF2122/97
cgcgugggcgugcaggcugg

SEQ ID NO: 1216399 - RNA, 17 nt, Mycobacterium bovis subsp bovis AF2122/97
cgcgugguaccgcuugu

SEQ ID NO: 1216400 - RNA, 20 nt, Mycobacterium bovis subsp bovis AF2122/97
cgcguccgcaggcgauugca

SEQ ID NO: 1216401 - RNA, 17 nt, Mycobacterium bovis subsp bovis AF2122/97
cgcgucccgccgcaccg

SEQ ID NO: 1216402 - RNA, 13 nt, Mycobacterium bovis subsp bovis AF2122/97
cgcguccgccucg

SEQ ID NO: 1216403 - RNA, 14 nt, Mycobacterium bovis subsp bovis AF2122/97
cgcguccgggcagc

SEQ ID NO: 1216404 - RNA, 22 nt, Mycobacterium bovis subsp bovis AF2122/97
cgcguccgggcagccgcgccgc

SEQ ID NO: 1216405 - RNA, 18 nt, Mycobacterium bovis subsp bovis AF2122/97
cgcguccgggcagccgcg

SEQ ID NO: 1216406 - RNA, 21 nt, Mycobacterium bovis subsp bovis AF2122/97
cgcguccgggcagccgcgccg

SEQ ID NO: 1216407 - RNA, 13 nt, Mycobacterium bovis subsp bovis AF2122/97
cgcgucaagucug

SEQ ID NO: 1216408 - RNA, 15 nt, Mycobacterium bovis subsp bovis AF2122/97
cgcgucaaacaccuc

SEQ ID NO: 1216409 - RNA, 17 nt, Mycobacterium bovis subsp bovis AF2122/97
cgcguagggccagcgcc

SEQ ID NO: 1216410 - RNA, 16 nt, Mycobacterium bovis subsp bovis AF2122/97
cgcguagaccagugac

SEQ ID NO: 1216411 - RNA, 15 nt, Mycobacterium bovis subsp bovis AF2122/97
cgcguagagcagcag

SEQ ID NO: 1216412 - RNA, 18 nt, Mycobacterium bovis subsp bovis AF2122/97
cgcguaaaccggcugacc

SEQ ID NO: 1216413 - RNA, 22 nt, Mycobacterium bovis subsp bovis AF2122/97
cgcguaauccgagcgcggcggc

SEQ ID NO: 1216414 - RNA, 18 nt, Mycobacterium bovis subsp bovis AF2122/97
cgcggcggccuccaccac

SEQ ID NO: 1216415 - RNA, 15 nt, Mycobacterium bovis subsp bovis AF2122/97
cgcggcggccagcgc

SEQ ID NO: 1216416 - RNA, 24 nt, Mycobacterium bovis subsp bovis AF2122/97
cgcggcgacaagccgagcccgucg

SEQ ID NO: 1216417 - RNA, 19 nt, Mycobacterium bovis subsp bovis AF2122/97
cgcggcggcguccaccugc

SEQ ID NO: 1216418 - RNA, 12 nt, Mycobacterium bovis subsp bovis AF2122/97
cgcggcggcgcc

SEQ ID NO: 1216419 - RNA, 12 nt, Mycobacterium bovis subsp bovis AF2122/97
cgcggcgggccc

SEQ ID NO: 1216420 - RNA, 14 nt, Mycobacterium bovis subsp bovis AF2122/97
cgcggcgggcccga

SEQ ID NO: 1216421 - RNA, 21 nt, Mycobacterium bovis subsp bovis AF2122/97
cgcggcggguccucgcggagc

SEQ ID NO: 1216422 - RNA, 22 nt, Mycobacterium bovis subsp bovis AF2122/97
cgcggcggucguugccgaccga

SEQ ID NO: 1216423 - RNA, 17 nt, Mycobacterium bovis subsp bovis AF2122/97
cgcggcggucuggguga

SEQ ID NO: 1216424 - RNA, 23 nt, Mycobacterium bovis subsp bovis AF2122/97
cgcggcugccagaaugggcggca

SEQ ID NO: 1216425 - RNA, 21 nt, Mycobacterium bovis subsp bovis AF2122/97
cgcggcugccaucccgauccc

SEQ ID NO: 1216426 - RNA, 12 nt, Mycobacterium bovis subsp bovis AF2122/97
cgcggccagcgg

SEQ ID NO: 1216427 - RNA, 20 nt, Mycobacterium bovis subsp bovis AF2122/97
cgcggccauggcagcgcgcu

SEQ ID NO: 1216428 - RNA, 13 nt, Mycobacterium bovis subsp bovis AF2122/97
cgcggccggcgcu

SEQ ID NO: 1216429 - RNA, 14 nt, Mycobacterium bovis subsp bovis AF2122/97
cgcggccggccgcu

SEQ ID NO: 1216430 - RNA, 22 nt, Mycobacterium bovis subsp bovis AF2122/97
cgcggccauuagcagcacccgg

SEQ ID NO: 1216431 - RNA, 13 nt, Mycobacterium bovis subsp bovis AF2122/97
cgcggccgggcgc

SEQ ID NO: 1216432 - RNA, 13 nt, Mycobacterium bovis subsp bovis AF2122/97
cgcggccggcgug

SEQ ID NO: 1216433 - RNA, 16 nt, Mycobacterium bovis subsp bovis AF2122/97
cgcggccucguagucc

SEQ ID NO: 1216434 - RNA, 16 nt, Mycobacterium bovis subsp bovis AF2122/97
cgcggccugacgcugc

SEQ ID NO: 1216435 - RNA, 12 nt, Mycobacterium bovis subsp bovis AF2122/97
cgcggccugcac

SEQ ID NO: 1216436 - RNA, 19 nt, Mycobacterium bovis subsp bovis AF2122/97
cgcgggaucgguggcggca

SEQ ID NO: 1216437 - RNA, 18 nt, Mycobacterium bovis subsp bovis AF2122/97
cgcgggauggggcccgca

SEQ ID NO: 1216438 - RNA, 20 nt, Mycobacterium bovis subsp bovis AF2122/97
cgcgggauguaccccggccc

SEQ ID NO: 1216439 - RNA, 19 nt, Mycobacterium bovis subsp bovis AF2122/97
cgcgggcgguaaucgcgag

SEQ ID NO: 1216440 - RNA, 21 nt, Mycobacterium bovis subsp bovis AF2122/97
cgcgggcguuggccagcaggu

SEQ ID NO: 1216441 - RNA, 12 nt, Mycobacterium bovis subsp bovis AF2122/97
cgcgggcugacc

SEQ ID NO: 1216442 - RNA, 20 nt, Mycobacterium bovis subsp bovis AF2122/97
cgcggcuucaguccggcccc

SEQ ID NO: 1216443 - RNA, 19 nt, Mycobacterium bovis subsp bovis AF2122/97
cgcgggaccuucgagccgc

SEQ ID NO: 1216444 - RNA, 20 nt, Mycobacterium bovis subsp bovis AF2122/97
cgcgggagaaaacggcggcg

SEQ ID NO: 1216445 - RNA, 15 nt, Mycobacterium bovis subsp bovis AF2122/97
cgcggcuugucgccc

SEQ ID NO: 1216446 - RNA, 16 nt, Mycobacterium bovis subsp bovis AF2122/97
cgcggcuugucgcccc

SEQ ID NO: 1216447 - RNA, 20 nt, Mycobacterium bovis subsp bovis AF2122/97
cgcggcuuugacgcccggca

SEQ ID NO: 1216448 - RNA, 23 nt, Mycobacterium bovis subsp bovis AF2122/97
cgcggcuuggccuagccgcggca

SEQ ID NO: 1216449 - RNA, 16 nt, Mycobacterium bovis subsp bovis AF2122/97
cgcgggacaccaccgc

SEQ ID NO: 1216450 - RNA, 20 nt, Mycobacterium bovis subsp bovis AF2122/97
cgcgggacacgucgcgccag

SEQ ID NO: 1216451 - RNA, 17 nt, Mycobacterium bovis subsp bovis AF2122/97
cgcggcuucacugcuag

SEQ ID NO: 1216452 - RNA, 16 nt, Mycobacterium bovis subsp bovis AF2122/97
cgcggcuucaguccgg

SEQ ID NO: 1216453 - RNA, 19 nt, Mycobacterium bovis subsp bovis AF2122/97
cgcggcuggugucgggcgu

SEQ ID NO: 1216454 - RNA, 13 nt, Mycobacterium bovis subsp bovis AF2122/97
cgcgggugaucuc

SEQ ID NO: 1216455 - RNA, 18 nt, Mycobacterium bovis subsp bovis AF2122/97
cgcgggugaucuccaccg

SEQ ID NO: 1216456 - RNA, 20 nt, Mycobacterium bovis subsp bovis AF2122/97
cgcgggugaucuccaccggc

SEQ ID NO: 1216457 - RNA, 20 nt, Mycobacterium bovis subsp bovis AF2122/97
cgcgggugccgacgucggca

SEQ ID NO: 1216458 - RNA, 22 nt, Mycobacterium bovis subsp bovis AF2122/97
cgcgggugccgggcaugaucac

SEQ ID NO: 1216459 - RNA, 14 nt, Mycobacterium bovis subsp bovis AF2122/97
cgcgggguggcggc

SEQ ID NO: 1216460 - RNA, 20 nt, Mycobacterium bovis subsp bovis AF2122/97
cgcgggguugauugacccgu

SEQ ID NO: 1216461 - RNA, 15 nt, Mycobacterium bovis subsp bovis AF2122/97
cgcggguccagccac

SEQ ID NO: 1216462 - RNA, 12 nt, Mycobacterium bovis subsp bovis AF2122/97
cgcggggccgcc

SEQ ID NO: 1216463 - RNA, 14 nt, Mycobacterium bovis subsp bovis AF2122/97
cgcggggccgccgc

SEQ ID NO: 1216464 - RNA, 17 nt, Mycobacterium bovis subsp bovis AF2122/97
cgcgggcgugcuacacc

SEQ ID NO: 1216465 - RNA, 17 nt, Mycobacterium bovis subsp bovis AF2122/97
cgcggggccggccggca

SEQ ID NO: 1216466 - RNA, 11 nt, Mycobacterium bovis subsp bovis AF2122/97
cgcgcgcgcca

SEQ ID NO: 1216467 - RNA, 13 nt, Mycobacterium bovis subsp bovis AF2122/97
cgcgcggaacacc

SEQ ID NO: 1216468 - RNA, 18 nt, Mycobacterium bovis subsp bovis AF2122/97
cgcgcggacccagcaccc

SEQ ID NO: 1216469 - RNA, 13 nt, Mycobacterium bovis subsp bovis AF2122/97
cgcgcgcucgccc

SEQ ID NO: 1216470 - RNA, 14 nt, Mycobacterium bovis subsp bovis AF2122/97
cgcgcgcucgcggc

SEQ ID NO: 1216471 - RNA, 20 nt, Mycobacterium bovis subsp bovis AF2122/97
cgcgcuguacugccccagca

SEQ ID NO: 1216472 - RNA, 18 nt, Mycobacterium bovis subsp bovis AF2122/97
cgcggaggcggccagccu

SEQ ID NO: 1216473 - RNA, 23 nt, Mycobacterium bovis subsp bovis AF2122/97
cgcggacucgggcaggccccacu

SEQ ID NO: 1216474 - RNA, 19 nt, Mycobacterium bovis subsp bovis AF2122/97
cgcggaguacuccagccgc

SEQ ID NO: 1216475 - RNA, 18 nt, Mycobacterium bovis subsp bovis AF2122/97
cgcggauagaugacgggc

SEQ ID NO: 1216476 - RNA, 15 nt, Mycobacterium bovis subsp bovis AF2122/97
cgcggauaggccgcg

SEQ ID NO: 1216477 - RNA, 20 nt, Mycobacterium bovis subsp bovis AF2122/97
cgcggauaggccgcgcggcg

SEQ ID NO: 1216478 - RNA, 23 nt, Mycobacterium bovis subsp bovis AF2122/97
cgcggauaggccgcgcggcggcg

SEQ ID NO: 1216479 - RNA, 13 nt, Mycobacterium bovis subsp bovis AF2122/97
cgcggagccagga

SEQ ID NO: 1216480 - RNA, 23 nt, Mycobacterium bovis subsp bovis AF2122/97
cgcggaccucgaagcccagcacc

SEQ ID NO: 1216481 - RNA, 21 nt, Mycobacterium bovis subsp bovis AF2122/97
cgcggacccgcagcugcggau

SEQ ID NO: 1216482 - RNA, 20 nt, Mycobacterium bovis subsp bovis AF2122/97
cgcggacagcccggacgcgc

SEQ ID NO: 1216483 - RNA, 15 nt, Mycobacterium bovis subsp bovis AF2122/97
cgcggaccagagugg

SEQ ID NO: 1216484 - RNA, 18 nt, Mycobacterium bovis subsp bovis AF2122/97
cgcgcuugcgaucggcac

SEQ ID NO: 1216485 - RNA, 20 nt, Mycobacterium bovis subsp bovis AF2122/97
cgcgcuucaggcaucaccgg

SEQ ID NO: 1216486 - RNA, 20 nt, Mycobacterium bovis subsp bovis AF2122/97
cgcgcuugcgaucgccgcua

SEQ ID NO: 1216487 - RNA, 17 nt, Mycobacterium bovis subsp bovis AF2122/97
cgcgcuugcgaucggca

SEQ ID NO: 1216488 - RNA, 14 nt, Mycobacterium bovis subsp bovis AF2122/97
cgcggcagccggcg

SEQ ID NO: 1216489 - RNA, 16 nt, Mycobacterium bovis subsp bovis AF2122/97
cgcggcagccggcgga

SEQ ID NO: 1216490 - RNA, 14 nt, Mycobacterium bovis subsp bovis AF2122/97
cgcggcaggccugg

SEQ ID NO: 1216491 - RNA, 22 nt, Mycobacterium bovis subsp bovis AF2122/97
cgcggcaugcaaugcuggcggc

SEQ ID NO: 1216492 - RNA, 23 nt, Mycobacterium bovis subsp bovis AF2122/97
cgcggcaugcaaugcuggcggcg

SEQ ID NO: 1216493 - RNA, 21 nt, Mycobacterium bovis subsp bovis AF2122/97
cgcggcaucccgccacaccaa

SEQ ID NO: 1216494 - RNA, 22 nt, Mycobacterium bovis subsp bovis AF2122/97
cgcggcagguugcguugcagga

SEQ ID NO: 1216495 - RNA, 14 nt, Mycobacterium bovis subsp bovis AF2122/97
cgcggcaccgccga

SEQ ID NO: 1216496 - RNA, 17 nt, Mycobacterium bovis subsp bovis AF2122/97
cgcggcacgcccacagc

SEQ ID NO: 1216497 - RNA, 19 nt, Mycobacterium bovis subsp bovis AF2122/97
cgcggcacgcuccagcucg

SEQ ID NO: 1216498 - RNA, 12 nt, Mycobacterium bovis subsp bovis AF2122/97
cgcggcaagagu

SEQ ID NO: 1216499 - RNA, 16 nt, Mycobacterium bovis subsp bovis AF2122/97
cgcggcaagcucgucc

SEQ ID NO: 1216500 - RNA, 22 nt, Mycobacterium bovis subsp bovis AF2122/97
cgcggcaaaguuggccgcccga

SEQ ID NO: 1216501 - RNA, 17 nt, Mycobacterium bovis subsp bovis AF2122/97
cgcggccaccgccgccg

SEQ ID NO: 1216502 - RNA, 19 nt, Mycobacterium bovis subsp bovis AF2122/97
cgcggccacggucagccag

SEQ ID NO: 1216503 - RNA, 14 nt, Mycobacterium bovis subsp bovis AF2122/97
cgcggccacccgcg

SEQ ID NO: 1216504 - RNA, 16 nt, Mycobacterium bovis subsp bovis AF2122/97
cgcggccaccgaccgc

SEQ ID NO: 1216505 - RNA, 12 nt, Mycobacterium bovis subsp bovis AF2122/97
cgcggccaccgc

SEQ ID NO: 1216506 - RNA, 20 nt, Mycobacterium bovis subsp bovis AF2122/97
cgcggccaccaccgccgccg

SEQ ID NO: 1216507 - RNA, 15 nt, Mycobacterium bovis subsp bovis AF2122/97
cgcggccaccgccgc

SEQ ID NO: 1216508 - RNA, 13 nt, Mycobacterium bovis subsp bovis AF2122/97
cgcggccagcagc

SEQ ID NO: 1216509 - RNA, 15 nt, Mycobacterium bovis subsp bovis AF2122/97
cgcggccagagccgc

SEQ ID NO: 1216510 - RNA, 12 nt, Mycobacterium bovis subsp bovis AF2122/97
cgcggccaccac

SEQ ID NO: 1216511 - RNA, 16 nt, Mycobacterium bovis subsp bovis AF2122/97
cgcggccaccaccgcc

SEQ ID NO: 1216512 - RNA, 18 nt, Mycobacterium bovis subsp bovis AF2122/97
cgcggccacaucgccagc

SEQ ID NO: 1216513 - RNA, 19 nt, Mycobacterium bovis subsp bovis AF2122/97
cgcggccacaucgccagca

SEQ ID NO: 1216514 - RNA, 21 nt, Mycobacterium bovis subsp bovis AF2122/97
cgcggccaaucagcccgccgg

SEQ ID NO: 1216515 - RNA, 18 nt, Mycobacterium bovis subsp bovis AF2122/97
cgcggccaauugcgccgc

SEQ ID NO: 1216516 - RNA, 15 nt, Mycobacterium bovis subsp bovis AF2122/97
cgccccaccggccga

SEQ ID NO: 1216517 - RNA, 12 nt, Mycobacterium bovis subsp bovis AF2122/97
cgccccgcccgc

SEQ ID NO: 1216518 - RNA, 23 nt, Mycobacterium bovis subsp bovis AF2122/97
cgcccauuggguaaccagcgcca

SEQ ID NO: 1216519 - RNA, 15 nt, Mycobacterium bovis subsp bovis AF2122/97
cgccccaccgcgccg

SEQ ID NO: 1216520 - RNA, 13 nt, Mycobacterium bovis subsp bovis AF2122/97
cgccccaccggcc

SEQ ID NO: 1216521 - RNA, 15 nt, Mycobacterium bovis subsp bovis AF2122/97
cgcccagggugucug

SEQ ID NO: 1216522 - RNA, 18 nt, Mycobacterium bovis subsp bovis AF2122/97
cgcccagcgacaacacca

SEQ ID NO: 1216523 - RNA, 16 nt, Mycobacterium bovis subsp bovis AF2122/97
cgcccaggcgcgacgu

SEQ ID NO: 1216524 - RNA, 21 nt, Mycobacterium bovis subsp bovis AF2122/97
cgcccauucccagaggcccgc

SEQ ID NO: 1216525 - RNA, 19 nt, Mycobacterium bovis subsp bovis AF2122/97
cgcccgaggcgagacgcuc

SEQ ID NO: 1216526 - RNA, 16 nt, Mycobacterium bovis subsp bovis AF2122/97
cgcccgagccgcugcg

SEQ ID NO: 1216527 - RNA, 21 nt, Mycobacterium bovis subsp bovis AF2122/97
cgcccgagccggugccacugc

SEQ ID NO: 1216528 - RNA, 18 nt, Mycobacterium bovis subsp bovis AF2122/97
cgcccgaagccgggcccc

SEQ ID NO: 1216529 - RNA, 16 nt, Mycobacterium bovis subsp bovis AF2122/97
cgcccgaagccgggcc

SEQ ID NO: 1216530 - RNA, 12 nt, Mycobacterium bovis subsp bovis AF2122/97
cgccccgcgccc

SEQ ID NO: 1216531 - RNA, 15 nt, Mycobacterium bovis subsp bovis AF2122/97
cgccccgaucggcca

SEQ ID NO: 1216532 - RNA, 23 nt, Mycobacterium bovis subsp bovis AF2122/97
cgcccgcaccagcugucgggcag

SEQ ID NO: 1216533 - RNA, 16 nt, Mycobacterium bovis subsp bovis AF2122/97
cgcccgcacccaugau

SEQ ID NO: 1216534 - RNA, 19 nt, Mycobacterium bovis subsp bovis AF2122/97
cgcccgcaccaccggcccc

SEQ ID NO: 1216535 - RNA, 20 nt, Mycobacterium bovis subsp bovis AF2122/97
cgcccgcaauuguucgcggc

SEQ ID NO: 1216536 - RNA, 14 nt, Mycobacterium bovis subsp bovis AF2122/97
cgcccgccggcgcg

SEQ ID NO: 1216537 - RNA, 15 nt, Mycobacterium bovis subsp bovis AF2122/97
cgcccgccggcgcga

SEQ ID NO: 1216538 - RNA, 12 nt, Mycobacterium bovis subsp bovis AF2122/97
cgcccgccaccg

SEQ ID NO: 1216539 - RNA, 14 nt, Mycobacterium bovis subsp bovis AF2122/97
cgcccgccaccggg

SEQ ID NO: 1216540 - RNA, 14 nt, Mycobacterium bovis subsp bovis AF2122/97
cgcccgccccgcgc

SEQ ID NO: 1216541 - RNA, 17 nt, Mycobacterium bovis subsp bovis AF2122/97
cgcccgcccgagccgcu

SEQ ID NO: 1216542 - RNA, 11 nt, Mycobacterium bovis subsp bovis AF2122/97
cgcccgccccg

SEQ ID NO: 1216543 - RNA, 21 nt, Mycobacterium bovis subsp bovis AF2122/97
cgcccacaggggcagcgcggc

SEQ ID NO: 1216544 - RNA, 21 nt, Mycobacterium bovis subsp bovis AF2122/97
cgcccacagcugacgagccgg

SEQ ID NO: 1216545 - RNA, 14 nt, Mycobacterium bovis subsp bovis AF2122/97
cgcccacagcugac

SEQ ID NO: 1216546 - RNA, 21 nt, Mycobacterium bovis subsp bovis AF2122/97
cgcccaccacacagccgcgcu

SEQ ID NO: 1216547 - RNA, 14 nt, Mycobacterium bovis subsp bovis AF2122/97
cgcccacccgcgcc

SEQ ID NO: 1216548 - RNA, 23 nt, Mycobacterium bovis subsp bovis AF2122/97
cgcccaccacugugacacccgag

SEQ ID NO: 1216549 - RNA, 14 nt, Mycobacterium bovis subsp bovis AF2122/97
cgccaugucggcca

SEQ ID NO: 1216550 - RNA, 19 nt, Mycobacterium bovis subsp bovis AF2122/97
cgcccagcaucucggcggc

SEQ ID NO: 1216551 - RNA, 23 nt, Mycobacterium bovis subsp bovis AF2122/97
cgcccagccacugacggcuucca

SEQ ID NO: 1216552 - RNA, 15 nt, Mycobacterium bovis subsp bovis AF2122/97
cgcccagcgagcgcc

SEQ ID NO: 1216553 - RNA, 15 nt, Mycobacterium bovis subsp bovis AF2122/97
cgcccagcgaggugg

SEQ ID NO: 1216554 - RNA, 14 nt, Mycobacterium bovis subsp bovis AF2122/97
cgcccaccgaugcg

SEQ ID NO: 1216555 - RNA, 15 nt, Mycobacterium bovis subsp bovis AF2122/97
cgcccacccgcugcg

SEQ ID NO: 1216556 - RNA, 20 nt, Mycobacterium bovis subsp bovis AF2122/97
cgccacggcaucggccaccu

SEQ ID NO: 1216557 - RNA, 19 nt, Mycobacterium bovis subsp bovis AF2122/97
cgccacggcggcuuccggc

SEQ ID NO: 1216558 - RNA, 22 nt, Mycobacterium bovis subsp bovis AF2122/97
cgccaucgguugacccggcagc

SEQ ID NO: 1216559 - RNA, 18 nt, Mycobacterium bovis subsp bovis AF2122/97
cgccacggaucgcggcgg

SEQ ID NO: 1216560 - RNA, 13 nt, Mycobacterium bovis subsp bovis AF2122/97
cgccaccggugag

SEQ ID NO: 1216561 - RNA, 18 nt, Mycobacterium bovis subsp bovis AF2122/97
cgccaccgugguggacga

SEQ ID NO: 1216562 - RNA, 20 nt, Mycobacterium bovis subsp bovis AF2122/97
cgccaccgugguggacgacc

SEQ ID NO: 1216563 - RNA, 18 nt, Mycobacterium bovis subsp bovis AF2122/97
cgccaccgugucacgcga

SEQ ID NO: 1216564 - RNA, 19 nt, Mycobacterium bovis subsp bovis AF2122/97
cgccaccguuugcgcaccg

SEQ ID NO: 1216565 - RNA, 20 nt, Mycobacterium bovis subsp bovis AF2122/97
cgccaucguuucacccgggc

SEQ ID NO: 1216566 - RNA, 19 nt, Mycobacterium bovis subsp bovis AF2122/97
cgccaucgucgaagaccuc

SEQ ID NO: 1216567 - RNA, 16 nt, Mycobacterium bovis subsp bovis AF2122/97
cgccaucgucgcgccg

SEQ ID NO: 1216568 - RNA, 15 nt, Mycobacterium bovis subsp bovis AF2122/97
cgccaugauggacag

SEQ ID NO: 1216569 - RNA, 22 nt, Mycobacterium bovis subsp bovis AF2122/97
cgccaugagcgcgcccaaccug

SEQ ID NO: 1216570 - RNA, 19 nt, Mycobacterium bovis subsp bovis AF2122/97
cgccaugcgccaacccggc

SEQ ID NO: 1216571 - RNA, 16 nt, Mycobacterium bovis subsp bovis AF2122/97
cgccaugccgggaacc

SEQ ID NO: 1216572 - RNA, 21 nt, Mycobacterium bovis subsp bovis AF2122/97
cgccgcagaugggccuccacc

SEQ ID NO: 1216573 - RNA, 13 nt, Mycobacterium bovis subsp bovis AF2122/97
cgccgcagauggg

SEQ ID NO: 1216574 - RNA, 19 nt, Mycobacterium bovis subsp bovis AF2122/97
cgccgcagaugggccucca

SEQ ID NO: 1216575 - RNA, 17 nt, Mycobacterium bovis subsp bovis AF2122/97
cgccgcagcgucguaac

SEQ ID NO: 1216576 - RNA, 20 nt, Mycobacterium bovis subsp bovis AF2122/97
cgccgcagaucaccgccagc

SEQ ID NO: 1216577 - RNA, 15 nt, Mycobacterium bovis subsp bovis AF2122/97
cgccgcacgccgacc

SEQ ID NO: 1216578 - RNA, 23 nt, Mycobacterium bovis subsp bovis AF2122/97
cgccgcacgcuagccgacagcuc

SEQ ID NO: 1216579 - RNA, 18 nt, Mycobacterium bovis subsp bovis AF2122/97
cgccgcacggcgacgcca

SEQ ID NO: 1216580 - RNA, 19 nt, Mycobacterium bovis subsp bovis AF2122/97
cgccgcagggccgcgcgca

SEQ ID NO: 1216581 - RNA, 15 nt, Mycobacterium bovis subsp bovis AF2122/97
cgccgccaccggcgc

SEQ ID NO: 1216582 - RNA, 17 nt, Mycobacterium bovis subsp bovis AF2122/97
cgccgccaccggcgccg

SEQ ID NO: 1216583 - RNA, 18 nt, Mycobacterium bovis subsp bovis AF2122/97
cgccgccaccggcgccgc

SEQ ID NO: 1216584 - RNA, 21 nt, Mycobacterium bovis subsp bovis AF2122/97
cgccgccaccgaagccgccgg

SEQ ID NO: 1216585 - RNA, 14 nt, Mycobacterium bovis subsp bovis AF2122/97
cgccgccaccccgc

SEQ ID NO: 1216586 - RNA, 20 nt, Mycobacterium bovis subsp bovis AF2122/97
cgccgccaccagcgcacgcu

SEQ ID NO: 1216587 - RNA, 16 nt, Mycobacterium bovis subsp bovis AF2122/97
cgccgccaaagccggg

SEQ ID NO: 1216588 - RNA, 16 nt, Mycobacterium bovis subsp bovis AF2122/97
cgccgccacagcaccc

SEQ ID NO: 1216589 - RNA, 22 nt, Mycobacterium bovis subsp bovis AF2122/97
cgccgccaccaccgcugccggc

SEQ ID NO: 1216590 - RNA, 13 nt, Mycobacterium bovis subsp bovis AF2122/97
cgccgccaccagc

SEQ ID NO: 1216591 - RNA, 21 nt, Mycobacterium bovis subsp bovis AF2122/97
cgccgccauuaggcgcggugc

SEQ ID NO: 1216592 - RNA, 17 nt, Mycobacterium bovis subsp bovis AF2122/97
cgccgccauugccgccg

SEQ ID NO: 1216593 - RNA, 17 nt, Mycobacterium bovis subsp bovis AF2122/97
cgccgccagucguccuc

SEQ ID NO: 1216594 - RNA, 15 nt, Mycobacterium bovis subsp bovis AF2122/97
cgccgccaucacgca

SEQ ID NO: 1216595 - RNA, 13 nt, Mycobacterium bovis subsp bovis AF2122/97
cgccgccaucagc

SEQ ID NO: 1216596 - RNA, 15 nt, Mycobacterium bovis subsp bovis AF2122/97
cgccgccaucagccc

SEQ ID NO: 1216597 - RNA, 16 nt, Mycobacterium bovis subsp bovis AF2122/97
cgccgaguucugcugg

SEQ ID NO: 1216598 - RNA, 20 nt, Mycobacterium bovis subsp bovis AF2122/97
cgccgaucaccaccggcaga

SEQ ID NO: 1216599 - RNA, 21 nt, Mycobacterium bovis subsp bovis AF2122/97
cgccgauacuucaucggcaca

SEQ ID NO: 1216600 - RNA, 17 nt, Mycobacterium bovis subsp bovis AF2122/97
cgccgauacccagcggg

SEQ ID NO: 1216601 - RNA, 16 nt, Mycobacterium bovis subsp bovis AF2122/97
cgccgauaccgccggc

SEQ ID NO: 1216602 - RNA, 14 nt, Mycobacterium bovis subsp bovis AF2122/97
cgccgauaccggcg

SEQ ID NO: 1216603 - RNA, 16 nt, Mycobacterium bovis subsp bovis AF2122/97
cgccgagcucggucac

SEQ ID NO: 1216604 - RNA, 17 nt, Mycobacterium bovis subsp bovis AF2122/97
cgccgagcccgggccgu

SEQ ID NO: 1216605 - RNA, 22 nt, Mycobacterium bovis subsp bovis AF2122/97
cgccgagcuggcaacgccgcgc

SEQ ID NO: 1216606 - RNA, 22 nt, Mycobacterium bovis subsp bovis AF2122/97
cgccgagcugguugacggcgaa

SEQ ID NO: 1216607 - RNA, 19 nt, Mycobacterium bovis subsp bovis AF2122/97
cgccgaggaaaccaccagu

SEQ ID NO: 1216608 - RNA, 16 nt, Mycobacterium bovis subsp bovis AF2122/97
cgccgaggacgccggc

SEQ ID NO: 1216609 - RNA, 18 nt, Mycobacterium bovis subsp bovis AF2122/97
cgccgaggucgguucggc

SEQ ID NO: 1216610 - RNA, 19 nt, Mycobacterium bovis subsp bovis AF2122/97
cgccgagcugguugacggc

SEQ ID NO: 1216611 - RNA, 16 nt, Mycobacterium bovis subsp bovis AF2122/97
cgccgagccagcaccc

SEQ ID NO: 1216612 - RNA, 13 nt, Mycobacterium bovis subsp bovis AF2122/97
cgccgagcccgcc

SEQ ID NO: 1216613 - RNA, 15 nt, Mycobacterium bovis subsp bovis AF2122/97
cgccgagcccgccgg

SEQ ID NO: 1216614 - RNA, 21 nt, Mycobacterium bovis subsp bovis AF2122/97
cgccgagcacacgucgggagu

SEQ ID NO: 1216615 - RNA, 24 nt, Mycobacterium bovis subsp bovis AF2122/97
cgccgacgaacaguugcggcuggc

SEQ ID NO: 1216616 - RNA, 19 nt, Mycobacterium bovis subsp bovis AF2122/97
cgccgaccuucggcccgcu

SEQ ID NO: 1216617 - RNA, 16 nt, Mycobacterium bovis subsp bovis AF2122/97
cgccgacgaugacgcg

SEQ ID NO: 1216618 - RNA, 15 nt, Mycobacterium bovis subsp bovis AF2122/97
cgccgacgccgccgg

SEQ ID NO: 1216619 - RNA, 18 nt, Mycobacterium bovis subsp bovis AF2122/97
cgccgacgccgccggccc

SEQ ID NO: 1216620 - RNA, 18 nt, Mycobacterium bovis subsp bovis AF2122/97
cgccgagaugcugcaccc

SEQ ID NO: 1216621 - RNA, 23 nt, Mycobacterium bovis subsp bovis AF2122/97
cgcccuagcgagcggcaccaaug

SEQ ID NO: 1216622 - RNA, 13 nt, Mycobacterium bovis subsp bovis AF2122/97
cgcccuccuuggc

SEQ ID NO: 1216623 - RNA, 15 nt, Mycobacterium bovis subsp bovis AF2122/97
cgcccucccuggggc

SEQ ID NO: 1216624 - RNA, 14 nt, Mycobacterium bovis subsp bovis AF2122/97
cgcccucagccgcg

SEQ ID NO: 1216625 - RNA, 22 nt, Mycobacterium bovis subsp bovis AF2122/97
cgcccgggcggaacgccggcac

SEQ ID NO: 1216626 - RNA, 13 nt, Mycobacterium bovis subsp bovis AF2122/97
cgcccgggcggcg

SEQ ID NO: 1216627 - RNA, 12 nt, Mycobacterium bovis subsp bovis AF2122/97
cgcccgggcggc

SEQ ID NO: 1216628 - RNA, 20 nt, Mycobacterium bovis subsp bovis AF2122/97
cgcccggggcggugggcgcu

SEQ ID NO: 1216629 - RNA, 21 nt, Mycobacterium bovis subsp bovis AF2122/97
cgcccgggucccggcagcugg

SEQ ID NO: 1216630 - RNA, 21 nt, Mycobacterium bovis subsp bovis AF2122/97
cgcccggucgagccagcggag

SEQ ID NO: 1216631 - RNA, 22 nt, Mycobacterium bovis subsp bovis AF2122/97
cgcccggcguggcuucacccaa

SEQ ID NO: 1216632 - RNA, 13 nt, Mycobacterium bovis subsp bovis AF2122/97
cgcccgggcccac

SEQ ID NO: 1216633 - RNA, 17 nt, Mycobacterium bovis subsp bovis AF2122/97
cgcccggcacacggccu

SEQ ID NO: 1216634 - RNA, 14 nt, Mycobacterium bovis subsp bovis AF2122/97
cgcccggcaccccu

SEQ ID NO: 1216635 - RNA, 20 nt, Mycobacterium bovis subsp bovis AF2122/97
cgcccggccaagccggcgag

SEQ ID NO: 1216636 - RNA, 14 nt, Mycobacterium bovis subsp bovis AF2122/97
cgcccgccucgacc

SEQ ID NO: 1216637 - RNA, 16 nt, Mycobacterium bovis subsp bovis AF2122/97
cgcccgcucggccgca

SEQ ID NO: 1216638 - RNA, 14 nt, Mycobacterium bovis subsp bovis AF2122/97
cgcccgcugcggcg

SEQ ID NO: 1216639 - RNA, 15 nt, Mycobacterium bovis subsp bovis AF2122/97
cgcccgcugcggcgg

SEQ ID NO: 1216640 - RNA, 17 nt, Mycobacterium bovis subsp bovis AF2122/97
cgcccgcugcggcggcu

SEQ ID NO: 1216641 - RNA, 21 nt, Mycobacterium bovis subsp bovis AF2122/97
cgcccggacgcaacacccggg

SEQ ID NO: 1216642 - RNA, 15 nt, Mycobacterium bovis subsp bovis AF2122/97
cgcccggaaccggcg

SEQ ID NO: 1216643 - RNA, 19 nt, Mycobacterium bovis subsp bovis AF2122/97
cgcccggaaccggcgugca

SEQ ID NO: 1216644 - RNA, 16 nt, Mycobacterium bovis subsp bovis AF2122/97
cgccgacaaccccgcc

SEQ ID NO: 1216645 - RNA, 16 nt, Mycobacterium bovis subsp bovis AF2122/97
cgccgaccgcgccgca

SEQ ID NO: 1216646 - RNA, 14 nt, Mycobacterium bovis subsp bovis AF2122/97
cgccgaccggaccg

SEQ ID NO: 1216647 - RNA, 14 nt, Mycobacterium bovis subsp bovis AF2122/97
cgccgaccuggaca

SEQ ID NO: 1216648 - RNA, 20 nt, Mycobacterium bovis subsp bovis AF2122/97
cgccgaaggcgggggagccc

SEQ ID NO: 1216649 - RNA, 24 nt, Mycobacterium bovis subsp bovis AF2122/97
cgccgaauacggcugccuccauga

SEQ ID NO: 1216650 - RNA, 14 nt, Mycobacterium bovis subsp bovis AF2122/97
cgccgaaucggcag

SEQ ID NO: 1216651 - RNA, 23 nt, Mycobacterium bovis subsp bovis AF2122/97
cgccgaaguagccgaccggcagc

SEQ ID NO: 1216652 - RNA, 21 nt, Mycobacterium bovis subsp bovis AF2122/97
cgcccugguccaggcccuggc

SEQ ID NO: 1216653 - RNA, 23 nt, Mycobacterium bovis subsp bovis AF2122/97
cgcccuuaagccggcgcggcggc

SEQ ID NO: 1216654 - RNA, 14 nt, Mycobacterium bovis subsp bovis AF2122/97
cgcccugggcgccg

SEQ ID NO: 1216655 - RNA, 20 nt, Mycobacterium bovis subsp bovis AF2122/97
cgcccuguucuccgugaucg

SEQ ID NO: 1216656 - RNA, 14 nt, Mycobacterium bovis subsp bovis AF2122/97
cgcccuggccgccg

SEQ ID NO: 1216657 - RNA, 20 nt, Mycobacterium bovis subsp bovis AF2122/97
cgcccucggcgaccuggcuc

SEQ ID NO: 1216658 - RNA, 16 nt, Mycobacterium bovis subsp bovis AF2122/97
cgcccugaagggccgc

SEQ ID NO: 1216659 - RNA, 20 nt, Mycobacterium bovis subsp bovis AF2122/97
cgccggaugcugucagcagc

SEQ ID NO: 1216660 - RNA, 19 nt, Mycobacterium bovis subsp bovis AF2122/97
cgccggauucgcccgggcg

SEQ ID NO: 1216661 - RNA, 21 nt, Mycobacterium bovis subsp bovis AF2122/97
cgccggcacccgccgugcccc

SEQ ID NO: 1216662 - RNA, 18 nt, Mycobacterium bovis subsp bovis AF2122/97
cgccggcaccggggcugc

SEQ ID NO: 1216663 - RNA, 15 nt, Mycobacterium bovis subsp bovis AF2122/97
cgccggcaccgccag

SEQ ID NO: 1216664 - RNA, 16 nt, Mycobacterium bovis subsp bovis AF2122/97
cgccggcaccgccagu

SEQ ID NO: 1216665 - RNA, 15 nt, Mycobacterium bovis subsp bovis AF2122/97
cgccggcaccgccgc

SEQ ID NO: 1216666 - RNA, 17 nt, Mycobacterium bovis subsp bovis AF2122/97
cgccggcaccgccgccc

SEQ ID NO: 1216667 - RNA, 16 nt, Mycobacterium bovis subsp bovis AF2122/97
cgccggcaccgccggc

SEQ ID NO: 1216668 - RNA, 20 nt, Mycobacterium bovis subsp bovis AF2122/97
cgccggcacgaaucccccgg

SEQ ID NO: 1216669 - RNA, 16 nt, Mycobacterium bovis subsp bovis AF2122/97
cgccggcaucuccacc

SEQ ID NO: 1216670 - RNA, 15 nt, Mycobacterium bovis subsp bovis AF2122/97
cgccggcaggguucc

SEQ ID NO: 1216671 - RNA, 20 nt, Mycobacterium bovis subsp bovis AF2122/97
cgccggccagcacuccgcgg

SEQ ID NO: 1216672 - RNA, 14 nt, Mycobacterium bovis subsp bovis AF2122/97
cgccggccaccagc

SEQ ID NO: 1216673 - RNA, 13 nt, Mycobacterium bovis subsp bovis AF2122/97
cgccggccacccg

SEQ ID NO: 1216674 - RNA, 16 nt, Mycobacterium bovis subsp bovis AF2122/97
cgccggccacccgcgc

SEQ ID NO: 1216675 - RNA, 14 nt, Mycobacterium bovis subsp bovis AF2122/97
cgccggccagcggc

SEQ ID NO: 1216676 - RNA, 23 nt, Mycobacterium bovis subsp bovis AF2122/97
cgccggacccggucgccgggacg

SEQ ID NO: 1216677 - RNA, 13 nt, Mycobacterium bovis subsp bovis AF2122/97
cgccggacccgcc

SEQ ID NO: 1216678 - RNA, 20 nt, Mycobacterium bovis subsp bovis AF2122/97
cgccggacccgccggguccg

SEQ ID NO: 1216679 - RNA, 18 nt, Mycobacterium bovis subsp bovis AF2122/97
cgccggacugcggcccga

SEQ ID NO: 1216680 - RNA, 16 nt, Mycobacterium bovis subsp bovis AF2122/97
cgccggaccagcuccu

SEQ ID NO: 1216681 - RNA, 19 nt, Mycobacterium bovis subsp bovis AF2122/97
cgccggaccagcuccugca

SEQ ID NO: 1216682 - RNA, 14 nt, Mycobacterium bovis subsp bovis AF2122/97
cgccggaucgccac

SEQ ID NO: 1216683 - RNA, 16 nt, Mycobacterium bovis subsp bovis AF2122/97
cgccggauccgccaga

SEQ ID NO: 1216684 - RNA, 21 nt, Mycobacterium bovis subsp bovis AF2122/97
cgccggaguuucccuuaccag

SEQ ID NO: 1216685 - RNA, 23 nt, Mycobacterium bovis subsp bovis AF2122/97
cgccggauagcaccggcacccgc

SEQ ID NO: 1216686 - RNA, 15 nt, Mycobacterium bovis subsp bovis AF2122/97
cgccggauauggcag

SEQ ID NO: 1216687 - RNA, 20 nt, Mycobacterium bovis subsp bovis AF2122/97
cgccggagaucgucgcguag

SEQ ID NO: 1216688 - RNA, 14 nt, Mycobacterium bovis subsp bovis AF2122/97
cgccggagccgccc

SEQ ID NO: 1216689 - RNA, 21 nt, Mycobacterium bovis subsp bovis AF2122/97
cgccggagucgacccugccca

SEQ ID NO: 1216690 - RNA, 21 nt, Mycobacterium bovis subsp bovis AF2122/97
cgccggaguugaagaagcccg

SEQ ID NO: 1216691 - RNA, 14 nt, Mycobacterium bovis subsp bovis AF2122/97
cgccggccccgcca

SEQ ID NO: 1216692 - RNA, 16 nt, Mycobacterium bovis subsp bovis AF2122/97
cgccggccccgccagc

SEQ ID NO: 1216693 - RNA, 15 nt, Mycobacterium bovis subsp bovis AF2122/97
cgccggcccgacggg

SEQ ID NO: 1216694 - RNA, 14 nt, Mycobacterium bovis subsp bovis AF2122/97
cgccggcccgcggg

SEQ ID NO: 1216695 - RNA, 15 nt, Mycobacterium bovis subsp bovis AF2122/97
cgccggccccgccga

SEQ ID NO: 1216696 - RNA, 21 nt, Mycobacterium bovis subsp bovis AF2122/97
cgccggccccgccgaugccgc

SEQ ID NO: 1216697 - RNA, 15 nt, Mycobacterium bovis subsp bovis AF2122/97
cgccggccccgccgc

SEQ ID NO: 1216698 - RNA, 16 nt, Mycobacterium bovis subsp bovis AF2122/97
cgccggccccgccgcu

SEQ ID NO: 1216699 - RNA, 21 nt, Mycobacterium bovis subsp bovis AF2122/97
cgccggccccgccggcgccgc

SEQ ID NO: 1216700 - RNA, 21 nt, Mycobacterium bovis subsp bovis AF2122/97
cgccggccccgccgucgccgc

SEQ ID NO: 1216701 - RNA, 14 nt, Mycobacterium bovis subsp bovis AF2122/97
cgccggccgcgcag

SEQ ID NO: 1216702 - RNA, 21 nt, Mycobacterium bovis subsp bovis AF2122/97
cgccggccgcggcggccccgc

SEQ ID NO: 1216703 - RNA, 13 nt, Mycobacterium bovis subsp bovis AF2122/97
cgccggccgcgcu

SEQ ID NO: 1216704 - RNA, 12 nt, Mycobacterium bovis subsp bovis AF2122/97
cgccggccggca

SEQ ID NO: 1216705 - RNA, 14 nt, Mycobacterium bovis subsp bovis AF2122/97
cgccggccggcagg

SEQ ID NO: 1216706 - RNA, 13 nt, Mycobacterium bovis subsp bovis AF2122/97
cgccggccggcau

SEQ ID NO: 1216707 - RNA, 12 nt, Mycobacterium bovis subsp bovis AF2122/97
cgccggccggcc

SEQ ID NO: 1216708 - RNA, 15 nt, Mycobacterium bovis subsp bovis AF2122/97
cgccggccggcccgg

SEQ ID NO: 1216709 - RNA, 13 nt, Mycobacterium bovis subsp bovis AF2122/97
cgccggccgcggg

SEQ ID NO: 1216710 - RNA, 19 nt, Mycobacterium bovis subsp bovis AF2122/97
cgccggccgcgggcgcgca

SEQ ID NO: 1216711 - RNA, 15 nt, Mycobacterium bovis subsp bovis AF2122/97
cgccggccgcugccu

SEQ ID NO: 1216712 - RNA, 17 nt, Mycobacterium bovis subsp bovis AF2122/97
cgccggcgccggugccg

SEQ ID NO: 1216713 - RNA, 14 nt, Mycobacterium bovis subsp bovis AF2122/97
cgccggccggcgca

SEQ ID NO: 1216714 - RNA, 18 nt, Mycobacterium bovis subsp bovis AF2122/97
cgccggcgccggugccgc

SEQ ID NO: 1216715 - RNA, 13 nt, Mycobacterium bovis subsp bovis AF2122/97
cgccggcgcgcag

SEQ ID NO: 1216716 - RNA, 15 nt, Mycobacterium bovis subsp bovis AF2122/97
cgccggcgcgccgau

SEQ ID NO: 1216717 - RNA, 19 nt, Mycobacterium bovis subsp bovis AF2122/97
cgccggcgccgccguuccc

SEQ ID NO: 1216718 - RNA, 17 nt, Mycobacterium bovis subsp bovis AF2122/97
cgccggcgccgcccgcg

SEQ ID NO: 1216719 - RNA, 18 nt, Mycobacterium bovis subsp bovis AF2122/97
cgccggcgccgcccgcgc

SEQ ID NO: 1216720 - RNA, 19 nt, Mycobacterium bovis subsp bovis AF2122/97
cgccggcgccggagccgcc

SEQ ID NO: 1216721 - RNA, 13 nt, Mycobacterium bovis subsp bovis AF2122/97
cgccggcgccgcc

SEQ ID NO: 1216722 - RNA, 17 nt, Mycobacterium bovis subsp bovis AF2122/97
cgccggcgcccaggccg

SEQ ID NO: 1216723 - RNA, 18 nt, Mycobacterium bovis subsp bovis AF2122/97
cgccggcgcccaggccga

SEQ ID NO: 1216724 - RNA, 21 nt, Mycobacterium bovis subsp bovis AF2122/97
cgccggcgccacccgcgccgc

SEQ ID NO: 1216725 - RNA, 14 nt, Mycobacterium bovis subsp bovis AF2122/97
cgccggcgccagca

SEQ ID NO: 1216726 - RNA, 16 nt, Mycobacterium bovis subsp bovis AF2122/97
cgccggcgccagcaga

SEQ ID NO: 1216727 - RNA, 18 nt, Mycobacterium bovis subsp bovis AF2122/97
cgccggcgccagcgccgc

SEQ ID NO: 1216728 - RNA, 19 nt, Mycobacterium bovis subsp bovis AF2122/97
cgccggcgccagcgccgcc

SEQ ID NO: 1216729 - RNA, 17 nt, Mycobacterium bovis subsp bovis AF2122/97
cgccggccgucggccgg

SEQ ID NO: 1216730 - RNA, 19 nt, Mycobacterium bovis subsp bovis AF2122/97
cgccggccucgccggggca

SEQ ID NO: 1216731 - RNA, 12 nt, Mycobacterium bovis subsp bovis AF2122/97
cgccggccuggc

SEQ ID NO: 1216732 - RNA, 15 nt, Mycobacterium bovis subsp bovis AF2122/97
cgccggcgccacccg

SEQ ID NO: 1216733 - RNA, 18 nt, Mycobacterium bovis subsp bovis AF2122/97
cgccggcgccacccgcgc

SEQ ID NO: 1216734 - RNA, 20 nt, Mycobacterium bovis subsp bovis AF2122/97
cgccgggcaguuuggcggca

SEQ ID NO: 1216735 - RNA, 21 nt, Mycobacterium bovis subsp bovis AF2122/97
cgccgggcguccgccggcgag

SEQ ID NO: 1216736 - RNA, 13 nt, Mycobacterium bovis subsp bovis AF2122/97
cgccggggaccac

SEQ ID NO: 1216737 - RNA, 19 nt, Mycobacterium bovis subsp bovis AF2122/97
cgccgggaaacaccggcuu

SEQ ID NO: 1216738 - RNA, 12 nt, Mycobacterium bovis subsp bovis AF2122/97
cgccgggaaaca

SEQ ID NO: 1216739 - RNA, 19 nt, Mycobacterium bovis subsp bovis AF2122/97
cgccgggaacaucccagcg

SEQ ID NO: 1216740 - RNA, 22 nt, Mycobacterium bovis subsp bovis AF2122/97
cgccgggcaucggugccacggc

SEQ ID NO: 1216741 - RNA, 19 nt, Mycobacterium bovis subsp bovis AF2122/97
cgccgggccccggggugcc

SEQ ID NO: 1216742 - RNA, 15 nt, Mycobacterium bovis subsp bovis AF2122/97
cgccggcggacgccc

SEQ ID NO: 1216743 - RNA, 18 nt, Mycobacterium bovis subsp bovis AF2122/97
cgccggcggacgcccggc

SEQ ID NO: 1216744 - RNA, 13 nt, Mycobacterium bovis subsp bovis AF2122/97
cgccggcgcugcu

SEQ ID NO: 1216745 - RNA, 13 nt, Mycobacterium bovis subsp bovis AF2122/97
cgccggcggccgc

SEQ ID NO: 1216746 - RNA, 17 nt, Mycobacterium bovis subsp bovis AF2122/97
cgccggcggcggccgca

SEQ ID NO: 1216747 - RNA, 14 nt, Mycobacterium bovis subsp bovis AF2122/97
cgccggcguccgga

SEQ ID NO: 1216748 - RNA, 20 nt, Mycobacterium bovis subsp bovis AF2122/97
cgccggcgggacgggggcug

SEQ ID NO: 1216749 - RNA, 19 nt, Mycobacterium bovis subsp bovis AF2122/97
cgccggcggguggcccccg

SEQ ID NO: 1216750 - RNA, 22 nt, Mycobacterium bovis subsp bovis AF2122/97
cgccggcggguggcccccgccg

SEQ ID NO: 1216751 - RNA, 18 nt, Mycobacterium bovis subsp bovis AF2122/97
cgccggcguccggagccc

SEQ ID NO: 1216752 - RNA, 18 nt, Mycobacterium bovis subsp bovis AF2122/97
cgccggcgucggcgccca

SEQ ID NO: 1216753 - RNA, 15 nt, Mycobacterium bovis subsp bovis AF2122/97
cgccggcuccgcagc

SEQ ID NO: 1216754 - RNA, 19 nt, Mycobacterium bovis subsp bovis AF2122/97
cgccggcuucgcccagagc

SEQ ID NO: 1216755 - RNA, 22 nt, Mycobacterium bovis subsp bovis AF2122/97
cgccggcuucgcccagagccgc

SEQ ID NO: 1216756 - RNA, 20 nt, Mycobacterium bovis subsp bovis AF2122/97
cgccgguaggcggccagcgc

SEQ ID NO: 1216757 - RNA, 23 nt, Mycobacterium bovis subsp bovis AF2122/97
cgccgggcuguucggccauggcg

SEQ ID NO: 1216758 - RNA, 15 nt, Mycobacterium bovis subsp bovis AF2122/97
cgccggggacgccgc

SEQ ID NO: 1216759 - RNA, 20 nt, Mycobacterium bovis subsp bovis AF2122/97
cgccggggacgccgcggcgc

SEQ ID NO: 1216760 - RNA, 14 nt, Mycobacterium bovis subsp bovis AF2122/97
cgccggucagcgug

SEQ ID NO: 1216761 - RNA, 18 nt, Mycobacterium bovis subsp bovis AF2122/97
cgccggucaaacugccau

SEQ ID NO: 1216762 - RNA, 24 nt, Mycobacterium bovis subsp bovis AF2122/97
cgccggucaucccaagcguccgcu

SEQ ID NO: 1216763 - RNA, 17 nt, Mycobacterium bovis subsp bovis AF2122/97
cgccgguccccgccggc

SEQ ID NO: 1216764 - RNA, 19 nt, Mycobacterium bovis subsp bovis AF2122/97
cgccgguccccgccggcgg

SEQ ID NO: 1216765 - RNA, 18 nt, Mycobacterium bovis subsp bovis AF2122/97
cgccggugacgacgucgc

SEQ ID NO: 1216766 - RNA, 13 nt, Mycobacterium bovis subsp bovis AF2122/97
cgccggucgccgg

SEQ ID NO: 1216767 - RNA, 17 nt, Mycobacterium bovis subsp bovis AF2122/97
cgccggucgccggcugg

SEQ ID NO: 1216768 - RNA, 17 nt, Mycobacterium bovis subsp bovis AF2122/97
cgccggugagccggaug

SEQ ID NO: 1216769 - RNA, 17 nt, Mycobacterium bovis subsp bovis AF2122/97
cgccggugacgaugacc

SEQ ID NO: 1216770 - RNA, 22 nt, Mycobacterium bovis subsp bovis AF2122/97
cgccggugacgaugaccgcgcg

SEQ ID NO: 1216771 - RNA, 16 nt, Mycobacterium bovis subsp bovis AF2122/97
cgccguaacggucgcu

SEQ ID NO: 1216772 - RNA, 20 nt, Mycobacterium bovis subsp bovis AF2122/97
cgccguaagcaccagccagc

SEQ ID NO: 1216773 - RNA, 19 nt, Mycobacterium bovis subsp bovis AF2122/97
cgccguagaccagcaggcc

SEQ ID NO: 1216774 - RNA, 23 nt, Mycobacterium bovis subsp bovis AF2122/97
cgccguaucggggcaccacgcca

SEQ ID NO: 1216775 - RNA, 17 nt, Mycobacterium bovis subsp bovis AF2122/97
cgccgucgaccggcggg

SEQ ID NO: 1216776 - RNA, 16 nt, Mycobacterium bovis subsp bovis AF2122/97
cgccgucgcagccagc

SEQ ID NO: 1216777 - RNA, 15 nt, Mycobacterium bovis subsp bovis AF2122/97
cgccgucgccgccgc

SEQ ID NO: 1216778 - RNA, 16 nt, Mycobacterium bovis subsp bovis AF2122/97
cgccgucgccgccggc

SEQ ID NO: 1216779 - RNA, 18 nt, Mycobacterium bovis subsp bovis AF2122/97
cgccgucggagccggcca

SEQ ID NO: 1216780 - RNA, 15 nt, Mycobacterium bovis subsp bovis AF2122/97
cgccgcccccgccgg

SEQ ID NO: 1216781 - RNA, 16 nt, Mycobacterium bovis subsp bovis AF2122/97
cgccgcccccgccggc

SEQ ID NO: 1216782 - RNA, 15 nt, Mycobacterium bovis subsp bovis AF2122/97
cgccgcccgcagggc

SEQ ID NO: 1216783 - RNA, 21 nt, Mycobacterium bovis subsp bovis AF2122/97
cgccgcccgcagggccgccgc

SEQ ID NO: 1216784 - RNA, 14 nt, Mycobacterium bovis subsp bovis AF2122/97
cgccgccggccgcc

SEQ ID NO: 1216785 - RNA, 15 nt, Mycobacterium bovis subsp bovis AF2122/97
cgccgccggccgcca

SEQ ID NO: 1216786 - RNA, 15 nt, Mycobacterium bovis subsp bovis AF2122/97
cgccgccggccccgc

SEQ ID NO: 1216787 - RNA, 13 nt, Mycobacterium bovis subsp bovis AF2122/97
cgccgccggcggc

SEQ ID NO: 1216788 - RNA, 18 nt, Mycobacterium bovis subsp bovis AF2122/97
cgccgccggcgccgcccg

SEQ ID NO: 1216789 - RNA, 19 nt, Mycobacterium bovis subsp bovis AF2122/97
cgccgccggcgccgcccgc

SEQ ID NO: 1216790 - RNA, 14 nt, Mycobacterium bovis subsp bovis AF2122/97
cgccgccggcgccg

SEQ ID NO: 1216791 - RNA, 22 nt, Mycobacterium bovis subsp bovis AF2122/97
cgccgccguccagcgccgcggc

SEQ ID NO: 1216792 - RNA, 16 nt, Mycobacterium bovis subsp bovis AF2122/97
cgccgccggcuccggc

SEQ ID NO: 1216793 - RNA, 17 nt, Mycobacterium bovis subsp bovis AF2122/97
cgccgccggcucgccgg

SEQ ID NO: 1216794 - RNA, 18 nt, Mycobacterium bovis subsp bovis AF2122/97
cgccgccguccagcgccg

SEQ ID NO: 1216795 - RNA, 20 nt, Mycobacterium bovis subsp bovis AF2122/97
cgccgccggugccaccgacg

SEQ ID NO: 1216796 - RNA, 17 nt, Mycobacterium bovis subsp bovis AF2122/97
cgccgccggugccgccc

SEQ ID NO: 1216797 - RNA, 19 nt, Mycobacterium bovis subsp bovis AF2122/97
cgccgccguugccgccggc

SEQ ID NO: 1216798 - RNA, 24 nt, Mycobacterium bovis subsp bovis AF2122/97
cgccgccguugccgccggcgccgc

SEQ ID NO: 1216799 - RNA, 19 nt, Mycobacterium bovis subsp bovis AF2122/97
cgccgccguugccgccguc

SEQ ID NO: 1216800 - RNA, 19 nt, Mycobacterium bovis subsp bovis AF2122/97
cgccgccguugccgccauc

SEQ ID NO: 1216801 - RNA, 18 nt, Mycobacterium bovis subsp bovis AF2122/97
cgccgccguugccgccgg

SEQ ID NO: 1216802 - RNA, 13 nt, Mycobacterium bovis subsp bovis AF2122/97
cgccgccuggacg

SEQ ID NO: 1216803 - RNA, 15 nt, Mycobacterium bovis subsp bovis AF2122/97
cgccgccuggacgcc

SEQ ID NO: 1216804 - RNA, 16 nt, Mycobacterium bovis subsp bovis AF2122/97
cgccgcgaacuccagc

SEQ ID NO: 1216805 - RNA, 18 nt, Mycobacterium bovis subsp bovis AF2122/97
cgccgcgaagcgcucggc

SEQ ID NO: 1216806 - RNA, 20 nt, Mycobacterium bovis subsp bovis AF2122/97
cgccgcgaaggggugcccgg

SEQ ID NO: 1216807 - RNA, 21 nt, Mycobacterium bovis subsp bovis AF2122/97
cgccgcgaaggggugcccggc

SEQ ID NO: 1216808 - RNA, 21 nt, Mycobacterium bovis subsp bovis AF2122/97
cgccgcgaaugucgccgccug

SEQ ID NO: 1216809 - RNA, 22 nt, Mycobacterium bovis subsp bovis AF2122/97
cgccgcgaccacgcaccgcccc

SEQ ID NO: 1216810 - RNA, 16 nt, Mycobacterium bovis subsp bovis AF2122/97
cgccgcgaccgcgagc

SEQ ID NO: 1216811 - RNA, 20 nt, Mycobacterium bovis subsp bovis AF2122/97
cgccgcgacgcacugccccg

SEQ ID NO: 1216812 - RNA, 16 nt, Mycobacterium bovis subsp bovis AF2122/97
cgccgcgcauccgcag

SEQ ID NO: 1216813 - RNA, 15 nt, Mycobacterium bovis subsp bovis AF2122/97
cgccgcgcagcgagg

SEQ ID NO: 1216814 - RNA, 18 nt, Mycobacterium bovis subsp bovis AF2122/97
cgccgcgcauccgcagcc

SEQ ID NO: 1216815 - RNA, 21 nt, Mycobacterium bovis subsp bovis AF2122/97
cgccgcgccccagacgcgcag

SEQ ID NO: 1216816 - RNA, 15 nt, Mycobacterium bovis subsp bovis AF2122/97
cgccgcgcagccgcu

SEQ ID NO: 1216817 - RNA, 14 nt, Mycobacterium bovis subsp bovis AF2122/97
cgccgcgcagccgg

SEQ ID NO: 1216818 - RNA, 16 nt, Mycobacterium bovis subsp bovis AF2122/97
cgccgcgcccggcgcu

SEQ ID NO: 1216819 - RNA, 13 nt, Mycobacterium bovis subsp bovis AF2122/97
cgccgcgccccgc

SEQ ID NO: 1216820 - RNA, 16 nt, Mycobacterium bovis subsp bovis AF2122/97
cgccgcgccgcgccgc

SEQ ID NO: 1216821 - RNA, 18 nt, Mycobacterium bovis subsp bovis AF2122/97
cgccgcgccgcgccgccu

SEQ ID NO: 1216822 - RNA, 16 nt, Mycobacterium bovis subsp bovis AF2122/97
cgccgcgccggcggcc

SEQ ID NO: 1216823 - RNA, 20 nt, Mycobacterium bovis subsp bovis AF2122/97
cgccgcgccggcggccaccu

SEQ ID NO: 1216824 - RNA, 18 nt, Mycobacterium bovis subsp bovis AF2122/97
cgccgcgcgacaggcccu

SEQ ID NO: 1216825 - RNA, 16 nt, Mycobacterium bovis subsp bovis AF2122/97
cgccgcgcgucgcgag

SEQ ID NO: 1216826 - RNA, 20 nt, Mycobacterium bovis subsp bovis AF2122/97
cgccgcgcguucggcgcuga

SEQ ID NO: 1216827 - RNA, 14 nt, Mycobacterium bovis subsp bovis AF2122/97
cgccgcgcucgacg

SEQ ID NO: 1216828 - RNA, 19 nt, Mycobacterium bovis subsp bovis AF2122/97
cgccgcuaggugacgccgc

SEQ ID NO: 1216829 - RNA, 14 nt, Mycobacterium bovis subsp bovis AF2122/97
cgccgcuacgccgg

SEQ ID NO: 1216830 - RNA, 15 nt, Mycobacterium bovis subsp bovis AF2122/97
cgccgcuacgccggc

SEQ ID NO: 1216831 - RNA, 16 nt, Mycobacterium bovis subsp bovis AF2122/97
cgccgcugacuccugc

SEQ ID NO: 1216832 - RNA, 17 nt, Mycobacterium bovis subsp bovis AF2122/97
cgccgcugacuccugcg

SEQ ID NO: 1216833 - RNA, 13 nt, Mycobacterium bovis subsp bovis AF2122/97
cgccgcugccgcc

SEQ ID NO: 1216834 - RNA, 14 nt, Mycobacterium bovis subsp bovis AF2122/97
cgccgcugccgccg

SEQ ID NO: 1216835 - RNA, 17 nt, Mycobacterium bovis subsp bovis AF2122/97
cgccgcugccgcgcggc

SEQ ID NO: 1216836 - RNA, 21 nt, Mycobacterium bovis subsp bovis AF2122/97
cgccgcuaggugacgccgcca

SEQ ID NO: 1216837 - RNA, 24 nt, Mycobacterium bovis subsp bovis AF2122/97
cgccgcuaugaggcagucguugau

SEQ ID NO: 1216838 - RNA, 22 nt, Mycobacterium bovis subsp bovis AF2122/97
cgccgcuuucuuggcgggcgcc

SEQ ID NO: 1216839 - RNA, 19 nt, Mycobacterium bovis subsp bovis AF2122/97
cgccggaagcuucgggaac

SEQ ID NO: 1216840 - RNA, 16 nt, Mycobacterium bovis subsp bovis AF2122/97
cgccgcuggccagcac

SEQ ID NO: 1216841 - RNA, 17 nt, Mycobacterium bovis subsp bovis AF2122/97
cgccgcggucagaucca

SEQ ID NO: 1216842 - RNA, 16 nt, Mycobacterium bovis subsp bovis AF2122/97
cgccgcgggugaucug

SEQ ID NO: 1216843 - RNA, 18 nt, Mycobacterium bovis subsp bovis AF2122/97
cgccgcgggcuccccggc

SEQ ID NO: 1216844 - RNA, 16 nt, Mycobacterium bovis subsp bovis AF2122/97
cgccgcggcgcccggc

SEQ ID NO: 1216845 - RNA, 13 nt, Mycobacterium bovis subsp bovis AF2122/97
cgccgcggccgcc

SEQ ID NO: 1216846 - RNA, 14 nt, Mycobacterium bovis subsp bovis AF2122/97
cgccgcggcccgcu

SEQ ID NO: 1216847 - RNA, 17 nt, Mycobacterium bovis subsp bovis AF2122/97
cgccgcggccaccaccg

SEQ ID NO: 1216848 - RNA, 22 nt, Mycobacterium bovis subsp bovis AF2122/97
cgccgcggacucgggcaggccc

SEQ ID NO: 1216849 - RNA, 22 nt, Mycobacterium bovis subsp bovis AF2122/97
cgaugucggcucggcccccgag

SEQ ID NO: 1216850 - RNA, 14 nt, Mycobacterium bovis subsp bovis AF2122/97
cgauguccuggaag

SEQ ID NO: 1216851 - RNA, 15 nt, Mycobacterium bovis subsp bovis AF2122/97
cgauguccuggaagc

SEQ ID NO: 1216852 - RNA, 19 nt, Mycobacterium bovis subsp bovis AF2122/97
cgaugugaaccgggcacca

SEQ ID NO: 1216853 - RNA, 20 nt, Mycobacterium bovis subsp bovis AF2122/97
cgaugugguggacgccaugg

SEQ ID NO: 1216854 - RNA, 15 nt, Mycobacterium bovis subsp bovis AF2122/97
cgaugugcccgccag

SEQ ID NO: 1216855 - RNA, 21 nt, Mycobacterium bovis subsp bovis AF2122/97
cgaugugccgauuggccugcc

SEQ ID NO: 1216856 - RNA, 15 nt, Mycobacterium bovis subsp bovis AF2122/97
cgauguuggcagggc

SEQ ID NO: 1216857 - RNA, 21 nt, Mycobacterium bovis subsp bovis AF2122/97
cgaugucguuguacggggccg

SEQ ID NO: 1216858 - RNA, 16 nt, Mycobacterium bovis subsp bovis AF2122/97
cgauucugugucugcu

SEQ ID NO: 1216859 - RNA, 12 nt, Mycobacterium bovis subsp bovis AF2122/97
cgauucugcguc

SEQ ID NO: 1216860 - RNA, 13 nt, Mycobacterium bovis subsp bovis AF2122/97
cgauugccaccga

SEQ ID NO: 1216861 - RNA, 13 nt, Mycobacterium bovis subsp bovis AF2122/97
cgauugagcccca

SEQ ID NO: 1216862 - RNA, 23 nt, Mycobacterium bovis subsp bovis AF2122/97
cgauuggcaggcaaugcccgacc

SEQ ID NO: 1216863 - RNA, 14 nt, Mycobacterium bovis subsp bovis AF2122/97
cgauuggcucgccg

SEQ ID NO: 1216864 - RNA, 17 nt, Mycobacterium bovis subsp bovis AF2122/97
cgauugcucggggagga

SEQ ID NO: 1216865 - RNA, 22 nt, Mycobacterium bovis subsp bovis AF2122/97
cgauuuuggcaagcugccccgc

SEQ ID NO: 1216866 - RNA, 19 nt, Mycobacterium bovis subsp bovis AF2122/97
cgcaaaccacccgcaacac

SEQ ID NO: 1216867 - RNA, 22 nt, Mycobacterium bovis subsp bovis AF2122/97
cgcaaagacaccgaaagccucu

SEQ ID NO: 1216868 - RNA, 17 nt, Mycobacterium bovis subsp bovis AF2122/97
cgcaaaaucgcacgguu

SEQ ID NO: 1216869 - RNA, 17 nt, Mycobacterium bovis subsp bovis AF2122/97
cgaugaugccggacagc

SEQ ID NO: 1216870 - RNA, 15 nt, Mycobacterium bovis subsp bovis AF2122/97
cgaugaugccgucgu

SEQ ID NO: 1216871 - RNA, 18 nt, Mycobacterium bovis subsp bovis AF2122/97
cgaugaugcggcgcagcg

SEQ ID NO: 1216872 - RNA, 20 nt, Mycobacterium bovis subsp bovis AF2122/97
cgaugauggacaccagccag

SEQ ID NO: 1216873 - RNA, 16 nt, Mycobacterium bovis subsp bovis AF2122/97
cgaugauggcuccggc

SEQ ID NO: 1216874 - RNA, 14 nt, Mycobacterium bovis subsp bovis AF2122/97
cgaugauguugagc

SEQ ID NO: 1216875 - RNA, 18 nt, Mycobacterium bovis subsp bovis AF2122/97
cgaugccgugccgggcca

SEQ ID NO: 1216876 - RNA, 16 nt, Mycobacterium bovis subsp bovis AF2122/97
cgaugccgugcugggc

SEQ ID NO: 1216877 - RNA, 17 nt, Mycobacterium bovis subsp bovis AF2122/97
cgaugccguguucagca

SEQ ID NO: 1216878 - RNA, 15 nt, Mycobacterium bovis subsp bovis AF2122/97
cgaugaucaccaguc

SEQ ID NO: 1216879 - RNA, 18 nt, Mycobacterium bovis subsp bovis AF2122/97
cgaugaucccgccaccga

SEQ ID NO: 1216880 - RNA, 21 nt, Mycobacterium bovis subsp bovis AF2122/97
cgaucaacaacagccgcagcc

SEQ ID NO: 1216881 - RNA, 16 nt, Mycobacterium bovis subsp bovis AF2122/97
cgaucaacaccaaucg

SEQ ID NO: 1216882 - RNA, 18 nt, Mycobacterium bovis subsp bovis AF2122/97
cgaucaaagccagcaccu

SEQ ID NO: 1216883 - RNA, 13 nt, Mycobacterium bovis subsp bovis AF2122/97
cgauauugggaua

SEQ ID NO: 1216884 - RNA, 21 nt, Mycobacterium bovis subsp bovis AF2122/97
cgauaucguuggcgaccaccg

SEQ ID NO: 1216885 - RNA, 15 nt, Mycobacterium bovis subsp bovis AF2122/97
cgauaucgggcucag

SEQ ID NO: 1216886 - RNA, 22 nt, Mycobacterium bovis subsp bovis AF2122/97
cgaugcgcacucccggcucggc

SEQ ID NO: 1216887 - RNA, 13 nt, Mycobacterium bovis subsp bovis AF2122/97
cgaugcgcgccgg

SEQ ID NO: 1216888 - RNA, 16 nt, Mycobacterium bovis subsp bovis AF2122/97
cgaugcgcgccggcuu

SEQ ID NO: 1216889 - RNA, 14 nt, Mycobacterium bovis subsp bovis AF2122/97
cgaugcgguucucg

SEQ ID NO: 1216890 - RNA, 22 nt, Mycobacterium bovis subsp bovis AF2122/97
cgaugcguccgcccagccgcag

SEQ ID NO: 1216891 - RNA, 15 nt, Mycobacterium bovis subsp bovis AF2122/97
cgaugcucagcuggu

SEQ ID NO: 1216892 - RNA, 13 nt, Mycobacterium bovis subsp bovis AF2122/97
cgaugcugaucac

SEQ ID NO: 1216893 - RNA, 15 nt, Mycobacterium bovis subsp bovis AF2122/97
cgaugcugaacacgc

SEQ ID NO: 1216894 - RNA, 16 nt, Mycobacterium bovis subsp bovis AF2122/97
cgauggucagcagauc

SEQ ID NO: 1216895 - RNA, 17 nt, Mycobacterium bovis subsp bovis AF2122/97
cgaugguaucgccgcua

SEQ ID NO: 1216896 - RNA, 14 nt, Mycobacterium bovis subsp bovis AF2122/97
cgaugggugcaccg

SEQ ID NO: 1216897 - RNA, 19 nt, Mycobacterium bovis subsp bovis AF2122/97
cgaugguacccgcgccgcg

SEQ ID NO: 1216898 - RNA, 19 nt, Mycobacterium bovis subsp bovis AF2122/97
cgaugggaaucagugaaga

SEQ ID NO: 1216899 - RNA, 18 nt, Mycobacterium bovis subsp bovis AF2122/97
cgaugggagcccggcggc

SEQ ID NO: 1216900 - RNA, 19 nt, Mycobacterium bovis subsp bovis AF2122/97
cgaugggagcccggcggcc

SEQ ID NO: 1216901 - RNA, 18 nt, Mycobacterium bovis subsp bovis AF2122/97
cgauggcuuggugcccaa

SEQ ID NO: 1216902 - RNA, 18 nt, Mycobacterium bovis subsp bovis AF2122/97
cgauggcgucggccagga

SEQ ID NO: 1216903 - RNA, 13 nt, Mycobacterium bovis subsp bovis AF2122/97
cgcaccucggcga

SEQ ID NO: 1216904 - RNA, 19 nt, Mycobacterium bovis subsp bovis AF2122/97
cgcaccucgguggcugcca

SEQ ID NO: 1216905 - RNA, 22 nt, Mycobacterium bovis subsp bovis AF2122/97
cgcaccugcgcgcggccgcgcu

SEQ ID NO: 1216906 - RNA, 16 nt, Mycobacterium bovis subsp bovis AF2122/97
cgcaccugcgcgcggc

SEQ ID NO: 1216907 - RNA, 20 nt, Mycobacterium bovis subsp bovis AF2122/97
cgcacgacgcgacacgccgg

SEQ ID NO: 1216908 - RNA, 19 nt, Mycobacterium bovis subsp bovis AF2122/97
cgcacgacugugcgccgca

SEQ ID NO: 1216909 - RNA, 20 nt, Mycobacterium bovis subsp bovis AF2122/97
cgcacgacugugcgccgcag

SEQ ID NO: 1216910 - RNA, 22 nt, Mycobacterium bovis subsp bovis AF2122/97
cgcacgacugugcgccgcagcc

SEQ ID NO: 1216911 - RNA, 19 nt, Mycobacterium bovis subsp bovis AF2122/97
cgcaccugggcugccggcc

SEQ ID NO: 1216912 - RNA, 22 nt, Mycobacterium bovis subsp bovis AF2122/97
cgcaccuugaccgucgcgcauu

SEQ ID NO: 1216913 - RNA, 14 nt, Mycobacterium bovis subsp bovis AF2122/97
cgcaccaccugggc

SEQ ID NO: 1216914 - RNA, 12 nt, Mycobacterium bovis subsp bovis AF2122/97
cgcaccaccgcg

SEQ ID NO: 1216915 - RNA, 17 nt, Mycobacterium bovis subsp bovis AF2122/97
cgcaccaccgcggcggc

SEQ ID NO: 1216916 - RNA, 12 nt, Mycobacterium bovis subsp bovis AF2122/97
cgcaccaccacg

SEQ ID NO: 1216917 - RNA, 13 nt, Mycobacterium bovis subsp bovis AF2122/97
cgcaccaccgccc

SEQ ID NO: 1216918 - RNA, 22 nt, Mycobacterium bovis subsp bovis AF2122/97
cgcaccacgagcagccgaugcu

SEQ ID NO: 1216919 - RNA, 19 nt, Mycobacterium bovis subsp bovis AF2122/97
cgcaccaagacgccaccca

SEQ ID NO: 1216920 - RNA, 17 nt, Mycobacterium bovis subsp bovis AF2122/97
cgcaccaagcagcgacc

SEQ ID NO: 1216921 - RNA, 14 nt, Mycobacterium bovis subsp bovis AF2122/97
cgcaccacaccgug

SEQ ID NO: 1216922 - RNA, 18 nt, Mycobacterium bovis subsp bovis AF2122/97
cgcaccacaauccacgca

SEQ ID NO: 1216923 - RNA, 21 nt, Mycobacterium bovis subsp bovis AF2122/97
cgcaccacacuggcagugugg

SEQ ID NO: 1216924 - RNA, 19 nt, Mycobacterium bovis subsp bovis AF2122/97
cgcacgauagccaccgacg

SEQ ID NO: 1216925 - RNA, 22 nt, Mycobacterium bovis subsp bovis AF2122/97
cgcacgaucggggaagccugcg

SEQ ID NO: 1216926 - RNA, 18 nt, Mycobacterium bovis subsp bovis AF2122/97
cgcacgaucugcaggccc

SEQ ID NO: 1216927 - RNA, 16 nt, Mycobacterium bovis subsp bovis AF2122/97
cgcacgcacgccacug

SEQ ID NO: 1216928 - RNA, 18 nt, Mycobacterium bovis subsp bovis AF2122/97
cgcacgcagccgauacag

SEQ ID NO: 1216929 - RNA, 21 nt, Mycobacterium bovis subsp bovis AF2122/97
cgcacgauuucgagcgcugcu

SEQ ID NO: 1216930 - RNA, 19 nt, Mycobacterium bovis subsp bovis AF2122/97
cgcacgccgaccagcaccc

SEQ ID NO: 1216931 - RNA, 14 nt, Mycobacterium bovis subsp bovis AF2122/97
cgcacgccggcaug

SEQ ID NO: 1216932 - RNA, 21 nt, Mycobacterium bovis subsp bovis AF2122/97
cgcacgcgaaaugccugcgcg

SEQ ID NO: 1216933 - RNA, 23 nt, Mycobacterium bovis subsp bovis AF2122/97
cgcacgcggaaaggcuuccgcgu

SEQ ID NO: 1216934 - RNA, 20 nt, Mycobacterium bovis subsp bovis AF2122/97
cgcacgcgguucaccacguc

SEQ ID NO: 1216935 - RNA, 19 nt, Mycobacterium bovis subsp bovis AF2122/97
cgcacgugaugcccugggg

SEQ ID NO: 1216936 - RNA, 20 nt, Mycobacterium bovis subsp bovis AF2122/97
cgcacuaccgccuuugcccg

SEQ ID NO: 1216937 - RNA, 19 nt, Mycobacterium bovis subsp bovis AF2122/97
cgcacucggcgguuccggc

SEQ ID NO: 1216938 - RNA, 21 nt, Mycobacterium bovis subsp bovis AF2122/97
cgcacucccggcucggccagc

SEQ ID NO: 1216939 - RNA, 17 nt, Mycobacterium bovis subsp bovis AF2122/97
cgcacucagucugggga

SEQ ID NO: 1216940 - RNA, 22 nt, Mycobacterium bovis subsp bovis AF2122/97
cgcacucauagaacucgccgcu

SEQ ID NO: 1216941 - RNA, 22 nt, Mycobacterium bovis subsp bovis AF2122/97
cgcacuuucuuccucggggcuc

SEQ ID NO: 1216942 - RNA, 16 nt, Mycobacterium bovis subsp bovis AF2122/97
cgcagaacaccaccgc

SEQ ID NO: 1216943 - RNA, 15 nt, Mycobacterium bovis subsp bovis AF2122/97
cgcagaaagucgcgc

SEQ ID NO: 1216944 - RNA, 18 nt, Mycobacterium bovis subsp bovis AF2122/97
cgcaaccggcggacaccu

SEQ ID NO: 1216945 - RNA, 14 nt, Mycobacterium bovis subsp bovis AF2122/97
cgcaaccgccgcca

SEQ ID NO: 1216946 - RNA, 17 nt, Mycobacterium bovis subsp bovis AF2122/97
cgcaaccgccgcgucau

SEQ ID NO: 1216947 - RNA, 12 nt, Mycobacterium bovis subsp bovis AF2122/97
cgcaaccgagcg

SEQ ID NO: 1216948 - RNA, 20 nt, Mycobacterium bovis subsp bovis AF2122/97
cgcaaccgagggcauuccga

SEQ ID NO: 1216949 - RNA, 20 nt, Mycobacterium bovis subsp bovis AF2122/97
cgcaacccagccgcgccagc

SEQ ID NO: 1216950 - RNA, 23 nt, Mycobacterium bovis subsp bovis AF2122/97
cgcaaccauguuaacgcgcgucc

SEQ ID NO: 1216951 - RNA, 19 nt, Mycobacterium bovis subsp bovis AF2122/97
cgcaaccagccuuuccggc

SEQ ID NO: 1216952 - RNA, 13 nt, Mycobacterium bovis subsp bovis AF2122/97
cgcaacccagccg

SEQ ID NO: 1216953 - RNA, 14 nt, Mycobacterium bovis subsp bovis AF2122/97
cgcaacggaugugg

SEQ ID NO: 1216954 - RNA, 21 nt, Mycobacterium bovis subsp bovis AF2122/97
cgcaacgacugaucaagugcc

SEQ ID NO: 1216955 - RNA, 15 nt, Mycobacterium bovis subsp bovis AF2122/97
cgcaacgccgccagc

SEQ ID NO: 1216956 - RNA, 17 nt, Mycobacterium bovis subsp bovis AF2122/97
cgcaaccgguggaugaa

SEQ ID NO: 1216957 - RNA, 19 nt, Mycobacterium bovis subsp bovis AF2122/97
cgcaaauugcaacagagcg

SEQ ID NO: 1216958 - RNA, 19 nt, Mycobacterium bovis subsp bovis AF2122/97
cgcaacaccgccaacuccu

SEQ ID NO: 1216959 - RNA, 22 nt, Mycobacterium bovis subsp bovis AF2122/97
cgcaacagcucggccaggcugg

SEQ ID NO: 1216960 - RNA, 14 nt, Mycobacterium bovis subsp bovis AF2122/97
cgcaacaccgugca

SEQ ID NO: 1216961 - RNA, 15 nt, Mycobacterium bovis subsp bovis AF2122/97
cgcaaaggccccggu

SEQ ID NO: 1216962 - RNA, 13 nt, Mycobacterium bovis subsp bovis AF2122/97
cgcaaaggagaag

SEQ ID NO: 1216963 - RNA, 12 nt, Mycobacterium bovis subsp bovis AF2122/97
cgcacagcacca

SEQ ID NO: 1216964 - RNA, 18 nt, Mycobacterium bovis subsp bovis AF2122/97
cgcacagagugaggcgcu

SEQ ID NO: 1216965 - RNA, 15 nt, Mycobacterium bovis subsp bovis AF2122/97
cgcacagcagcaccg

SEQ ID NO: 1216966 - RNA, 14 nt, Mycobacterium bovis subsp bovis AF2122/97
cgcacaggauuuuc

SEQ ID NO: 1216967 - RNA, 13 nt, Mycobacterium bovis subsp bovis AF2122/97
cgcacaccgaccc

SEQ ID NO: 1216968 - RNA, 16 nt, Mycobacterium bovis subsp bovis AF2122/97
cgcacaccugcgcggc

SEQ ID NO: 1216969 - RNA, 15 nt, Mycobacterium bovis subsp bovis AF2122/97
cgcaacggccagcgc

SEQ ID NO: 1216970 - RNA, 23 nt, Mycobacterium bovis subsp bovis AF2122/97
cgcaacucgccgaaaucggccag

SEQ ID NO: 1216971 - RNA, 17 nt, Mycobacterium bovis subsp bovis AF2122/97
cgcaagcaaauucuggu

SEQ ID NO: 1216972 - RNA, 14 nt, Mycobacterium bovis subsp bovis AF2122/97
cgcagcggcggcaa

SEQ ID NO: 1216973 - RNA, 13 nt, Mycobacterium bovis subsp bovis AF2122/97
cgcagcggcggca

SEQ ID NO: 1216974 - RNA, 18 nt, Mycobacterium bovis subsp bovis AF2122/97
cgcagcggccagcccagc

SEQ ID NO: 1216975 - RNA, 19 nt, Mycobacterium bovis subsp bovis AF2122/97
cgcagcggccagcccagcc

SEQ ID NO: 1216976 - RNA, 16 nt, Mycobacterium bovis subsp bovis AF2122/97
cgcagcgguccgccgc

SEQ ID NO: 1216977 - RNA, 21 nt, Mycobacterium bovis subsp bovis AF2122/97
cgcagcgguggucggcgcgcc

SEQ ID NO: 1216978 - RNA, 21 nt, Mycobacterium bovis subsp bovis AF2122/97
cgcagcguguaguggcccgcg

SEQ ID NO: 1216979 - RNA, 18 nt, Mycobacterium bovis subsp bovis AF2122/97
cgcagcguuggccgcugu

SEQ ID NO: 1216980 - RNA, 22 nt, Mycobacterium bovis subsp bovis AF2122/97
cgcagcuccaccgugacggcca

SEQ ID NO: 1216981 - RNA, 13 nt, Mycobacterium bovis subsp bovis AF2122/97
cgcaggaccugcg

SEQ ID NO: 1216982 - RNA, 15 nt, Mycobacterium bovis subsp bovis AF2122/97
cgcaggaagcccacg

SEQ ID NO: 1216983 - RNA, 19 nt, Mycobacterium bovis subsp bovis AF2122/97
cgcaggaagccggcgugcu

SEQ ID NO: 1216984 - RNA, 18 nt, Mycobacterium bovis subsp bovis AF2122/97
cgcagauuugcuccagcg

SEQ ID NO: 1216985 - RNA, 14 nt, Mycobacterium bovis subsp bovis AF2122/97
cgcagauuccugau

SEQ ID NO: 1216986 - RNA, 18 nt, Mycobacterium bovis subsp bovis AF2122/97
cgcagauuggcggcuucg

SEQ ID NO: 1216987 - RNA, 19 nt, Mycobacterium bovis subsp bovis AF2122/97
cgcagauccccgccaccga

SEQ ID NO: 1216988 - RNA, 18 nt, Mycobacterium bovis subsp bovis AF2122/97
cgcagauccccgccaccg

SEQ ID NO: 1216989 - RNA, 15 nt, Mycobacterium bovis subsp bovis AF2122/97
cgcagaucaccgcca

SEQ ID NO: 1216990 - RNA, 17 nt, Mycobacterium bovis subsp bovis AF2122/97
cgcagaucaccgccagc

SEQ ID NO: 1216991 - RNA, 19 nt, Mycobacterium bovis subsp bovis AF2122/97
cgcagaacggcguugcgga

SEQ ID NO: 1216992 - RNA, 15 nt, Mycobacterium bovis subsp bovis AF2122/97
cgcagaauccggcaa

SEQ ID NO: 1216993 - RNA, 15 nt, Mycobacterium bovis subsp bovis AF2122/97
cgcaggccggcggcg

SEQ ID NO: 1216994 - RNA, 21 nt, Mycobacterium bovis subsp bovis AF2122/97
cgcaggcgcagauuccucuuc

SEQ ID NO: 1216995 - RNA, 19 nt, Mycobacterium bovis subsp bovis AF2122/97
cgcaggcgauugcagcuuc

SEQ ID NO: 1216996 - RNA, 20 nt, Mycobacterium bovis subsp bovis AF2122/97
cgcaggcuuccagccacagc

SEQ ID NO: 1216997 - RNA, 18 nt, Mycobacterium bovis subsp bovis AF2122/97
cgcaggcucaccgagccg

SEQ ID NO: 1216998 - RNA, 15 nt, Mycobacterium bovis subsp bovis AF2122/97
cgcaggccgccgcca

SEQ ID NO: 1216999 - RNA, 15 nt, Mycobacterium bovis subsp bovis AF2122/97
cgcaggcacaucgcg

SEQ ID NO: 1217000 - RNA, 18 nt, Mycobacterium bovis subsp bovis AF2122/97
cgcaggcaccccgaucac

SEQ ID NO: 1217001 - RNA, 21 nt, Mycobacterium bovis subsp bovis AF2122/97
cgcaggauucccaguccagga

SEQ ID NO: 1217002 - RNA, 18 nt, Mycobacterium bovis subsp bovis AF2122/97
cgcaggaucacacuggcc

SEQ ID NO: 1217003 - RNA, 22 nt, Mycobacterium bovis subsp bovis AF2122/97
cgcaggaauucgccauagcggg

SEQ ID NO: 1217004 - RNA, 15 nt, Mycobacterium bovis subsp bovis AF2122/97
cgcaggacgcugccg

SEQ ID NO: 1217005 - RNA, 19 nt, Mycobacterium bovis subsp bovis AF2122/97
cgcaucauagacagggccg

SEQ ID NO: 1217006 - RNA, 15 nt, Mycobacterium bovis subsp bovis AF2122/97
cgcaucgccgacagc

SEQ ID NO: 1217007 - RNA, 21 nt, Mycobacterium bovis subsp bovis AF2122/97
cgcaucgcacgggccaccagc

SEQ ID NO: 1217008 - RNA, 15 nt, Mycobacterium bovis subsp bovis AF2122/97
cgcaucgccuccucg

SEQ ID NO: 1217009 - RNA, 15 nt, Mycobacterium bovis subsp bovis AF2122/97
cgcaucgagcaccuc

SEQ ID NO: 1217010 - RNA, 18 nt, Mycobacterium bovis subsp bovis AF2122/97
cgcaucgucgaaagccug

SEQ ID NO: 1217011 - RNA, 23 nt, Mycobacterium bovis subsp bovis AF2122/97
cgcaucggcgggucugggucagg

SEQ ID NO: 1217012 - RNA, 14 nt, Mycobacterium bovis subsp bovis AF2122/97
cgcaucggcaaggc

SEQ ID NO: 1217013 - RNA, 23 nt, Mycobacterium bovis subsp bovis AF2122/97
cgcaucggccagcagcgacucca

SEQ ID NO: 1217014 - RNA, 18 nt, Mycobacterium bovis subsp bovis AF2122/97
cgcaugaucgcaccgagg

SEQ ID NO: 1217015 - RNA, 15 nt, Mycobacterium bovis subsp bovis AF2122/97
cgcagggaucacccc

SEQ ID NO: 1217016 - RNA, 15 nt, Mycobacterium bovis subsp bovis AF2122/97
cgcagggccuggaag

SEQ ID NO: 1217017 - RNA, 22 nt, Mycobacterium bovis subsp bovis AF2122/97
aaacgggguggcacgcaugagg

SEQ ID NO: 1217018 - RNA, 17 nt, Mycobacterium bovis subsp bovis AF2122/97
cgcauaggccccgccag

SEQ ID NO: 1217019 - RNA, 18 nt, Mycobacterium bovis subsp bovis AF2122/97
cgcauaggccccgccagc

SEQ ID NO: 1217020 - RNA, 18 nt, Mycobacterium bovis subsp bovis AF2122/97
cgcauagugcggcugcaa

SEQ ID NO: 1217021 - RNA, 21 nt, Mycobacterium bovis subsp bovis AF2122/97
cgcauaggcuuccggcgcgac

SEQ ID NO: 1217022 - RNA, 15 nt, Mycobacterium bovis subsp bovis AF2122/97
cgcauagggccaccg

SEQ ID NO: 1217023 - RNA, 15 nt, Mycobacterium bovis subsp bovis AF2122/97
cgcaucaccacccga

SEQ ID NO: 1217024 - RNA, 14 nt, Mycobacterium bovis subsp bovis AF2122/97
cgcaucaccacugg

SEQ ID NO: 1217025 - RNA, 13 nt, Mycobacterium bovis subsp bovis AF2122/97
cgcaucacccggg

SEQ ID NO: 1217026 - RNA, 19 nt, Mycobacterium bovis subsp bovis AF2122/97
cgcaugcgcuccggcgcga

SEQ ID NO: 1217027 - RNA, 19 nt, Mycobacterium bovis subsp bovis AF2122/97
cgcauggacaacagcuugg

SEQ ID NO: 1217028 - RNA, 13 nt, Mycobacterium bovis subsp bovis AF2122/97
cgcaugccacggc

SEQ ID NO: 1217029 - RNA, 16 nt, Mycobacterium bovis subsp bovis AF2122/97
cgcaugcgcgcgccgg

SEQ ID NO: 1217030 - RNA, 19 nt, Mycobacterium bovis subsp bovis AF2122/97
cgcaugucgggccaggcga

SEQ ID NO: 1217031 - RNA, 17 nt, Mycobacterium bovis subsp bovis AF2122/97
cgcauguucuccacgcc

SEQ ID NO: 1217032 - RNA, 23 nt, Mycobacterium bovis subsp bovis AF2122/97
cgcauuagccugcguggagcgcu

SEQ ID NO: 1217033 - RNA, 22 nt, Mycobacterium bovis subsp bovis AF2122/97
cgcauuccagcaggccacugcg

SEQ ID NO: 1217034 - RNA, 15 nt, Mycobacterium bovis subsp bovis AF2122/97
cgccaaccccaacau

SEQ ID NO: 1217035 - RNA, 12 nt, Mycobacterium bovis subsp bovis AF2122/97
cgccaacgccaa

SEQ ID NO: 1217036 - RNA, 15 nt, Mycobacterium bovis subsp bovis AF2122/97
cgccaacccggccaa

SEQ ID NO: 1217037 - RNA, 20 nt, Mycobacterium bovis subsp bovis AF2122/97
cgccaaccguucccggcaga

SEQ ID NO: 1217038 - RNA, 19 nt, Mycobacterium bovis subsp bovis AF2122/97
cgccaacuucaccacccug

SEQ ID NO: 1217039 - RNA, 18 nt, Mycobacterium bovis subsp bovis AF2122/97
cgccaacguugcgccagc

SEQ ID NO: 1217040 - RNA, 18 nt, Mycobacterium bovis subsp bovis AF2122/97
cgccaacgggcugccccu

SEQ ID NO: 1217041 - RNA, 14 nt, Mycobacterium bovis subsp bovis AF2122/97
cgccaacgccagca

SEQ ID NO: 1217042 - RNA, 15 nt, Mycobacterium bovis subsp bovis AF2122/97
cgccaacgccagcac

SEQ ID NO: 1217043 - RNA, 17 nt, Mycobacterium bovis subsp bovis AF2122/97
cgccaacgugacgccgg

SEQ ID NO: 1217044 - RNA, 22 nt, Mycobacterium bovis subsp bovis AF2122/97
cgccaaauccggugcccgcacc

SEQ ID NO: 1217045 - RNA, 23 nt, Mycobacterium bovis subsp bovis AF2122/97
cgccaacaacccaacaaaaggcc

SEQ ID NO: 1217046 - RNA, 14 nt, Mycobacterium bovis subsp bovis AF2122/97
cgccaaacccggcg

SEQ ID NO: 1217047 - RNA, 20 nt, Mycobacterium bovis subsp bovis AF2122/97
cgccaaacgcugcgcccgga

SEQ ID NO: 1217048 - RNA, 23 nt, Mycobacterium bovis subsp bovis AF2122/97
cgccaaacccaugucggcgcgcc

SEQ ID NO: 1217049 - RNA, 18 nt, Mycobacterium bovis subsp bovis AF2122/97
cgcauuuuucgccagcug

SEQ ID NO: 1217050 - RNA, 17 nt, Mycobacterium bovis subsp bovis AF2122/97
cgccacagcacccacgc

SEQ ID NO: 1217051 - RNA, 16 nt, Mycobacterium bovis subsp bovis AF2122/97
cgccacaacggcggcg

SEQ ID NO: 1217052 - RNA, 14 nt, Mycobacterium bovis subsp bovis AF2122/97
cgccacacccgcga

SEQ ID NO: 1217053 - RNA, 13 nt, Mycobacterium bovis subsp bovis AF2122/97
cgccacacccgug

SEQ ID NO: 1217054 - RNA, 19 nt, Mycobacterium bovis subsp bovis AF2122/97
cgccaaguccgcucaccuu

SEQ ID NO: 1217055 - RNA, 19 nt, Mycobacterium bovis subsp bovis AF2122/97
cgccaagugcagggcugcu

SEQ ID NO: 1217056 - RNA, 18 nt, Mycobacterium bovis subsp bovis AF2122/97
cgccaagcucggccacca

SEQ ID NO: 1217057 - RNA, 17 nt, Mycobacterium bovis subsp bovis AF2122/97
cgccaagacgucggcgu

SEQ ID NO: 1217058 - RNA, 15 nt, Mycobacterium bovis subsp bovis AF2122/97
cgccaagcucggcca

SEQ ID NO: 1217059 - RNA, 17 nt, Mycobacterium bovis subsp bovis AF2122/97
cgccaccgcgacgagcg

SEQ ID NO: 1217060 - RNA, 19 nt, Mycobacterium bovis subsp bovis AF2122/97
cgccaccgcgacaccccgg

SEQ ID NO: 1217061 - RNA, 17 nt, Mycobacterium bovis subsp bovis AF2122/97
cgccaccgccagcgucg

SEQ ID NO: 1217062 - RNA, 16 nt, Mycobacterium bovis subsp bovis AF2122/97
cgccaccgaacgcacc

SEQ ID NO: 1217063 - RNA, 13 nt, Mycobacterium bovis subsp bovis AF2122/97
cgccaccgaagcc

SEQ ID NO: 1217064 - RNA, 23 nt, Mycobacterium bovis subsp bovis AF2122/97
cgccaccgauaccgucagcgccg

SEQ ID NO: 1217065 - RNA, 21 nt, Mycobacterium bovis subsp bovis AF2122/97
cgccaccgcaagaaucagcag

SEQ ID NO: 1217066 - RNA, 19 nt, Mycobacterium bovis subsp bovis AF2122/97
cgccaccggcgccgcccgc

SEQ ID NO: 1217067 - RNA, 16 nt, Mycobacterium bovis subsp bovis AF2122/97
cgccaccggcgcgacc

SEQ ID NO: 1217068 - RNA, 12 nt, Mycobacterium bovis subsp bovis AF2122/97
cgccaccggcgu

SEQ ID NO: 1217069 - RNA, 17 nt, Mycobacterium bovis subsp bovis AF2122/97
cgccaccggcgccgccc

SEQ ID NO: 1217070 - RNA, 14 nt, Mycobacterium bovis subsp bovis AF2122/97
cgccaccgcggccu

SEQ ID NO: 1217071 - RNA, 20 nt, Mycobacterium bovis subsp bovis AF2122/97
cgccaccgcggucaccgacg

SEQ ID NO: 1217072 - RNA, 20 nt, Mycobacterium bovis subsp bovis AF2122/97
cgccaccgcgucacuucccg

SEQ ID NO: 1217073 - RNA, 20 nt, Mycobacterium bovis subsp bovis AF2122/97
cgccaccggcaaucggcggc

SEQ ID NO: 1217074 - RNA, 23 nt, Mycobacterium bovis subsp bovis AF2122/97
cgccaccggcaccgccugcgccg

SEQ ID NO: 1217075 - RNA, 17 nt, Mycobacterium bovis subsp bovis AF2122/97
cgccaccccgcgcgcca

SEQ ID NO: 1217076 - RNA, 22 nt, Mycobacterium bovis subsp bovis AF2122/97
cgccaccccgcguaugccagga

SEQ ID NO: 1217077 - RNA, 19 nt, Mycobacterium bovis subsp bovis AF2122/97
cgccacccccaaccgccgg

SEQ ID NO: 1217078 - RNA, 18 nt, Mycobacterium bovis subsp bovis AF2122/97
cgccacccgaucgggcgu

SEQ ID NO: 1217079 - RNA, 21 nt, Mycobacterium bovis subsp bovis AF2122/97
cgccacccgcgccgcccgcuc

SEQ ID NO: 1217080 - RNA, 18 nt, Mycobacterium bovis subsp bovis AF2122/97
cgccacccggcgggcggu

SEQ ID NO: 1217081 - RNA, 11 nt, Mycobacterium bovis subsp bovis AF2122/97
cgccaccaccg

SEQ ID NO: 1217082 - RNA, 14 nt, Mycobacterium bovis subsp bovis AF2122/97
cgccaccaccggcg

SEQ ID NO: 1217083 - RNA, 12 nt, Mycobacterium bovis subsp bovis AF2122/97
cgccaccaccuc

SEQ ID NO: 1217084 - RNA, 14 nt, Mycobacterium bovis subsp bovis AF2122/97
cgccaccaccaggg

SEQ ID NO: 1217085 - RNA, 16 nt, Mycobacterium bovis subsp bovis AF2122/97
cgccaccaccagggca

SEQ ID NO: 1217086 - RNA, 18 nt, Mycobacterium bovis subsp bovis AF2122/97
cgccacauuucaccaccg

SEQ ID NO: 1217087 - RNA, 17 nt, Mycobacterium bovis subsp bovis AF2122/97
cgagcgcaccgcugacc

SEQ ID NO: 1217088 - RNA, 19 nt, Mycobacterium bovis subsp bovis AF2122/97
cgagcgcacuggggaggcc

SEQ ID NO: 1217089 - RNA, 20 nt, Mycobacterium bovis subsp bovis AF2122/97
cgagcgcacuggggaggcca

SEQ ID NO: 1217090 - RNA, 19 nt, Mycobacterium bovis subsp bovis AF2122/97
cgagcgcaucagggugggc

SEQ ID NO: 1217091 - RNA, 23 nt, Mycobacterium bovis subsp bovis AF2122/97
cgagcgcauguugcaggcgcagc

SEQ ID NO: 1217092 - RNA, 20 nt, Mycobacterium bovis subsp bovis AF2122/97
cgagccgcggucaccccggc

SEQ ID NO: 1217093 - RNA, 22 nt, Mycobacterium bovis subsp bovis AF2122/97
cgagccgcggucggcgugcagg

SEQ ID NO: 1217094 - RNA, 15 nt, Mycobacterium bovis subsp bovis AF2122/97
cgagccgcgugggcc

SEQ ID NO: 1217095 - RNA, 13 nt, Mycobacterium bovis subsp bovis AF2122/97
cgagccggcgcgc

SEQ ID NO: 1217096 - RNA, 15 nt, Mycobacterium bovis subsp bovis AF2122/97
cgagccggcucagac

SEQ ID NO: 1217097 - RNA, 21 nt, Mycobacterium bovis subsp bovis AF2122/97
cgagccgguauacccggcccc

SEQ ID NO: 1217098 - RNA, 22 nt, Mycobacterium bovis subsp bovis AF2122/97
cgagccgguaaccgcgucgacc

SEQ ID NO: 1217099 - RNA, 19 nt, Mycobacterium bovis subsp bovis AF2122/97
cgagccggugccacugccg

SEQ ID NO: 1217100 - RNA, 22 nt, Mycobacterium bovis subsp bovis AF2122/97
cgagccguccaauuccgcagag

SEQ ID NO: 1217101 - RNA, 20 nt, Mycobacterium bovis subsp bovis AF2122/97
cgagccugauaaagcccggc

SEQ ID NO: 1217102 - RNA, 23 nt, Mycobacterium bovis subsp bovis AF2122/97
cgagccugauaaagcccggcggc

SEQ ID NO: 1217103 - RNA, 21 nt, Mycobacterium bovis subsp bovis AF2122/97
cgagcgaccgucccagcgccg

SEQ ID NO: 1217104 - RNA, 14 nt, Mycobacterium bovis subsp bovis AF2122/97
cgagcgagccaacu

SEQ ID NO: 1217105 - RNA, 20 nt, Mycobacterium bovis subsp bovis AF2122/97
cgagcgacguuaaugacgcc

SEQ ID NO: 1217106 - RNA, 14 nt, Mycobacterium bovis subsp bovis AF2122/97
cgagcccggccucg

SEQ ID NO: 1217107 - RNA, 21 nt, Mycobacterium bovis subsp bovis AF2122/97
cgagcccgaucgcggcccggc

SEQ ID NO: 1217108 - RNA, 17 nt, Mycobacterium bovis subsp bovis AF2122/97
cgagcccgccggccucu

SEQ ID NO: 1217109 - RNA, 14 nt, Mycobacterium bovis subsp bovis AF2122/97
cgagcccguccucg

SEQ ID NO: 1217110 - RNA, 20 nt, Mycobacterium bovis subsp bovis AF2122/97
cgagcccggugcuaccggcu

SEQ ID NO: 1217111 - RNA, 14 nt, Mycobacterium bovis subsp bovis AF2122/97
cgagccgcggcaac

SEQ ID NO: 1217112 - RNA, 21 nt, Mycobacterium bovis subsp bovis AF2122/97
cgagccgcggcaacaccaccu

SEQ ID NO: 1217113 - RNA, 15 nt, Mycobacterium bovis subsp bovis AF2122/97
cgagccgaucugcug

SEQ ID NO: 1217114 - RNA, 14 nt, Mycobacterium bovis subsp bovis AF2122/97
cgagccgcccgccc

SEQ ID NO: 1217115 - RNA, 14 nt, Mycobacterium bovis subsp bovis AF2122/97
cgagccgccaccgu

SEQ ID NO: 1217116 - RNA, 15 nt, Mycobacterium bovis subsp bovis AF2122/97
cgagcccaccgucgc

SEQ ID NO: 1217117 - RNA, 17 nt, Mycobacterium bovis subsp bovis AF2122/97
cgagccaucaccgcaag

SEQ ID NO: 1217118 - RNA, 15 nt, Mycobacterium bovis subsp bovis AF2122/97
cgagcccaaggggca

SEQ ID NO: 1217119 - RNA, 14 nt, Mycobacterium bovis subsp bovis AF2122/97
cgagcccaccuggg

SEQ ID NO: 1217120 - RNA, 21 nt, Mycobacterium bovis subsp bovis AF2122/97
cgagccagcugcuccacccga

SEQ ID NO: 1217121 - RNA, 19 nt, Mycobacterium bovis subsp bovis AF2122/97
cgagccagcuucccgcugg

SEQ ID NO: 1217122 - RNA, 22 nt, Mycobacterium bovis subsp bovis AF2122/97
cgagccagcuucccgcuggugg

SEQ ID NO: 1217123 - RNA, 13 nt, Mycobacterium bovis subsp bovis AF2122/97
cgagccagcggag

SEQ ID NO: 1217124 - RNA, 14 nt, Mycobacterium bovis subsp bovis AF2122/97
cgagccagcggagc

SEQ ID NO: 1217125 - RNA, 14 nt, Mycobacterium bovis subsp bovis AF2122/97
cgagccaaggcuuc

SEQ ID NO: 1217126 - RNA, 20 nt, Mycobacterium bovis subsp bovis AF2122/97
cgagccaacuccacccaacg

SEQ ID NO: 1217127 - RNA, 21 nt, Mycobacterium bovis subsp bovis AF2122/97
cgagccaacuccacccaacgc

SEQ ID NO: 1217128 - RNA, 13 nt, Mycobacterium bovis subsp bovis AF2122/97
cgagccaccaccg

SEQ ID NO: 1217129 - RNA, 16 nt, Mycobacterium bovis subsp bovis AF2122/97
cgagccaccaccgccg

SEQ ID NO: 1217130 - RNA, 14 nt, Mycobacterium bovis subsp bovis AF2122/97
cgagccacgccagc

SEQ ID NO: 1217131 - RNA, 21 nt, Mycobacterium bovis subsp bovis AF2122/97
cgagcaucucgacaucggcca

SEQ ID NO: 1217132 - RNA, 20 nt, Mycobacterium bovis subsp bovis AF2122/97
cgagcaucaauugaguagau

SEQ ID NO: 1217133 - RNA, 18 nt, Mycobacterium bovis subsp bovis AF2122/97
cgagcaucuucgcgcagc

SEQ ID NO: 1217134 - RNA, 14 nt, Mycobacterium bovis subsp bovis AF2122/97
cgagcaugcccagc

SEQ ID NO: 1217135 - RNA, 17 nt, Mycobacterium bovis subsp bovis AF2122/97
cgagcaugcccagcgaa

SEQ ID NO: 1217136 - RNA, 12 nt, Mycobacterium bovis subsp bovis AF2122/97
cgagcaccaccc

SEQ ID NO: 1217137 - RNA, 18 nt, Mycobacterium bovis subsp bovis AF2122/97
cgagcacaggaucaccca

SEQ ID NO: 1217138 - RNA, 16 nt, Mycobacterium bovis subsp bovis AF2122/97
cgagcaccaccccagc

SEQ ID NO: 1217139 - RNA, 18 nt, Mycobacterium bovis subsp bovis AF2122/97
cgagcaccacccgggccu

SEQ ID NO: 1217140 - RNA, 23 nt, Mycobacterium bovis subsp bovis AF2122/97
cgagcacggugagccgguggccc

SEQ ID NO: 1217141 - RNA, 16 nt, Mycobacterium bovis subsp bovis AF2122/97
cgagcaccuccacugg

SEQ ID NO: 1217142 - RNA, 20 nt, Mycobacterium bovis subsp bovis AF2122/97
cgagcaccgugcccugggug

SEQ ID NO: 1217143 - RNA, 14 nt, Mycobacterium bovis subsp bovis AF2122/97
cgagcagacgccgc

SEQ ID NO: 1217144 - RNA, 20 nt, Mycobacterium bovis subsp bovis AF2122/97
cgagcacuccggagcccaca

SEQ ID NO: 1217145 - RNA, 14 nt, Mycobacterium bovis subsp bovis AF2122/97
cgagcacucggcca

SEQ ID NO: 1217146 - RNA, 20 nt, Mycobacterium bovis subsp bovis AF2122/97
cgagcagauacuccgcgguu

SEQ ID NO: 1217147 - RNA, 16 nt, Mycobacterium bovis subsp bovis AF2122/97
cgagcagaucagcacg

SEQ ID NO: 1217148 - RNA, 13 nt, Mycobacterium bovis subsp bovis AF2122/97
cgagcagcaggua

SEQ ID NO: 1217149 - RNA, 14 nt, Mycobacterium bovis subsp bovis AF2122/97
cgagcagcccggcg

SEQ ID NO: 1217150 - RNA, 13 nt, Mycobacterium bovis subsp bovis AF2122/97
cgagcagcccggg

SEQ ID NO: 1217151 - RNA, 13 nt, Mycobacterium bovis subsp bovis AF2122/97
cgagcagcgcgcc

SEQ ID NO: 1217152 - RNA, 14 nt, Mycobacterium bovis subsp bovis AF2122/97
cgagcagcuacagc

SEQ ID NO: 1217153 - RNA, 21 nt, Mycobacterium bovis subsp bovis AF2122/97
cgagcagcuagcccggcagca

SEQ ID NO: 1217154 - RNA, 12 nt, Mycobacterium bovis subsp bovis AF2122/97
cgagcagcucaa

SEQ ID NO: 1217155 - RNA, 14 nt, Mycobacterium bovis subsp bovis AF2122/97
cgagcaggccgccc

SEQ ID NO: 1217156 - RNA, 20 nt, Mycobacterium bovis subsp bovis AF2122/97
cgagcaggauaaacccggcg

SEQ ID NO: 1217157 - RNA, 13 nt, Mycobacterium bovis subsp bovis AF2122/97
cgagcaggcuggc

SEQ ID NO: 1217158 - RNA, 21 nt, Mycobacterium bovis subsp bovis AF2122/97
cgagcaggcuggcugccacga

SEQ ID NO: 1217159 - RNA, 16 nt, Mycobacterium bovis subsp bovis AF2122/97
cgagcagggcgucgac

SEQ ID NO: 1217160 - RNA, 17 nt, Mycobacterium bovis subsp bovis AF2122/97
cgagcaggggaguugcu

SEQ ID NO: 1217161 - RNA, 19 nt, Mycobacterium bovis subsp bovis AF2122/97
cgagcauaccgccgcugcc

SEQ ID NO: 1217162 - RNA, 17 nt, Mycobacterium bovis subsp bovis AF2122/97
cgagcaguuccagcucg

SEQ ID NO: 1217163 - RNA, 16 nt, Mycobacterium bovis subsp bovis AF2122/97
cgagcagugccgugcg

SEQ ID NO: 1217164 - RNA, 17 nt, Mycobacterium bovis subsp bovis AF2122/97
cgagcagugaccgcugg

SEQ ID NO: 1217165 - RNA, 15 nt, Mycobacterium bovis subsp bovis AF2122/97
cgagcaauuccucag

SEQ ID NO: 1217166 - RNA, 21 nt, Mycobacterium bovis subsp bovis AF2122/97
cgagcaacucguccagcagug

SEQ ID NO: 1217167 - RNA, 21 nt, Mycobacterium bovis subsp bovis AF2122/97
cgagcaacggacgaagcaccu

SEQ ID NO: 1217168 - RNA, 17 nt, Mycobacterium bovis subsp bovis AF2122/97
cgagcaacaccagggcc

SEQ ID NO: 1217169 - RNA, 19 nt, Mycobacterium bovis subsp bovis AF2122/97
cgagcaaacauccacccgc

SEQ ID NO: 1217170 - RNA, 20 nt, Mycobacterium bovis subsp bovis AF2122/97
cgagauuggguccagcgagg

SEQ ID NO: 1217171 - RNA, 13 nt, Mycobacterium bovis subsp bovis AF2122/97
cgagauuggugca

SEQ ID NO: 1217172 - RNA, 16 nt, Mycobacterium bovis subsp bovis AF2122/97
cgagauuggugcagac

SEQ ID NO: 1217173 - RNA, 16 nt, Mycobacterium bovis subsp bovis AF2122/97
cgagaucagcaugccc

SEQ ID NO: 1217174 - RNA, 15 nt, Mycobacterium bovis subsp bovis AF2122/97
cgagaucaccgccac

SEQ ID NO: 1217175 - RNA, 13 nt, Mycobacterium bovis subsp bovis AF2122/97
cgagaucaccgcc

SEQ ID NO: 1217176 - RNA, 17 nt, Mycobacterium bovis subsp bovis AF2122/97
cgagauauugcgcgccu

SEQ ID NO: 1217177 - RNA, 13 nt, Mycobacterium bovis subsp bovis AF2122/97
cgagauacggcca

SEQ ID NO: 1217178 - RNA, 19 nt, Mycobacterium bovis subsp bovis AF2122/97
cgagauacggccaccaggu

SEQ ID NO: 1217179 - RNA, 24 nt, Mycobacterium bovis subsp bovis AF2122/97
cgagaucccagcgggacaaaauca

SEQ ID NO: 1217180 - RNA, 12 nt, Mycobacterium bovis subsp bovis AF2122/97
cgagaugcugca

SEQ ID NO: 1217181 - RNA, 13 nt, Mycobacterium bovis subsp bovis AF2122/97
cgagaugccgcga

SEQ ID NO: 1217182 - RNA, 14 nt, Mycobacterium bovis subsp bovis AF2122/97
cgagagcagccagc

SEQ ID NO: 1217183 - RNA, 16 nt, Mycobacterium bovis subsp bovis AF2122/97
cgagagcagccagcca

SEQ ID NO: 1217184 - RNA, 19 nt, Mycobacterium bovis subsp bovis AF2122/97
cgagagcagccagccaccg

SEQ ID NO: 1217185 - RNA, 18 nt, Mycobacterium bovis subsp bovis AF2122/97
cgagacgcuuuccgccgc

SEQ ID NO: 1217186 - RNA, 18 nt, Mycobacterium bovis subsp bovis AF2122/97
cgagaauuccccagccgc

SEQ ID NO: 1217187 - RNA, 20 nt, Mycobacterium bovis subsp bovis AF2122/97
cgagaauuccccagccgcau

SEQ ID NO: 1217188 - RNA, 23 nt, Mycobacterium bovis subsp bovis AF2122/97
cgacuuugagucguuggacggca

SEQ ID NO: 1217189 - RNA, 22 nt, Mycobacterium bovis subsp bovis AF2122/97
cgagaacgcccgagugaccagg

SEQ ID NO: 1217190 - RNA, 12 nt, Mycobacterium bovis subsp bovis AF2122/97
cgagaacgucga

SEQ ID NO: 1217191 - RNA, 21 nt, Mycobacterium bovis subsp bovis AF2122/97
cgagaagaucucguagccgcc

SEQ ID NO: 1217192 - RNA, 17 nt, Mycobacterium bovis subsp bovis AF2122/97
cgagaaagugcaguucc

SEQ ID NO: 1217193 - RNA, 14 nt, Mycobacterium bovis subsp bovis AF2122/97
cgacuucgcccggg

SEQ ID NO: 1217194 - RNA, 16 nt, Mycobacterium bovis subsp bovis AF2122/97
cgacuucuucgcgcaa

SEQ ID NO: 1217195 - RNA, 20 nt, Mycobacterium bovis subsp bovis AF2122/97
cgacuugccuagcgcgggcu

SEQ ID NO: 1217196 - RNA, 19 nt, Mycobacterium bovis subsp bovis AF2122/97
cgacuguggcgccgccggc

SEQ ID NO: 1217197 - RNA, 22 nt, Mycobacterium bovis subsp bovis AF2122/97
cgacuguggcgccgccggcacc

SEQ ID NO: 1217198 - RNA, 21 nt, Mycobacterium bovis subsp bovis AF2122/97
cgacugcacauaguccgagcg

SEQ ID NO: 1217199 - RNA, 21 nt, Mycobacterium bovis subsp bovis AF2122/97
cgacugcagaaacagccgcag

SEQ ID NO: 1217200 - RNA, 22 nt, Mycobacterium bovis subsp bovis AF2122/97
cgacugcagaaacagccgcagc

SEQ ID NO: 1217201 - RNA, 23 nt, Mycobacterium bovis subsp bovis AF2122/97
cgacugcagaaacagccgcagcg

SEQ ID NO: 1217202 - RNA, 13 nt, Mycobacterium bovis subsp bovis AF2122/97
cgacuggccccgc

SEQ ID NO: 1217203 - RNA, 17 nt, Mycobacterium bovis subsp bovis AF2122/97
cgacuggccccgccagc

SEQ ID NO: 1217204 - RNA, 17 nt, Mycobacterium bovis subsp bovis AF2122/97
cgacugcgucggcggcu

SEQ ID NO: 1217205 - RNA, 16 nt, Mycobacterium bovis subsp bovis AF2122/97
cgacugcugucaccgc

SEQ ID NO: 1217206 - RNA, 13 nt, Mycobacterium bovis subsp bovis AF2122/97
cgacugccagcgc

SEQ ID NO: 1217207 - RNA, 19 nt, Mycobacterium bovis subsp bovis AF2122/97
cgacucgccacauuucacc

SEQ ID NO: 1217208 - RNA, 17 nt, Mycobacterium bovis subsp bovis AF2122/97
cgacuccccgccgggca

SEQ ID NO: 1217209 - RNA, 15 nt, Mycobacterium bovis subsp bovis AF2122/97
cgacucccccucuac

SEQ ID NO: 1217210 - RNA, 18 nt, Mycobacterium bovis subsp bovis AF2122/97
cgacucggccgugaccga

SEQ ID NO: 1217211 - RNA, 19 nt, Mycobacterium bovis subsp bovis AF2122/97
cgacucguggcgccacggc

SEQ ID NO: 1217212 - RNA, 18 nt, Mycobacterium bovis subsp bovis AF2122/97
cgacucgugucugccucg

SEQ ID NO: 1217213 - RNA, 16 nt, Mycobacterium bovis subsp bovis AF2122/97
cgacucacccacccgc

SEQ ID NO: 1217214 - RNA, 21 nt, Mycobacterium bovis subsp bovis AF2122/97
cgacuccagcaccagcacggc

SEQ ID NO: 1217215 - RNA, 17 nt, Mycobacterium bovis subsp bovis AF2122/97
cgacgucggugaccucg

SEQ ID NO: 1217216 - RNA, 15 nt, Mycobacterium bovis subsp bovis AF2122/97
cgacgucgccggacg

SEQ ID NO: 1217217 - RNA, 14 nt, Mycobacterium bovis subsp bovis AF2122/97
cgacgucggccgca

SEQ ID NO: 1217218 - RNA, 16 nt, Mycobacterium bovis subsp bovis AF2122/97
cgacgucuaggccaaa

SEQ ID NO: 1217219 - RNA, 20 nt, Mycobacterium bovis subsp bovis AF2122/97
cgacgucugccaggcgcagc

SEQ ID NO: 1217220 - RNA, 21 nt, Mycobacterium bovis subsp bovis AF2122/97
cgacgucuucgaccucaccca

SEQ ID NO: 1217221 - RNA, 17 nt, Mycobacterium bovis subsp bovis AF2122/97
cgacgucgccaagacca

SEQ ID NO: 1217222 - RNA, 14 nt, Mycobacterium bovis subsp bovis AF2122/97
cgacgucgccgacc

SEQ ID NO: 1217223 - RNA, 14 nt, Mycobacterium bovis subsp bovis AF2122/97
cgacgucgccgccg

SEQ ID NO: 1217224 - RNA, 15 nt, Mycobacterium bovis subsp bovis AF2122/97
cgacgucgccgccgc

SEQ ID NO: 1217225 - RNA, 21 nt, Mycobacterium bovis subsp bovis AF2122/97
cgaauaccgguggcagccugc

SEQ ID NO: 1217226 - RNA, 19 nt, Mycobacterium bovis subsp bovis AF2122/97
cgacgugcaggaacaccca

SEQ ID NO: 1217227 - RNA, 15 nt, Mycobacterium bovis subsp bovis AF2122/97
cgacgugcggcggcc

SEQ ID NO: 1217228 - RNA, 15 nt, Mycobacterium bovis subsp bovis AF2122/97
cgacguuccagcagu

SEQ ID NO: 1217229 - RNA, 16 nt, Mycobacterium bovis subsp bovis AF2122/97
cgacguugcguagcag

SEQ ID NO: 1217230 - RNA, 17 nt, Mycobacterium bovis subsp bovis AF2122/97
cgacguuggcgggagca

SEQ ID NO: 1217231 - RNA, 17 nt, Mycobacterium bovis subsp bovis AF2122/97
cgacuagacgccgccgc

SEQ ID NO: 1217232 - RNA, 19 nt, Mycobacterium bovis subsp bovis AF2122/97
cgacuagacgccgccgcug

SEQ ID NO: 1217233 - RNA, 22 nt, Mycobacterium bovis subsp bovis AF2122/97
cgaggccuaccaggcgcggccc

SEQ ID NO: 1217234 - RNA, 18 nt, Mycobacterium bovis subsp bovis AF2122/97
cgaggcgaguucgcgcac

SEQ ID NO: 1217235 - RNA, 17 nt, Mycobacterium bovis subsp bovis AF2122/97
cgaggccgcugccaggg

SEQ ID NO: 1217236 - RNA, 19 nt, Mycobacterium bovis subsp bovis AF2122/97
cgaggcgcccagcgacaac

SEQ ID NO: 1217237 - RNA, 18 nt, Mycobacterium bovis subsp bovis AF2122/97
cgaggcguucaccacgau

SEQ ID NO: 1217238 - RNA, 21 nt, Mycobacterium bovis subsp bovis AF2122/97
cgaggcgucaccccggucccg

SEQ ID NO: 1217239 - RNA, 17 nt, Mycobacterium bovis subsp bovis AF2122/97
cgaggcggguacaccac

SEQ ID NO: 1217240 - RNA, 12 nt, Mycobacterium bovis subsp bovis AF2122/97
cgaggcggcggu

SEQ ID NO: 1217241 - RNA, 20 nt, Mycobacterium bovis subsp bovis AF2122/97
cgagggccagcagccgcgac

SEQ ID NO: 1217242 - RNA, 15 nt, Mycobacterium bovis subsp bovis AF2122/97
cgagggccagcagcc

SEQ ID NO: 1217243 - RNA, 18 nt, Mycobacterium bovis subsp bovis AF2122/97
cgagggccagcagccgcg

SEQ ID NO: 1217244 - RNA, 23 nt, Mycobacterium bovis subsp bovis AF2122/97
cgagggcgcgagcagacgcagaa

SEQ ID NO: 1217245 - RNA, 12 nt, Mycobacterium bovis subsp bovis AF2122/97
cgagggcgcgcc

SEQ ID NO: 1217246 - RNA, 19 nt, Mycobacterium bovis subsp bovis AF2122/97
cgagggcugacgggauggu

SEQ ID NO: 1217247 - RNA, 15 nt, Mycobacterium bovis subsp bovis AF2122/97
cgagggcgggacccg

SEQ ID NO: 1217248 - RNA, 19 nt, Mycobacterium bovis subsp bovis AF2122/97
cgagggcggucagcggcca

SEQ ID NO: 1217249 - RNA, 14 nt, Mycobacterium bovis subsp bovis AF2122/97
cgaggcuggcaucc

SEQ ID NO: 1217250 - RNA, 22 nt, Mycobacterium bovis subsp bovis AF2122/97
cgaggcuggcaucccgggcagu

SEQ ID NO: 1217251 - RNA, 19 nt, Mycobacterium bovis subsp bovis AF2122/97
cgagggccacguagcagca

SEQ ID NO: 1217252 - RNA, 20 nt, Mycobacterium bovis subsp bovis AF2122/97
cgagggccacguagcagcag

SEQ ID NO: 1217253 - RNA, 14 nt, Mycobacterium bovis subsp bovis AF2122/97
cgagggccagcagc

SEQ ID NO: 1217254 - RNA, 20 nt, Mycobacterium bovis subsp bovis AF2122/97
cgaggaugcugagcgccagg

SEQ ID NO: 1217255 - RNA, 16 nt, Mycobacterium bovis subsp bovis AF2122/97
cgaggauccauuggaa

SEQ ID NO: 1217256 - RNA, 15 nt, Mycobacterium bovis subsp bovis AF2122/97
cgaggauucauggcg

SEQ ID NO: 1217257 - RNA, 15 nt, Mycobacterium bovis subsp bovis AF2122/97
cgaggaugugguugg

SEQ ID NO: 1217258 - RNA, 15 nt, Mycobacterium bovis subsp bovis AF2122/97
cgaggauguugugcc

SEQ ID NO: 1217259 - RNA, 24 nt, Mycobacterium bovis subsp bovis AF2122/97
cgaggauguugugccgaucggcca

SEQ ID NO: 1217260 - RNA, 22 nt, Mycobacterium bovis subsp bovis AF2122/97
cgaggcacaaucaccgccgcga

SEQ ID NO: 1217261 - RNA, 17 nt, Mycobacterium bovis subsp bovis AF2122/97
cgaggcagcacccgcac

SEQ ID NO: 1217262 - RNA, 23 nt, Mycobacterium bovis subsp bovis AF2122/97
cgaggccaaguugcagcgggcca

SEQ ID NO: 1217263 - RNA, 15 nt, Mycobacterium bovis subsp bovis AF2122/97
cgaggccacgccagc

SEQ ID NO: 1217264 - RNA, 17 nt, Mycobacterium bovis subsp bovis AF2122/97
cgaggcauucucccggu

SEQ ID NO: 1217265 - RNA, 20 nt, Mycobacterium bovis subsp bovis AF2122/97
cgaggccacgccagcucgcc

SEQ ID NO: 1217266 - RNA, 16 nt, Mycobacterium bovis subsp bovis AF2122/97
cgaggaacucggaccc

SEQ ID NO: 1217267 - RNA, 20 nt, Mycobacterium bovis subsp bovis AF2122/97
cgaggaacucggacccaccc

SEQ ID NO: 1217268 - RNA, 24 nt, Mycobacterium bovis subsp bovis AF2122/97
cgaggaacuggaccggugccagca

SEQ ID NO: 1217269 - RNA, 17 nt, Mycobacterium bovis subsp bovis AF2122/97
cgaggacuggaaagcag

SEQ ID NO: 1217270 - RNA, 12 nt, Mycobacterium bovis subsp bovis AF2122/97
cgaggagcccgg

SEQ ID NO: 1217271 - RNA, 17 nt, Mycobacterium bovis subsp bovis AF2122/97
cgaggaccagaggcgcu

SEQ ID NO: 1217272 - RNA, 14 nt, Mycobacterium bovis subsp bovis AF2122/97
cgaggacgccggcg

SEQ ID NO: 1217273 - RNA, 19 nt, Mycobacterium bovis subsp bovis AF2122/97
cgaggaccugcucgggcgu

SEQ ID NO: 1217274 - RNA, 16 nt, Mycobacterium bovis subsp bovis AF2122/97
cgagcucgaagcccgg

SEQ ID NO: 1217275 - RNA, 18 nt, Mycobacterium bovis subsp bovis AF2122/97
cgagcucgaagcccggac

SEQ ID NO: 1217276 - RNA, 14 nt, Mycobacterium bovis subsp bovis AF2122/97
cgagcuccgaugcc

SEQ ID NO: 1217277 - RNA, 21 nt, Mycobacterium bovis subsp bovis AF2122/97
cgagcucaggucgacaggugc

SEQ ID NO: 1217278 - RNA, 20 nt, Mycobacterium bovis subsp bovis AF2122/97
cgagcucaccgcacaccugc

SEQ ID NO: 1217279 - RNA, 13 nt, Mycobacterium bovis subsp bovis AF2122/97
cgagcucacuuca

SEQ ID NO: 1217280 - RNA, 15 nt, Mycobacterium bovis subsp bovis AF2122/97
cgagcuccuccacca

SEQ ID NO: 1217281 - RNA, 15 nt, Mycobacterium bovis subsp bovis AF2122/97
cgagcucggccccgc

SEQ ID NO: 1217282 - RNA, 16 nt, Mycobacterium bovis subsp bovis AF2122/97
cgagcucggccccgcc

SEQ ID NO: 1217283 - RNA, 18 nt, Mycobacterium bovis subsp bovis AF2122/97
cgagcucggccccgccgc

SEQ ID NO: 1217284 - RNA, 15 nt, Mycobacterium bovis subsp bovis AF2122/97
cgagcuaacacccga

SEQ ID NO: 1217285 - RNA, 23 nt, Mycobacterium bovis subsp bovis AF2122/97
cgagcucaacgacggcugaccuu

SEQ ID NO: 1217286 - RNA, 17 nt, Mycobacterium bovis subsp bovis AF2122/97
cgagcucaccaaggucg

SEQ ID NO: 1217287 - RNA, 19 nt, Mycobacterium bovis subsp bovis AF2122/97
cgagcuugucgagcaggcc

SEQ ID NO: 1217288 - RNA, 14 nt, Mycobacterium bovis subsp bovis AF2122/97
cgagcuucagcgcg

SEQ ID NO: 1217289 - RNA, 15 nt, Mycobacterium bovis subsp bovis AF2122/97
cgagcuugccgucgc

SEQ ID NO: 1217290 - RNA, 15 nt, Mycobacterium bovis subsp bovis AF2122/97
cgagcuuggcuuggc

SEQ ID NO: 1217291 - RNA, 20 nt, Mycobacterium bovis subsp bovis AF2122/97
cgagcugguaaacgggugga

SEQ ID NO: 1217292 - RNA, 17 nt, Mycobacterium bovis subsp bovis AF2122/97
cgagcugagcggccagc

SEQ ID NO: 1217293 - RNA, 21 nt, Mycobacterium bovis subsp bovis AF2122/97
cgagcugagcggccagcaucg

SEQ ID NO: 1217294 - RNA, 12 nt, Mycobacterium bovis subsp bovis AF2122/97
cgagcugccagg

SEQ ID NO: 1217295 - RNA, 22 nt, Mycobacterium bovis subsp bovis AF2122/97
cgagcugcgacgaugccgccug

SEQ ID NO: 1217296 - RNA, 13 nt, Mycobacterium bovis subsp bovis AF2122/97
cgagcugcggguc

SEQ ID NO: 1217297 - RNA, 18 nt, Mycobacterium bovis subsp bovis AF2122/97
cgagcgcuaucaccgccu

SEQ ID NO: 1217298 - RNA, 18 nt, Mycobacterium bovis subsp bovis AF2122/97
cgagcgcggugccgccac

SEQ ID NO: 1217299 - RNA, 21 nt, Mycobacterium bovis subsp bovis AF2122/97
cgagcgcggugccgccaccgg

SEQ ID NO: 1217300 - RNA, 23 nt, Mycobacterium bovis subsp bovis AF2122/97
cgagcggcaucggucaccgcggc

SEQ ID NO: 1217301 - RNA, 20 nt, Mycobacterium bovis subsp bovis AF2122/97
cgagcggaccaccgcucgcc

SEQ ID NO: 1217302 - RNA, 16 nt, Mycobacterium bovis subsp bovis AF2122/97
cgagcgcuguggccca

SEQ ID NO: 1217303 - RNA, 22 nt, Mycobacterium bovis subsp bovis AF2122/97
cgagcgcgucggucaccgaacg

SEQ ID NO: 1217304 - RNA, 17 nt, Mycobacterium bovis subsp bovis AF2122/97
cgagcgcuugaccccgc

SEQ ID NO: 1217305 - RNA, 22 nt, Mycobacterium bovis subsp bovis AF2122/97
cgagcguaaugcugcugcagca

SEQ ID NO: 1217306 - RNA, 15 nt, Mycobacterium bovis subsp bovis AF2122/97
cgagcggugccggcg

SEQ ID NO: 1217307 - RNA, 17 nt, Mycobacterium bovis subsp bovis AF2122/97
cgagcgggaucgggccc

SEQ ID NO: 1217308 - RNA, 15 nt, Mycobacterium bovis subsp bovis AF2122/97
cgagcggccgcgcgc

SEQ ID NO: 1217309 - RNA, 16 nt, Mycobacterium bovis subsp bovis AF2122/97
cgagcggccuccagca

SEQ ID NO: 1217310 - RNA, 19 nt, Mycobacterium bovis subsp bovis AF2122/97
cgagcggccuccagcaccc

SEQ ID NO: 1217311 - RNA, 14 nt, Mycobacterium bovis subsp bovis AF2122/97
cgagcgcgccuuca

SEQ ID NO: 1217312 - RNA, 16 nt, Mycobacterium bovis subsp bovis AF2122/97
cgagcgcgccaaucgc

SEQ ID NO: 1217313 - RNA, 17 nt, Mycobacterium bovis subsp bovis AF2122/97
cgagcgcgaucgggccg

SEQ ID NO: 1217314 - RNA, 11 nt, Mycobacterium bovis subsp bovis AF2122/97
cgagcgcgcca

SEQ ID NO: 1217315 - RNA, 11 nt, Mycobacterium bovis subsp bovis AF2122/97
cgagcgccggc

SEQ ID NO: 1217316 - RNA, 13 nt, Mycobacterium bovis subsp bovis AF2122/97
cgagcgccggccg

SEQ ID NO: 1217317 - RNA, 14 nt, Mycobacterium bovis subsp bovis AF2122/97
aaacgcugcuggca

SEQ ID NO: 1217318 - RNA, 15 nt, Mycobacterium bovis subsp bovis AF2122/97
cgagguggcgggcga

SEQ ID NO: 1217319 - RNA, 17 nt, Mycobacterium bovis subsp bovis AF2122/97
cgagguggggugguggu

SEQ ID NO: 1217320 - RNA, 14 nt, Mycobacterium bovis subsp bovis AF2122/97
cgagguggucgacc

SEQ ID NO: 1217321 - RNA, 21 nt, Mycobacterium bovis subsp bovis AF2122/97
cgaggugauguuggccgccac

SEQ ID NO: 1217322 - RNA, 19 nt, Mycobacterium bovis subsp bovis AF2122/97
cgaggugagguugaccccc

SEQ ID NO: 1217323 - RNA, 23 nt, Mycobacterium bovis subsp bovis AF2122/97
cgaggucguuucccuggccgccg

SEQ ID NO: 1217324 - RNA, 20 nt, Mycobacterium bovis subsp bovis AF2122/97
cgagguuguaggcgaaccgc

SEQ ID NO: 1217325 - RNA, 19 nt, Mycobacterium bovis subsp bovis AF2122/97
cgagguugacgucaggcug

SEQ ID NO: 1217326 - RNA, 20 nt, Mycobacterium bovis subsp bovis AF2122/97
cgagguugacgucaggcuga

SEQ ID NO: 1217327 - RNA, 15 nt, Mycobacterium bovis subsp bovis AF2122/97
cgagguugccgcacc

SEQ ID NO: 1217328 - RNA, 13 nt, Mycobacterium bovis subsp bovis AF2122/97
cgagguugcgccg

SEQ ID NO: 1217329 - RNA, 15 nt, Mycobacterium bovis subsp bovis AF2122/97
cgaggucagcucccg

SEQ ID NO: 1217330 - RNA, 15 nt, Mycobacterium bovis subsp bovis AF2122/97
cgaggucgccaaccc

SEQ ID NO: 1217331 - RNA, 22 nt, Mycobacterium bovis subsp bovis AF2122/97
cgagguccucgagguccucguc

SEQ ID NO: 1217332 - RNA, 14 nt, Mycobacterium bovis subsp bovis AF2122/97
cgaggucgccaacc

SEQ ID NO: 1217333 - RNA, 22 nt, Mycobacterium bovis subsp bovis AF2122/97
cgagguauaaacgcggcgcgcu

SEQ ID NO: 1217334 - RNA, 23 nt, Mycobacterium bovis subsp bovis AF2122/97
cgagguauaaacgcggcgcgcug

SEQ ID NO: 1217335 - RNA, 17 nt, Mycobacterium bovis subsp bovis AF2122/97
cgagggcuuuagugucu

SEQ ID NO: 1217336 - RNA, 19 nt, Mycobacterium bovis subsp bovis AF2122/97
cgagggggguguugaggcc

SEQ ID NO: 1217337 - RNA, 20 nt, Mycobacterium bovis subsp bovis AF2122/97
cgagggggguguugaggccg

SEQ ID NO: 1217338 - RNA, 23 nt, Mycobacterium bovis subsp bovis AF2122/97
cgaggguaucgucauugcgaaaa

SEQ ID NO: 1217339 - RNA, 20 nt, Mycobacterium bovis subsp bovis AF2122/97
cgagggugaaguggcgcagc

SEQ ID NO: 1217340 - RNA, 21 nt, Mycobacterium bovis subsp bovis AF2122/97
cgagggugaaguggcgcagca

SEQ ID NO: 1217341 - RNA, 13 nt, Mycobacterium bovis subsp bovis AF2122/97
cgaggggcggcaa

SEQ ID NO: 1217342 - RNA, 17 nt, Mycobacterium bovis subsp bovis AF2122/97
cgaggguaccaggcgcc

SEQ ID NO: 1217343 - RNA, 15 nt, Mycobacterium bovis subsp bovis AF2122/97
cgagucgccagaccg

SEQ ID NO: 1217344 - RNA, 16 nt, Mycobacterium bovis subsp bovis AF2122/97
cgagucgggggccgcg

SEQ ID NO: 1217345 - RNA, 17 nt, Mycobacterium bovis subsp bovis AF2122/97
cgagucuaaggaugacc

SEQ ID NO: 1217346 - RNA, 21 nt, Mycobacterium bovis subsp bovis AF2122/97
cgagugcggacuucgccgccc

SEQ ID NO: 1217347 - RNA, 16 nt, Mycobacterium bovis subsp bovis AF2122/97
cgagugggugaggcca

SEQ ID NO: 1217348 - RNA, 16 nt, Mycobacterium bovis subsp bovis AF2122/97
cgagugccgccaccgc

SEQ ID NO: 1217349 - RNA, 13 nt, Mycobacterium bovis subsp bovis AF2122/97
cgagugucagcag

SEQ ID NO: 1217350 - RNA, 14 nt, Mycobacterium bovis subsp bovis AF2122/97
cgagugucagcaga

SEQ ID NO: 1217351 - RNA, 21 nt, Mycobacterium bovis subsp bovis AF2122/97
cgagugggugaggccaaccac

SEQ ID NO: 1217352 - RNA, 17 nt, Mycobacterium bovis subsp bovis AF2122/97
cgagugguccagccaga

SEQ ID NO: 1217353 - RNA, 19 nt, Mycobacterium bovis subsp bovis AF2122/97
cgaguaccgauagccugcg

SEQ ID NO: 1217354 - RNA, 16 nt, Mycobacterium bovis subsp bovis AF2122/97
cgaguaccggccagcc

SEQ ID NO: 1217355 - RNA, 16 nt, Mycobacterium bovis subsp bovis AF2122/97
cgaguagugcaggugc

SEQ ID NO: 1217356 - RNA, 18 nt, Mycobacterium bovis subsp bovis AF2122/97
cgaguccccuuagcucca

SEQ ID NO: 1217357 - RNA, 16 nt, Mycobacterium bovis subsp bovis AF2122/97
cgagucgaacccgcga

SEQ ID NO: 1217358 - RNA, 16 nt, Mycobacterium bovis subsp bovis AF2122/97
cgaguccaggcagcuu

SEQ ID NO: 1217359 - RNA, 14 nt, Mycobacterium bovis subsp bovis AF2122/97
cgaguccaccaccu

SEQ ID NO: 1217360 - RNA, 13 nt, Mycobacterium bovis subsp bovis AF2122/97
cgauagcggcggc

SEQ ID NO: 1217361 - RNA, 17 nt, Mycobacterium bovis subsp bovis AF2122/97
cgauagcggauucacgc

SEQ ID NO: 1217362 - RNA, 21 nt, Mycobacterium bovis subsp bovis AF2122/97
cgauagcggcccgaucaccag

SEQ ID NO: 1217363 - RNA, 22 nt, Mycobacterium bovis subsp bovis AF2122/97
cgauagcgcggcaccagcaccg

SEQ ID NO: 1217364 - RNA, 12 nt, Mycobacterium bovis subsp bovis AF2122/97
cgauagcccgcc

SEQ ID NO: 1217365 - RNA, 21 nt, Mycobacterium bovis subsp bovis AF2122/97
cgauaaugaucucggcaagga

SEQ ID NO: 1217366 - RNA, 16 nt, Mycobacterium bovis subsp bovis AF2122/97
cgauaaccucagcgcg

SEQ ID NO: 1217367 - RNA, 15 nt, Mycobacterium bovis subsp bovis AF2122/97
cgauaaaaaccaccc

SEQ ID NO: 1217368 - RNA, 14 nt, Mycobacterium bovis subsp bovis AF2122/97
cgaguugcucgaca

SEQ ID NO: 1217369 - RNA, 12 nt, Mycobacterium bovis subsp bovis AF2122/97
cgaguuggccau

SEQ ID NO: 1217370 - RNA, 23 nt, Mycobacterium bovis subsp bovis AF2122/97
cgaguugaagaagccgguguuga

SEQ ID NO: 1217371 - RNA, 17 nt, Mycobacterium bovis subsp bovis AF2122/97
cgaguuaggccgccagc

SEQ ID NO: 1217372 - RNA, 22 nt, Mycobacterium bovis subsp bovis AF2122/97
cgaguuaggccgccagccggcg

SEQ ID NO: 1217373 - RNA, 12 nt, Mycobacterium bovis subsp bovis AF2122/97
cgauaacacccg

SEQ ID NO: 1217374 - RNA, 21 nt, Mycobacterium bovis subsp bovis AF2122/97
ccaggcgguacgggucgccgg

SEQ ID NO: 1217375 - RNA, 21 nt, Mycobacterium bovis subsp bovis AF2122/97
ccaggcguuggaucccagccc

SEQ ID NO: 1217376 - RNA, 15 nt, Mycobacterium bovis subsp bovis AF2122/97
ccaggcgcgccgcac

SEQ ID NO: 1217377 - RNA, 12 nt, Mycobacterium bovis subsp bovis AF2122/97
ccaggcgcgccg

SEQ ID NO: 1217378 - RNA, 21 nt, Mycobacterium bovis subsp bovis AF2122/97
ccaggcgcgcuaccagcucac

SEQ ID NO: 1217379 - RNA, 22 nt, Mycobacterium bovis subsp bovis AF2122/97
ccaggcggcaaggacggagccc

SEQ ID NO: 1217380 - RNA, 18 nt, Mycobacterium bovis subsp bovis AF2122/97
ccaggcgcgcaccaccgc

SEQ ID NO: 1217381 - RNA, 23 nt, Mycobacterium bovis subsp bovis AF2122/97
ccaggcgcauagggccaccgccg

SEQ ID NO: 1217382 - RNA, 14 nt, Mycobacterium bovis subsp bovis AF2122/97
ccaggcgagccgcc

SEQ ID NO: 1217383 - RNA, 19 nt, Mycobacterium bovis subsp bovis AF2122/97
ccaggcgagccgccaccgu

SEQ ID NO: 1217384 - RNA, 15 nt, Mycobacterium bovis subsp bovis AF2122/97
ccaggcgagccggcg

SEQ ID NO: 1217385 - RNA, 21 nt, Mycobacterium bovis subsp bovis AF2122/97
ccaggcgagugaacucguccu

SEQ ID NO: 1217386 - RNA, 18 nt, Mycobacterium bovis subsp bovis AF2122/97
ccaggcgauaaagccgcu

SEQ ID NO: 1217387 - RNA, 21 nt, Mycobacterium bovis subsp bovis AF2122/97
ccaggcgaucgcccggccccg

SEQ ID NO: 1217388 - RNA, 22 nt, Mycobacterium bovis subsp bovis AF2122/97
ccaggccguugcuauucgccag

SEQ ID NO: 1217389 - RNA, 15 nt, Mycobacterium bovis subsp bovis AF2122/97
ccaggccucgcaccg

SEQ ID NO: 1217390 - RNA, 19 nt, Mycobacterium bovis subsp bovis AF2122/97
ccaggcccaagccguggcc

SEQ ID NO: 1217391 - RNA, 18 nt, Mycobacterium bovis subsp bovis AF2122/97
ccaggcccauacgugccg

SEQ ID NO: 1217392 - RNA, 19 nt, Mycobacterium bovis subsp bovis AF2122/97
ccaggcccaucucgggcag

SEQ ID NO: 1217393 - RNA, 20 nt, Mycobacterium bovis subsp bovis AF2122/97
ccaggcccccucggcgugau

SEQ ID NO: 1217394 - RNA, 23 nt, Mycobacterium bovis subsp bovis AF2122/97
ccaggcccccucggcgugaucac

SEQ ID NO: 1217395 - RNA, 20 nt, Mycobacterium bovis subsp bovis AF2122/97
ccaggcccgacacggcggcu

SEQ ID NO: 1217396 - RNA, 14 nt, Mycobacterium bovis subsp bovis AF2122/97
ccaggcccggcggu

SEQ ID NO: 1217397 - RNA, 15 nt, Mycobacterium bovis subsp bovis AF2122/97
ccaggcccuggccag

SEQ ID NO: 1217398 - RNA, 16 nt, Mycobacterium bovis subsp bovis AF2122/97
ccaggcccuggccagc

SEQ ID NO: 1217399 - RNA, 23 nt, Mycobacterium bovis subsp bovis AF2122/97
ccaggcccuggccagcccgagcu

SEQ ID NO: 1217400 - RNA, 19 nt, Mycobacterium bovis subsp bovis AF2122/97
ccaggccgagcccggugcu

SEQ ID NO: 1217401 - RNA, 13 nt, Mycobacterium bovis subsp bovis AF2122/97
ccaggccgagccg

SEQ ID NO: 1217402 - RNA, 21 nt, Mycobacterium bovis subsp bovis AF2122/97
ccaggccgagcucguugcugg

SEQ ID NO: 1217403 - RNA, 16 nt, Mycobacterium bovis subsp bovis AF2122/97
ccaggccgagccgccc

SEQ ID NO: 1217404 - RNA, 16 nt, Mycobacterium bovis subsp bovis AF2122/97
ccaggccgagcucguu

SEQ ID NO: 1217405 - RNA, 17 nt, Mycobacterium bovis subsp bovis AF2122/97
ccaggccgagcucguug

SEQ ID NO: 1217406 - RNA, 15 nt, Mycobacterium bovis subsp bovis AF2122/97
ccaggccgcacagca

SEQ ID NO: 1217407 - RNA, 13 nt, Mycobacterium bovis subsp bovis AF2122/97
ccaggccgccgcc

SEQ ID NO: 1217408 - RNA, 20 nt, Mycobacterium bovis subsp bovis AF2122/97
ccaggccgcgacaauggugc

SEQ ID NO: 1217409 - RNA, 21 nt, Mycobacterium bovis subsp bovis AF2122/97
ccaggccgcgacaauggugcc

SEQ ID NO: 1217410 - RNA, 15 nt, Mycobacterium bovis subsp bovis AF2122/97
ccaggccgcuugccc

SEQ ID NO: 1217411 - RNA, 13 nt, Mycobacterium bovis subsp bovis AF2122/97
ccaggccggcccg

SEQ ID NO: 1217412 - RNA, 18 nt, Mycobacterium bovis subsp bovis AF2122/97
ccaggccggcacccacca

SEQ ID NO: 1217413 - RNA, 14 nt, Mycobacterium bovis subsp bovis AF2122/97
ccaggccggcggcg

SEQ ID NO: 1217414 - RNA, 19 nt, Mycobacterium bovis subsp bovis AF2122/97
ccaggccggcggcggcgcu

SEQ ID NO: 1217415 - RNA, 17 nt, Mycobacterium bovis subsp bovis AF2122/97
ccaggccguagcccacg

SEQ ID NO: 1217416 - RNA, 22 nt, Mycobacterium bovis subsp bovis AF2122/97
ccagggagugccgcacgauggc

SEQ ID NO: 1217417 - RNA, 20 nt, Mycobacterium bovis subsp bovis AF2122/97
ccagggcaucagcagagccc

SEQ ID NO: 1217418 - RNA, 17 nt, Mycobacterium bovis subsp bovis AF2122/97
ccaggcugguccgggug

SEQ ID NO: 1217419 - RNA, 14 nt, Mycobacterium bovis subsp bovis AF2122/97
ccaggcugguccgg

SEQ ID NO: 1217420 - RNA, 23 nt, Mycobacterium bovis subsp bovis AF2122/97
ccaggcuguggccagcaucauca

SEQ ID NO: 1217421 - RNA, 20 nt, Mycobacterium bovis subsp bovis AF2122/97
ccaggcuaauagcucgccgg

SEQ ID NO: 1217422 - RNA, 21 nt, Mycobacterium bovis subsp bovis AF2122/97
ccaggcuaauagcucgccggc

SEQ ID NO: 1217423 - RNA, 22 nt, Mycobacterium bovis subsp bovis AF2122/97
ccaggcuaauagcucgccggcg

SEQ ID NO: 1217424 - RNA, 15 nt, Mycobacterium bovis subsp bovis AF2122/97
ccagggccaccgcgc

SEQ ID NO: 1217425 - RNA, 14 nt, Mycobacterium bovis subsp bovis AF2122/97
ccagggccaucugg

SEQ ID NO: 1217426 - RNA, 16 nt, Mycobacterium bovis subsp bovis AF2122/97
ccagggccgagcagcu

SEQ ID NO: 1217427 - RNA, 19 nt, Mycobacterium bovis subsp bovis AF2122/97
ccagggccuccacccgcca

SEQ ID NO: 1217428 - RNA, 21 nt, Mycobacterium bovis subsp bovis AF2122/97
ccagggccucgaccgccagcc

SEQ ID NO: 1217429 - RNA, 22 nt, Mycobacterium bovis subsp bovis AF2122/97
ccagggccucgaccgccagccg

SEQ ID NO: 1217430 - RNA, 16 nt, Mycobacterium bovis subsp bovis AF2122/97
ccagggccgccgcugc

SEQ ID NO: 1217431 - RNA, 11 nt, Mycobacterium bovis subsp bovis AF2122/97
ccagggccgcc

SEQ ID NO: 1217432 - RNA, 13 nt, Mycobacterium bovis subsp bovis AF2122/97
ccagggccgccgc

SEQ ID NO: 1217433 - RNA, 14 nt, Mycobacterium bovis subsp bovis AF2122/97
ccagggcggcaucc

SEQ ID NO: 1217434 - RNA, 18 nt, Mycobacterium bovis subsp bovis AF2122/97
ccagggcgguggccaccc

SEQ ID NO: 1217435 - RNA, 22 nt, Mycobacterium bovis subsp bovis AF2122/97
ccagggcgccgaauuggcccgg

SEQ ID NO: 1217436 - RNA, 16 nt, Mycobacterium bovis subsp bovis AF2122/97
ccagggccuuccugag

SEQ ID NO: 1217437 - RNA, 14 nt, Mycobacterium bovis subsp bovis AF2122/97
ccaggucaugccgu

SEQ ID NO: 1217438 - RNA, 18 nt, Mycobacterium bovis subsp bovis AF2122/97
ccagguccaccccgccga

SEQ ID NO: 1217439 - RNA, 15 nt, Mycobacterium bovis subsp bovis AF2122/97
ccagguccgccggug

SEQ ID NO: 1217440 - RNA, 17 nt, Mycobacterium bovis subsp bovis AF2122/97
ccagggggcgugccgcc

SEQ ID NO: 1217441 - RNA, 19 nt, Mycobacterium bovis subsp bovis AF2122/97
ccagggcucggcggcccgg

SEQ ID NO: 1217442 - RNA, 15 nt, Mycobacterium bovis subsp bovis AF2122/97
ccaggggaccgcggc

SEQ ID NO: 1217443 - RNA, 17 nt, Mycobacterium bovis subsp bovis AF2122/97
ccaggggaccgcggcgc

SEQ ID NO: 1217444 - RNA, 17 nt, Mycobacterium bovis subsp bovis AF2122/97
ccaggggagcugaccac

SEQ ID NO: 1217445 - RNA, 14 nt, Mycobacterium bovis subsp bovis AF2122/97
ccaggggauugccc

SEQ ID NO: 1217446 - RNA, 15 nt, Mycobacterium bovis subsp bovis AF2122/97
ccaggggcaccagcg

SEQ ID NO: 1217447 - RNA, 17 nt, Mycobacterium bovis subsp bovis AF2122/97
ccagcucgcgggccgcg

SEQ ID NO: 1217448 - RNA, 18 nt, Mycobacterium bovis subsp bovis AF2122/97
ccagcucggcacccgccg

SEQ ID NO: 1217449 - RNA, 16 nt, Mycobacterium bovis subsp bovis AF2122/97
ccagcucggccagcug

SEQ ID NO: 1217450 - RNA, 19 nt, Mycobacterium bovis subsp bovis AF2122/97
ccagcucgcgggccgcguc

SEQ ID NO: 1217451 - RNA, 18 nt, Mycobacterium bovis subsp bovis AF2122/97
ccagcucgucgucggcgu

SEQ ID NO: 1217452 - RNA, 18 nt, Mycobacterium bovis subsp bovis AF2122/97
ccagcugagcggccggca

SEQ ID NO: 1217453 - RNA, 17 nt, Mycobacterium bovis subsp bovis AF2122/97
ccagcucggcggcagcg

SEQ ID NO: 1217454 - RNA, 18 nt, Mycobacterium bovis subsp bovis AF2122/97
ccagcuguacaacgccgu

SEQ ID NO: 1217455 - RNA, 14 nt, Mycobacterium bovis subsp bovis AF2122/97
ccagcugggcagcc

SEQ ID NO: 1217456 - RNA, 18 nt, Mycobacterium bovis subsp bovis AF2122/97
ccagcugucauccccggc

SEQ ID NO: 1217457 - RNA, 19 nt, Mycobacterium bovis subsp bovis AF2122/97
ccagcugucauccccggcc

SEQ ID NO: 1217458 - RNA, 16 nt, Mycobacterium bovis subsp bovis AF2122/97
ccagcugucgggcagc

SEQ ID NO: 1217459 - RNA, 13 nt, Mycobacterium bovis subsp bovis AF2122/97
ccagcugcucguc

SEQ ID NO: 1217460 - RNA, 17 nt, Mycobacterium bovis subsp bovis AF2122/97
ccagcugcgcgggcgag

SEQ ID NO: 1217461 - RNA, 12 nt, Mycobacterium bovis subsp bovis AF2122/97
ccaggaaguccc

SEQ ID NO: 1217462 - RNA, 13 nt, Mycobacterium bovis subsp bovis AF2122/97
ccaggaagucccg

SEQ ID NO: 1217463 - RNA, 21 nt, Mycobacterium bovis subsp bovis AF2122/97
ccaggaaucccucggccgcag

SEQ ID NO: 1217464 - RNA, 16 nt, Mycobacterium bovis subsp bovis AF2122/97
ccaggaacgggacgcc

SEQ ID NO: 1217465 - RNA, 22 nt, Mycobacterium bovis subsp bovis AF2122/97
ccaggaagcacaugcucggccu

SEQ ID NO: 1217466 - RNA, 12 nt, Mycobacterium bovis subsp bovis AF2122/97
ccaggaacccgu

SEQ ID NO: 1217467 - RNA, 22 nt, Mycobacterium bovis subsp bovis AF2122/97
ccagcuugucguagcgacgcca

SEQ ID NO: 1217468 - RNA, 16 nt, Mycobacterium bovis subsp bovis AF2122/97
ccagcuuggcaaccug

SEQ ID NO: 1217469 - RNA, 17 nt, Mycobacterium bovis subsp bovis AF2122/97
ccagcuuggcgagcagg

SEQ ID NO: 1217470 - RNA, 21 nt, Mycobacterium bovis subsp bovis AF2122/97
ccagcuucucagcaccaugcu

SEQ ID NO: 1217471 - RNA, 22 nt, Mycobacterium bovis subsp bovis AF2122/97
ccaggaugaauuuggugaagug

SEQ ID NO: 1217472 - RNA, 15 nt, Mycobacterium bovis subsp bovis AF2122/97
ccaggaucgccgcuu

SEQ ID NO: 1217473 - RNA, 20 nt, Mycobacterium bovis subsp bovis AF2122/97
ccaggagugcgggcaugccg

SEQ ID NO: 1217474 - RNA, 19 nt, Mycobacterium bovis subsp bovis AF2122/97
ccaggaguuugaccaccug

SEQ ID NO: 1217475 - RNA, 14 nt, Mycobacterium bovis subsp bovis AF2122/97
ccaggacagcagcc

SEQ ID NO: 1217476 - RNA, 13 nt, Mycobacterium bovis subsp bovis AF2122/97
ccaggaccaccgc

SEQ ID NO: 1217477 - RNA, 12 nt, Mycobacterium bovis subsp bovis AF2122/97
ccaggacaccuu

SEQ ID NO: 1217478 - RNA, 17 nt, Mycobacterium bovis subsp bovis AF2122/97
ccaggacgaguccuagc

SEQ ID NO: 1217479 - RNA, 18 nt, Mycobacterium bovis subsp bovis AF2122/97
ccaggagcaccucgaagu

SEQ ID NO: 1217480 - RNA, 20 nt, Mycobacterium bovis subsp bovis AF2122/97
ccaggacuggcaccgccagc

SEQ ID NO: 1217481 - RNA, 21 nt, Mycobacterium bovis subsp bovis AF2122/97
ccaggacuggcaccgccagcc

SEQ ID NO: 1217482 - RNA, 19 nt, Mycobacterium bovis subsp bovis AF2122/97
ccaggacuggcaccgccag

SEQ ID NO: 1217483 - RNA, 20 nt, Mycobacterium bovis subsp bovis AF2122/97
ccaggcauuggugaguagau

SEQ ID NO: 1217484 - RNA, 14 nt, Mycobacterium bovis subsp bovis AF2122/97
ccaggcauggccug

SEQ ID NO: 1217485 - RNA, 19 nt, Mycobacterium bovis subsp bovis AF2122/97
ccaggccaagguggccacc

SEQ ID NO: 1217486 - RNA, 15 nt, Mycobacterium bovis subsp bovis AF2122/97
ccaggccaccggcug

SEQ ID NO: 1217487 - RNA, 20 nt, Mycobacterium bovis subsp bovis AF2122/97
ccaggccaccggcugcaacc

SEQ ID NO: 1217488 - RNA, 17 nt, Mycobacterium bovis subsp bovis AF2122/97
ccaggccagugccaccu

SEQ ID NO: 1217489 - RNA, 14 nt, Mycobacterium bovis subsp bovis AF2122/97
ccaggcacuccagc

SEQ ID NO: 1217490 - RNA, 16 nt, Mycobacterium bovis subsp bovis AF2122/97
ccaggcacuccagcgg

SEQ ID NO: 1217491 - RNA, 17 nt, Mycobacterium bovis subsp bovis AF2122/97
ccaggcacuccagcggc

SEQ ID NO: 1217492 - RNA, 20 nt, Mycobacterium bovis subsp bovis AF2122/97
ccaggcacuccagcggcggg

SEQ ID NO: 1217493 - RNA, 18 nt, Mycobacterium bovis subsp bovis AF2122/97
ccaggcaaccggucagcc

SEQ ID NO: 1217494 - RNA, 16 nt, Mycobacterium bovis subsp bovis AF2122/97
ccagcgccggucaggg

SEQ ID NO: 1217495 - RNA, 12 nt, Mycobacterium bovis subsp bovis AF2122/97
ccagcgccuuga

SEQ ID NO: 1217496 - RNA, 17 nt, Mycobacterium bovis subsp bovis AF2122/97
ccagcgccucggcaucg

SEQ ID NO: 1217497 - RNA, 18 nt, Mycobacterium bovis subsp bovis AF2122/97
ccagcgccugcgcccagc

SEQ ID NO: 1217498 - RNA, 14 nt, Mycobacterium bovis subsp bovis AF2122/97
ccagcgcccggcca

SEQ ID NO: 1217499 - RNA, 16 nt, Mycobacterium bovis subsp bovis AF2122/97
ccagcgccgaccuccu

SEQ ID NO: 1217500 - RNA, 18 nt, Mycobacterium bovis subsp bovis AF2122/97
ccagcgccgcacccgcuc

SEQ ID NO: 1217501 - RNA, 15 nt, Mycobacterium bovis subsp bovis AF2122/97
ccagcgccagugccu

SEQ ID NO: 1217502 - RNA, 20 nt, Mycobacterium bovis subsp bovis AF2122/97
ccagcgagcccagcugcgcc

SEQ ID NO: 1217503 - RNA, 14 nt, Mycobacterium bovis subsp bovis AF2122/97
ccagcgagcccagc

SEQ ID NO: 1217504 - RNA, 16 nt, Mycobacterium bovis subsp bovis AF2122/97
ccagcgagcccagcug

SEQ ID NO: 1217505 - RNA, 20 nt, Mycobacterium bovis subsp bovis AF2122/97
ccagcgagaucagcaugccc

SEQ ID NO: 1217506 - RNA, 22 nt, Mycobacterium bovis subsp bovis AF2122/97
ccagcgagcgccaggucagcuc

SEQ ID NO: 1217507 - RNA, 14 nt, Mycobacterium bovis subsp bovis AF2122/97
ccagcgacccggcc

SEQ ID NO: 1217508 - RNA, 21 nt, Mycobacterium bovis subsp bovis AF2122/97
ccagcgauaucggcggcuugg

SEQ ID NO: 1217509 - RNA, 17 nt, Mycobacterium bovis subsp bovis AF2122/97
ccagcgaguugagcaug

SEQ ID NO: 1217510 - RNA, 14 nt, Mycobacterium bovis subsp bovis AF2122/97
ccagcgaggccagc

SEQ ID NO: 1217511 - RNA, 16 nt, Mycobacterium bovis subsp bovis AF2122/97
ccagcgaggccagcgg

SEQ ID NO: 1217512 - RNA, 22 nt, Mycobacterium bovis subsp bovis AF2122/97
ccagcgauggguguugcuggcc

SEQ ID NO: 1217513 - RNA, 19 nt, Mycobacterium bovis subsp bovis AF2122/97
ccagcgcauuuuccacauc

SEQ ID NO: 1217514 - RNA, 18 nt, Mycobacterium bovis subsp bovis AF2122/97
ccagcgccacuggaagcc

SEQ ID NO: 1217515 - RNA, 21 nt, Mycobacterium bovis subsp bovis AF2122/97
ccagcgccaccguuugcgcac

SEQ ID NO: 1217516 - RNA, 14 nt, Mycobacterium bovis subsp bovis AF2122/97
ccagcgcagcagcg

SEQ ID NO: 1217517 - RNA, 14 nt, Mycobacterium bovis subsp bovis AF2122/97
ccagcgcaccgccg

SEQ ID NO: 1217518 - RNA, 13 nt, Mycobacterium bovis subsp bovis AF2122/97
ccagccuggcaac

SEQ ID NO: 1217519 - RNA, 14 nt, Mycobacterium bovis subsp bovis AF2122/97
ccagccuaccggcu

SEQ ID NO: 1217520 - RNA, 14 nt, Mycobacterium bovis subsp bovis AF2122/97
ccagccggucuugg

SEQ ID NO: 1217521 - RNA, 15 nt, Mycobacterium bovis subsp bovis AF2122/97
ccagccggucgucgc

SEQ ID NO: 1217522 - RNA, 16 nt, Mycobacterium bovis subsp bovis AF2122/97
ccagccgugcggcggc

SEQ ID NO: 1217523 - RNA, 23 nt, Mycobacterium bovis subsp bovis AF2122/97
ccagccgucggcgcugcgcgcga

SEQ ID NO: 1217524 - RNA, 12 nt, Mycobacterium bovis subsp bovis AF2122/97
ccagccguggcg

SEQ ID NO: 1217525 - RNA, 20 nt, Mycobacterium bovis subsp bovis AF2122/97
ccagccgucgucagguggcc

SEQ ID NO: 1217526 - RNA, 17 nt, Mycobacterium bovis subsp bovis AF2122/97
ccagcgacgcggccagc

SEQ ID NO: 1217527 - RNA, 18 nt, Mycobacterium bovis subsp bovis AF2122/97
ccagcgaccuagcagcgc

SEQ ID NO: 1217528 - RNA, 23 nt, Mycobacterium bovis subsp bovis AF2122/97
ccagcgacaacaccacggugccg

SEQ ID NO: 1217529 - RNA, 18 nt, Mycobacterium bovis subsp bovis AF2122/97
ccagcgaaucacccgcga

SEQ ID NO: 1217530 - RNA, 17 nt, Mycobacterium bovis subsp bovis AF2122/97
ccagcgaauccaggccg

SEQ ID NO: 1217531 - RNA, 20 nt, Mycobacterium bovis subsp bovis AF2122/97
ccagccuuaugcagugacag

SEQ ID NO: 1217532 - RNA, 12 nt, Mycobacterium bovis subsp bovis AF2122/97
ccagccugugcu

SEQ ID NO: 1217533 - RNA, 21 nt, Mycobacterium bovis subsp bovis AF2122/97
ccagccuggccaucgagggca

SEQ ID NO: 1217534 - RNA, 23 nt, Mycobacterium bovis subsp bovis AF2122/97
ccagccuggccaucgagggcauc

SEQ ID NO: 1217535 - RNA, 14 nt, Mycobacterium bovis subsp bovis AF2122/97
ccagccggcgcgcc

SEQ ID NO: 1217536 - RNA, 20 nt, Mycobacterium bovis subsp bovis AF2122/97
ccagccgguagagcgggcca

SEQ ID NO: 1217537 - RNA, 13 nt, Mycobacterium bovis subsp bovis AF2122/97
ccagccgguccag

SEQ ID NO: 1217538 - RNA, 21 nt, Mycobacterium bovis subsp bovis AF2122/97
ccagccgguccagacccagcu

SEQ ID NO: 1217539 - RNA, 15 nt, Mycobacterium bovis subsp bovis AF2122/97
ccacugagccacagg

SEQ ID NO: 1217540 - RNA, 16 nt, Mycobacterium bovis subsp bovis AF2122/97
ccacugagucugaugg

SEQ ID NO: 1217541 - RNA, 16 nt, Mycobacterium bovis subsp bovis AF2122/97
ccacuccccagcccca

SEQ ID NO: 1217542 - RNA, 14 nt, Mycobacterium bovis subsp bovis AF2122/97
ccacucccgccccg

SEQ ID NO: 1217543 - RNA, 16 nt, Mycobacterium bovis subsp bovis AF2122/97
ccacuccacgcagccc

SEQ ID NO: 1217544 - RNA, 13 nt, Mycobacterium bovis subsp bovis AF2122/97
ccacucggacccg

SEQ ID NO: 1217545 - RNA, 16 nt, Mycobacterium bovis subsp bovis AF2122/97
ccacucgcagcagcau

SEQ ID NO: 1217546 - RNA, 15 nt, Mycobacterium bovis subsp bovis AF2122/97
ccacuccgguggcca

SEQ ID NO: 1217547 - RNA, 17 nt, Mycobacterium bovis subsp bovis AF2122/97
ccacucggcccggcagg

SEQ ID NO: 1217548 - RNA, 20 nt, Mycobacterium bovis subsp bovis AF2122/97
ccacucggucguugccgcgg

SEQ ID NO: 1217549 - RNA, 15 nt, Mycobacterium bovis subsp bovis AF2122/97
ccagcucgcgcaccc

SEQ ID NO: 1217550 - RNA, 18 nt, Mycobacterium bovis subsp bovis AF2122/97
ccagcucgcgcacccagc

SEQ ID NO: 1217551 - RNA, 20 nt, Mycobacterium bovis subsp bovis AF2122/97
ccagcuccgccugccgcugg

SEQ ID NO: 1217552 - RNA, 22 nt, Mycobacterium bovis subsp bovis AF2122/97
ccagcucacccggagcacccgg

SEQ ID NO: 1217553 - RNA, 21 nt, Mycobacterium bovis subsp bovis AF2122/97
ccagcguguggagcucgcggc

SEQ ID NO: 1217554 - RNA, 20 nt, Mycobacterium bovis subsp bovis AF2122/97
ccagcguuaggucgccggcu

SEQ ID NO: 1217555 - RNA, 14 nt, Mycobacterium bovis subsp bovis AF2122/97
ccagcguuugcugg

SEQ ID NO: 1217556 - RNA, 22 nt, Mycobacterium bovis subsp bovis AF2122/97
ccagcgugcccgccaccggcgc

SEQ ID NO: 1217557 - RNA, 14 nt, Mycobacterium bovis subsp bovis AF2122/97
ccagcgugcccgcc

SEQ ID NO: 1217558 - RNA, 21 nt, Mycobacterium bovis subsp bovis AF2122/97
ccagcguggugaagucggugc

SEQ ID NO: 1217559 - RNA, 23 nt, Mycobacterium bovis subsp bovis AF2122/97
ccagcguggugaagucggugccg

SEQ ID NO: 1217560 - RNA, 23 nt, Mycobacterium bovis subsp bovis AF2122/97
ccagcguggggccgccaccagcg

SEQ ID NO: 1217561 - RNA, 16 nt, Mycobacterium bovis subsp bovis AF2122/97
ccagcguggggccgcc

SEQ ID NO: 1217562 - RNA, 17 nt, Mycobacterium bovis subsp bovis AF2122/97
ccagcguggggccgcca

SEQ ID NO: 1217563 - RNA, 15 nt, Mycobacterium bovis subsp bovis AF2122/97
ccagcguccaaccca

SEQ ID NO: 1217564 - RNA, 23 nt, Mycobacterium bovis subsp bovis AF2122/97
ccagcgucgcacgcgcgcaggcc

SEQ ID NO: 1217565 - RNA, 20 nt, Mycobacterium bovis subsp bovis AF2122/97
ccagcgucgcgauugccgcg

SEQ ID NO: 1217566 - RNA, 22 nt, Mycobacterium bovis subsp bovis AF2122/97
ccagcgucccgauguaugacag

SEQ ID NO: 1217567 - RNA, 16 nt, Mycobacterium bovis subsp bovis AF2122/97
ccagcgucgacacacc

SEQ ID NO: 1217568 - RNA, 18 nt, Mycobacterium bovis subsp bovis AF2122/97
ccagcgucgacacaccca

SEQ ID NO: 1217569 - RNA, 18 nt, Mycobacterium bovis subsp bovis AF2122/97
ccagcguaaauagcgccc

SEQ ID NO: 1217570 - RNA, 14 nt, Mycobacterium bovis subsp bovis AF2122/97
ccagcgcggcgucg

SEQ ID NO: 1217571 - RNA, 18 nt, Mycobacterium bovis subsp bovis AF2122/97
ccagcgcgcgcugagccg

SEQ ID NO: 1217572 - RNA, 23 nt, Mycobacterium bovis subsp bovis AF2122/97
ccagcgcgacguccaccagccgg

SEQ ID NO: 1217573 - RNA, 17 nt, Mycobacterium bovis subsp bovis AF2122/97
ccagcgcgucucguuga

SEQ ID NO: 1217574 - RNA, 16 nt, Mycobacterium bovis subsp bovis AF2122/97
ccagcgcgucgggaug

SEQ ID NO: 1217575 - RNA, 16 nt, Mycobacterium bovis subsp bovis AF2122/97
ccagcgcuagccgggc

SEQ ID NO: 1217576 - RNA, 15 nt, Mycobacterium bovis subsp bovis AF2122/97
ccagcgcucaccggc

SEQ ID NO: 1217577 - RNA, 17 nt, Mycobacterium bovis subsp bovis AF2122/97
ccagcgcuccagcaccc

SEQ ID NO: 1217578 - RNA, 16 nt, Mycobacterium bovis subsp bovis AF2122/97
ccagcgcuucggccug

SEQ ID NO: 1217579 - RNA, 12 nt, Mycobacterium bovis subsp bovis AF2122/97
ccagcggccgcc

SEQ ID NO: 1217580 - RNA, 14 nt, Mycobacterium bovis subsp bovis AF2122/97
ccagcggccgccgc

SEQ ID NO: 1217581 - RNA, 19 nt, Mycobacterium bovis subsp bovis AF2122/97
ccagcggcaauggccagca

SEQ ID NO: 1217582 - RNA, 21 nt, Mycobacterium bovis subsp bovis AF2122/97
ccagcggaguaaacaaaccca

SEQ ID NO: 1217583 - RNA, 19 nt, Mycobacterium bovis subsp bovis AF2122/97
ccagcggauuugccccguu

SEQ ID NO: 1217584 - RNA, 14 nt, Mycobacterium bovis subsp bovis AF2122/97
ccagcggcaccgcg

SEQ ID NO: 1217585 - RNA, 16 nt, Mycobacterium bovis subsp bovis AF2122/97
ccagcggcaccgcggc

SEQ ID NO: 1217586 - RNA, 21 nt, Mycobacterium bovis subsp bovis AF2122/97
ccagcggcaccgcggccagcg

SEQ ID NO: 1217587 - RNA, 12 nt, Mycobacterium bovis subsp bovis AF2122/97
ccagcggcggcc

SEQ ID NO: 1217588 - RNA, 12 nt, Mycobacterium bovis subsp bovis AF2122/97
ccagcggcggca

SEQ ID NO: 1217589 - RNA, 23 nt, Mycobacterium bovis subsp bovis AF2122/97
ccagcggcggucuuuuugggcuu

SEQ ID NO: 1217590 - RNA, 19 nt, Mycobacterium bovis subsp bovis AF2122/97
ccagcgggcauaacccgca

SEQ ID NO: 1217591 - RNA, 19 nt, Mycobacterium bovis subsp bovis AF2122/97
ccagcgggcgaugagcgcg

SEQ ID NO: 1217592 - RNA, 22 nt, Mycobacterium bovis subsp bovis AF2122/97
ccagcggucggcgaccaccagc

SEQ ID NO: 1217593 - RNA, 17 nt, Mycobacterium bovis subsp bovis AF2122/97
ccagcgguagccgagcu

SEQ ID NO: 1217594 - RNA, 14 nt, Mycobacterium bovis subsp bovis AF2122/97
ccagcggucggcga

SEQ ID NO: 1217595 - RNA, 21 nt, Mycobacterium bovis subsp bovis AF2122/97
ccagcggggucuugacggcgc

SEQ ID NO: 1217596 - RNA, 15 nt, Mycobacterium bovis subsp bovis AF2122/97
ccaucaccccggccu

SEQ ID NO: 1217597 - RNA, 23 nt, Mycobacterium bovis subsp bovis AF2122/97
ccaucaccacggccgccgacucc

SEQ ID NO: 1217598 - RNA, 17 nt, Mycobacterium bovis subsp bovis AF2122/97
ccaucacaucggccucu

SEQ ID NO: 1217599 - RNA, 19 nt, Mycobacterium bovis subsp bovis AF2122/97
ccaucaacugcaucaccac

SEQ ID NO: 1217600 - RNA, 13 nt, Mycobacterium bovis subsp bovis AF2122/97
ccauauagaucac

SEQ ID NO: 1217601 - RNA, 18 nt, Mycobacterium bovis subsp bovis AF2122/97
ccaucaacaucggcccgc

SEQ ID NO: 1217602 - RNA, 15 nt, Mycobacterium bovis subsp bovis AF2122/97
ccauacucggcggcu

SEQ ID NO: 1217603 - RNA, 20 nt, Mycobacterium bovis subsp bovis AF2122/97
ccauagugaggccgaccagc

SEQ ID NO: 1217604 - RNA, 18 nt, Mycobacterium bovis subsp bovis AF2122/97
ccauagugcggcagcggu

SEQ ID NO: 1217605 - RNA, 17 nt, Mycobacterium bovis subsp bovis AF2122/97
ccauagacccggcugag

SEQ ID NO: 1217606 - RNA, 21 nt, Mycobacterium bovis subsp bovis AF2122/97
ccauaagcucguagagcaccg

SEQ ID NO: 1217607 - RNA, 20 nt, Mycobacterium bovis subsp bovis AF2122/97
ccauaagcucguagagcacc

SEQ ID NO: 1217608 - RNA, 19 nt, Mycobacterium bovis subsp bovis AF2122/97
ccaguuucaucaugugguc

SEQ ID NO: 1217609 - RNA, 15 nt, Mycobacterium bovis subsp bovis AF2122/97
ccagguccaccccgc

SEQ ID NO: 1217610 - RNA, 22 nt, Mycobacterium bovis subsp bovis AF2122/97
ccaguucgcgccacgcacccgg

SEQ ID NO: 1217611 - RNA, 17 nt, Mycobacterium bovis subsp bovis AF2122/97
ccaguucggcggccgcc

SEQ ID NO: 1217612 - RNA, 19 nt, Mycobacterium bovis subsp bovis AF2122/97
ccaguucggcggccgccgc

SEQ ID NO: 1217613 - RNA, 14 nt, Mycobacterium bovis subsp bovis AF2122/97
ccaguucugcagga

SEQ ID NO: 1217614 - RNA, 21 nt, Mycobacterium bovis subsp bovis AF2122/97
ccaggucgcgauagccgccgc

SEQ ID NO: 1217615 - RNA, 23 nt, Mycobacterium bovis subsp bovis AF2122/97
ccaggucgcgauagccgccgcgg

SEQ ID NO: 1217616 - RNA, 12 nt, Mycobacterium bovis subsp bovis AF2122/97
ccaggucggcca

SEQ ID NO: 1217617 - RNA, 22 nt, Mycobacterium bovis subsp bovis AF2122/97
ccaggucuccaucaaccgcgcu

SEQ ID NO: 1217618 - RNA, 18 nt, Mycobacterium bovis subsp bovis AF2122/97
ccaggucuuucgaauccc

SEQ ID NO: 1217619 - RNA, 14 nt, Mycobacterium bovis subsp bovis AF2122/97
ccaggucugcggug

SEQ ID NO: 1217620 - RNA, 22 nt, Mycobacterium bovis subsp bovis AF2122/97
ccaggucugggcuuugcagcgu

SEQ ID NO: 1217621 - RNA, 22 nt, Mycobacterium bovis subsp bovis AF2122/97
ccaggucguaggcgcuaggaac

SEQ ID NO: 1217622 - RNA, 16 nt, Mycobacterium bovis subsp bovis AF2122/97
ccaggucggcguugau

SEQ ID NO: 1217623 - RNA, 15 nt, Mycobacterium bovis subsp bovis AF2122/97
ccaggucuccaucaa

SEQ ID NO: 1217624 - RNA, 19 nt, Mycobacterium bovis subsp bovis AF2122/97
ccaguggcgcgugcagcgg

SEQ ID NO: 1217625 - RNA, 12 nt, Mycobacterium bovis subsp bovis AF2122/97
ccaguggcagcc

SEQ ID NO: 1217626 - RNA, 15 nt, Mycobacterium bovis subsp bovis AF2122/97
ccaguggcgcgugca

SEQ ID NO: 1217627 - RNA, 16 nt, Mycobacterium bovis subsp bovis AF2122/97
ccagugcgguggcagg

SEQ ID NO: 1217628 - RNA, 16 nt, Mycobacterium bovis subsp bovis AF2122/97
ccaguguguccugucg

SEQ ID NO: 1217629 - RNA, 19 nt, Mycobacterium bovis subsp bovis AF2122/97
ccaguucccuacacccauu

SEQ ID NO: 1217630 - RNA, 14 nt, Mycobacterium bovis subsp bovis AF2122/97
ccaucuccaacagg

SEQ ID NO: 1217631 - RNA, 17 nt, Mycobacterium bovis subsp bovis AF2122/97
ccaucuaccagcucacc

SEQ ID NO: 1217632 - RNA, 14 nt, Mycobacterium bovis subsp bovis AF2122/97
ccaucucaugcauc

SEQ ID NO: 1217633 - RNA, 23 nt, Mycobacterium bovis subsp bovis AF2122/97
ccaucuccgguguguuuggcaug

SEQ ID NO: 1217634 - RNA, 16 nt, Mycobacterium bovis subsp bovis AF2122/97
ccaucuccgccgucgc

SEQ ID NO: 1217635 - RNA, 23 nt, Mycobacterium bovis subsp bovis AF2122/97
ccaucgcauccccagcacaacca

SEQ ID NO: 1217636 - RNA, 16 nt, Mycobacterium bovis subsp bovis AF2122/97
ccaucgugcugaagcu

SEQ ID NO: 1217637 - RNA, 19 nt, Mycobacterium bovis subsp bovis AF2122/97
ccaucguuguugaccacca

SEQ ID NO: 1217638 - RNA, 19 nt, Mycobacterium bovis subsp bovis AF2122/97
ccaucguuucacccgggcu

SEQ ID NO: 1217639 - RNA, 14 nt, Mycobacterium bovis subsp bovis AF2122/97
ccaucgaccgcccg

SEQ ID NO: 1217640 - RNA, 15 nt, Mycobacterium bovis subsp bovis AF2122/97
ccaucgaguccacca

SEQ ID NO: 1217641 - RNA, 18 nt, Mycobacterium bovis subsp bovis AF2122/97
ccaucgaguccaccaccu

SEQ ID NO: 1217642 - RNA, 16 nt, Mycobacterium bovis subsp bovis AF2122/97
ccauccgauggcccgg

SEQ ID NO: 1217643 - RNA, 13 nt, Mycobacterium bovis subsp bovis AF2122/97
ccauccgaguugu

SEQ ID NO: 1217644 - RNA, 15 nt, Mycobacterium bovis subsp bovis AF2122/97
ccaucccggcgccgc

SEQ ID NO: 1217645 - RNA, 20 nt, Mycobacterium bovis subsp bovis AF2122/97
ccaugaugccuaccgggccc

SEQ ID NO: 1217646 - RNA, 20 nt, Mycobacterium bovis subsp bovis AF2122/97
ccaugccgcucggcaaccug

SEQ ID NO: 1217647 - RNA, 17 nt, Mycobacterium bovis subsp bovis AF2122/97
ccaucucuugcaaccug

SEQ ID NO: 1217648 - RNA, 20 nt, Mycobacterium bovis subsp bovis AF2122/97
ccaucugaucgggcccgucc

SEQ ID NO: 1217649 - RNA, 22 nt, Mycobacterium bovis subsp bovis AF2122/97
ccaucuggccgcgggcgcggcc

SEQ ID NO: 1217650 - RNA, 14 nt, Mycobacterium bovis subsp bovis AF2122/97
ccaucugcuggcug

SEQ ID NO: 1217651 - RNA, 20 nt, Mycobacterium bovis subsp bovis AF2122/97
ccaucugugcgcggacaccu

SEQ ID NO: 1217652 - RNA, 14 nt, Mycobacterium bovis subsp bovis AF2122/97
ccaugaucccgcug

SEQ ID NO: 1217653 - RNA, 22 nt, Mycobacterium bovis subsp bovis AF2122/97
ccauccccuugguggccagcca

SEQ ID NO: 1217654 - RNA, 16 nt, Mycobacterium bovis subsp bovis AF2122/97
ccaucccgaucccggc

SEQ ID NO: 1217655 - RNA, 20 nt, Mycobacterium bovis subsp bovis AF2122/97
ccaucccgaucccggccagc

SEQ ID NO: 1217656 - RNA, 22 nt, Mycobacterium bovis subsp bovis AF2122/97
ccaucccgauccugcccaccau

SEQ ID NO: 1217657 - RNA, 15 nt, Mycobacterium bovis subsp bovis AF2122/97
ccaucaugugcgcga

SEQ ID NO: 1217658 - RNA, 22 nt, Mycobacterium bovis subsp bovis AF2122/97
ccaucaugugcgcgaccacccg

SEQ ID NO: 1217659 - RNA, 15 nt, Mycobacterium bovis subsp bovis AF2122/97
ccaucaucgccacca

SEQ ID NO: 1217660 - RNA, 15 nt, Mycobacterium bovis subsp bovis AF2122/97
ccaucaucaccucuc

SEQ ID NO: 1217661 - RNA, 17 nt, Mycobacterium bovis subsp bovis AF2122/97
ccaucaccccggccuug

SEQ ID NO: 1217662 - RNA, 21 nt, Mycobacterium bovis subsp bovis AF2122/97
ccaucaccgcgccagccucca

SEQ ID NO: 1217663 - RNA, 13 nt, Mycobacterium bovis subsp bovis AF2122/97
ccaucaccggcgg

SEQ ID NO: 1217664 - RNA, 15 nt, Mycobacterium bovis subsp bovis AF2122/97
ccaucacggaccagg

SEQ ID NO: 1217665 - RNA, 16 nt, Mycobacterium bovis subsp bovis AF2122/97
ccaucacggaccaggc

SEQ ID NO: 1217666 - RNA, 16 nt, Mycobacterium bovis subsp bovis AF2122/97
ccaucacgaccagggu

SEQ ID NO: 1217667 - RNA, 22 nt, Mycobacterium bovis subsp bovis AF2122/97
ccaucagaaugccuggcccguc

SEQ ID NO: 1217668 - RNA, 19 nt, Mycobacterium bovis subsp bovis AF2122/97
ccaucagagacagcagcgu

SEQ ID NO: 1217669 - RNA, 19 nt, Mycobacterium bovis subsp bovis AF2122/97
ccaucacgcccuguucucc

SEQ ID NO: 1217670 - RNA, 21 nt, Mycobacterium bovis subsp bovis AF2122/97
ccaucagccgcugcguagugu

SEQ ID NO: 1217671 - RNA, 23 nt, Mycobacterium bovis subsp bovis AF2122/97
cccaccgucgucguuucgccagc

SEQ ID NO: 1217672 - RNA, 16 nt, Mycobacterium bovis subsp bovis AF2122/97
cccaccgguaccgcca

SEQ ID NO: 1217673 - RNA, 21 nt, Mycobacterium bovis subsp bovis AF2122/97
cccaccguugcgaagaagaag

SEQ ID NO: 1217674 - RNA, 12 nt, Mycobacterium bovis subsp bovis AF2122/97
cccacgauaggu

SEQ ID NO: 1217675 - RNA, 13 nt, Mycobacterium bovis subsp bovis AF2122/97
cccaccgcgccga

SEQ ID NO: 1217676 - RNA, 14 nt, Mycobacterium bovis subsp bovis AF2122/97
cccaccgccccggc

SEQ ID NO: 1217677 - RNA, 16 nt, Mycobacterium bovis subsp bovis AF2122/97
cccaccgcugcggcac

SEQ ID NO: 1217678 - RNA, 18 nt, Mycobacterium bovis subsp bovis AF2122/97
cccaccgcugcggcacca

SEQ ID NO: 1217679 - RNA, 13 nt, Mycobacterium bovis subsp bovis AF2122/97
cccaccggcgccg

SEQ ID NO: 1217680 - RNA, 18 nt, Mycobacterium bovis subsp bovis AF2122/97
cccaccggcgccgccggc

SEQ ID NO: 1217681 - RNA, 16 nt, Mycobacterium bovis subsp bovis AF2122/97
cccaccggccaccagg

SEQ ID NO: 1217682 - RNA, 16 nt, Mycobacterium bovis subsp bovis AF2122/97
cccacccgcggcgccg

SEQ ID NO: 1217683 - RNA, 18 nt, Mycobacterium bovis subsp bovis AF2122/97
cccacccgcaccgccggc

SEQ ID NO: 1217684 - RNA, 21 nt, Mycobacterium bovis subsp bovis AF2122/97
cccacccgcaccaccggcccc

SEQ ID NO: 1217685 - RNA, 23 nt, Mycobacterium bovis subsp bovis AF2122/97
cccaccgacauguguggcagccc

SEQ ID NO: 1217686 - RNA, 23 nt, Mycobacterium bovis subsp bovis AF2122/97
cccaccgacaagaauggccgccu

SEQ ID NO: 1217687 - RNA, 15 nt, Mycobacterium bovis subsp bovis AF2122/97
cccaccgaaccgagg

SEQ ID NO: 1217688 - RNA, 15 nt, Mycobacterium bovis subsp bovis AF2122/97
cccacccgcaccgcg

SEQ ID NO: 1217689 - RNA, 15 nt, Mycobacterium bovis subsp bovis AF2122/97
cccaccagcggcggc

SEQ ID NO: 1217690 - RNA, 12 nt, Mycobacterium bovis subsp bovis AF2122/97
cccaccagugca

SEQ ID NO: 1217691 - RNA, 13 nt, Mycobacterium bovis subsp bovis AF2122/97
cccacccacgccg

SEQ ID NO: 1217692 - RNA, 15 nt, Mycobacterium bovis subsp bovis AF2122/97
cccacaggcuuuucc

SEQ ID NO: 1217693 - RNA, 19 nt, Mycobacterium bovis subsp bovis AF2122/97
cccacaucagccgcaccag

SEQ ID NO: 1217694 - RNA, 19 nt, Mycobacterium bovis subsp bovis AF2122/97
cccacagucgccggccggc

SEQ ID NO: 1217695 - RNA, 20 nt, Mycobacterium bovis subsp bovis AF2122/97
cccacagucgccggccggcc

SEQ ID NO: 1217696 - RNA, 23 nt, Mycobacterium bovis subsp bovis AF2122/97
cccacacgcccucgacgccgcgc

SEQ ID NO: 1217697 - RNA, 12 nt, Mycobacterium bovis subsp bovis AF2122/97
cccacaccuugg

SEQ ID NO: 1217698 - RNA, 13 nt, Mycobacterium bovis subsp bovis AF2122/97
cccaccagcgcag

SEQ ID NO: 1217699 - RNA, 14 nt, Mycobacterium bovis subsp bovis AF2122/97
cccaccaccaccgc

SEQ ID NO: 1217700 - RNA, 13 nt, Mycobacterium bovis subsp bovis AF2122/97
cccaccaccaccg

SEQ ID NO: 1217701 - RNA, 12 nt, Mycobacterium bovis subsp bovis AF2122/97
cccaccacacag

SEQ ID NO: 1217702 - RNA, 14 nt, Mycobacterium bovis subsp bovis AF2122/97
cccaccacacagcc

SEQ ID NO: 1217703 - RNA, 21 nt, Mycobacterium bovis subsp bovis AF2122/97
cccacaugacgaucgcggcgg

SEQ ID NO: 1217704 - RNA, 16 nt, Mycobacterium bovis subsp bovis AF2122/97
cccacaucgucggcgg

SEQ ID NO: 1217705 - RNA, 22 nt, Mycobacterium bovis subsp bovis AF2122/97
cccacaucagccgcaccagugg

SEQ ID NO: 1217706 - RNA, 15 nt, Mycobacterium bovis subsp bovis AF2122/97
cccagaccgccgacg

SEQ ID NO: 1217707 - RNA, 20 nt, Mycobacterium bovis subsp bovis AF2122/97
cccagagcaucagguuguac

SEQ ID NO: 1217708 - RNA, 21 nt, Mycobacterium bovis subsp bovis AF2122/97
cccagauagagcuggugcaga

SEQ ID NO: 1217709 - RNA, 14 nt, Mycobacterium bovis subsp bovis AF2122/97
cccagcagggugug

SEQ ID NO: 1217710 - RNA, 15 nt, Mycobacterium bovis subsp bovis AF2122/97
cccagcagggugugc

SEQ ID NO: 1217711 - RNA, 17 nt, Mycobacterium bovis subsp bovis AF2122/97
cccagcaguucgccgcg

SEQ ID NO: 1217712 - RNA, 22 nt, Mycobacterium bovis subsp bovis AF2122/97
cccagcaguucgccgcgcagcg

SEQ ID NO: 1217713 - RNA, 12 nt, Mycobacterium bovis subsp bovis AF2122/97
cccacuggaggu

SEQ ID NO: 1217714 - RNA, 15 nt, Mycobacterium bovis subsp bovis AF2122/97
cccacuugccgggca

SEQ ID NO: 1217715 - RNA, 18 nt, Mycobacterium bovis subsp bovis AF2122/97
cccacucucgccacgccg

SEQ ID NO: 1217716 - RNA, 18 nt, Mycobacterium bovis subsp bovis AF2122/97
cccacucccgccccgcuc

SEQ ID NO: 1217717 - RNA, 23 nt, Mycobacterium bovis subsp bovis AF2122/97
cccacugaccgaacgcaacagcc

SEQ ID NO: 1217718 - RNA, 13 nt, Mycobacterium bovis subsp bovis AF2122/97
cccacuccagcag

SEQ ID NO: 1217719 - RNA, 13 nt, Mycobacterium bovis subsp bovis AF2122/97
cccacucccgccc

SEQ ID NO: 1217720 - RNA, 13 nt, Mycobacterium bovis subsp bovis AF2122/97
cccacuccgccga

SEQ ID NO: 1217721 - RNA, 14 nt, Mycobacterium bovis subsp bovis AF2122/97
cccacgccagcgcg

SEQ ID NO: 1217722 - RNA, 15 nt, Mycobacterium bovis subsp bovis AF2122/97
cccacgcccaauguc

SEQ ID NO: 1217723 - RNA, 14 nt, Mycobacterium bovis subsp bovis AF2122/97
cccacgcccggccc

SEQ ID NO: 1217724 - RNA, 16 nt, Mycobacterium bovis subsp bovis AF2122/97
cccacgcacagcaacg

SEQ ID NO: 1217725 - RNA, 22 nt, Mycobacterium bovis subsp bovis AF2122/97
cccacgcacagcaacgcccaac

SEQ ID NO: 1217726 - RNA, 19 nt, Mycobacterium bovis subsp bovis AF2122/97
cccacgaucagcagcgucg

SEQ ID NO: 1217727 - RNA, 12 nt, Mycobacterium bovis subsp bovis AF2122/97
cccacgccgccg

SEQ ID NO: 1217728 - RNA, 21 nt, Mycobacterium bovis subsp bovis AF2122/97
cccacgcgcacucgaccagga

SEQ ID NO: 1217729 - RNA, 15 nt, Mycobacterium bovis subsp bovis AF2122/97
cccacggcagcgccg

SEQ ID NO: 1217730 - RNA, 13 nt, Mycobacterium bovis subsp bovis AF2122/97
cccacgggccggc

SEQ ID NO: 1217731 - RNA, 14 nt, Mycobacterium bovis subsp bovis AF2122/97
cccacgggccggcc

SEQ ID NO: 1217732 - RNA, 23 nt, Mycobacterium bovis subsp bovis AF2122/97
cccacggcgagaaaaugacccac

SEQ ID NO: 1217733 - RNA, 17 nt, Mycobacterium bovis subsp bovis AF2122/97
cccacggcgggcgagcc

SEQ ID NO: 1217734 - RNA, 16 nt, Mycobacterium bovis subsp bovis AF2122/97
cccacggccggccgcu

SEQ ID NO: 1217735 - RNA, 18 nt, Mycobacterium bovis subsp bovis AF2122/97
cccacggcgaccacgccg

SEQ ID NO: 1217736 - RNA, 20 nt, Mycobacterium bovis subsp bovis AF2122/97
cccacggcgaccacgccgcc

SEQ ID NO: 1217737 - RNA, 23 nt, Mycobacterium bovis subsp bovis AF2122/97
cccacguugaugaugccggcguu

SEQ ID NO: 1217738 - RNA, 14 nt, Mycobacterium bovis subsp bovis AF2122/97
cccacgugcugccu

SEQ ID NO: 1217739 - RNA, 14 nt, Mycobacterium bovis subsp bovis AF2122/97
cccacgucgagcag

SEQ ID NO: 1217740 - RNA, 16 nt, Mycobacterium bovis subsp bovis AF2122/97
cccacgugcugccuuu

SEQ ID NO: 1217741 - RNA, 16 nt, Mycobacterium bovis subsp bovis AF2122/97
cccacguuggccccgc

SEQ ID NO: 1217742 - RNA, 22 nt, Mycobacterium bovis subsp bovis AF2122/97
cccaauccaccgaagccccucc

SEQ ID NO: 1217743 - RNA, 17 nt, Mycobacterium bovis subsp bovis AF2122/97
cccaaucagugcagcgu

SEQ ID NO: 1217744 - RNA, 15 nt, Mycobacterium bovis subsp bovis AF2122/97
cccaacccauaucga

SEQ ID NO: 1217745 - RNA, 21 nt, Mycobacterium bovis subsp bovis AF2122/97
cccaaguccagcagcgacgcu

SEQ ID NO: 1217746 - RNA, 18 nt, Mycobacterium bovis subsp bovis AF2122/97
cccaaucgucggccagca

SEQ ID NO: 1217747 - RNA, 19 nt, Mycobacterium bovis subsp bovis AF2122/97
cccaaugccaccgcggccg

SEQ ID NO: 1217748 - RNA, 15 nt, Mycobacterium bovis subsp bovis AF2122/97
cccaauguccaggcg

SEQ ID NO: 1217749 - RNA, 22 nt, Mycobacterium bovis subsp bovis AF2122/97
cccaauuucgugccgaaauggg

SEQ ID NO: 1217750 - RNA, 18 nt, Mycobacterium bovis subsp bovis AF2122/97
cccaauucgacugcaacu

SEQ ID NO: 1217751 - RNA, 17 nt, Mycobacterium bovis subsp bovis AF2122/97
cccaaagcgccagcagc

SEQ ID NO: 1217752 - RNA, 22 nt, Mycobacterium bovis subsp bovis AF2122/97
cccaaaggcuguaacacccggc

SEQ ID NO: 1217753 - RNA, 21 nt, Mycobacterium bovis subsp bovis AF2122/97
cccaaaaugccuuggcagccc

SEQ ID NO: 1217754 - RNA, 23 nt, Mycobacterium bovis subsp bovis AF2122/97
cccaacagcccaccggugccgcc

SEQ ID NO: 1217755 - RNA, 18 nt, Mycobacterium bovis subsp bovis AF2122/97
ccaugcgccaacccggcc

SEQ ID NO: 1217756 - RNA, 16 nt, Mycobacterium bovis subsp bovis AF2122/97
ccaugcgcaccagucc

SEQ ID NO: 1217757 - RNA, 17 nt, Mycobacterium bovis subsp bovis AF2122/97
ccaugcgccacgccacu

SEQ ID NO: 1217758 - RNA, 18 nt, Mycobacterium bovis subsp bovis AF2122/97
ccaugcgguuagcagccg

SEQ ID NO: 1217759 - RNA, 22 nt, Mycobacterium bovis subsp bovis AF2122/97
ccaugcuaggaccaccagcgcu

SEQ ID NO: 1217760 - RNA, 19 nt, Mycobacterium bovis subsp bovis AF2122/97
ccaugcugcccuuguugaa

SEQ ID NO: 1217761 - RNA, 14 nt, Mycobacterium bovis subsp bovis AF2122/97
ccaugcuaggacca

SEQ ID NO: 1217762 - RNA, 18 nt, Mycobacterium bovis subsp bovis AF2122/97
ccaugcuaggaccaccag

SEQ ID NO: 1217763 - RNA, 19 nt, Mycobacterium bovis subsp bovis AF2122/97
ccaugcuaggaccaccagc

SEQ ID NO: 1217764 - RNA, 17 nt, Mycobacterium bovis subsp bovis AF2122/97
ccauugacauugagguc

SEQ ID NO: 1217765 - RNA, 21 nt, Mycobacterium bovis subsp bovis AF2122/97
ccauuccaucgcgcaccgcau

SEQ ID NO: 1217766 - RNA, 22 nt, Mycobacterium bovis subsp bovis AF2122/97
ccauugucgaucaccugcagca

SEQ ID NO: 1217767 - RNA, 18 nt, Mycobacterium bovis subsp bovis AF2122/97
ccauuguugggccgccag

SEQ ID NO: 1217768 - RNA, 22 nt, Mycobacterium bovis subsp bovis AF2122/97
ccauuggaccgagacuugcugg

SEQ ID NO: 1217769 - RNA, 19 nt, Mycobacterium bovis subsp bovis AF2122/97
ccauuggccaagucagccc

SEQ ID NO: 1217770 - RNA, 14 nt, Mycobacterium bovis subsp bovis AF2122/97
ccauuggcgccgcc

SEQ ID NO: 1217771 - RNA, 24 nt, Mycobacterium bovis subsp bovis AF2122/97
cccgccggauccgccagaccgcgg

SEQ ID NO: 1217772 - RNA, 14 nt, Mycobacterium bovis subsp bovis AF2122/97
cccgccggaacugc

SEQ ID NO: 1217773 - RNA, 13 nt, Mycobacterium bovis subsp bovis AF2122/97
cccgccggcagug

SEQ ID NO: 1217774 - RNA, 16 nt, Mycobacterium bovis subsp bovis AF2122/97
cccgccggacccgccc

SEQ ID NO: 1217775 - RNA, 16 nt, Mycobacterium bovis subsp bovis AF2122/97
cccgccguugccaccg

SEQ ID NO: 1217776 - RNA, 19 nt, Mycobacterium bovis subsp bovis AF2122/97
cccgccguuuccgccgccg

SEQ ID NO: 1217777 - RNA, 20 nt, Mycobacterium bovis subsp bovis AF2122/97
cccgccucgaccgccagccc

SEQ ID NO: 1217778 - RNA, 18 nt, Mycobacterium bovis subsp bovis AF2122/97
cccgccugaccgccaccg

SEQ ID NO: 1217779 - RNA, 21 nt, Mycobacterium bovis subsp bovis AF2122/97
cccgccuaaagcgugucgccc

SEQ ID NO: 1217780 - RNA, 17 nt, Mycobacterium bovis subsp bovis AF2122/97
cccgccucaucuccugu

SEQ ID NO: 1217781 - RNA, 13 nt, Mycobacterium bovis subsp bovis AF2122/97
cccgccgcgcccg

SEQ ID NO: 1217782 - RNA, 19 nt, Mycobacterium bovis subsp bovis AF2122/97
cccgccgaacguguugacc

SEQ ID NO: 1217783 - RNA, 16 nt, Mycobacterium bovis subsp bovis AF2122/97
cccgcccuugccgcca

SEQ ID NO: 1217784 - RNA, 21 nt, Mycobacterium bovis subsp bovis AF2122/97
cccgccgcgcauccgcagccc

SEQ ID NO: 1217785 - RNA, 16 nt, Mycobacterium bovis subsp bovis AF2122/97
cccgcccgagccgcug

SEQ ID NO: 1217786 - RNA, 14 nt, Mycobacterium bovis subsp bovis AF2122/97
cccgccccgcgccu

SEQ ID NO: 1217787 - RNA, 21 nt, Mycobacterium bovis subsp bovis AF2122/97
cccgcccgacgugaagccaag

SEQ ID NO: 1217788 - RNA, 12 nt, Mycobacterium bovis subsp bovis AF2122/97
cccgcccgagcc

SEQ ID NO: 1217789 - RNA, 18 nt, Mycobacterium bovis subsp bovis AF2122/97
cccgccccgggccaccag

SEQ ID NO: 1217790 - RNA, 21 nt, Mycobacterium bovis subsp bovis AF2122/97
cccgcaggucgaucugcgcca

SEQ ID NO: 1217791 - RNA, 18 nt, Mycobacterium bovis subsp bovis AF2122/97
cccgcaggucgcuggccg

SEQ ID NO: 1217792 - RNA, 14 nt, Mycobacterium bovis subsp bovis AF2122/97
cccgcagcucgacc

SEQ ID NO: 1217793 - RNA, 13 nt, Mycobacterium bovis subsp bovis AF2122/97
cccgcaggacgcu

SEQ ID NO: 1217794 - RNA, 16 nt, Mycobacterium bovis subsp bovis AF2122/97
cccgcccaggcgucca

SEQ ID NO: 1217795 - RNA, 13 nt, Mycobacterium bovis subsp bovis AF2122/97
cccgcccagcagc

SEQ ID NO: 1217796 - RNA, 15 nt, Mycobacterium bovis subsp bovis AF2122/97
cccgcaucgcccaag

SEQ ID NO: 1217797 - RNA, 18 nt, Mycobacterium bovis subsp bovis AF2122/97
cccgcaugcccuggacca

SEQ ID NO: 1217798 - RNA, 19 nt, Mycobacterium bovis subsp bovis AF2122/97
cccgcaugccggcgcacca

SEQ ID NO: 1217799 - RNA, 18 nt, Mycobacterium bovis subsp bovis AF2122/97
cccgcauccacgucgccc

SEQ ID NO: 1217800 - RNA, 19 nt, Mycobacterium bovis subsp bovis AF2122/97
cccgcaucggaaucgcgag

SEQ ID NO: 1217801 - RNA, 19 nt, Mycobacterium bovis subsp bovis AF2122/97
cccgauggcgucgccggcc

SEQ ID NO: 1217802 - RNA, 23 nt, Mycobacterium bovis subsp bovis AF2122/97
cccgauguuacggccccacagcg

SEQ ID NO: 1217803 - RNA, 23 nt, Mycobacterium bovis subsp bovis AF2122/97
cccgaugccgugccgggccagau

SEQ ID NO: 1217804 - RNA, 15 nt, Mycobacterium bovis subsp bovis AF2122/97
cccgaugaccgccuu

SEQ ID NO: 1217805 - RNA, 13 nt, Mycobacterium bovis subsp bovis AF2122/97
cccgaucggcaac

SEQ ID NO: 1217806 - RNA, 13 nt, Mycobacterium bovis subsp bovis AF2122/97
cccgaugaccgcc

SEQ ID NO: 1217807 - RNA, 20 nt, Mycobacterium bovis subsp bovis AF2122/97
ccccuggaaagggccgccgc

SEQ ID NO: 1217808 - RNA, 19 nt, Mycobacterium bovis subsp bovis AF2122/97
ccccuggacuucgggggcc

SEQ ID NO: 1217809 - RNA, 13 nt, Mycobacterium bovis subsp bovis AF2122/97
ccccuggccagca

SEQ ID NO: 1217810 - RNA, 14 nt, Mycobacterium bovis subsp bovis AF2122/97
ccccuggccgccgg

SEQ ID NO: 1217811 - RNA, 22 nt, Mycobacterium bovis subsp bovis AF2122/97
ccccuggccgccggcgccgcca

SEQ ID NO: 1217812 - RNA, 14 nt, Mycobacterium bovis subsp bovis AF2122/97
cccgaaccaccacc

SEQ ID NO: 1217813 - RNA, 13 nt, Mycobacterium bovis subsp bovis AF2122/97
ccccuggccgccg

SEQ ID NO: 1217814 - RNA, 21 nt, Mycobacterium bovis subsp bovis AF2122/97
ccccguucuggaaccccgagc

SEQ ID NO: 1217815 - RNA, 19 nt, Mycobacterium bovis subsp bovis AF2122/97
ccccgugggguguggcggc

SEQ ID NO: 1217816 - RNA, 19 nt, Mycobacterium bovis subsp bovis AF2122/97
ccccguuggucagcgugga

SEQ ID NO: 1217817 - RNA, 21 nt, Mycobacterium bovis subsp bovis AF2122/97
ccccguugccgccguugccgc

SEQ ID NO: 1217818 - RNA, 11 nt, Mycobacterium bovis subsp bovis AF2122/97
ccccuaaaccg

SEQ ID NO: 1217819 - RNA, 16 nt, Mycobacterium bovis subsp bovis AF2122/97
ccccuaaaccggcagg

SEQ ID NO: 1217820 - RNA, 13 nt, Mycobacterium bovis subsp bovis AF2122/97
ccccgggcgguga

SEQ ID NO: 1217821 - RNA, 19 nt, Mycobacterium bovis subsp bovis AF2122/97
ccccgggcggugaggcagc

SEQ ID NO: 1217822 - RNA, 14 nt, Mycobacterium bovis subsp bovis AF2122/97
ccccggggguccac

SEQ ID NO: 1217823 - RNA, 15 nt, Mycobacterium bovis subsp bovis AF2122/97
cccgacgucgcggag

SEQ ID NO: 1217824 - RNA, 20 nt, Mycobacterium bovis subsp bovis AF2122/97
cccgacggguaucccguccc

SEQ ID NO: 1217825 - RNA, 12 nt, Mycobacterium bovis subsp bovis AF2122/97
cccgacacccgu

SEQ ID NO: 1217826 - RNA, 19 nt, Mycobacterium bovis subsp bovis AF2122/97
cccgacaccguccagcagc

SEQ ID NO: 1217827 - RNA, 17 nt, Mycobacterium bovis subsp bovis AF2122/97
cccgacaccgccccgcc

SEQ ID NO: 1217828 - RNA, 16 nt, Mycobacterium bovis subsp bovis AF2122/97
cccgaaccaccgcguu

SEQ ID NO: 1217829 - RNA, 14 nt, Mycobacterium bovis subsp bovis AF2122/97
cccgaaccccgacc

SEQ ID NO: 1217830 - RNA, 14 nt, Mycobacterium bovis subsp bovis AF2122/97
cccgaagccgaccg

SEQ ID NO: 1217831 - RNA, 18 nt, Mycobacterium bovis subsp bovis AF2122/97
cccgaaguagaagcccag

SEQ ID NO: 1217832 - RNA, 23 nt, Mycobacterium bovis subsp bovis AF2122/97
cccgaauagucggcaucgcgagc

SEQ ID NO: 1217833 - RNA, 20 nt, Mycobacterium bovis subsp bovis AF2122/97
cccgagcccagcgccuccag

SEQ ID NO: 1217834 - RNA, 21 nt, Mycobacterium bovis subsp bovis AF2122/97
cccgagcaacggcggcaggcc

SEQ ID NO: 1217835 - RNA, 19 nt, Mycobacterium bovis subsp bovis AF2122/97
cccgacuucaagacagccg

SEQ ID NO: 1217836 - RNA, 12 nt, Mycobacterium bovis subsp bovis AF2122/97
cccgaucacgcu

SEQ ID NO: 1217837 - RNA, 14 nt, Mycobacterium bovis subsp bovis AF2122/97
cccgauccuggcca

SEQ ID NO: 1217838 - RNA, 17 nt, Mycobacterium bovis subsp bovis AF2122/97
cccgauaguucuggccc

SEQ ID NO: 1217839 - RNA, 12 nt, Mycobacterium bovis subsp bovis AF2122/97
ccccagagcugg

SEQ ID NO: 1217840 - RNA, 19 nt, Mycobacterium bovis subsp bovis AF2122/97
ccccacuggugcagcgccg

SEQ ID NO: 1217841 - RNA, 11 nt, Mycobacterium bovis subsp bovis AF2122/97
ccccacugccg

SEQ ID NO: 1217842 - RNA, 21 nt, Mycobacterium bovis subsp bovis AF2122/97
ccccacuugccgggcaaucgc

SEQ ID NO: 1217843 - RNA, 15 nt, Mycobacterium bovis subsp bovis AF2122/97
ccccagggagugccg

SEQ ID NO: 1217844 - RNA, 20 nt, Mycobacterium bovis subsp bovis AF2122/97
ccccaggccgcuugccccgc

SEQ ID NO: 1217845 - RNA, 21 nt, Mycobacterium bovis subsp bovis AF2122/97
ccccaggccgcuugccccgcc

SEQ ID NO: 1217846 - RNA, 20 nt, Mycobacterium bovis subsp bovis AF2122/97
ccccagcgguuuccgcacga

SEQ ID NO: 1217847 - RNA, 18 nt, Mycobacterium bovis subsp bovis AF2122/97
ccccagcggccaccgagg

SEQ ID NO: 1217848 - RNA, 16 nt, Mycobacterium bovis subsp bovis AF2122/97
ccccaugcgguuugga

SEQ ID NO: 1217849 - RNA, 21 nt, Mycobacterium bovis subsp bovis AF2122/97
ccccaggugggcagcaggccc

SEQ ID NO: 1217850 - RNA, 24 nt, Mycobacterium bovis subsp bovis AF2122/97
ccccaggugggcagcaggcccacc

SEQ ID NO: 1217851 - RNA, 13 nt, Mycobacterium bovis subsp bovis AF2122/97
ccccaggugggca

SEQ ID NO: 1217852 - RNA, 16 nt, Mycobacterium bovis subsp bovis AF2122/97
cccagcaugaaguccc

SEQ ID NO: 1217853 - RNA, 15 nt, Mycobacterium bovis subsp bovis AF2122/97
cccagccaacccguc

SEQ ID NO: 1217854 - RNA, 14 nt, Mycobacterium bovis subsp bovis AF2122/97
cccagccagcugga

SEQ ID NO: 1217855 - RNA, 23 nt, Mycobacterium bovis subsp bovis AF2122/97
cccauucccaacacagccgucgc

SEQ ID NO: 1217856 - RNA, 13 nt, Mycobacterium bovis subsp bovis AF2122/97
cccagcccagccg

SEQ ID NO: 1217857 - RNA, 23 nt, Mycobacterium bovis subsp bovis AF2122/97
cccauucucggccggcggcgccc

SEQ ID NO: 1217858 - RNA, 15 nt, Mycobacterium bovis subsp bovis AF2122/97
ccccaagcccgauuc

SEQ ID NO: 1217859 - RNA, 21 nt, Mycobacterium bovis subsp bovis AF2122/97
ccccaacugcgaaacgccacc

SEQ ID NO: 1217860 - RNA, 22 nt, Mycobacterium bovis subsp bovis AF2122/97
cccauugucgaucaccugcagc

SEQ ID NO: 1217861 - RNA, 14 nt, Mycobacterium bovis subsp bovis AF2122/97
cccauugccgucgc

SEQ ID NO: 1217862 - RNA, 12 nt, Mycobacterium bovis subsp bovis AF2122/97
cccauuggaccg

SEQ ID NO: 1217863 - RNA, 23 nt, Mycobacterium bovis subsp bovis AF2122/97
cccauuggaccgagacuugcugg

SEQ ID NO: 1217864 - RNA, 21 nt, Mycobacterium bovis subsp bovis AF2122/97
cccauuggguaaccagcgcca

SEQ ID NO: 1217865 - RNA, 16 nt, Mycobacterium bovis subsp bovis AF2122/97
ccccaaucagugcagc

SEQ ID NO: 1217866 - RNA, 16 nt, Mycobacterium bovis subsp bovis AF2122/97
ccccggccuuggcggc

SEQ ID NO: 1217867 - RNA, 17 nt, Mycobacterium bovis subsp bovis AF2122/97
ccccggcgcggccagcu

SEQ ID NO: 1217868 - RNA, 14 nt, Mycobacterium bovis subsp bovis AF2122/97
ccccggcugccagc

SEQ ID NO: 1217869 - RNA, 17 nt, Mycobacterium bovis subsp bovis AF2122/97
ccccggccauggcgcgc

SEQ ID NO: 1217870 - RNA, 12 nt, Mycobacterium bovis subsp bovis AF2122/97
ccccggccagga

SEQ ID NO: 1217871 - RNA, 12 nt, Mycobacterium bovis subsp bovis AF2122/97
ccccggccagcc

SEQ ID NO: 1217872 - RNA, 22 nt, Mycobacterium bovis subsp bovis AF2122/97
ccccggcauugcccgagcccag

SEQ ID NO: 1217873 - RNA, 16 nt, Mycobacterium bovis subsp bovis AF2122/97
ccccggacggcaggcu

SEQ ID NO: 1217874 - RNA, 14 nt, Mycobacterium bovis subsp bovis AF2122/97
ccccggcagcgccc

SEQ ID NO: 1217875 - RNA, 15 nt, Mycobacterium bovis subsp bovis AF2122/97
ccccggcaccgccgg

SEQ ID NO: 1217876 - RNA, 21 nt, Mycobacterium bovis subsp bovis AF2122/97
ccccgcagccagaucuccccg

SEQ ID NO: 1217877 - RNA, 22 nt, Mycobacterium bovis subsp bovis AF2122/97
ccccgcagccagaucuccccga

SEQ ID NO: 1217878 - RNA, 13 nt, Mycobacterium bovis subsp bovis AF2122/97
ccccgcagcgccu

SEQ ID NO: 1217879 - RNA, 13 nt, Mycobacterium bovis subsp bovis AF2122/97
ccccgaccgccgu

SEQ ID NO: 1217880 - RNA, 12 nt, Mycobacterium bovis subsp bovis AF2122/97
ccccgaccgcgc

SEQ ID NO: 1217881 - RNA, 23 nt, Mycobacterium bovis subsp bovis AF2122/97
ccccgacgaugcgcacucccggc

SEQ ID NO: 1217882 - RNA, 20 nt, Mycobacterium bovis subsp bovis AF2122/97
ccccgacggacuccggccgg

SEQ ID NO: 1217883 - RNA, 22 nt, Mycobacterium bovis subsp bovis AF2122/97
ccccgacggacuccggccggcc

SEQ ID NO: 1217884 - RNA, 21 nt, Mycobacterium bovis subsp bovis AF2122/97
ccccgacggcaaugcggggca

SEQ ID NO: 1217885 - RNA, 13 nt, Mycobacterium bovis subsp bovis AF2122/97
ccccgccaacccc

SEQ ID NO: 1217886 - RNA, 11 nt, Mycobacterium bovis subsp bovis AF2122/97
ccccgcagcuc

SEQ ID NO: 1217887 - RNA, 20 nt, Mycobacterium bovis subsp bovis AF2122/97
ccccgcagcucaccucauga

SEQ ID NO: 1217888 - RNA, 23 nt, Mycobacterium bovis subsp bovis AF2122/97
ccccgcaggggguggugucgcgg

SEQ ID NO: 1217889 - RNA, 15 nt, Mycobacterium bovis subsp bovis AF2122/97
ccccgccaccucgcc

SEQ ID NO: 1217890 - RNA, 13 nt, Mycobacterium bovis subsp bovis AF2122/97
ccccgccagcgcc

SEQ ID NO: 1217891 - RNA, 14 nt, Mycobacterium bovis subsp bovis AF2122/97
ccccgccagcgccg

SEQ ID NO: 1217892 - RNA, 13 nt, Mycobacterium bovis subsp bovis AF2122/97
ccccgccgagcgg

SEQ ID NO: 1217893 - RNA, 12 nt, Mycobacterium bovis subsp bovis AF2122/97
ccccgccgccac

SEQ ID NO: 1217894 - RNA, 11 nt, Mycobacterium bovis subsp bovis AF2122/97
ccccgccgccc

SEQ ID NO: 1217895 - RNA, 11 nt, Mycobacterium bovis subsp bovis AF2122/97
ccccgccgcua

SEQ ID NO: 1217896 - RNA, 13 nt, Mycobacterium bovis subsp bovis AF2122/97
ccccgccggccgg

SEQ ID NO: 1217897 - RNA, 22 nt, Mycobacterium bovis subsp bovis AF2122/97
cccccaaaucaacagggugggc

SEQ ID NO: 1217898 - RNA, 15 nt, Mycobacterium bovis subsp bovis AF2122/97
cccccaaccgccggc

SEQ ID NO: 1217899 - RNA, 18 nt, Mycobacterium bovis subsp bovis AF2122/97
ccccaugaucuggugcgc

SEQ ID NO: 1217900 - RNA, 22 nt, Mycobacterium bovis subsp bovis AF2122/97
cccccgauagcgaccgcggccc

SEQ ID NO: 1217901 - RNA, 20 nt, Mycobacterium bovis subsp bovis AF2122/97
cccccgacuccggcaggccc

SEQ ID NO: 1217902 - RNA, 14 nt, Mycobacterium bovis subsp bovis AF2122/97
ccccccacccacca

SEQ ID NO: 1217903 - RNA, 13 nt, Mycobacterium bovis subsp bovis AF2122/97
cccccccacccac

SEQ ID NO: 1217904 - RNA, 13 nt, Mycobacterium bovis subsp bovis AF2122/97
ccccccccaccca

SEQ ID NO: 1217905 - RNA, 16 nt, Mycobacterium bovis subsp bovis AF2122/97
ccccgaccugcaagac

SEQ ID NO: 1217906 - RNA, 21 nt, Mycobacterium bovis subsp bovis AF2122/97
ccccgacgagauacggccacc

SEQ ID NO: 1217907 - RNA, 12 nt, Mycobacterium bovis subsp bovis AF2122/97
cccccgccgcgc

SEQ ID NO: 1217908 - RNA, 20 nt, Mycobacterium bovis subsp bovis AF2122/97
cccccgcgggggcggccggc

SEQ ID NO: 1217909 - RNA, 23 nt, Mycobacterium bovis subsp bovis AF2122/97
cccccggcagcgugcggggcgcc

SEQ ID NO: 1217910 - RNA, 18 nt, Mycobacterium bovis subsp bovis AF2122/97
ccccgaacauugcgccca

SEQ ID NO: 1217911 - RNA, 21 nt, Mycobacterium bovis subsp bovis AF2122/97
cccggccaccagcaugccugc

SEQ ID NO: 1217912 - RNA, 17 nt, Mycobacterium bovis subsp bovis AF2122/97
cccggccaccagcaugc

SEQ ID NO: 1217913 - RNA, 16 nt, Mycobacterium bovis subsp bovis AF2122/97
cccggcauugagccgg

SEQ ID NO: 1217914 - RNA, 21 nt, Mycobacterium bovis subsp bovis AF2122/97
cccggcauugcccgagcccag

SEQ ID NO: 1217915 - RNA, 14 nt, Mycobacterium bovis subsp bovis AF2122/97
cccggccaaaaugg

SEQ ID NO: 1217916 - RNA, 17 nt, Mycobacterium bovis subsp bovis AF2122/97
cccggccaaccaccaac

SEQ ID NO: 1217917 - RNA, 11 nt, Mycobacterium bovis subsp bovis AF2122/97
cccggccaggc

SEQ ID NO: 1217918 - RNA, 22 nt, Mycobacterium bovis subsp bovis AF2122/97
cccggccagcuccucagccacc

SEQ ID NO: 1217919 - RNA, 14 nt, Mycobacterium bovis subsp bovis AF2122/97
cccggcagagcacg

SEQ ID NO: 1217920 - RNA, 15 nt, Mycobacterium bovis subsp bovis AF2122/97
cccggcagaugcagc

SEQ ID NO: 1217921 - RNA, 16 nt, Mycobacterium bovis subsp bovis AF2122/97
cccggcagcacgugga

SEQ ID NO: 1217922 - RNA, 21 nt, Mycobacterium bovis subsp bovis AF2122/97
cccggcagcaucggucacacc

SEQ ID NO: 1217923 - RNA, 23 nt, Mycobacterium bovis subsp bovis AF2122/97
cccggcagcgugcggggcgccug

SEQ ID NO: 1217924 - RNA, 21 nt, Mycobacterium bovis subsp bovis AF2122/97
cccggcauacaacuggugggc

SEQ ID NO: 1217925 - RNA, 23 nt, Mycobacterium bovis subsp bovis AF2122/97
cccggcauacaacuggugggcca

SEQ ID NO: 1217926 - RNA, 11 nt, Mycobacterium bovis subsp bovis AF2122/97
cccggccgccg

SEQ ID NO: 1217927 - RNA, 18 nt, Mycobacterium bovis subsp bovis AF2122/97
cccggccgcgcacccguc

SEQ ID NO: 1217928 - RNA, 16 nt, Mycobacterium bovis subsp bovis AF2122/97
cccggccgcgcacccg

SEQ ID NO: 1217929 - RNA, 12 nt, Mycobacterium bovis subsp bovis AF2122/97
cccggccgccga

SEQ ID NO: 1217930 - RNA, 13 nt, Mycobacterium bovis subsp bovis AF2122/97
cccggcccggcuc

SEQ ID NO: 1217931 - RNA, 16 nt, Mycobacterium bovis subsp bovis AF2122/97
cccggcccgccacccc

SEQ ID NO: 1217932 - RNA, 15 nt, Mycobacterium bovis subsp bovis AF2122/97
cccggcccgccaccc

SEQ ID NO: 1217933 - RNA, 22 nt, Mycobacterium bovis subsp bovis AF2122/97
cccggcccgaucggcaacccgc

SEQ ID NO: 1217934 - RNA, 23 nt, Mycobacterium bovis subsp bovis AF2122/97
cccggccaggaguuugaccaccu

SEQ ID NO: 1217935 - RNA, 15 nt, Mycobacterium bovis subsp bovis AF2122/97
cccggccaggggcgc

SEQ ID NO: 1217936 - RNA, 21 nt, Mycobacterium bovis subsp bovis AF2122/97
cccggccauagcccgagcgcu

SEQ ID NO: 1217937 - RNA, 12 nt, Mycobacterium bovis subsp bovis AF2122/97
cccggcgccgcg

SEQ ID NO: 1217938 - RNA, 12 nt, Mycobacterium bovis subsp bovis AF2122/97
cccggcgcgcca

SEQ ID NO: 1217939 - RNA, 16 nt, Mycobacterium bovis subsp bovis AF2122/97
cccggcgcaagcgccg

SEQ ID NO: 1217940 - RNA, 14 nt, Mycobacterium bovis subsp bovis AF2122/97
cccggccgcgcccc

SEQ ID NO: 1217941 - RNA, 16 nt, Mycobacterium bovis subsp bovis AF2122/97
cccggccuugccgccg

SEQ ID NO: 1217942 - RNA, 20 nt, Mycobacterium bovis subsp bovis AF2122/97
cccggccuugccgccggccc

SEQ ID NO: 1217943 - RNA, 15 nt, Mycobacterium bovis subsp bovis AF2122/97
cccggcgacgacccg

SEQ ID NO: 1217944 - RNA, 18 nt, Mycobacterium bovis subsp bovis AF2122/97
cccggcgaugcagccggg

SEQ ID NO: 1217945 - RNA, 17 nt, Mycobacterium bovis subsp bovis AF2122/97
cccggcgaugcagccgg

SEQ ID NO: 1217946 - RNA, 19 nt, Mycobacterium bovis subsp bovis AF2122/97
cccggcgacggcguagccg

SEQ ID NO: 1217947 - RNA, 14 nt, Mycobacterium bovis subsp bovis AF2122/97
cccggccggcccgg

SEQ ID NO: 1217948 - RNA, 19 nt, Mycobacterium bovis subsp bovis AF2122/97
cccggccggucgagacgcu

SEQ ID NO: 1217949 - RNA, 14 nt, Mycobacterium bovis subsp bovis AF2122/97
cccggccugcgucg

SEQ ID NO: 1217950 - RNA, 13 nt, Mycobacterium bovis subsp bovis AF2122/97
cccggccugcugg

SEQ ID NO: 1217951 - RNA, 17 nt, Mycobacterium bovis subsp bovis AF2122/97
cccggccuggagcagcc

SEQ ID NO: 1217952 - RNA, 14 nt, Mycobacterium bovis subsp bovis AF2122/97
cccggucggcggca

SEQ ID NO: 1217953 - RNA, 22 nt, Mycobacterium bovis subsp bovis AF2122/97
cccggucgggcgcggggcggcc

SEQ ID NO: 1217954 - RNA, 16 nt, Mycobacterium bovis subsp bovis AF2122/97
cccggucggcccgcgc

SEQ ID NO: 1217955 - RNA, 22 nt, Mycobacterium bovis subsp bovis AF2122/97
cccggucgacgggucggcgccg

SEQ ID NO: 1217956 - RNA, 23 nt, Mycobacterium bovis subsp bovis AF2122/97
cccggucgagccagcggagcagc

SEQ ID NO: 1217957 - RNA, 18 nt, Mycobacterium bovis subsp bovis AF2122/97
cccggucgcacuuggccc

SEQ ID NO: 1217958 - RNA, 21 nt, Mycobacterium bovis subsp bovis AF2122/97
cccggucgcacuuggcccccg

SEQ ID NO: 1217959 - RNA, 13 nt, Mycobacterium bovis subsp bovis AF2122/97
cccggucgccgcg

SEQ ID NO: 1217960 - RNA, 18 nt, Mycobacterium bovis subsp bovis AF2122/97
cccgguugugcgcgcgcc

SEQ ID NO: 1217961 - RNA, 11 nt, Mycobacterium bovis subsp bovis AF2122/97
cccggucucga

SEQ ID NO: 1217962 - RNA, 19 nt, Mycobacterium bovis subsp bovis AF2122/97
cccggucucgacggcggcc

SEQ ID NO: 1217963 - RNA, 13 nt, Mycobacterium bovis subsp bovis AF2122/97
cccggugaccacu

SEQ ID NO: 1217964 - RNA, 22 nt, Mycobacterium bovis subsp bovis AF2122/97
cccggucuuuaauccagcgccg

SEQ ID NO: 1217965 - RNA, 23 nt, Mycobacterium bovis subsp bovis AF2122/97
cccgguguugagcgaacccgcgu

SEQ ID NO: 1217966 - RNA, 14 nt, Mycobacterium bovis subsp bovis AF2122/97
cccguagcaccaca

SEQ ID NO: 1217967 - RNA, 15 nt, Mycobacterium bovis subsp bovis AF2122/97
cccguacgccggcgg

SEQ ID NO: 1217968 - RNA, 20 nt, Mycobacterium bovis subsp bovis AF2122/97
cccguaggugcacaacccgu

SEQ ID NO: 1217969 - RNA, 14 nt, Mycobacterium bovis subsp bovis AF2122/97
cccguaaaccgaua

SEQ ID NO: 1217970 - RNA, 14 nt, Mycobacterium bovis subsp bovis AF2122/97
cccggcgcuccaac

SEQ ID NO: 1217971 - RNA, 18 nt, Mycobacterium bovis subsp bovis AF2122/97
cccggcgcuggugcgcca

SEQ ID NO: 1217972 - RNA, 17 nt, Mycobacterium bovis subsp bovis AF2122/97
cccggcggcagcugcug

SEQ ID NO: 1217973 - RNA, 14 nt, Mycobacterium bovis subsp bovis AF2122/97
cccggcggcgcgcc

SEQ ID NO: 1217974 - RNA, 19 nt, Mycobacterium bovis subsp bovis AF2122/97
cccggcgggcccgccggcc

SEQ ID NO: 1217975 - RNA, 20 nt, Mycobacterium bovis subsp bovis AF2122/97
cccggcgggcccgccggccc

SEQ ID NO: 1217976 - RNA, 21 nt, Mycobacterium bovis subsp bovis AF2122/97
cccggcgggcccgccggcccc

SEQ ID NO: 1217977 - RNA, 18 nt, Mycobacterium bovis subsp bovis AF2122/97
cccggcgggcggugggca

SEQ ID NO: 1217978 - RNA, 15 nt, Mycobacterium bovis subsp bovis AF2122/97
cccggcgguaccgcc

SEQ ID NO: 1217979 - RNA, 21 nt, Mycobacterium bovis subsp bovis AF2122/97
cccggcgguaccggagcagcu

SEQ ID NO: 1217980 - RNA, 22 nt, Mycobacterium bovis subsp bovis AF2122/97
cccggcguauugcaccgccagg

SEQ ID NO: 1217981 - RNA, 22 nt, Mycobacterium bovis subsp bovis AF2122/97
cccggcggaucccgaggcgccc

SEQ ID NO: 1217982 - RNA, 15 nt, Mycobacterium bovis subsp bovis AF2122/97
cccggcgggcccgcc

SEQ ID NO: 1217983 - RNA, 16 nt, Mycobacterium bovis subsp bovis AF2122/97
cccggcguccgaccgg

SEQ ID NO: 1217984 - RNA, 15 nt, Mycobacterium bovis subsp bovis AF2122/97
cccggcgucucgcag

SEQ ID NO: 1217985 - RNA, 20 nt, Mycobacterium bovis subsp bovis AF2122/97
cccggcguggcuucacccaa

SEQ ID NO: 1217986 - RNA, 19 nt, Mycobacterium bovis subsp bovis AF2122/97
cccggcguggugagccucg

SEQ ID NO: 1217987 - RNA, 17 nt, Mycobacterium bovis subsp bovis AF2122/97
cccggcgugucgccgcc

SEQ ID NO: 1217988 - RNA, 18 nt, Mycobacterium bovis subsp bovis AF2122/97
cccggcgugucgccgcca

SEQ ID NO: 1217989 - RNA, 17 nt, Mycobacterium bovis subsp bovis AF2122/97
cccgggccucggcgccg

SEQ ID NO: 1217990 - RNA, 15 nt, Mycobacterium bovis subsp bovis AF2122/97
cccggcguugccgcc

SEQ ID NO: 1217991 - RNA, 21 nt, Mycobacterium bovis subsp bovis AF2122/97
cccggcguggugagccucggc

SEQ ID NO: 1217992 - RNA, 21 nt, Mycobacterium bovis subsp bovis AF2122/97
cccgggccgccgcgauggccc

SEQ ID NO: 1217993 - RNA, 20 nt, Mycobacterium bovis subsp bovis AF2122/97
cccgggcggccagcugcagc

SEQ ID NO: 1217994 - RNA, 20 nt, Mycobacterium bovis subsp bovis AF2122/97
cccgggcggcggccugggcc

SEQ ID NO: 1217995 - RNA, 19 nt, Mycobacterium bovis subsp bovis AF2122/97
cccggggacgggucggcag

SEQ ID NO: 1217996 - RNA, 20 nt, Mycobacterium bovis subsp bovis AF2122/97
cccggggcgcucgcgcgcug

SEQ ID NO: 1217997 - RNA, 17 nt, Mycobacterium bovis subsp bovis AF2122/97
cccggggcgcacagcug

SEQ ID NO: 1217998 - RNA, 13 nt, Mycobacterium bovis subsp bovis AF2122/97
cccggguccugga

SEQ ID NO: 1217999 - RNA, 16 nt, Mycobacterium bovis subsp bovis AF2122/97
cccgggucggcacgac

SEQ ID NO: 1218000 - RNA, 16 nt, Mycobacterium bovis subsp bovis AF2122/97
cccgggguguucgucg

SEQ ID NO: 1218001 - RNA, 19 nt, Mycobacterium bovis subsp bovis AF2122/97
cccggucaggacggcaccc

SEQ ID NO: 1218002 - RNA, 13 nt, Mycobacterium bovis subsp bovis AF2122/97
cccggucccgccg

SEQ ID NO: 1218003 - RNA, 17 nt, Mycobacterium bovis subsp bovis AF2122/97
cccggacgauggcgucg

SEQ ID NO: 1218004 - RNA, 23 nt, Mycobacterium bovis subsp bovis AF2122/97
cccggaaucgcgaaacagcuugc

SEQ ID NO: 1218005 - RNA, 18 nt, Mycobacterium bovis subsp bovis AF2122/97
cccgcuuuuucccggcgg

SEQ ID NO: 1218006 - RNA, 16 nt, Mycobacterium bovis subsp bovis AF2122/97
cccggaacgccgccag

SEQ ID NO: 1218007 - RNA, 23 nt, Mycobacterium bovis subsp bovis AF2122/97
cccggaguggccaguuggccggc

SEQ ID NO: 1218008 - RNA, 22 nt, Mycobacterium bovis subsp bovis AF2122/97
cccggacuccaaagccgugcca

SEQ ID NO: 1218009 - RNA, 17 nt, Mycobacterium bovis subsp bovis AF2122/97
cccggacguaggcaccc

SEQ ID NO: 1218010 - RNA, 23 nt, Mycobacterium bovis subsp bovis AF2122/97
cccggacucuccccuggccccca

SEQ ID NO: 1218011 - RNA, 15 nt, Mycobacterium bovis subsp bovis AF2122/97
cccggagcacccggg

SEQ ID NO: 1218012 - RNA, 17 nt, Mycobacterium bovis subsp bovis AF2122/97
cccggagccgccaggug

SEQ ID NO: 1218013 - RNA, 24 nt, Mycobacterium bovis subsp bovis AF2122/97
cccggagccgccaggugcucgucg

SEQ ID NO: 1218014 - RNA, 12 nt, Mycobacterium bovis subsp bovis AF2122/97
cccggagccgcu

SEQ ID NO: 1218015 - RNA, 21 nt, Mycobacterium bovis subsp bovis AF2122/97
cccggaugucgugcgggcgca

SEQ ID NO: 1218016 - RNA, 17 nt, Mycobacterium bovis subsp bovis AF2122/97
cccggcacggugucgcg

SEQ ID NO: 1218017 - RNA, 15 nt, Mycobacterium bovis subsp bovis AF2122/97
cccggcaccccuuug

SEQ ID NO: 1218018 - RNA, 17 nt, Mycobacterium bovis subsp bovis AF2122/97
cccggcaccccuuugac

SEQ ID NO: 1218019 - RNA, 13 nt, Mycobacterium bovis subsp bovis AF2122/97
cccggcaccgccg

SEQ ID NO: 1218020 - RNA, 14 nt, Mycobacterium bovis subsp bovis AF2122/97
cccggcacacccuc

SEQ ID NO: 1218021 - RNA, 15 nt, Mycobacterium bovis subsp bovis AF2122/97
cccgcugcggcggcu

SEQ ID NO: 1218022 - RNA, 20 nt, Mycobacterium bovis subsp bovis AF2122/97
cccgcugaccaucacaccca

SEQ ID NO: 1218023 - RNA, 17 nt, Mycobacterium bovis subsp bovis AF2122/97
cccgcuccgccgucgcc

SEQ ID NO: 1218024 - RNA, 13 nt, Mycobacterium bovis subsp bovis AF2122/97
cccgcucgagcag

SEQ ID NO: 1218025 - RNA, 15 nt, Mycobacterium bovis subsp bovis AF2122/97
cccgcucgagcagcg

SEQ ID NO: 1218026 - RNA, 20 nt, Mycobacterium bovis subsp bovis AF2122/97
cccgcucgagcagcgcgccg

SEQ ID NO: 1218027 - RNA, 17 nt, Mycobacterium bovis subsp bovis AF2122/97
cccgcucgcccgccgcc

SEQ ID NO: 1218028 - RNA, 18 nt, Mycobacterium bovis subsp bovis AF2122/97
cccgcucgcgagcggcug

SEQ ID NO: 1218029 - RNA, 12 nt, Mycobacterium bovis subsp bovis AF2122/97
cccgcuccgcgg

SEQ ID NO: 1218030 - RNA, 16 nt, Mycobacterium bovis subsp bovis AF2122/97
cccgcuagcccaccac

SEQ ID NO: 1218031 - RNA, 20 nt, Mycobacterium bovis subsp bovis AF2122/97
cccgcuaggcgaagcgucug

SEQ ID NO: 1218032 - RNA, 13 nt, Mycobacterium bovis subsp bovis AF2122/97
cccgcucagcauu

SEQ ID NO: 1218033 - RNA, 19 nt, Mycobacterium bovis subsp bovis AF2122/97
cccgcucauaccgggagga

SEQ ID NO: 1218034 - RNA, 19 nt, Mycobacterium bovis subsp bovis AF2122/97
cccgcuguuuggcaacauc

SEQ ID NO: 1218035 - RNA, 15 nt, Mycobacterium bovis subsp bovis AF2122/97
cccgcuucagcacgg

SEQ ID NO: 1218036 - RNA, 15 nt, Mycobacterium bovis subsp bovis AF2122/97
cccgcuguaccucca

SEQ ID NO: 1218037 - RNA, 17 nt, Mycobacterium bovis subsp bovis AF2122/97
cccgcgagcagcccggc

SEQ ID NO: 1218038 - RNA, 17 nt, Mycobacterium bovis subsp bovis AF2122/97
cccgcgaggacagcugg

SEQ ID NO: 1218039 - RNA, 23 nt, Mycobacterium bovis subsp bovis AF2122/97
cccgcgaggacagcugguugugc

SEQ ID NO: 1218040 - RNA, 13 nt, Mycobacterium bovis subsp bovis AF2122/97
cccgcgagcagcc

SEQ ID NO: 1218041 - RNA, 21 nt, Mycobacterium bovis subsp bovis AF2122/97
cccgcgagguugaccaccagc

SEQ ID NO: 1218042 - RNA, 21 nt, Mycobacterium bovis subsp bovis AF2122/97
cccgccuucucccgcacggcc

SEQ ID NO: 1218043 - RNA, 19 nt, Mycobacterium bovis subsp bovis AF2122/97
cccgccucugucuucagcu

SEQ ID NO: 1218044 - RNA, 13 nt, Mycobacterium bovis subsp bovis AF2122/97
cccgcgccggccg

SEQ ID NO: 1218045 - RNA, 14 nt, Mycobacterium bovis subsp bovis AF2122/97
cccgcgccggccgc

SEQ ID NO: 1218046 - RNA, 19 nt, Mycobacterium bovis subsp bovis AF2122/97
cccgcgccggccgcacgcc

SEQ ID NO: 1218047 - RNA, 15 nt, Mycobacterium bovis subsp bovis AF2122/97
cccgcgcgagccgcu

SEQ ID NO: 1218048 - RNA, 13 nt, Mycobacterium bovis subsp bovis AF2122/97
cccgcgcgccagc

SEQ ID NO: 1218049 - RNA, 18 nt, Mycobacterium bovis subsp bovis AF2122/97
cccgcgccuccguugccc

SEQ ID NO: 1218050 - RNA, 20 nt, Mycobacterium bovis subsp bovis AF2122/97
cccgcgccuccguugccccc

SEQ ID NO: 1218051 - RNA, 12 nt, Mycobacterium bovis subsp bovis AF2122/97
cccgcgcccaac

SEQ ID NO: 1218052 - RNA, 19 nt, Mycobacterium bovis subsp bovis AF2122/97
cccgcgccaccagcaccgc

SEQ ID NO: 1218053 - RNA, 13 nt, Mycobacterium bovis subsp bovis AF2122/97
cccgcgccgcccg

SEQ ID NO: 1218054 - RNA, 20 nt, Mycobacterium bovis subsp bovis AF2122/97
cccgcgccgcccgcgccccc

SEQ ID NO: 1218055 - RNA, 12 nt, Mycobacterium bovis subsp bovis AF2122/97
cccgcgccgccg

SEQ ID NO: 1218056 - RNA, 20 nt, Mycobacterium bovis subsp bovis AF2122/97
cccgcgccaccucccacgcc

SEQ ID NO: 1218057 - RNA, 20 nt, Mycobacterium bovis subsp bovis AF2122/97
cccgcgucgagugccgccac

SEQ ID NO: 1218058 - RNA, 22 nt, Mycobacterium bovis subsp bovis AF2122/97
cccgcgucgagugccgccaccg

SEQ ID NO: 1218059 - RNA, 19 nt, Mycobacterium bovis subsp bovis AF2122/97
cccgcguaccacggugguc

SEQ ID NO: 1218060 - RNA, 16 nt, Mycobacterium bovis subsp bovis AF2122/97
cccgcguaugccagga

SEQ ID NO: 1218061 - RNA, 17 nt, Mycobacterium bovis subsp bovis AF2122/97
cccgcguaugccaggac

SEQ ID NO: 1218062 - RNA, 21 nt, Mycobacterium bovis subsp bovis AF2122/97
cccgcguucgagagccccgac

SEQ ID NO: 1218063 - RNA, 19 nt, Mycobacterium bovis subsp bovis AF2122/97
cccgcguucucggcacccu

SEQ ID NO: 1218064 - RNA, 22 nt, Mycobacterium bovis subsp bovis AF2122/97
cccgcuaacuggcccggacaug

SEQ ID NO: 1218065 - RNA, 15 nt, Mycobacterium bovis subsp bovis AF2122/97
cccgcuacgcgcgcu

SEQ ID NO: 1218066 - RNA, 20 nt, Mycobacterium bovis subsp bovis AF2122/97
cccgcuacgcgcgcucgcuc

SEQ ID NO: 1218067 - RNA, 17 nt, Mycobacterium bovis subsp bovis AF2122/97
cccgcuacggcagcccg

SEQ ID NO: 1218068 - RNA, 14 nt, Mycobacterium bovis subsp bovis AF2122/97
cccgcggccgggcc

SEQ ID NO: 1218069 - RNA, 22 nt, Mycobacterium bovis subsp bovis AF2122/97
cccgcggcgcggagagccugcu

SEQ ID NO: 1218070 - RNA, 20 nt, Mycobacterium bovis subsp bovis AF2122/97
cccgcgggcaguggcagccc

SEQ ID NO: 1218071 - RNA, 19 nt, Mycobacterium bovis subsp bovis AF2122/97
cccgcggggaaucacccac

SEQ ID NO: 1218072 - RNA, 23 nt, Mycobacterium bovis subsp bovis AF2122/97
cccgcggggaaucacccacucgc

SEQ ID NO: 1218073 - RNA, 19 nt, Mycobacterium bovis subsp bovis AF2122/97
cccgcgguccugguguagc

SEQ ID NO: 1218074 - RNA, 17 nt, Mycobacterium bovis subsp bovis AF2122/97
cccgcgcggagaccccg

SEQ ID NO: 1218075 - RNA, 16 nt, Mycobacterium bovis subsp bovis AF2122/97
cccgcgcgccagcucg

SEQ ID NO: 1218076 - RNA, 17 nt, Mycobacterium bovis subsp bovis AF2122/97
cccgcgcgucgcccagu

SEQ ID NO: 1218077 - RNA, 17 nt, Mycobacterium bovis subsp bovis AF2122/97
cccgcgcucgcacccgc

SEQ ID NO: 1218078 - RNA, 19 nt, Mycobacterium bovis subsp bovis AF2122/97
cccgcgcugagcacgcgga

SEQ ID NO: 1218079 - RNA, 14 nt, Mycobacterium bovis subsp bovis AF2122/97
cccgcggccgccag

SEQ ID NO: 1218080 - RNA, 13 nt, Mycobacterium bovis subsp bovis AF2122/97
cccgcgcucgcac

SEQ ID NO: 1218081 - RNA, 15 nt, Mycobacterium bovis subsp bovis AF2122/97
cccgcggacagcccg

SEQ ID NO: 1218082 - RNA, 15 nt, Mycobacterium bovis subsp bovis AF2122/97
ccgaucagcccggcc

SEQ ID NO: 1218083 - RNA, 14 nt, Mycobacterium bovis subsp bovis AF2122/97
ccgaucagccgugg

SEQ ID NO: 1218084 - RNA, 16 nt, Mycobacterium bovis subsp bovis AF2122/97
ccgaucacggugggcg

SEQ ID NO: 1218085 - RNA, 22 nt, Mycobacterium bovis subsp bovis AF2122/97
ccgaucaccucggcgacgucgg

SEQ ID NO: 1218086 - RNA, 14 nt, Mycobacterium bovis subsp bovis AF2122/97
ccgauauaccaggg

SEQ ID NO: 1218087 - RNA, 22 nt, Mycobacterium bovis subsp bovis AF2122/97
ccgaucaccuucggccgaccgg

SEQ ID NO: 1218088 - RNA, 20 nt, Mycobacterium bovis subsp bovis AF2122/97
ccgaucagcaccgacggcgc

SEQ ID NO: 1218089 - RNA, 16 nt, Mycobacterium bovis subsp bovis AF2122/97
ccgaucagcgcggcgc

SEQ ID NO: 1218090 - RNA, 16 nt, Mycobacterium bovis subsp bovis AF2122/97
ccgaucagcguggcgc

SEQ ID NO: 1218091 - RNA, 23 nt, Mycobacterium bovis subsp bovis AF2122/97
ccgauccagugguaggccgccgg

SEQ ID NO: 1218092 - RNA, 20 nt, Mycobacterium bovis subsp bovis AF2122/97
ccgauccacaacagcccgua

SEQ ID NO: 1218093 - RNA, 12 nt, Mycobacterium bovis subsp bovis AF2122/97
ccgauccccagg

SEQ ID NO: 1218094 - RNA, 12 nt, Mycobacterium bovis subsp bovis AF2122/97
ccgaucccgccc

SEQ ID NO: 1218095 - RNA, 16 nt, Mycobacterium bovis subsp bovis AF2122/97
ccgaucccggcgagca

SEQ ID NO: 1218096 - RNA, 13 nt, Mycobacterium bovis subsp bovis AF2122/97
ccgaucccgucgg

SEQ ID NO: 1218097 - RNA, 15 nt, Mycobacterium bovis subsp bovis AF2122/97
ccgauccgcacagca

SEQ ID NO: 1218098 - RNA, 21 nt, Mycobacterium bovis subsp bovis AF2122/97
ccgauagcgaccgcggccccg

SEQ ID NO: 1218099 - RNA, 13 nt, Mycobacterium bovis subsp bovis AF2122/97
ccgaucaccaucc

SEQ ID NO: 1218100 - RNA, 14 nt, Mycobacterium bovis subsp bovis AF2122/97
ccgaucaccaucca

SEQ ID NO: 1218101 - RNA, 21 nt, Mycobacterium bovis subsp bovis AF2122/97
ccgaucaccauccagcccauc

SEQ ID NO: 1218102 - RNA, 22 nt, Mycobacterium bovis subsp bovis AF2122/97
ccgaucaccccggucggcccgc

SEQ ID NO: 1218103 - RNA, 15 nt, Mycobacterium bovis subsp bovis AF2122/97
ccgauaccgccggcc

SEQ ID NO: 1218104 - RNA, 19 nt, Mycobacterium bovis subsp bovis AF2122/97
ccgauaccggcggcgagcg

SEQ ID NO: 1218105 - RNA, 19 nt, Mycobacterium bovis subsp bovis AF2122/97
ccgauagacgugucauccc

SEQ ID NO: 1218106 - RNA, 20 nt, Mycobacterium bovis subsp bovis AF2122/97
ccgaugaccagggucugcuc

SEQ ID NO: 1218107 - RNA, 15 nt, Mycobacterium bovis subsp bovis AF2122/97
ccgaugaccugcccg

SEQ ID NO: 1218108 - RNA, 18 nt, Mycobacterium bovis subsp bovis AF2122/97
ccgaugaucucacccagc

SEQ ID NO: 1218109 - RNA, 19 nt, Mycobacterium bovis subsp bovis AF2122/97
ccgaugauggacaccagcc

SEQ ID NO: 1218110 - RNA, 18 nt, Mycobacterium bovis subsp bovis AF2122/97
ccgaugccgacggcgccc

SEQ ID NO: 1218111 - RNA, 22 nt, Mycobacterium bovis subsp bovis AF2122/97
ccgaugauggacaccagccaga

SEQ ID NO: 1218112 - RNA, 21 nt, Mycobacterium bovis subsp bovis AF2122/97
ccgaugauguuuuccccgccc

SEQ ID NO: 1218113 - RNA, 14 nt, Mycobacterium bovis subsp bovis AF2122/97
ccgaucggcaaccc

SEQ ID NO: 1218114 - RNA, 18 nt, Mycobacterium bovis subsp bovis AF2122/97
ccgaucgcggcggccucc

SEQ ID NO: 1218115 - RNA, 18 nt, Mycobacterium bovis subsp bovis AF2122/97
ccgaucgaacagugccug

SEQ ID NO: 1218116 - RNA, 21 nt, Mycobacterium bovis subsp bovis AF2122/97
ccgaucgaaccgcugcuccuc

SEQ ID NO: 1218117 - RNA, 16 nt, Mycobacterium bovis subsp bovis AF2122/97
ccgauccugcccacca

SEQ ID NO: 1218118 - RNA, 19 nt, Mycobacterium bovis subsp bovis AF2122/97
ccgauccugcccaccaucc

SEQ ID NO: 1218119 - RNA, 20 nt, Mycobacterium bovis subsp bovis AF2122/97
ccgaucuggaugucccaugc

SEQ ID NO: 1218120 - RNA, 23 nt, Mycobacterium bovis subsp bovis AF2122/97
ccgaucuggaugucccaugcacg

SEQ ID NO: 1218121 - RNA, 19 nt, Mycobacterium bovis subsp bovis AF2122/97
ccgaucuucgcgcgcucaa

SEQ ID NO: 1218122 - RNA, 21 nt, Mycobacterium bovis subsp bovis AF2122/97
ccgaugcgccggaccagcucc

SEQ ID NO: 1218123 - RNA, 15 nt, Mycobacterium bovis subsp bovis AF2122/97
ccgaugcugccgccg

SEQ ID NO: 1218124 - RNA, 18 nt, Mycobacterium bovis subsp bovis AF2122/97
ccgaugcugccgccgccg

SEQ ID NO: 1218125 - RNA, 22 nt, Mycobacterium bovis subsp bovis AF2122/97
ccgaugcugccgccgccgccgg

SEQ ID NO: 1218126 - RNA, 23 nt, Mycobacterium bovis subsp bovis AF2122/97
ccgauggauuggcgucagcagca

SEQ ID NO: 1218127 - RNA, 17 nt, Mycobacterium bovis subsp bovis AF2122/97
ccgauggcgucgccggc

SEQ ID NO: 1218128 - RNA, 21 nt, Mycobacterium bovis subsp bovis AF2122/97
ccgauggcgucgccggccccg

SEQ ID NO: 1218129 - RNA, 16 nt, Mycobacterium bovis subsp bovis AF2122/97
ccgaugcgcagugcac

SEQ ID NO: 1218130 - RNA, 16 nt, Mycobacterium bovis subsp bovis AF2122/97
ccgauggcuaccuugg

SEQ ID NO: 1218131 - RNA, 19 nt, Mycobacterium bovis subsp bovis AF2122/97
ccgauggcucaccagcucc

SEQ ID NO: 1218132 - RNA, 16 nt, Mycobacterium bovis subsp bovis AF2122/97
ccgaugguacccgcgc

SEQ ID NO: 1218133 - RNA, 18 nt, Mycobacterium bovis subsp bovis AF2122/97
ccgaugguacccgcgccg

SEQ ID NO: 1218134 - RNA, 22 nt, Mycobacterium bovis subsp bovis AF2122/97
ccgauggugaugggggagccgg

SEQ ID NO: 1218135 - RNA, 20 nt, Mycobacterium bovis subsp bovis AF2122/97
ccgauggugccgacccgccg

SEQ ID NO: 1218136 - RNA, 17 nt, Mycobacterium bovis subsp bovis AF2122/97
ccgcaacagcucggcca

SEQ ID NO: 1218137 - RNA, 22 nt, Mycobacterium bovis subsp bovis AF2122/97
ccgcaacagcucggccaggcug

SEQ ID NO: 1218138 - RNA, 18 nt, Mycobacterium bovis subsp bovis AF2122/97
ccgcaacaccccccgucc

SEQ ID NO: 1218139 - RNA, 23 nt, Mycobacterium bovis subsp bovis AF2122/97
ccgcaacucgccgaaaucggcca

SEQ ID NO: 1218140 - RNA, 18 nt, Mycobacterium bovis subsp bovis AF2122/97
ccgcaacgcuucggcagc

SEQ ID NO: 1218141 - RNA, 15 nt, Mycobacterium bovis subsp bovis AF2122/97
ccgcacgaccagcug

SEQ ID NO: 1218142 - RNA, 15 nt, Mycobacterium bovis subsp bovis AF2122/97
ccgcacgccgaccag

SEQ ID NO: 1218143 - RNA, 15 nt, Mycobacterium bovis subsp bovis AF2122/97
ccgcacgccgaccgg

SEQ ID NO: 1218144 - RNA, 13 nt, Mycobacterium bovis subsp bovis AF2122/97
ccgcacgccggca

SEQ ID NO: 1218145 - RNA, 23 nt, Mycobacterium bovis subsp bovis AF2122/97
ccgcacgcaaugcgggcccucua

SEQ ID NO: 1218146 - RNA, 18 nt, Mycobacterium bovis subsp bovis AF2122/97
ccgcacgauggccgucga

SEQ ID NO: 1218147 - RNA, 22 nt, Mycobacterium bovis subsp bovis AF2122/97
ccgcacggaggcggaccaggcc

SEQ ID NO: 1218148 - RNA, 17 nt, Mycobacterium bovis subsp bovis AF2122/97
ccgcacgcacggcgugu

SEQ ID NO: 1218149 - RNA, 16 nt, Mycobacterium bovis subsp bovis AF2122/97
ccgcacgccggccagc

SEQ ID NO: 1218150 - RNA, 18 nt, Mycobacterium bovis subsp bovis AF2122/97
ccgcacgguugccgucag

SEQ ID NO: 1218151 - RNA, 13 nt, Mycobacterium bovis subsp bovis AF2122/97
ccgcagcaccguc

SEQ ID NO: 1218152 - RNA, 15 nt, Mycobacterium bovis subsp bovis AF2122/97
ccgcagcaccgucgg

SEQ ID NO: 1218153 - RNA, 17 nt, Mycobacterium bovis subsp bovis AF2122/97
ccgcagcaccgucgggc

SEQ ID NO: 1218154 - RNA, 12 nt, Mycobacterium bovis subsp bovis AF2122/97
ccgcacccgucc

SEQ ID NO: 1218155 - RNA, 14 nt, Mycobacterium bovis subsp bovis AF2122/97
ccgcacccggccgc

SEQ ID NO: 1218156 - RNA, 21 nt, Mycobacterium bovis subsp bovis AF2122/97
ccgcaccggaucaccgcgccc

SEQ ID NO: 1218157 - RNA, 17 nt, Mycobacterium bovis subsp bovis AF2122/97
ccgcaccggaucggcua

SEQ ID NO: 1218158 - RNA, 17 nt, Mycobacterium bovis subsp bovis AF2122/97
ccgcacccguugcuccc

SEQ ID NO: 1218159 - RNA, 15 nt, Mycobacterium bovis subsp bovis AF2122/97
ccgcaccgcugaccc

SEQ ID NO: 1218160 - RNA, 23 nt, Mycobacterium bovis subsp bovis AF2122/97
ccgcaccgcgguacgccggucgg

SEQ ID NO: 1218161 - RNA, 20 nt, Mycobacterium bovis subsp bovis AF2122/97
ccgcaccuacccugcgcguu

SEQ ID NO: 1218162 - RNA, 20 nt, Mycobacterium bovis subsp bovis AF2122/97
ccgcaccggugacgcacagc

SEQ ID NO: 1218163 - RNA, 17 nt, Mycobacterium bovis subsp bovis AF2122/97
ccgagggcgucgccgcc

SEQ ID NO: 1218164 - RNA, 20 nt, Mycobacterium bovis subsp bovis AF2122/97
ccgagggcgccgggggcgcc

SEQ ID NO: 1218165 - RNA, 19 nt, Mycobacterium bovis subsp bovis AF2122/97
ccgagggcuugcaccugca

SEQ ID NO: 1218166 - RNA, 13 nt, Mycobacterium bovis subsp bovis AF2122/97
ccgagggucgggc

SEQ ID NO: 1218167 - RNA, 17 nt, Mycobacterium bovis subsp bovis AF2122/97
ccgaggcucgggccgca

SEQ ID NO: 1218168 - RNA, 16 nt, Mycobacterium bovis subsp bovis AF2122/97
ccgaggcuggcauccc

SEQ ID NO: 1218169 - RNA, 18 nt, Mycobacterium bovis subsp bovis AF2122/97
ccgagggaacggugcaca

SEQ ID NO: 1218170 - RNA, 14 nt, Mycobacterium bovis subsp bovis AF2122/97
ccgaggcgcccaac

SEQ ID NO: 1218171 - RNA, 22 nt, Mycobacterium bovis subsp bovis AF2122/97
ccgaggauguugugccgaucgg

SEQ ID NO: 1218172 - RNA, 21 nt, Mycobacterium bovis subsp bovis AF2122/97
ccgaggacacauugaccaggu

SEQ ID NO: 1218173 - RNA, 23 nt, Mycobacterium bovis subsp bovis AF2122/97
ccgaggcagacacgagucgccag

SEQ ID NO: 1218174 - RNA, 14 nt, Mycobacterium bovis subsp bovis AF2122/97
ccgaggagggccgc

SEQ ID NO: 1218175 - RNA, 18 nt, Mycobacterium bovis subsp bovis AF2122/97
ccgaggccaugcucgcca

SEQ ID NO: 1218176 - RNA, 15 nt, Mycobacterium bovis subsp bovis AF2122/97
ccgaggccgccgaga

SEQ ID NO: 1218177 - RNA, 20 nt, Mycobacterium bovis subsp bovis AF2122/97
ccgaggccgccaucgccgcc

SEQ ID NO: 1218178 - RNA, 13 nt, Mycobacterium bovis subsp bovis AF2122/97
ccgaggccgucgc

SEQ ID NO: 1218179 - RNA, 16 nt, Mycobacterium bovis subsp bovis AF2122/97
ccgaggccugacugaa

SEQ ID NO: 1218180 - RNA, 16 nt, Mycobacterium bovis subsp bovis AF2122/97
ccgaggacgccggcgc

SEQ ID NO: 1218181 - RNA, 18 nt, Mycobacterium bovis subsp bovis AF2122/97
ccgaggaaguccagcugg

SEQ ID NO: 1218182 - RNA, 12 nt, Mycobacterium bovis subsp bovis AF2122/97
ccgagcuucagc

SEQ ID NO: 1218183 - RNA, 23 nt, Mycobacterium bovis subsp bovis AF2122/97
ccgagcuucagcgcgcugcagug

SEQ ID NO: 1218184 - RNA, 22 nt, Mycobacterium bovis subsp bovis AF2122/97
ccgagcuugagcgugagcgccg

SEQ ID NO: 1218185 - RNA, 22 nt, Mycobacterium bovis subsp bovis AF2122/97
ccgagcuuggccgccgccaccu

SEQ ID NO: 1218186 - RNA, 22 nt, Mycobacterium bovis subsp bovis AF2122/97
ccgagcuugggccggugcagca

SEQ ID NO: 1218187 - RNA, 18 nt, Mycobacterium bovis subsp bovis AF2122/97
ccgagcuugucgagcagg

SEQ ID NO: 1218188 - RNA, 19 nt, Mycobacterium bovis subsp bovis AF2122/97
ccgagcuugucgagcaggc

SEQ ID NO: 1218189 - RNA, 17 nt, Mycobacterium bovis subsp bovis AF2122/97
ccgagucucgucgggua

SEQ ID NO: 1218190 - RNA, 18 nt, Mycobacterium bovis subsp bovis AF2122/97
ccgaggugccggggcccc

SEQ ID NO: 1218191 - RNA, 20 nt, Mycobacterium bovis subsp bovis AF2122/97
ccgaggucgguucggccgga

SEQ ID NO: 1218192 - RNA, 23 nt, Mycobacterium bovis subsp bovis AF2122/97
ccgaggucuccggugcgcagcca

SEQ ID NO: 1218193 - RNA, 22 nt, Mycobacterium bovis subsp bovis AF2122/97
ccgaguagaagauggcaccgcc

SEQ ID NO: 1218194 - RNA, 23 nt, Mycobacterium bovis subsp bovis AF2122/97
ccgaguauuggucggugggguau

SEQ ID NO: 1218195 - RNA, 16 nt, Mycobacterium bovis subsp bovis AF2122/97
ccgagugcggugugug

SEQ ID NO: 1218196 - RNA, 22 nt, Mycobacterium bovis subsp bovis AF2122/97
ccgagugcggugugugcaagcc

SEQ ID NO: 1218197 - RNA, 18 nt, Mycobacterium bovis subsp bovis AF2122/97
ccgaguuucugaagcccg

SEQ ID NO: 1218198 - RNA, 22 nt, Mycobacterium bovis subsp bovis AF2122/97
ccgaguugucgccggaguucug

SEQ ID NO: 1218199 - RNA, 20 nt, Mycobacterium bovis subsp bovis AF2122/97
ccgaguuguggacgcccgag

SEQ ID NO: 1218200 - RNA, 18 nt, Mycobacterium bovis subsp bovis AF2122/97
ccgaguucgucagcggcc

SEQ ID NO: 1218201 - RNA, 18 nt, Mycobacterium bovis subsp bovis AF2122/97
ccgaguugaacguucccu

SEQ ID NO: 1218202 - RNA, 17 nt, Mycobacterium bovis subsp bovis AF2122/97
ccgaguugcccucuggc

SEQ ID NO: 1218203 - RNA, 17 nt, Mycobacterium bovis subsp bovis AF2122/97
ccgauaacacccgggcc

SEQ ID NO: 1218204 - RNA, 19 nt, Mycobacterium bovis subsp bovis AF2122/97
ccgagaugcuggucggcga

SEQ ID NO: 1218205 - RNA, 20 nt, Mycobacterium bovis subsp bovis AF2122/97
ccgagaugcuggucggcgau

SEQ ID NO: 1218206 - RNA, 16 nt, Mycobacterium bovis subsp bovis AF2122/97
ccgagauuggugcaga

SEQ ID NO: 1218207 - RNA, 20 nt, Mycobacterium bovis subsp bovis AF2122/97
ccgagcaaacauccacccgc

SEQ ID NO: 1218208 - RNA, 18 nt, Mycobacterium bovis subsp bovis AF2122/97
ccgagccggugccacugc

SEQ ID NO: 1218209 - RNA, 18 nt, Mycobacterium bovis subsp bovis AF2122/97
ccgagcgaccgucccagc

SEQ ID NO: 1218210 - RNA, 17 nt, Mycobacterium bovis subsp bovis AF2122/97
ccgagcgcaacucccag

SEQ ID NO: 1218211 - RNA, 14 nt, Mycobacterium bovis subsp bovis AF2122/97
ccgagccucgcucu

SEQ ID NO: 1218212 - RNA, 16 nt, Mycobacterium bovis subsp bovis AF2122/97
ccgagccuugagcgcg

SEQ ID NO: 1218213 - RNA, 20 nt, Mycobacterium bovis subsp bovis AF2122/97
ccgagcgcgccgaaggccgc

SEQ ID NO: 1218214 - RNA, 13 nt, Mycobacterium bovis subsp bovis AF2122/97
ccgagcggcggca

SEQ ID NO: 1218215 - RNA, 18 nt, Mycobacterium bovis subsp bovis AF2122/97
ccgagcggcugagccgca

SEQ ID NO: 1218216 - RNA, 16 nt, Mycobacterium bovis subsp bovis AF2122/97
ccgagcggagccgccg

SEQ ID NO: 1218217 - RNA, 17 nt, Mycobacterium bovis subsp bovis AF2122/97
ccgagcggagccgccga

SEQ ID NO: 1218218 - RNA, 20 nt, Mycobacterium bovis subsp bovis AF2122/97
ccgagcgcuugaccccgccg

SEQ ID NO: 1218219 - RNA, 22 nt, Mycobacterium bovis subsp bovis AF2122/97
ccgagcggaccaccgcucgcca

SEQ ID NO: 1218220 - RNA, 15 nt, Mycobacterium bovis subsp bovis AF2122/97
ccgagacgucggcgu

SEQ ID NO: 1218221 - RNA, 18 nt, Mycobacterium bovis subsp bovis AF2122/97
ccgagaccacgcgcgucg

SEQ ID NO: 1218222 - RNA, 23 nt, Mycobacterium bovis subsp bovis AF2122/97
ccgagacgccccauucguauccc

SEQ ID NO: 1218223 - RNA, 16 nt, Mycobacterium bovis subsp bovis AF2122/97
ccgagaucggacaggu

SEQ ID NO: 1218224 - RNA, 15 nt, Mycobacterium bovis subsp bovis AF2122/97
ccgagaucccagcgg

SEQ ID NO: 1218225 - RNA, 19 nt, Mycobacterium bovis subsp bovis AF2122/97
ccgagaucaccgccaccac

SEQ ID NO: 1218226 - RNA, 22 nt, Mycobacterium bovis subsp bovis AF2122/97
ccgagauagcaacgaagccggc

SEQ ID NO: 1218227 - RNA, 16 nt, Mycobacterium bovis subsp bovis AF2122/97
ccgagacaccacguug

SEQ ID NO: 1218228 - RNA, 21 nt, Mycobacterium bovis subsp bovis AF2122/97
ccgagaccgggcaacggcggg

SEQ ID NO: 1218229 - RNA, 21 nt, Mycobacterium bovis subsp bovis AF2122/97
ccgacuucgucaaccaccagg

SEQ ID NO: 1218230 - RNA, 15 nt, Mycobacterium bovis subsp bovis AF2122/97
ccgacuucuccaggc

SEQ ID NO: 1218231 - RNA, 16 nt, Mycobacterium bovis subsp bovis AF2122/97
ccgacuucuccaggcu

SEQ ID NO: 1218232 - RNA, 15 nt, Mycobacterium bovis subsp bovis AF2122/97
ccgacuucaagacag

SEQ ID NO: 1218233 - RNA, 17 nt, Mycobacterium bovis subsp bovis AF2122/97
ccgacuguagaaaaccc

SEQ ID NO: 1218234 - RNA, 21 nt, Mycobacterium bovis subsp bovis AF2122/97
ccgacuuccgcgucgccggcc

SEQ ID NO: 1218235 - RNA, 23 nt, Mycobacterium bovis subsp bovis AF2122/97
ccgacuccggcaggcccgacggc

SEQ ID NO: 1218236 - RNA, 19 nt, Mycobacterium bovis subsp bovis AF2122/97
ccgacucggcaccgcggcc

SEQ ID NO: 1218237 - RNA, 21 nt, Mycobacterium bovis subsp bovis AF2122/97
ccgacucgucggccugguacu

SEQ ID NO: 1218238 - RNA, 18 nt, Mycobacterium bovis subsp bovis AF2122/97
ccgacuggccccgccagc

SEQ ID NO: 1218239 - RNA, 21 nt, Mycobacterium bovis subsp bovis AF2122/97
ccgacuggccccgccagcggc

SEQ ID NO: 1218240 - RNA, 19 nt, Mycobacterium bovis subsp bovis AF2122/97
ccgacugggcgcgacccca

SEQ ID NO: 1218241 - RNA, 21 nt, Mycobacterium bovis subsp bovis AF2122/97
ccgacugggcgcgaccccagg

SEQ ID NO: 1218242 - RNA, 16 nt, Mycobacterium bovis subsp bovis AF2122/97
ccgacgucgccgacgg

SEQ ID NO: 1218243 - RNA, 18 nt, Mycobacterium bovis subsp bovis AF2122/97
ccgacguauagaccaggu

SEQ ID NO: 1218244 - RNA, 23 nt, Mycobacterium bovis subsp bovis AF2122/97
ccgacgucaggcagcuccgccgc

SEQ ID NO: 1218245 - RNA, 20 nt, Mycobacterium bovis subsp bovis AF2122/97
ccgacguacaggacgguuga

SEQ ID NO: 1218246 - RNA, 16 nt, Mycobacterium bovis subsp bovis AF2122/97
ccgacuaucggccgcc

SEQ ID NO: 1218247 - RNA, 18 nt, Mycobacterium bovis subsp bovis AF2122/97
ccgacguugcuggcuggg

SEQ ID NO: 1218248 - RNA, 20 nt, Mycobacterium bovis subsp bovis AF2122/97
ccgacuccccgccgggcaau

SEQ ID NO: 1218249 - RNA, 15 nt, Mycobacterium bovis subsp bovis AF2122/97
ccgacucaucggccg

SEQ ID NO: 1218250 - RNA, 14 nt, Mycobacterium bovis subsp bovis AF2122/97
ccgacuccaguucg

SEQ ID NO: 1218251 - RNA, 13 nt, Mycobacterium bovis subsp bovis AF2122/97
ccgacugccgcgg

SEQ ID NO: 1218252 - RNA, 18 nt, Mycobacterium bovis subsp bovis AF2122/97
ccgacugccguucagcgg

SEQ ID NO: 1218253 - RNA, 18 nt, Mycobacterium bovis subsp bovis AF2122/97
ccgacggaaugucagccg

SEQ ID NO: 1218254 - RNA, 18 nt, Mycobacterium bovis subsp bovis AF2122/97
ccgacggacuucccgcgc

SEQ ID NO: 1218255 - RNA, 13 nt, Mycobacterium bovis subsp bovis AF2122/97
aaaccacccccac

SEQ ID NO: 1218256 - RNA, 17 nt, Mycobacterium bovis subsp bovis AF2122/97
aaaccacccgcaacaca

SEQ ID NO: 1218257 - RNA, 16 nt, Mycobacterium bovis subsp bovis AF2122/97
ccgacgcggucggcgg

SEQ ID NO: 1218258 - RNA, 20 nt, Mycobacterium bovis subsp bovis AF2122/97
ccgacgcguccggugcacca

SEQ ID NO: 1218259 - RNA, 13 nt, Mycobacterium bovis subsp bovis AF2122/97
ccgacggccagca

SEQ ID NO: 1218260 - RNA, 15 nt, Mycobacterium bovis subsp bovis AF2122/97
ccgacggccagcagg

SEQ ID NO: 1218261 - RNA, 22 nt, Mycobacterium bovis subsp bovis AF2122/97
ccgacggggaugggggagccgg

SEQ ID NO: 1218262 - RNA, 16 nt, Mycobacterium bovis subsp bovis AF2122/97
ccgacgggggucgggc

SEQ ID NO: 1218263 - RNA, 20 nt, Mycobacterium bovis subsp bovis AF2122/97
ccgacgggacaaggucaucg

SEQ ID NO: 1218264 - RNA, 22 nt, Mycobacterium bovis subsp bovis AF2122/97
ccgacggguaucccgucccagc

SEQ ID NO: 1218265 - RNA, 16 nt, Mycobacterium bovis subsp bovis AF2122/97
ccgacggcgcccagcg

SEQ ID NO: 1218266 - RNA, 20 nt, Mycobacterium bovis subsp bovis AF2122/97
ccgacgggccgucgccgucc

SEQ ID NO: 1218267 - RNA, 19 nt, Mycobacterium bovis subsp bovis AF2122/97
ccgacggugaaccaccacu

SEQ ID NO: 1218268 - RNA, 19 nt, Mycobacterium bovis subsp bovis AF2122/97
cccugcgccucggcggcca

SEQ ID NO: 1218269 - RNA, 17 nt, Mycobacterium bovis subsp bovis AF2122/97
cccugcgcggccaccuc

SEQ ID NO: 1218270 - RNA, 13 nt, Mycobacterium bovis subsp bovis AF2122/97
cccuggacuucgg

SEQ ID NO: 1218271 - RNA, 17 nt, Mycobacterium bovis subsp bovis AF2122/97
cccuggaaugccgccac

SEQ ID NO: 1218272 - RNA, 17 nt, Mycobacterium bovis subsp bovis AF2122/97
cccuggacauaccggcc

SEQ ID NO: 1218273 - RNA, 20 nt, Mycobacterium bovis subsp bovis AF2122/97
cccuggaccagcgggcggcc

SEQ ID NO: 1218274 - RNA, 15 nt, Mycobacterium bovis subsp bovis AF2122/97
cccuggccgccggcg

SEQ ID NO: 1218275 - RNA, 20 nt, Mycobacterium bovis subsp bovis AF2122/97
cccuggccgccggcgccgcc

SEQ ID NO: 1218276 - RNA, 17 nt, Mycobacterium bovis subsp bovis AF2122/97
cccuggcggcccggguu

SEQ ID NO: 1218277 - RNA, 14 nt, Mycobacterium bovis subsp bovis AF2122/97
cccuggccgcccag

SEQ ID NO: 1218278 - RNA, 14 nt, Mycobacterium bovis subsp bovis AF2122/97
cccuggccgccggc

SEQ ID NO: 1218279 - RNA, 14 nt, Mycobacterium bovis subsp bovis AF2122/97
cccuggccagcaga

SEQ ID NO: 1218280 - RNA, 20 nt, Mycobacterium bovis subsp bovis AF2122/97
cccuggccgccggccccgcc

SEQ ID NO: 1218281 - RNA, 20 nt, Mycobacterium bovis subsp bovis AF2122/97
cccuggauggcgcccugcgc

SEQ ID NO: 1218282 - RNA, 15 nt, Mycobacterium bovis subsp bovis AF2122/97
cccugcgcagccgcc

SEQ ID NO: 1218283 - RNA, 16 nt, Mycobacterium bovis subsp bovis AF2122/97
cccugcauaggcgcgg

SEQ ID NO: 1218284 - RNA, 14 nt, Mycobacterium bovis subsp bovis AF2122/97
cccugcacccagcc

SEQ ID NO: 1218285 - RNA, 18 nt, Mycobacterium bovis subsp bovis AF2122/97
cccugcacccagccgugc

SEQ ID NO: 1218286 - RNA, 11 nt, Mycobacterium bovis subsp bovis AF2122/97
cccgucggcgg

SEQ ID NO: 1218287 - RNA, 13 nt, Mycobacterium bovis subsp bovis AF2122/97
cccugcacagcag

SEQ ID NO: 1218288 - RNA, 15 nt, Mycobacterium bovis subsp bovis AF2122/97
cccugcacagcaggc

SEQ ID NO: 1218289 - RNA, 15 nt, Mycobacterium bovis subsp bovis AF2122/97
cccugcacggugccc

SEQ ID NO: 1218290 - RNA, 22 nt, Mycobacterium bovis subsp bovis AF2122/97
cccugcacggugcccagggcga

SEQ ID NO: 1218291 - RNA, 13 nt, Mycobacterium bovis subsp bovis AF2122/97
cccgucgcggccg

SEQ ID NO: 1218292 - RNA, 18 nt, Mycobacterium bovis subsp bovis AF2122/97
cccgucgaguagguaacg

SEQ ID NO: 1218293 - RNA, 19 nt, Mycobacterium bovis subsp bovis AF2122/97
cccgucgaucagcggcagc

SEQ ID NO: 1218294 - RNA, 18 nt, Mycobacterium bovis subsp bovis AF2122/97
cccgucgccaaucugcgc

SEQ ID NO: 1218295 - RNA, 14 nt, Mycobacterium bovis subsp bovis AF2122/97
cccgucgagcagca

SEQ ID NO: 1218296 - RNA, 13 nt, Mycobacterium bovis subsp bovis AF2122/97
cccguccgcgccc

SEQ ID NO: 1218297 - RNA, 19 nt, Mycobacterium bovis subsp bovis AF2122/97
cccguccgcgcccaccggc

SEQ ID NO: 1218298 - RNA, 14 nt, Mycobacterium bovis subsp bovis AF2122/97
cccuucgcggugug

SEQ ID NO: 1218299 - RNA, 20 nt, Mycobacterium bovis subsp bovis AF2122/97
cccuucgcgagcagacgcgg

SEQ ID NO: 1218300 - RNA, 16 nt, Mycobacterium bovis subsp bovis AF2122/97
cccugugucgccgucg

SEQ ID NO: 1218301 - RNA, 14 nt, Mycobacterium bovis subsp bovis AF2122/97
cccugugccagcag

SEQ ID NO: 1218302 - RNA, 22 nt, Mycobacterium bovis subsp bovis AF2122/97
cccuguugcagaaaacccucgc

SEQ ID NO: 1218303 - RNA, 19 nt, Mycobacterium bovis subsp bovis AF2122/97
cccugucauguccugggcc

SEQ ID NO: 1218304 - RNA, 20 nt, Mycobacterium bovis subsp bovis AF2122/97
cccuugccgcagaaucccaa

SEQ ID NO: 1218305 - RNA, 20 nt, Mycobacterium bovis subsp bovis AF2122/97
cccuugccgccggccccgcc

SEQ ID NO: 1218306 - RNA, 21 nt, Mycobacterium bovis subsp bovis AF2122/97
cccuugccgccggccccgccg

SEQ ID NO: 1218307 - RNA, 16 nt, Mycobacterium bovis subsp bovis AF2122/97
cccuugccgccuuggc

SEQ ID NO: 1218308 - RNA, 16 nt, Mycobacterium bovis subsp bovis AF2122/97
cccuugaccgcugccc

SEQ ID NO: 1218309 - RNA, 16 nt, Mycobacterium bovis subsp bovis AF2122/97
cccuugacggugagau

SEQ ID NO: 1218310 - RNA, 13 nt, Mycobacterium bovis subsp bovis AF2122/97
cccuucgucacau

SEQ ID NO: 1218311 - RNA, 22 nt, Mycobacterium bovis subsp bovis AF2122/97
cccuuguggucugccagcaccc

SEQ ID NO: 1218312 - RNA, 19 nt, Mycobacterium bovis subsp bovis AF2122/97
cccuuguucccgaaacccg

SEQ ID NO: 1218313 - RNA, 14 nt, Mycobacterium bovis subsp bovis AF2122/97
cccuuuacaccccc

SEQ ID NO: 1218314 - RNA, 21 nt, Mycobacterium bovis subsp bovis AF2122/97
ccgaacagcugcccgccagcg

SEQ ID NO: 1218315 - RNA, 19 nt, Mycobacterium bovis subsp bovis AF2122/97
ccgaacaccggcuccagca

SEQ ID NO: 1218316 - RNA, 11 nt, Mycobacterium bovis subsp bovis AF2122/97
ccgaacaccgu

SEQ ID NO: 1218317 - RNA, 12 nt, Mycobacterium bovis subsp bovis AF2122/97
ccgaacagcugg

SEQ ID NO: 1218318 - RNA, 19 nt, Mycobacterium bovis subsp bovis AF2122/97
ccgaacauccgccgccccc

SEQ ID NO: 1218319 - RNA, 18 nt, Mycobacterium bovis subsp bovis AF2122/97
ccgaacaacaucacugcc

SEQ ID NO: 1218320 - RNA, 20 nt, Mycobacterium bovis subsp bovis AF2122/97
ccgaacaacaucacugccuu

SEQ ID NO: 1218321 - RNA, 17 nt, Mycobacterium bovis subsp bovis AF2122/97
ccgaacaauuucugcag

SEQ ID NO: 1218322 - RNA, 11 nt, Mycobacterium bovis subsp bovis AF2122/97
ccgaacaccga

SEQ ID NO: 1218323 - RNA, 22 nt, Mycobacterium bovis subsp bovis AF2122/97
ccgaacaccgagugcggugugu

SEQ ID NO: 1218324 - RNA, 17 nt, Mycobacterium bovis subsp bovis AF2122/97
cccuuugcacgguggca

SEQ ID NO: 1218325 - RNA, 20 nt, Mycobacterium bovis subsp bovis AF2122/97
cccuuuggguagcaaacccc

SEQ ID NO: 1218326 - RNA, 15 nt, Mycobacterium bovis subsp bovis AF2122/97
ccgaacgccucugcg

SEQ ID NO: 1218327 - RNA, 21 nt, Mycobacterium bovis subsp bovis AF2122/97
ccgaacgacggguccgggcca

SEQ ID NO: 1218328 - RNA, 15 nt, Mycobacterium bovis subsp bovis AF2122/97
ccgaacgccaccacc

SEQ ID NO: 1218329 - RNA, 21 nt, Mycobacterium bovis subsp bovis AF2122/97
ccgaacgacccuggccuuuga

SEQ ID NO: 1218330 - RNA, 16 nt, Mycobacterium bovis subsp bovis AF2122/97
ccgaaccugcggcagc

SEQ ID NO: 1218331 - RNA, 19 nt, Mycobacterium bovis subsp bovis AF2122/97
ccgaaccggcaccagcggc

SEQ ID NO: 1218332 - RNA, 16 nt, Mycobacterium bovis subsp bovis AF2122/97
ccgaaccggcaccagc

SEQ ID NO: 1218333 - RNA, 15 nt, Mycobacterium bovis subsp bovis AF2122/97
ccgaacccgccaccg

SEQ ID NO: 1218334 - RNA, 20 nt, Mycobacterium bovis subsp bovis AF2122/97
ccgaaccaccuguccggugg

SEQ ID NO: 1218335 - RNA, 18 nt, Mycobacterium bovis subsp bovis AF2122/97
ccgaaguacuggccgccg

SEQ ID NO: 1218336 - RNA, 18 nt, Mycobacterium bovis subsp bovis AF2122/97
ccgaaguagaagcccagg

SEQ ID NO: 1218337 - RNA, 12 nt, Mycobacterium bovis subsp bovis AF2122/97
ccgaaguugaag

SEQ ID NO: 1218338 - RNA, 14 nt, Mycobacterium bovis subsp bovis AF2122/97
ccgaacugggcgau

SEQ ID NO: 1218339 - RNA, 18 nt, Mycobacterium bovis subsp bovis AF2122/97
ccgaacuugcggaccugg

SEQ ID NO: 1218340 - RNA, 22 nt, Mycobacterium bovis subsp bovis AF2122/97
ccgaagaaaacgaacccacugc

SEQ ID NO: 1218341 - RNA, 12 nt, Mycobacterium bovis subsp bovis AF2122/97
ccgaagcugccc

SEQ ID NO: 1218342 - RNA, 17 nt, Mycobacterium bovis subsp bovis AF2122/97
ccgacaacccggccggg

SEQ ID NO: 1218343 - RNA, 18 nt, Mycobacterium bovis subsp bovis AF2122/97
ccgacaagaauggccgcc

SEQ ID NO: 1218344 - RNA, 20 nt, Mycobacterium bovis subsp bovis AF2122/97
ccgacaccaccggcgccgcc

SEQ ID NO: 1218345 - RNA, 14 nt, Mycobacterium bovis subsp bovis AF2122/97
ccgaauggccgccg

SEQ ID NO: 1218346 - RNA, 16 nt, Mycobacterium bovis subsp bovis AF2122/97
ccgaauuugucggcga

SEQ ID NO: 1218347 - RNA, 16 nt, Mycobacterium bovis subsp bovis AF2122/97
ccgacaaccccgccag

SEQ ID NO: 1218348 - RNA, 14 nt, Mycobacterium bovis subsp bovis AF2122/97
ccgacaccggcggc

SEQ ID NO: 1218349 - RNA, 15 nt, Mycobacterium bovis subsp bovis AF2122/97
ccgacaccggcggca

SEQ ID NO: 1218350 - RNA, 17 nt, Mycobacterium bovis subsp bovis AF2122/97
ccgacaccggcggcauc

SEQ ID NO: 1218351 - RNA, 17 nt, Mycobacterium bovis subsp bovis AF2122/97
ccgacaccaccaggucc

SEQ ID NO: 1218352 - RNA, 13 nt, Mycobacterium bovis subsp bovis AF2122/97
aaaccacagcgcc

SEQ ID NO: 1218353 - RNA, 18 nt, Mycobacterium bovis subsp bovis AF2122/97
ccgcgagcgccggccgcg

SEQ ID NO: 1218354 - RNA, 17 nt, Mycobacterium bovis subsp bovis AF2122/97
ccgcgaucgcggcaucg

SEQ ID NO: 1218355 - RNA, 23 nt, Mycobacterium bovis subsp bovis AF2122/97
ccgcgagcuuggccagcagcagc

SEQ ID NO: 1218356 - RNA, 14 nt, Mycobacterium bovis subsp bovis AF2122/97
ccgcgagcccggcc

SEQ ID NO: 1218357 - RNA, 13 nt, Mycobacterium bovis subsp bovis AF2122/97
ccgcgagcagcac

SEQ ID NO: 1218358 - RNA, 15 nt, Mycobacterium bovis subsp bovis AF2122/97
ccgcgacuuugccuu

SEQ ID NO: 1218359 - RNA, 17 nt, Mycobacterium bovis subsp bovis AF2122/97
ccgcgacggcacgauca

SEQ ID NO: 1218360 - RNA, 20 nt, Mycobacterium bovis subsp bovis AF2122/97
ccgcgagacgcaugucgggc

SEQ ID NO: 1218361 - RNA, 18 nt, Mycobacterium bovis subsp bovis AF2122/97
ccgcgagaucgggccggc

SEQ ID NO: 1218362 - RNA, 15 nt, Mycobacterium bovis subsp bovis AF2122/97
ccgcgacugcaccug

SEQ ID NO: 1218363 - RNA, 17 nt, Mycobacterium bovis subsp bovis AF2122/97
ccgcgacugcaccuggc

SEQ ID NO: 1218364 - RNA, 23 nt, Mycobacterium bovis subsp bovis AF2122/97
ccgcgacugcaccuggccgcccg

SEQ ID NO: 1218365 - RNA, 16 nt, Mycobacterium bovis subsp bovis AF2122/97
ccgcgacggcgccggc

SEQ ID NO: 1218366 - RNA, 15 nt, Mycobacterium bovis subsp bovis AF2122/97
ccgcgacgagcggcc

SEQ ID NO: 1218367 - RNA, 14 nt, Mycobacterium bovis subsp bovis AF2122/97
ccgcgaccgccucg

SEQ ID NO: 1218368 - RNA, 17 nt, Mycobacterium bovis subsp bovis AF2122/97
ccgcgaccgccucgccg

SEQ ID NO: 1218369 - RNA, 18 nt, Mycobacterium bovis subsp bovis AF2122/97
ccgcgaccucgcggcgcu

SEQ ID NO: 1218370 - RNA, 15 nt, Mycobacterium bovis subsp bovis AF2122/97
ccgcgaccucgcggc

SEQ ID NO: 1218371 - RNA, 21 nt, Mycobacterium bovis subsp bovis AF2122/97
ccgcgaccccugguagcaccc

SEQ ID NO: 1218372 - RNA, 12 nt, Mycobacterium bovis subsp bovis AF2122/97
ccgcgacccggc

SEQ ID NO: 1218373 - RNA, 21 nt, Mycobacterium bovis subsp bovis AF2122/97
ccgcgacccggcccagcgccc

SEQ ID NO: 1218374 - RNA, 16 nt, Mycobacterium bovis subsp bovis AF2122/97
ccgcgaccagcgccgc

SEQ ID NO: 1218375 - RNA, 21 nt, Mycobacterium bovis subsp bovis AF2122/97
ccgcgaccagcgccgcacccg

SEQ ID NO: 1218376 - RNA, 15 nt, Mycobacterium bovis subsp bovis AF2122/97
ccgcgaccagcuggc

SEQ ID NO: 1218377 - RNA, 20 nt, Mycobacterium bovis subsp bovis AF2122/97
ccgcgaccacgcaccgcccc

SEQ ID NO: 1218378 - RNA, 15 nt, Mycobacterium bovis subsp bovis AF2122/97
ccgcgacauccgcgg

SEQ ID NO: 1218379 - RNA, 20 nt, Mycobacterium bovis subsp bovis AF2122/97
ccgcgacauccgcggcaugc

SEQ ID NO: 1218380 - RNA, 17 nt, Mycobacterium bovis subsp bovis AF2122/97
ccgcgaaugcugugccg

SEQ ID NO: 1218381 - RNA, 23 nt, Mycobacterium bovis subsp bovis AF2122/97
ccgcgaauucggcauaacccugg

SEQ ID NO: 1218382 - RNA, 23 nt, Mycobacterium bovis subsp bovis AF2122/97
ccgcgaugacgaccgaucggcgc

SEQ ID NO: 1218383 - RNA, 20 nt, Mycobacterium bovis subsp bovis AF2122/97
ccgcgauucgcggcagccgg

SEQ ID NO: 1218384 - RNA, 15 nt, Mycobacterium bovis subsp bovis AF2122/97
ccgcgcaccgaccgc

SEQ ID NO: 1218385 - RNA, 19 nt, Mycobacterium bovis subsp bovis AF2122/97
ccgcgcaccgaccgcaccg

SEQ ID NO: 1218386 - RNA, 17 nt, Mycobacterium bovis subsp bovis AF2122/97
ccgcgcagauucccggc

SEQ ID NO: 1218387 - RNA, 13 nt, Mycobacterium bovis subsp bovis AF2122/97
ccgcgcacggcug

SEQ ID NO: 1218388 - RNA, 17 nt, Mycobacterium bovis subsp bovis AF2122/97
ccgcgcaucugucgcgc

SEQ ID NO: 1218389 - RNA, 17 nt, Mycobacterium bovis subsp bovis AF2122/97
ccgcgcaucaucgccca

SEQ ID NO: 1218390 - RNA, 13 nt, Mycobacterium bovis subsp bovis AF2122/97
ccgcgccagccuc

SEQ ID NO: 1218391 - RNA, 17 nt, Mycobacterium bovis subsp bovis AF2122/97
ccgcgccagccuccacc

SEQ ID NO: 1218392 - RNA, 20 nt, Mycobacterium bovis subsp bovis AF2122/97
ccgcgccagccuccaccagg

SEQ ID NO: 1218393 - RNA, 18 nt, Mycobacterium bovis subsp bovis AF2122/97
ccgcgcagcugccgcacc

SEQ ID NO: 1218394 - RNA, 20 nt, Mycobacterium bovis subsp bovis AF2122/97
ccgcgcagcacugcggcagc

SEQ ID NO: 1218395 - RNA, 13 nt, Mycobacterium bovis subsp bovis AF2122/97
ccgcgcagcugcc

SEQ ID NO: 1218396 - RNA, 17 nt, Mycobacterium bovis subsp bovis AF2122/97
ccgccugcgccgcccgc

SEQ ID NO: 1218397 - RNA, 15 nt, Mycobacterium bovis subsp bovis AF2122/97
ccgccugcccggccc

SEQ ID NO: 1218398 - RNA, 22 nt, Mycobacterium bovis subsp bovis AF2122/97
ccgccugccccacccgcggcgc

SEQ ID NO: 1218399 - RNA, 21 nt, Mycobacterium bovis subsp bovis AF2122/97
ccgccugcagguuuccggccu

SEQ ID NO: 1218400 - RNA, 16 nt, Mycobacterium bovis subsp bovis AF2122/97
ccgccugcccggcccg

SEQ ID NO: 1218401 - RNA, 17 nt, Mycobacterium bovis subsp bovis AF2122/97
ccgccugcccggcccgc

SEQ ID NO: 1218402 - RNA, 14 nt, Mycobacterium bovis subsp bovis AF2122/97
ccgccugccgacgg

SEQ ID NO: 1218403 - RNA, 20 nt, Mycobacterium bovis subsp bovis AF2122/97
ccgcagcggaacugggcccc

SEQ ID NO: 1218404 - RNA, 13 nt, Mycobacterium bovis subsp bovis AF2122/97
ccgcagcggccug

SEQ ID NO: 1218405 - RNA, 15 nt, Mycobacterium bovis subsp bovis AF2122/97
ccgccugaccgccac

SEQ ID NO: 1218406 - RNA, 17 nt, Mycobacterium bovis subsp bovis AF2122/97
ccgccugcaccgccgcc

SEQ ID NO: 1218407 - RNA, 20 nt, Mycobacterium bovis subsp bovis AF2122/97
ccgcagcccgugacugguga

SEQ ID NO: 1218408 - RNA, 23 nt, Mycobacterium bovis subsp bovis AF2122/97
ccgcagcaggugcaucgccacag

SEQ ID NO: 1218409 - RNA, 11 nt, Mycobacterium bovis subsp bovis AF2122/97
ccgcagcagca

SEQ ID NO: 1218410 - RNA, 13 nt, Mycobacterium bovis subsp bovis AF2122/97
ccgcagccagcgg

SEQ ID NO: 1218411 - RNA, 13 nt, Mycobacterium bovis subsp bovis AF2122/97
ccgccugggcggc

SEQ ID NO: 1218412 - RNA, 17 nt, Mycobacterium bovis subsp bovis AF2122/97
ccgccugggcggccagc

SEQ ID NO: 1218413 - RNA, 18 nt, Mycobacterium bovis subsp bovis AF2122/97
ccgccugggcggccagca

SEQ ID NO: 1218414 - RNA, 19 nt, Mycobacterium bovis subsp bovis AF2122/97
ccgccugugccgccggcgc

SEQ ID NO: 1218415 - RNA, 17 nt, Mycobacterium bovis subsp bovis AF2122/97
ccgccuuccuggcgggc

SEQ ID NO: 1218416 - RNA, 14 nt, Mycobacterium bovis subsp bovis AF2122/97
ccgccuucucccgc

SEQ ID NO: 1218417 - RNA, 13 nt, Mycobacterium bovis subsp bovis AF2122/97
ccgccuucuuggc

SEQ ID NO: 1218418 - RNA, 22 nt, Mycobacterium bovis subsp bovis AF2122/97
ccgccuucuuggcggccuuugu

SEQ ID NO: 1218419 - RNA, 16 nt, Mycobacterium bovis subsp bovis AF2122/97
ccgcgaacgcgacagc

SEQ ID NO: 1218420 - RNA, 14 nt, Mycobacterium bovis subsp bovis AF2122/97
ccgccuucuuggcg

SEQ ID NO: 1218421 - RNA, 14 nt, Mycobacterium bovis subsp bovis AF2122/97
ccgccuugaggccc

SEQ ID NO: 1218422 - RNA, 17 nt, Mycobacterium bovis subsp bovis AF2122/97
ccgccuuugccgccggc

SEQ ID NO: 1218423 - RNA, 14 nt, Mycobacterium bovis subsp bovis AF2122/97
ccgccuuugccccc

SEQ ID NO: 1218424 - RNA, 16 nt, Mycobacterium bovis subsp bovis AF2122/97
ccgccuuugccgccgg

SEQ ID NO: 1218425 - RNA, 14 nt, Mycobacterium bovis subsp bovis AF2122/97
ccgcgcccagaccg

SEQ ID NO: 1218426 - RNA, 13 nt, Mycobacterium bovis subsp bovis AF2122/97
ccgcgcccgccgc

SEQ ID NO: 1218427 - RNA, 12 nt, Mycobacterium bovis subsp bovis AF2122/97
ccgcgcccggcg

SEQ ID NO: 1218428 - RNA, 18 nt, Mycobacterium bovis subsp bovis AF2122/97
ccgcgccgaaucgcgggc

SEQ ID NO: 1218429 - RNA, 17 nt, Mycobacterium bovis subsp bovis AF2122/97
ccgcgccccgcggcaga

SEQ ID NO: 1218430 - RNA, 20 nt, Mycobacterium bovis subsp bovis AF2122/97
ccgcgcccaccagcggcggc

SEQ ID NO: 1218431 - RNA, 17 nt, Mycobacterium bovis subsp bovis AF2122/97
ccgcgcccaccccggcc

SEQ ID NO: 1218432 - RNA, 20 nt, Mycobacterium bovis subsp bovis AF2122/97
ccgcgccaguggccaccauc

SEQ ID NO: 1218433 - RNA, 21 nt, Mycobacterium bovis subsp bovis AF2122/97
ccgcgccgaucaccaccggca

SEQ ID NO: 1218434 - RNA, 19 nt, Mycobacterium bovis subsp bovis AF2122/97
ccgcgccgauuccaccgcc

SEQ ID NO: 1218435 - RNA, 20 nt, Mycobacterium bovis subsp bovis AF2122/97
ccgcgccgcggcccgcucca

SEQ ID NO: 1218436 - RNA, 19 nt, Mycobacterium bovis subsp bovis AF2122/97
ccgcgccgccggacccacc

SEQ ID NO: 1218437 - RNA, 11 nt, Mycobacterium bovis subsp bovis AF2122/97
ccgcgccgccu

SEQ ID NO: 1218438 - RNA, 23 nt, Mycobacterium bovis subsp bovis AF2122/97
ccgcgccgucgucgagcaccacc

SEQ ID NO: 1218439 - RNA, 15 nt, Mycobacterium bovis subsp bovis AF2122/97
ccgcgccgucgucgc

SEQ ID NO: 1218440 - RNA, 14 nt, Mycobacterium bovis subsp bovis AF2122/97
ccgcgccggccccg

SEQ ID NO: 1218441 - RNA, 20 nt, Mycobacterium bovis subsp bovis AF2122/97
ccgcgcgcacggcgucggcc

SEQ ID NO: 1218442 - RNA, 15 nt, Mycobacterium bovis subsp bovis AF2122/97
ccgcgcgccggcggu

SEQ ID NO: 1218443 - RNA, 13 nt, Mycobacterium bovis subsp bovis AF2122/97
ccgcgccuccguu

SEQ ID NO: 1218444 - RNA, 14 nt, Mycobacterium bovis subsp bovis AF2122/97
ccgcgcgagccucg

SEQ ID NO: 1218445 - RNA, 17 nt, Mycobacterium bovis subsp bovis AF2122/97
ccgcgcgcucgagcagg

SEQ ID NO: 1218446 - RNA, 17 nt, Mycobacterium bovis subsp bovis AF2122/97
ccgcgcgcucgcccagg

SEQ ID NO: 1218447 - RNA, 17 nt, Mycobacterium bovis subsp bovis AF2122/97
ccgcgcggcgagagccu

SEQ ID NO: 1218448 - RNA, 14 nt, Mycobacterium bovis subsp bovis AF2122/97
ccgcgcggcgcagc

SEQ ID NO: 1218449 - RNA, 15 nt, Mycobacterium bovis subsp bovis AF2122/97
aaacccugcacccga

SEQ ID NO: 1218450 - RNA, 13 nt, Mycobacterium bovis subsp bovis AF2122/97
aaacccugcugcg

SEQ ID NO: 1218451 - RNA, 20 nt, Mycobacterium bovis subsp bovis AF2122/97
ccgcgcggugcccugccggc

SEQ ID NO: 1218452 - RNA, 22 nt, Mycobacterium bovis subsp bovis AF2122/97
ccgcgcggugcccugccggcag

SEQ ID NO: 1218453 - RNA, 20 nt, Mycobacterium bovis subsp bovis AF2122/97
ccgcgcguaauccgagcgcg

SEQ ID NO: 1218454 - RNA, 19 nt, Mycobacterium bovis subsp bovis AF2122/97
ccgcgcgguacugcgcagc

SEQ ID NO: 1218455 - RNA, 20 nt, Mycobacterium bovis subsp bovis AF2122/97
ccgcgcgguacugcgcagcg

SEQ ID NO: 1218456 - RNA, 23 nt, Mycobacterium bovis subsp bovis AF2122/97
ccgcgcggugauggucaccgucu

SEQ ID NO: 1218457 - RNA, 18 nt, Mycobacterium bovis subsp bovis AF2122/97
ccgcgcguccgucggcga

SEQ ID NO: 1218458 - RNA, 18 nt, Mycobacterium bovis subsp bovis AF2122/97
ccgcgcucgaacuccccg

SEQ ID NO: 1218459 - RNA, 21 nt, Mycobacterium bovis subsp bovis AF2122/97
ccgcgcucaccggggccgucg

SEQ ID NO: 1218460 - RNA, 20 nt, Mycobacterium bovis subsp bovis AF2122/97
ccgcgcguucggcgagcagc

SEQ ID NO: 1218461 - RNA, 15 nt, Mycobacterium bovis subsp bovis AF2122/97
ccgcgcguucggcgc

SEQ ID NO: 1218462 - RNA, 15 nt, Mycobacterium bovis subsp bovis AF2122/97
ccgcgcgggccgccg

SEQ ID NO: 1218463 - RNA, 20 nt, Mycobacterium bovis subsp bovis AF2122/97
ccgcgcgggaaacguuccag

SEQ ID NO: 1218464 - RNA, 17 nt, Mycobacterium bovis subsp bovis AF2122/97
aaaccgcagucgcggca

SEQ ID NO: 1218465 - RNA, 16 nt, Mycobacterium bovis subsp bovis AF2122/97
aaaccgaggauguggu

SEQ ID NO: 1218466 - RNA, 21 nt, Mycobacterium bovis subsp bovis AF2122/97
ccgcggaucgaccgccagcgc

SEQ ID NO: 1218467 - RNA, 22 nt, Mycobacterium bovis subsp bovis AF2122/97
ccgcggaucauccuucgccggc

SEQ ID NO: 1218468 - RNA, 17 nt, Mycobacterium bovis subsp bovis AF2122/97
ccgcggauaggccgcgc

SEQ ID NO: 1218469 - RNA, 16 nt, Mycobacterium bovis subsp bovis AF2122/97
ccgcggccaccgccgc

SEQ ID NO: 1218470 - RNA, 18 nt, Mycobacterium bovis subsp bovis AF2122/97
ccgcggccaccgccgccg

SEQ ID NO: 1218471 - RNA, 19 nt, Mycobacterium bovis subsp bovis AF2122/97
ccgcggccaccgccgccgc

SEQ ID NO: 1218472 - RNA, 17 nt, Mycobacterium bovis subsp bovis AF2122/97
ccgcggcaugcaaugcu

SEQ ID NO: 1218473 - RNA, 17 nt, Mycobacterium bovis subsp bovis AF2122/97
ccgcggccacaucgcca

SEQ ID NO: 1218474 - RNA, 18 nt, Mycobacterium bovis subsp bovis AF2122/97
ccgcggccacaucgccag

SEQ ID NO: 1218475 - RNA, 13 nt, Mycobacterium bovis subsp bovis AF2122/97
ccgcggccgccag

SEQ ID NO: 1218476 - RNA, 14 nt, Mycobacterium bovis subsp bovis AF2122/97
ccgcggccagcggg

SEQ ID NO: 1218477 - RNA, 23 nt, Mycobacterium bovis subsp bovis AF2122/97
ccgcggccggcgcucgcggcggc

SEQ ID NO: 1218478 - RNA, 20 nt, Mycobacterium bovis subsp bovis AF2122/97
ccgcggccggguggcccggc

SEQ ID NO: 1218479 - RNA, 15 nt, Mycobacterium bovis subsp bovis AF2122/97
ccgcgcuggucagcc

SEQ ID NO: 1218480 - RNA, 19 nt, Mycobacterium bovis subsp bovis AF2122/97
ccgcgcuugcgaucgccgc

SEQ ID NO: 1218481 - RNA, 20 nt, Mycobacterium bovis subsp bovis AF2122/97
ccgcgcugccgacuccucgu

SEQ ID NO: 1218482 - RNA, 17 nt, Mycobacterium bovis subsp bovis AF2122/97
ccgcggaggcggccagc

SEQ ID NO: 1218483 - RNA, 22 nt, Mycobacterium bovis subsp bovis AF2122/97
ccgcggacucgggcaggcccca

SEQ ID NO: 1218484 - RNA, 12 nt, Mycobacterium bovis subsp bovis AF2122/97
ccgcggagcgca

SEQ ID NO: 1218485 - RNA, 23 nt, Mycobacterium bovis subsp bovis AF2122/97
ccgcggacucgggcaggccccac

SEQ ID NO: 1218486 - RNA, 19 nt, Mycobacterium bovis subsp bovis AF2122/97
ccgcggacuugcgagccgu

SEQ ID NO: 1218487 - RNA, 19 nt, Mycobacterium bovis subsp bovis AF2122/97
ccgcgcuugguccugcggu

SEQ ID NO: 1218488 - RNA, 20 nt, Mycobacterium bovis subsp bovis AF2122/97
ccgcgcuuucgagugcagcg

SEQ ID NO: 1218489 - RNA, 15 nt, Mycobacterium bovis subsp bovis AF2122/97
ccgcggaaggccagc

SEQ ID NO: 1218490 - RNA, 16 nt, Mycobacterium bovis subsp bovis AF2122/97
ccgcggaaggccagcu

SEQ ID NO: 1218491 - RNA, 17 nt, Mycobacterium bovis subsp bovis AF2122/97
ccgcgguggcggcgagc

SEQ ID NO: 1218492 - RNA, 18 nt, Mycobacterium bovis subsp bovis AF2122/97
ccgcgguggggucgacgc

SEQ ID NO: 1218493 - RNA, 13 nt, Mycobacterium bovis subsp bovis AF2122/97
ccgcggucugcgc

SEQ ID NO: 1218494 - RNA, 15 nt, Mycobacterium bovis subsp bovis AF2122/97
ccgcggucuucuuca

SEQ ID NO: 1218495 - RNA, 17 nt, Mycobacterium bovis subsp bovis AF2122/97
ccgcggugacggcggcu

SEQ ID NO: 1218496 - RNA, 22 nt, Mycobacterium bovis subsp bovis AF2122/97
ccgcgguuggcaguggcgcggc

SEQ ID NO: 1218497 - RNA, 23 nt, Mycobacterium bovis subsp bovis AF2122/97
ccgcggucaccccggcucggcca

SEQ ID NO: 1218498 - RNA, 19 nt, Mycobacterium bovis subsp bovis AF2122/97
ccgcggugccugcagcuug

SEQ ID NO: 1218499 - RNA, 17 nt, Mycobacterium bovis subsp bovis AF2122/97
ccgcgguuggcaguggc

SEQ ID NO: 1218500 - RNA, 17 nt, Mycobacterium bovis subsp bovis AF2122/97
ccgcguacaggccggcc

SEQ ID NO: 1218501 - RNA, 15 nt, Mycobacterium bovis subsp bovis AF2122/97
ccgcguagagcagca

SEQ ID NO: 1218502 - RNA, 17 nt, Mycobacterium bovis subsp bovis AF2122/97
ccgcguagagcagcagc

SEQ ID NO: 1218503 - RNA, 22 nt, Mycobacterium bovis subsp bovis AF2122/97
ccgcgucaccggaggccgccgc

SEQ ID NO: 1218504 - RNA, 17 nt, Mycobacterium bovis subsp bovis AF2122/97
ccgcguaguccaggccg

SEQ ID NO: 1218505 - RNA, 19 nt, Mycobacterium bovis subsp bovis AF2122/97
ccgcgucgaguggccgugg

SEQ ID NO: 1218506 - RNA, 12 nt, Mycobacterium bovis subsp bovis AF2122/97
ccgcgucgccgg

SEQ ID NO: 1218507 - RNA, 15 nt, Mycobacterium bovis subsp bovis AF2122/97
ccgcgucgccggccu

SEQ ID NO: 1218508 - RNA, 15 nt, Mycobacterium bovis subsp bovis AF2122/97
ccgcgucgaacuggg

SEQ ID NO: 1218509 - RNA, 16 nt, Mycobacterium bovis subsp bovis AF2122/97
ccgcgucgaacugggc

SEQ ID NO: 1218510 - RNA, 17 nt, Mycobacterium bovis subsp bovis AF2122/97
ccgcgucacggaccugg

SEQ ID NO: 1218511 - RNA, 23 nt, Mycobacterium bovis subsp bovis AF2122/97
ccgcgucacggaccuggaacugc

SEQ ID NO: 1218512 - RNA, 17 nt, Mycobacterium bovis subsp bovis AF2122/97
ccgcguccaaggcgcgc

SEQ ID NO: 1218513 - RNA, 14 nt, Mycobacterium bovis subsp bovis AF2122/97
ccgcguccagaccg

SEQ ID NO: 1218514 - RNA, 22 nt, Mycobacterium bovis subsp bovis AF2122/97
ccgcgucuuggugcgcgucagc

SEQ ID NO: 1218515 - RNA, 14 nt, Mycobacterium bovis subsp bovis AF2122/97
ccgcgucgucgaga

SEQ ID NO: 1218516 - RNA, 13 nt, Mycobacterium bovis subsp bovis AF2122/97
ccgcgucugcucg

SEQ ID NO: 1218517 - RNA, 16 nt, Mycobacterium bovis subsp bovis AF2122/97
ccgcgucuaccaaccg

SEQ ID NO: 1218518 - RNA, 23 nt, Mycobacterium bovis subsp bovis AF2122/97
ccgcgucggcggcgaccgccagc

SEQ ID NO: 1218519 - RNA, 14 nt, Mycobacterium bovis subsp bovis AF2122/97
ccgcgucgggccgc

SEQ ID NO: 1218520 - RNA, 14 nt, Mycobacterium bovis subsp bovis AF2122/97
ccgcggucggacca

SEQ ID NO: 1218521 - RNA, 17 nt, Mycobacterium bovis subsp bovis AF2122/97
ccgcgguaggugcaugu

SEQ ID NO: 1218522 - RNA, 19 nt, Mycobacterium bovis subsp bovis AF2122/97
ccgcgguacccaccucccg

SEQ ID NO: 1218523 - RNA, 22 nt, Mycobacterium bovis subsp bovis AF2122/97
ccgcgggucguccggcggcagg

SEQ ID NO: 1218524 - RNA, 21 nt, Mycobacterium bovis subsp bovis AF2122/97
ccgcggguuugaucuccaccu

SEQ ID NO: 1218525 - RNA, 18 nt, Mycobacterium bovis subsp bovis AF2122/97
ccgcgguaauggcgugca

SEQ ID NO: 1218526 - RNA, 20 nt, Mycobacterium bovis subsp bovis AF2122/97
ccgcgggcagcguguaaccg

SEQ ID NO: 1218527 - RNA, 21 nt, Mycobacterium bovis subsp bovis AF2122/97
ccgcgggaccuucgagccgca

SEQ ID NO: 1218528 - RNA, 18 nt, Mycobacterium bovis subsp bovis AF2122/97
ccgcgggggaccgcccga

SEQ ID NO: 1218529 - RNA, 14 nt, Mycobacterium bovis subsp bovis AF2122/97
ccgcgggcguugcu

SEQ ID NO: 1218530 - RNA, 17 nt, Mycobacterium bovis subsp bovis AF2122/97
ccgcgggcggcaucgcc

SEQ ID NO: 1218531 - RNA, 14 nt, Mycobacterium bovis subsp bovis AF2122/97
ccgcgggcugacca

SEQ ID NO: 1218532 - RNA, 21 nt, Mycobacterium bovis subsp bovis AF2122/97
ccgcgggcgccuuccaggcgg

SEQ ID NO: 1218533 - RNA, 14 nt, Mycobacterium bovis subsp bovis AF2122/97
ccgcggcgaagaua

SEQ ID NO: 1218534 - RNA, 15 nt, Mycobacterium bovis subsp bovis AF2122/97
ccgcggcgaagcaag

SEQ ID NO: 1218535 - RNA, 20 nt, Mycobacterium bovis subsp bovis AF2122/97
ccgcggcgcugaugccgucu

SEQ ID NO: 1218536 - RNA, 14 nt, Mycobacterium bovis subsp bovis AF2122/97
ccgcggcggcagcg

SEQ ID NO: 1218537 - RNA, 17 nt, Mycobacterium bovis subsp bovis AF2122/97
ccgcggcggcagcggcg

SEQ ID NO: 1218538 - RNA, 15 nt, Mycobacterium bovis subsp bovis AF2122/97
ccgcggcggccagcg

SEQ ID NO: 1218539 - RNA, 13 nt, Mycobacterium bovis subsp bovis AF2122/97
ccgcggcggcccc

SEQ ID NO: 1218540 - RNA, 18 nt, Mycobacterium bovis subsp bovis AF2122/97
ccgcggcgccggugggcg

SEQ ID NO: 1218541 - RNA, 14 nt, Mycobacterium bovis subsp bovis AF2122/97
ccgcggcgcggaga

SEQ ID NO: 1218542 - RNA, 17 nt, Mycobacterium bovis subsp bovis AF2122/97
ccgcggcggccccgcgc

SEQ ID NO: 1218543 - RNA, 18 nt, Mycobacterium bovis subsp bovis AF2122/97
ccgcuagucgucggcgcu

SEQ ID NO: 1218544 - RNA, 19 nt, Mycobacterium bovis subsp bovis AF2122/97
ccgcuaggugacgccgcca

SEQ ID NO: 1218545 - RNA, 21 nt, Mycobacterium bovis subsp bovis AF2122/97
ccgcuaggugacgccgccagc

SEQ ID NO: 1218546 - RNA, 14 nt, Mycobacterium bovis subsp bovis AF2122/97
ccgcuacgcgcgcu

SEQ ID NO: 1218547 - RNA, 21 nt, Mycobacterium bovis subsp bovis AF2122/97
ccgcuacccggacagggcggc

SEQ ID NO: 1218548 - RNA, 17 nt, Mycobacterium bovis subsp bovis AF2122/97
ccgcuaccgcccgcgcc

SEQ ID NO: 1218549 - RNA, 16 nt, Mycobacterium bovis subsp bovis AF2122/97
ccgcuaccagcugggc

SEQ ID NO: 1218550 - RNA, 20 nt, Mycobacterium bovis subsp bovis AF2122/97
ccgcuaccccagccggcagc

SEQ ID NO: 1218551 - RNA, 14 nt, Mycobacterium bovis subsp bovis AF2122/97
ccgcuacgccggcc

SEQ ID NO: 1218552 - RNA, 13 nt, Mycobacterium bovis subsp bovis AF2122/97
ccgcuaccgcaca

SEQ ID NO: 1218553 - RNA, 16 nt, Mycobacterium bovis subsp bovis AF2122/97
ccgcguugaaggcgcc

SEQ ID NO: 1218554 - RNA, 19 nt, Mycobacterium bovis subsp bovis AF2122/97
ccgcguugaugaccgccgc

SEQ ID NO: 1218555 - RNA, 22 nt, Mycobacterium bovis subsp bovis AF2122/97
ccgcguugaugaccgccgccgg

SEQ ID NO: 1218556 - RNA, 18 nt, Mycobacterium bovis subsp bovis AF2122/97
ccgcguuaugccaggcgc

SEQ ID NO: 1218557 - RNA, 16 nt, Mycobacterium bovis subsp bovis AF2122/97
ccgcgugcgucagcgc

SEQ ID NO: 1218558 - RNA, 20 nt, Mycobacterium bovis subsp bovis AF2122/97
ccgcguggugcugaccgcgc

SEQ ID NO: 1218559 - RNA, 13 nt, Mycobacterium bovis subsp bovis AF2122/97
ccgcgugccgccc

SEQ ID NO: 1218560 - RNA, 22 nt, Mycobacterium bovis subsp bovis AF2122/97
ccgcguuuauaccucgccgccc

SEQ ID NO: 1218561 - RNA, 23 nt, Mycobacterium bovis subsp bovis AF2122/97
ccgcguuucgcgacgucugccag

SEQ ID NO: 1218562 - RNA, 20 nt, Mycobacterium bovis subsp bovis AF2122/97
ccgcguucgagagccccgac

SEQ ID NO: 1218563 - RNA, 23 nt, Mycobacterium bovis subsp bovis AF2122/97
ccgcuaacgcaccugcgcgcggc

SEQ ID NO: 1218564 - RNA, 21 nt, Mycobacterium bovis subsp bovis AF2122/97
ccgcuccacguacgcggcugc

SEQ ID NO: 1218565 - RNA, 12 nt, Mycobacterium bovis subsp bovis AF2122/97
ccgcucccccgc

SEQ ID NO: 1218566 - RNA, 15 nt, Mycobacterium bovis subsp bovis AF2122/97
ccgcucgcccgccgc

SEQ ID NO: 1218567 - RNA, 19 nt, Mycobacterium bovis subsp bovis AF2122/97
ccgcucgaucggcagccag

SEQ ID NO: 1218568 - RNA, 17 nt, Mycobacterium bovis subsp bovis AF2122/97
ccgcucgacggcccgcc

SEQ ID NO: 1218569 - RNA, 12 nt, Mycobacterium bovis subsp bovis AF2122/97
ccgcuccaccac

SEQ ID NO: 1218570 - RNA, 22 nt, Mycobacterium bovis subsp bovis AF2122/97
ccgcuccaaaagccucagccgc

SEQ ID NO: 1218571 - RNA, 18 nt, Mycobacterium bovis subsp bovis AF2122/97
ccgcucauuagcccccgc

SEQ ID NO: 1218572 - RNA, 17 nt, Mycobacterium bovis subsp bovis AF2122/97
ccgcucagggugcgccg

SEQ ID NO: 1218573 - RNA, 14 nt, Mycobacterium bovis subsp bovis AF2122/97
ccgcucauccagcg

SEQ ID NO: 1218574 - RNA, 17 nt, Mycobacterium bovis subsp bovis AF2122/97
ccgcucauccagcgcgu

SEQ ID NO: 1218575 - RNA, 15 nt, Mycobacterium bovis subsp bovis AF2122/97
ccgcucagcgcagca

SEQ ID NO: 1218576 - RNA, 14 nt, Mycobacterium bovis subsp bovis AF2122/97
ccgcucacgcucac

SEQ ID NO: 1218577 - RNA, 16 nt, Mycobacterium bovis subsp bovis AF2122/97
ccgcucacccgcccgg

SEQ ID NO: 1218578 - RNA, 18 nt, Mycobacterium bovis subsp bovis AF2122/97
ccgcucacgcucacccgg

SEQ ID NO: 1218579 - RNA, 14 nt, Mycobacterium bovis subsp bovis AF2122/97
ccgcucacccgccc

SEQ ID NO: 1218580 - RNA, 21 nt, Mycobacterium bovis subsp bovis AF2122/97
ccgcucacauacagcaggccg

SEQ ID NO: 1218581 - RNA, 23 nt, Mycobacterium bovis subsp bovis AF2122/97
ccgcuaugaugccgccggugccg

SEQ ID NO: 1218582 - RNA, 14 nt, Mycobacterium bovis subsp bovis AF2122/97
ccggaaccaccagu

SEQ ID NO: 1218583 - RNA, 22 nt, Mycobacterium bovis subsp bovis AF2122/97
ccggaaccggcgugcagcacuu

SEQ ID NO: 1218584 - RNA, 14 nt, Mycobacterium bovis subsp bovis AF2122/97
ccggaacccccagc

SEQ ID NO: 1218585 - RNA, 17 nt, Mycobacterium bovis subsp bovis AF2122/97
ccggaacccccagcugc

SEQ ID NO: 1218586 - RNA, 13 nt, Mycobacterium bovis subsp bovis AF2122/97
ccggaaagcucuc

SEQ ID NO: 1218587 - RNA, 17 nt, Mycobacterium bovis subsp bovis AF2122/97
ccggaaagaucucgguc

SEQ ID NO: 1218588 - RNA, 19 nt, Mycobacterium bovis subsp bovis AF2122/97
ccggaaagcccgucgucgg

SEQ ID NO: 1218589 - RNA, 23 nt, Mycobacterium bovis subsp bovis AF2122/97
ccggaaacuggggguuguucaac

SEQ ID NO: 1218590 - RNA, 14 nt, Mycobacterium bovis subsp bovis AF2122/97
ccgcuuggcgugac

SEQ ID NO: 1218591 - RNA, 13 nt, Mycobacterium bovis subsp bovis AF2122/97
ccgcuugggccug

SEQ ID NO: 1218592 - RNA, 16 nt, Mycobacterium bovis subsp bovis AF2122/97
ccgcuugcggggccgg

SEQ ID NO: 1218593 - RNA, 14 nt, Mycobacterium bovis subsp bovis AF2122/97
ccgcuuggcgcggc

SEQ ID NO: 1218594 - RNA, 20 nt, Mycobacterium bovis subsp bovis AF2122/97
ccgcuggucgagcagugccu

SEQ ID NO: 1218595 - RNA, 20 nt, Mycobacterium bovis subsp bovis AF2122/97
ccgcugguggucagcaccca

SEQ ID NO: 1218596 - RNA, 13 nt, Mycobacterium bovis subsp bovis AF2122/97
ccgcugguggcgc

SEQ ID NO: 1218597 - RNA, 20 nt, Mycobacterium bovis subsp bovis AF2122/97
ccgcugguggcgccaucccc

SEQ ID NO: 1218598 - RNA, 14 nt, Mycobacterium bovis subsp bovis AF2122/97
ccgcuugccccgcc

SEQ ID NO: 1218599 - RNA, 22 nt, Mycobacterium bovis subsp bovis AF2122/97
ccgcuugaccccuggccgccgg

SEQ ID NO: 1218600 - RNA, 18 nt, Mycobacterium bovis subsp bovis AF2122/97
ccggacucuccccuggcc

SEQ ID NO: 1218601 - RNA, 19 nt, Mycobacterium bovis subsp bovis AF2122/97
ccggacucuccccuggccc

SEQ ID NO: 1218602 - RNA, 18 nt, Mycobacterium bovis subsp bovis AF2122/97
ccggacuaccgccggcgg

SEQ ID NO: 1218603 - RNA, 15 nt, Mycobacterium bovis subsp bovis AF2122/97
ccggacguucuggau

SEQ ID NO: 1218604 - RNA, 17 nt, Mycobacterium bovis subsp bovis AF2122/97
ccggacuuggccugcgg

SEQ ID NO: 1218605 - RNA, 16 nt, Mycobacterium bovis subsp bovis AF2122/97
ccggacguucuggauc

SEQ ID NO: 1218606 - RNA, 22 nt, Mycobacterium bovis subsp bovis AF2122/97
ccggagccccugucaacgccgc

SEQ ID NO: 1218607 - RNA, 22 nt, Mycobacterium bovis subsp bovis AF2122/97
ccggagccgcccaagccgccgg

SEQ ID NO: 1218608 - RNA, 13 nt, Mycobacterium bovis subsp bovis AF2122/97
ccggagccgccgg

SEQ ID NO: 1218609 - RNA, 17 nt, Mycobacterium bovis subsp bovis AF2122/97
ccggagccgccggcccc

SEQ ID NO: 1218610 - RNA, 23 nt, Mycobacterium bovis subsp bovis AF2122/97
ccggagccgccggccccgccagc

SEQ ID NO: 1218611 - RNA, 22 nt, Mycobacterium bovis subsp bovis AF2122/97
ccggagccggugccgacggcgc

SEQ ID NO: 1218612 - RNA, 16 nt, Mycobacterium bovis subsp bovis AF2122/97
ccggagacgucgccgc

SEQ ID NO: 1218613 - RNA, 14 nt, Mycobacterium bovis subsp bovis AF2122/97
ccggagacacccgc

SEQ ID NO: 1218614 - RNA, 21 nt, Mycobacterium bovis subsp bovis AF2122/97
ccggaagcggcguucgaugcc

SEQ ID NO: 1218615 - RNA, 19 nt, Mycobacterium bovis subsp bovis AF2122/97
ccggaauacgcgccgccgg

SEQ ID NO: 1218616 - RNA, 20 nt, Mycobacterium bovis subsp bovis AF2122/97
ccggaacgagcggccgcgcg

SEQ ID NO: 1218617 - RNA, 14 nt, Mycobacterium bovis subsp bovis AF2122/97
ccggaacgccgcca

SEQ ID NO: 1218618 - RNA, 17 nt, Mycobacterium bovis subsp bovis AF2122/97
ccggaauccuggccgcc

SEQ ID NO: 1218619 - RNA, 20 nt, Mycobacterium bovis subsp bovis AF2122/97
ccggacgggaguugaucucc

SEQ ID NO: 1218620 - RNA, 21 nt, Mycobacterium bovis subsp bovis AF2122/97
ccggacggggaggucaaaauc

SEQ ID NO: 1218621 - RNA, 13 nt, Mycobacterium bovis subsp bovis AF2122/97
ccgcugagcccug

SEQ ID NO: 1218622 - RNA, 22 nt, Mycobacterium bovis subsp bovis AF2122/97
ccgcugaagcggacccgacagc

SEQ ID NO: 1218623 - RNA, 23 nt, Mycobacterium bovis subsp bovis AF2122/97
ccgcugaugagccgcagaugcac

SEQ ID NO: 1218624 - RNA, 24 nt, Mycobacterium bovis subsp bovis AF2122/97
ccgcugagguauugggcgcggcag

SEQ ID NO: 1218625 - RNA, 15 nt, Mycobacterium bovis subsp bovis AF2122/97
ccgcugaucugccgc

SEQ ID NO: 1218626 - RNA, 17 nt, Mycobacterium bovis subsp bovis AF2122/97
ccgcugaugagccgcag

SEQ ID NO: 1218627 - RNA, 21 nt, Mycobacterium bovis subsp bovis AF2122/97
ccgcugcagacgccccuuccc

SEQ ID NO: 1218628 - RNA, 21 nt, Mycobacterium bovis subsp bovis AF2122/97
ccgcugcagugguaccggcgc

SEQ ID NO: 1218629 - RNA, 19 nt, Mycobacterium bovis subsp bovis AF2122/97
ccgcugcagcaccgcagcg

SEQ ID NO: 1218630 - RNA, 18 nt, Mycobacterium bovis subsp bovis AF2122/97
ccgcugccauugccuggg

SEQ ID NO: 1218631 - RNA, 20 nt, Mycobacterium bovis subsp bovis AF2122/97
ccgcucgccgguaggcggcc

SEQ ID NO: 1218632 - RNA, 16 nt, Mycobacterium bovis subsp bovis AF2122/97
ccgcucggaguugagc

SEQ ID NO: 1218633 - RNA, 15 nt, Mycobacterium bovis subsp bovis AF2122/97
ccgcucggccgucag

SEQ ID NO: 1218634 - RNA, 15 nt, Mycobacterium bovis subsp bovis AF2122/97
ccgcucgguccagcc

SEQ ID NO: 1218635 - RNA, 13 nt, Mycobacterium bovis subsp bovis AF2122/97
ccgcugaccccgg

SEQ ID NO: 1218636 - RNA, 15 nt, Mycobacterium bovis subsp bovis AF2122/97
ccgcuggcccgccag

SEQ ID NO: 1218637 - RNA, 23 nt, Mycobacterium bovis subsp bovis AF2122/97
ccgcuggccguauaggcccgggc

SEQ ID NO: 1218638 - RNA, 19 nt, Mycobacterium bovis subsp bovis AF2122/97
ccgcugcugcugcccccca

SEQ ID NO: 1218639 - RNA, 13 nt, Mycobacterium bovis subsp bovis AF2122/97
ccgcuggcccgcc

SEQ ID NO: 1218640 - RNA, 16 nt, Mycobacterium bovis subsp bovis AF2122/97
ccgcuggacggaucug

SEQ ID NO: 1218641 - RNA, 16 nt, Mycobacterium bovis subsp bovis AF2122/97
ccgcuggaggcggcgc

SEQ ID NO: 1218642 - RNA, 16 nt, Mycobacterium bovis subsp bovis AF2122/97
ccgcugcggcaccacc

SEQ ID NO: 1218643 - RNA, 20 nt, Mycobacterium bovis subsp bovis AF2122/97
ccgcugcggcaccacccggc

SEQ ID NO: 1218644 - RNA, 19 nt, Mycobacterium bovis subsp bovis AF2122/97
ccgcugcggguagccgucg

SEQ ID NO: 1218645 - RNA, 21 nt, Mycobacterium bovis subsp bovis AF2122/97
ccgcugcgccgucgcagccag

SEQ ID NO: 1218646 - RNA, 13 nt, Mycobacterium bovis subsp bovis AF2122/97
ccgcugcgccagg

SEQ ID NO: 1218647 - RNA, 16 nt, Mycobacterium bovis subsp bovis AF2122/97
ccgcugcgccagguca

SEQ ID NO: 1218648 - RNA, 18 nt, Mycobacterium bovis subsp bovis AF2122/97
ccgcugccuuggcgcggc

SEQ ID NO: 1218649 - RNA, 13 nt, Mycobacterium bovis subsp bovis AF2122/97
ccgcugccgccgg

SEQ ID NO: 1218650 - RNA, 12 nt, Mycobacterium bovis subsp bovis AF2122/97
ccgcugccgccc

SEQ ID NO: 1218651 - RNA, 14 nt, Mycobacterium bovis subsp bovis AF2122/97
ccgcugccgcccgc

SEQ ID NO: 1218652 - RNA, 22 nt, Mycobacterium bovis subsp bovis AF2122/97
ccgcugccuucuuugccggcgc

SEQ ID NO: 1218653 - RNA, 12 nt, Mycobacterium bovis subsp bovis AF2122/97
ccgcugccgucg

SEQ ID NO: 1218654 - RNA, 19 nt, Mycobacterium bovis subsp bovis AF2122/97
ccgcugccggugucucccu

SEQ ID NO: 1218655 - RNA, 14 nt, Mycobacterium bovis subsp bovis AF2122/97
ccgcugccggcagc

SEQ ID NO: 1218656 - RNA, 21 nt, Mycobacterium bovis subsp bovis AF2122/97
ccggagcgccgagcucggcgc

SEQ ID NO: 1218657 - RNA, 14 nt, Mycobacterium bovis subsp bovis AF2122/97
ccggaggcaagcaa

SEQ ID NO: 1218658 - RNA, 18 nt, Mycobacterium bovis subsp bovis AF2122/97
ccggagggguuagguugu

SEQ ID NO: 1218659 - RNA, 11 nt, Mycobacterium bovis subsp bovis AF2122/97
ccggaguugaa

SEQ ID NO: 1218660 - RNA, 21 nt, Mycobacterium bovis subsp bovis AF2122/97
ccggaguugguguuauugaug

SEQ ID NO: 1218661 - RNA, 18 nt, Mycobacterium bovis subsp bovis AF2122/97
ccggaguuuaagacgccc

SEQ ID NO: 1218662 - RNA, 13 nt, Mycobacterium bovis subsp bovis AF2122/97
ccggccacggucc

SEQ ID NO: 1218663 - RNA, 21 nt, Mycobacterium bovis subsp bovis AF2122/97
ccggccacuacggccuggcca

SEQ ID NO: 1218664 - RNA, 12 nt, Mycobacterium bovis subsp bovis AF2122/97
ccggccaccagg

SEQ ID NO: 1218665 - RNA, 19 nt, Mycobacterium bovis subsp bovis AF2122/97
ccggccaacugggccgagc

SEQ ID NO: 1218666 - RNA, 13 nt, Mycobacterium bovis subsp bovis AF2122/97
ccggccaagccgg

SEQ ID NO: 1218667 - RNA, 19 nt, Mycobacterium bovis subsp bovis AF2122/97
ccggccaauggccugcagc

SEQ ID NO: 1218668 - RNA, 14 nt, Mycobacterium bovis subsp bovis AF2122/97
ccggccagccgcgg

SEQ ID NO: 1218669 - RNA, 12 nt, Mycobacterium bovis subsp bovis AF2122/97
ccggccagaccc

SEQ ID NO: 1218670 - RNA, 15 nt, Mycobacterium bovis subsp bovis AF2122/97
ccggccagauggugg

SEQ ID NO: 1218671 - RNA, 21 nt, Mycobacterium bovis subsp bovis AF2122/97
ccggccaugccuucggugccg

SEQ ID NO: 1218672 - RNA, 20 nt, Mycobacterium bovis subsp bovis AF2122/97
ccggccauucuuggugaucg

SEQ ID NO: 1218673 - RNA, 14 nt, Mycobacterium bovis subsp bovis AF2122/97
ccggccccgccggc

SEQ ID NO: 1218674 - RNA, 16 nt, Mycobacterium bovis subsp bovis AF2122/97
ccggccccgccggccc

SEQ ID NO: 1218675 - RNA, 19 nt, Mycobacterium bovis subsp bovis AF2122/97
ccggccccgccgucgccgc

SEQ ID NO: 1218676 - RNA, 13 nt, Mycobacterium bovis subsp bovis AF2122/97
ccggccgacccgg

SEQ ID NO: 1218677 - RNA, 18 nt, Mycobacterium bovis subsp bovis AF2122/97
ccggccccgccggccccg

SEQ ID NO: 1218678 - RNA, 19 nt, Mycobacterium bovis subsp bovis AF2122/97
ccggccgacgaacagcggu

SEQ ID NO: 1218679 - RNA, 13 nt, Mycobacterium bovis subsp bovis AF2122/97
ccggccgccgaaa

SEQ ID NO: 1218680 - RNA, 16 nt, Mycobacterium bovis subsp bovis AF2122/97
ccggcccccgacuccg

SEQ ID NO: 1218681 - RNA, 18 nt, Mycobacterium bovis subsp bovis AF2122/97
ccggccccgcaagcggau

SEQ ID NO: 1218682 - RNA, 14 nt, Mycobacterium bovis subsp bovis AF2122/97
ccggccccgccagc

SEQ ID NO: 1218683 - RNA, 16 nt, Mycobacterium bovis subsp bovis AF2122/97
ccggccccgccagcgc

SEQ ID NO: 1218684 - RNA, 18 nt, Mycobacterium bovis subsp bovis AF2122/97
ccggccccgccagcgccg

SEQ ID NO: 1218685 - RNA, 22 nt, Mycobacterium bovis subsp bovis AF2122/97
ccggcccaucuucggacgccag

SEQ ID NO: 1218686 - RNA, 21 nt, Mycobacterium bovis subsp bovis AF2122/97
ccggccauugcgggcucaaca

SEQ ID NO: 1218687 - RNA, 12 nt, Mycobacterium bovis subsp bovis AF2122/97
ccggcccaagga

SEQ ID NO: 1218688 - RNA, 15 nt, Mycobacterium bovis subsp bovis AF2122/97
ccggcccaccaggcc

SEQ ID NO: 1218689 - RNA, 22 nt, Mycobacterium bovis subsp bovis AF2122/97
ccggccugcgcgaccgaccagc

SEQ ID NO: 1218690 - RNA, 20 nt, Mycobacterium bovis subsp bovis AF2122/97
ccggccucgccgaagcgggc

SEQ ID NO: 1218691 - RNA, 13 nt, Mycobacterium bovis subsp bovis AF2122/97
ccggccgccgaga

SEQ ID NO: 1218692 - RNA, 15 nt, Mycobacterium bovis subsp bovis AF2122/97
ccggccgccaucauc

SEQ ID NO: 1218693 - RNA, 22 nt, Mycobacterium bovis subsp bovis AF2122/97
ccggccgccgcgggacaccacc

SEQ ID NO: 1218694 - RNA, 11 nt, Mycobacterium bovis subsp bovis AF2122/97
ccggccgcgcg

SEQ ID NO: 1218695 - RNA, 15 nt, Mycobacterium bovis subsp bovis AF2122/97
ccggccgcucacccc

SEQ ID NO: 1218696 - RNA, 20 nt, Mycobacterium bovis subsp bovis AF2122/97
ccggccgcguaaaccggcug

SEQ ID NO: 1218697 - RNA, 17 nt, Mycobacterium bovis subsp bovis AF2122/97
ccggccuagccgauggc

SEQ ID NO: 1218698 - RNA, 21 nt, Mycobacterium bovis subsp bovis AF2122/97
ccggcgccgcaaucagacggc

SEQ ID NO: 1218699 - RNA, 23 nt, Mycobacterium bovis subsp bovis AF2122/97
ccggcgcccggggcggugggcgc

SEQ ID NO: 1218700 - RNA, 15 nt, Mycobacterium bovis subsp bovis AF2122/97
ccggcgcccgccgcg

SEQ ID NO: 1218701 - RNA, 14 nt, Mycobacterium bovis subsp bovis AF2122/97
ccggcgcccaggcc

SEQ ID NO: 1218702 - RNA, 22 nt, Mycobacterium bovis subsp bovis AF2122/97
ccggcgcccacaucgucggcgg

SEQ ID NO: 1218703 - RNA, 17 nt, Mycobacterium bovis subsp bovis AF2122/97
ccggcgcccagcgccuc

SEQ ID NO: 1218704 - RNA, 13 nt, Mycobacterium bovis subsp bovis AF2122/97
ccggcgccgccag

SEQ ID NO: 1218705 - RNA, 13 nt, Mycobacterium bovis subsp bovis AF2122/97
ccggcgccgccgg

SEQ ID NO: 1218706 - RNA, 20 nt, Mycobacterium bovis subsp bovis AF2122/97
ccggcgccgccggcgccgcc

SEQ ID NO: 1218707 - RNA, 12 nt, Mycobacterium bovis subsp bovis AF2122/97
ccggcgccgccg

SEQ ID NO: 1218708 - RNA, 14 nt, Mycobacterium bovis subsp bovis AF2122/97
ccggcgccaccgcc

SEQ ID NO: 1218709 - RNA, 18 nt, Mycobacterium bovis subsp bovis AF2122/97
ccggcgcagugcagguca

SEQ ID NO: 1218710 - RNA, 24 nt, Mycobacterium bovis subsp bovis AF2122/97
ccggcgcagugcgacucugcgucu

SEQ ID NO: 1218711 - RNA, 16 nt, Mycobacterium bovis subsp bovis AF2122/97
ccggcgcagguucucg

SEQ ID NO: 1218712 - RNA, 20 nt, Mycobacterium bovis subsp bovis AF2122/97
ccggcgccacccgcgccgcc

SEQ ID NO: 1218713 - RNA, 13 nt, Mycobacterium bovis subsp bovis AF2122/97
ccggcgccaccgc

SEQ ID NO: 1218714 - RNA, 23 nt, Mycobacterium bovis subsp bovis AF2122/97
ccggcgacgaucucgccgccagc

SEQ ID NO: 1218715 - RNA, 17 nt, Mycobacterium bovis subsp bovis AF2122/97
ccggcgacgggucgggc

SEQ ID NO: 1218716 - RNA, 22 nt, Mycobacterium bovis subsp bovis AF2122/97
ccggcgacgauauagggcuccu

SEQ ID NO: 1218717 - RNA, 15 nt, Mycobacterium bovis subsp bovis AF2122/97
ccggcgacccgggua

SEQ ID NO: 1218718 - RNA, 13 nt, Mycobacterium bovis subsp bovis AF2122/97
ccggcgacgccgg

SEQ ID NO: 1218719 - RNA, 14 nt, Mycobacterium bovis subsp bovis AF2122/97
ccggcgagcaggcc

SEQ ID NO: 1218720 - RNA, 15 nt, Mycobacterium bovis subsp bovis AF2122/97
ccggcgagcaggccg

SEQ ID NO: 1218721 - RNA, 17 nt, Mycobacterium bovis subsp bovis AF2122/97
ccggcgccggagccgcc

SEQ ID NO: 1218722 - RNA, 17 nt, Mycobacterium bovis subsp bovis AF2122/97
ccggcgccggaguugaa

SEQ ID NO: 1218723 - RNA, 23 nt, Mycobacterium bovis subsp bovis AF2122/97
ccggcgccggaguugaagaagcc

SEQ ID NO: 1218724 - RNA, 12 nt, Mycobacterium bovis subsp bovis AF2122/97
ccggcgccgcgg

SEQ ID NO: 1218725 - RNA, 19 nt, Mycobacterium bovis subsp bovis AF2122/97
ccggcgccgccgucgccgc

SEQ ID NO: 1218726 - RNA, 17 nt, Mycobacterium bovis subsp bovis AF2122/97
ccggcgccgccguuccc

SEQ ID NO: 1218727 - RNA, 13 nt, Mycobacterium bovis subsp bovis AF2122/97
ccggcgccgccau

SEQ ID NO: 1218728 - RNA, 18 nt, Mycobacterium bovis subsp bovis AF2122/97
ccggcgccggcgcgucgg

SEQ ID NO: 1218729 - RNA, 14 nt, Mycobacterium bovis subsp bovis AF2122/97
ccggcgccuccggc

SEQ ID NO: 1218730 - RNA, 17 nt, Mycobacterium bovis subsp bovis AF2122/97
ccggcgcgcaccccggc

SEQ ID NO: 1218731 - RNA, 23 nt, Mycobacterium bovis subsp bovis AF2122/97
ccggcgccuccggcaccuccagc

SEQ ID NO: 1218732 - RNA, 15 nt, Mycobacterium bovis subsp bovis AF2122/97
ccggcgcgauccccg

SEQ ID NO: 1218733 - RNA, 15 nt, Mycobacterium bovis subsp bovis AF2122/97
ccggcgcgccccgcc

SEQ ID NO: 1218734 - RNA, 17 nt, Mycobacterium bovis subsp bovis AF2122/97
ccggcgcgccccgccgc

SEQ ID NO: 1218735 - RNA, 19 nt, Mycobacterium bovis subsp bovis AF2122/97
ccggcgcgccgggcggcgc

SEQ ID NO: 1218736 - RNA, 15 nt, Mycobacterium bovis subsp bovis AF2122/97
ccggcgcgccccacc

SEQ ID NO: 1218737 - RNA, 13 nt, Mycobacterium bovis subsp bovis AF2122/97
ccggcgcgccccg

SEQ ID NO: 1218738 - RNA, 11 nt, Mycobacterium bovis subsp bovis AF2122/97
ccggcgcggcc

SEQ ID NO: 1218739 - RNA, 15 nt, Mycobacterium bovis subsp bovis AF2122/97
ccggcgcggucucgg

SEQ ID NO: 1218740 - RNA, 16 nt, Mycobacterium bovis subsp bovis AF2122/97
ccggcgcuagcgccgc

SEQ ID NO: 1218741 - RNA, 19 nt, Mycobacterium bovis subsp bovis AF2122/97
ccggcgcucgcggcggcgc

SEQ ID NO: 1218742 - RNA, 14 nt, Mycobacterium bovis subsp bovis AF2122/97
ccggcgcggccagc

SEQ ID NO: 1218743 - RNA, 20 nt, Mycobacterium bovis subsp bovis AF2122/97
ccggcgcuccacugaccagg

SEQ ID NO: 1218744 - RNA, 16 nt, Mycobacterium bovis subsp bovis AF2122/97
ccggcgcugcugccau

SEQ ID NO: 1218745 - RNA, 12 nt, Mycobacterium bovis subsp bovis AF2122/97
ccggcgcugccc

SEQ ID NO: 1218746 - RNA, 17 nt, Mycobacterium bovis subsp bovis AF2122/97
ccgggcggaacgccggc

SEQ ID NO: 1218747 - RNA, 14 nt, Mycobacterium bovis subsp bovis AF2122/97
ccgggcggacagga

SEQ ID NO: 1218748 - RNA, 23 nt, Mycobacterium bovis subsp bovis AF2122/97
ccgggcgcuugcaccaggggcgc

SEQ ID NO: 1218749 - RNA, 23 nt, Mycobacterium bovis subsp bovis AF2122/97
ccgggcgcucggucuccaccacc

SEQ ID NO: 1218750 - RNA, 16 nt, Mycobacterium bovis subsp bovis AF2122/97
ccgggcggccagcugc

SEQ ID NO: 1218751 - RNA, 19 nt, Mycobacterium bovis subsp bovis AF2122/97
ccgggcggccucccgggcc

SEQ ID NO: 1218752 - RNA, 15 nt, Mycobacterium bovis subsp bovis AF2122/97
ccgggcggccucccg

SEQ ID NO: 1218753 - RNA, 19 nt, Mycobacterium bovis subsp bovis AF2122/97
ccgggcgggauccacccag

SEQ ID NO: 1218754 - RNA, 15 nt, Mycobacterium bovis subsp bovis AF2122/97
ccgggcuggccagcg

SEQ ID NO: 1218755 - RNA, 19 nt, Mycobacterium bovis subsp bovis AF2122/97
ccgggcuggccagcgcgcu

SEQ ID NO: 1218756 - RNA, 20 nt, Mycobacterium bovis subsp bovis AF2122/97
ccggggaguggaaacccgcc

SEQ ID NO: 1218757 - RNA, 12 nt, Mycobacterium bovis subsp bovis AF2122/97
ccggggaaugag

SEQ ID NO: 1218758 - RNA, 15 nt, Mycobacterium bovis subsp bovis AF2122/97
ccggggacgcgcccc

SEQ ID NO: 1218759 - RNA, 18 nt, Mycobacterium bovis subsp bovis AF2122/97
ccgggcuuggccgcgccg

SEQ ID NO: 1218760 - RNA, 19 nt, Mycobacterium bovis subsp bovis AF2122/97
ccggggcgcccggccaggu

SEQ ID NO: 1218761 - RNA, 20 nt, Mycobacterium bovis subsp bovis AF2122/97
ccggggcgaugucggcuggu

SEQ ID NO: 1218762 - RNA, 18 nt, Mycobacterium bovis subsp bovis AF2122/97
ccggggcgcucgcgcgcu

SEQ ID NO: 1218763 - RNA, 23 nt, Mycobacterium bovis subsp bovis AF2122/97
ccggggcgcucgcgcgcugggcg

SEQ ID NO: 1218764 - RNA, 15 nt, Mycobacterium bovis subsp bovis AF2122/97
ccgggggcgccgccg

SEQ ID NO: 1218765 - RNA, 22 nt, Mycobacterium bovis subsp bovis AF2122/97
ccggggcucaagucucccggcc

SEQ ID NO: 1218766 - RNA, 16 nt, Mycobacterium bovis subsp bovis AF2122/97
ccgggaugccgccgcu

SEQ ID NO: 1218767 - RNA, 17 nt, Mycobacterium bovis subsp bovis AF2122/97
ccgggaggacaccagcu

SEQ ID NO: 1218768 - RNA, 23 nt, Mycobacterium bovis subsp bovis AF2122/97
ccgggaucuagaugcggaacgcc

SEQ ID NO: 1218769 - RNA, 16 nt, Mycobacterium bovis subsp bovis AF2122/97
ccgggccgcggcggcc

SEQ ID NO: 1218770 - RNA, 18 nt, Mycobacterium bovis subsp bovis AF2122/97
ccgggccguguccgccgg

SEQ ID NO: 1218771 - RNA, 15 nt, Mycobacterium bovis subsp bovis AF2122/97
ccgggccgccgcgau

SEQ ID NO: 1218772 - RNA, 20 nt, Mycobacterium bovis subsp bovis AF2122/97
ccgggccgccgcgauggccc

SEQ ID NO: 1218773 - RNA, 16 nt, Mycobacterium bovis subsp bovis AF2122/97
ccgggccgccagggcc

SEQ ID NO: 1218774 - RNA, 20 nt, Mycobacterium bovis subsp bovis AF2122/97
ccggcuugucgaccacgacc

SEQ ID NO: 1218775 - RNA, 16 nt, Mycobacterium bovis subsp bovis AF2122/97
ccggcuuggcggcgau

SEQ ID NO: 1218776 - RNA, 21 nt, Mycobacterium bovis subsp bovis AF2122/97
ccggcuugggccaggcccagc

SEQ ID NO: 1218777 - RNA, 18 nt, Mycobacterium bovis subsp bovis AF2122/97
ccggcuuucccaccgcuu

SEQ ID NO: 1218778 - RNA, 14 nt, Mycobacterium bovis subsp bovis AF2122/97
ccgggaaacaccgg

SEQ ID NO: 1218779 - RNA, 16 nt, Mycobacterium bovis subsp bovis AF2122/97
ccggcuuuugcgccca

SEQ ID NO: 1218780 - RNA, 20 nt, Mycobacterium bovis subsp bovis AF2122/97
ccggcucggaaaccgccccg

SEQ ID NO: 1218781 - RNA, 20 nt, Mycobacterium bovis subsp bovis AF2122/97
ccggcuuaccggcgggcgaa

SEQ ID NO: 1218782 - RNA, 23 nt, Mycobacterium bovis subsp bovis AF2122/97
ccggcuucggcgaacccuccgca

SEQ ID NO: 1218783 - RNA, 20 nt, Mycobacterium bovis subsp bovis AF2122/97
ccgggauagccgcgaccaga

SEQ ID NO: 1218784 - RNA, 22 nt, Mycobacterium bovis subsp bovis AF2122/97
ccgggagucgacggugccgucg

SEQ ID NO: 1218785 - RNA, 16 nt, Mycobacterium bovis subsp bovis AF2122/97
ccgggagugcgccggc

SEQ ID NO: 1218786 - RNA, 17 nt, Mycobacterium bovis subsp bovis AF2122/97
ccgggacuaccacccgc

SEQ ID NO: 1218787 - RNA, 13 nt, Mycobacterium bovis subsp bovis AF2122/97
ccgggacggcgau

SEQ ID NO: 1218788 - RNA, 18 nt, Mycobacterium bovis subsp bovis AF2122/97
ccgggaacgccucagggg

SEQ ID NO: 1218789 - RNA, 22 nt, Mycobacterium bovis subsp bovis AF2122/97
ccgggaacgccucaggggcgcc

SEQ ID NO: 1218790 - RNA, 19 nt, Mycobacterium bovis subsp bovis AF2122/97
ccgggaacgcugacgcccu

SEQ ID NO: 1218791 - RNA, 15 nt, Mycobacterium bovis subsp bovis AF2122/97
ccgggaaccaacacc

SEQ ID NO: 1218792 - RNA, 21 nt, Mycobacterium bovis subsp bovis AF2122/97
ccgggaccauagucgccgucg

SEQ ID NO: 1218793 - RNA, 16 nt, Mycobacterium bovis subsp bovis AF2122/97
ccgggaaggaaccggg

SEQ ID NO: 1218794 - RNA, 22 nt, Mycobacterium bovis subsp bovis AF2122/97
ccggcggacgcccggcgcacca

SEQ ID NO: 1218795 - RNA, 21 nt, Mycobacterium bovis subsp bovis AF2122/97
ccggcggacaccucgggcgcc

SEQ ID NO: 1218796 - RNA, 16 nt, Mycobacterium bovis subsp bovis AF2122/97
ccggcggcagcggcgc

SEQ ID NO: 1218797 - RNA, 21 nt, Mycobacterium bovis subsp bovis AF2122/97
ccggcggcagcggcgccgccu

SEQ ID NO: 1218798 - RNA, 15 nt, Mycobacterium bovis subsp bovis AF2122/97
ccggcggaagcggcg

SEQ ID NO: 1218799 - RNA, 14 nt, Mycobacterium bovis subsp bovis AF2122/97
ccggcggccgccau

SEQ ID NO: 1218800 - RNA, 23 nt, Mycobacterium bovis subsp bovis AF2122/97
ccggcggccgccaucagccgcug

SEQ ID NO: 1218801 - RNA, 15 nt, Mycobacterium bovis subsp bovis AF2122/97
ccggcggccauggug

SEQ ID NO: 1218802 - RNA, 18 nt, Mycobacterium bovis subsp bovis AF2122/97
ccggcggccauggugagu

SEQ ID NO: 1218803 - RNA, 14 nt, Mycobacterium bovis subsp bovis AF2122/97
ccggcucggccacc

SEQ ID NO: 1218804 - RNA, 14 nt, Mycobacterium bovis subsp bovis AF2122/97
ccggcucggccagc

SEQ ID NO: 1218805 - RNA, 19 nt, Mycobacterium bovis subsp bovis AF2122/97
ccggcucucuucgcgcgcu

SEQ ID NO: 1218806 - RNA, 18 nt, Mycobacterium bovis subsp bovis AF2122/97
ccggcucgucgauccccg

SEQ ID NO: 1218807 - RNA, 16 nt, Mycobacterium bovis subsp bovis AF2122/97
ccggcucggugcgcca

SEQ ID NO: 1218808 - RNA, 22 nt, Mycobacterium bovis subsp bovis AF2122/97
ccggcucggugcgccagaucac

SEQ ID NO: 1218809 - RNA, 16 nt, Mycobacterium bovis subsp bovis AF2122/97
ccggcucguccgggca

SEQ ID NO: 1218810 - RNA, 19 nt, Mycobacterium bovis subsp bovis AF2122/97
ccggugcgaucccacccuc

SEQ ID NO: 1218811 - RNA, 15 nt, Mycobacterium bovis subsp bovis AF2122/97
ccggugcgcaccagc

SEQ ID NO: 1218812 - RNA, 16 nt, Mycobacterium bovis subsp bovis AF2122/97
ccggugcgcaccagca

SEQ ID NO: 1218813 - RNA, 13 nt, Mycobacterium bovis subsp bovis AF2122/97
ccggugccgcgau

SEQ ID NO: 1218814 - RNA, 13 nt, Mycobacterium bovis subsp bovis AF2122/97
ccggugccguugg

SEQ ID NO: 1218815 - RNA, 13 nt, Mycobacterium bovis subsp bovis AF2122/97
ccggugccgcggu

SEQ ID NO: 1218816 - RNA, 15 nt, Mycobacterium bovis subsp bovis AF2122/97
ccggugccugcaacg

SEQ ID NO: 1218817 - RNA, 15 nt, Mycobacterium bovis subsp bovis AF2122/97
ccggugccgccgucg

SEQ ID NO: 1218818 - RNA, 15 nt, Mycobacterium bovis subsp bovis AF2122/97
ccggugccgccgcgg

SEQ ID NO: 1218819 - RNA, 23 nt, Mycobacterium bovis subsp bovis AF2122/97
ccggugccgccgcggccaccacc

SEQ ID NO: 1218820 - RNA, 13 nt, Mycobacterium bovis subsp bovis AF2122/97
ccggugccgccgg

SEQ ID NO: 1218821 - RNA, 22 nt, Mycobacterium bovis subsp bovis AF2122/97
ccggugccgccguucccaccac

SEQ ID NO: 1218822 - RNA, 23 nt, Mycobacterium bovis subsp bovis AF2122/97
ccggugccgccguugccauugcc

SEQ ID NO: 1218823 - RNA, 15 nt, Mycobacterium bovis subsp bovis AF2122/97
ccggugccgccuccg

SEQ ID NO: 1218824 - RNA, 21 nt, Mycobacterium bovis subsp bovis AF2122/97
ccggugccgccugcgccgcca

SEQ ID NO: 1218825 - RNA, 18 nt, Mycobacterium bovis subsp bovis AF2122/97
ccggugacgacgucgccg

SEQ ID NO: 1218826 - RNA, 22 nt, Mycobacterium bovis subsp bovis AF2122/97
ccggucuugcaucgccaaugcg

SEQ ID NO: 1218827 - RNA, 13 nt, Mycobacterium bovis subsp bovis AF2122/97
ccggugaacaggg

SEQ ID NO: 1218828 - RNA, 15 nt, Mycobacterium bovis subsp bovis AF2122/97
ccggugacggggcug

SEQ ID NO: 1218829 - RNA, 21 nt, Mycobacterium bovis subsp bovis AF2122/97
ccggugacccgcugggccgca

SEQ ID NO: 1218830 - RNA, 18 nt, Mycobacterium bovis subsp bovis AF2122/97
ccggugacguggugggcu

SEQ ID NO: 1218831 - RNA, 21 nt, Mycobacterium bovis subsp bovis AF2122/97
ccgguggugccggcgccgcca

SEQ ID NO: 1218832 - RNA, 17 nt, Mycobacterium bovis subsp bovis AF2122/97
ccgguggugggccgugg

SEQ ID NO: 1218833 - RNA, 19 nt, Mycobacterium bovis subsp bovis AF2122/97
ccgguguagcagcgccagc

SEQ ID NO: 1218834 - RNA, 23 nt, Mycobacterium bovis subsp bovis AF2122/97
ccgguguagcagcgccagcagcu

SEQ ID NO: 1218835 - RNA, 22 nt, Mycobacterium bovis subsp bovis AF2122/97
ccgguggggucggucuggcugg

SEQ ID NO: 1218836 - RNA, 19 nt, Mycobacterium bovis subsp bovis AF2122/97
ccggugucggccagcaacu

SEQ ID NO: 1218837 - RNA, 18 nt, Mycobacterium bovis subsp bovis AF2122/97
ccgguguccuuggccgcc

SEQ ID NO: 1218838 - RNA, 23 nt, Mycobacterium bovis subsp bovis AF2122/97
ccgguguccuuggccgccacucg

SEQ ID NO: 1218839 - RNA, 24 nt, Mycobacterium bovis subsp bovis AF2122/97
ccggugucgaugcgcagcccgucg

SEQ ID NO: 1218840 - RNA, 13 nt, Mycobacterium bovis subsp bovis AF2122/97
ccggugggcggcu

SEQ ID NO: 1218841 - RNA, 18 nt, Mycobacterium bovis subsp bovis AF2122/97
ccgguggcggcggcggca

SEQ ID NO: 1218842 - RNA, 19 nt, Mycobacterium bovis subsp bovis AF2122/97
ccggugguaccggcggcgc

SEQ ID NO: 1218843 - RNA, 13 nt, Mycobacterium bovis subsp bovis AF2122/97
ccgguggucgcgc

SEQ ID NO: 1218844 - RNA, 18 nt, Mycobacterium bovis subsp bovis AF2122/97
ccgguggcuggccgccac

SEQ ID NO: 1218845 - RNA, 21 nt, Mycobacterium bovis subsp bovis AF2122/97
ccgggguccaucggggccguc

SEQ ID NO: 1218846 - RNA, 17 nt, Mycobacterium bovis subsp bovis AF2122/97
ccgggguagacgccccg

SEQ ID NO: 1218847 - RNA, 16 nt, Mycobacterium bovis subsp bovis AF2122/97
ccggggggcugcugcu

SEQ ID NO: 1218848 - RNA, 18 nt, Mycobacterium bovis subsp bovis AF2122/97
ccggggugcccggccgcc

SEQ ID NO: 1218849 - RNA, 22 nt, Mycobacterium bovis subsp bovis AF2122/97
ccggggugcccccggugccgcc

SEQ ID NO: 1218850 - RNA, 14 nt, Mycobacterium bovis subsp bovis AF2122/97
ccggggugcccccg

SEQ ID NO: 1218851 - RNA, 12 nt, Mycobacterium bovis subsp bovis AF2122/97
ccggggucggcc

SEQ ID NO: 1218852 - RNA, 23 nt, Mycobacterium bovis subsp bovis AF2122/97
ccgggguccaucggggccgucgg

SEQ ID NO: 1218853 - RNA, 22 nt, Mycobacterium bovis subsp bovis AF2122/97
ccggggugaaaaucgccaucgg

SEQ ID NO: 1218854 - RNA, 12 nt, Mycobacterium bovis subsp bovis AF2122/97
ccgggguggcgc

SEQ ID NO: 1218855 - RNA, 15 nt, Mycobacterium bovis subsp bovis AF2122/97
ccggggugugcgggc

SEQ ID NO: 1218856 - RNA, 22 nt, Mycobacterium bovis subsp bovis AF2122/97
ccggguaaagcgaugggaacgg

SEQ ID NO: 1218857 - RNA, 12 nt, Mycobacterium bovis subsp bovis AF2122/97
ccggguaccgag

SEQ ID NO: 1218858 - RNA, 18 nt, Mycobacterium bovis subsp bovis AF2122/97
ccggguagcggcgccgcc

SEQ ID NO: 1218859 - RNA, 17 nt, Mycobacterium bovis subsp bovis AF2122/97
ccgguccucgucggcga

SEQ ID NO: 1218860 - RNA, 19 nt, Mycobacterium bovis subsp bovis AF2122/97
ccgguccgucaccaccgcc

SEQ ID NO: 1218861 - RNA, 23 nt, Mycobacterium bovis subsp bovis AF2122/97
ccgguccgucaccaccgccgcca

SEQ ID NO: 1218862 - RNA, 23 nt, Mycobacterium bovis subsp bovis AF2122/97
ccgguccagcgccggaagcuucg

SEQ ID NO: 1218863 - RNA, 16 nt, Mycobacterium bovis subsp bovis AF2122/97
ccgguccagcggccgc

SEQ ID NO: 1218864 - RNA, 15 nt, Mycobacterium bovis subsp bovis AF2122/97
ccggucccccgccca

SEQ ID NO: 1218865 - RNA, 13 nt, Mycobacterium bovis subsp bovis AF2122/97
ccgguccccgccg

SEQ ID NO: 1218866 - RNA, 17 nt, Mycobacterium bovis subsp bovis AF2122/97
ccgguccccgccggcgg

SEQ ID NO: 1218867 - RNA, 13 nt, Mycobacterium bovis subsp bovis AF2122/97
ccgguccagaccc

SEQ ID NO: 1218868 - RNA, 19 nt, Mycobacterium bovis subsp bovis AF2122/97
ccgguccagcagcucggcc

SEQ ID NO: 1218869 - RNA, 19 nt, Mycobacterium bovis subsp bovis AF2122/97
ccggucgacgggucggcgc

SEQ ID NO: 1218870 - RNA, 20 nt, Mycobacterium bovis subsp bovis AF2122/97
ccggucgagccagcggagca

SEQ ID NO: 1218871 - RNA, 15 nt, Mycobacterium bovis subsp bovis AF2122/97
ccggucgacccacuc

SEQ ID NO: 1218872 - RNA, 22 nt, Mycobacterium bovis subsp bovis AF2122/97
ccggucugcugggcacgauggc

SEQ ID NO: 1218873 - RNA, 23 nt, Mycobacterium bovis subsp bovis AF2122/97
ccggucucgacggcggccgcgau

SEQ ID NO: 1218874 - RNA, 14 nt, Mycobacterium bovis subsp bovis AF2122/97
ccguauagcgugac

SEQ ID NO: 1218875 - RNA, 22 nt, Mycobacterium bovis subsp bovis AF2122/97
ccguagugaacggcucgggcag

SEQ ID NO: 1218876 - RNA, 16 nt, Mycobacterium bovis subsp bovis AF2122/97
ccguagcgcccacucc

SEQ ID NO: 1218877 - RNA, 17 nt, Mycobacterium bovis subsp bovis AF2122/97
ccguagcgcagcgccuc

SEQ ID NO: 1218878 - RNA, 15 nt, Mycobacterium bovis subsp bovis AF2122/97
ccguagcaccacauc

SEQ ID NO: 1218879 - RNA, 17 nt, Mycobacterium bovis subsp bovis AF2122/97
ccguagcguccgcgccc

SEQ ID NO: 1218880 - RNA, 14 nt, Mycobacterium bovis subsp bovis AF2122/97
ccguaggccacagc

SEQ ID NO: 1218881 - RNA, 22 nt, Mycobacterium bovis subsp bovis AF2122/97
ccgucaaccagggugccggcgg

SEQ ID NO: 1218882 - RNA, 16 nt, Mycobacterium bovis subsp bovis AF2122/97
ccguaucggggcacca

SEQ ID NO: 1218883 - RNA, 15 nt, Mycobacterium bovis subsp bovis AF2122/97
ccgguuucuucuuca

SEQ ID NO: 1218884 - RNA, 18 nt, Mycobacterium bovis subsp bovis AF2122/97
ccgguuugacguccaggg

SEQ ID NO: 1218885 - RNA, 23 nt, Mycobacterium bovis subsp bovis AF2122/97
ccgguuugacguccagggccacg

SEQ ID NO: 1218886 - RNA, 19 nt, Mycobacterium bovis subsp bovis AF2122/97
ccguagaagcgcuccagcu

SEQ ID NO: 1218887 - RNA, 20 nt, Mycobacterium bovis subsp bovis AF2122/97
ccguagagcaugccgcccgc

SEQ ID NO: 1218888 - RNA, 19 nt, Mycobacterium bovis subsp bovis AF2122/97
ccguagacgccgagcaagg

SEQ ID NO: 1218889 - RNA, 16 nt, Mycobacterium bovis subsp bovis AF2122/97
ccguacaaccacccac

SEQ ID NO: 1218890 - RNA, 22 nt, Mycobacterium bovis subsp bovis AF2122/97
ccgucaguucggugugcggcgc

SEQ ID NO: 1218891 - RNA, 19 nt, Mycobacterium bovis subsp bovis AF2122/97
ccgucagggucagcuggga

SEQ ID NO: 1218892 - RNA, 12 nt, Mycobacterium bovis subsp bovis AF2122/97
ccgucagcgccg

SEQ ID NO: 1218893 - RNA, 17 nt, Mycobacterium bovis subsp bovis AF2122/97
ccgucagcgccgcgcgc

SEQ ID NO: 1218894 - RNA, 21 nt, Mycobacterium bovis subsp bovis AF2122/97
ccgucagcgccgcugacuccu

SEQ ID NO: 1218895 - RNA, 17 nt, Mycobacterium bovis subsp bovis AF2122/97
ccgucagcgcgaccguc

SEQ ID NO: 1218896 - RNA, 15 nt, Mycobacterium bovis subsp bovis AF2122/97
ccgucagcggacagu

SEQ ID NO: 1218897 - RNA, 23 nt, Mycobacterium bovis subsp bovis AF2122/97
ccgucaccgaucgaacagugccu

SEQ ID NO: 1218898 - RNA, 14 nt, Mycobacterium bovis subsp bovis AF2122/97
ccgucaccaccgcc

SEQ ID NO: 1218899 - RNA, 14 nt, Mycobacterium bovis subsp bovis AF2122/97
ccgucacccccgau

SEQ ID NO: 1218900 - RNA, 13 nt, Mycobacterium bovis subsp bovis AF2122/97
ccgucacaggccg

SEQ ID NO: 1218901 - RNA, 14 nt, Mycobacterium bovis subsp bovis AF2122/97
ccgucaccgccggc

SEQ ID NO: 1218902 - RNA, 19 nt, Mycobacterium bovis subsp bovis AF2122/97
ccguccagcgccgcggccc

SEQ ID NO: 1218903 - RNA, 12 nt, Mycobacterium bovis subsp bovis AF2122/97
ccguccaggacg

SEQ ID NO: 1218904 - RNA, 21 nt, Mycobacterium bovis subsp bovis AF2122/97
aaaccuugcggcagaccaagc

SEQ ID NO: 1218905 - RNA, 23 nt, Mycobacterium bovis subsp bovis AF2122/97
ccgucauggcgaaccgucagcgc

SEQ ID NO: 1218906 - RNA, 12 nt, Mycobacterium bovis subsp bovis AF2122/97
ccgucauggcga

SEQ ID NO: 1218907 - RNA, 14 nt, Mycobacterium bovis subsp bovis AF2122/97
ccgucauuggcuug

SEQ ID NO: 1218908 - RNA, 16 nt, Mycobacterium bovis subsp bovis AF2122/97
ccguccaauagcugac

SEQ ID NO: 1218909 - RNA, 19 nt, Mycobacterium bovis subsp bovis AF2122/97
ccgucccgauacggccggc

SEQ ID NO: 1218910 - RNA, 14 nt, Mycobacterium bovis subsp bovis AF2122/97
ccgucccagcugac

SEQ ID NO: 1218911 - RNA, 14 nt, Mycobacterium bovis subsp bovis AF2122/97
ccguccccgcagcg

SEQ ID NO: 1218912 - RNA, 15 nt, Mycobacterium bovis subsp bovis AF2122/97
ccguccccgccgacg

SEQ ID NO: 1218913 - RNA, 13 nt, Mycobacterium bovis subsp bovis AF2122/97
ccgucccaccagc

SEQ ID NO: 1218914 - RNA, 21 nt, Mycobacterium bovis subsp bovis AF2122/97
ccgucccacgugugcggaagc

SEQ ID NO: 1218915 - RNA, 20 nt, Mycobacterium bovis subsp bovis AF2122/97
ccgucccaggugcaagcggu

SEQ ID NO: 1218916 - RNA, 20 nt, Mycobacterium bovis subsp bovis AF2122/97
ccgucccgcgagcagcccgg

SEQ ID NO: 1218917 - RNA, 14 nt, Mycobacterium bovis subsp bovis AF2122/97
ccgucccggccucg

SEQ ID NO: 1218918 - RNA, 15 nt, Mycobacterium bovis subsp bovis AF2122/97
ccguccgggucacca

SEQ ID NO: 1218919 - RNA, 19 nt, Mycobacterium bovis subsp bovis AF2122/97
ccguccucgcuauugggug

SEQ ID NO: 1218920 - RNA, 16 nt, Mycobacterium bovis subsp bovis AF2122/97
ccguccucccacaggu

SEQ ID NO: 1218921 - RNA, 20 nt, Mycobacterium bovis subsp bovis AF2122/97
ccguccggccgggcccucca

SEQ ID NO: 1218922 - RNA, 19 nt, Mycobacterium bovis subsp bovis AF2122/97
ccguccggggccgcggccc

SEQ ID NO: 1218923 - RNA, 19 nt, Mycobacterium bovis subsp bovis AF2122/97
ccgucgaaccagaggucac

SEQ ID NO: 1218924 - RNA, 14 nt, Mycobacterium bovis subsp bovis AF2122/97
ccguccuuuccagg

SEQ ID NO: 1218925 - RNA, 18 nt, Mycobacterium bovis subsp bovis AF2122/97
ccgucgaaauacccgguc

SEQ ID NO: 1218926 - RNA, 12 nt, Mycobacterium bovis subsp bovis AF2122/97
ccguccugcagg

SEQ ID NO: 1218927 - RNA, 18 nt, Mycobacterium bovis subsp bovis AF2122/97
ccgucgauccgucggcgg

SEQ ID NO: 1218928 - RNA, 22 nt, Mycobacterium bovis subsp bovis AF2122/97
ccgucgccacgcccagcgcccg

SEQ ID NO: 1218929 - RNA, 14 nt, Mycobacterium bovis subsp bovis AF2122/97
ccgucgccaccggu

SEQ ID NO: 1218930 - RNA, 20 nt, Mycobacterium bovis subsp bovis AF2122/97
ccgucgcagccagcugaaca

SEQ ID NO: 1218931 - RNA, 17 nt, Mycobacterium bovis subsp bovis AF2122/97
aaacgauugcugcggcu

SEQ ID NO: 1218932 - RNA, 18 nt, Mycobacterium bovis subsp bovis AF2122/97
ccgucgauguugcccagc

SEQ ID NO: 1218933 - RNA, 20 nt, Mycobacterium bovis subsp bovis AF2122/97
ccgucgauugcaggucggcc

SEQ ID NO: 1218934 - RNA, 19 nt, Mycobacterium bovis subsp bovis AF2122/97
ccgucggugauggagccgg

SEQ ID NO: 1218935 - RNA, 18 nt, Mycobacterium bovis subsp bovis AF2122/97
ccgucggugccgccgccg

SEQ ID NO: 1218936 - RNA, 20 nt, Mycobacterium bovis subsp bovis AF2122/97
ccgucggugggugccagccg

SEQ ID NO: 1218937 - RNA, 22 nt, Mycobacterium bovis subsp bovis AF2122/97
ccgucggugggugccagccggu

SEQ ID NO: 1218938 - RNA, 23 nt, Mycobacterium bovis subsp bovis AF2122/97
ccgucgggugcagcacggcgccg

SEQ ID NO: 1218939 - RNA, 20 nt, Mycobacterium bovis subsp bovis AF2122/97
ccgucggggucaacaggccg

SEQ ID NO: 1218940 - RNA, 23 nt, Mycobacterium bovis subsp bovis AF2122/97
ccgucggugguguuccaggucau

SEQ ID NO: 1218941 - RNA, 21 nt, Mycobacterium bovis subsp bovis AF2122/97
ccgucugcggaccggcgcgcu

SEQ ID NO: 1218942 - RNA, 20 nt, Mycobacterium bovis subsp bovis AF2122/97
ccgucugcggggugagugac

SEQ ID NO: 1218943 - RNA, 12 nt, Mycobacterium bovis subsp bovis AF2122/97
ccgucggcggcg

SEQ ID NO: 1218944 - RNA, 14 nt, Mycobacterium bovis subsp bovis AF2122/97
ccgucggcgcccgg

SEQ ID NO: 1218945 - RNA, 20 nt, Mycobacterium bovis subsp bovis AF2122/97
ccgucggcgcucgucgcggc

SEQ ID NO: 1218946 - RNA, 12 nt, Mycobacterium bovis subsp bovis AF2122/97
ccgucgccgccc

SEQ ID NO: 1218947 - RNA, 13 nt, Mycobacterium bovis subsp bovis AF2122/97
ccgucggcgagca

SEQ ID NO: 1218948 - RNA, 19 nt, Mycobacterium bovis subsp bovis AF2122/97
ccgucggcgugcagcagcu

SEQ ID NO: 1218949 - RNA, 16 nt, Mycobacterium bovis subsp bovis AF2122/97
ccgucgggcccagccg

SEQ ID NO: 1218950 - RNA, 18 nt, Mycobacterium bovis subsp bovis AF2122/97
ccgucgggcccagccgga

SEQ ID NO: 1218951 - RNA, 17 nt, Mycobacterium bovis subsp bovis AF2122/97
ccgugaagcccuggcca

SEQ ID NO: 1218952 - RNA, 18 nt, Mycobacterium bovis subsp bovis AF2122/97
ccgugaaucgagcaccgc

SEQ ID NO: 1218953 - RNA, 22 nt, Mycobacterium bovis subsp bovis AF2122/97
ccgugaauggcagcacgaccug

SEQ ID NO: 1218954 - RNA, 14 nt, Mycobacterium bovis subsp bovis AF2122/97
ccgugaccagccgg

SEQ ID NO: 1218955 - RNA, 15 nt, Mycobacterium bovis subsp bovis AF2122/97
ccgugaccgccgcgc

SEQ ID NO: 1218956 - RNA, 16 nt, Mycobacterium bovis subsp bovis AF2122/97
ccgugaccgccgcgcc

SEQ ID NO: 1218957 - RNA, 17 nt, Mycobacterium bovis subsp bovis AF2122/97
ccgugaccgccgcgccg

SEQ ID NO: 1218958 - RNA, 18 nt, Mycobacterium bovis subsp bovis AF2122/97
ccgugagcaccagcagca

SEQ ID NO: 1218959 - RNA, 14 nt, Mycobacterium bovis subsp bovis AF2122/97
ccgugagcaccagc

SEQ ID NO: 1218960 - RNA, 15 nt, Mycobacterium bovis subsp bovis AF2122/97
ccgucuuccagccag

SEQ ID NO: 1218961 - RNA, 15 nt, Mycobacterium bovis subsp bovis AF2122/97
ccgugaaccgcccgc

SEQ ID NO: 1218962 - RNA, 20 nt, Mycobacterium bovis subsp bovis AF2122/97
ccucaccgccugugccgccg

SEQ ID NO: 1218963 - RNA, 19 nt, Mycobacterium bovis subsp bovis AF2122/97
ccucaaggagcccguccag

SEQ ID NO: 1218964 - RNA, 22 nt, Mycobacterium bovis subsp bovis AF2122/97
ccucaccggguuggaagccgca

SEQ ID NO: 1218965 - RNA, 18 nt, Mycobacterium bovis subsp bovis AF2122/97
ccucaacgaucgcgccgu

SEQ ID NO: 1218966 - RNA, 18 nt, Mycobacterium bovis subsp bovis AF2122/97
ccucacguggacugaccu

SEQ ID NO: 1218967 - RNA, 11 nt, Mycobacterium bovis subsp bovis AF2122/97
ccucagcugcu

SEQ ID NO: 1218968 - RNA, 19 nt, Mycobacterium bovis subsp bovis AF2122/97
ccgugccgcccgcgccgcc

SEQ ID NO: 1218969 - RNA, 15 nt, Mycobacterium bovis subsp bovis AF2122/97
ccgugcgcgcgcagc

SEQ ID NO: 1218970 - RNA, 16 nt, Mycobacterium bovis subsp bovis AF2122/97
ccgugcgaucaccucc

SEQ ID NO: 1218971 - RNA, 18 nt, Mycobacterium bovis subsp bovis AF2122/97
ccgugcgaucgucaacga

SEQ ID NO: 1218972 - RNA, 18 nt, Mycobacterium bovis subsp bovis AF2122/97
ccgugccuggccggugcg

SEQ ID NO: 1218973 - RNA, 15 nt, Mycobacterium bovis subsp bovis AF2122/97
ccgugccgucggcgu

SEQ ID NO: 1218974 - RNA, 18 nt, Mycobacterium bovis subsp bovis AF2122/97
ccgugccgucggcgugca

SEQ ID NO: 1218975 - RNA, 12 nt, Mycobacterium bovis subsp bovis AF2122/97
ccgugccgucgg

SEQ ID NO: 1218976 - RNA, 14 nt, Mycobacterium bovis subsp bovis AF2122/97
ccgugcggucgcgc

SEQ ID NO: 1218977 - RNA, 14 nt, Mycobacterium bovis subsp bovis AF2122/97
ccgugcggcggcug

SEQ ID NO: 1218978 - RNA, 17 nt, Mycobacterium bovis subsp bovis AF2122/97
ccgugcggcggcugccg

SEQ ID NO: 1218979 - RNA, 19 nt, Mycobacterium bovis subsp bovis AF2122/97
ccgugcggcucgccggcgg

SEQ ID NO: 1218980 - RNA, 22 nt, Mycobacterium bovis subsp bovis AF2122/97
ccuaucguuaucgacaccacca

SEQ ID NO: 1218981 - RNA, 16 nt, Mycobacterium bovis subsp bovis AF2122/97
ccuaugauucagccgg

SEQ ID NO: 1218982 - RNA, 19 nt, Mycobacterium bovis subsp bovis AF2122/97
ccuccagcaggucgccugc

SEQ ID NO: 1218983 - RNA, 16 nt, Mycobacterium bovis subsp bovis AF2122/97
ccuccagcagcgacgg

SEQ ID NO: 1218984 - RNA, 19 nt, Mycobacterium bovis subsp bovis AF2122/97
ccuccagcagcgacgguca

SEQ ID NO: 1218985 - RNA, 11 nt, Mycobacterium bovis subsp bovis AF2122/97
ccuccagcacc

SEQ ID NO: 1218986 - RNA, 15 nt, Mycobacterium bovis subsp bovis AF2122/97
ccuccagcacccggu

SEQ ID NO: 1218987 - RNA, 19 nt, Mycobacterium bovis subsp bovis AF2122/97
ccuccagcacgccguccag

SEQ ID NO: 1218988 - RNA, 16 nt, Mycobacterium bovis subsp bovis AF2122/97
ccuccagcgcaccggu

SEQ ID NO: 1218989 - RNA, 18 nt, Mycobacterium bovis subsp bovis AF2122/97
ccuccagcugcgcgggcg

SEQ ID NO: 1218990 - RNA, 15 nt, Mycobacterium bovis subsp bovis AF2122/97
ccucccuuccgcgcu

SEQ ID NO: 1218991 - RNA, 14 nt, Mycobacterium bovis subsp bovis AF2122/97
ccuccgccaaggag

SEQ ID NO: 1218992 - RNA, 17 nt, Mycobacterium bovis subsp bovis AF2122/97
ccuccgacggccgcggc

SEQ ID NO: 1218993 - RNA, 13 nt, Mycobacterium bovis subsp bovis AF2122/97
ccuccgagcacag

SEQ ID NO: 1218994 - RNA, 21 nt, Mycobacterium bovis subsp bovis AF2122/97
ccuccgaggaauacagcuuga

SEQ ID NO: 1218995 - RNA, 23 nt, Mycobacterium bovis subsp bovis AF2122/97
ccucccgcaaugcgagcgcgccg

SEQ ID NO: 1218996 - RNA, 16 nt, Mycobacterium bovis subsp bovis AF2122/97
ccucccgcagccgggc

SEQ ID NO: 1218997 - RNA, 19 nt, Mycobacterium bovis subsp bovis AF2122/97
ccucccgcagccgggcacc

SEQ ID NO: 1218998 - RNA, 13 nt, Mycobacterium bovis subsp bovis AF2122/97
ccucccgcggcac

SEQ ID NO: 1218999 - RNA, 14 nt, Mycobacterium bovis subsp bovis AF2122/97
ccucccgcggcacc

SEQ ID NO: 1219000 - RNA, 20 nt, Mycobacterium bovis subsp bovis AF2122/97
ccuccccgaccgccaccgcc

SEQ ID NO: 1219001 - RNA, 19 nt, Mycobacterium bovis subsp bovis AF2122/97
ccucccgggcccgcugggc

SEQ ID NO: 1219002 - RNA, 13 nt, Mycobacterium bovis subsp bovis AF2122/97
ccucccgggcccg

SEQ ID NO: 1219003 - RNA, 21 nt, Mycobacterium bovis subsp bovis AF2122/97
ccucauagagcggcaccagau

SEQ ID NO: 1219004 - RNA, 22 nt, Mycobacterium bovis subsp bovis AF2122/97
ccucauagauacagucgaccgg

SEQ ID NO: 1219005 - RNA, 17 nt, Mycobacterium bovis subsp bovis AF2122/97
aaacgcccgcgcugccg

SEQ ID NO: 1219006 - RNA, 13 nt, Mycobacterium bovis subsp bovis AF2122/97
ccucaugcacgcc

SEQ ID NO: 1219007 - RNA, 21 nt, Mycobacterium bovis subsp bovis AF2122/97
ccucaugcacgccguagcauc

SEQ ID NO: 1219008 - RNA, 12 nt, Mycobacterium bovis subsp bovis AF2122/97
ccucgcccuccc

SEQ ID NO: 1219009 - RNA, 16 nt, Mycobacterium bovis subsp bovis AF2122/97
ccucgccccaccggcc

SEQ ID NO: 1219010 - RNA, 18 nt, Mycobacterium bovis subsp bovis AF2122/97
ccuccgcguagagcagca

SEQ ID NO: 1219011 - RNA, 21 nt, Mycobacterium bovis subsp bovis AF2122/97
ccuccgccgaggaaaccacca

SEQ ID NO: 1219012 - RNA, 24 nt, Mycobacterium bovis subsp bovis AF2122/97
ccuccguaacgccaagcucggccc

SEQ ID NO: 1219013 - RNA, 17 nt, Mycobacterium bovis subsp bovis AF2122/97
ccuccgcgacggcggcu

SEQ ID NO: 1219014 - RNA, 16 nt, Mycobacterium bovis subsp bovis AF2122/97
ccuccguugcccccau

SEQ ID NO: 1219015 - RNA, 19 nt, Mycobacterium bovis subsp bovis AF2122/97
ccuccgucagcgccgcgcg

SEQ ID NO: 1219016 - RNA, 16 nt, Mycobacterium bovis subsp bovis AF2122/97
ccuccgucagcgccgc

SEQ ID NO: 1219017 - RNA, 14 nt, Mycobacterium bovis subsp bovis AF2122/97
ccuccuccccgacc

SEQ ID NO: 1219018 - RNA, 16 nt, Mycobacterium bovis subsp bovis AF2122/97
ccuccucgugcaggac

SEQ ID NO: 1219019 - RNA, 14 nt, Mycobacterium bovis subsp bovis AF2122/97
ccuccuccguuugg

SEQ ID NO: 1219020 - RNA, 14 nt, Mycobacterium bovis subsp bovis AF2122/97
ccuccucgagcagg

SEQ ID NO: 1219021 - RNA, 18 nt, Mycobacterium bovis subsp bovis AF2122/97
ccucgcggaugagcucgg

SEQ ID NO: 1219022 - RNA, 17 nt, Mycobacterium bovis subsp bovis AF2122/97
ccucgcuaacuccccag

SEQ ID NO: 1219023 - RNA, 19 nt, Mycobacterium bovis subsp bovis AF2122/97
ccucgcggagccgucgcau

SEQ ID NO: 1219024 - RNA, 17 nt, Mycobacterium bovis subsp bovis AF2122/97
ccucgcgggaagucccg

SEQ ID NO: 1219025 - RNA, 21 nt, Mycobacterium bovis subsp bovis AF2122/97
ccucggcgcgaaaccagucca

SEQ ID NO: 1219026 - RNA, 23 nt, Mycobacterium bovis subsp bovis AF2122/97
ccucgggguucuuccacagcgcg

SEQ ID NO: 1219027 - RNA, 18 nt, Mycobacterium bovis subsp bovis AF2122/97
ccucggcgagcacgucac

SEQ ID NO: 1219028 - RNA, 18 nt, Mycobacterium bovis subsp bovis AF2122/97
ccucggcgaugggccggu

SEQ ID NO: 1219029 - RNA, 22 nt, Mycobacterium bovis subsp bovis AF2122/97
ccucggcgaagucacgcacccg

SEQ ID NO: 1219030 - RNA, 18 nt, Mycobacterium bovis subsp bovis AF2122/97
ccucggccucgucgugca

SEQ ID NO: 1219031 - RNA, 21 nt, Mycobacterium bovis subsp bovis AF2122/97
ccucgguagcauccagcgcgc

SEQ ID NO: 1219032 - RNA, 20 nt, Mycobacterium bovis subsp bovis AF2122/97
ccucggugaccaggccggcc

SEQ ID NO: 1219033 - RNA, 23 nt, Mycobacterium bovis subsp bovis AF2122/97
ccucggugaccaggccggcccgc

SEQ ID NO: 1219034 - RNA, 23 nt, Mycobacterium bovis subsp bovis AF2122/97
ccucggugcggaacaccgcccgg

SEQ ID NO: 1219035 - RNA, 23 nt, Mycobacterium bovis subsp bovis AF2122/97
ccucguacucaucgacguuccag

SEQ ID NO: 1219036 - RNA, 21 nt, Mycobacterium bovis subsp bovis AF2122/97
ccucgucggccgacaccgcca

SEQ ID NO: 1219037 - RNA, 22 nt, Mycobacterium bovis subsp bovis AF2122/97
ccucgucgggaucggcguccau

SEQ ID NO: 1219038 - RNA, 23 nt, Mycobacterium bovis subsp bovis AF2122/97
ccucgucggugugccagugcugc

SEQ ID NO: 1219039 - RNA, 17 nt, Mycobacterium bovis subsp bovis AF2122/97
ccucgucgugcaccucg

SEQ ID NO: 1219040 - RNA, 15 nt, Mycobacterium bovis subsp bovis AF2122/97
ccucgucgcgggcca

SEQ ID NO: 1219041 - RNA, 18 nt, Mycobacterium bovis subsp bovis AF2122/97
ccucgucgcgggccaccg

SEQ ID NO: 1219042 - RNA, 22 nt, Mycobacterium bovis subsp bovis AF2122/97
ccucgucgcgggccaccgcugu

SEQ ID NO: 1219043 - RNA, 16 nt, Mycobacterium bovis subsp bovis AF2122/97
ccucgucgcucccggu

SEQ ID NO: 1219044 - RNA, 15 nt, Mycobacterium bovis subsp bovis AF2122/97
ccucgucgccuagcc

SEQ ID NO: 1219045 - RNA, 19 nt, Mycobacterium bovis subsp bovis AF2122/97
ccucgucgagcgugcgcac

SEQ ID NO: 1219046 - RNA, 20 nt, Mycobacterium bovis subsp bovis AF2122/97
ccucgucgaucgccgcgaug

SEQ ID NO: 1219047 - RNA, 19 nt, Mycobacterium bovis subsp bovis AF2122/97
ccucgucgaucgccgcgcc

SEQ ID NO: 1219048 - RNA, 23 nt, Mycobacterium bovis subsp bovis AF2122/97
ccucguccugcgagaggugcugc

SEQ ID NO: 1219049 - RNA, 17 nt, Mycobacterium bovis subsp bovis AF2122/97
ccucgucaaucaccacc

SEQ ID NO: 1219050 - RNA, 14 nt, Mycobacterium bovis subsp bovis AF2122/97
ccucguuguagccg

SEQ ID NO: 1219051 - RNA, 19 nt, Mycobacterium bovis subsp bovis AF2122/97
ccucguuaucgaccgccgc

SEQ ID NO: 1219052 - RNA, 18 nt, Mycobacterium bovis subsp bovis AF2122/97
ccucgucguaccguucgg

SEQ ID NO: 1219053 - RNA, 19 nt, Mycobacterium bovis subsp bovis AF2122/97
ccucgugaguugacggugg

SEQ ID NO: 1219054 - RNA, 14 nt, Mycobacterium bovis subsp bovis AF2122/97
ccucgugcagcacu

SEQ ID NO: 1219055 - RNA, 21 nt, Mycobacterium bovis subsp bovis AF2122/97
ccucgugcgugggcgcggcgc

SEQ ID NO: 1219056 - RNA, 16 nt, Mycobacterium bovis subsp bovis AF2122/97
ccucuccguccucguc

SEQ ID NO: 1219057 - RNA, 12 nt, Mycobacterium bovis subsp bovis AF2122/97
ccucucugcgcc

SEQ ID NO: 1219058 - RNA, 14 nt, Mycobacterium bovis subsp bovis AF2122/97
ccucucugcgccag

SEQ ID NO: 1219059 - RNA, 15 nt, Mycobacterium bovis subsp bovis AF2122/97
ccucucugcgccagg

SEQ ID NO: 1219060 - RNA, 19 nt, Mycobacterium bovis subsp bovis AF2122/97
ccucucugucgcguugugg

SEQ ID NO: 1219061 - RNA, 22 nt, Mycobacterium bovis subsp bovis AF2122/97
ccucuaugcgggcagcgaucuu

SEQ ID NO: 1219062 - RNA, 19 nt, Mycobacterium bovis subsp bovis AF2122/97
ccugacgaucauugcaccc

SEQ ID NO: 1219063 - RNA, 23 nt, Mycobacterium bovis subsp bovis AF2122/97
ccugacgguaaaugucgaacagg

SEQ ID NO: 1219064 - RNA, 21 nt, Mycobacterium bovis subsp bovis AF2122/97
ccugacggaaguacuccaugg

SEQ ID NO: 1219065 - RNA, 19 nt, Mycobacterium bovis subsp bovis AF2122/97
ccugacgaaggucuccggc

SEQ ID NO: 1219066 - RNA, 16 nt, Mycobacterium bovis subsp bovis AF2122/97
ccugacgaucauugca

SEQ ID NO: 1219067 - RNA, 13 nt, Mycobacterium bovis subsp bovis AF2122/97
ccugacagcgagc

SEQ ID NO: 1219068 - RNA, 18 nt, Mycobacterium bovis subsp bovis AF2122/97
ccugacacgcccgcgagc

SEQ ID NO: 1219069 - RNA, 13 nt, Mycobacterium bovis subsp bovis AF2122/97
ccugagcucccgc

SEQ ID NO: 1219070 - RNA, 23 nt, Mycobacterium bovis subsp bovis AF2122/97
ccugagucggcauugcugguugc

SEQ ID NO: 1219071 - RNA, 21 nt, Mycobacterium bovis subsp bovis AF2122/97
ccugauaccaauccggcugcg

SEQ ID NO: 1219072 - RNA, 14 nt, Mycobacterium bovis subsp bovis AF2122/97
ccugagccaccaac

SEQ ID NO: 1219073 - RNA, 18 nt, Mycobacterium bovis subsp bovis AF2122/97
ccucuucgggugcagcca

SEQ ID NO: 1219074 - RNA, 17 nt, Mycobacterium bovis subsp bovis AF2122/97
ccucuucgggugcagcc

SEQ ID NO: 1219075 - RNA, 18 nt, Mycobacterium bovis subsp bovis AF2122/97
ccucuucgaucuguuccu

SEQ ID NO: 1219076 - RNA, 20 nt, Mycobacterium bovis subsp bovis AF2122/97
ccucugguggcgcugaagcc

SEQ ID NO: 1219077 - RNA, 13 nt, Mycobacterium bovis subsp bovis AF2122/97
ccucugcucagcc

SEQ ID NO: 1219078 - RNA, 23 nt, Mycobacterium bovis subsp bovis AF2122/97
ccugaaacgauugcugcggcuuu

SEQ ID NO: 1219079 - RNA, 14 nt, Mycobacterium bovis subsp bovis AF2122/97
ccugaaccggccgc

SEQ ID NO: 1219080 - RNA, 22 nt, Mycobacterium bovis subsp bovis AF2122/97
ccugaaucaccggagcgccgag

SEQ ID NO: 1219081 - RNA, 17 nt, Mycobacterium bovis subsp bovis AF2122/97
ccugaagccagcgcagc

SEQ ID NO: 1219082 - RNA, 18 nt, Mycobacterium bovis subsp bovis AF2122/97
ccugcgucgaaauccaca

SEQ ID NO: 1219083 - RNA, 23 nt, Mycobacterium bovis subsp bovis AF2122/97
ccugcgcggcugccgucuccugg

SEQ ID NO: 1219084 - RNA, 19 nt, Mycobacterium bovis subsp bovis AF2122/97
ccugcgcgacggcgcugug

SEQ ID NO: 1219085 - RNA, 17 nt, Mycobacterium bovis subsp bovis AF2122/97
ccugcgcgagugccagu

SEQ ID NO: 1219086 - RNA, 21 nt, Mycobacterium bovis subsp bovis AF2122/97
ccugcgcgagugccaguccga

SEQ ID NO: 1219087 - RNA, 24 nt, Mycobacterium bovis subsp bovis AF2122/97
ccugcgcggcgaucgcuccgcggc

SEQ ID NO: 1219088 - RNA, 13 nt, Mycobacterium bovis subsp bovis AF2122/97
ccugcgccgcgcg

SEQ ID NO: 1219089 - RNA, 20 nt, Mycobacterium bovis subsp bovis AF2122/97
ccugcgccgccagcgccgcc

SEQ ID NO: 1219090 - RNA, 13 nt, Mycobacterium bovis subsp bovis AF2122/97
ccugcgccgcagu

SEQ ID NO: 1219091 - RNA, 15 nt, Mycobacterium bovis subsp bovis AF2122/97
ccugcgccgaguugu

SEQ ID NO: 1219092 - RNA, 19 nt, Mycobacterium bovis subsp bovis AF2122/97
ccugcgccacacccggcac

SEQ ID NO: 1219093 - RNA, 19 nt, Mycobacterium bovis subsp bovis AF2122/97
ccugccgcacgggcccagg

SEQ ID NO: 1219094 - RNA, 22 nt, Mycobacterium bovis subsp bovis AF2122/97
ccugccgaucccgugguggcgc

SEQ ID NO: 1219095 - RNA, 21 nt, Mycobacterium bovis subsp bovis AF2122/97
ccugccacgacgaacaccagc

SEQ ID NO: 1219096 - RNA, 15 nt, Mycobacterium bovis subsp bovis AF2122/97
ccugcgagucgcgcu

SEQ ID NO: 1219097 - RNA, 12 nt, Mycobacterium bovis subsp bovis AF2122/97
ccugccgggcca

SEQ ID NO: 1219098 - RNA, 15 nt, Mycobacterium bovis subsp bovis AF2122/97
ccugccggcagcggc

SEQ ID NO: 1219099 - RNA, 14 nt, Mycobacterium bovis subsp bovis AF2122/97
ccugccacagcgac

SEQ ID NO: 1219100 - RNA, 23 nt, Mycobacterium bovis subsp bovis AF2122/97
ccugcagcgaaacaccggccagc

SEQ ID NO: 1219101 - RNA, 21 nt, Mycobacterium bovis subsp bovis AF2122/97
ccugcaagacgccgauccggu

SEQ ID NO: 1219102 - RNA, 19 nt, Mycobacterium bovis subsp bovis AF2122/97
ccugcaagcuaagcgccug

SEQ ID NO: 1219103 - RNA, 21 nt, Mycobacterium bovis subsp bovis AF2122/97
ccugcaacgucacucccuggc

SEQ ID NO: 1219104 - RNA, 22 nt, Mycobacterium bovis subsp bovis AF2122/97
ccugaucaaggaccgcucugcg

SEQ ID NO: 1219105 - RNA, 15 nt, Mycobacterium bovis subsp bovis AF2122/97
ccugauugaagcccc

SEQ ID NO: 1219106 - RNA, 23 nt, Mycobacterium bovis subsp bovis AF2122/97
ccuguccggugauccaacuggcc

SEQ ID NO: 1219107 - RNA, 23 nt, Mycobacterium bovis subsp bovis AF2122/97
ccuguccggcauaccgaacagca

SEQ ID NO: 1219108 - RNA, 17 nt, Mycobacterium bovis subsp bovis AF2122/97
ccugucccgcacccggc

SEQ ID NO: 1219109 - RNA, 16 nt, Mycobacterium bovis subsp bovis AF2122/97
ccugucccgccggccc

SEQ ID NO: 1219110 - RNA, 17 nt, Mycobacterium bovis subsp bovis AF2122/97
ccugucccgccggcccc

SEQ ID NO: 1219111 - RNA, 14 nt, Mycobacterium bovis subsp bovis AF2122/97
ccuguaugccgcgg

SEQ ID NO: 1219112 - RNA, 19 nt, Mycobacterium bovis subsp bovis AF2122/97
ccugucauguccugggccg

SEQ ID NO: 1219113 - RNA, 22 nt, Mycobacterium bovis subsp bovis AF2122/97
ccugucauguccugggccgccg

SEQ ID NO: 1219114 - RNA, 20 nt, Mycobacterium bovis subsp bovis AF2122/97
ccuguaguucgaugacugaa

SEQ ID NO: 1219115 - RNA, 16 nt, Mycobacterium bovis subsp bovis AF2122/97
ccuggucgagcacgcu

SEQ ID NO: 1219116 - RNA, 14 nt, Mycobacterium bovis subsp bovis AF2122/97
ccuggucaaccgcg

SEQ ID NO: 1219117 - RNA, 20 nt, Mycobacterium bovis subsp bovis AF2122/97
ccugguccaggcccuggcca

SEQ ID NO: 1219118 - RNA, 20 nt, Mycobacterium bovis subsp bovis AF2122/97
ccugcugcagggccuggcca

SEQ ID NO: 1219119 - RNA, 19 nt, Mycobacterium bovis subsp bovis AF2122/97
ccuggguuggcauccaaaa

SEQ ID NO: 1219120 - RNA, 17 nt, Mycobacterium bovis subsp bovis AF2122/97
ccugguaaggccggccg

SEQ ID NO: 1219121 - RNA, 18 nt, Mycobacterium bovis subsp bovis AF2122/97
ccugguaaggccggccgg

SEQ ID NO: 1219122 - RNA, 14 nt, Mycobacterium bovis subsp bovis AF2122/97
ccuggguggcgucg

SEQ ID NO: 1219123 - RNA, 17 nt, Mycobacterium bovis subsp bovis AF2122/97
ccuggguugaccgccac

SEQ ID NO: 1219124 - RNA, 14 nt, Mycobacterium bovis subsp bovis AF2122/97
ccugguacucccgc

SEQ ID NO: 1219125 - RNA, 23 nt, Mycobacterium bovis subsp bovis AF2122/97
ccugcugcaaccgacuucgaugg

SEQ ID NO: 1219126 - RNA, 19 nt, Mycobacterium bovis subsp bovis AF2122/97
ccugcugcagaaaggccaa

SEQ ID NO: 1219127 - RNA, 19 nt, Mycobacterium bovis subsp bovis AF2122/97
ccugcucgggggccgacca

SEQ ID NO: 1219128 - RNA, 17 nt, Mycobacterium bovis subsp bovis AF2122/97
ccugcuaaccacggugu

SEQ ID NO: 1219129 - RNA, 14 nt, Mycobacterium bovis subsp bovis AF2122/97
ccugugcgcgguga

SEQ ID NO: 1219130 - RNA, 18 nt, Mycobacterium bovis subsp bovis AF2122/97
ccugugcggagccgccau

SEQ ID NO: 1219131 - RNA, 18 nt, Mycobacterium bovis subsp bovis AF2122/97
ccuguuccagcgugccug

SEQ ID NO: 1219132 - RNA, 21 nt, Mycobacterium bovis subsp bovis AF2122/97
ccuguuugagcgcacucaccu

SEQ ID NO: 1219133 - RNA, 23 nt, Mycobacterium bovis subsp bovis AF2122/97
ccuguuguugucggugucgguga

SEQ ID NO: 1219134 - RNA, 23 nt, Mycobacterium bovis subsp bovis AF2122/97
ccuugccgccuuggcccccgggu

SEQ ID NO: 1219135 - RNA, 16 nt, Mycobacterium bovis subsp bovis AF2122/97
ccuugccgccggcccc

SEQ ID NO: 1219136 - RNA, 19 nt, Mycobacterium bovis subsp bovis AF2122/97
ccuugccgccggccccgcc

SEQ ID NO: 1219137 - RNA, 14 nt, Mycobacterium bovis subsp bovis AF2122/97
ccuugccgccggcg

SEQ ID NO: 1219138 - RNA, 17 nt, Mycobacterium bovis subsp bovis AF2122/97
ccuugccgccggcgccg

SEQ ID NO: 1219139 - RNA, 17 nt, Mycobacterium bovis subsp bovis AF2122/97
ccuugccgccagcccca

SEQ ID NO: 1219140 - RNA, 16 nt, Mycobacterium bovis subsp bovis AF2122/97
ccuugccgccauucca

SEQ ID NO: 1219141 - RNA, 17 nt, Mycobacterium bovis subsp bovis AF2122/97
ccuugccuuccgaccca

SEQ ID NO: 1219142 - RNA, 16 nt, Mycobacterium bovis subsp bovis AF2122/97
ccuugccuagccgcag

SEQ ID NO: 1219143 - RNA, 17 nt, Mycobacterium bovis subsp bovis AF2122/97
ccuugccuagccgcagc

SEQ ID NO: 1219144 - RNA, 14 nt, Mycobacterium bovis subsp bovis AF2122/97
ccuugcggcagacc

SEQ ID NO: 1219145 - RNA, 18 nt, Mycobacterium bovis subsp bovis AF2122/97
ccuugcggcagaccaagc

SEQ ID NO: 1219146 - RNA, 17 nt, Mycobacterium bovis subsp bovis AF2122/97
ccuuggcugggcccgcc

SEQ ID NO: 1219147 - RNA, 20 nt, Mycobacterium bovis subsp bovis AF2122/97
ccuuggcuucgacgcuuccu

SEQ ID NO: 1219148 - RNA, 13 nt, Mycobacterium bovis subsp bovis AF2122/97
ccuugggcagcuu

SEQ ID NO: 1219149 - RNA, 23 nt, Mycobacterium bovis subsp bovis AF2122/97
ccuugcgcgccauuggcgccgcc

SEQ ID NO: 1219150 - RNA, 14 nt, Mycobacterium bovis subsp bovis AF2122/97
ccuugcgcagcacc

SEQ ID NO: 1219151 - RNA, 16 nt, Mycobacterium bovis subsp bovis AF2122/97
ccuugcggaagaagug

SEQ ID NO: 1219152 - RNA, 13 nt, Mycobacterium bovis subsp bovis AF2122/97
ccuugcacaagcu

SEQ ID NO: 1219153 - RNA, 15 nt, Mycobacterium bovis subsp bovis AF2122/97
ccuugcagcgccccc

SEQ ID NO: 1219154 - RNA, 21 nt, Mycobacterium bovis subsp bovis AF2122/97
ccuugcagcgcccccgcugcc

SEQ ID NO: 1219155 - RNA, 19 nt, Mycobacterium bovis subsp bovis AF2122/97
ccuugccaaucgccgucag

SEQ ID NO: 1219156 - RNA, 15 nt, Mycobacterium bovis subsp bovis AF2122/97
ccuugauugccgcgu

SEQ ID NO: 1219157 - RNA, 17 nt, Mycobacterium bovis subsp bovis AF2122/97
ccuugaucgugcuggcg

SEQ ID NO: 1219158 - RNA, 22 nt, Mycobacterium bovis subsp bovis AF2122/97
ccuugaucgagcagggugacca

SEQ ID NO: 1219159 - RNA, 18 nt, Mycobacterium bovis subsp bovis AF2122/97
ccuucugacuaucucgcu

SEQ ID NO: 1219160 - RNA, 21 nt, Mycobacterium bovis subsp bovis AF2122/97
ccuucucguaacgcggcacca

SEQ ID NO: 1219161 - RNA, 18 nt, Mycobacterium bovis subsp bovis AF2122/97
ccuucguagcggccgcag

SEQ ID NO: 1219162 - RNA, 21 nt, Mycobacterium bovis subsp bovis AF2122/97
ccuucuaccgaauaaaaguac

SEQ ID NO: 1219163 - RNA, 12 nt, Mycobacterium bovis subsp bovis AF2122/97
ccuucucacgca

SEQ ID NO: 1219164 - RNA, 21 nt, Mycobacterium bovis subsp bovis AF2122/97
ccuucucccgcacggccgggu

SEQ ID NO: 1219165 - RNA, 15 nt, Mycobacterium bovis subsp bovis AF2122/97
ccuucaucaacgaca

SEQ ID NO: 1219166 - RNA, 21 nt, Mycobacterium bovis subsp bovis AF2122/97
ccuucaucaacgacaccagau

SEQ ID NO: 1219167 - RNA, 21 nt, Mycobacterium bovis subsp bovis AF2122/97
ccuuagggucgccgcauugca

SEQ ID NO: 1219168 - RNA, 16 nt, Mycobacterium bovis subsp bovis AF2122/97
ccuuggugcccagcag

SEQ ID NO: 1219169 - RNA, 12 nt, Mycobacterium bovis subsp bovis AF2122/97
ccuuggucaccu

SEQ ID NO: 1219170 - RNA, 23 nt, Mycobacterium bovis subsp bovis AF2122/97
ccuuggucaccuucuuggcgggu

SEQ ID NO: 1219171 - RNA, 17 nt, Mycobacterium bovis subsp bovis AF2122/97
ccuuucugaagcugagc

SEQ ID NO: 1219172 - RNA, 18 nt, Mycobacterium bovis subsp bovis AF2122/97
ccuuggucuucgccgucg

SEQ ID NO: 1219173 - RNA, 17 nt, Mycobacterium bovis subsp bovis AF2122/97
ccuugguggccagccag

SEQ ID NO: 1219174 - RNA, 20 nt, Mycobacterium bovis subsp bovis AF2122/97
ccuuugagcgcggccaccag

SEQ ID NO: 1219175 - RNA, 18 nt, Mycobacterium bovis subsp bovis AF2122/97
ccuuuguggggccgggcu

SEQ ID NO: 1219176 - RNA, 20 nt, Mycobacterium bovis subsp bovis AF2122/97
ccuuugucgccuucuuggca

SEQ ID NO: 1219177 - RNA, 15 nt, Mycobacterium bovis subsp bovis AF2122/97
cgaaaaacaccagcg

SEQ ID NO: 1219178 - RNA, 21 nt, Mycobacterium bovis subsp bovis AF2122/97
cgaaaaccucggacugcagcg

SEQ ID NO: 1219179 - RNA, 22 nt, Mycobacterium bovis subsp bovis AF2122/97
cgaaaagggcgacagcggcgac

SEQ ID NO: 1219180 - RNA, 18 nt, Mycobacterium bovis subsp bovis AF2122/97
cgaaaaguagaccgagcc

SEQ ID NO: 1219181 - RNA, 14 nt, Mycobacterium bovis subsp bovis AF2122/97
cgaaaacugacccc

SEQ ID NO: 1219182 - RNA, 13 nt, Mycobacterium bovis subsp bovis AF2122/97
cgaaaauugcucc

SEQ ID NO: 1219183 - RNA, 15 nt, Mycobacterium bovis subsp bovis AF2122/97
cgaaacagcacccag

SEQ ID NO: 1219184 - RNA, 12 nt, Mycobacterium bovis subsp bovis AF2122/97
cgaaacccauga

SEQ ID NO: 1219185 - RNA, 15 nt, Mycobacterium bovis subsp bovis AF2122/97
cgaaaccgcagcgcg

SEQ ID NO: 1219186 - RNA, 18 nt, Mycobacterium bovis subsp bovis AF2122/97
cgaaacucaccagcaccc

SEQ ID NO: 1219187 - RNA, 19 nt, Mycobacterium bovis subsp bovis AF2122/97
cgaaaucucaucgauuggc

SEQ ID NO: 1219188 - RNA, 17 nt, Mycobacterium bovis subsp bovis AF2122/97
cgaaaucaguugcgcuc

SEQ ID NO: 1219189 - RNA, 19 nt, Mycobacterium bovis subsp bovis AF2122/97
cgaaaucaguugcgcucca

SEQ ID NO: 1219190 - RNA, 20 nt, Mycobacterium bovis subsp bovis AF2122/97
cgaaagccaggcggcaagga

SEQ ID NO: 1219191 - RNA, 18 nt, Mycobacterium bovis subsp bovis AF2122/97
cgaaagugguggcaacgg

SEQ ID NO: 1219192 - RNA, 15 nt, Mycobacterium bovis subsp bovis AF2122/97
cgaacaggaugaugu

SEQ ID NO: 1219193 - RNA, 22 nt, Mycobacterium bovis subsp bovis AF2122/97
cgaaccagcuugcgccgcagcg

SEQ ID NO: 1219194 - RNA, 13 nt, Mycobacterium bovis subsp bovis AF2122/97
cgaaccaccaccg

SEQ ID NO: 1219195 - RNA, 21 nt, Mycobacterium bovis subsp bovis AF2122/97
cgaacauggccagcaucagcg

SEQ ID NO: 1219196 - RNA, 13 nt, Mycobacterium bovis subsp bovis AF2122/97
cgaacauugcgcc

SEQ ID NO: 1219197 - RNA, 18 nt, Mycobacterium bovis subsp bovis AF2122/97
cgaacgccguggugcgca

SEQ ID NO: 1219198 - RNA, 23 nt, Mycobacterium bovis subsp bovis AF2122/97
cgaacgccucgccggccaccagc

SEQ ID NO: 1219199 - RNA, 16 nt, Mycobacterium bovis subsp bovis AF2122/97
cgaaccggcaccagcg

SEQ ID NO: 1219200 - RNA, 17 nt, Mycobacterium bovis subsp bovis AF2122/97
cgaaccgccggcaccgc

SEQ ID NO: 1219201 - RNA, 15 nt, Mycobacterium bovis subsp bovis AF2122/97
cgaacccuccgcagc

SEQ ID NO: 1219202 - RNA, 23 nt, Mycobacterium bovis subsp bovis AF2122/97
cgaacccgguguugagcgaaccc

SEQ ID NO: 1219203 - RNA, 13 nt, Mycobacterium bovis subsp bovis AF2122/97
cgaacccacugcc

SEQ ID NO: 1219204 - RNA, 13 nt, Mycobacterium bovis subsp bovis AF2122/97
cgaacccccgccg

SEQ ID NO: 1219205 - RNA, 19 nt, Mycobacterium bovis subsp bovis AF2122/97
cgaacccgcagucggucac

SEQ ID NO: 1219206 - RNA, 14 nt, Mycobacterium bovis subsp bovis AF2122/97
cgaacagcucgaac

SEQ ID NO: 1219207 - RNA, 22 nt, Mycobacterium bovis subsp bovis AF2122/97
cgaacagcgguccagccaccgc

SEQ ID NO: 1219208 - RNA, 15 nt, Mycobacterium bovis subsp bovis AF2122/97
cgaacaggccggccg

SEQ ID NO: 1219209 - RNA, 20 nt, Mycobacterium bovis subsp bovis AF2122/97
cgaacacgucuaucuggucg

SEQ ID NO: 1219210 - RNA, 14 nt, Mycobacterium bovis subsp bovis AF2122/97
cgaacagacaugcg

SEQ ID NO: 1219211 - RNA, 13 nt, Mycobacterium bovis subsp bovis AF2122/97
cgaacagcaccgc

SEQ ID NO: 1219212 - RNA, 22 nt, Mycobacterium bovis subsp bovis AF2122/97
cgaacacaccggugucuucugc

SEQ ID NO: 1219213 - RNA, 17 nt, Mycobacterium bovis subsp bovis AF2122/97
cgaacaccagauggcuc

SEQ ID NO: 1219214 - RNA, 20 nt, Mycobacterium bovis subsp bovis AF2122/97
cgaacaauucacgcaccaca

SEQ ID NO: 1219215 - RNA, 14 nt, Mycobacterium bovis subsp bovis AF2122/97
cgaacaauucacgc

SEQ ID NO: 1219216 - RNA, 18 nt, Mycobacterium bovis subsp bovis AF2122/97
cgaacaaguggccagcgc

SEQ ID NO: 1219217 - RNA, 20 nt, Mycobacterium bovis subsp bovis AF2122/97
cgaacaaguggccagcgcca

SEQ ID NO: 1219218 - RNA, 15 nt, Mycobacterium bovis subsp bovis AF2122/97
cgaaauucucgcccu

SEQ ID NO: 1219219 - RNA, 14 nt, Mycobacterium bovis subsp bovis AF2122/97
cgaaggcggcucca

SEQ ID NO: 1219220 - RNA, 20 nt, Mycobacterium bovis subsp bovis AF2122/97
cgaaggucucgaaagccgcg

SEQ ID NO: 1219221 - RNA, 23 nt, Mycobacterium bovis subsp bovis AF2122/97
cgaaggucgcggucgagcaggug

SEQ ID NO: 1219222 - RNA, 19 nt, Mycobacterium bovis subsp bovis AF2122/97
cgaaggccgccaaccguuc

SEQ ID NO: 1219223 - RNA, 19 nt, Mycobacterium bovis subsp bovis AF2122/97
cgaagcgggaaggcucacc

SEQ ID NO: 1219224 - RNA, 15 nt, Mycobacterium bovis subsp bovis AF2122/97
cgaagcggccaccgc

SEQ ID NO: 1219225 - RNA, 20 nt, Mycobacterium bovis subsp bovis AF2122/97
cgaagguguccuccagcugc

SEQ ID NO: 1219226 - RNA, 20 nt, Mycobacterium bovis subsp bovis AF2122/97
cgaaguagaagcccaggacg

SEQ ID NO: 1219227 - RNA, 21 nt, Mycobacterium bovis subsp bovis AF2122/97
cgaagucgacgaacucgccca

SEQ ID NO: 1219228 - RNA, 15 nt, Mycobacterium bovis subsp bovis AF2122/97
cgaaguccuggcaga

SEQ ID NO: 1219229 - RNA, 15 nt, Mycobacterium bovis subsp bovis AF2122/97
cgaagaggagaacga

SEQ ID NO: 1219230 - RNA, 22 nt, Mycobacterium bovis subsp bovis AF2122/97
cgaagaucggcgcuagccaggg

SEQ ID NO: 1219231 - RNA, 18 nt, Mycobacterium bovis subsp bovis AF2122/97
cgaagcgaucgccggccg

SEQ ID NO: 1219232 - RNA, 19 nt, Mycobacterium bovis subsp bovis AF2122/97
cgaagccgccgggugcgcc

SEQ ID NO: 1219233 - RNA, 18 nt, Mycobacterium bovis subsp bovis AF2122/97
cgaagccuugcagcgccc

SEQ ID NO: 1219234 - RNA, 21 nt, Mycobacterium bovis subsp bovis AF2122/97
cgaagacgugccggcucaggu

SEQ ID NO: 1219235 - RNA, 17 nt, Mycobacterium bovis subsp bovis AF2122/97
cgaagaccgccuccacc

SEQ ID NO: 1219236 - RNA, 22 nt, Mycobacterium bovis subsp bovis AF2122/97
cgaagaccaagagcgcgcagca

SEQ ID NO: 1219237 - RNA, 19 nt, Mycobacterium bovis subsp bovis AF2122/97
cgaacgcgaucgaccuugg

SEQ ID NO: 1219238 - RNA, 17 nt, Mycobacterium bovis subsp bovis AF2122/97
caugucggccggggcca

SEQ ID NO: 1219239 - RNA, 13 nt, Mycobacterium bovis subsp bovis AF2122/97
caugucggcgcgc

SEQ ID NO: 1219240 - RNA, 15 nt, Mycobacterium bovis subsp bovis AF2122/97
caugucggcgcgccg

SEQ ID NO: 1219241 - RNA, 17 nt, Mycobacterium bovis subsp bovis AF2122/97
caugucggcgcgccgca

SEQ ID NO: 1219242 - RNA, 19 nt, Mycobacterium bovis subsp bovis AF2122/97
caugucgcugccgccgccg

SEQ ID NO: 1219243 - RNA, 14 nt, Mycobacterium bovis subsp bovis AF2122/97
caugucgaugucca

SEQ ID NO: 1219244 - RNA, 15 nt, Mycobacterium bovis subsp bovis AF2122/97
caugucgcugccgcc

SEQ ID NO: 1219245 - RNA, 23 nt, Mycobacterium bovis subsp bovis AF2122/97
caugucgaucagcgcgacggucc

SEQ ID NO: 1219246 - RNA, 18 nt, Mycobacterium bovis subsp bovis AF2122/97
caugucgaagaaccggcc

SEQ ID NO: 1219247 - RNA, 22 nt, Mycobacterium bovis subsp bovis AF2122/97
cauguccugggccgccgcccug

SEQ ID NO: 1219248 - RNA, 18 nt, Mycobacterium bovis subsp bovis AF2122/97
cauguccgcaguucgguc

SEQ ID NO: 1219249 - RNA, 17 nt, Mycobacterium bovis subsp bovis AF2122/97
cauguccgaccucugcg

SEQ ID NO: 1219250 - RNA, 18 nt, Mycobacterium bovis subsp bovis AF2122/97
cauguccaucgcgcggcu

SEQ ID NO: 1219251 - RNA, 17 nt, Mycobacterium bovis subsp bovis AF2122/97
cauguccauguuuugcu

SEQ ID NO: 1219252 - RNA, 15 nt, Mycobacterium bovis subsp bovis AF2122/97
cauggugcggcggcg

SEQ ID NO: 1219253 - RNA, 22 nt, Mycobacterium bovis subsp bovis AF2122/97
cauggcccgcucguaggaccuc

SEQ ID NO: 1219254 - RNA, 22 nt, Mycobacterium bovis subsp bovis AF2122/97
cauggcccuggcgaccagccga

SEQ ID NO: 1219255 - RNA, 19 nt, Mycobacterium bovis subsp bovis AF2122/97
cauggcggcuccgcccggc

SEQ ID NO: 1219256 - RNA, 16 nt, Mycobacterium bovis subsp bovis AF2122/97
cauggccagugucccg

SEQ ID NO: 1219257 - RNA, 20 nt, Mycobacterium bovis subsp bovis AF2122/97
cauggccagcaucagcgcca

SEQ ID NO: 1219258 - RNA, 13 nt, Mycobacterium bovis subsp bovis AF2122/97
cauggcuugcucu

SEQ ID NO: 1219259 - RNA, 19 nt, Mycobacterium bovis subsp bovis AF2122/97
caugggugaaucgacaggu

SEQ ID NO: 1219260 - RNA, 14 nt, Mycobacterium bovis subsp bovis AF2122/97
cauggguagccgcc

SEQ ID NO: 1219261 - RNA, 16 nt, Mycobacterium bovis subsp bovis AF2122/97
cauggguagccgccca

SEQ ID NO: 1219262 - RNA, 16 nt, Mycobacterium bovis subsp bovis AF2122/97
caugggucauggcgcu

SEQ ID NO: 1219263 - RNA, 20 nt, Mycobacterium bovis subsp bovis AF2122/97
caugguagcgccccgaugcu

SEQ ID NO: 1219264 - RNA, 17 nt, Mycobacterium bovis subsp bovis AF2122/97
caugguccaaccagcac

SEQ ID NO: 1219265 - RNA, 18 nt, Mycobacterium bovis subsp bovis AF2122/97
caugguccaaccagcacc

SEQ ID NO: 1219266 - RNA, 14 nt, Mycobacterium bovis subsp bovis AF2122/97
caugguccacagcc

SEQ ID NO: 1219267 - RNA, 21 nt, Mycobacterium bovis subsp bovis AF2122/97
caugguccacagccggcggcu

SEQ ID NO: 1219268 - RNA, 13 nt, Mycobacterium bovis subsp bovis AF2122/97
caugguccgacca

SEQ ID NO: 1219269 - RNA, 13 nt, Mycobacterium bovis subsp bovis AF2122/97
cauggcacugccg

SEQ ID NO: 1219270 - RNA, 22 nt, Mycobacterium bovis subsp bovis AF2122/97
cauggcacgcgggaagugcacc

SEQ ID NO: 1219271 - RNA, 21 nt, Mycobacterium bovis subsp bovis AF2122/97
caugcuggaaguugugcgcac

SEQ ID NO: 1219272 - RNA, 22 nt, Mycobacterium bovis subsp bovis AF2122/97
caugcuggagaaaccacuggau

SEQ ID NO: 1219273 - RNA, 15 nt, Mycobacterium bovis subsp bovis AF2122/97
cauggaacucacccu

SEQ ID NO: 1219274 - RNA, 20 nt, Mycobacterium bovis subsp bovis AF2122/97
caucuucgcgcagccgccgc

SEQ ID NO: 1219275 - RNA, 15 nt, Mycobacterium bovis subsp bovis AF2122/97
caucuucggacgcca

SEQ ID NO: 1219276 - RNA, 19 nt, Mycobacterium bovis subsp bovis AF2122/97
caugcucgacgcccgccac

SEQ ID NO: 1219277 - RNA, 20 nt, Mycobacterium bovis subsp bovis AF2122/97
caugcucgacgcccgccacc

SEQ ID NO: 1219278 - RNA, 23 nt, Mycobacterium bovis subsp bovis AF2122/97
caugcucgagugggugaggccaa

SEQ ID NO: 1219279 - RNA, 18 nt, Mycobacterium bovis subsp bovis AF2122/97
caugucuccgacauuggc

SEQ ID NO: 1219280 - RNA, 17 nt, Mycobacterium bovis subsp bovis AF2122/97
caugugcgacauugguc

SEQ ID NO: 1219281 - RNA, 21 nt, Mycobacterium bovis subsp bovis AF2122/97
caugugcccaggucuccauca

SEQ ID NO: 1219282 - RNA, 15 nt, Mycobacterium bovis subsp bovis AF2122/97
cauuagcagcacccg

SEQ ID NO: 1219283 - RNA, 18 nt, Mycobacterium bovis subsp bovis AF2122/97
cauuccgaacaacaucac

SEQ ID NO: 1219284 - RNA, 23 nt, Mycobacterium bovis subsp bovis AF2122/97
cauuccgaacaacaucacugccu

SEQ ID NO: 1219285 - RNA, 18 nt, Mycobacterium bovis subsp bovis AF2122/97
cauuccggucagguacau

SEQ ID NO: 1219286 - RNA, 22 nt, Mycobacterium bovis subsp bovis AF2122/97
cauuccggucagguacaucccg

SEQ ID NO: 1219287 - RNA, 13 nt, Mycobacterium bovis subsp bovis AF2122/97
cauuccggcgcca

SEQ ID NO: 1219288 - RNA, 20 nt, Mycobacterium bovis subsp bovis AF2122/97
cauuccguuuuuguugaccc

SEQ ID NO: 1219289 - RNA, 14 nt, Mycobacterium bovis subsp bovis AF2122/97
cauucgccccaccc

SEQ ID NO: 1219290 - RNA, 21 nt, Mycobacterium bovis subsp bovis AF2122/97
cauuccucgacgguguaacug

SEQ ID NO: 1219291 - RNA, 23 nt, Mycobacterium bovis subsp bovis AF2122/97
cauucaacagauccgacgaccgc

SEQ ID NO: 1219292 - RNA, 20 nt, Mycobacterium bovis subsp bovis AF2122/97
cauugccgccguugccgccg

SEQ ID NO: 1219293 - RNA, 18 nt, Mycobacterium bovis subsp bovis AF2122/97
cauugccggccaccagcc

SEQ ID NO: 1219294 - RNA, 20 nt, Mycobacterium bovis subsp bovis AF2122/97
cauugccgacgcgcggccag

SEQ ID NO: 1219295 - RNA, 21 nt, Mycobacterium bovis subsp bovis AF2122/97
cauugcccguguuaaagaagc

SEQ ID NO: 1219296 - RNA, 20 nt, Mycobacterium bovis subsp bovis AF2122/97
cauugccgccagcccagccc

SEQ ID NO: 1219297 - RNA, 19 nt, Mycobacterium bovis subsp bovis AF2122/97
cauugcgcccagcgacccg

SEQ ID NO: 1219298 - RNA, 15 nt, Mycobacterium bovis subsp bovis AF2122/97
cauugcgccugaaua

SEQ ID NO: 1219299 - RNA, 21 nt, Mycobacterium bovis subsp bovis AF2122/97
cauugcuguguugcacccgaa

SEQ ID NO: 1219300 - RNA, 22 nt, Mycobacterium bovis subsp bovis AF2122/97
cauugcugcucgugagccccag

SEQ ID NO: 1219301 - RNA, 18 nt, Mycobacterium bovis subsp bovis AF2122/97
cauugcccauagccaggu

SEQ ID NO: 1219302 - RNA, 14 nt, Mycobacterium bovis subsp bovis AF2122/97
cauugcccauagcc

SEQ ID NO: 1219303 - RNA, 11 nt, Mycobacterium bovis subsp bovis AF2122/97
cauugcccaca

SEQ ID NO: 1219304 - RNA, 15 nt, Mycobacterium bovis subsp bovis AF2122/97
cauugcaucugccaa

SEQ ID NO: 1219305 - RNA, 22 nt, Mycobacterium bovis subsp bovis AF2122/97
cauugcaugguuucguuccucg

SEQ ID NO: 1219306 - RNA, 16 nt, Mycobacterium bovis subsp bovis AF2122/97
cauucggcgagccgcg

SEQ ID NO: 1219307 - RNA, 13 nt, Mycobacterium bovis subsp bovis AF2122/97
cauucgcgggccg

SEQ ID NO: 1219308 - RNA, 22 nt, Mycobacterium bovis subsp bovis AF2122/97
cauuggccaggucggccaccgu

SEQ ID NO: 1219309 - RNA, 19 nt, Mycobacterium bovis subsp bovis AF2122/97
cauuggaugccauaggaca

SEQ ID NO: 1219310 - RNA, 13 nt, Mycobacterium bovis subsp bovis AF2122/97
cauuggcuccgaa

SEQ ID NO: 1219311 - RNA, 16 nt, Mycobacterium bovis subsp bovis AF2122/97
cauuggcuuguccggu

SEQ ID NO: 1219312 - RNA, 18 nt, Mycobacterium bovis subsp bovis AF2122/97
cauuggccuaggacaccg

SEQ ID NO: 1219313 - RNA, 18 nt, Mycobacterium bovis subsp bovis AF2122/97
cauuggcgaucagcagcc

SEQ ID NO: 1219314 - RNA, 20 nt, Mycobacterium bovis subsp bovis AF2122/97
cauuggcggugcgcaccacc

SEQ ID NO: 1219315 - RNA, 22 nt, Mycobacterium bovis subsp bovis AF2122/97
cauugguguggaauacgcugcu

SEQ ID NO: 1219316 - RNA, 19 nt, Mycobacterium bovis subsp bovis AF2122/97
cauuggugagguggucagc

SEQ ID NO: 1219317 - RNA, 16 nt, Mycobacterium bovis subsp bovis AF2122/97
cauugggguggcaucg

SEQ ID NO: 1219318 - RNA, 21 nt, Mycobacterium bovis subsp bovis AF2122/97
cauuucaacguauccccgacc

SEQ ID NO: 1219319 - RNA, 17 nt, Mycobacterium bovis subsp bovis AF2122/97
ccaacaacuccagcagg

SEQ ID NO: 1219320 - RNA, 14 nt, Mycobacterium bovis subsp bovis AF2122/97
ccaacaaaaggcca

SEQ ID NO: 1219321 - RNA, 15 nt, Mycobacterium bovis subsp bovis AF2122/97
ccaacaaaaggccau

SEQ ID NO: 1219322 - RNA, 16 nt, Mycobacterium bovis subsp bovis AF2122/97
ccaacaaaaggccauc

SEQ ID NO: 1219323 - RNA, 19 nt, Mycobacterium bovis subsp bovis AF2122/97
ccaacaacccaacaaaagg

SEQ ID NO: 1219324 - RNA, 15 nt, Mycobacterium bovis subsp bovis AF2122/97
ccaaaggacgacacc

SEQ ID NO: 1219325 - RNA, 14 nt, Mycobacterium bovis subsp bovis AF2122/97
ccaacgccaccguc

SEQ ID NO: 1219326 - RNA, 19 nt, Mycobacterium bovis subsp bovis AF2122/97
ccaacgcaacggugaucag

SEQ ID NO: 1219327 - RNA, 13 nt, Mycobacterium bovis subsp bovis AF2122/97
ccaacgcccgggc

SEQ ID NO: 1219328 - RNA, 14 nt, Mycobacterium bovis subsp bovis AF2122/97
ccaacgcccgggcg

SEQ ID NO: 1219329 - RNA, 13 nt, Mycobacterium bovis subsp bovis AF2122/97
ccaacgccagcgg

SEQ ID NO: 1219330 - RNA, 22 nt, Mycobacterium bovis subsp bovis AF2122/97
ccaacgcgggaacgaugccgcc

SEQ ID NO: 1219331 - RNA, 19 nt, Mycobacterium bovis subsp bovis AF2122/97
ccaacgcgguaaagccccg

SEQ ID NO: 1219332 - RNA, 13 nt, Mycobacterium bovis subsp bovis AF2122/97
ccaacgcgguggg

SEQ ID NO: 1219333 - RNA, 21 nt, Mycobacterium bovis subsp bovis AF2122/97
ccaacgcggugggcacagcca

SEQ ID NO: 1219334 - RNA, 22 nt, Mycobacterium bovis subsp bovis AF2122/97
ccaacgcggugggcacagccag

SEQ ID NO: 1219335 - RNA, 22 nt, Mycobacterium bovis subsp bovis AF2122/97
ccaacgcucccuacgagcccac

SEQ ID NO: 1219336 - RNA, 13 nt, Mycobacterium bovis subsp bovis AF2122/97
ccaacgaccacca

SEQ ID NO: 1219337 - RNA, 16 nt, Mycobacterium bovis subsp bovis AF2122/97
ccaacgaccaccacca

SEQ ID NO: 1219338 - RNA, 20 nt, Mycobacterium bovis subsp bovis AF2122/97
ccaacgaucagucgucuuga

SEQ ID NO: 1219339 - RNA, 15 nt, Mycobacterium bovis subsp bovis AF2122/97
ccaacgcuucugccu

SEQ ID NO: 1219340 - RNA, 23 nt, Mycobacterium bovis subsp bovis AF2122/97
ccaacgcgcaccuggcgcgcgca

SEQ ID NO: 1219341 - RNA, 16 nt, Mycobacterium bovis subsp bovis AF2122/97
ccaacgcgcagagcgu

SEQ ID NO: 1219342 - RNA, 22 nt, Mycobacterium bovis subsp bovis AF2122/97
ccaacucuucagcaagccaacc

SEQ ID NO: 1219343 - RNA, 16 nt, Mycobacterium bovis subsp bovis AF2122/97
ccaacugaaccgagug

SEQ ID NO: 1219344 - RNA, 20 nt, Mycobacterium bovis subsp bovis AF2122/97
ccaacugaauggcaccgagg

SEQ ID NO: 1219345 - RNA, 18 nt, Mycobacterium bovis subsp bovis AF2122/97
ccaagaucggcgccccug

SEQ ID NO: 1219346 - RNA, 12 nt, Mycobacterium bovis subsp bovis AF2122/97
ccaagauggcgc

SEQ ID NO: 1219347 - RNA, 18 nt, Mycobacterium bovis subsp bovis AF2122/97
ccaaggacgaacgcgccg

SEQ ID NO: 1219348 - RNA, 19 nt, Mycobacterium bovis subsp bovis AF2122/97
ccaauacgugauguagcug

SEQ ID NO: 1219349 - RNA, 22 nt, Mycobacterium bovis subsp bovis AF2122/97
ccaauaguccuugcgccagcgg

SEQ ID NO: 1219350 - RNA, 15 nt, Mycobacterium bovis subsp bovis AF2122/97
ccaauaguccuugcg

SEQ ID NO: 1219351 - RNA, 22 nt, Mycobacterium bovis subsp bovis AF2122/97
ccaauaggcgaaaauugcucca

SEQ ID NO: 1219352 - RNA, 21 nt, Mycobacterium bovis subsp bovis AF2122/97
ccaaguucagcacgugggcca

SEQ ID NO: 1219353 - RNA, 22 nt, Mycobacterium bovis subsp bovis AF2122/97
ccaaguugcagcgggccacuga

SEQ ID NO: 1219354 - RNA, 18 nt, Mycobacterium bovis subsp bovis AF2122/97
ccaagucucgggcuuacu

SEQ ID NO: 1219355 - RNA, 14 nt, Mycobacterium bovis subsp bovis AF2122/97
ccaagugcagggcu

SEQ ID NO: 1219356 - RNA, 14 nt, Mycobacterium bovis subsp bovis AF2122/97
ccaaggccuucagc

SEQ ID NO: 1219357 - RNA, 16 nt, Mycobacterium bovis subsp bovis AF2122/97
ccaaggccuucagcgg

SEQ ID NO: 1219358 - RNA, 18 nt, Mycobacterium bovis subsp bovis AF2122/97
ccaaucgucggccagcag

SEQ ID NO: 1219359 - RNA, 15 nt, Mycobacterium bovis subsp bovis AF2122/97
ccaaucgaguagcug

SEQ ID NO: 1219360 - RNA, 23 nt, Mycobacterium bovis subsp bovis AF2122/97
ccaauccggaauagcaacgcugc

SEQ ID NO: 1219361 - RNA, 19 nt, Mycobacterium bovis subsp bovis AF2122/97
ccaaugcggugacaaccgc

SEQ ID NO: 1219362 - RNA, 20 nt, Mycobacterium bovis subsp bovis AF2122/97
ccaauggugggcgagcugcu

SEQ ID NO: 1219363 - RNA, 20 nt, Mycobacterium bovis subsp bovis AF2122/97
ccaauggccgcggcacccag

SEQ ID NO: 1219364 - RNA, 15 nt, Mycobacterium bovis subsp bovis AF2122/97
ccaaugucagugccc

SEQ ID NO: 1219365 - RNA, 22 nt, Mycobacterium bovis subsp bovis AF2122/97
ccaaugucagugccccgcccgg

SEQ ID NO: 1219366 - RNA, 23 nt, Mycobacterium bovis subsp bovis AF2122/97
ccaauugcccuuucccaccuuca

SEQ ID NO: 1219367 - RNA, 13 nt, Mycobacterium bovis subsp bovis AF2122/97
ccacagcucgccg

SEQ ID NO: 1219368 - RNA, 11 nt, Mycobacterium bovis subsp bovis AF2122/97
ccacaccagcg

SEQ ID NO: 1219369 - RNA, 15 nt, Mycobacterium bovis subsp bovis AF2122/97
ccacaccagcgcagc

SEQ ID NO: 1219370 - RNA, 14 nt, Mycobacterium bovis subsp bovis AF2122/97
ccacaccaaggccg

SEQ ID NO: 1219371 - RNA, 14 nt, Mycobacterium bovis subsp bovis AF2122/97
ccacacacugugcu

SEQ ID NO: 1219372 - RNA, 19 nt, Mycobacterium bovis subsp bovis AF2122/97
ccacacagucggugcagcg

SEQ ID NO: 1219373 - RNA, 11 nt, Mycobacterium bovis subsp bovis AF2122/97
ccacagcaacg

SEQ ID NO: 1219374 - RNA, 14 nt, Mycobacterium bovis subsp bovis AF2122/97
ccacacccaaaccg

SEQ ID NO: 1219375 - RNA, 21 nt, Mycobacterium bovis subsp bovis AF2122/97
ccacacccagcgugcccgcca

SEQ ID NO: 1219376 - RNA, 13 nt, Mycobacterium bovis subsp bovis AF2122/97
ccaccgaaaaguc

SEQ ID NO: 1219377 - RNA, 12 nt, Mycobacterium bovis subsp bovis AF2122/97
ccacccuugccg

SEQ ID NO: 1219378 - RNA, 15 nt, Mycobacterium bovis subsp bovis AF2122/97
ccacccuugccgccg

SEQ ID NO: 1219379 - RNA, 19 nt, Mycobacterium bovis subsp bovis AF2122/97
ccaccgaaaaguccgccgc

SEQ ID NO: 1219380 - RNA, 17 nt, Mycobacterium bovis subsp bovis AF2122/97
ccaccgaaauugcccua

SEQ ID NO: 1219381 - RNA, 20 nt, Mycobacterium bovis subsp bovis AF2122/97
ccaccgaaauugcccuagca

SEQ ID NO: 1219382 - RNA, 24 nt, Mycobacterium bovis subsp bovis AF2122/97
ccaccgaacgcggccaccgaccgc

SEQ ID NO: 1219383 - RNA, 21 nt, Mycobacterium bovis subsp bovis AF2122/97
ccaccgacaagaauggccgcc

SEQ ID NO: 1219384 - RNA, 15 nt, Mycobacterium bovis subsp bovis AF2122/97
ccaccgacagcaccc

SEQ ID NO: 1219385 - RNA, 19 nt, Mycobacterium bovis subsp bovis AF2122/97
ccaccgccaccacccaggc

SEQ ID NO: 1219386 - RNA, 14 nt, Mycobacterium bovis subsp bovis AF2122/97
ccaccgccggcccg

SEQ ID NO: 1219387 - RNA, 16 nt, Mycobacterium bovis subsp bovis AF2122/97
ccaccgccgccugccc

SEQ ID NO: 1219388 - RNA, 22 nt, Mycobacterium bovis subsp bovis AF2122/97
ccaccgccgccugcccggcccg

SEQ ID NO: 1219389 - RNA, 12 nt, Mycobacterium bovis subsp bovis AF2122/97
ccaccgccgcgc

SEQ ID NO: 1219390 - RNA, 12 nt, Mycobacterium bovis subsp bovis AF2122/97
ccaccgccgcug

SEQ ID NO: 1219391 - RNA, 18 nt, Mycobacterium bovis subsp bovis AF2122/97
ccaccgccuggaucagcg

SEQ ID NO: 1219392 - RNA, 19 nt, Mycobacterium bovis subsp bovis AF2122/97
ccaccgccugggcggccag

SEQ ID NO: 1219393 - RNA, 12 nt, Mycobacterium bovis subsp bovis AF2122/97
ccaccgccgcca

SEQ ID NO: 1219394 - RNA, 13 nt, Mycobacterium bovis subsp bovis AF2122/97
ccaccgccgccac

SEQ ID NO: 1219395 - RNA, 12 nt, Mycobacterium bovis subsp bovis AF2122/97
ccaccgccgccg

SEQ ID NO: 1219396 - RNA, 15 nt, Mycobacterium bovis subsp bovis AF2122/97
ccaccggcugcaacc

SEQ ID NO: 1219397 - RNA, 12 nt, Mycobacterium bovis subsp bovis AF2122/97
ccaccggcuggu

SEQ ID NO: 1219398 - RNA, 21 nt, Mycobacterium bovis subsp bovis AF2122/97
ccaccggcuggugccuuacca

SEQ ID NO: 1219399 - RNA, 23 nt, Mycobacterium bovis subsp bovis AF2122/97
ccaccggcgucugcccgcccagc

SEQ ID NO: 1219400 - RNA, 16 nt, Mycobacterium bovis subsp bovis AF2122/97
ccaccggcuaugcugg

SEQ ID NO: 1219401 - RNA, 20 nt, Mycobacterium bovis subsp bovis AF2122/97
ccaccggcuaugcuggcgca

SEQ ID NO: 1219402 - RNA, 14 nt, Mycobacterium bovis subsp bovis AF2122/97
ccaccgggcccgcc

SEQ ID NO: 1219403 - RNA, 19 nt, Mycobacterium bovis subsp bovis AF2122/97
ccaccgggcccgccggccc

SEQ ID NO: 1219404 - RNA, 20 nt, Mycobacterium bovis subsp bovis AF2122/97
ccaccgggcccgccggcccc

SEQ ID NO: 1219405 - RNA, 21 nt, Mycobacterium bovis subsp bovis AF2122/97
ccaccggggaagaucucggcc

SEQ ID NO: 1219406 - RNA, 14 nt, Mycobacterium bovis subsp bovis AF2122/97
ccaccgccgacccu

SEQ ID NO: 1219407 - RNA, 17 nt, Mycobacterium bovis subsp bovis AF2122/97
ccaccgguuauggcauu

SEQ ID NO: 1219408 - RNA, 16 nt, Mycobacterium bovis subsp bovis AF2122/97
ccaccgguaccgccac

SEQ ID NO: 1219409 - RNA, 21 nt, Mycobacterium bovis subsp bovis AF2122/97
ccaccggugccgccguugcca

SEQ ID NO: 1219410 - RNA, 16 nt, Mycobacterium bovis subsp bovis AF2122/97
ccaccgguccagcgcc

SEQ ID NO: 1219411 - RNA, 21 nt, Mycobacterium bovis subsp bovis AF2122/97
ccaccggugagcgcagcuuga

SEQ ID NO: 1219412 - RNA, 16 nt, Mycobacterium bovis subsp bovis AF2122/97
ccaccggugccgccgu

SEQ ID NO: 1219413 - RNA, 15 nt, Mycobacterium bovis subsp bovis AF2122/97
ccaccgucacccccg

SEQ ID NO: 1219414 - RNA, 16 nt, Mycobacterium bovis subsp bovis AF2122/97
ccaccucccacgccgc

SEQ ID NO: 1219415 - RNA, 21 nt, Mycobacterium bovis subsp bovis AF2122/97
ccacgaacgcuuccagcgugu

SEQ ID NO: 1219416 - RNA, 22 nt, Mycobacterium bovis subsp bovis AF2122/97
ccacgaacugaucgaccgccuc

SEQ ID NO: 1219417 - RNA, 23 nt, Mycobacterium bovis subsp bovis AF2122/97
ccacgacaggucgcccggucucg

SEQ ID NO: 1219418 - RNA, 15 nt, Mycobacterium bovis subsp bovis AF2122/97
ccaccucgacgguga

SEQ ID NO: 1219419 - RNA, 18 nt, Mycobacterium bovis subsp bovis AF2122/97
ccaccucggugaccaggc

SEQ ID NO: 1219420 - RNA, 18 nt, Mycobacterium bovis subsp bovis AF2122/97
ccaccucuucucggacac

SEQ ID NO: 1219421 - RNA, 18 nt, Mycobacterium bovis subsp bovis AF2122/97
ccaccucgacgagcacca

SEQ ID NO: 1219422 - RNA, 15 nt, Mycobacterium bovis subsp bovis AF2122/97
ccacgaucagcagcg

SEQ ID NO: 1219423 - RNA, 13 nt, Mycobacterium bovis subsp bovis AF2122/97
ccacgauccuugg

SEQ ID NO: 1219424 - RNA, 20 nt, Mycobacterium bovis subsp bovis AF2122/97
ccacgaucggcccagcccuu

SEQ ID NO: 1219425 - RNA, 20 nt, Mycobacterium bovis subsp bovis AF2122/97
ccacgauggcggccaccguc

SEQ ID NO: 1219426 - RNA, 20 nt, Mycobacterium bovis subsp bovis AF2122/97
ccacgacgucgucguccucg

SEQ ID NO: 1219427 - RNA, 13 nt, Mycobacterium bovis subsp bovis AF2122/97
ccacgagcagccg

SEQ ID NO: 1219428 - RNA, 16 nt, Mycobacterium bovis subsp bovis AF2122/97
ccacgaccucgggauc

SEQ ID NO: 1219429 - RNA, 14 nt, Mycobacterium bovis subsp bovis AF2122/97
ccacgaguccgcgg

SEQ ID NO: 1219430 - RNA, 24 nt, Mycobacterium bovis subsp bovis AF2122/97
ccacccaacgcggugggcacagcc

SEQ ID NO: 1219431 - RNA, 15 nt, Mycobacterium bovis subsp bovis AF2122/97
ccacccgggugggcc

SEQ ID NO: 1219432 - RNA, 15 nt, Mycobacterium bovis subsp bovis AF2122/97
ccacccucgggucca

SEQ ID NO: 1219433 - RNA, 23 nt, Mycobacterium bovis subsp bovis AF2122/97
ccaccaucaccgccuuugccgcc

SEQ ID NO: 1219434 - RNA, 13 nt, Mycobacterium bovis subsp bovis AF2122/97
ccaccaucgccgc

SEQ ID NO: 1219435 - RNA, 23 nt, Mycobacterium bovis subsp bovis AF2122/97
ccaccaucgccgccguugccgcc

SEQ ID NO: 1219436 - RNA, 14 nt, Mycobacterium bovis subsp bovis AF2122/97
ccaccaucgccucg

SEQ ID NO: 1219437 - RNA, 23 nt, Mycobacterium bovis subsp bovis AF2122/97
ccaccaucuguuccgugccagcu

SEQ ID NO: 1219438 - RNA, 15 nt, Mycobacterium bovis subsp bovis AF2122/97
ccacccaacagcgcu

SEQ ID NO: 1219439 - RNA, 23 nt, Mycobacterium bovis subsp bovis AF2122/97
ccaccagggcaacggccgcuagc

SEQ ID NO: 1219440 - RNA, 15 nt, Mycobacterium bovis subsp bovis AF2122/97
ccaccaggugccgug

SEQ ID NO: 1219441 - RNA, 18 nt, Mycobacterium bovis subsp bovis AF2122/97
ccaccagggcggccuccc

SEQ ID NO: 1219442 - RNA, 23 nt, Mycobacterium bovis subsp bovis AF2122/97
ccaccagggcggccuccccgacc

SEQ ID NO: 1219443 - RNA, 20 nt, Mycobacterium bovis subsp bovis AF2122/97
ccaccaggggaccgcggcgc

SEQ ID NO: 1219444 - RNA, 13 nt, Mycobacterium bovis subsp bovis AF2122/97
ccaccaggcuguc

SEQ ID NO: 1219445 - RNA, 21 nt, Mycobacterium bovis subsp bovis AF2122/97
ccaccaguggcgcgugcagcg

SEQ ID NO: 1219446 - RNA, 22 nt, Mycobacterium bovis subsp bovis AF2122/97
ccaccaguccgaugggaaucag

SEQ ID NO: 1219447 - RNA, 20 nt, Mycobacterium bovis subsp bovis AF2122/97
ccaccagugcaucgaucacc

SEQ ID NO: 1219448 - RNA, 23 nt, Mycobacterium bovis subsp bovis AF2122/97
ccaccaccgucgagccggacagg

SEQ ID NO: 1219449 - RNA, 13 nt, Mycobacterium bovis subsp bovis AF2122/97
ccaccaccgugaa

SEQ ID NO: 1219450 - RNA, 13 nt, Mycobacterium bovis subsp bovis AF2122/97
ccaccaccuccgc

SEQ ID NO: 1219451 - RNA, 12 nt, Mycobacterium bovis subsp bovis AF2122/97
ccaccaccgcuc

SEQ ID NO: 1219452 - RNA, 23 nt, Mycobacterium bovis subsp bovis AF2122/97
ccaccaccggcacccgcuggcgg

SEQ ID NO: 1219453 - RNA, 13 nt, Mycobacterium bovis subsp bovis AF2122/97
ccaccaccgccgc

SEQ ID NO: 1219454 - RNA, 18 nt, Mycobacterium bovis subsp bovis AF2122/97
ccaccaccgccggugccg

SEQ ID NO: 1219455 - RNA, 21 nt, Mycobacterium bovis subsp bovis AF2122/97
ccacaggacaauggacaccaa

SEQ ID NO: 1219456 - RNA, 15 nt, Mycobacterium bovis subsp bovis AF2122/97
ccaccacccaggcca

SEQ ID NO: 1219457 - RNA, 13 nt, Mycobacterium bovis subsp bovis AF2122/97
ccaccagaaacac

SEQ ID NO: 1219458 - RNA, 12 nt, Mycobacterium bovis subsp bovis AF2122/97
ccaccagaacca

SEQ ID NO: 1219459 - RNA, 14 nt, Mycobacterium bovis subsp bovis AF2122/97
ccaccacugcgccc

SEQ ID NO: 1219460 - RNA, 16 nt, Mycobacterium bovis subsp bovis AF2122/97
ccaccacugcgcccgc

SEQ ID NO: 1219461 - RNA, 18 nt, Mycobacterium bovis subsp bovis AF2122/97
ccaccacugcgcccgcca

SEQ ID NO: 1219462 - RNA, 13 nt, Mycobacterium bovis subsp bovis AF2122/97
ccaccacgcuccc

SEQ ID NO: 1219463 - RNA, 15 nt, Mycobacterium bovis subsp bovis AF2122/97
ccacggcgucggcca

SEQ ID NO: 1219464 - RNA, 22 nt, Mycobacterium bovis subsp bovis AF2122/97
ccacggcgucggccacccgguc

SEQ ID NO: 1219465 - RNA, 16 nt, Mycobacterium bovis subsp bovis AF2122/97
ccacggcggugccgug

SEQ ID NO: 1219466 - RNA, 17 nt, Mycobacterium bovis subsp bovis AF2122/97
ccacggcgggcgagcca

SEQ ID NO: 1219467 - RNA, 15 nt, Mycobacterium bovis subsp bovis AF2122/97
ccacggcgggcgagc

SEQ ID NO: 1219468 - RNA, 20 nt, Mycobacterium bovis subsp bovis AF2122/97
ccacggcggcaucaccuggc

SEQ ID NO: 1219469 - RNA, 19 nt, Mycobacterium bovis subsp bovis AF2122/97
ccacggcggccaccugcug

SEQ ID NO: 1219470 - RNA, 21 nt, Mycobacterium bovis subsp bovis AF2122/97
ccacggcggccaccugcuggc

SEQ ID NO: 1219471 - RNA, 22 nt, Mycobacterium bovis subsp bovis AF2122/97
ccacgggcggccaccgcacgcu

SEQ ID NO: 1219472 - RNA, 21 nt, Mycobacterium bovis subsp bovis AF2122/97
ccacguacuuggacgacccgg

SEQ ID NO: 1219473 - RNA, 22 nt, Mycobacterium bovis subsp bovis AF2122/97
ccacguacuuggacgacccggg

SEQ ID NO: 1219474 - RNA, 14 nt, Mycobacterium bovis subsp bovis AF2122/97
ccacguagacaagg

SEQ ID NO: 1219475 - RNA, 19 nt, Mycobacterium bovis subsp bovis AF2122/97
ccacguccaacucggcccg

SEQ ID NO: 1219476 - RNA, 23 nt, Mycobacterium bovis subsp bovis AF2122/97
ccacgucccaggacuccggccgc

SEQ ID NO: 1219477 - RNA, 22 nt, Mycobacterium bovis subsp bovis AF2122/97
ccacgucaucuggcgcugcugg

SEQ ID NO: 1219478 - RNA, 23 nt, Mycobacterium bovis subsp bovis AF2122/97
ccacgucaucuggcgcugcuggc

SEQ ID NO: 1219479 - RNA, 18 nt, Mycobacterium bovis subsp bovis AF2122/97
ccacggugccgacgauga

SEQ ID NO: 1219480 - RNA, 14 nt, Mycobacterium bovis subsp bovis AF2122/97
ccacggugcgguga

SEQ ID NO: 1219481 - RNA, 23 nt, Mycobacterium bovis subsp bovis AF2122/97
ccacgguuggccaccagcuggcg

SEQ ID NO: 1219482 - RNA, 18 nt, Mycobacterium bovis subsp bovis AF2122/97
ccacgguccggcccacca

SEQ ID NO: 1219483 - RNA, 15 nt, Mycobacterium bovis subsp bovis AF2122/97
ccacggucugccacg

SEQ ID NO: 1219484 - RNA, 15 nt, Mycobacterium bovis subsp bovis AF2122/97
ccacggucgaccagg

SEQ ID NO: 1219485 - RNA, 16 nt, Mycobacterium bovis subsp bovis AF2122/97
ccacggucagcacgcu

SEQ ID NO: 1219486 - RNA, 19 nt, Mycobacterium bovis subsp bovis AF2122/97
ccacgguccggcccaccag

SEQ ID NO: 1219487 - RNA, 19 nt, Mycobacterium bovis subsp bovis AF2122/97
ccacgucgagcacccgcuc

SEQ ID NO: 1219488 - RNA, 14 nt, Mycobacterium bovis subsp bovis AF2122/97
ccacgugaucagau

SEQ ID NO: 1219489 - RNA, 16 nt, Mycobacterium bovis subsp bovis AF2122/97
ccacguugcugaugcc

SEQ ID NO: 1219490 - RNA, 21 nt, Mycobacterium bovis subsp bovis AF2122/97
ccacguugaugaugccggcgu

SEQ ID NO: 1219491 - RNA, 20 nt, Mycobacterium bovis subsp bovis AF2122/97
ccacgucgagguccaccacc

SEQ ID NO: 1219492 - RNA, 16 nt, Mycobacterium bovis subsp bovis AF2122/97
ccacguucgcgggcgu

SEQ ID NO: 1219493 - RNA, 20 nt, Mycobacterium bovis subsp bovis AF2122/97
ccacucaacgaccugggaca

SEQ ID NO: 1219494 - RNA, 22 nt, Mycobacterium bovis subsp bovis AF2122/97
ccacuagcuucgcuugccgaua

SEQ ID NO: 1219495 - RNA, 17 nt, Mycobacterium bovis subsp bovis AF2122/97
ccacuaggucgccggcc

SEQ ID NO: 1219496 - RNA, 19 nt, Mycobacterium bovis subsp bovis AF2122/97
ccacgcccacaggggcagc

SEQ ID NO: 1219497 - RNA, 12 nt, Mycobacterium bovis subsp bovis AF2122/97
ccacgccaggag

SEQ ID NO: 1219498 - RNA, 20 nt, Mycobacterium bovis subsp bovis AF2122/97
ccacgccaggagcgugucgg

SEQ ID NO: 1219499 - RNA, 13 nt, Mycobacterium bovis subsp bovis AF2122/97
ccacgcacccggc

SEQ ID NO: 1219500 - RNA, 17 nt, Mycobacterium bovis subsp bovis AF2122/97
ccacgcccgacgccagc

SEQ ID NO: 1219501 - RNA, 21 nt, Mycobacterium bovis subsp bovis AF2122/97
ccacgccgacuaguccgaggg

SEQ ID NO: 1219502 - RNA, 19 nt, Mycobacterium bovis subsp bovis AF2122/97
ccacgccgaccaucucacc

SEQ ID NO: 1219503 - RNA, 21 nt, Mycobacterium bovis subsp bovis AF2122/97
ccacgccgaccaucucaccgg

SEQ ID NO: 1219504 - RNA, 22 nt, Mycobacterium bovis subsp bovis AF2122/97
ccacgcacaauacggucagcag

SEQ ID NO: 1219505 - RNA, 23 nt, Mycobacterium bovis subsp bovis AF2122/97
ccacgccguggagaucuccucga

SEQ ID NO: 1219506 - RNA, 20 nt, Mycobacterium bovis subsp bovis AF2122/97
ccacgccgggcaaggccacc

SEQ ID NO: 1219507 - RNA, 19 nt, Mycobacterium bovis subsp bovis AF2122/97
ccacgccggggcaacgaau

SEQ ID NO: 1219508 - RNA, 20 nt, Mycobacterium bovis subsp bovis AF2122/97
ccacggccagaaacccggcg

SEQ ID NO: 1219509 - RNA, 13 nt, Mycobacterium bovis subsp bovis AF2122/97
ccacggccgccga

SEQ ID NO: 1219510 - RNA, 13 nt, Mycobacterium bovis subsp bovis AF2122/97
ccacggccgccgc

SEQ ID NO: 1219511 - RNA, 23 nt, Mycobacterium bovis subsp bovis AF2122/97
ccacggcgaccaggagccuccag

SEQ ID NO: 1219512 - RNA, 16 nt, Mycobacterium bovis subsp bovis AF2122/97
ccacggcgaccacgcc

SEQ ID NO: 1219513 - RNA, 19 nt, Mycobacterium bovis subsp bovis AF2122/97
ccacggcgaccaggagccu

SEQ ID NO: 1219514 - RNA, 14 nt, Mycobacterium bovis subsp bovis AF2122/97
ccacggcagcgccc

SEQ ID NO: 1219515 - RNA, 18 nt, Mycobacterium bovis subsp bovis AF2122/97
ccacggcaaucaacgcaa

SEQ ID NO: 1219516 - RNA, 20 nt, Mycobacterium bovis subsp bovis AF2122/97
ccacggaggguugccgccga

SEQ ID NO: 1219517 - RNA, 17 nt, Mycobacterium bovis subsp bovis AF2122/97
ccacggacgugacgucg

SEQ ID NO: 1219518 - RNA, 17 nt, Mycobacterium bovis subsp bovis AF2122/97
ccacggagaccggccgg

SEQ ID NO: 1219519 - RNA, 21 nt, Mycobacterium bovis subsp bovis AF2122/97
ccacggcaagcgugacccgcc

SEQ ID NO: 1219520 - RNA, 14 nt, Mycobacterium bovis subsp bovis AF2122/97
ccacgcugccgcag

SEQ ID NO: 1219521 - RNA, 15 nt, Mycobacterium bovis subsp bovis AF2122/97
ccacgcugccgcagu

SEQ ID NO: 1219522 - RNA, 20 nt, Mycobacterium bovis subsp bovis AF2122/97
ccacgcugccgcaguucauc

SEQ ID NO: 1219523 - RNA, 23 nt, Mycobacterium bovis subsp bovis AF2122/97
ccacgcggauaucuugcgcaugu

SEQ ID NO: 1219524 - RNA, 17 nt, Mycobacterium bovis subsp bovis AF2122/97
cagugguuacagaugaa

SEQ ID NO: 1219525 - RNA, 19 nt, Mycobacterium bovis subsp bovis AF2122/97
caguguacaccgcgcccgc

SEQ ID NO: 1219526 - RNA, 20 nt, Mycobacterium bovis subsp bovis AF2122/97
caguguacaccgcgcccgcc

SEQ ID NO: 1219527 - RNA, 15 nt, Mycobacterium bovis subsp bovis AF2122/97
caguggcgcauuggc

SEQ ID NO: 1219528 - RNA, 17 nt, Mycobacterium bovis subsp bovis AF2122/97
caguggcgcgugcagcg

SEQ ID NO: 1219529 - RNA, 14 nt, Mycobacterium bovis subsp bovis AF2122/97
caguggccagaccc

SEQ ID NO: 1219530 - RNA, 18 nt, Mycobacterium bovis subsp bovis AF2122/97
cagugggacaggucggca

SEQ ID NO: 1219531 - RNA, 17 nt, Mycobacterium bovis subsp bovis AF2122/97
cagugggacuggcguga

SEQ ID NO: 1219532 - RNA, 20 nt, Mycobacterium bovis subsp bovis AF2122/97
cagugcucaucgacaaucgc

SEQ ID NO: 1219533 - RNA, 23 nt, Mycobacterium bovis subsp bovis AF2122/97
cagugcgggggcgaccuggugga

SEQ ID NO: 1219534 - RNA, 18 nt, Mycobacterium bovis subsp bovis AF2122/97
cagugcgguggcagguga

SEQ ID NO: 1219535 - RNA, 14 nt, Mycobacterium bovis subsp bovis AF2122/97
caguggauccggca

SEQ ID NO: 1219536 - RNA, 23 nt, Mycobacterium bovis subsp bovis AF2122/97
cagugcgaacucaucgugguaac

SEQ ID NO: 1219537 - RNA, 15 nt, Mycobacterium bovis subsp bovis AF2122/97
cagugcgcaacccag

SEQ ID NO: 1219538 - RNA, 17 nt, Mycobacterium bovis subsp bovis AF2122/97
cagugcgcaacccagcc

SEQ ID NO: 1219539 - RNA, 19 nt, Mycobacterium bovis subsp bovis AF2122/97
cagugcgcaacccagccgc

SEQ ID NO: 1219540 - RNA, 16 nt, Mycobacterium bovis subsp bovis AF2122/97
cagugcgcgugcccgu

SEQ ID NO: 1219541 - RNA, 14 nt, Mycobacterium bovis subsp bovis AF2122/97
cagugcggccuugg

SEQ ID NO: 1219542 - RNA, 19 nt, Mycobacterium bovis subsp bovis AF2122/97
cagugcccgcacugccgcc

SEQ ID NO: 1219543 - RNA, 16 nt, Mycobacterium bovis subsp bovis AF2122/97
cagugcccgcacugcc

SEQ ID NO: 1219544 - RNA, 20 nt, Mycobacterium bovis subsp bovis AF2122/97
cagugccagugccagcgucc

SEQ ID NO: 1219545 - RNA, 14 nt, Mycobacterium bovis subsp bovis AF2122/97
cagugccaucuaca

SEQ ID NO: 1219546 - RNA, 17 nt, Mycobacterium bovis subsp bovis AF2122/97
cagugccccgcagcacu

SEQ ID NO: 1219547 - RNA, 14 nt, Mycobacterium bovis subsp bovis AF2122/97
cagugccccgcccg

SEQ ID NO: 1219548 - RNA, 13 nt, Mycobacterium bovis subsp bovis AF2122/97
cagugugcgccgu

SEQ ID NO: 1219549 - RNA, 23 nt, Mycobacterium bovis subsp bovis AF2122/97
cagugugcgguuggaucggcggc

SEQ ID NO: 1219550 - RNA, 21 nt, Mycobacterium bovis subsp bovis AF2122/97
caguguggcgaugaccacgcc

SEQ ID NO: 1219551 - RNA, 17 nt, Mycobacterium bovis subsp bovis AF2122/97
caguuccaccgcgcagg

SEQ ID NO: 1219552 - RNA, 13 nt, Mycobacterium bovis subsp bovis AF2122/97
caguuccaccgcg

SEQ ID NO: 1219553 - RNA, 17 nt, Mycobacterium bovis subsp bovis AF2122/97
caguucaucgggcacca

SEQ ID NO: 1219554 - RNA, 17 nt, Mycobacterium bovis subsp bovis AF2122/97
caguucaacgaggccga

SEQ ID NO: 1219555 - RNA, 19 nt, Mycobacterium bovis subsp bovis AF2122/97
caguucccggccauagccc

SEQ ID NO: 1219556 - RNA, 16 nt, Mycobacterium bovis subsp bovis AF2122/97
caguucccuacaccca

SEQ ID NO: 1219557 - RNA, 21 nt, Mycobacterium bovis subsp bovis AF2122/97
caguuccgcggcgaguggcuc

SEQ ID NO: 1219558 - RNA, 14 nt, Mycobacterium bovis subsp bovis AF2122/97
caguucccagacca

SEQ ID NO: 1219559 - RNA, 21 nt, Mycobacterium bovis subsp bovis AF2122/97
caguucggccuugaucgugcu

SEQ ID NO: 1219560 - RNA, 15 nt, Mycobacterium bovis subsp bovis AF2122/97
caguucggcgaugcg

SEQ ID NO: 1219561 - RNA, 20 nt, Mycobacterium bovis subsp bovis AF2122/97
caguucggcgaugcgcgggu

SEQ ID NO: 1219562 - RNA, 15 nt, Mycobacterium bovis subsp bovis AF2122/97
caguucgcgccacgc

SEQ ID NO: 1219563 - RNA, 13 nt, Mycobacterium bovis subsp bovis AF2122/97
caguucgcgccgu

SEQ ID NO: 1219564 - RNA, 18 nt, Mycobacterium bovis subsp bovis AF2122/97
caguucggcggccgccgc

SEQ ID NO: 1219565 - RNA, 20 nt, Mycobacterium bovis subsp bovis AF2122/97
caguucggcggccgccgcgu

SEQ ID NO: 1219566 - RNA, 16 nt, Mycobacterium bovis subsp bovis AF2122/97
caguugcgcuccaaca

SEQ ID NO: 1219567 - RNA, 16 nt, Mycobacterium bovis subsp bovis AF2122/97
caguugauccugcagu

SEQ ID NO: 1219568 - RNA, 20 nt, Mycobacterium bovis subsp bovis AF2122/97
caguugcacaccgaucggca

SEQ ID NO: 1219569 - RNA, 20 nt, Mycobacterium bovis subsp bovis AF2122/97
caguugcacaccggcacugc

SEQ ID NO: 1219570 - RNA, 21 nt, Mycobacterium bovis subsp bovis AF2122/97
caguugcguuguccaccauca

SEQ ID NO: 1219571 - RNA, 17 nt, Mycobacterium bovis subsp bovis AF2122/97
caguuggcaccagccgg

SEQ ID NO: 1219572 - RNA, 15 nt, Mycobacterium bovis subsp bovis AF2122/97
caguuggaacugccc

SEQ ID NO: 1219573 - RNA, 12 nt, Mycobacterium bovis subsp bovis AF2122/97
caguugacccau

SEQ ID NO: 1219574 - RNA, 16 nt, Mycobacterium bovis subsp bovis AF2122/97
caguugaacucgacca

SEQ ID NO: 1219575 - RNA, 18 nt, Mycobacterium bovis subsp bovis AF2122/97
caguugguagagcaccag

SEQ ID NO: 1219576 - RNA, 19 nt, Mycobacterium bovis subsp bovis AF2122/97
caguugguagccgcccucc

SEQ ID NO: 1219577 - RNA, 17 nt, Mycobacterium bovis subsp bovis AF2122/97
cauacccgcgcgcacca

SEQ ID NO: 1219578 - RNA, 23 nt, Mycobacterium bovis subsp bovis AF2122/97
cauaccgaugguggugccaaccu

SEQ ID NO: 1219579 - RNA, 20 nt, Mycobacterium bovis subsp bovis AF2122/97
cauacgagcagugaccgcug

SEQ ID NO: 1219580 - RNA, 19 nt, Mycobacterium bovis subsp bovis AF2122/97
cauacgcccacuccagcag

SEQ ID NO: 1219581 - RNA, 20 nt, Mycobacterium bovis subsp bovis AF2122/97
cauacgcccacuccagcagc

SEQ ID NO: 1219582 - RNA, 22 nt, Mycobacterium bovis subsp bovis AF2122/97
cauacgcccacuccagcagcuc

SEQ ID NO: 1219583 - RNA, 15 nt, Mycobacterium bovis subsp bovis AF2122/97
cauacgccggccgcg

SEQ ID NO: 1219584 - RNA, 17 nt, Mycobacterium bovis subsp bovis AF2122/97
cauaccguucacccagc

SEQ ID NO: 1219585 - RNA, 22 nt, Mycobacterium bovis subsp bovis AF2122/97
cauaccguucacccagcggaac

SEQ ID NO: 1219586 - RNA, 22 nt, Mycobacterium bovis subsp bovis AF2122/97
cauacacaacgccaugugugca

SEQ ID NO: 1219587 - RNA, 16 nt, Mycobacterium bovis subsp bovis AF2122/97
cauacaaccccgcgcu

SEQ ID NO: 1219588 - RNA, 19 nt, Mycobacterium bovis subsp bovis AF2122/97
cauaaagaucagcaugguc

SEQ ID NO: 1219589 - RNA, 21 nt, Mycobacterium bovis subsp bovis AF2122/97
cauaaccggcgcgccccgccg

SEQ ID NO: 1219590 - RNA, 13 nt, Mycobacterium bovis subsp bovis AF2122/97
cauaaccgguggg

SEQ ID NO: 1219591 - RNA, 12 nt, Mycobacterium bovis subsp bovis AF2122/97
cauaacagcugg

SEQ ID NO: 1219592 - RNA, 15 nt, Mycobacterium bovis subsp bovis AF2122/97
cauaagcccccgaca

SEQ ID NO: 1219593 - RNA, 20 nt, Mycobacterium bovis subsp bovis AF2122/97
cauaagcccccgacacgccg

SEQ ID NO: 1219594 - RNA, 23 nt, Mycobacterium bovis subsp bovis AF2122/97
cauaagcccccgcacgcacggcg

SEQ ID NO: 1219595 - RNA, 13 nt, Mycobacterium bovis subsp bovis AF2122/97
cauauagaucacu

SEQ ID NO: 1219596 - RNA, 16 nt, Mycobacterium bovis subsp bovis AF2122/97
cauagugcggcugcaa

SEQ ID NO: 1219597 - RNA, 18 nt, Mycobacterium bovis subsp bovis AF2122/97
cauagugcggcugcaacg

SEQ ID NO: 1219598 - RNA, 17 nt, Mycobacterium bovis subsp bovis AF2122/97
cauaguccgaaccgagc

SEQ ID NO: 1219599 - RNA, 20 nt, Mycobacterium bovis subsp bovis AF2122/97
cauagucgaauggcaacaca

SEQ ID NO: 1219600 - RNA, 23 nt, Mycobacterium bovis subsp bovis AF2122/97
cauauuggcgcggccgaaagagc

SEQ ID NO: 1219601 - RNA, 19 nt, Mycobacterium bovis subsp bovis AF2122/97
caucaacugcaucaccacu

SEQ ID NO: 1219602 - RNA, 16 nt, Mycobacterium bovis subsp bovis AF2122/97
caucaacgcgggcgcu

SEQ ID NO: 1219603 - RNA, 21 nt, Mycobacterium bovis subsp bovis AF2122/97
caucaacgccggcgacggcgu

SEQ ID NO: 1219604 - RNA, 16 nt, Mycobacterium bovis subsp bovis AF2122/97
caucaacgacaccaga

SEQ ID NO: 1219605 - RNA, 19 nt, Mycobacterium bovis subsp bovis AF2122/97
caucagauucgcgcuggcc

SEQ ID NO: 1219606 - RNA, 12 nt, Mycobacterium bovis subsp bovis AF2122/97
caucagccgcac

SEQ ID NO: 1219607 - RNA, 19 nt, Mycobacterium bovis subsp bovis AF2122/97
caucagcggcgccaguaug

SEQ ID NO: 1219608 - RNA, 13 nt, Mycobacterium bovis subsp bovis AF2122/97
caucagcggcgcc

SEQ ID NO: 1219609 - RNA, 22 nt, Mycobacterium bovis subsp bovis AF2122/97
caucacgccgccggaggugaca

SEQ ID NO: 1219610 - RNA, 22 nt, Mycobacterium bovis subsp bovis AF2122/97
caucacggcggggaucgcuggc

SEQ ID NO: 1219611 - RNA, 16 nt, Mycobacterium bovis subsp bovis AF2122/97
caucagaaucaggcuc

SEQ ID NO: 1219612 - RNA, 18 nt, Mycobacterium bovis subsp bovis AF2122/97
caucagaaugccuggccc

SEQ ID NO: 1219613 - RNA, 14 nt, Mycobacterium bovis subsp bovis AF2122/97
caucacgcccacga

SEQ ID NO: 1219614 - RNA, 15 nt, Mycobacterium bovis subsp bovis AF2122/97
caucacgaccagggu

SEQ ID NO: 1219615 - RNA, 17 nt, Mycobacterium bovis subsp bovis AF2122/97
caucacgacucccccgg

SEQ ID NO: 1219616 - RNA, 18 nt, Mycobacterium bovis subsp bovis AF2122/97
caucaucggaaccguuug

SEQ ID NO: 1219617 - RNA, 17 nt, Mycobacterium bovis subsp bovis AF2122/97
caucaucgcccugggcg

SEQ ID NO: 1219618 - RNA, 12 nt, Mycobacterium bovis subsp bovis AF2122/97
caucaucgccac

SEQ ID NO: 1219619 - RNA, 14 nt, Mycobacterium bovis subsp bovis AF2122/97
caucaggucggcga

SEQ ID NO: 1219620 - RNA, 17 nt, Mycobacterium bovis subsp bovis AF2122/97
caucaggugcgccuggc

SEQ ID NO: 1219621 - RNA, 16 nt, Mycobacterium bovis subsp bovis AF2122/97
caucgaccgcccgcca

SEQ ID NO: 1219622 - RNA, 14 nt, Mycobacterium bovis subsp bovis AF2122/97
caucgacgcgcgcu

SEQ ID NO: 1219623 - RNA, 17 nt, Mycobacterium bovis subsp bovis AF2122/97
caucgacggugaucagg

SEQ ID NO: 1219624 - RNA, 21 nt, Mycobacterium bovis subsp bovis AF2122/97
caucgaugucggcucggcccc

SEQ ID NO: 1219625 - RNA, 23 nt, Mycobacterium bovis subsp bovis AF2122/97
caucgacguagcgaagugcgcgc

SEQ ID NO: 1219626 - RNA, 22 nt, Mycobacterium bovis subsp bovis AF2122/97
caucgaguucggcccgcaaaca

SEQ ID NO: 1219627 - RNA, 12 nt, Mycobacterium bovis subsp bovis AF2122/97
cauccugcagcu

SEQ ID NO: 1219628 - RNA, 17 nt, Mycobacterium bovis subsp bovis AF2122/97
cauccugcagcucgggc

SEQ ID NO: 1219629 - RNA, 19 nt, Mycobacterium bovis subsp bovis AF2122/97
cauccugcagcucgggcag

SEQ ID NO: 1219630 - RNA, 22 nt, Mycobacterium bovis subsp bovis AF2122/97
caucgcgacuagacgccgccgc

SEQ ID NO: 1219631 - RNA, 23 nt, Mycobacterium bovis subsp bovis AF2122/97
caucgcgacuagacgccgccgcu

SEQ ID NO: 1219632 - RNA, 15 nt, Mycobacterium bovis subsp bovis AF2122/97
caucgccuugcccag

SEQ ID NO: 1219633 - RNA, 17 nt, Mycobacterium bovis subsp bovis AF2122/97
caucgccuugcccagcg

SEQ ID NO: 1219634 - RNA, 20 nt, Mycobacterium bovis subsp bovis AF2122/97
caucgcgauuccggcggcca

SEQ ID NO: 1219635 - RNA, 15 nt, Mycobacterium bovis subsp bovis AF2122/97
caucgcgcacgcccu

SEQ ID NO: 1219636 - RNA, 19 nt, Mycobacterium bovis subsp bovis AF2122/97
caucgcgagccagcugcuc

SEQ ID NO: 1219637 - RNA, 16 nt, Mycobacterium bovis subsp bovis AF2122/97
caucgcggcggcgcuc

SEQ ID NO: 1219638 - RNA, 16 nt, Mycobacterium bovis subsp bovis AF2122/97
caucgcgcgcggcucc

SEQ ID NO: 1219639 - RNA, 14 nt, Mycobacterium bovis subsp bovis AF2122/97
caucgccgcggcca

SEQ ID NO: 1219640 - RNA, 23 nt, Mycobacterium bovis subsp bovis AF2122/97
caucgccggagucgacccugccc

SEQ ID NO: 1219641 - RNA, 13 nt, Mycobacterium bovis subsp bovis AF2122/97
caucgcacccacc

SEQ ID NO: 1219642 - RNA, 18 nt, Mycobacterium bovis subsp bovis AF2122/97
caucgcacgggccaccag

SEQ ID NO: 1219643 - RNA, 16 nt, Mycobacterium bovis subsp bovis AF2122/97
cauccgcggcaugcaa

SEQ ID NO: 1219644 - RNA, 14 nt, Mycobacterium bovis subsp bovis AF2122/97
cauccgacagcagc

SEQ ID NO: 1219645 - RNA, 15 nt, Mycobacterium bovis subsp bovis AF2122/97
cauccgacagcagcc

SEQ ID NO: 1219646 - RNA, 18 nt, Mycobacterium bovis subsp bovis AF2122/97
caucccuuucgcgccgcg

SEQ ID NO: 1219647 - RNA, 17 nt, Mycobacterium bovis subsp bovis AF2122/97
caucccguucagcuucc

SEQ ID NO: 1219648 - RNA, 22 nt, Mycobacterium bovis subsp bovis AF2122/97
caucccggccgaguaccagccc

SEQ ID NO: 1219649 - RNA, 15 nt, Mycobacterium bovis subsp bovis AF2122/97
caucccggcgccgcg

SEQ ID NO: 1219650 - RNA, 22 nt, Mycobacterium bovis subsp bovis AF2122/97
cauccgggccgagcgcaccacg

SEQ ID NO: 1219651 - RNA, 23 nt, Mycobacterium bovis subsp bovis AF2122/97
cauccgggcgaccaccaccgccg

SEQ ID NO: 1219652 - RNA, 22 nt, Mycobacterium bovis subsp bovis AF2122/97
cauccgugucgagaucucacgu

SEQ ID NO: 1219653 - RNA, 19 nt, Mycobacterium bovis subsp bovis AF2122/97
cauccgucguacacgccau

SEQ ID NO: 1219654 - RNA, 12 nt, Mycobacterium bovis subsp bovis AF2122/97
cauccgucaagu

SEQ ID NO: 1219655 - RNA, 19 nt, Mycobacterium bovis subsp bovis AF2122/97
cauccucgacuugcuuggc

SEQ ID NO: 1219656 - RNA, 13 nt, Mycobacterium bovis subsp bovis AF2122/97
cauccucgagcug

SEQ ID NO: 1219657 - RNA, 16 nt, Mycobacterium bovis subsp bovis AF2122/97
cauccucgagcugcug

SEQ ID NO: 1219658 - RNA, 15 nt, Mycobacterium bovis subsp bovis AF2122/97
cauccuccugcgccg

SEQ ID NO: 1219659 - RNA, 15 nt, Mycobacterium bovis subsp bovis AF2122/97
cauccugcacgaccc

SEQ ID NO: 1219660 - RNA, 19 nt, Mycobacterium bovis subsp bovis AF2122/97
caucucccgaccgccgagc

SEQ ID NO: 1219661 - RNA, 20 nt, Mycobacterium bovis subsp bovis AF2122/97
caucucccgaccgccgagcg

SEQ ID NO: 1219662 - RNA, 19 nt, Mycobacterium bovis subsp bovis AF2122/97
caucuccgccgucgccacc

SEQ ID NO: 1219663 - RNA, 16 nt, Mycobacterium bovis subsp bovis AF2122/97
caucucaugcaucugc

SEQ ID NO: 1219664 - RNA, 19 nt, Mycobacterium bovis subsp bovis AF2122/97
caucgcgggcggcgcuggc

SEQ ID NO: 1219665 - RNA, 21 nt, Mycobacterium bovis subsp bovis AF2122/97
caucgcgggcgugccgaccag

SEQ ID NO: 1219666 - RNA, 19 nt, Mycobacterium bovis subsp bovis AF2122/97
caucgcgucgucuucuucg

SEQ ID NO: 1219667 - RNA, 16 nt, Mycobacterium bovis subsp bovis AF2122/97
caucguaggccggcau

SEQ ID NO: 1219668 - RNA, 21 nt, Mycobacterium bovis subsp bovis AF2122/97
caucgucgccacgaugccggc

SEQ ID NO: 1219669 - RNA, 16 nt, Mycobacterium bovis subsp bovis AF2122/97
caucgucgaaagccug

SEQ ID NO: 1219670 - RNA, 23 nt, Mycobacterium bovis subsp bovis AF2122/97
caucguccacgcagaggcggcug

SEQ ID NO: 1219671 - RNA, 14 nt, Mycobacterium bovis subsp bovis AF2122/97
caucgucacugcca

SEQ ID NO: 1219672 - RNA, 14 nt, Mycobacterium bovis subsp bovis AF2122/97
caucgucaggaacc

SEQ ID NO: 1219673 - RNA, 21 nt, Mycobacterium bovis subsp bovis AF2122/97
caucguuucacccgggcugcu

SEQ ID NO: 1219674 - RNA, 16 nt, Mycobacterium bovis subsp bovis AF2122/97
caucugaugacggugu

SEQ ID NO: 1219675 - RNA, 14 nt, Mycobacterium bovis subsp bovis AF2122/97
caucugccugccug

SEQ ID NO: 1219676 - RNA, 19 nt, Mycobacterium bovis subsp bovis AF2122/97
caucucgagcaugcccagc

SEQ ID NO: 1219677 - RNA, 15 nt, Mycobacterium bovis subsp bovis AF2122/97
caucuccucgccugc

SEQ ID NO: 1219678 - RNA, 22 nt, Mycobacterium bovis subsp bovis AF2122/97
caucucggcuacgccucggcgu

SEQ ID NO: 1219679 - RNA, 18 nt, Mycobacterium bovis subsp bovis AF2122/97
caucuguaaccuccucga

SEQ ID NO: 1219680 - RNA, 11 nt, Mycobacterium bovis subsp bovis AF2122/97
caucuggguga

SEQ ID NO: 1219681 - RNA, 19 nt, Mycobacterium bovis subsp bovis AF2122/97
caucugguggaccuccgga

SEQ ID NO: 1219682 - RNA, 19 nt, Mycobacterium bovis subsp bovis AF2122/97
caucuggcgccguuagcgu

SEQ ID NO: 1219683 - RNA, 20 nt, Mycobacterium bovis subsp bovis AF2122/97
caucuggcgcgccguucuga

SEQ ID NO: 1219684 - RNA, 14 nt, Mycobacterium bovis subsp bovis AF2122/97
caucuggcgcugcu

SEQ ID NO: 1219685 - RNA, 22 nt, Mycobacterium bovis subsp bovis AF2122/97
cacugccgccgguuccgccggc

SEQ ID NO: 1219686 - RNA, 23 nt, Mycobacterium bovis subsp bovis AF2122/97
cacugccggugggcguucccccg

SEQ ID NO: 1219687 - RNA, 15 nt, Mycobacterium bovis subsp bovis AF2122/97
cacugccgcgcgccc

SEQ ID NO: 1219688 - RNA, 14 nt, Mycobacterium bovis subsp bovis AF2122/97
cacugcccagcaga

SEQ ID NO: 1219689 - RNA, 19 nt, Mycobacterium bovis subsp bovis AF2122/97
cacugcgaccgucccggcc

SEQ ID NO: 1219690 - RNA, 18 nt, Mycobacterium bovis subsp bovis AF2122/97
cacugccggcagcgcccc

SEQ ID NO: 1219691 - RNA, 17 nt, Mycobacterium bovis subsp bovis AF2122/97
cacugccguugccgccg

SEQ ID NO: 1219692 - RNA, 13 nt, Mycobacterium bovis subsp bovis AF2122/97
cacugcgcccgcc

SEQ ID NO: 1219693 - RNA, 17 nt, Mycobacterium bovis subsp bovis AF2122/97
cacugcgagcgccggcu

SEQ ID NO: 1219694 - RNA, 16 nt, Mycobacterium bovis subsp bovis AF2122/97
cacugcugcggcagcg

SEQ ID NO: 1219695 - RNA, 17 nt, Mycobacterium bovis subsp bovis AF2122/97
cacugcgccgugaccca

SEQ ID NO: 1219696 - RNA, 22 nt, Mycobacterium bovis subsp bovis AF2122/97
cacugcgaucgcgacccgaucg

SEQ ID NO: 1219697 - RNA, 16 nt, Mycobacterium bovis subsp bovis AF2122/97
cacugcgcccgccacg

SEQ ID NO: 1219698 - RNA, 20 nt, Mycobacterium bovis subsp bovis AF2122/97
cacugcggccugcucgacca

SEQ ID NO: 1219699 - RNA, 12 nt, Mycobacterium bovis subsp bovis AF2122/97
cacugccaccgc

SEQ ID NO: 1219700 - RNA, 13 nt, Mycobacterium bovis subsp bovis AF2122/97
cacugccagccgu

SEQ ID NO: 1219701 - RNA, 18 nt, Mycobacterium bovis subsp bovis AF2122/97
cacugaugucacccgccc

SEQ ID NO: 1219702 - RNA, 14 nt, Mycobacterium bovis subsp bovis AF2122/97
cacugagccacagg

SEQ ID NO: 1219703 - RNA, 18 nt, Mycobacterium bovis subsp bovis AF2122/97
cacugaguucggugcugu

SEQ ID NO: 1219704 - RNA, 21 nt, Mycobacterium bovis subsp bovis AF2122/97
cacugaccgaacgcaacagcc

SEQ ID NO: 1219705 - RNA, 14 nt, Mycobacterium bovis subsp bovis AF2122/97
cacucccauccgcc

SEQ ID NO: 1219706 - RNA, 14 nt, Mycobacterium bovis subsp bovis AF2122/97
cacuccagcggcgg

SEQ ID NO: 1219707 - RNA, 17 nt, Mycobacterium bovis subsp bovis AF2122/97
cacuccaggagccgagg

SEQ ID NO: 1219708 - RNA, 23 nt, Mycobacterium bovis subsp bovis AF2122/97
cacucccggcucggccagccagc

SEQ ID NO: 1219709 - RNA, 14 nt, Mycobacterium bovis subsp bovis AF2122/97
cacuccccagcccc

SEQ ID NO: 1219710 - RNA, 16 nt, Mycobacterium bovis subsp bovis AF2122/97
cacucccccacacacc

SEQ ID NO: 1219711 - RNA, 19 nt, Mycobacterium bovis subsp bovis AF2122/97
cacuccgguggccaacacc

SEQ ID NO: 1219712 - RNA, 13 nt, Mycobacterium bovis subsp bovis AF2122/97
cacuccugcacac

SEQ ID NO: 1219713 - RNA, 13 nt, Mycobacterium bovis subsp bovis AF2122/97
cacuccgcggggu

SEQ ID NO: 1219714 - RNA, 12 nt, Mycobacterium bovis subsp bovis AF2122/97
cacuccgccgau

SEQ ID NO: 1219715 - RNA, 19 nt, Mycobacterium bovis subsp bovis AF2122/97
cacucgaagucgcccaguc

SEQ ID NO: 1219716 - RNA, 19 nt, Mycobacterium bovis subsp bovis AF2122/97
cacucgcccaagcgcagcc

SEQ ID NO: 1219717 - RNA, 17 nt, Mycobacterium bovis subsp bovis AF2122/97
cacucgccacucagccc

SEQ ID NO: 1219718 - RNA, 23 nt, Mycobacterium bovis subsp bovis AF2122/97
cacucgccagggccaucuggcug

SEQ ID NO: 1219719 - RNA, 16 nt, Mycobacterium bovis subsp bovis AF2122/97
cacucgcucaggaaca

SEQ ID NO: 1219720 - RNA, 20 nt, Mycobacterium bovis subsp bovis AF2122/97
cacucgccgcgacugcaccu

SEQ ID NO: 1219721 - RNA, 17 nt, Mycobacterium bovis subsp bovis AF2122/97
cacucgcgccagugugg

SEQ ID NO: 1219722 - RNA, 19 nt, Mycobacterium bovis subsp bovis AF2122/97
cacucgcggauccgggcgu

SEQ ID NO: 1219723 - RNA, 15 nt, Mycobacterium bovis subsp bovis AF2122/97
cacucggcccggccc

SEQ ID NO: 1219724 - RNA, 13 nt, Mycobacterium bovis subsp bovis AF2122/97
cacucggcgcccu

SEQ ID NO: 1219725 - RNA, 18 nt, Mycobacterium bovis subsp bovis AF2122/97
cacucggugucggccgcg

SEQ ID NO: 1219726 - RNA, 19 nt, Mycobacterium bovis subsp bovis AF2122/97
cacugaccaggucugcggu

SEQ ID NO: 1219727 - RNA, 23 nt, Mycobacterium bovis subsp bovis AF2122/97
cacugaacaggccgguucccuug

SEQ ID NO: 1219728 - RNA, 21 nt, Mycobacterium bovis subsp bovis AF2122/97
cacucuggucacugguccaac

SEQ ID NO: 1219729 - RNA, 18 nt, Mycobacterium bovis subsp bovis AF2122/97
cacucguugaccggccgg

SEQ ID NO: 1219730 - RNA, 23 nt, Mycobacterium bovis subsp bovis AF2122/97
cacucucggugaacgccgccccg

SEQ ID NO: 1219731 - RNA, 19 nt, Mycobacterium bovis subsp bovis AF2122/97
cacuacggccuggccaccu

SEQ ID NO: 1219732 - RNA, 18 nt, Mycobacterium bovis subsp bovis AF2122/97
cacguucaccgcgcgcuc

SEQ ID NO: 1219733 - RNA, 14 nt, Mycobacterium bovis subsp bovis AF2122/97
cacguuauucaugc

SEQ ID NO: 1219734 - RNA, 20 nt, Mycobacterium bovis subsp bovis AF2122/97
cacguggauguguagguggg

SEQ ID NO: 1219735 - RNA, 16 nt, Mycobacterium bovis subsp bovis AF2122/97
cacgugaugcccuggg

SEQ ID NO: 1219736 - RNA, 22 nt, Mycobacterium bovis subsp bovis AF2122/97
cacguuggccccgcggagcgca

SEQ ID NO: 1219737 - RNA, 16 nt, Mycobacterium bovis subsp bovis AF2122/97
cacguucucaccacca

SEQ ID NO: 1219738 - RNA, 14 nt, Mycobacterium bovis subsp bovis AF2122/97
cacguucggcugcg

SEQ ID NO: 1219739 - RNA, 20 nt, Mycobacterium bovis subsp bovis AF2122/97
cacucaugaugccggacgcc

SEQ ID NO: 1219740 - RNA, 12 nt, Mycobacterium bovis subsp bovis AF2122/97
cacuccaaaugg

SEQ ID NO: 1219741 - RNA, 18 nt, Mycobacterium bovis subsp bovis AF2122/97
cacuccaccgcuggcccg

SEQ ID NO: 1219742 - RNA, 23 nt, Mycobacterium bovis subsp bovis AF2122/97
cacuccaagucacagcucaccau

SEQ ID NO: 1219743 - RNA, 20 nt, Mycobacterium bovis subsp bovis AF2122/97
cacuccagcagcucgccggc

SEQ ID NO: 1219744 - RNA, 20 nt, Mycobacterium bovis subsp bovis AF2122/97
cacuccagcgaaccgacccg

SEQ ID NO: 1219745 - RNA, 23 nt, Mycobacterium bovis subsp bovis AF2122/97
cacuccagcgaaccgacccggcc

SEQ ID NO: 1219746 - RNA, 13 nt, Mycobacterium bovis subsp bovis AF2122/97
cacucacccagcu

SEQ ID NO: 1219747 - RNA, 12 nt, Mycobacterium bovis subsp bovis AF2122/97
cacucaccuugu

SEQ ID NO: 1219748 - RNA, 19 nt, Mycobacterium bovis subsp bovis AF2122/97
cacuagcagggggacccgg

SEQ ID NO: 1219749 - RNA, 22 nt, Mycobacterium bovis subsp bovis AF2122/97
cacuagcauugucgccggaugc

SEQ ID NO: 1219750 - RNA, 18 nt, Mycobacterium bovis subsp bovis AF2122/97
cacuacucgaacaacccc

SEQ ID NO: 1219751 - RNA, 19 nt, Mycobacterium bovis subsp bovis AF2122/97
cacuaguucgagcugccag

SEQ ID NO: 1219752 - RNA, 23 nt, Mycobacterium bovis subsp bovis AF2122/97
cacuaguucgagcugccaggccc

SEQ ID NO: 1219753 - RNA, 13 nt, Mycobacterium bovis subsp bovis AF2122/97
cacuggcgccggu

SEQ ID NO: 1219754 - RNA, 18 nt, Mycobacterium bovis subsp bovis AF2122/97
cacuggcgccggugccgc

SEQ ID NO: 1219755 - RNA, 19 nt, Mycobacterium bovis subsp bovis AF2122/97
cacuggcgauaucggcccc

SEQ ID NO: 1219756 - RNA, 22 nt, Mycobacterium bovis subsp bovis AF2122/97
cacuggcgauaucggcccccaa

SEQ ID NO: 1219757 - RNA, 16 nt, Mycobacterium bovis subsp bovis AF2122/97
cacuggugacccugau

SEQ ID NO: 1219758 - RNA, 12 nt, Mycobacterium bovis subsp bovis AF2122/97
cacuggugaucu

SEQ ID NO: 1219759 - RNA, 18 nt, Mycobacterium bovis subsp bovis AF2122/97
cacugucggguaacccca

SEQ ID NO: 1219760 - RNA, 18 nt, Mycobacterium bovis subsp bovis AF2122/97
cacuguuacggccacacc

SEQ ID NO: 1219761 - RNA, 21 nt, Mycobacterium bovis subsp bovis AF2122/97
cacugguugggcgagaccgcg

SEQ ID NO: 1219762 - RNA, 14 nt, Mycobacterium bovis subsp bovis AF2122/97
cacugugaggucau

SEQ ID NO: 1219763 - RNA, 19 nt, Mycobacterium bovis subsp bovis AF2122/97
cacuguugaagaagcccga

SEQ ID NO: 1219764 - RNA, 22 nt, Mycobacterium bovis subsp bovis AF2122/97
cacuguuggugccgccaccacc

SEQ ID NO: 1219765 - RNA, 23 nt, Mycobacterium bovis subsp bovis AF2122/97
cacuguuggugccgccaccaccg

SEQ ID NO: 1219766 - RNA, 21 nt, Mycobacterium bovis subsp bovis AF2122/97
cacuugaaauugagccggccc

SEQ ID NO: 1219767 - RNA, 19 nt, Mycobacterium bovis subsp bovis AF2122/97
cacuuggacccggccggcc

SEQ ID NO: 1219768 - RNA, 14 nt, Mycobacterium bovis subsp bovis AF2122/97
cacuuggacgaaca

SEQ ID NO: 1219769 - RNA, 13 nt, Mycobacterium bovis subsp bovis AF2122/97
cacuuggacccgg

SEQ ID NO: 1219770 - RNA, 15 nt, Mycobacterium bovis subsp bovis AF2122/97
cacuuggacccggcc

SEQ ID NO: 1219771 - RNA, 15 nt, Mycobacterium bovis subsp bovis AF2122/97
cacuucggcgccgcg

SEQ ID NO: 1219772 - RNA, 16 nt, Mycobacterium bovis subsp bovis AF2122/97
cacuucacgccgcccc

SEQ ID NO: 1219773 - RNA, 14 nt, Mycobacterium bovis subsp bovis AF2122/97
cacuuccaagccga

SEQ ID NO: 1219774 - RNA, 15 nt, Mycobacterium bovis subsp bovis AF2122/97
cagaacgcggccucg

SEQ ID NO: 1219775 - RNA, 23 nt, Mycobacterium bovis subsp bovis AF2122/97
cagaaguagguuuucggcggcuc

SEQ ID NO: 1219776 - RNA, 14 nt, Mycobacterium bovis subsp bovis AF2122/97
cagaaccagcgacc

SEQ ID NO: 1219777 - RNA, 15 nt, Mycobacterium bovis subsp bovis AF2122/97
cagaaccgacggcca

SEQ ID NO: 1219778 - RNA, 16 nt, Mycobacterium bovis subsp bovis AF2122/97
cagaaccgacggccag

SEQ ID NO: 1219779 - RNA, 14 nt, Mycobacterium bovis subsp bovis AF2122/97
cagaacggcggcag

SEQ ID NO: 1219780 - RNA, 17 nt, Mycobacterium bovis subsp bovis AF2122/97
cagaacgugacggucca

SEQ ID NO: 1219781 - RNA, 17 nt, Mycobacterium bovis subsp bovis AF2122/97
cagaaccggcucaagga

SEQ ID NO: 1219782 - RNA, 19 nt, Mycobacterium bovis subsp bovis AF2122/97
cagaaccuggagccgugcg

SEQ ID NO: 1219783 - RNA, 21 nt, Mycobacterium bovis subsp bovis AF2122/97
cagaaaacccucgcugcggug

SEQ ID NO: 1219784 - RNA, 14 nt, Mycobacterium bovis subsp bovis AF2122/97
cagaccggcgccgu

SEQ ID NO: 1219785 - RNA, 22 nt, Mycobacterium bovis subsp bovis AF2122/97
cagaccuagcaccgcgccgaac

SEQ ID NO: 1219786 - RNA, 17 nt, Mycobacterium bovis subsp bovis AF2122/97
cagaccggaaacagcau

SEQ ID NO: 1219787 - RNA, 18 nt, Mycobacterium bovis subsp bovis AF2122/97
cagaccggaaacagcaug

SEQ ID NO: 1219788 - RNA, 17 nt, Mycobacterium bovis subsp bovis AF2122/97
cagaccgccgacgccgu

SEQ ID NO: 1219789 - RNA, 22 nt, Mycobacterium bovis subsp bovis AF2122/97
cagacccaguccgguagcagcg

SEQ ID NO: 1219790 - RNA, 14 nt, Mycobacterium bovis subsp bovis AF2122/97
cagaccaaggcgaa

SEQ ID NO: 1219791 - RNA, 14 nt, Mycobacterium bovis subsp bovis AF2122/97
cagacgacgaucag

SEQ ID NO: 1219792 - RNA, 21 nt, Mycobacterium bovis subsp bovis AF2122/97
cagacggugcagcuccccgcc

SEQ ID NO: 1219793 - RNA, 18 nt, Mycobacterium bovis subsp bovis AF2122/97
cagaauccugcgcugcac

SEQ ID NO: 1219794 - RNA, 20 nt, Mycobacterium bovis subsp bovis AF2122/97
cagaauccggucggcccaca

SEQ ID NO: 1219795 - RNA, 14 nt, Mycobacterium bovis subsp bovis AF2122/97
cagacaucugggug

SEQ ID NO: 1219796 - RNA, 16 nt, Mycobacterium bovis subsp bovis AF2122/97
cagacaucggagauca

SEQ ID NO: 1219797 - RNA, 11 nt, Mycobacterium bovis subsp bovis AF2122/97
cagacauggca

SEQ ID NO: 1219798 - RNA, 15 nt, Mycobacterium bovis subsp bovis AF2122/97
cagaaucucgccggg

SEQ ID NO: 1219799 - RNA, 13 nt, Mycobacterium bovis subsp bovis AF2122/97
cagaaucugccuc

SEQ ID NO: 1219800 - RNA, 15 nt, Mycobacterium bovis subsp bovis AF2122/97
cagaaucugccucuc

SEQ ID NO: 1219801 - RNA, 18 nt, Mycobacterium bovis subsp bovis AF2122/97
cagaaucugccucucagc

SEQ ID NO: 1219802 - RNA, 14 nt, Mycobacterium bovis subsp bovis AF2122/97
cagaaugccuggcc

SEQ ID NO: 1219803 - RNA, 14 nt, Mycobacterium bovis subsp bovis AF2122/97
cagagcggcacgca

SEQ ID NO: 1219804 - RNA, 14 nt, Mycobacterium bovis subsp bovis AF2122/97
cagagcggcaguca

SEQ ID NO: 1219805 - RNA, 14 nt, Mycobacterium bovis subsp bovis AF2122/97
cagaggcggcuggc

SEQ ID NO: 1219806 - RNA, 12 nt, Mycobacterium bovis subsp bovis AF2122/97
cagagcgcuggu

SEQ ID NO: 1219807 - RNA, 19 nt, Mycobacterium bovis subsp bovis AF2122/97
cagaggucacgcagcaccc

SEQ ID NO: 1219808 - RNA, 19 nt, Mycobacterium bovis subsp bovis AF2122/97
cagaguuugcgaugcccac

SEQ ID NO: 1219809 - RNA, 20 nt, Mycobacterium bovis subsp bovis AF2122/97
cagagccgccguugccgccg

SEQ ID NO: 1219810 - RNA, 15 nt, Mycobacterium bovis subsp bovis AF2122/97
cagagccgcgcgccg

SEQ ID NO: 1219811 - RNA, 12 nt, Mycobacterium bovis subsp bovis AF2122/97
cagauagacuag

SEQ ID NO: 1219812 - RNA, 18 nt, Mycobacterium bovis subsp bovis AF2122/97
cagauacaggaacaacgc

SEQ ID NO: 1219813 - RNA, 23 nt, Mycobacterium bovis subsp bovis AF2122/97
cagauacaucgggaucugggcuc

SEQ ID NO: 1219814 - RNA, 17 nt, Mycobacterium bovis subsp bovis AF2122/97
cagauauuugucggcgc

SEQ ID NO: 1219815 - RNA, 21 nt, Mycobacterium bovis subsp bovis AF2122/97
cagauaguccggcuuguccuc

SEQ ID NO: 1219816 - RNA, 15 nt, Mycobacterium bovis subsp bovis AF2122/97
aaaaucgccaucggu

SEQ ID NO: 1219817 - RNA, 17 nt, Mycobacterium bovis subsp bovis AF2122/97
cagcacgcuggcguugu

SEQ ID NO: 1219818 - RNA, 15 nt, Mycobacterium bovis subsp bovis AF2122/97
cagcacggcgccgcc

SEQ ID NO: 1219819 - RNA, 17 nt, Mycobacterium bovis subsp bovis AF2122/97
cagcacggcacccaccc

SEQ ID NO: 1219820 - RNA, 16 nt, Mycobacterium bovis subsp bovis AF2122/97
cagcaccgcgaccauc

SEQ ID NO: 1219821 - RNA, 14 nt, Mycobacterium bovis subsp bovis AF2122/97
cagcaccuccaccg

SEQ ID NO: 1219822 - RNA, 16 nt, Mycobacterium bovis subsp bovis AF2122/97
cagcaccuccaccgcg

SEQ ID NO: 1219823 - RNA, 20 nt, Mycobacterium bovis subsp bovis AF2122/97
cagcaccgaacccgccaccg

SEQ ID NO: 1219824 - RNA, 18 nt, Mycobacterium bovis subsp bovis AF2122/97
cagcaccgccgcgccggc

SEQ ID NO: 1219825 - RNA, 16 nt, Mycobacterium bovis subsp bovis AF2122/97
cagcaccgccgcugcc

SEQ ID NO: 1219826 - RNA, 11 nt, Mycobacterium bovis subsp bovis AF2122/97
cagcaccgccg

SEQ ID NO: 1219827 - RNA, 20 nt, Mycobacterium bovis subsp bovis AF2122/97
cagcacccugcgggccgaga

SEQ ID NO: 1219828 - RNA, 18 nt, Mycobacterium bovis subsp bovis AF2122/97
cagcaccgaacccgccac

SEQ ID NO: 1219829 - RNA, 13 nt, Mycobacterium bovis subsp bovis AF2122/97
cagcaccagcgcc

SEQ ID NO: 1219830 - RNA, 17 nt, Mycobacterium bovis subsp bovis AF2122/97
cagcaccagcgccuuga

SEQ ID NO: 1219831 - RNA, 13 nt, Mycobacterium bovis subsp bovis AF2122/97
cagcaccacggcc

SEQ ID NO: 1219832 - RNA, 12 nt, Mycobacterium bovis subsp bovis AF2122/97
cagcaccagcac

SEQ ID NO: 1219833 - RNA, 14 nt, Mycobacterium bovis subsp bovis AF2122/97
cagcaccaccagca

SEQ ID NO: 1219834 - RNA, 12 nt, Mycobacterium bovis subsp bovis AF2122/97
cagcaccacauc

SEQ ID NO: 1219835 - RNA, 13 nt, Mycobacterium bovis subsp bovis AF2122/97
cagcaccacaacg

SEQ ID NO: 1219836 - RNA, 17 nt, Mycobacterium bovis subsp bovis AF2122/97
cagcaccacaacgucgg

SEQ ID NO: 1219837 - RNA, 14 nt, Mycobacterium bovis subsp bovis AF2122/97
cagcagcagcgccg

SEQ ID NO: 1219838 - RNA, 15 nt, Mycobacterium bovis subsp bovis AF2122/97
cagcagcauccggcc

SEQ ID NO: 1219839 - RNA, 16 nt, Mycobacterium bovis subsp bovis AF2122/97
cagcagcagcgccgcg

SEQ ID NO: 1219840 - RNA, 10 nt, Mycobacterium bovis subsp bovis AF2122/97
cagcagcacu

SEQ ID NO: 1219841 - RNA, 18 nt, Mycobacterium bovis subsp bovis AF2122/97
cagcagauccuggccggu

SEQ ID NO: 1219842 - RNA, 13 nt, Mycobacterium bovis subsp bovis AF2122/97
cagcagcaccgcg

SEQ ID NO: 1219843 - RNA, 22 nt, Mycobacterium bovis subsp bovis AF2122/97
cagcagcaaaacccgagccugg

SEQ ID NO: 1219844 - RNA, 11 nt, Mycobacterium bovis subsp bovis AF2122/97
cagcagcaacg

SEQ ID NO: 1219845 - RNA, 23 nt, Mycobacterium bovis subsp bovis AF2122/97
cagcacgguguugcgcacccgcg

SEQ ID NO: 1219846 - RNA, 17 nt, Mycobacterium bovis subsp bovis AF2122/97
cagcacggcggccacgu

SEQ ID NO: 1219847 - RNA, 17 nt, Mycobacterium bovis subsp bovis AF2122/97
cagcacggcuucgacca

SEQ ID NO: 1219848 - RNA, 15 nt, Mycobacterium bovis subsp bovis AF2122/97
cagcacgucacgcaa

SEQ ID NO: 1219849 - RNA, 16 nt, Mycobacterium bovis subsp bovis AF2122/97
cagcacguaacgccgc

SEQ ID NO: 1219850 - RNA, 17 nt, Mycobacterium bovis subsp bovis AF2122/97
cagcacguaacgccgcu

SEQ ID NO: 1219851 - RNA, 18 nt, Mycobacterium bovis subsp bovis AF2122/97
cagcacguaacgccgcuc

SEQ ID NO: 1219852 - RNA, 14 nt, Mycobacterium bovis subsp bovis AF2122/97
cagcacgugugcgg

SEQ ID NO: 1219853 - RNA, 16 nt, Mycobacterium bovis subsp bovis AF2122/97
cagcacuccaccgcug

SEQ ID NO: 1219854 - RNA, 13 nt, Mycobacterium bovis subsp bovis AF2122/97
cagcagaucaggu

SEQ ID NO: 1219855 - RNA, 14 nt, Mycobacterium bovis subsp bovis AF2122/97
cagauugauuuaac

SEQ ID NO: 1219856 - RNA, 22 nt, Mycobacterium bovis subsp bovis AF2122/97
cagaucacgcacucgcgucccg

SEQ ID NO: 1219857 - RNA, 20 nt, Mycobacterium bovis subsp bovis AF2122/97
cagaucgaagcgcagcaccu

SEQ ID NO: 1219858 - RNA, 19 nt, Mycobacterium bovis subsp bovis AF2122/97
cagcaacgugugcaccauc

SEQ ID NO: 1219859 - RNA, 20 nt, Mycobacterium bovis subsp bovis AF2122/97
cagcaagugugagcagaccc

SEQ ID NO: 1219860 - RNA, 20 nt, Mycobacterium bovis subsp bovis AF2122/97
aaaaugccuuggcagcccag

SEQ ID NO: 1219861 - RNA, 14 nt, Mycobacterium bovis subsp bovis AF2122/97
cagcaacagcgagc

SEQ ID NO: 1219862 - RNA, 23 nt, Mycobacterium bovis subsp bovis AF2122/97
cagcaacaacgucugcagccucg

SEQ ID NO: 1219863 - RNA, 16 nt, Mycobacterium bovis subsp bovis AF2122/97
cagcaaaugcggcgcg

SEQ ID NO: 1219864 - RNA, 13 nt, Mycobacterium bovis subsp bovis AF2122/97
cagcaacaggccc

SEQ ID NO: 1219865 - RNA, 19 nt, Mycobacterium bovis subsp bovis AF2122/97
cagcguuugcuggcggaac

SEQ ID NO: 1219866 - RNA, 13 nt, Mycobacterium bovis subsp bovis AF2122/97
cagcucgggcagg

SEQ ID NO: 1219867 - RNA, 18 nt, Mycobacterium bovis subsp bovis AF2122/97
cagcucgucggcgauggc

SEQ ID NO: 1219868 - RNA, 23 nt, Mycobacterium bovis subsp bovis AF2122/97
cagcugaacacgaauccggccac

SEQ ID NO: 1219869 - RNA, 21 nt, Mycobacterium bovis subsp bovis AF2122/97
cagcugaacacgaauccggcc

SEQ ID NO: 1219870 - RNA, 22 nt, Mycobacterium bovis subsp bovis AF2122/97
cagcugccgaucaauggcaacg

SEQ ID NO: 1219871 - RNA, 19 nt, Mycobacterium bovis subsp bovis AF2122/97
cagcugccgcacccccucc

SEQ ID NO: 1219872 - RNA, 19 nt, Mycobacterium bovis subsp bovis AF2122/97
cagcugcucggucaggcgg

SEQ ID NO: 1219873 - RNA, 16 nt, Mycobacterium bovis subsp bovis AF2122/97
cagcuggacggccucc

SEQ ID NO: 1219874 - RNA, 22 nt, Mycobacterium bovis subsp bovis AF2122/97
cagcugacacccgcagcugugg

SEQ ID NO: 1219875 - RNA, 22 nt, Mycobacterium bovis subsp bovis AF2122/97
cagcugaccagcguccagccgc

SEQ ID NO: 1219876 - RNA, 22 nt, Mycobacterium bovis subsp bovis AF2122/97
cagcugaucccagaucggcguu

SEQ ID NO: 1219877 - RNA, 18 nt, Mycobacterium bovis subsp bovis AF2122/97
cagcugcaauagccuuac

SEQ ID NO: 1219878 - RNA, 16 nt, Mycobacterium bovis subsp bovis AF2122/97
cagcugcaaugacugg

SEQ ID NO: 1219879 - RNA, 13 nt, Mycobacterium bovis subsp bovis AF2122/97
cagcugcaccucc

SEQ ID NO: 1219880 - RNA, 22 nt, Mycobacterium bovis subsp bovis AF2122/97
cagcugcaccuccgacggccgc

SEQ ID NO: 1219881 - RNA, 18 nt, Mycobacterium bovis subsp bovis AF2122/97
cagcugcacacagagguc

SEQ ID NO: 1219882 - RNA, 15 nt, Mycobacterium bovis subsp bovis AF2122/97
caggaagaagccgaa

SEQ ID NO: 1219883 - RNA, 15 nt, Mycobacterium bovis subsp bovis AF2122/97
caggaacucggccca

SEQ ID NO: 1219884 - RNA, 19 nt, Mycobacterium bovis subsp bovis AF2122/97
caggaacucggcccacacg

SEQ ID NO: 1219885 - RNA, 14 nt, Mycobacterium bovis subsp bovis AF2122/97
caggaagccgagac

SEQ ID NO: 1219886 - RNA, 17 nt, Mycobacterium bovis subsp bovis AF2122/97
cagcuugggcagcagcg

SEQ ID NO: 1219887 - RNA, 23 nt, Mycobacterium bovis subsp bovis AF2122/97
cagcuuguuuuccaccagcgagc

SEQ ID NO: 1219888 - RNA, 21 nt, Mycobacterium bovis subsp bovis AF2122/97
cagcuuuaaucguggcacuga

SEQ ID NO: 1219889 - RNA, 21 nt, Mycobacterium bovis subsp bovis AF2122/97
cagcuugucguagcgacgcca

SEQ ID NO: 1219890 - RNA, 24 nt, Mycobacterium bovis subsp bovis AF2122/97
cagcuuggagaggcggugcagcuc

SEQ ID NO: 1219891 - RNA, 14 nt, Mycobacterium bovis subsp bovis AF2122/97
cagcuuggccagcc

SEQ ID NO: 1219892 - RNA, 21 nt, Mycobacterium bovis subsp bovis AF2122/97
cagcuuggccucagccaccgg

SEQ ID NO: 1219893 - RNA, 18 nt, Mycobacterium bovis subsp bovis AF2122/97
cagcuuggcgucgaugcg

SEQ ID NO: 1219894 - RNA, 14 nt, Mycobacterium bovis subsp bovis AF2122/97
cagcugggcagcca

SEQ ID NO: 1219895 - RNA, 17 nt, Mycobacterium bovis subsp bovis AF2122/97
cagcugggcagccagau

SEQ ID NO: 1219896 - RNA, 22 nt, Mycobacterium bovis subsp bovis AF2122/97
cagcugggcagccagaucucca

SEQ ID NO: 1219897 - RNA, 17 nt, Mycobacterium bovis subsp bovis AF2122/97
cagcugggcgaccacuu

SEQ ID NO: 1219898 - RNA, 18 nt, Mycobacterium bovis subsp bovis AF2122/97
cagcuggcgaaugcgggc

SEQ ID NO: 1219899 - RNA, 17 nt, Mycobacterium bovis subsp bovis AF2122/97
cagcuggggcggauaug

SEQ ID NO: 1219900 - RNA, 23 nt, Mycobacterium bovis subsp bovis AF2122/97
cagcuggucgugggccaccaccu

SEQ ID NO: 1219901 - RNA, 16 nt, Mycobacterium bovis subsp bovis AF2122/97
cagcuggugagccaga

SEQ ID NO: 1219902 - RNA, 20 nt, Mycobacterium bovis subsp bovis AF2122/97
cagcuggugcugcuuauugg

SEQ ID NO: 1219903 - RNA, 17 nt, Mycobacterium bovis subsp bovis AF2122/97
cagcuucgccagguggc

SEQ ID NO: 1219904 - RNA, 21 nt, Mycobacterium bovis subsp bovis AF2122/97
cagcuucgccagguggccgcu

SEQ ID NO: 1219905 - RNA, 18 nt, Mycobacterium bovis subsp bovis AF2122/97
caggaugccugccacccg

SEQ ID NO: 1219906 - RNA, 21 nt, Mycobacterium bovis subsp bovis AF2122/97
caggauguguugccagaucag

SEQ ID NO: 1219907 - RNA, 19 nt, Mycobacterium bovis subsp bovis AF2122/97
caggauggugcggccgcgg

SEQ ID NO: 1219908 - RNA, 17 nt, Mycobacterium bovis subsp bovis AF2122/97
caggaucgaggcgucgg

SEQ ID NO: 1219909 - RNA, 17 nt, Mycobacterium bovis subsp bovis AF2122/97
caggaucgccgcuugac

SEQ ID NO: 1219910 - RNA, 20 nt, Mycobacterium bovis subsp bovis AF2122/97
caggaucgccugagcgccgc

SEQ ID NO: 1219911 - RNA, 20 nt, Mycobacterium bovis subsp bovis AF2122/97
caggaucggcuugggaaacc

SEQ ID NO: 1219912 - RNA, 15 nt, Mycobacterium bovis subsp bovis AF2122/97
caggaucgcaaugcc

SEQ ID NO: 1219913 - RNA, 23 nt, Mycobacterium bovis subsp bovis AF2122/97
caggaucgcaaugccgugcgcca

SEQ ID NO: 1219914 - RNA, 16 nt, Mycobacterium bovis subsp bovis AF2122/97
caggaucgcggcgccg

SEQ ID NO: 1219915 - RNA, 20 nt, Mycobacterium bovis subsp bovis AF2122/97
caggaucgcggcgccgucgu

SEQ ID NO: 1219916 - RNA, 17 nt, Mycobacterium bovis subsp bovis AF2122/97
caggaucgcuacgucga

SEQ ID NO: 1219917 - RNA, 14 nt, Mycobacterium bovis subsp bovis AF2122/97
caggagugcgggca

SEQ ID NO: 1219918 - RNA, 20 nt, Mycobacterium bovis subsp bovis AF2122/97
caggaucagcgacuugcugg

SEQ ID NO: 1219919 - RNA, 21 nt, Mycobacterium bovis subsp bovis AF2122/97
caggacaauggacaccaaccc

SEQ ID NO: 1219920 - RNA, 22 nt, Mycobacterium bovis subsp bovis AF2122/97
caggaccgggaucgucaggccc

SEQ ID NO: 1219921 - RNA, 20 nt, Mycobacterium bovis subsp bovis AF2122/97
caggaccggugggucugcuc

SEQ ID NO: 1219922 - RNA, 20 nt, Mycobacterium bovis subsp bovis AF2122/97
caggagguugggaacagccu

SEQ ID NO: 1219923 - RNA, 19 nt, Mycobacterium bovis subsp bovis AF2122/97
caggcaccggaugaugugg

SEQ ID NO: 1219924 - RNA, 20 nt, Mycobacterium bovis subsp bovis AF2122/97
caggcaagccagcacugcca

SEQ ID NO: 1219925 - RNA, 22 nt, Mycobacterium bovis subsp bovis AF2122/97
caggcaaguugugagggaggcc

SEQ ID NO: 1219926 - RNA, 14 nt, Mycobacterium bovis subsp bovis AF2122/97
caggcacaacgcga

SEQ ID NO: 1219927 - RNA, 21 nt, Mycobacterium bovis subsp bovis AF2122/97
caggauucugcugaccaugac

SEQ ID NO: 1219928 - RNA, 16 nt, Mycobacterium bovis subsp bovis AF2122/97
caggauucccagucca

SEQ ID NO: 1219929 - RNA, 22 nt, Mycobacterium bovis subsp bovis AF2122/97
caggauuuucucgggguggugg

SEQ ID NO: 1219930 - RNA, 14 nt, Mycobacterium bovis subsp bovis AF2122/97
caggcaggaggcgu

SEQ ID NO: 1219931 - RNA, 17 nt, Mycobacterium bovis subsp bovis AF2122/97
caggcagguuggccacc

SEQ ID NO: 1219932 - RNA, 19 nt, Mycobacterium bovis subsp bovis AF2122/97
caggcacuccagcggcggg

SEQ ID NO: 1219933 - RNA, 20 nt, Mycobacterium bovis subsp bovis AF2122/97
caggcacguccgaucggcgc

SEQ ID NO: 1219934 - RNA, 23 nt, Mycobacterium bovis subsp bovis AF2122/97
caggccuaguccggcacugcggc

SEQ ID NO: 1219935 - RNA, 20 nt, Mycobacterium bovis subsp bovis AF2122/97
caggccuccaaaaucgcggc

SEQ ID NO: 1219936 - RNA, 15 nt, Mycobacterium bovis subsp bovis AF2122/97
caggccuccaagccc

SEQ ID NO: 1219937 - RNA, 20 nt, Mycobacterium bovis subsp bovis AF2122/97
caggccuccucuugggucca

SEQ ID NO: 1219938 - RNA, 17 nt, Mycobacterium bovis subsp bovis AF2122/97
caggccuccaagcccgc

SEQ ID NO: 1219939 - RNA, 15 nt, Mycobacterium bovis subsp bovis AF2122/97
caggccaccccgacc

SEQ ID NO: 1219940 - RNA, 17 nt, Mycobacterium bovis subsp bovis AF2122/97
caggccaccccgaccuc

SEQ ID NO: 1219941 - RNA, 20 nt, Mycobacterium bovis subsp bovis AF2122/97
caggccaccgcagacgccgu

SEQ ID NO: 1219942 - RNA, 20 nt, Mycobacterium bovis subsp bovis AF2122/97
caggcauuuucacugugccg

SEQ ID NO: 1219943 - RNA, 21 nt, Mycobacterium bovis subsp bovis AF2122/97
caggccaacuuggcggccagc

SEQ ID NO: 1219944 - RNA, 15 nt, Mycobacterium bovis subsp bovis AF2122/97
caggccaagguggcc

SEQ ID NO: 1219945 - RNA, 19 nt, Mycobacterium bovis subsp bovis AF2122/97
caggcgcucgaaggccgca

SEQ ID NO: 1219946 - RNA, 15 nt, Mycobacterium bovis subsp bovis AF2122/97
caggcgcgcaccacc

SEQ ID NO: 1219947 - RNA, 14 nt, Mycobacterium bovis subsp bovis AF2122/97
caggcgccgauguc

SEQ ID NO: 1219948 - RNA, 17 nt, Mycobacterium bovis subsp bovis AF2122/97
caggcgccacugcuucc

SEQ ID NO: 1219949 - RNA, 23 nt, Mycobacterium bovis subsp bovis AF2122/97
caggcgccacugcuuccggaaca

SEQ ID NO: 1219950 - RNA, 23 nt, Mycobacterium bovis subsp bovis AF2122/97
caggcgcauagggccaccgccgc

SEQ ID NO: 1219951 - RNA, 22 nt, Mycobacterium bovis subsp bovis AF2122/97
caggcgcauagggccaccgccg

SEQ ID NO: 1219952 - RNA, 15 nt, Mycobacterium bovis subsp bovis AF2122/97
caggcgagccggcgc

SEQ ID NO: 1219953 - RNA, 19 nt, Mycobacterium bovis subsp bovis AF2122/97
caggcgaguuaggccgcca

SEQ ID NO: 1219954 - RNA, 20 nt, Mycobacterium bovis subsp bovis AF2122/97
caggcgaguuaggccgccag

SEQ ID NO: 1219955 - RNA, 23 nt, Mycobacterium bovis subsp bovis AF2122/97
caggcgugcaucgcgauuccggc

SEQ ID NO: 1219956 - RNA, 16 nt, Mycobacterium bovis subsp bovis AF2122/97
caggcgugcacagguc

SEQ ID NO: 1219957 - RNA, 17 nt, Mycobacterium bovis subsp bovis AF2122/97
caggcggcuggcccgca

SEQ ID NO: 1219958 - RNA, 17 nt, Mycobacterium bovis subsp bovis AF2122/97
caggcggacgggacgca

SEQ ID NO: 1219959 - RNA, 22 nt, Mycobacterium bovis subsp bovis AF2122/97
caggcgcucgaaggccgcacuc

SEQ ID NO: 1219960 - RNA, 13 nt, Mycobacterium bovis subsp bovis AF2122/97
caggcggccagcg

SEQ ID NO: 1219961 - RNA, 15 nt, Mycobacterium bovis subsp bovis AF2122/97
caggcggcgaacugc

SEQ ID NO: 1219962 - RNA, 22 nt, Mycobacterium bovis subsp bovis AF2122/97
caggcggcgaacugccucagac

SEQ ID NO: 1219963 - RNA, 19 nt, Mycobacterium bovis subsp bovis AF2122/97
caggcuaguugccaacaca

SEQ ID NO: 1219964 - RNA, 22 nt, Mycobacterium bovis subsp bovis AF2122/97
caggcugaaaccuugcggcaga

SEQ ID NO: 1219965 - RNA, 16 nt, Mycobacterium bovis subsp bovis AF2122/97
caggcugaaggacggc

SEQ ID NO: 1219966 - RNA, 14 nt, Mycobacterium bovis subsp bovis AF2122/97
cagggucagcuggg

SEQ ID NO: 1219967 - RNA, 17 nt, Mycobacterium bovis subsp bovis AF2122/97
cagggucugcgccgccg

SEQ ID NO: 1219968 - RNA, 19 nt, Mycobacterium bovis subsp bovis AF2122/97
cagggucaccugcgggccc

SEQ ID NO: 1219969 - RNA, 18 nt, Mycobacterium bovis subsp bovis AF2122/97
cagggucacaaacccagc

SEQ ID NO: 1219970 - RNA, 20 nt, Mycobacterium bovis subsp bovis AF2122/97
caggguauccacgccgggca

SEQ ID NO: 1219971 - RNA, 13 nt, Mycobacterium bovis subsp bovis AF2122/97
caggggcagcgcg

SEQ ID NO: 1219972 - RNA, 15 nt, Mycobacterium bovis subsp bovis AF2122/97
caggggacccggggc

SEQ ID NO: 1219973 - RNA, 13 nt, Mycobacterium bovis subsp bovis AF2122/97
caggggacgacca

SEQ ID NO: 1219974 - RNA, 16 nt, Mycobacterium bovis subsp bovis AF2122/97
caggggacgggcggcc

SEQ ID NO: 1219975 - RNA, 17 nt, Mycobacterium bovis subsp bovis AF2122/97
cagggcuucgugcacca

SEQ ID NO: 1219976 - RNA, 20 nt, Mycobacterium bovis subsp bovis AF2122/97
cagggcgcggaucugcagca

SEQ ID NO: 1219977 - RNA, 14 nt, Mycobacterium bovis subsp bovis AF2122/97
cagggcgacggcca

SEQ ID NO: 1219978 - RNA, 20 nt, Mycobacterium bovis subsp bovis AF2122/97
cagggcgccgaucgugcccc

SEQ ID NO: 1219979 - RNA, 21 nt, Mycobacterium bovis subsp bovis AF2122/97
cagggcgcaaaccacccgcaa

SEQ ID NO: 1219980 - RNA, 11 nt, Mycobacterium bovis subsp bovis AF2122/97
cagggccuuga

SEQ ID NO: 1219981 - RNA, 18 nt, Mycobacterium bovis subsp bovis AF2122/97
cagggauuuccagcagug

SEQ ID NO: 1219982 - RNA, 22 nt, Mycobacterium bovis subsp bovis AF2122/97
cagggaucagccgugcgggccg

SEQ ID NO: 1219983 - RNA, 21 nt, Mycobacterium bovis subsp bovis AF2122/97
cagggaucgauuuggaucggc

SEQ ID NO: 1219984 - RNA, 15 nt, Mycobacterium bovis subsp bovis AF2122/97
cagggauucuggaug

SEQ ID NO: 1219985 - RNA, 17 nt, Mycobacterium bovis subsp bovis AF2122/97
cagguaagcagccagca

SEQ ID NO: 1219986 - RNA, 20 nt, Mycobacterium bovis subsp bovis AF2122/97
cagguaagcagccagcaaca

SEQ ID NO: 1219987 - RNA, 15 nt, Mycobacterium bovis subsp bovis AF2122/97
cagguaagccacaua

SEQ ID NO: 1219988 - RNA, 20 nt, Mycobacterium bovis subsp bovis AF2122/97
cagguagcggguugggaccg

SEQ ID NO: 1219989 - RNA, 14 nt, Mycobacterium bovis subsp bovis AF2122/97
cagguacucgcccc

SEQ ID NO: 1219990 - RNA, 23 nt, Mycobacterium bovis subsp bovis AF2122/97
cagggugcgcuugcggccgcgcg

SEQ ID NO: 1219991 - RNA, 15 nt, Mycobacterium bovis subsp bovis AF2122/97
cagggugucugugau

SEQ ID NO: 1219992 - RNA, 14 nt, Mycobacterium bovis subsp bovis AF2122/97
cagggugccgucgg

SEQ ID NO: 1219993 - RNA, 20 nt, Mycobacterium bovis subsp bovis AF2122/97
cagggugcgccgcagcaggu

SEQ ID NO: 1219994 - RNA, 14 nt, Mycobacterium bovis subsp bovis AF2122/97
cagggugcgccggu

SEQ ID NO: 1219995 - RNA, 18 nt, Mycobacterium bovis subsp bovis AF2122/97
cagggugucgaagagcag

SEQ ID NO: 1219996 - RNA, 19 nt, Mycobacterium bovis subsp bovis AF2122/97
cagggugugcgucugcggc

SEQ ID NO: 1219997 - RNA, 18 nt, Mycobacterium bovis subsp bovis AF2122/97
caggguguuuauggcccu

SEQ ID NO: 1219998 - RNA, 21 nt, Mycobacterium bovis subsp bovis AF2122/97
caggguguuuauggcccuggg

SEQ ID NO: 1219999 - RNA, 17 nt, Mycobacterium bovis subsp bovis AF2122/97
caggguugccaucaagg

SEQ ID NO: 1220000 - RNA, 15 nt, Mycobacterium bovis subsp bovis AF2122/97
caggguuggcaccgu

SEQ ID NO: 1220001 - RNA, 14 nt, Mycobacterium bovis subsp bovis AF2122/97
cagccggcuugggc

SEQ ID NO: 1220002 - RNA, 22 nt, Mycobacterium bovis subsp bovis AF2122/97
cagccgcuccacguacgcggcu

SEQ ID NO: 1220003 - RNA, 12 nt, Mycobacterium bovis subsp bovis AF2122/97
cagccgcugauc

SEQ ID NO: 1220004 - RNA, 21 nt, Mycobacterium bovis subsp bovis AF2122/97
cagccgcugaucugccgccgc

SEQ ID NO: 1220005 - RNA, 20 nt, Mycobacterium bovis subsp bovis AF2122/97
cagccgcggcggcagcaccc

SEQ ID NO: 1220006 - RNA, 14 nt, Mycobacterium bovis subsp bovis AF2122/97
cagccgcgggccgc

SEQ ID NO: 1220007 - RNA, 15 nt, Mycobacterium bovis subsp bovis AF2122/97
cagcccggcgcgccg

SEQ ID NO: 1220008 - RNA, 17 nt, Mycobacterium bovis subsp bovis AF2122/97
cagcccgggcagcacca

SEQ ID NO: 1220009 - RNA, 14 nt, Mycobacterium bovis subsp bovis AF2122/97
cagcccgggcagcc

SEQ ID NO: 1220010 - RNA, 18 nt, Mycobacterium bovis subsp bovis AF2122/97
cagcccgggcagccccuc

SEQ ID NO: 1220011 - RNA, 17 nt, Mycobacterium bovis subsp bovis AF2122/97
cagcccggugugcugca

SEQ ID NO: 1220012 - RNA, 22 nt, Mycobacterium bovis subsp bovis AF2122/97
cagccgcgccgcggcccgcucc

SEQ ID NO: 1220013 - RNA, 13 nt, Mycobacterium bovis subsp bovis AF2122/97
cagccgcgccggg

SEQ ID NO: 1220014 - RNA, 22 nt, Mycobacterium bovis subsp bovis AF2122/97
cagcccguccaggcgcugcagc

SEQ ID NO: 1220015 - RNA, 15 nt, Mycobacterium bovis subsp bovis AF2122/97
cagccgcgccgcggc

SEQ ID NO: 1220016 - RNA, 15 nt, Mycobacterium bovis subsp bovis AF2122/97
cagcccggugauggu

SEQ ID NO: 1220017 - RNA, 20 nt, Mycobacterium bovis subsp bovis AF2122/97
cagcccgggcagccccuccg

SEQ ID NO: 1220018 - RNA, 18 nt, Mycobacterium bovis subsp bovis AF2122/97
cagcccggucauggucag

SEQ ID NO: 1220019 - RNA, 16 nt, Mycobacterium bovis subsp bovis AF2122/97
cagcccguccggcccc

SEQ ID NO: 1220020 - RNA, 22 nt, Mycobacterium bovis subsp bovis AF2122/97
cagccggcggagaaggcgacca

SEQ ID NO: 1220021 - RNA, 14 nt, Mycobacterium bovis subsp bovis AF2122/97
cagccgggcacccu

SEQ ID NO: 1220022 - RNA, 14 nt, Mycobacterium bovis subsp bovis AF2122/97
cagccgguccagac

SEQ ID NO: 1220023 - RNA, 17 nt, Mycobacterium bovis subsp bovis AF2122/97
cagccggugcgcugguu

SEQ ID NO: 1220024 - RNA, 23 nt, Mycobacterium bovis subsp bovis AF2122/97
cagccguagcugggcaccccguu

SEQ ID NO: 1220025 - RNA, 17 nt, Mycobacterium bovis subsp bovis AF2122/97
cagccgucaccgcgacc

SEQ ID NO: 1220026 - RNA, 12 nt, Mycobacterium bovis subsp bovis AF2122/97
cagccguccggg

SEQ ID NO: 1220027 - RNA, 21 nt, Mycobacterium bovis subsp bovis AF2122/97
cagccgucguccgcugacccg

SEQ ID NO: 1220028 - RNA, 19 nt, Mycobacterium bovis subsp bovis AF2122/97
cagccgugcccaggccacc

SEQ ID NO: 1220029 - RNA, 20 nt, Mycobacterium bovis subsp bovis AF2122/97
cagccgugcccaggccaccg

SEQ ID NO: 1220030 - RNA, 24 nt, Mycobacterium bovis subsp bovis AF2122/97
cagccgugcccaggccaccggcug

SEQ ID NO: 1220031 - RNA, 16 nt, Mycobacterium bovis subsp bovis AF2122/97
cagccguggcggcggg

SEQ ID NO: 1220032 - RNA, 22 nt, Mycobacterium bovis subsp bovis AF2122/97
cagccguucccggugaccacuu

SEQ ID NO: 1220033 - RNA, 13 nt, Mycobacterium bovis subsp bovis AF2122/97
cagccguucucgc

SEQ ID NO: 1220034 - RNA, 19 nt, Mycobacterium bovis subsp bovis AF2122/97
cagcgagcauaccgccgcu

SEQ ID NO: 1220035 - RNA, 19 nt, Mycobacterium bovis subsp bovis AF2122/97
cagcgagaucagcaugccc

SEQ ID NO: 1220036 - RNA, 18 nt, Mycobacterium bovis subsp bovis AF2122/97
cagcgacgcuaggacggc

SEQ ID NO: 1220037 - RNA, 17 nt, Mycobacterium bovis subsp bovis AF2122/97
cagcgacgcggccagcg

SEQ ID NO: 1220038 - RNA, 19 nt, Mycobacterium bovis subsp bovis AF2122/97
cagcgaccaccgucacgau

SEQ ID NO: 1220039 - RNA, 20 nt, Mycobacterium bovis subsp bovis AF2122/97
cagcgaccaggucgccagcu

SEQ ID NO: 1220040 - RNA, 22 nt, Mycobacterium bovis subsp bovis AF2122/97
cagcgacgaagucgcagcugcc

SEQ ID NO: 1220041 - RNA, 18 nt, Mycobacterium bovis subsp bovis AF2122/97
cagccuuaugcagugaca

SEQ ID NO: 1220042 - RNA, 21 nt, Mycobacterium bovis subsp bovis AF2122/97
cagccuuggacgugcgcgcca

SEQ ID NO: 1220043 - RNA, 16 nt, Mycobacterium bovis subsp bovis AF2122/97
cagcgacagcgugccg

SEQ ID NO: 1220044 - RNA, 19 nt, Mycobacterium bovis subsp bovis AF2122/97
cagcgauggguguugcugg

SEQ ID NO: 1220045 - RNA, 16 nt, Mycobacterium bovis subsp bovis AF2122/97
cagcgaugcucacuac

SEQ ID NO: 1220046 - RNA, 14 nt, Mycobacterium bovis subsp bovis AF2122/97
cagcgaugacgacc

SEQ ID NO: 1220047 - RNA, 15 nt, Mycobacterium bovis subsp bovis AF2122/97
cagcgaugacgacca

SEQ ID NO: 1220048 - RNA, 18 nt, Mycobacterium bovis subsp bovis AF2122/97
cagcgaugcgcucacugc

SEQ ID NO: 1220049 - RNA, 20 nt, Mycobacterium bovis subsp bovis AF2122/97
cagcgaugcgcucacugcag

SEQ ID NO: 1220050 - RNA, 18 nt, Mycobacterium bovis subsp bovis AF2122/97
cagcgaugcggcccucga

SEQ ID NO: 1220051 - RNA, 14 nt, Mycobacterium bovis subsp bovis AF2122/97
cagcgaugcggcgu

SEQ ID NO: 1220052 - RNA, 15 nt, Mycobacterium bovis subsp bovis AF2122/97
cagcgcagccgaucg

SEQ ID NO: 1220053 - RNA, 23 nt, Mycobacterium bovis subsp bovis AF2122/97
cagcgagucgggguacaggcugc

SEQ ID NO: 1220054 - RNA, 16 nt, Mycobacterium bovis subsp bovis AF2122/97
cagcgaggccagcggu

SEQ ID NO: 1220055 - RNA, 14 nt, Mycobacterium bovis subsp bovis AF2122/97
cagcgaggccaugu

SEQ ID NO: 1220056 - RNA, 11 nt, Mycobacterium bovis subsp bovis AF2122/97
cagccagcaag

SEQ ID NO: 1220057 - RNA, 18 nt, Mycobacterium bovis subsp bovis AF2122/97
cagccagaucuccccgac

SEQ ID NO: 1220058 - RNA, 15 nt, Mycobacterium bovis subsp bovis AF2122/97
cagccagaccaacau

SEQ ID NO: 1220059 - RNA, 19 nt, Mycobacterium bovis subsp bovis AF2122/97
cagccaguaaaaaggcagg

SEQ ID NO: 1220060 - RNA, 19 nt, Mycobacterium bovis subsp bovis AF2122/97
cagccaguugaucaggccg

SEQ ID NO: 1220061 - RNA, 17 nt, Mycobacterium bovis subsp bovis AF2122/97
cagccaguccagcgcgc

SEQ ID NO: 1220062 - RNA, 14 nt, Mycobacterium bovis subsp bovis AF2122/97
cagcagcccgggca

SEQ ID NO: 1220063 - RNA, 16 nt, Mycobacterium bovis subsp bovis AF2122/97
cagcagcccgggcagc

SEQ ID NO: 1220064 - RNA, 18 nt, Mycobacterium bovis subsp bovis AF2122/97
cagcagcccgguggugcu

SEQ ID NO: 1220065 - RNA, 20 nt, Mycobacterium bovis subsp bovis AF2122/97
cagcagcgacgcugccgcca

SEQ ID NO: 1220066 - RNA, 17 nt, Mycobacterium bovis subsp bovis AF2122/97
cagcagcgacuccagcg

SEQ ID NO: 1220067 - RNA, 16 nt, Mycobacterium bovis subsp bovis AF2122/97
cagcagcgacuccagc

SEQ ID NO: 1220068 - RNA, 22 nt, Mycobacterium bovis subsp bovis AF2122/97
cagcagcgagucgaaugucccg

SEQ ID NO: 1220069 - RNA, 18 nt, Mycobacterium bovis subsp bovis AF2122/97
cagcagcgcaacggccag

SEQ ID NO: 1220070 - RNA, 21 nt, Mycobacterium bovis subsp bovis AF2122/97
cagccacucgccacucagccc

SEQ ID NO: 1220071 - RNA, 15 nt, Mycobacterium bovis subsp bovis AF2122/97
cagccaaaucagcca

SEQ ID NO: 1220072 - RNA, 17 nt, Mycobacterium bovis subsp bovis AF2122/97
cagccaaaucagccagg

SEQ ID NO: 1220073 - RNA, 19 nt, Mycobacterium bovis subsp bovis AF2122/97
cagccaacgucaccaaguu

SEQ ID NO: 1220074 - RNA, 21 nt, Mycobacterium bovis subsp bovis AF2122/97
cagccaacucaggccgguacc

SEQ ID NO: 1220075 - RNA, 20 nt, Mycobacterium bovis subsp bovis AF2122/97
cagccccccggcgacggcgu

SEQ ID NO: 1220076 - RNA, 22 nt, Mycobacterium bovis subsp bovis AF2122/97
cagccccgcgcccaccccggcc

SEQ ID NO: 1220077 - RNA, 17 nt, Mycobacterium bovis subsp bovis AF2122/97
cagccccgacugcgccc

SEQ ID NO: 1220078 - RNA, 15 nt, Mycobacterium bovis subsp bovis AF2122/97
cagccccgcgcccac

SEQ ID NO: 1220079 - RNA, 21 nt, Mycobacterium bovis subsp bovis AF2122/97
cagcccgaugaucccgccacc

SEQ ID NO: 1220080 - RNA, 22 nt, Mycobacterium bovis subsp bovis AF2122/97
cagcccgaugaucccgccaccg

SEQ ID NO: 1220081 - RNA, 12 nt, Mycobacterium bovis subsp bovis AF2122/97
cagcccgaugcc

SEQ ID NO: 1220082 - RNA, 16 nt, Mycobacterium bovis subsp bovis AF2122/97
cagcccgcccaaugcg

SEQ ID NO: 1220083 - RNA, 17 nt, Mycobacterium bovis subsp bovis AF2122/97
cagcccgcccggugugu

SEQ ID NO: 1220084 - RNA, 16 nt, Mycobacterium bovis subsp bovis AF2122/97
cagcccgccgcugaac

SEQ ID NO: 1220085 - RNA, 14 nt, Mycobacterium bovis subsp bovis AF2122/97
cagcccgccggcgu

SEQ ID NO: 1220086 - RNA, 15 nt, Mycobacterium bovis subsp bovis AF2122/97
cagcccgccggaccc

SEQ ID NO: 1220087 - RNA, 16 nt, Mycobacterium bovis subsp bovis AF2122/97
cagcccgcgcagcggu

SEQ ID NO: 1220088 - RNA, 14 nt, Mycobacterium bovis subsp bovis AF2122/97
cagcccggccagcc

SEQ ID NO: 1220089 - RNA, 23 nt, Mycobacterium bovis subsp bovis AF2122/97
cagcccggacguaggcaccccgg

SEQ ID NO: 1220090 - RNA, 15 nt, Mycobacterium bovis subsp bovis AF2122/97
cagccccacccgccg

SEQ ID NO: 1220091 - RNA, 15 nt, Mycobacterium bovis subsp bovis AF2122/97
cagcccaugcccggc

SEQ ID NO: 1220092 - RNA, 13 nt, Mycobacterium bovis subsp bovis AF2122/97
cagcccagccggg

SEQ ID NO: 1220093 - RNA, 17 nt, Mycobacterium bovis subsp bovis AF2122/97
cagcccaggccuuagau

SEQ ID NO: 1220094 - RNA, 19 nt, Mycobacterium bovis subsp bovis AF2122/97
cagcccaccggugccgccc

SEQ ID NO: 1220095 - RNA, 21 nt, Mycobacterium bovis subsp bovis AF2122/97
cagcccaccggugccgcccgc

SEQ ID NO: 1220096 - RNA, 17 nt, Mycobacterium bovis subsp bovis AF2122/97
cagcccacaggcggcgc

SEQ ID NO: 1220097 - RNA, 21 nt, Mycobacterium bovis subsp bovis AF2122/97
cagcccacaggcggcgcugca

SEQ ID NO: 1220098 - RNA, 20 nt, Mycobacterium bovis subsp bovis AF2122/97
cagcgcuuugaugccgaugu

SEQ ID NO: 1220099 - RNA, 13 nt, Mycobacterium bovis subsp bovis AF2122/97
cagcgcguggaac

SEQ ID NO: 1220100 - RNA, 22 nt, Mycobacterium bovis subsp bovis AF2122/97
cagcgcggccuuggugggcaga

SEQ ID NO: 1220101 - RNA, 14 nt, Mycobacterium bovis subsp bovis AF2122/97
cagcgcguggaacu

SEQ ID NO: 1220102 - RNA, 20 nt, Mycobacterium bovis subsp bovis AF2122/97
cagcgcgucgccgaaagccu

SEQ ID NO: 1220103 - RNA, 12 nt, Mycobacterium bovis subsp bovis AF2122/97
cagcgcggcgcg

SEQ ID NO: 1220104 - RNA, 19 nt, Mycobacterium bovis subsp bovis AF2122/97
cagcgcggccgggcgcccu

SEQ ID NO: 1220105 - RNA, 18 nt, Mycobacterium bovis subsp bovis AF2122/97
cagcgcggcgcacaaccc

SEQ ID NO: 1220106 - RNA, 15 nt, Mycobacterium bovis subsp bovis AF2122/97
cagcgcaucgccgcu

SEQ ID NO: 1220107 - RNA, 20 nt, Mycobacterium bovis subsp bovis AF2122/97
cagcgcaagguugccaacgc

SEQ ID NO: 1220108 - RNA, 22 nt, Mycobacterium bovis subsp bovis AF2122/97
cagcgcaggauucugcugacca

SEQ ID NO: 1220109 - RNA, 13 nt, Mycobacterium bovis subsp bovis AF2122/97
cagcgcagugccu

SEQ ID NO: 1220110 - RNA, 16 nt, Mycobacterium bovis subsp bovis AF2122/97
cagcgcauccacaauc

SEQ ID NO: 1220111 - RNA, 16 nt, Mycobacterium bovis subsp bovis AF2122/97
cagcgccugcggcagc

SEQ ID NO: 1220112 - RNA, 15 nt, Mycobacterium bovis subsp bovis AF2122/97
cagcgccugcgcgca

SEQ ID NO: 1220113 - RNA, 17 nt, Mycobacterium bovis subsp bovis AF2122/97
cagcgccugcgcccagc

SEQ ID NO: 1220114 - RNA, 18 nt, Mycobacterium bovis subsp bovis AF2122/97
cagcgcauuuuccacauc

SEQ ID NO: 1220115 - RNA, 23 nt, Mycobacterium bovis subsp bovis AF2122/97
cagcgcggccauuagcagcaccc

SEQ ID NO: 1220116 - RNA, 16 nt, Mycobacterium bovis subsp bovis AF2122/97
cagcgcggccagugcu

SEQ ID NO: 1220117 - RNA, 14 nt, Mycobacterium bovis subsp bovis AF2122/97
cagcgcggccaccc

SEQ ID NO: 1220118 - RNA, 22 nt, Mycobacterium bovis subsp bovis AF2122/97
cagcgcggccaauugcgccgcc

SEQ ID NO: 1220119 - RNA, 19 nt, Mycobacterium bovis subsp bovis AF2122/97
cagcgcggcacccaaccag

SEQ ID NO: 1220120 - RNA, 19 nt, Mycobacterium bovis subsp bovis AF2122/97
cagcgccuuguggcacacc

SEQ ID NO: 1220121 - RNA, 21 nt, Mycobacterium bovis subsp bovis AF2122/97
cagcgccuuguggcacacccg

SEQ ID NO: 1220122 - RNA, 17 nt, Mycobacterium bovis subsp bovis AF2122/97
cagcggcacgaucggca

SEQ ID NO: 1220123 - RNA, 13 nt, Mycobacterium bovis subsp bovis AF2122/97
cagcggcagcacc

SEQ ID NO: 1220124 - RNA, 23 nt, Mycobacterium bovis subsp bovis AF2122/97
cagcggcaauggccagcaccacg

SEQ ID NO: 1220125 - RNA, 20 nt, Mycobacterium bovis subsp bovis AF2122/97
cagcggcacacccaucaccg

SEQ ID NO: 1220126 - RNA, 21 nt, Mycobacterium bovis subsp bovis AF2122/97
cagcggcaaggucggacuggc

SEQ ID NO: 1220127 - RNA, 22 nt, Mycobacterium bovis subsp bovis AF2122/97
cagcggcaucgcgggcggcgcu

SEQ ID NO: 1220128 - RNA, 19 nt, Mycobacterium bovis subsp bovis AF2122/97
cagcggcaucgcgggcggc

SEQ ID NO: 1220129 - RNA, 20 nt, Mycobacterium bovis subsp bovis AF2122/97
cagcggcaucgcgggcggcg

SEQ ID NO: 1220130 - RNA, 15 nt, Mycobacterium bovis subsp bovis AF2122/97
cagcggcauugccag

SEQ ID NO: 1220131 - RNA, 15 nt, Mycobacterium bovis subsp bovis AF2122/97
cagcggcaucggcca

SEQ ID NO: 1220132 - RNA, 22 nt, Mycobacterium bovis subsp bovis AF2122/97
cagcggcaguuccugacgccau

SEQ ID NO: 1220133 - RNA, 19 nt, Mycobacterium bovis subsp bovis AF2122/97
cagcggccagcagugcggu

SEQ ID NO: 1220134 - RNA, 17 nt, Mycobacterium bovis subsp bovis AF2122/97
cagcggcgccgccugga

SEQ ID NO: 1220135 - RNA, 15 nt, Mycobacterium bovis subsp bovis AF2122/97
cagcggcuugcccag

SEQ ID NO: 1220136 - RNA, 17 nt, Mycobacterium bovis subsp bovis AF2122/97
cagcggcuugcccaggc

SEQ ID NO: 1220137 - RNA, 21 nt, Mycobacterium bovis subsp bovis AF2122/97
cagcggcuugcccaggcgcaa

SEQ ID NO: 1220138 - RNA, 22 nt, Mycobacterium bovis subsp bovis AF2122/97
cagcggccgguacacguccagu

SEQ ID NO: 1220139 - RNA, 23 nt, Mycobacterium bovis subsp bovis AF2122/97
cagcggcgaagucuuucuccccc

SEQ ID NO: 1220140 - RNA, 15 nt, Mycobacterium bovis subsp bovis AF2122/97
cagcggcgccgccaa

SEQ ID NO: 1220141 - RNA, 18 nt, Mycobacterium bovis subsp bovis AF2122/97
cagcggcgcgaccgucug

SEQ ID NO: 1220142 - RNA, 12 nt, Mycobacterium bovis subsp bovis AF2122/97
cagcgggccgcc

SEQ ID NO: 1220143 - RNA, 12 nt, Mycobacterium bovis subsp bovis AF2122/97
cagcggcgcgcu

SEQ ID NO: 1220144 - RNA, 13 nt, Mycobacterium bovis subsp bovis AF2122/97
cagcgggcgcgcu

SEQ ID NO: 1220145 - RNA, 14 nt, Mycobacterium bovis subsp bovis AF2122/97
cagcgggcugcgcu

SEQ ID NO: 1220146 - RNA, 17 nt, Mycobacterium bovis subsp bovis AF2122/97
cagcgggucgaccccgg

SEQ ID NO: 1220147 - RNA, 21 nt, Mycobacterium bovis subsp bovis AF2122/97
cagcgggugaaucgacaccgc

SEQ ID NO: 1220148 - RNA, 17 nt, Mycobacterium bovis subsp bovis AF2122/97
cagcggguuugccgggc

SEQ ID NO: 1220149 - RNA, 24 nt, Mycobacterium bovis subsp bovis AF2122/97
cagcgguaucccccagccgcggcg

SEQ ID NO: 1220150 - RNA, 17 nt, Mycobacterium bovis subsp bovis AF2122/97
cagcggucagccggcca

SEQ ID NO: 1220151 - RNA, 14 nt, Mycobacterium bovis subsp bovis AF2122/97
cagcgguccgccgc

SEQ ID NO: 1220152 - RNA, 17 nt, Mycobacterium bovis subsp bovis AF2122/97
cagcgguggcaagccua

SEQ ID NO: 1220153 - RNA, 15 nt, Mycobacterium bovis subsp bovis AF2122/97
cagcgucaccucacc

SEQ ID NO: 1220154 - RNA, 15 nt, Mycobacterium bovis subsp bovis AF2122/97
cagcgugcgcuggcu

SEQ ID NO: 1220155 - RNA, 18 nt, Mycobacterium bovis subsp bovis AF2122/97
cagcguggacgcccgccc

SEQ ID NO: 1220156 - RNA, 19 nt, Mycobacterium bovis subsp bovis AF2122/97
cagcgugcgaugcagcgcg

SEQ ID NO: 1220157 - RNA, 22 nt, Mycobacterium bovis subsp bovis AF2122/97
cagcguggcgcccgugccgccc

SEQ ID NO: 1220158 - RNA, 14 nt, Mycobacterium bovis subsp bovis AF2122/97
cagcguggugaucc

SEQ ID NO: 1220159 - RNA, 18 nt, Mycobacterium bovis subsp bovis AF2122/97
cagcguggggccgccacc

SEQ ID NO: 1220160 - RNA, 19 nt, Mycobacterium bovis subsp bovis AF2122/97
cagcguuaggucgccggcu

SEQ ID NO: 1220161 - RNA, 19 nt, Mycobacterium bovis subsp bovis AF2122/97
cagcguggggccgccacca

SEQ ID NO: 1220162 - RNA, 15 nt, Mycobacterium bovis subsp bovis AF2122/97
cagcguugucgggug

SEQ ID NO: 1220163 - RNA, 19 nt, Mycobacterium bovis subsp bovis AF2122/97
cagcguccgucgucggcgu

SEQ ID NO: 1220164 - RNA, 21 nt, Mycobacterium bovis subsp bovis AF2122/97
cagcguccuggcguagugcag

SEQ ID NO: 1220165 - RNA, 18 nt, Mycobacterium bovis subsp bovis AF2122/97
cagcguccgaaccaccug

SEQ ID NO: 1220166 - RNA, 16 nt, Mycobacterium bovis subsp bovis AF2122/97
cagcguccagccgccc

SEQ ID NO: 1220167 - RNA, 21 nt, Mycobacterium bovis subsp bovis AF2122/97
cagcguccagccgcccucggg

SEQ ID NO: 1220168 - RNA, 16 nt, Mycobacterium bovis subsp bovis AF2122/97
cagcgucgcggccacg

SEQ ID NO: 1220169 - RNA, 23 nt, Mycobacterium bovis subsp bovis AF2122/97
cagcgucgcggccacggucagcc

SEQ ID NO: 1220170 - RNA, 17 nt, Mycobacterium bovis subsp bovis AF2122/97
cagcgucgacgucagca

SEQ ID NO: 1220171 - RNA, 13 nt, Mycobacterium bovis subsp bovis AF2122/97
cagcgucaggugc

SEQ ID NO: 1220172 - RNA, 20 nt, Mycobacterium bovis subsp bovis AF2122/97
cagcgucaggugcgcgacca

SEQ ID NO: 1220173 - RNA, 21 nt, Mycobacterium bovis subsp bovis AF2122/97
cagcgucagcuguuugccggc

SEQ ID NO: 1220174 - RNA, 19 nt, Mycobacterium bovis subsp bovis AF2122/97
cagcguccaaaccuucaac

SEQ ID NO: 1220175 - RNA, 13 nt, Mycobacterium bovis subsp bovis AF2122/97
cagcguccaaccc

SEQ ID NO: 1220176 - RNA, 17 nt, Mycobacterium bovis subsp bovis AF2122/97
cagcguccagccgcccu

SEQ ID NO: 1220177 - RNA, 16 nt, Mycobacterium bovis subsp bovis AF2122/97
cagcgucauccucguc

SEQ ID NO: 1220178 - RNA, 20 nt, Mycobacterium bovis subsp bovis AF2122/97
cagcgucuucagguccaccg

SEQ ID NO: 1220179 - RNA, 16 nt, Mycobacterium bovis subsp bovis AF2122/97
cagcgugaucuggcca

SEQ ID NO: 1220180 - RNA, 15 nt, Mycobacterium bovis subsp bovis AF2122/97
cagcgugaucuggcc

SEQ ID NO: 1220181 - RNA, 15 nt, Mycobacterium bovis subsp bovis AF2122/97
cagcgugcccaguac

SEQ ID NO: 1220182 - RNA, 15 nt, Mycobacterium bovis subsp bovis AF2122/97
cagcgugagugcagc

SEQ ID NO: 1220183 - RNA, 16 nt, Mycobacterium bovis subsp bovis AF2122/97
cagcgucucucgcagc

SEQ ID NO: 1220184 - RNA, 19 nt, Mycobacterium bovis subsp bovis AF2122/97
cagcgucucaaggccuuuc

SEQ ID NO: 1220185 - RNA, 18 nt, Mycobacterium bovis subsp bovis AF2122/97
cagcgucguaaccgucgc

SEQ ID NO: 1220186 - RNA, 14 nt, Human
uauaacucaucaua

SEQ ID NO: 1220187 - RNA, 17 nt, Human
guuuccuagcgcagcca

SEQ ID NO: 1220188 - RNA, 17 nt, Human
guuccugagaccagcca

SEQ ID NO: 1220189 - RNA, 14 nt, Human
gcucaacauaacau

SEQ ID NO: 1220190 - RNA, 14 nt, Human
gccgcuccugucug

SEQ ID NO: 1220191 - RNA, 19 nt, Human
gccuagcccacuggcuccc

SEQ ID NO: 1220192 - RNA, 13 nt, Human
uggagacaccacc

SEQ ID NO: 1220193 - RNA, 15 nt, Human
uggcgcgcgccacca

SEQ ID NO: 1220194 - RNA, 16 nt, Human
uggagacaccaccacc

SEQ ID NO: 1220195 - RNA, 16 nt, Human
ugcuacaaaaacacag

SEQ ID NO: 1220196 - RNA, 12 nt, Human
ugccagccagca

SEQ ID NO: 1220197 - RNA, 17 nt, Human
ucagaucauuucaaaac

SEQ ID NO: 1220198 - RNA, 22 nt, Human
uccaaagcugaauacauucugc

SEQ ID NO: 1220199 - RNA, 17 nt, Human
ugaggcagacagcagcu

SEQ ID NO: 1220200 - RNA, 15 nt, Human
ugagcucgguggacc

SEQ ID NO: 1220201 - RNA, 20 nt, Human
gacuauucccuucuaaccug

SEQ ID NO: 1220202 - RNA, 21 nt, Human
gacccacuucacacacaggca

SEQ ID NO: 1220203 - RNA, 17 nt, Human
gacagcagcucaggcac

SEQ ID NO: 1220204 - RNA, 15 nt, Human
cuuggacucauuuua

SEQ ID NO: 1220205 - RNA, 23 nt, Human
cugucccagcgagggacaccgag

SEQ ID NO: 1220206 - RNA, 19 nt, Human
cugucccugcagacaugag

SEQ ID NO: 1220207 - RNA, 15 nt, Human
cugugaaauaguuca

SEQ ID NO: 1220208 - RNA, 15 nt, Human
cuguuaaaagaugaa

SEQ ID NO: 1220209 - RNA, 15 nt, Human
cuucacacacaggca

SEQ ID NO: 1220210 - RNA, 17 nt, Human
cuuccauuuggaaucau

SEQ ID NO: 1220211 - RNA, 18 nt, Human
cugcacugucaagaugau

SEQ ID NO: 1220212 - RNA, 21 nt, Human
cuggcucccuggaagagauca

SEQ ID NO: 1220213 - RNA, 16 nt, Human
cuggauuugcaacccc

SEQ ID NO: 1220214 - RNA, 20 nt, Human
gaugacaugucccuacaccc

SEQ ID NO: 1220215 - RNA, 23 nt, Human
gauggguuugacaagguucuucc

SEQ ID NO: 1220216 - RNA, 14 nt, Human
gagacagcaggucu

SEQ ID NO: 1220217 - RNA, 18 nt, Human
gacuguggcugcuagcac

SEQ ID NO: 1220218 - RNA, 22 nt, Human
gagccaaggguucagagacuca

SEQ ID NO: 1220219 - RNA, 16 nt, Human
gagccaccaaacccgg

SEQ ID NO: 1220220 - RNA, 20 nt, Human
gagcuugaaauagugucuga

SEQ ID NO: 1220221 - RNA, 22 nt, Human
gaggcagacagcagcucaggca

SEQ ID NO: 1220222 - RNA, 12 nt, Human
gccagacaugug

SEQ ID NO: 1220223 - RNA, 13 nt, Human
gccaugcuggcca

SEQ ID NO: 1220224 - RNA, 14 nt, Human
gcaggcagcaggau

SEQ ID NO: 1220225 - RNA, 16 nt, Human
gcaucucugaacauuu

SEQ ID NO: 1220226 - RNA, 12 nt, Human
gcagaacagccg

SEQ ID NO: 1220227 - RNA, 13 nt, Human
gcagaacagccgc

SEQ ID NO: 1220228 - RNA, 21 nt, Human
gcaacugaggcagacagcagc

SEQ ID NO: 1220229 - RNA, 19 nt, Human
gcaaaugagccggagcccc

SEQ ID NO: 1220230 - RNA, 17 nt, Human
cucagggccccagcacu

SEQ ID NO: 1220231 - RNA, 13 nt, Human
cuauauuaucaug

SEQ ID NO: 1220232 - RNA, 17 nt, Human
cucagaaacaucaguua

SEQ ID NO: 1220233 - RNA, 18 nt, Human
cucaaaauaccaugccau

SEQ ID NO: 1220234 - RNA, 18 nt, Human
cucaacuuugacaaccau

SEQ ID NO: 1220235 - RNA, 17 nt, Human
cuccugucugccagcca

SEQ ID NO: 1220236 - RNA, 11 nt, Human
cucgaaucacu

SEQ ID NO: 1220237 - RNA, 17 nt, Human
cugaggcagacagcagc

SEQ ID NO: 1220238 - RNA, 20 nt, Human
cugaggcagacagcagcuca

SEQ ID NO: 1220239 - RNA, 16 nt, Human
cugauuuuccuggaca

SEQ ID NO: 1220240 - RNA, 16 nt, Human
cuacucuguuccuuca

SEQ ID NO: 1220241 - RNA, 11 nt, Human
cgggaguggcg

SEQ ID NO: 1220242 - RNA, 14 nt, Human
cgugagccaccaaa

SEQ ID NO: 1220243 - RNA, 11 nt, Human
cggagauaucc

SEQ ID NO: 1220244 - RNA, 21 nt, Human
cggagccccuugggcagguca

SEQ ID NO: 1220245 - RNA, 20 nt, Human
ccugcuggauguggaggggg

SEQ ID NO: 1220246 - RNA, 16 nt, Human
ccuaaguuucaguuga

SEQ ID NO: 1220247 - RNA, 23 nt, Human
aacgaguaauuuauuguuuuucc

SEQ ID NO: 1220248 - RNA, 13 nt, Human
aacugcuggauuc

SEQ ID NO: 1220249 - RNA, 16 nt, Human
aacuggaaauaaaaga

SEQ ID NO: 1220250 - RNA, 19 nt, Human
aaauggagacaccaccacc

SEQ ID NO: 1220251 - RNA, 17 nt, Human
aaauggauaugacacau

SEQ ID NO: 1220252 - RNA, 20 nt, Human
aagguaaaauugaaaggcau

SEQ ID NO: 1220253 - RNA, 12 nt, Human
guuuuucacauu

SEQ ID NO: 1220254 - RNA, 19 nt, Human
guccagggcccugagcucg

SEQ ID NO: 1220255 - RNA, 17 nt, Human
gucucccaaagugcugg

SEQ ID NO: 1220256 - RNA, 15 nt, Human
ggauguggagggggc

SEQ ID NO: 1220257 - RNA, 13 nt, Human
ggauuugcaaccc

SEQ ID NO: 1220258 - RNA, 18 nt, Human
ggacccagggaugacaug

SEQ ID NO: 1220259 - RNA, 14 nt, Human
ggaccugacuauug

SEQ ID NO: 1220260 - RNA, 15 nt, Human
uaugacgugacuggc

SEQ ID NO: 1220261 - RNA, 22 nt, Human
uaugacgugacuggccugcugg

SEQ ID NO: 1220262 - RNA, 16 nt, Human
uaugagaaucagauca

SEQ ID NO: 1220263 - RNA, 20 nt, Human
uaaagcaguggacaccagga

SEQ ID NO: 1220264 - RNA, 14 nt, Human
uagggaccugcugu

SEQ ID NO: 1220265 - RNA, 23 nt, Human
uaggugcuacaaaaacacagcaa

SEQ ID NO: 1220266 - RNA, 23 nt, Human
ugcuggauucaagugauccgccc

SEQ ID NO: 1220267 - RNA, 22 nt, Human
uguagcauuacagugggugccc

SEQ ID NO: 1220268 - RNA, 17 nt, Human
gacagcuucucauccug

SEQ ID NO: 1220269 - RNA, 19 nt, Human
gacacaggcuccaaacugg

SEQ ID NO: 1220270 - RNA, 17 nt, Human
gauagcagggcauggcu

SEQ ID NO: 1220271 - RNA, 17 nt, Human
gcccgucuucagccuag

SEQ ID NO: 1220272 - RNA, 20 nt, Human
gcccagggcucagccuggug

SEQ ID NO: 1220273 - RNA, 18 nt, Human
gccaugcuggccaggcug

SEQ ID NO: 1220274 - RNA, 21 nt, Human
gcccacaccagggccuggcug

SEQ ID NO: 1220275 - RNA, 12 nt, Human
gcuuagaccuca

SEQ ID NO: 1220276 - RNA, 13 nt, Human
gcuguauucuucu

SEQ ID NO: 1220277 - RNA, 19 nt, Human
gcuggagugcaguggcgca

SEQ ID NO: 1220278 - RNA, 13 nt, Human
gccggagccccuu

SEQ ID NO: 1220279 - RNA, 19 nt, Human
gaauacuaauaaaauacau

SEQ ID NO: 1220280 - RNA, 16 nt, Human
cuggcugggaguggca

SEQ ID NO: 1220281 - RNA, 20 nt, Human
cuggcgacaguuuuccuucu

SEQ ID NO: 1220282 - RNA, 14 nt, Human
cuggccugcuggau

SEQ ID NO: 1220283 - RNA, 19 nt, Human
cuuauuaaaacucauuuuu

SEQ ID NO: 1220284 - RNA, 13 nt, Human
caaccugggggcu

SEQ ID NO: 1220285 - RNA, 13 nt, Human
auggcaagaugug

SEQ ID NO: 1220286 - RNA, 17 nt, Human
augugaacacaucagcu

SEQ ID NO: 1220287 - RNA, 16 nt, Human
cagcccaagggugggu

SEQ ID NO: 1220288 - RNA, 15 nt, Human
ccaacacgagcaggc

SEQ ID NO: 1220289 - RNA, 12 nt, Human
ccaaucauuuua

SEQ ID NO: 1220290 - RNA, 16 nt, Human
cauuucugcaucagcu

SEQ ID NO: 1220291 - RNA, 13 nt, Human
caucuuucacauu

SEQ ID NO: 1220292 - RNA, 11 nt, Human
ccuucauuuuu

SEQ ID NO: 1220293 - RNA, 9 nt, Human
cgaaaaaca

SEQ ID NO: 1220294 - RNA, 12 nt, Human
cgcgccaccacg

SEQ ID NO: 1220295 - RNA, 19 nt, Human
ccucaguuuuaucauuuuc

SEQ ID NO: 1220296 - RNA, 14 nt, Human
ccucauccgaggca

SEQ ID NO: 1220297 - RNA, 13 nt, Human
cccuugccagaca

SEQ ID NO: 1220298 - RNA, 22 nt, Human
acuuugacaaccaugagaccac

SEQ ID NO: 1220299 - RNA, 12 nt, Human
acuucacuuuuu

SEQ ID NO: 1220300 - RNA, 18 nt, Human
agggauggcaagaugugg

SEQ ID NO: 1220301 - RNA, 14 nt, Human
agguagccaucaug

SEQ ID NO: 1220302 - RNA, 19 nt, Human
agguauuuauugagcaccu

SEQ ID NO: 1220303 - RNA, 16 nt, Human
agaucuuacaucugca

SEQ ID NO: 1220304 - RNA, 13 nt, Human
agaggcagcuuga

SEQ ID NO: 1220305 - RNA, 16 nt, Human
auauugauaauaaaau

SEQ ID NO: 1220306 - RNA, 22 nt, Human
agugggugccccccuugccaga

SEQ ID NO: 1220307 - RNA, 15 nt, Human
aucccauagccagga

SEQ ID NO: 1220308 - RNA, 19 nt, Human
auccaaagcugaauacauu

SEQ ID NO: 1220309 - RNA, 21 nt, Human
aucaguuacucugaagggcau

SEQ ID NO: 1220310 - RNA, 17 nt, Human
aucaaacugaagccaga

SEQ ID NO: 1220311 - RNA, 16 nt, Human
acaaagaagacaacau

SEQ ID NO: 1220312 - RNA, 12 nt, Human
acaaagacaaau

SEQ ID NO: 1220313 - RNA, 14 nt, Human
acaaaaaaagcauu

SEQ ID NO: 1220314 - RNA, 17 nt, Human
acuuaugaaccuuuaca

SEQ ID NO: 1220315 - RNA, 14 nt, Human
acugggggagggga

SEQ ID NO: 1220316 - RNA, 12 nt, Human
accugggcauuc

SEQ ID NO: 1220317 - RNA, 23 nt, Human
ucugcccugcuuuugcuagguca

SEQ ID NO: 1220318 - RNA, 23 nt, Human
ucuaaaaauugugaucagaccau

SEQ ID NO: 1220319 - RNA, 15 nt, Human
ucuaaguaaaaccac

SEQ ID NO: 1220320 - RNA, 19 nt, Human
ugucugccagccagcagcc

SEQ ID NO: 1220321 - RNA, 14 nt, Human
ucuuuauucagccc

SEQ ID NO: 1220322 - RNA, 20 nt, Human
uuguucccaaauuucauacc

SEQ ID NO: 1220323 - RNA, 14 nt, Human
uuguuuucauuauc

SEQ ID NO: 1220324 - RNA, 16 nt, Human
uuccuuaucacugaca

SEQ ID NO: 1220325 - RNA, 14 nt, Human
gugagccaccaaac

SEQ ID NO: 1220326 - RNA, 15 nt, Human
guccaagcauaccaa

SEQ ID NO: 1220327 - RNA, 12 nt, Human
guuagucauuug

SEQ ID NO: 1220328 - RNA, 20 nt, Human
uaucuuguuuuuccacuacu

SEQ ID NO: 1220329 - RNA, 17 nt, Human
ucccaaauuucauaccu

SEQ ID NO: 1220330 - RNA, 13 nt, Human
ucccugagcagga

SEQ ID NO: 1220331 - RNA, 19 nt, Human
ggcacuugggacaaaaaca

SEQ ID NO: 1220332 - RNA, 12 nt, Human
ggaggucauuuu

SEQ ID NO: 1220333 - RNA, 12 nt, Human
ggaugacauguc

SEQ ID NO: 1220334 - RNA, 18 nt, Human
ggacaguuccugagacca

SEQ ID NO: 1220335 - RNA, 13 nt, Human
gcugggaguggca

SEQ ID NO: 1220336 - RNA, 22 nt, Human
gcuuagaccucagccugugcug

SEQ ID NO: 1220337 - RNA, 21 nt, Human
gcuggucucgaacugcuggau

SEQ ID NO: 1220338 - RNA, 16 nt, Human
gggccucggagccuca

SEQ ID NO: 1220339 - RNA, 13 nt, Human
gggccuggcuggg

SEQ ID NO: 1220340 - RNA, 20 nt, Human
ggugggccuccucuguccag

SEQ ID NO: 1220341 - RNA, 17 nt, Human
ggccuccucuguccagg

SEQ ID NO: 1220342 - RNA, 15 nt, Human
ggcgugagccaccaa

SEQ ID NO: 1220343 - RNA, 12 nt, Human
aaagggauggca

SEQ ID NO: 1220344 - RNA, 13 nt, Human
auuuucacuuuug

SEQ ID NO: 1220345 - RNA, 19 nt, Human
cacauuggcuauuuaaaga

SEQ ID NO: 1220346 - RNA, 17 nt, Human
auuaccuugagccagua

SEQ ID NO: 1220347 - RNA, 22 nt, Human
acagccgcuccugucugccagc

SEQ ID NO: 1220348 - RNA, 14 nt, Human
agcccaaaagucaa

SEQ ID NO: 1220349 - RNA, 23 nt, Human
agcuaaaguaucuguauugcauu

SEQ ID NO: 1220350 - RNA, 16 nt, Human
agccugugcugcccgu

SEQ ID NO: 1220351 - RNA, 15 nt, Human
aggcgugagccacca

SEQ ID NO: 1220352 - RNA, 10 nt, Human
auaacucauc

SEQ ID NO: 1220353 - RNA, 18 nt, Human
auacaccagagauaauau

SEQ ID NO: 1220354 - RNA, 13 nt, Human
auacagggcauuu

SEQ ID NO: 1220355 - RNA, 23 nt, Human
aaugauuuuacggagauauccca

SEQ ID NO: 1220356 - RNA, 15 nt, Human
acugcacugucaaga

SEQ ID NO: 1220357 - RNA, 20 nt, Human
acugcacugucaagaugaug

SEQ ID NO: 1220358 - RNA, 20 nt, Human
acuaacagugugauucaccc

SEQ ID NO: 1220359 - RNA, 14 nt, Human
accccaucauccuc

SEQ ID NO: 1220360 - RNA, 23 nt, Human
accagggccuggcugggaguggc

SEQ ID NO: 1220361 - RNA, 22 nt, Human
accugacuauugaaguugcaga

SEQ ID NO: 1220362 - RNA, 17 nt, Human
aaagccaaaaaccaaau

SEQ ID NO: 1220363 - RNA, 17 nt, Human
aaguaaaaccacagcag

SEQ ID NO: 1220364 - RNA, 20 nt, Human
aaaauaaaguauauauagaa

SEQ ID NO: 1220365 - RNA, 17 nt, Human
aauugcuaucgccauca

SEQ ID NO: 1220366 - RNA, 14 nt, Human
accaagaagcccaa

SEQ ID NO: 1220367 - RNA, 16 nt, Human
acacucaaaucaagaa

SEQ ID NO: 1220368 - RNA, 15 nt, Human
acagaagagugacau

SEQ ID NO: 1220369 - RNA, 16 nt, Human
cagggaggucauuuug

SEQ ID NO: 1220370 - RNA, 23 nt, Human
caguuacucugaagggcaucaug

SEQ ID NO: 1220371 - RNA, 12 nt, Human
caggucacacaa

SEQ ID NO: 1220372 - RNA, 17 nt, Human
cagccagcucucagcca

SEQ ID NO: 1220373 - RNA, 14 nt, Human
cagcuugaaacuga

SEQ ID NO: 1220374 - RNA, 18 nt, Human
cauugaacaaguuguuuc

SEQ ID NO: 1220375 - RNA, 12 nt, Human
ccagccagcagc

SEQ ID NO: 1220376 - RNA, 14 nt, Human
ccagccagcagcca

SEQ ID NO: 1220377 - RNA, 14 nt, Human
auucaaaaguugaa

SEQ ID NO: 1220378 - RNA, 18 nt, Human
auucaaacuaauagaauu

SEQ ID NO: 1220379 - RNA, 18 nt, Human
caaccacucauucaaaag

SEQ ID NO: 1220380 - RNA, 13 nt, Human
cacaucagcuugc

SEQ ID NO: 1220381 - RNA, 23 nt, Human
caccagggccuggcugggagugg

SEQ ID NO: 1220382 - RNA, 13 nt, Human
caaucaucaaccc

SEQ ID NO: 1220383 - RNA, 20 nt, Human
cacuagcuaauaucaauaga

SEQ ID NO: 1220384 - RNA, 23 nt, Human
cagagacucagggccccagcacu

SEQ ID NO: 1220385 - RNA, 22 nt, Human
cagacagcagcucaggcacacu

SEQ ID NO: 1220386 - RNA, 13 nt, Human
auacuaauaaaau

SEQ ID NO: 1220387 - RNA, 12 nt, Human
auacaaucauca

SEQ ID NO: 1220388 - RNA, 13 nt, Human
auaaauuuuccca

SEQ ID NO: 1220389 - RNA, 13 nt, Human
auccaaagcugaa

SEQ ID NO: 1220390 - RNA, 18 nt, Human
auguagauaaacucagaa

SEQ ID NO: 1220391 - RNA, 21 nt, Human
agugggugccccccuugccag

SEQ ID NO: 1220392 - RNA, 19 nt, Human
agcuugaaacugagaugug

SEQ ID NO: 1220393 - RNA, 20 nt, Human
agcuugaaacugagauguga

SEQ ID NO: 1220394 - RNA, 19 nt, Human
aggaggguuagggaggggu

SEQ ID NO: 1220395 - RNA, 21 nt, Human
agccgcuccugucugccagcc

SEQ ID NO: 1220396 - RNA, 14 nt, Human
ugcauacaaucuga

SEQ ID NO: 1220397 - RNA, 12 nt, Human
ugcagagacagg

SEQ ID NO: 1220398 - RNA, 16 nt, Human
gcaaauuccaauacau

SEQ ID NO: 1220399 - RNA, 15 nt, Human
gagcaguagcagcag

SEQ ID NO: 1220400 - RNA, 17 nt, Human
gagcaguagcagcagca

SEQ ID NO: 1220401 - RNA, 14 nt, Human
gagcagucagaaga

SEQ ID NO: 1220402 - RNA, 22 nt, Human
gagacgggguuugccaugcugg

SEQ ID NO: 1220403 - RNA, 13 nt, Human
gagacaccaccac

SEQ ID NO: 1220404 - RNA, 19 nt, Human
gcaugggccuagcccacug

SEQ ID NO: 1220405 - RNA, 23 nt, Human
gcagauuucuuuccauugugggc

SEQ ID NO: 1220406 - RNA, 15 nt, Human
gcacuaaucaauacu

SEQ ID NO: 1220407 - RNA, 17 nt, Human
agcaugggccuagccca

SEQ ID NO: 1220408 - RNA, 21 nt, Human
agcauuacagugggugccccc

SEQ ID NO: 1220409 - RNA, 23 nt, Human
cuuuaaaaaaaaaaaaaaagcca

SEQ ID NO: 1220410 - RNA, 15 nt, Human
gaccagccaaccugg

SEQ ID NO: 1220411 - RNA, 18 nt, Human
gacucagggccccagcac

SEQ ID NO: 1220412 - RNA, 12 nt, Human
gacuguggcugc

SEQ ID NO: 1220413 - RNA, 12 nt, Human
gacauguggugg

SEQ ID NO: 1220414 - RNA, 15 nt, Human
agcaucucugaacau

SEQ ID NO: 1220415 - RNA, 11 nt, Human
agagacggggu

SEQ ID NO: 1220416 - RNA, 16 nt, Human
cucagggccccagcac

SEQ ID NO: 1220417 - RNA, 17 nt, Human
cucauccugcaggcagc

SEQ ID NO: 1220418 - RNA, 15 nt, Human
caguuuuuauauaga

SEQ ID NO: 1220419 - RNA, 16 nt, Human
caggcgugagccacca

SEQ ID NO: 1220420 - RNA, 21 nt, Human
gcuacucuguuccuucacauc

SEQ ID NO: 1220421 - RNA, 19 nt, Human
gccagcagccagcucucag

SEQ ID NO: 1220422 - RNA, 16 nt, Human
gccuugcuccuggcug

SEQ ID NO: 1220423 - RNA, 16 nt, Human
gccuugguauagcaua

SEQ ID NO: 1220424 - RNA, 17 nt, Human
ggcucagccuggugggc

SEQ ID NO: 1220425 - RNA, 18 nt, Human
ggcagacagcagcucagg

SEQ ID NO: 1220426 - RNA, 22 nt, Human
gguuugccaugcuggccaggcu

SEQ ID NO: 1220427 - RNA, 20 nt, Human
ggugccccccuugccagaca

SEQ ID NO: 1220428 - RNA, 18 nt, Human
ggggccucggagccucau

SEQ ID NO: 1220429 - RNA, 17 nt, Human
ggucaaagcaacuggau

SEQ ID NO: 1220430 - RNA, 10 nt, Human
gggaaacugc

SEQ ID NO: 1220431 - RNA, 15 nt, Human
gggcgcgugcaggca

SEQ ID NO: 1220432 - RNA, 21 nt, Human
gggaguggcgcgcgccaccac

SEQ ID NO: 1220433 - RNA, 21 nt, Human
guucaccugggcugaggcauc

SEQ ID NO: 1220434 - RNA, 18 nt, Human
guugccaaggcuggagug

SEQ ID NO: 1220435 - RNA, 20 nt, Human
uacaccccuccccugcccua

SEQ ID NO: 1220436 - RNA, 13 nt, Human
uaccugggcauuc

SEQ ID NO: 1220437 - RNA, 15 nt, Human
uaccuuuuuccuucc

SEQ ID NO: 1220438 - RNA, 16 nt, Human
ucacaaacucauccau

SEQ ID NO: 1220439 - RNA, 22 nt, Human
ucagagacucagggccccagca

SEQ ID NO: 1220440 - RNA, 16 nt, Human
ucagccccgggagugg

SEQ ID NO: 1220441 - RNA, 14 nt, Human
ucuggaaaccacau

SEQ ID NO: 1220442 - RNA, 19 nt, Human
ucauuaauacagggcauuu

SEQ ID NO: 1220443 - RNA, 14 nt, Human
ucucuaacucagaa

SEQ ID NO: 1220444 - RNA, 13 nt, Human
ucauuuuaaaaaa

SEQ ID NO: 1220445 - RNA, 12 nt, Human
ggaaaucaaaua

SEQ ID NO: 1220446 - RNA, 19 nt, Human
ccugagcaggauuuuaauc

SEQ ID NO: 1220447 - RNA, 11 nt, Human
ggcuuguaaag

SEQ ID NO: 1220448 - RNA, 19 nt, Human
uucuauugugcuuucuauc

SEQ ID NO: 1220449 - RNA, 13 nt, Human
uugggacaaaaac

SEQ ID NO: 1220450 - RNA, 14 nt, Human
uagaauuaauggaa

SEQ ID NO: 1220451 - RNA, 14 nt, Human
cuacuuuaaaaaaa

SEQ ID NO: 1220452 - RNA, 20 nt, Human
cuuaaagaauuuucaaaauc

SEQ ID NO: 1220453 - RNA, 12 nt, Human
uauuauuuaaac

SEQ ID NO: 1220454 - RNA, 22 nt, Human
auuuuaaaaaauggaacauaaa

SEQ ID NO: 1220455 - RNA, 14 nt, Human
ggacagggacccac

SEQ ID NO: 1220456 - RNA, 12 nt, Human
gcuuucuaucua

SEQ ID NO: 1220457 - RNA, 20 nt, Human
aaguaaguuugauuucauua

SEQ ID NO: 1220458 - RNA, 15 nt, Human
acaaaaacaaacaaa

SEQ ID NO: 1220459 - RNA, 15 nt, Human
cuguacuuuuuccag

SEQ ID NO: 1220460 - RNA, 21 nt, Human
agacuggcacaguuuucugag

SEQ ID NO: 1220461 - RNA, 21 nt, Human
cuggcuuaaaauguaauuaau

SEQ ID NO: 1220462 - RNA, 12 nt, Human
uuuauaaauaua

SEQ ID NO: 1220463 - RNA, 21 nt, Human
uauaacucaucauaaaauaaa

SEQ ID NO: 1220464 - RNA, 18 nt, Human
ucuucuagguucuaaaaa

SEQ ID NO: 1220465 - RNA, 15 nt, Human
ccccuccccugcccu

SEQ ID NO: 1220466 - RNA, 18 nt, Human
cuauaggugcuacaaaaa

SEQ ID NO: 1220467 - RNA, 22 nt, Human
cauguacauccauggugugcug

SEQ ID NO: 1220468 - RNA, 21 nt, Human
auugugaucagaccauaaugu

SEQ ID NO: 1220469 - RNA, 18 nt, Human
acuauugaaguugcagau

SEQ ID NO: 1220470 - RNA, 19 nt, Human
agcuucucauccugcaggc

SEQ ID NO: 1220471 - RNA, 22 nt, Human
gaguggcgcgcgccaccacgcc

SEQ ID NO: 1220472 - RNA, 14 nt, Human
agcaguggacacca

SEQ ID NO: 1220473 - RNA, 20 nt, Human
ucaggaggaaggcuuacacc

SEQ ID NO: 1220474 - RNA, 15 nt, Human
aauuuuuuucaucuu

SEQ ID NO: 1220475 - RNA, 21 nt, Human
ccugucccugcagacaugaga

SEQ ID NO: 1220476 - RNA, 14 nt, Human
gcagcucaggcaca

SEQ ID NO: 1220477 - RNA, 15 nt, Human
uagauguagauaaac

SEQ ID NO: 1220478 - RNA, 19 nt, Human
cucauugcaaccuccaccu

SEQ ID NO: 1220479 - RNA, 22 nt, Human
uauuuauaaauauauuuaagau

SEQ ID NO: 1220480 - RNA, 15 nt, Human
uguauuuauaaauau

SEQ ID NO: 1220481 - RNA, 19 nt, Human
aaucuuaacucauugcaac

SEQ ID NO: 1220482 - RNA, 23 nt, Human
ucgcugauauauguguuuuucac

SEQ ID NO: 1220483 - RNA, 24 nt, Human
gaaauguaagggaaacugccagca

SEQ ID NO: 1220484 - RNA, 12 nt, Human
gcuuuuaaaaaa

SEQ ID NO: 1220485 - RNA, 14 nt, Human
agggcuugaggacu

SEQ ID NO: 1220486 - RNA, 14 nt, Human
ggcgcgugcaggca

SEQ ID NO: 1220487 - RNA, 17 nt, Human
auucacccugauuuuac

SEQ ID NO: 1220488 - RNA, 15 nt, Human
acucauuuuaaaaaa

SEQ ID NO: 1220489 - RNA, 14 nt, Human
ugagcauguacuga

SEQ ID NO: 1220490 - RNA, 13 nt, Human
cacaccaggcuug

SEQ ID NO: 1220491 - RNA, 18 nt, Human
accaggcuugccugcagg

SEQ ID NO: 1220492 - RNA, 22 nt, Human
aauacugauguuccuagugaaa

SEQ ID NO: 1220493 - RNA, 15 nt, Human
caaauaugcaaagca

SEQ ID NO: 1220494 - RNA, 19 nt, Human
ugcuuuuaaaaaaaaauac

SEQ ID NO: 1220495 - RNA, 16 nt, Human
uugcuaggucacagag

SEQ ID NO: 1220496 - RNA, 15 nt, Human
ugcaucagcugcuga

SEQ ID NO: 1220497 - RNA, 21 nt, Human
aggcaugagucagucugauga

SEQ ID NO: 1220498 - RNA, 15 nt, Human
accccuucauccucu

SEQ ID NO: 1220499 - RNA, 19 nt, Human
ggaaaggagaaguuaagca

SEQ ID NO: 1220500 - RNA, 15 nt, Human
aguuuuugauagcuu

SEQ ID NO: 1220501 - RNA, 13 nt, Human
uauuuauauauuu

SEQ ID NO: 1220502 - RNA, 23 nt, Human
gcagugaugucacuagggcaggg

SEQ ID NO: 1220503 - RNA, 19 nt, Human
aaauggaacauaaaauaca

SEQ ID NO: 1220504 - RNA, 14 nt, Human
uggccugcuggaug

SEQ ID NO: 1220505 - RNA, 17 nt, Human
uaaaacuguaaauuuau

SEQ ID NO: 1220506 - RNA, 11 nt, Human
cucaucauaaa

SEQ ID NO: 1220507 - RNA, 21 nt, Human
aagauuaugaucucagaaauu

SEQ ID NO: 1220508 - RNA, 23 nt, Human
ccucuguccagggcccugagcuc

SEQ ID NO: 1220509 - RNA, 15 nt, Human
ggagagaagauagca

SEQ ID NO: 1220510 - RNA, 21 nt, Human
ucaccugggcugaggcauccu

SEQ ID NO: 1220511 - RNA, 16 nt, Human
uuuaagauuuuguuuu

SEQ ID NO: 1220512 - RNA, 23 nt, Human
ugauggguuucuccagagggaau

SEQ ID NO: 1220513 - RNA, 18 nt, Human
aagaagacaacauuaaaa

SEQ ID NO: 1220514 - RNA, 20 nt, Human
acaagcuuuuuuuuuuuuuc

SEQ ID NO: 1220515 - RNA, 15 nt, Human
cagugucuggcacuu

SEQ ID NO: 1220516 - RNA, 22 nt, Human
aaagauuaugaucucagaaauu

SEQ ID NO: 1220517 - RNA, 19 nt, Human
guuguucucuucuuuaaag

SEQ ID NO: 1220518 - RNA, 19 nt, Human
uggcgcgcgccaccacgcc

SEQ ID NO: 1220519 - RNA, 19 nt, Human
acuuaaaaucuaauucaaa

SEQ ID NO: 1220520 - RNA, 15 nt, Human
agccuuccccuugcc

SEQ ID NO: 1220521 - RNA, 18 nt, Human
aaagaauauuuuaacuuc

SEQ ID NO: 1220522 - RNA, 13 nt, Human
guauuuauauauu

SEQ ID NO: 1220523 - RNA, 19 nt, Human
uauauuuuuuaugaaacau

SEQ ID NO: 1220524 - RNA, 23 nt, Human
aauagaaacguguauauuuuuua

SEQ ID NO: 1220525 - RNA, 14 nt, Human
auuaauuuguaaga

SEQ ID NO: 1220526 - RNA, 20 nt, Human
gaacacugggggaggggaca

SEQ ID NO: 1220527 - RNA, 20 nt, Human
cagcuugcccuguuaaaaga

SEQ ID NO: 1220528 - RNA, 15 nt, Human
uccaaauucacaagu

SEQ ID NO: 1220529 - RNA, 20 nt, Human
cuucugucuucacaacagau

SEQ ID NO: 1220530 - RNA, 20 nt, Human
cuggauguggagggggcgcg

SEQ ID NO: 1220531 - RNA, 22 nt, Human
uuuaauuauuauucuucauaac

SEQ ID NO: 1220532 - RNA, 20 nt, Human
gugugcuggcuuaaaaugua

SEQ ID NO: 1220533 - RNA, 22 nt, Human
aaccacagcaguugaaaagacu

SEQ ID NO: 1220534 - RNA, 15 nt, Human
gcaaauuccaauaca

SEQ ID NO: 1220535 - RNA, 19 nt, Human
cgaucuuugacucuuuugc

SEQ ID NO: 1220536 - RNA, 23 nt, Human
caucauaaaauaaaguauauaua

SEQ ID NO: 1220537 - RNA, 15 nt, Human
cagcaguugaaaaga

SEQ ID NO: 1220538 - RNA, 12 nt, Human
uugccugcaggc

SEQ ID NO: 1220539 - RNA, 15 nt, Human
cuugcccagggcuca

SEQ ID NO: 1220540 - RNA, 21 nt, Human
ugagccagugucaggaggaag

SEQ ID NO: 1220541 - RNA, 13 nt, Human
uaagcuagaaaaa

SEQ ID NO: 1220542 - RNA, 14 nt, Human
aaagcuuauuaaaa

SEQ ID NO: 1220543 - RNA, 19 nt, Human
cucccagucauuuaauaaa

SEQ ID NO: 1220544 - RNA, 18 nt, Human
cuggggccuguugaagau

SEQ ID NO: 1220545 - RNA, 21 nt, Human
cuguuccuucacauccugugu

SEQ ID NO: 1220546 - RNA, 18 nt, Human
ucacacaaccugucccag

SEQ ID NO: 1220547 - RNA, 18 nt, Human
uaacuggcaguuuuccau

SEQ ID NO: 1220548 - RNA, 12 nt, Human
acccuauauuuu

SEQ ID NO: 1220549 - RNA, 20 nt, Human
auuuauauauuuauaacuca

SEQ ID NO: 1220550 - RNA, 23 nt, Human
acaguucauauguaccauguaca

SEQ ID NO: 1220551 - RNA, 14 nt, Human
ugaugaucuuuaaa

SEQ ID NO: 1220552 - RNA, 14 nt, Human
agcugaacuuguug

SEQ ID NO: 1220553 - RNA, 20 nt, Human
ugcaaagcacugacuucuaa

SEQ ID NO: 1220554 - RNA, 19 nt, Human
cugcuggauguggaggggg

SEQ ID NO: 1220555 - RNA, 16 nt, Human
uauuuccauauuaaaa

SEQ ID NO: 1220556 - RNA, 14 nt, Human
cuacaccccucccc

SEQ ID NO: 1220557 - RNA, 18 nt, Human
uuacacacauuaaaaugu

SEQ ID NO: 1220558 - RNA, 15 nt, Human
gccagcucucagcca

SEQ ID NO: 1220559 - RNA, 22 nt, Human
uacuccuaguaauuuaagauuu

SEQ ID NO: 1220560 - RNA, 15 nt, Human
ccuccucuguccagg

SEQ ID NO: 1220561 - RNA, 14 nt, Human
gaagaaauucugca

SEQ ID NO: 1220562 - RNA, 17 nt, Human
uuuccguggcacugcau

SEQ ID NO: 1220563 - RNA, 19 nt, Human
ugugcuggcuuaaaaugua

SEQ ID NO: 1220564 - RNA, 14 nt, Human
aggcgggaaggagg

SEQ ID NO: 1220565 - RNA, 15 nt, Human
aaguauauauagaau

SEQ ID NO: 1220566 - RNA, 18 nt, Human
aaaugacuaaaaaacaaa

SEQ ID NO: 1220567 - RNA, 11 nt, Human
gaccucagccu

SEQ ID NO: 1220568 - RNA, 21 nt, Human
aaacauuacaguuagagauuu

SEQ ID NO: 1220569 - RNA, 16 nt, Human
gacagcagcucaggca

SEQ ID NO: 1220570 - RNA, 23 nt, Human
ucaacaagagacuggaaggacca

SEQ ID NO: 1220571 - RNA, 17 nt, Human
cacuagacaaguccagc

SEQ ID NO: 1220572 - RNA, 23 nt, Human
cagccaugugauuacccucuggg

SEQ ID NO: 1220573 - RNA, 18 nt, Human
ggaaagacagcuucucau

SEQ ID NO: 1220574 - RNA, 23 nt, Human
cagcaucucugaacauuucucug

SEQ ID NO: 1220575 - RNA, 11 nt, Human
uuuucaucuuc

SEQ ID NO: 1220576 - RNA, 17 nt, Human
ccucacugggguccugg

SEQ ID NO: 1220577 - RNA, 21 nt, Human
cuauucacaaccacucauuca

SEQ ID NO: 1220578 - RNA, 20 nt, Human
guacuuaaaacuguaaauuu

SEQ ID NO: 1220579 - RNA, 15 nt, Human
aggcgugagccacca

SEQ ID NO: 1220580 - RNA, 17 nt, Human
aaguaaaaccacagcag

SEQ ID NO: 1220581 - RNA, 13 nt, Human
agcuuauuaaaac

SEQ ID NO: 1220582 - RNA, 13 nt, Human
cagggcucagccu

SEQ ID NO: 1220583 - RNA, 14 nt, Human
ugcccuguuaaaag

SEQ ID NO: 1220584 - RNA, 20 nt, Human
auauaauaaauguacauuaa

SEQ ID NO: 1220585 - RNA, 18 nt, Human
gcuacaaaaacacagcaa

SEQ ID NO: 1220586 - RNA, 20 nt, Human
ugccaugcuggccaggcugg

SEQ ID NO: 1220587 - RNA, 21 nt, Human
gccuuccccuugcccagggcu

SEQ ID NO: 1220588 - RNA, 18 nt, Human
guuuuauuguuuaaaauc

SEQ ID NO: 1220589 - RNA, 16 nt, Human
auuagggagagaagau

SEQ ID NO: 1220590 - RNA, 17 nt, Human
cuguauugcauuaaaua

SEQ ID NO: 1220591 - RNA, 16 nt, Human
auugagcaccugcagg

SEQ ID NO: 1220592 - RNA, 17 nt, Human
aacugccagcaacgcag

SEQ ID NO: 1220593 - RNA, 14 nt, Human
cgcuaccuuuugcu

SEQ ID NO: 1220594 - RNA, 14 nt, Human
uauauuuauaacuc

SEQ ID NO: 1220595 - RNA, 13 nt, Human
ggaaagggucucc

SEQ ID NO: 1220596 - RNA, 12 nt, Human
gcuggauucaag

SEQ ID NO: 1220597 - RNA, 13 nt, Human
gagagcacuugaa

SEQ ID NO: 1220598 - RNA, 17 nt, Human
uaaaaggccugucccug

SEQ ID NO: 1220599 - RNA, 12 nt, Human
gcgugcaggcag

SEQ ID NO: 1220600 - RNA, 16 nt, Human
gcaguugaaaagacuc

SEQ ID NO: 1220601 - RNA, 15 nt, Human
auuuuuuaauuauua

SEQ ID NO: 1220602 - RNA, 20 nt, Human
cuguaaaauggagacaccac

SEQ ID NO: 1220603 - RNA, 16 nt, Human
aauuuucccaaaacug

SEQ ID NO: 1220604 - RNA, 13 nt, Human
gccuggcugggag

SEQ ID NO: 1220605 - RNA, 21 nt, Human
gacagcuucucauccugcagg

SEQ ID NO: 1220606 - RNA, 16 nt, Human
uuuuauuguuuaaaau

SEQ ID NO: 1220607 - RNA, 20 nt, Human
uaaaugugcuuuuaaaaaaa

SEQ ID NO: 1220608 - RNA, 18 nt, Human
gaaauggugaaaugcaga

SEQ ID NO: 1220609 - RNA, 13 nt, Human
uagauaaacucag

SEQ ID NO: 1220610 - RNA, 14 nt, Human
cuuauuuauuauug

SEQ ID NO: 1220611 - RNA, 13 nt, Human
uguacuuuuucca

SEQ ID NO: 1220612 - RNA, 14 nt, Human
gcaaaugcuguauu

SEQ ID NO: 1220613 - RNA, 16 nt, Human
ccagucauuuaauaaa

SEQ ID NO: 1220614 - RNA, 19 nt, Human
ucacaagugaaaaacaucc

SEQ ID NO: 1220615 - RNA, 16 nt, Human
guaucuuguuuuucca

SEQ ID NO: 1220616 - RNA, 18 nt, Human
ugucuuaauuaaaagaau

SEQ ID NO: 1220617 - RNA, 18 nt, Human
auuauuggacuuccauuu

SEQ ID NO: 1220618 - RNA, 21 nt, Human
cagcuugcccuguuaaaagau

SEQ ID NO: 1220619 - RNA, 15 nt, Human
uagaaggauguacau

SEQ ID NO: 1220620 - RNA, 16 nt, Human
auagaauuaauggaau

SEQ ID NO: 1220621 - RNA, 15 nt, Human
ggcugggaguggcau

SEQ ID NO: 1220622 - RNA, 19 nt, Human
agagggauuagggagagaa

SEQ ID NO: 1220623 - RNA, 13 nt, Human
gucucaguguccu

SEQ ID NO: 1220624 - RNA, 15 nt, Human
cagucauuuaauaaa

SEQ ID NO: 1220625 - RNA, 21 nt, Human
gcuaaguugcaccaacuuuga

SEQ ID NO: 1220626 - RNA, 16 nt, Human
cagggccuggcuggga

SEQ ID NO: 1220627 - RNA, 14 nt, Human
aaaguauaaauaaa

SEQ ID NO: 1220628 - RNA, 22 nt, Human
agaauucuuacauguuuucuuu

SEQ ID NO: 1220629 - RNA, 16 nt, Human
gugacuggccugcugg

SEQ ID NO: 1220630 - RNA, 23 nt, Human
aaaauguguauuuuauuacaucu

SEQ ID NO: 1220631 - RNA, 20 nt, Human
cagugggugccccccuugcc

SEQ ID NO: 1220632 - RNA, 14 nt, Human
uuaauuucaugaaa

SEQ ID NO: 1220633 - RNA, 18 nt, Human
gaaucauaugggauacug

SEQ ID NO: 1220634 - RNA, 13 nt, Human
caaaaacacagca

SEQ ID NO: 1220635 - RNA, 21 nt, Human
uuucucuggauuugcaacccc

SEQ ID NO: 1220636 - RNA, 13 nt, Human
gcuacaaaaacac

SEQ ID NO: 1220637 - RNA, 14 nt, Human
uuaacuuccuugga

SEQ ID NO: 1220638 - RNA, 12 nt, Human
uaaaauugaaag

SEQ ID NO: 1220639 - RNA, 21 nt, Human
aauguuauuuuuuaauuauua

SEQ ID NO: 1220640 - RNA, 14 nt, Human
cucauuuuaaaaaa

SEQ ID NO: 1220641 - RNA, 23 nt, Human
caggcaugagucagucugaugag

SEQ ID NO: 1220642 - RNA, 17 nt, Human
cuuagaccucagccugu

SEQ ID NO: 1220643 - RNA, 21 nt, Human
augcaucuuacugaagguaaa

SEQ ID NO: 1220644 - RNA, 20 nt, Human
cagccuggugggccuccucu

SEQ ID NO: 1220645 - RNA, 10 nt, Human
auaacucauc

SEQ ID NO: 1220646 - RNA, 17 nt, Human
uaacugcauugagaacu

SEQ ID NO: 1220647 - RNA, 14 nt, Human
uaacaauuuuagga

SEQ ID NO: 1220648 - RNA, 16 nt, Human
acuccuaguaauuuaa

SEQ ID NO: 1220649 - RNA, 21 nt, Human
ggaaaggaguagaaaaagcag

SEQ ID NO: 1220650 - RNA, 21 nt, Human
ccuuuacauccagauagguua

SEQ ID NO: 1220651 - RNA, 15 nt, Human
cacccuugccaugga

SEQ ID NO: 1220652 - RNA, 17 nt, Human
gagcucgguggacccag

SEQ ID NO: 1220653 - RNA, 18 nt, Human
aaauuuucuagaauacua

SEQ ID NO: 1220654 - RNA, 13 nt, Human
cuaagaaauaugc

SEQ ID NO: 1220655 - RNA, 21 nt, Human
acucauuuauuuccauauuaa

SEQ ID NO: 1220656 - RNA, 22 nt, Human
cuggcaaggguucaccugggcu

SEQ ID NO: 1220657 - RNA, 21 nt, Human
cuugaaauagugucugaugaa

SEQ ID NO: 1220658 - RNA, 20 nt, Human
uauauucaaaaauuauauuu

SEQ ID NO: 1220659 - RNA, 21 nt, Human
caaauuaaggcauaagaaaac

SEQ ID NO: 1220660 - RNA, 15 nt, Human
cagaccauaauguua

SEQ ID NO: 1220661 - RNA, 17 nt, Human
ucucuuaaacacuaaaa

SEQ ID NO: 1220662 - RNA, 17 nt, Human
ggacacaggcuccaaac

SEQ ID NO: 1220663 - RNA, 18 nt, Human
caacaguuuuuuaugcua

SEQ ID NO: 1220664 - RNA, 17 nt, Human
aaaaucuaauucaaacu

SEQ ID NO: 1220665 - RNA, 13 nt, Human
gcugggaguggca

SEQ ID NO: 1220666 - RNA, 15 nt, Human
aaagacuccaaagaa

SEQ ID NO: 1220667 - RNA, 16 nt, Human
auaaagaauuuuaaaa

SEQ ID NO: 1220668 - RNA, 18 nt, Human
cgcgccaccacgcccagc

SEQ ID NO: 1220669 - RNA, 22 nt, Human
guacauuaauuaccuugagcca

SEQ ID NO: 1220670 - RNA, 14 nt, Human
guugccaaggcugg

SEQ ID NO: 1220671 - RNA, 12 nt, Human
gcaguugaaaag

SEQ ID NO: 1220672 - RNA, 17 nt, Human
cuagccgaccucagccu

SEQ ID NO: 1220673 - RNA, 14 nt, Human
caugccauuuaaag

SEQ ID NO: 1220674 - RNA, 18 nt, Human
ccuuagcuuagaccucag

SEQ ID NO: 1220675 - RNA, 15 nt, Human
agaggcagcuugaaa

SEQ ID NO: 1220676 - RNA, 17 nt, Human
cugaugaauguuaaauu

SEQ ID NO: 1220677 - RNA, 23 nt, Human
ccugacagcccaagggugggugg

SEQ ID NO: 1220678 - RNA, 15 nt, Human
uaugaaacauuacag

SEQ ID NO: 1220679 - RNA, 15 nt, Human
cauuguaaaugugcu

SEQ ID NO: 1220680 - RNA, 19 nt, Human
gauucccugagcaggauuu

SEQ ID NO: 1220681 - RNA, 15 nt, Human
acuugugcaguguug

SEQ ID NO: 1220682 - RNA, 17 nt, Human
guaaaugugcuuuuaaa

SEQ ID NO: 1220683 - RNA, 19 nt, Human
guauuuaagguauauaaau

SEQ ID NO: 1220684 - RNA, 21 nt, Human
uguauuuuaaaauaaauuauu

SEQ ID NO: 1220685 - RNA, 16 nt, Human
caaacugaagccagaa

SEQ ID NO: 1220686 - RNA, 20 nt, Human
ccucagccugugcugcccgu

SEQ ID NO: 1220687 - RNA, 21 nt, Human
ucauucaaaaguugaaauuaa

SEQ ID NO: 1220688 - RNA, 19 nt, Human
agaccuaggauuucaugau

SEQ ID NO: 1220689 - RNA, 22 nt, Human
ucauguauuuuaaaauaaauua

SEQ ID NO: 1220690 - RNA, 18 nt, Human
aauucacaaguuguguuu

SEQ ID NO: 1220691 - RNA, 23 nt, Human
uacuugggagaccuguaaucaua

SEQ ID NO: 1220692 - RNA, 24 nt, Human
cucaucuguaaaauggagacacca

SEQ ID NO: 1220693 - RNA, 17 nt, Human
gaaaucagaguuuucau

SEQ ID NO: 1220694 - RNA, 22 nt, Human
auccagauagguuaccaguaac

SEQ ID NO: 1220695 - RNA, 12 nt, Human
ucauucaaaagu

SEQ ID NO: 1220696 - RNA, 12 nt, Human
caccccuccccu

SEQ ID NO: 1220697 - RNA, 16 nt, Human
cuucacuuuuuuucuu

SEQ ID NO: 1220698 - RNA, 23 nt, Human
ucucugaagaguggguuucacaa

SEQ ID NO: 1220699 - RNA, 19 nt, Human
aaauggagugacuuagugu

SEQ ID NO: 1220700 - RNA, 20 nt, Human
acgugacuggccugcuggau

SEQ ID NO: 1220701 - RNA, 15 nt, Human
auuucaugaaaagau

SEQ ID NO: 1220702 - RNA, 18 nt, Human
guugaagaugcuuguauu

SEQ ID NO: 1220703 - RNA, 21 nt, Human
ccucuguccagggcccugagc

SEQ ID NO: 1220704 - RNA, 12 nt, Human
aaaauuaauucu

SEQ ID NO: 1220705 - RNA, 18 nt, Human
auuuuaaaauaaauuauu

SEQ ID NO: 1220706 - RNA, 15 nt, Human
auuugaugaaaucag

SEQ ID NO: 1220707 - RNA, 12 nt, Human
uuagggagagaa

SEQ ID NO: 1220708 - RNA, 12 nt, Human
acauuaaaaugu

SEQ ID NO: 1220709 - RNA, 21 nt, Human
uaaacuuaccugggcauucuu

SEQ ID NO: 1220710 - RNA, 19 nt, Human
uacaguuagagauuuuuaa

SEQ ID NO: 1220711 - RNA, 14 nt, Human
cauuuuaauuauua

SEQ ID NO: 1220712 - RNA, 16 nt, Human
accucaagccagccuu

SEQ ID NO: 1220713 - RNA, 18 nt, Human
uugcccagggcucagccu

SEQ ID NO: 1220714 - RNA, 15 nt, Human
agccccgggaguggc

SEQ ID NO: 1220715 - RNA, 23 nt, Human
agggacuucugucuucacaacag

SEQ ID NO: 1220716 - RNA, 19 nt, Human
uauauguguuuuucacauu

SEQ ID NO: 1220717 - RNA, 19 nt, Human
agugucuuaauuaaaagaa

SEQ ID NO: 1220718 - RNA, 23 nt, Human
ugauaauaaaauucauuccauuu

SEQ ID NO: 1220719 - RNA, 13 nt, Human
cugggggagggga

SEQ ID NO: 1220720 - RNA, 16 nt, Human
aaaggccugucccugc

SEQ ID NO: 1220721 - RNA, 21 nt, Human
auucaaaaauuauauuuugaa

SEQ ID NO: 1220722 - RNA, 18 nt, Human
caaccuccaccuucuggg

SEQ ID NO: 1220723 - RNA, 12 nt, Human
uauuucauuucu

SEQ ID NO: 1220724 - RNA, 16 nt, Human
ugcuggauucaaguga

SEQ ID NO: 1220725 - RNA, 18 nt, Human
uugcaucaauuuuucuua

SEQ ID NO: 1220726 - RNA, 14 nt, Human
accaggcauccucc

SEQ ID NO: 1220727 - RNA, 15 nt, Human
acuuuccagagacca

SEQ ID NO: 1220728 - RNA, 17 nt, Human
cuagaauacuaauaaaa

SEQ ID NO: 1220729 - RNA, 15 nt, Human
gcaaccccaucaucc

SEQ ID NO: 1220730 - RNA, 19 nt, Human
auaauacaccagagauaau

SEQ ID NO: 1220731 - RNA, 16 nt, Human
gcuuuuucucucccac

SEQ ID NO: 1220732 - RNA, 19 nt, Human
gggaccugcuguuuccuag

SEQ ID NO: 1220733 - RNA, 16 nt, Human
agcauuguaaaugugc

SEQ ID NO: 1220734 - RNA, 12 nt, Human
aacauaaaauac

SEQ ID NO: 1220735 - RNA, 21 nt, Human
cagacauguggugggacaggg

SEQ ID NO: 1220736 - RNA, 17 nt, Human
cgugacuggccugcugg

SEQ ID NO: 1220737 - RNA, 17 nt, Human
aacauaagcuagaaaaa

SEQ ID NO: 1220738 - RNA, 19 nt, Human
agccgcuccugucugccag

SEQ ID NO: 1220739 - RNA, 20 nt, Human
aguuccugagaccagccaac

SEQ ID NO: 1220740 - RNA, 21 nt, Human
aggcagcaggauagaguggga

SEQ ID NO: 1220741 - RNA, 14 nt, Human
cccacuggcucccu

SEQ ID NO: 1220742 - RNA, 14 nt, Human
acuggccugcugga

SEQ ID NO: 1220743 - RNA, 22 nt, Human
uaucaaacugaagccagaaaua

SEQ ID NO: 1220744 - RNA, 21 nt, Human
gauacuagaucuuacaucugc

SEQ ID NO: 1220745 - RNA, 14 nt, Human
augcacuaaucaau

SEQ ID NO: 1220746 - RNA, 21 nt, Human
auucagagcuuacuuaaaauu

SEQ ID NO: 1220747 - RNA, 18 nt, Human
uguaaaugugcuuuuaaa

SEQ ID NO: 1220748 - RNA, 15 nt, Human
agaaacauuuaucuu

SEQ ID NO: 1220749 - RNA, 12 nt, Human
auacuaauaaaa

SEQ ID NO: 1220750 - RNA, 20 nt, Human
aacugccagcaacgcaggcc

SEQ ID NO: 1220751 - RNA, 11 nt, Human
aagccaaaaac

SEQ ID NO: 1220752 - RNA, 13 nt, Human
uuuaaacaaaaaa

SEQ ID NO: 1220753 - RNA, 18 nt, Human
uaagaaaacuaagaaaua

SEQ ID NO: 1220754 - RNA, 21 nt, Human
aguaugcacuaaucaauacuu

SEQ ID NO: 1220755 - RNA, 19 nt, Human
cuuugaaaaaguauaaaua

SEQ ID NO: 1220756 - RNA, 15 nt, Human
agaagagaauauuag

SEQ ID NO: 1220757 - RNA, 21 nt, Human
agagauuuuuaaauaaagaau

SEQ ID NO: 1220758 - RNA, 11 nt, Human
ucggagaagag

SEQ ID NO: 1220759 - RNA, 11 nt, Human
uugaaacugag

SEQ ID NO: 1220760 - RNA, 22 nt, Human
caccaaacccggccugauuaaa

SEQ ID NO: 1220761 - RNA, 21 nt, Human
uuccuggacaguuuucugcuu

SEQ ID NO: 1220762 - RNA, 23 nt, Human
guggugggacagggacccacuuc

SEQ ID NO: 1220763 - RNA, 13 nt, Human
auguggcuguauc

SEQ ID NO: 1220764 - RNA, 18 nt, Human
acagcagcucaggcacac

SEQ ID NO: 1220765 - RNA, 23 nt, Human
uuuaaaugaguguguuugucacc

SEQ ID NO: 1220766 - RNA, 15 nt, Human
agaauauuaaaaauu

SEQ ID NO: 1220767 - RNA, 22 nt, Human
uucuuaaaugggcuacuuuguc

SEQ ID NO: 1220768 - RNA, 15 nt, Human
aagcauaccaacacg

SEQ ID NO: 1220769 - RNA, 12 nt, Human
ccugucccagcg

SEQ ID NO: 1220770 - RNA, 21 nt, Human
caaaaguauauucaaaaauua

SEQ ID NO: 1220771 - RNA, 14 nt, Human
gaugcuuguauuuu

SEQ ID NO: 1220772 - RNA, 22 nt, Human
cuccgucucccaaagugcuggg

SEQ ID NO: 1220773 - RNA, 19 nt, Human
auuguauuuuaguaagaga

SEQ ID NO: 1220774 - RNA, 12 nt, Human
aaaacucauuuu

SEQ ID NO: 1220775 - RNA, 21 nt, Human
uuaucuaucuaucuauuuauu

SEQ ID NO: 1220776 - RNA, 18 nt, Human
gaauucuuacauguuuuc

SEQ ID NO: 1220777 - RNA, 17 nt, Human
agacgggguuugccaug

SEQ ID NO: 1220778 - RNA, 18 nt, Human
cuugcccagggcucagcc

SEQ ID NO: 1220779 - RNA, 13 nt, Human
ucaaaugauuuuc

SEQ ID NO: 1220780 - RNA, 13 nt, Human
aacuaauagaauu

SEQ ID NO: 1220781 - RNA, 15 nt, Human
uagauucccugagca

SEQ ID NO: 1220782 - RNA, 19 nt, Human
acaaucugaggccuccucu

SEQ ID NO: 1220783 - RNA, 16 nt, Human
cauuuuacuacuuuaa

SEQ ID NO: 1220784 - RNA, 15 nt, Human
agaagauagcagggc

SEQ ID NO: 1220785 - RNA, 18 nt, Human
auucaaacuaauagaauu

SEQ ID NO: 1220786 - RNA, 21 nt, Human
auguacaugaagaagcuaaau

SEQ ID NO: 1220787 - RNA, 21 nt, Human
acaaaucuuaacuugaaggag

SEQ ID NO: 1220788 - RNA, 21 nt, Human
aucggagcugcuagaguucug

SEQ ID NO: 1220789 - RNA, 16 nt, Human
cucauccugcaggcag

SEQ ID NO: 1220790 - RNA, 14 nt, Human
cuuaauuaaaagaa

SEQ ID NO: 1220791 - RNA, 16 nt, Human
ggcagggucaggagag

SEQ ID NO: 1220792 - RNA, 16 nt, Human
aauauuaaaaauuaau

SEQ ID NO: 1220793 - RNA, 19 nt, Human
uguauuuauaaauauauuu

SEQ ID NO: 1220794 - RNA, 17 nt, Human
gugcuacaaaaacacag

SEQ ID NO: 1220795 - RNA, 18 nt, Human
ggucacacaaccuguccc

SEQ ID NO: 1220796 - RNA, 17 nt, Human
agauccccguguuacug

SEQ ID NO: 1220797 - RNA, 21 nt, Human
cuaccuuuugcuguggcaaau

SEQ ID NO: 1220798 - RNA, 17 nt, Human
cuccucuguccagggcc

SEQ ID NO: 1220799 - RNA, 16 nt, Human
agaacucugagcagug

SEQ ID NO: 1220800 - RNA, 21 nt, Human
cuuugaaaaaguauaaauaaa

SEQ ID NO: 1220801 - RNA, 22 nt, Human
gaauuuuucucuaacucagaaa

SEQ ID NO: 1220802 - RNA, 23 nt, Human
cggagauaucccaggaaaauuaa

SEQ ID NO: 1220803 - RNA, 18 nt, Human
cacuuuuggcuuguaaag

SEQ ID NO: 1220804 - RNA, 21 nt, Human
aaacagucucaggaaaucaaa

SEQ ID NO: 1220805 - RNA, 22 nt, Human
augagaccacuguuaucaaaac

SEQ ID NO: 1220806 - RNA, 18 nt, Human
uguugauagcaagugaau

SEQ ID NO: 1220807 - RNA, 18 nt, Human
ggaggguuagggaggggu

SEQ ID NO: 1220808 - RNA, 21 nt, Human
ucuuuguaagaguggaaccaa

SEQ ID NO: 1220809 - RNA, 21 nt, Human
ugggcauucuuguuucaauuc

SEQ ID NO: 1220810 - RNA, 14 nt, Human
auuuauauauguau

SEQ ID NO: 1220811 - RNA, 14 nt, Human
gauaauaaaauuca

SEQ ID NO: 1220812 - RNA, 18 nt, Human
gacagcagcucaggcaca

SEQ ID NO: 1220813 - RNA, 16 nt, Human
auggagguuaagcacu

SEQ ID NO: 1220814 - RNA, 12 nt, Human
acauaaaauaca

SEQ ID NO: 1220815 - RNA, 14 nt, Human
uagccgaccucagc

SEQ ID NO: 1220816 - RNA, 20 nt, Human
cuuucuucuuugaauuuccu

SEQ ID NO: 1220817 - RNA, 19 nt, Human
uacuuaaaacuguaaauuu

SEQ ID NO: 1220818 - RNA, 20 nt, Human
cugaagaguggguuucacaa

SEQ ID NO: 1220819 - RNA, 16 nt, Human
gaugaauguuaaauua

SEQ ID NO: 1220820 - RNA, 20 nt, Human
ucucccagucauuuaauaaa

SEQ ID NO: 1220821 - RNA, 22 nt, Human
uaugcauacaguaauuuuaagu

SEQ ID NO: 1220822 - RNA, 14 nt, Human
ugcauuaaauauaa

SEQ ID NO: 1220823 - RNA, 19 nt, Human
auuacaguuagagauuuuu

SEQ ID NO: 1220824 - RNA, 14 nt, Human
gaugugggcaguga

SEQ ID NO: 1220825 - RNA, 16 nt, Human
acugauggguuucucc

SEQ ID NO: 1220826 - RNA, 22 nt, Human
uaucaaaacuuucuuuucugga

SEQ ID NO: 1220827 - RNA, 17 nt, Human
uuuauuacaucuuucac

SEQ ID NO: 1220828 - RNA, 13 nt, Human
aguguccucaucu

SEQ ID NO: 1220829 - RNA, 14 nt, Human
acacuaacauauaa

SEQ ID NO: 1220830 - RNA, 16 nt, Human
ucuuacugaagguaaa

SEQ ID NO: 1220831 - RNA, 14 nt, Human
uguaaguuuaugca

SEQ ID NO: 1220832 - RNA, 22 nt, Human
gggacaguuccugagaccagcc

SEQ ID NO: 1220833 - RNA, 20 nt, Human
uauaacucaucauaaaauaa

SEQ ID NO: 1220834 - RNA, 18 nt, Human
auugaaaggcauucucug

SEQ ID NO: 1220835 - RNA, 14 nt, Human
accugcuguuuccu

SEQ ID NO: 1220836 - RNA, 14 nt, Human
gucuuaauuaaaag

SEQ ID NO: 1220837 - RNA, 18 nt, Human
uuccuuggacucauuuua

SEQ ID NO: 1220838 - RNA, 14 nt, Human
ucccucuguugcca

SEQ ID NO: 1220839 - RNA, 12 nt, Human
ugcaggcagcag

SEQ ID NO: 1220840 - RNA, 15 nt, Human
cuuaauuaaaagaau

SEQ ID NO: 1220841 - RNA, 16 nt, Human
augacuaaaaaacaaa

SEQ ID NO: 1220842 - RNA, 20 nt, Human
uagcauauguuuuuguaagu

SEQ ID NO: 1220843 - RNA, 17 nt, Human
uucaaaaguugaaauua

SEQ ID NO: 1220844 - RNA, 20 nt, Human
aaacugauacccuuugaaaa

SEQ ID NO: 1220845 - RNA, 13 nt, Human
aguuuuccuucuc

SEQ ID NO: 1220846 - RNA, 23 nt, Human
uacuguauuuuuaccuuuuuccu

SEQ ID NO: 1220847 - RNA, 16 nt, Human
caacaguuuuuuaugc

SEQ ID NO: 1220848 - RNA, 22 nt, Human
acuggcaguuuuccauugguuu

SEQ ID NO: 1220849 - RNA, 11 nt, Human
cgaaauguuau

SEQ ID NO: 1220850 - RNA, 17 nt, Human
cagcucaggcacacuuc

SEQ ID NO: 1220851 - RNA, 16 nt, Human
agcucgguggacccag

SEQ ID NO: 1220852 - RNA, 14 nt, Human
gccaugcuggccag

SEQ ID NO: 1220853 - RNA, 21 nt, Human
uuguuuuuccuuguauuuaaa

SEQ ID NO: 1220854 - RNA, 14 nt, Human
acaguaauuuuaag

SEQ ID NO: 1220855 - RNA, 18 nt, Human
caaggguucagagacuca

SEQ ID NO: 1220856 - RNA, 18 nt, Human
agccgcuccugucugcca

SEQ ID NO: 1220857 - RNA, 17 nt, Human
acugauacccuuugaaa

SEQ ID NO: 1220858 - RNA, 16 nt, Human
gucagaagaccugguc

SEQ ID NO: 1220859 - RNA, 14 nt, Human
agaugcuuguauuu

SEQ ID NO: 1220860 - RNA, 12 nt, Human
accagccaaccu

SEQ ID NO: 1220861 - RNA, 18 nt, Human
aaaacuuucuuuucugga

SEQ ID NO: 1220862 - RNA, 16 nt, Human
aggcuugccugcaggc

SEQ ID NO: 1220863 - RNA, 14 nt, Human
uaccuuuuuccuuc

SEQ ID NO: 1220864 - RNA, 17 nt, Human
gcgccaccacgcccagc

SEQ ID NO: 1220865 - RNA, 14 nt, Human
uuaaaagaugaaaa

SEQ ID NO: 1220866 - RNA, 16 nt, Human
auuuaagauaauuaua

SEQ ID NO: 1220867 - RNA, 15 nt, Human
aagucugauuuuccu

SEQ ID NO: 1220868 - RNA, 14 nt, Human
ggcacuugggacaa

SEQ ID NO: 1220869 - RNA, 17 nt, Human
caauuauaucaguccuc

SEQ ID NO: 1220870 - RNA, 17 nt, Human
uaaacaaaaaaagcauu

SEQ ID NO: 1220871 - RNA, 13 nt, Human
cauuaaaauguua

SEQ ID NO: 1220872 - RNA, 18 nt, Human
aaaggcauucucugaaga

SEQ ID NO: 1220873 - RNA, 17 nt, Human
augauuucauuucaacu

SEQ ID NO: 1220874 - RNA, 13 nt, Human
uaaguuucuggga

SEQ ID NO: 1220875 - RNA, 22 nt, Human
cagcaagggugaugggaaagca

SEQ ID NO: 1220876 - RNA, 13 nt, Human
aaauaaagaauuu

SEQ ID NO: 1220877 - RNA, 22 nt, Human
cauauuucaaaugauuuucaaa

SEQ ID NO: 1220878 - RNA, 11 nt, Human
agguauuuauu

SEQ ID NO: 1220879 - RNA, 18 nt, Human
uugggcgggacacaggcu

SEQ ID NO: 1220880 - RNA, 19 nt, Human
gaaucacucauuuauuucc

SEQ ID NO: 1220881 - RNA, 17 nt, Human
uaaauaaagaauuuuaa

SEQ ID NO: 1220882 - RNA, 15 nt, Human
uuuaccuuuuuccuu

SEQ ID NO: 1220883 - RNA, 20 nt, Human
cagaaacaucaguuacucug

SEQ ID NO: 1220884 - RNA, 16 nt, Human
agaauauuaaaaauua

SEQ ID NO: 1220885 - RNA, 13 nt, Human
uuaguguacauga

SEQ ID NO: 1220886 - RNA, 14 nt, Human
gugggacaguuccu

SEQ ID NO: 1220887 - RNA, 17 nt, Human
uaccuugaacacugggg

SEQ ID NO: 1220888 - RNA, 13 nt, Human
aaaaugagcaaaa

SEQ ID NO: 1220889 - RNA, 15 nt, Human
aguacuuaaaacugu

SEQ ID NO: 1220890 - RNA, 19 nt, Human
aaaagucaaucuuaucaua

SEQ ID NO: 1220891 - RNA, 23 nt, Human
gucuucagccuagccgaccucag

SEQ ID NO: 1220892 - RNA, 14 nt, Human
cucauccugcaggc

SEQ ID NO: 1220893 - RNA, 16 nt, Human
acuuuccagagaccag

SEQ ID NO: 1220894 - RNA, 17 nt, Human
acaagagacuggaagga

SEQ ID NO: 1220895 - RNA, 11 nt, Human
aauugcagagu

SEQ ID NO: 1220896 - RNA, 17 nt, Human
acaaguccagccuggca

SEQ ID NO: 1220897 - RNA, 15 nt, Human
ucuugagaagagaau

SEQ ID NO: 1220898 - RNA, 14 nt, Human
aaaauuggacuuaa

SEQ ID NO: 1220899 - RNA, 19 nt, Human
gauuuuuaaauaaagaauu

SEQ ID NO: 1220900 - RNA, 20 nt, Human
uguggugggacagggaccca

SEQ ID NO: 1220901 - RNA, 13 nt, Human
aagaauuuuaaaa

SEQ ID NO: 1220902 - RNA, 21 nt, Human
guacauuuccaaauucacaag

SEQ ID NO: 1220903 - RNA, 17 nt, Human
acucagggccccagcac

SEQ ID NO: 1220904 - RNA, 17 nt, Human
aagcuugcaacaaaauu

SEQ ID NO: 1220905 - RNA, 19 nt, Human
cugagcaggauuuuaaucu

SEQ ID NO: 1220906 - RNA, 21 nt, Human
uuaaacaucagcaaaaaagua

SEQ ID NO: 1220907 - RNA, 18 nt, Human
acaaauaggaauuguuuu

SEQ ID NO: 1220908 - RNA, 13 nt, Human
ucucaaaacugca

SEQ ID NO: 1220909 - RNA, 23 nt, Human
aucacaaacucauccauuaaugu

SEQ ID NO: 1220910 - RNA, 18 nt, Human
ucugaugagaacucugag

SEQ ID NO: 1220911 - RNA, 22 nt, Human
gacagggaaagggucucccucu

SEQ ID NO: 1220912 - RNA, 18 nt, Human
acuccaaagaaauguaag

SEQ ID NO: 1220913 - RNA, 20 nt, Human
agcaagggugaugggaaagc

SEQ ID NO: 1220914 - RNA, 12 nt, Human
aagcauuguaac

SEQ ID NO: 1220915 - RNA, 15 nt, Human
agaaauuguaucuua

SEQ ID NO: 1220916 - RNA, 19 nt, Human
gcauccuuccucacaccag

SEQ ID NO: 1220917 - RNA, 22 nt, Human
acauuacaguuagagauuuuua

SEQ ID NO: 1220918 - RNA, 14 nt, Human
gucuucacaacaga

SEQ ID NO: 1220919 - RNA, 13 nt, Human
guuugauuucauu

SEQ ID NO: 1220920 - RNA, 17 nt, Human
uguuuaaaaucauuucu

SEQ ID NO: 1220921 - RNA, 15 nt, Human
acuggcucccuggaa

SEQ ID NO: 1220922 - RNA, 20 nt, Human
uuagaugacugaauuucuau

SEQ ID NO: 1220923 - RNA, 17 nt, Human
augagccggagccccuu

SEQ ID NO: 1220924 - RNA, 15 nt, Human
aucaaccaaauggag

SEQ ID NO: 1220925 - RNA, 18 nt, Human
aguaauuucagaagaaau

SEQ ID NO: 1220926 - RNA, 14 nt, Human
agaauauuagcuuu

SEQ ID NO: 1220927 - RNA, 16 nt, Human
uuagagauuuuuaaau

SEQ ID NO: 1220928 - RNA, 17 nt, Human
cccucugggucucagug

SEQ ID NO: 1220929 - RNA, 15 nt, Human
auuucauuucuuuga

SEQ ID NO: 1220930 - RNA, 23 nt, Human
uuauaaauauauuuaagauaauu

SEQ ID NO: 1220931 - RNA, 15 nt, Human
caccgaguggcccuu

SEQ ID NO: 1220932 - RNA, 13 nt, Human
uuaauuaaaagaa

SEQ ID NO: 1220933 - RNA, 16 nt, Human
gacaaagacaaauucu

SEQ ID NO: 1220934 - RNA, 16 nt, Human
acuuuaacacaguguc

SEQ ID NO: 1220935 - RNA, 15 nt, Human
auuuucaaaaucaaa

SEQ ID NO: 1220936 - RNA, 13 nt, Human
ccacuucacuuuu

SEQ ID NO: 1220937 - RNA, 14 nt, Human
auguaaauagaaac

SEQ ID NO: 1220938 - RNA, 13 nt, Human
uauauauagaauc

SEQ ID NO: 1220939 - RNA, 19 nt, Human
uugaauuuccuaucuguau

SEQ ID NO: 1220940 - RNA, 13 nt, Human
acaguuuuccuuc

SEQ ID NO: 1220941 - RNA, 14 nt, Human
cgcccaucuccguc

SEQ ID NO: 1220942 - RNA, 20 nt, Human
uaagauuuuguuuuuaaacu

SEQ ID NO: 1220943 - RNA, 18 nt, Human
uguuucuugagaagagaa

SEQ ID NO: 1220944 - RNA, 19 nt, Human
aaauuuucuagaauacuaa

SEQ ID NO: 1220945 - RNA, 14 nt, Human
ucacccugauuuua

SEQ ID NO: 1220946 - RNA, 19 nt, Human
aguuuucauguauuuuaaa

SEQ ID NO: 1220947 - RNA, 14 nt, Human
uuccauauuaaaau

SEQ ID NO: 1220948 - RNA, 19 nt, Human
uauuuccauauuaaaauca

SEQ ID NO: 1220949 - RNA, 22 nt, Human
uuacauguuuucuuugcuuuaa

SEQ ID NO: 1220950 - RNA, 17 nt, Human
cucgguggacccaggga

SEQ ID NO: 1220951 - RNA, 12 nt, Human
uccugcaggcag

SEQ ID NO: 1220952 - RNA, 23 nt, Human
auauauguauuuauaaauauauu

SEQ ID NO: 1220953 - RNA, 13 nt, Human
ugcuuuuaaaaaa

SEQ ID NO: 1220954 - RNA, 19 nt, Human
gaacacccuauauuuugca

SEQ ID NO: 1220955 - RNA, 19 nt, Human
ccaugcuggccaggcuggu

SEQ ID NO: 1220956 - RNA, 21 nt, Human
acuuuuuuucuuuucucugcc

SEQ ID NO: 1220957 - RNA, 19 nt, Human
gaauguaaucaauguuucu

SEQ ID NO: 1220958 - RNA, 23 nt, Human
aaguaucuguauugcauuaaaua

SEQ ID NO: 1220959 - RNA, 16 nt, Human
uacauuuccaaauuca

SEQ ID NO: 1220960 - RNA, 22 nt, Human
uaaucagggaggucauuuuggu

SEQ ID NO: 1220961 - RNA, 17 nt, Human
ucacaagugaaaaacau

SEQ ID NO: 1220962 - RNA, 15 nt, Human
ccccugcccuagagc

SEQ ID NO: 1220963 - RNA, 21 nt, Human
agccuuccccuugcccagggc

SEQ ID NO: 1220964 - RNA, 18 nt, Human
ugacuuaguguacaugaa

SEQ ID NO: 1220965 - RNA, 22 nt, Human
aaugaaauggugaaaugcagag

SEQ ID NO: 1220966 - RNA, 17 nt, Human
auucgcaauaaguacca

SEQ ID NO: 1220967 - RNA, 21 nt, Human
acuaauagaauuaauggaaua

SEQ ID NO: 1220968 - RNA, 16 nt, Human
guauuuauaaauauau

SEQ ID NO: 1220969 - RNA, 22 nt, Human
acugaggcagacagcagcucag

SEQ ID NO: 1220970 - RNA, 23 nt, Human
uaaucauauaauaaauguacauu

SEQ ID NO: 1220971 - RNA, 22 nt, Human
aauuguauuuuaguaagagauu

SEQ ID NO: 1220972 - RNA, 16 nt, Human
cuuuaaguguaacugg

SEQ ID NO: 1220973 - RNA, 16 nt, Human
cuccugucugccagcc

SEQ ID NO: 1220974 - RNA, 15 nt, Human
gacagggacccacuu

SEQ ID NO: 1220975 - RNA, 20 nt, Human
uuuaguaagagauuccugag

SEQ ID NO: 1220976 - RNA, 13 nt, Human
uaaggcuucucuu

SEQ ID NO: 1220977 - RNA, 16 nt, Human
gagcaccugcaggcgu

SEQ ID NO: 1220978 - RNA, 21 nt, Human
ugggccuccucuguccagggc

SEQ ID NO: 1220979 - RNA, 17 nt, Human
aggcaugagucagucug

SEQ ID NO: 1220980 - RNA, 23 nt, Human
ucaagaugaugaugaucuuuaaa

SEQ ID NO: 1220981 - RNA, 21 nt, Human
ccuucacauccuguguuucua

SEQ ID NO: 1220982 - RNA, 14 nt, Human
uucuagaauacuaa

SEQ ID NO: 1220983 - RNA, 16 nt, Human
uauaauaaauguacau

SEQ ID NO: 1220984 - RNA, 13 nt, Human
uaccuuuuuccuu

SEQ ID NO: 1220985 - RNA, 21 nt, Human
ucagaucauuucaaaacucau

SEQ ID NO: 1220986 - RNA, 14 nt, Human
uaugcauacaguaa

SEQ ID NO: 1220987 - RNA, 13 nt, Human
aaauaaaagauug

SEQ ID NO: 1220988 - RNA, 17 nt, Human
aacucgaaucacucauu

SEQ ID NO: 1220989 - RNA, 14 nt, Human
uuucuuaaagaauu

SEQ ID NO: 1220990 - RNA, 15 nt, Human
uguuacauuauuauc

SEQ ID NO: 1220991 - RNA, 22 nt, Human
gcagccaugugauuacccucug

SEQ ID NO: 1220992 - RNA, 16 nt, Human
auccugucccuccucc

SEQ ID NO: 1220993 - RNA, 16 nt, Human
cuguaucuuguuuuuc

SEQ ID NO: 1220994 - RNA, 19 nt, Human
cugacagcccaaggguggg

SEQ ID NO: 1220995 - RNA, 14 nt, Human
gagaagagaauauu

SEQ ID NO: 1220996 - RNA, 17 nt, Human
aauuucaugaaaagauu

SEQ ID NO: 1220997 - RNA, 16 nt, Human
gggcuuuagggaccug

SEQ ID NO: 1220998 - RNA, 21 nt, Human
aaaucaaauaugcaaagcacu

SEQ ID NO: 1220999 - RNA, 17 nt, Human
ucuagguucuaaaaauu

SEQ ID NO: 1221000 - RNA, 12 nt, Human
agauaucccagg

SEQ ID NO: 1221001 - RNA, 14 nt, Human
uguuauuuuuuaau

SEQ ID NO: 1221002 - RNA, 23 nt, Human
uaaauauacuccuaguaauuuaa

SEQ ID NO: 1221003 - RNA, 14 nt, Human
aucagucauaacua

SEQ ID NO: 1221004 - RNA, 22 nt, Human
gcccaucuccgucucccaaagu

SEQ ID NO: 1221005 - RNA, 13 nt, Human
cuguacuuuuucc

SEQ ID NO: 1221006 - RNA, 17 nt, Human
ggaauauguaaauagaa

SEQ ID NO: 1221007 - RNA, 21 nt, Human
auucccuccugcuacucuguu

SEQ ID NO: 1221008 - RNA, 23 nt, Human
auuuucuagaauacuaauaaaau

SEQ ID NO: 1221009 - RNA, 14 nt, Human
guuguucucuucuu

SEQ ID NO: 1221010 - RNA, 12 nt, Human
aucaucuuaagu

SEQ ID NO: 1221011 - RNA, 20 nt, Human
caggcuccaaacuggagcuu

SEQ ID NO: 1221012 - RNA, 18 nt, Human
uacaguaauuuuaaguaa

SEQ ID NO: 1221013 - RNA, 12 nt, Human
auuauuauuuau

SEQ ID NO: 1221014 - RNA, 12 nt, Human
cauucucugaag

SEQ ID NO: 1221015 - RNA, 18 nt, Human
auauacuccuaguaauuu

SEQ ID NO: 1221016 - RNA, 21 nt, Human
cuuuauuuuuuaaguauuuau

SEQ ID NO: 1221017 - RNA, 14 nt, Human
cacuagggcaggga

SEQ ID NO: 1221018 - RNA, 18 nt, Human
uauuuugcauaguaccaa

SEQ ID NO: 1221019 - RNA, 14 nt, Human
ugugccuucauuuu

SEQ ID NO: 1221020 - RNA, 19 nt, Human
uguuuucauuaucucaaaa

SEQ ID NO: 1221021 - RNA, 20 nt, Human
gccucuaaaaggccuguccc

SEQ ID NO: 1221022 - RNA, 15 nt, Human
aagaauuuuaaaacu

SEQ ID NO: 1221023 - RNA, 15 nt, Human
agccucaagaugaag

SEQ ID NO: 1221024 - RNA, 17 nt, Human
guacauuuccaaauuca

SEQ ID NO: 1221025 - RNA, 20 nt, Human
gucaagaugaugaugaucuu

SEQ ID NO: 1221026 - RNA, 17 nt, Human
ucugccagccagcagcc

SEQ ID NO: 1221027 - RNA, 16 nt, Human
uagcuuagaccucagc

SEQ ID NO: 1221028 - RNA, 14 nt, Human
aagggucucccucu

SEQ ID NO: 1221029 - RNA, 21 nt, Human
uuuagaauauuaaaaauuaau

SEQ ID NO: 1221030 - RNA, 20 nt, Human
gcagacaguguuuucuggga

SEQ ID NO: 1221031 - RNA, 22 nt, Human
cucagccuggugggccuccucu

SEQ ID NO: 1221032 - RNA, 14 nt, Human
uuauuguuuaaaau

SEQ ID NO: 1221033 - RNA, 20 nt, Human
ugcuggauucaagugauccg

SEQ ID NO: 1221034 - RNA, 19 nt, Human
uuaaaagaugaaaauauuu

SEQ ID NO: 1221035 - RNA, 21 nt, Human
ccccuugcccagggcucagcc

SEQ ID NO: 1221036 - RNA, 16 nt, Human
aaggguggguggggug

SEQ ID NO: 1221037 - RNA, 22 nt, Human
ucucuuaaacacuaaaaaggca

SEQ ID NO: 1221038 - RNA, 17 nt, Human
cugagcagugcuugaau

SEQ ID NO: 1221039 - RNA, 17 nt, Human
uggacuuccauuuggaa

SEQ ID NO: 1221040 - RNA, 22 nt, Human
uccauggugugcuggcuuaaaa

SEQ ID NO: 1221041 - RNA, 24 nt, Human
cugauauauguguuuuucacauuu

SEQ ID NO: 1221042 - RNA, 15 nt, Human
ccucagccuuccccu

SEQ ID NO: 1221043 - RNA, 17 nt, Human
aagggauggcaagaugu

SEQ ID NO: 1221044 - RNA, 23 nt, Human
cauagauguagauaaacucagaa

SEQ ID NO: 1221045 - RNA, 16 nt, Human
aaaaguauauucaaaa

SEQ ID NO: 1221046 - RNA, 13 nt, Human
auuuauuugagac

SEQ ID NO: 1221047 - RNA, 23 nt, Human
cuuguaaaguacagacuuuuuuu

SEQ ID NO: 1221048 - RNA, 21 nt, Human
gcuaaaguaucuguauugcau

SEQ ID NO: 1221049 - RNA, 19 nt, Human
cauauguuuuuguaaguuu

SEQ ID NO: 1221050 - RNA, 22 nt, Human
gaguccuugcaucaauuuuucu

SEQ ID NO: 1221051 - RNA, 17 nt, Human
aggcagggucaggagag

SEQ ID NO: 1221052 - RNA, 15 nt, Human
uacaucuuucacauu

SEQ ID NO: 1221053 - RNA, 15 nt, Human
uaauguuacauuauu

SEQ ID NO: 1221054 - RNA, 22 nt, Human
cagggcauggcugggaacccaa

SEQ ID NO: 1221055 - RNA, 23 nt, Human
accuguaaucauauaauaaaugu

SEQ ID NO: 1221056 - RNA, 21 nt, Human
aauuagaugacugaauuucua

SEQ ID NO: 1221057 - RNA, 21 nt, Human
ucaaaauuggacuuaaaaucu

SEQ ID NO: 1221058 - RNA, 20 nt, Human
auauguaccauguacaugaa

SEQ ID NO: 1221059 - RNA, 16 nt, Human
gaaggcuuacacccac

SEQ ID NO: 1221060 - RNA, 19 nt, Human
aggugcuacaaaaacacag

SEQ ID NO: 1221061 - RNA, 13 nt, Human
cacucaaaucaag

SEQ ID NO: 1221062 - RNA, 15 nt, Human
aagaagcuaaauccu

SEQ ID NO: 1221063 - RNA, 15 nt, Human
augaaccuuuacauc

SEQ ID NO: 1221064 - RNA, 13 nt, Human
acauaaaauacaa

SEQ ID NO: 1221065 - RNA, 17 nt, Human
ccgucuucagccuagcc

SEQ ID NO: 1221066 - RNA, 14 nt, Human
accugggcauucuu

SEQ ID NO: 1221067 - RNA, 22 nt, Human
ccagcaaauucgcugcaaccug

SEQ ID NO: 1221068 - RNA, 16 nt, Human
uauauaaauuuuccca

SEQ ID NO: 1221069 - RNA, 21 nt, Human
aaugacuaaaaaacaaagaag

SEQ ID NO: 1221070 - RNA, 15 nt, Human
uagccgaccucagcc

SEQ ID NO: 1221071 - RNA, 22 nt, Human
auacauuauuggacuuccauuu

SEQ ID NO: 1221072 - RNA, 21 nt, Human
ugggucucaguguccucaucu

SEQ ID NO: 1221073 - RNA, 22 nt, Human
aaagcaacuggauacuagaucu

SEQ ID NO: 1221074 - RNA, 11 nt, Human
auuauuauuua

SEQ ID NO: 1221075 - RNA, 24 nt, Human
uauuuauaaauauauuuaagauaa

SEQ ID NO: 1221076 - RNA, 12 nt, Human
accaaucauuuu

SEQ ID NO: 1221077 - RNA, 17 nt, Human
gugaagaaacauuuauc

SEQ ID NO: 1221078 - RNA, 17 nt, Human
cgagcaggcuacuguca

SEQ ID NO: 1221079 - RNA, 15 nt, Human
uuuucugcuuuaauu

SEQ ID NO: 1221080 - RNA, 20 nt, Human
cuuuugcugccucuaaaagg

SEQ ID NO: 1221081 - RNA, 22 nt, Human
agaggauguguggcauuuucac

SEQ ID NO: 1221082 - RNA, 16 nt, Human
aaguaaaaccacagca

SEQ ID NO: 1221083 - RNA, 15 nt, Human
gucccuacaccccuc

SEQ ID NO: 1221084 - RNA, 11 nt, Human
aauuauuauuu

SEQ ID NO: 1221085 - RNA, 13 nt, Human
gccagcucucagc

SEQ ID NO: 1221086 - RNA, 19 nt, Human
auugaaaggcauucucuga

SEQ ID NO: 1221087 - RNA, 21 nt, Human
aauggaauauguaaauagaaa

SEQ ID NO: 1221088 - RNA, 15 nt, Human
uuuaagauaauuaua

SEQ ID NO: 1221089 - RNA, 20 nt, Human
uuccuuagcuuagaccucag

SEQ ID NO: 1221090 - RNA, 14 nt, Human
uauuuuuuaugaaa

SEQ ID NO: 1221091 - RNA, 22 nt, Human
augacaugucccuacaccccuc

SEQ ID NO: 1221092 - RNA, 13 nt, Human
aagagcuguucac

SEQ ID NO: 1221093 - RNA, 14 nt, Human
caccccuccccugc

SEQ ID NO: 1221094 - RNA, 21 nt, Human
cuucucuuaaacacuaaaaag

SEQ ID NO: 1221095 - RNA, 16 nt, Human
uuguguguuauuuaaa

SEQ ID NO: 1221096 - RNA, 15 nt, Human
ggucaggagaggggc

SEQ ID NO: 1221097 - RNA, 15 nt, Human
ucaaaagguauuuau

SEQ ID NO: 1221098 - RNA, 20 nt, Human
aaaauaccaugccauuuaaa

SEQ ID NO: 1221099 - RNA, 15 nt, Human
aaaauaaauuauuau

SEQ ID NO: 1221100 - RNA, 23 nt, Human
acaaaaguauauucaaaaauuau

SEQ ID NO: 1221101 - RNA, 16 nt, Human
agucucaggaaaucaa

SEQ ID NO: 1221102 - RNA, 22 nt, Human
agugucugaugaauguuaaauu

SEQ ID NO: 1221103 - RNA, 22 nt, Human
uuuacacacauuaaaauguuag

SEQ ID NO: 1221104 - RNA, 14 nt, Human
cuuaaaauguaauu

SEQ ID NO: 1221105 - RNA, 18 nt, Human
ucuagaauacuaauaaaa

SEQ ID NO: 1221106 - RNA, 13 nt, Human
acaacauuaaaac

SEQ ID NO: 1221107 - RNA, 20 nt, Human
uugauagaguguuaucaguc

SEQ ID NO: 1221108 - RNA, 16 nt, Human
aucaguuacucugaag

SEQ ID NO: 1221109 - RNA, 14 nt, Human
auuuauuauugugu

SEQ ID NO: 1221110 - RNA, 15 nt, Human
ggaaaugaaagaaag

SEQ ID NO: 1221111 - RNA, 21 nt, Human
aaaaauggaacauaaaauaca

SEQ ID NO: 1221112 - RNA, 22 nt, Human
uaaaaucauuucugcaucagcu

SEQ ID NO: 1221113 - RNA, 12 nt, Human
aaaaaaaaauac

SEQ ID NO: 1221114 - RNA, 12 nt, Human
cuggcugggagu

SEQ ID NO: 1221115 - RNA, 17 nt, Human
uauaauauacuauauuu

SEQ ID NO: 1221116 - RNA, 13 nt, Human
acauuaaaacaau

SEQ ID NO: 1221117 - RNA, 21 nt, Human
ucuuaaagaauuuucaaaauc

SEQ ID NO: 1221118 - RNA, 18 nt, Human
aguauauucaaaaauuau

SEQ ID NO: 1221119 - RNA, 14 nt, Human
ugacagcccaaggg

SEQ ID NO: 1221120 - RNA, 17 nt, Human
caggcaacugaggcaga

SEQ ID NO: 1221121 - RNA, 15 nt, Human
cagagacucagggcc

SEQ ID NO: 1221122 - RNA, 21 nt, Human
aagaaacuuaagguuaccuuu

SEQ ID NO: 1221123 - RNA, 16 nt, Human
uguuuccuagcgcagc

SEQ ID NO: 1221124 - RNA, 21 nt, Human
aggcaacugaggcagacagca

SEQ ID NO: 1221125 - RNA, 14 nt, Human
auuauuugcagaga

SEQ ID NO: 1221126 - RNA, 14 nt, Human
acacaucagcuugc

SEQ ID NO: 1221127 - RNA, 16 nt, Human
cugcuggauucaagug

SEQ ID NO: 1221128 - RNA, 15 nt, Human
aaaugaaaugacugu

SEQ ID NO: 1221129 - RNA, 23 nt, Human
aaauacugauguuccuagugaaa

SEQ ID NO: 1221130 - RNA, 20 nt, Human
caguuagagauuuuuaaaua

SEQ ID NO: 1221131 - RNA, 21 nt, Human
aaaagacuccaaagaaaugua

SEQ ID NO: 1221132 - RNA, 15 nt, Human
accugacagcccaag

SEQ ID NO: 1221133 - RNA, 19 nt, Human
ggucucaguguccucaucu

SEQ ID NO: 1221134 - RNA, 17 nt, Human
ugaggcagacagcagcu

SEQ ID NO: 1221135 - RNA, 18 nt, Human
cugaugaauguuaaauua

SEQ ID NO: 1221136 - RNA, 22 nt, Human
gcuucucauccugcaggcagcu

SEQ ID NO: 1221137 - RNA, 14 nt, Human
ucuggcacuuggga

SEQ ID NO: 1221138 - RNA, 19 nt, Human
gaucucagaaauuguaucu

SEQ ID NO: 1221139 - RNA, 17 nt, Human
augggaaagcauuguaa

SEQ ID NO: 1221140 - RNA, 15 nt, Human
aaacauccagauaca

SEQ ID NO: 1221141 - RNA, 13 nt, Human
cugcccuagagca

SEQ ID NO: 1221142 - RNA, 16 nt, Human
uuuggcuuguaaagua

SEQ ID NO: 1221143 - RNA, 18 nt, Human
gaaaggccagcaaauucg

SEQ ID NO: 1221144 - RNA, 20 nt, Human
uauacuguauuuuuaccuuu

SEQ ID NO: 1221145 - RNA, 20 nt, Human
gaaagcaucauuauuugcag

SEQ ID NO: 1221146 - RNA, 12 nt, Human
uguaacuuauga

SEQ ID NO: 1221147 - RNA, 23 nt, Human
auuacaguuagagauuuuuaaau

SEQ ID NO: 1221148 - RNA, 18 nt, Human
ccauaauguuacauuauu

SEQ ID NO: 1221149 - RNA, 12 nt, Human
cuuuaauuucau

SEQ ID NO: 1221150 - RNA, 21 nt, Human
cuuuucaaaauuggacuuaaa

SEQ ID NO: 1221151 - RNA, 15 nt, Human
auauguauuuauaaa

SEQ ID NO: 1221152 - RNA, 21 nt, Human
auugggaaaggaguagaaaaa

SEQ ID NO: 1221153 - RNA, 17 nt, Human
ugaaaugacuaaaaaac

SEQ ID NO: 1221154 - RNA, 21 nt, Human
gggcucagccuggugggccuc

SEQ ID NO: 1221155 - RNA, 13 nt, Human
acucugcauucua

SEQ ID NO: 1221156 - RNA, 14 nt, Human
caaacgaaaaacau

SEQ ID NO: 1221157 - RNA, 22 nt, Human
cuuugagugucuuaauuaaaag

SEQ ID NO: 1221158 - RNA, 13 nt, Human
gggcucagccugg

SEQ ID NO: 1221159 - RNA, 23 nt, Human
uuuuaaacaaaaaaagcauugua

SEQ ID NO: 1221160 - RNA, 15 nt, Human
uaugcaaagcacuga

SEQ ID NO: 1221161 - RNA, 15 nt, Human
uaagauaauuauaau

SEQ ID NO: 1221162 - RNA, 19 nt, Human
aacauaagcuagaaaaauu

SEQ ID NO: 1221163 - RNA, 15 nt, Human
accccuccccugccc

SEQ ID NO: 1221164 - RNA, 12 nt, Human
uucuaaaugaau

SEQ ID NO: 1221165 - RNA, 20 nt, Human
gccauuuaaagcuuauuaaa

SEQ ID NO: 1221166 - RNA, 15 nt, Human
auggaauauguaaau

SEQ ID NO: 1221167 - RNA, 18 nt, Human
uggugugcuggcuuaaaa

SEQ ID NO: 1221168 - RNA, 18 nt, Human
accuguaaucauauaaua

SEQ ID NO: 1221169 - RNA, 16 nt, Human
gcaucuuacugaaggu

SEQ ID NO: 1221170 - RNA, 10 nt, Human
aaaagaugaa

SEQ ID NO: 1221171 - RNA, 21 nt, Human
cuucuaaccugaacugauggg

SEQ ID NO: 1221172 - RNA, 16 nt, Human
aggcuuugcauagauu

SEQ ID NO: 1221173 - RNA, 14 nt, Human
agggaaacugccag

SEQ ID NO: 1221174 - RNA, 15 nt, Human
uguaacuuaugaacc

SEQ ID NO: 1221175 - RNA, 16 nt, Human
uacagggcauuuuggu

SEQ ID NO: 1221176 - RNA, 15 nt, Human
gggcucuggaaacca

SEQ ID NO: 1221177 - RNA, 18 nt, Human
ccugcagacaugagagac

SEQ ID NO: 1221178 - RNA, 22 nt, Human
uguuugccuucuacuuuuaagu

SEQ ID NO: 1221179 - RNA, 13 nt, Human
acucauuuuuguu

SEQ ID NO: 1221180 - RNA, 15 nt, Human
uaaguauuuauauau

SEQ ID NO: 1221181 - RNA, 15 nt, Human
agagacucagggccc

SEQ ID NO: 1221182 - RNA, 14 nt, Human
ccugggcugaggca

SEQ ID NO: 1221183 - RNA, 16 nt, Human
aagucugauuuuccug

SEQ ID NO: 1221184 - RNA, 14 nt, Human
caggagaggggcag

SEQ ID NO: 1221185 - RNA, 19 nt, Human
cuugccugcaggcaugagu

SEQ ID NO: 1221186 - RNA, 21 nt, Human
uguaaaugugcuuuuaaaaaa

SEQ ID NO: 1221187 - RNA, 23 nt, Human
auaauguuacauuauuaucaaca

SEQ ID NO: 1221188 - RNA, 12 nt, Human
caucuuucacau

SEQ ID NO: 1221189 - RNA, 12 nt, Human
acccugauuuua

SEQ ID NO: 1221190 - RNA, 21 nt, Human
ugcagaguacuggcugaugga

SEQ ID NO: 1221191 - RNA, 18 nt, Human
uaaaacuguaaauuuauu

SEQ ID NO: 1221192 - RNA, 15 nt, Human
aaucacaaacucauc

SEQ ID NO: 1221193 - RNA, 23 nt, Human
uucagcagagacgggguuugcca

SEQ ID NO: 1221194 - RNA, 14 nt, Human
auuuauugagcacc

SEQ ID NO: 1221195 - RNA, 18 nt, Human
aaaccacagcaguugaaa

SEQ ID NO: 1221196 - RNA, 22 nt, Human
aaagcacgaaauguuauuuuuu

SEQ ID NO: 1221197 - RNA, 16 nt, Human
ugugcuggcuuaaaau

SEQ ID NO: 1221198 - RNA, 23 nt, Human
aguguacaugaaagcguaaagag

SEQ ID NO: 1221199 - RNA, 12 nt, Human
aaugaauguuua

SEQ ID NO: 1221200 - RNA, 16 nt, Human
gauguggagggggcgc

SEQ ID NO: 1221201 - RNA, 21 nt, Human
aggcagacagcagcucaggca

SEQ ID NO: 1221202 - RNA, 16 nt, Human
ccaggaaacucugcau

SEQ ID NO: 1221203 - RNA, 14 nt, Human
cccuacaccccucc

SEQ ID NO: 1221204 - RNA, 21 nt, Human
ugaaagaggcagcuugaaacu

SEQ ID NO: 1221205 - RNA, 15 nt, Human
uguuuuaaaauuaaa

SEQ ID NO: 1221206 - RNA, 16 nt, Human
caacacgagcaggcua

SEQ ID NO: 1221207 - RNA, 14 nt, Human
agaccagccaaccu

SEQ ID NO: 1221208 - RNA, 17 nt, Human
aaauuaaggcauaagaa

SEQ ID NO: 1221209 - RNA, 16 nt, Human
aaaugugcuuuuaaaa

SEQ ID NO: 1221210 - RNA, 18 nt, Human
uuuggcuuguaaaguaca

SEQ ID NO: 1221211 - RNA, 20 nt, Human
gaguaagcaccuuuagaaua

SEQ ID NO: 1221212 - RNA, 17 nt, Human
aucuguaugucugccua

SEQ ID NO: 1221213 - RNA, 13 nt, Human
aacuggaaauaaa

SEQ ID NO: 1221214 - RNA, 14 nt, Human
ucaucauaaaauaa

SEQ ID NO: 1221215 - RNA, 21 nt, Human
cagagucaaugaacuuuccac

SEQ ID NO: 1221216 - RNA, 11 nt, Human
acugaggcaga

SEQ ID NO: 1221217 - RNA, 17 nt, Human
auuaauggaauauguaa

SEQ ID NO: 1221218 - RNA, 18 nt, Human
caagugauccgcccaucu

SEQ ID NO: 1221219 - RNA, 22 nt, Human
uuaacuugaaggaguccuugca

SEQ ID NO: 1221220 - RNA, 21 nt, Human
aaaaaaauauauauuguauua

SEQ ID NO: 1221221 - RNA, 18 nt, Human
caagaugugggcagugau

SEQ ID NO: 1221222 - RNA, 20 nt, Human
acuaaauaaagcuugcaaca

SEQ ID NO: 1221223 - RNA, 15 nt, Human
gcaucaauuuuucuu

SEQ ID NO: 1221224 - RNA, 15 nt, Human
uccuuguauuuaaau

SEQ ID NO: 1221225 - RNA, 16 nt, Human
agaagauagcagggca

SEQ ID NO: 1221226 - RNA, 15 nt, Human
uuuuacaauugaaau

SEQ ID NO: 1221227 - RNA, 17 nt, Human
cccaaagugcugggaau

SEQ ID NO: 1221228 - RNA, 14 nt, Human
gaccacaagcaggc

SEQ ID NO: 1221229 - RNA, 18 nt, Human
ucuccgucucccaaagug

SEQ ID NO: 1221230 - RNA, 15 nt, Human
gcugcccgucuucag

SEQ ID NO: 1221231 - RNA, 16 nt, Human
uuuaauuucaugaaaa

SEQ ID NO: 1221232 - RNA, 22 nt, Human
guauuuuuaccuuuuuccuucc

SEQ ID NO: 1221233 - RNA, 15 nt, Human
auaauaaaauucauu

SEQ ID NO: 1221234 - RNA, 12 nt, Human
gcgcagccaugu

SEQ ID NO: 1221235 - RNA, 19 nt, Human
cacuuuaacacagugucug

SEQ ID NO: 1221236 - RNA, 18 nt, Human
cuuuaauuucaugaaaag

SEQ ID NO: 1221237 - RNA, 19 nt, Human
uucccaaauuucauaccua

SEQ ID NO: 1221238 - RNA, 22 nt, Human
uagauaaagcacuguuuggaua

SEQ ID NO: 1221239 - RNA, 23 nt, Human
cauuguaaaugugcuuuuaaaaa

SEQ ID NO: 1221240 - RNA, 19 nt, Human
cauuuauuuccauauuaaa

SEQ ID NO: 1221241 - RNA, 21 nt, Human
gacugguucaaauguuguucu

SEQ ID NO: 1221242 - RNA, 14 nt, Human
ccagacacuuuuuu

SEQ ID NO: 1221243 - RNA, 19 nt, Human
auaaaauacauacuauaga

SEQ ID NO: 1221244 - RNA, 17 nt, Human
caguccucuuucaaagg

SEQ ID NO: 1221245 - RNA, 14 nt, Human
ugaaacaagaagcc

SEQ ID NO: 1221246 - RNA, 16 nt, Human
cacagccagacuggca

SEQ ID NO: 1221247 - RNA, 21 nt, Human
agaagagcuguucacagccag

SEQ ID NO: 1221248 - RNA, 21 nt, Human
uguacauuuccaaauucacaa

SEQ ID NO: 1221249 - RNA, 20 nt, Human
ucaaaauggagggaauaaua

SEQ ID NO: 1221250 - RNA, 19 nt, Human
aauguuacauuauuaucaa

SEQ ID NO: 1221251 - RNA, 18 nt, Human
cagaguacuggcugaugg

SEQ ID NO: 1221252 - RNA, 15 nt, Human
uuugguaaaauacuu

SEQ ID NO: 1221253 - RNA, 19 nt, Human
uaacauaagcuagaaaaau

SEQ ID NO: 1221254 - RNA, 15 nt, Human
aggcuccaaacugga

SEQ ID NO: 1221255 - RNA, 21 nt, Human
gugaaauaguucaaagccaag

SEQ ID NO: 1221256 - RNA, 17 nt, Human
ccuguguuacugauuug

SEQ ID NO: 1221257 - RNA, 22 nt, Human
aaguuguagguaauauugcaag

SEQ ID NO: 1221258 - RNA, 19 nt, Human
uaguaccaaucauuuuaau

SEQ ID NO: 1221259 - RNA, 15 nt, Human
auguauuuauaaaua

SEQ ID NO: 1221260 - RNA, 20 nt, Human
agcuugcaacaaaauucucu

SEQ ID NO: 1221261 - RNA, 17 nt, Human
uguuucgcugauauaug

SEQ ID NO: 1221262 - RNA, 13 nt, Human
ugcaacaaaauuc

SEQ ID NO: 1221263 - RNA, 14 nt, Human
aucauauaauaaau

SEQ ID NO: 1221264 - RNA, 17 nt, Human
uugaaggaguccuugca

SEQ ID NO: 1221265 - RNA, 13 nt, Human
ugauagcuuuauu

SEQ ID NO: 1221266 - RNA, 20 nt, Human
agcaagugaauuuuucucua

SEQ ID NO: 1221267 - RNA, 20 nt, Human
cagccuagccgaccucagcc

SEQ ID NO: 1221268 - RNA, 12 nt, Human
ugcuuuuaaaaa

SEQ ID NO: 1221269 - RNA, 23 nt, Human
uugucugaaauuuucuagaauac

SEQ ID NO: 1221270 - RNA, 15 nt, Human
uuuaauuucaugaaa

SEQ ID NO: 1221271 - RNA, 19 nt, Human
aaucacaaacucauccauu

SEQ ID NO: 1221272 - RNA, 16 nt, Human
auuaaaagaauauuuu

SEQ ID NO: 1221273 - RNA, 22 nt, Human
augaauuuuuuucaucuucucu

SEQ ID NO: 1221274 - RNA, 24 nt, Human
gcuccugucugccagccagcagcc

SEQ ID NO: 1221275 - RNA, 23 nt, Human
ucaaccaaauggagugacuuagu

SEQ ID NO: 1221276 - RNA, 17 nt, Human
agucauuuaauaaaugu

SEQ ID NO: 1221277 - RNA, 23 nt, Human
uguagauaaacucagaaauuuaa

SEQ ID NO: 1221278 - RNA, 15 nt, Human
auacacacucaaauc

SEQ ID NO: 1221279 - RNA, 15 nt, Human
cacuucacuuuuuuu

SEQ ID NO: 1221280 - RNA, 20 nt, Human
agcaaaaaaguacuuaaaac

SEQ ID NO: 1221281 - RNA, 19 nt, Human
agcagccagcucucagcca

SEQ ID NO: 1221282 - RNA, 15 nt, Human
uaaagcuuauuaaaa

SEQ ID NO: 1221283 - RNA, 13 nt, Human
gccaugcuggcca

SEQ ID NO: 1221284 - RNA, 20 nt, Human
uagcuuuacuguuuguuaug

SEQ ID NO: 1221285 - RNA, 14 nt, Human
uuauauauguauuu

SEQ ID NO: 1221286 - RNA, 15 nt, Human
aaguauuuauauauu

SEQ ID NO: 1221287 - RNA, 17 nt, Human
agugucuuaauuaaaag

SEQ ID NO: 1221288 - RNA, 18 nt, Human
uuaaaauguuagaaaaaa

SEQ ID NO: 1221289 - RNA, 22 nt, Human
agcauauguuuuuguaaguuua

SEQ ID NO: 1221290 - RNA, 15 nt, Human
cuauauuaucaugca

SEQ ID NO: 1221291 - RNA, 16 nt, Human
uaagaaauaugcacaa

SEQ ID NO: 1221292 - RNA, 16 nt, Human
aaaguacuuaaaacug

SEQ ID NO: 1221293 - RNA, 17 nt, Human
uaaagaauuuucaaaau

SEQ ID NO: 1221294 - RNA, 18 nt, Human
auuggggaagacuguggc

SEQ ID NO: 1221295 - RNA, 15 nt, Human
gucugccagccagca

SEQ ID NO: 1221296 - RNA, 17 nt, Human
auuauuuauauauguau

SEQ ID NO: 1221297 - RNA, 16 nt, Human
ucaucuuggucacaua

SEQ ID NO: 1221298 - RNA, 21 nt, Human
accuccaccuucuggguucaa

SEQ ID NO: 1221299 - RNA, 17 nt, Human
auguagcaaauuccaau

SEQ ID NO: 1221300 - RNA, 18 nt, Human
ucaaauuccagaaugauu

SEQ ID NO: 1221301 - RNA, 18 nt, Human
aauaaauuauuauuuaaa

SEQ ID NO: 1221302 - RNA, 14 nt, Human
caggcuacugucag

SEQ ID NO: 1221303 - RNA, 13 nt, Human
auuuuaaaauaaa

SEQ ID NO: 1221304 - RNA, 15 nt, Human
uccuguacuuuuucc

SEQ ID NO: 1221305 - RNA, 20 nt, Human
auuaaggcauaagaaaacua

SEQ ID NO: 1221306 - RNA, 16 nt, Human
ucacaaaucuuaacuu

SEQ ID NO: 1221307 - RNA, 18 nt, Human
gcuuucuaucuaauuuuu

SEQ ID NO: 1221308 - RNA, 12 nt, Human
guccucuuucaa

SEQ ID NO: 1221309 - RNA, 15 nt, Human
caccuucuggguuca

SEQ ID NO: 1221310 - RNA, 20 nt, Human
ucccuuuugcugccucuaaa

SEQ ID NO: 1221311 - RNA, 23 nt, Human
ugagucagucugaugagaacucu

SEQ ID NO: 1221312 - RNA, 12 nt, Human
uagaauacuaau

SEQ ID NO: 1221313 - RNA, 21 nt, Human
aaauccuuuacuguuagucau

SEQ ID NO: 1221314 - RNA, 23 nt, Human
caagggaguuaggcuauucacaa

SEQ ID NO: 1221315 - RNA, 14 nt, Human
agaguacuggcuga

SEQ ID NO: 1221316 - RNA, 13 nt, Human
auagaaggguacc

SEQ ID NO: 1221317 - RNA, 20 nt, Human
cagacuggcacaguuuucug

SEQ ID NO: 1221318 - RNA, 19 nt, Human
uauguaacugcauugagaa

SEQ ID NO: 1221319 - RNA, 18 nt, Human
auuugcugauugucugaa

SEQ ID NO: 1221320 - RNA, 22 nt, Human
cccuugccauggagguuaagca

SEQ ID NO: 1221321 - RNA, 19 nt, Human
cuucuggguucaagcgauu

SEQ ID NO: 1221322 - RNA, 17 nt, Human
cacuggcucccuggaag

SEQ ID NO: 1221323 - RNA, 17 nt, Human
gauuuuaaucuuuuucu

SEQ ID NO: 1221324 - RNA, 15 nt, Human
agaaauaaaguuggu

SEQ ID NO: 1221325 - RNA, 18 nt, Human
auuuauuuccauauuaaa

SEQ ID NO: 1221326 - RNA, 17 nt, Human
gcagggcauggcuggga

SEQ ID NO: 1221327 - RNA, 16 nt, Human
uaaggcauaagaaaac

SEQ ID NO: 1221328 - RNA, 22 nt, Human
aagcacuuuaacacagugucug

SEQ ID NO: 1221329 - RNA, 15 nt, Human
aaaguacuuaaaacu

SEQ ID NO: 1221330 - RNA, 15 nt, Human
auaaagaauuuuaaa

SEQ ID NO: 1221331 - RNA, 23 nt, Human
ggcaaagacuauucccuucuaac

SEQ ID NO: 1221332 - RNA, 21 nt, Human
aaacaaaaaaagcauuguaac

SEQ ID NO: 1221333 - RNA, 14 nt, Human
ggcgcgcgccacca

SEQ ID NO: 1221334 - RNA, 15 nt, Human
aggcuggagugcagu

SEQ ID NO: 1221335 - RNA, 14 nt, Human
uggagacaccacca

SEQ ID NO: 1221336 - RNA, 23 nt, Human
cuccuguacuuuuuccagacacu

SEQ ID NO: 1221337 - RNA, 20 nt, Human
ucaucugugauucccuccug

SEQ ID NO: 1221338 - RNA, 17 nt, Human
gccaaggguucagagac

SEQ ID NO: 1221339 - RNA, 18 nt, Human
uguauuuuuaccuuuuuc

SEQ ID NO: 1221340 - RNA, 22 nt, Human
auuacaguuagagauuuuuaaa

SEQ ID NO: 1221341 - RNA, 19 nt, Human
aaaucagaguuuucaugua

SEQ ID NO: 1221342 - RNA, 19 nt, Human
cauccauggugugcuggcu

SEQ ID NO: 1221343 - RNA, 14 nt, Human
cauguaauugcuug

SEQ ID NO: 1221344 - RNA, 17 nt, Human
uaaauccuuuacuguua

SEQ ID NO: 1221345 - RNA, 13 nt, Human
acccuugccaugg

SEQ ID NO: 1221346 - RNA, 13 nt, Human
cuugccugcaggc

SEQ ID NO: 1221347 - RNA, 22 nt, Human
cagcaggauagagugggacagu

SEQ ID NO: 1221348 - RNA, 15 nt, Human
auauucaaaaauuau

SEQ ID NO: 1221349 - RNA, 14 nt, Human
agcgcagccaugug

SEQ ID NO: 1221350 - RNA, 19 nt, Human
gacucauuuuaaaaaaugg

SEQ ID NO: 1221351 - RNA, 15 nt, Human
aaagaauauuuuaac

SEQ ID NO: 1221352 - RNA, 19 nt, Human
caaaugauuuucaaauuug

SEQ ID NO: 1221353 - RNA, 19 nt, Human
cauuucaaaagguauuuau

SEQ ID NO: 1221354 - RNA, 15 nt, Human
cauccugcaggcagc

SEQ ID NO: 1221355 - RNA, 16 nt, Human
gaggacuugggcggga

SEQ ID NO: 1221356 - RNA, 14 nt, Human
aaagaugaaaauau

SEQ ID NO: 1221357 - RNA, 13 nt, Human
acuguuugccuuc

SEQ ID NO: 1221358 - RNA, 15 nt, Human
agacuggaaggacca

SEQ ID NO: 1221359 - RNA, 10 nt, Human
caacauuaaa

SEQ ID NO: 1221360 - RNA, 22 nt, Human
cucccacuagacaaguccagcc

SEQ ID NO: 1221361 - RNA, 22 nt, Human
cugcuagaguucugucuggacu

SEQ ID NO: 1221362 - RNA, 18 nt, Human
ugaguggaugauguuucg

SEQ ID NO: 1221363 - RNA, 20 nt, Human
cuagagcacacuguagcauu

SEQ ID NO: 1221364 - RNA, 17 nt, Human
caguauucccuuuugcu

SEQ ID NO: 1221365 - RNA, 12 nt, Human
uuaucauuuuca

SEQ ID NO: 1221366 - RNA, 15 nt, Human
caaaacuuucuuuuc

SEQ ID NO: 1221367 - RNA, 13 nt, Human
gcaaccuccaccu

SEQ ID NO: 1221368 - RNA, 12 nt, Human
gucuucagccua

SEQ ID NO: 1221369 - RNA, 18 nt, Human
ucugggucucaguguccu

SEQ ID NO: 1221370 - RNA, 15 nt, Human
ucucagaaauuguau

SEQ ID NO: 1221371 - RNA, 21 nt, Human
ggccccagcacuaaagcagug

SEQ ID NO: 1221372 - RNA, 15 nt, Human
aagauuucuugaguu

SEQ ID NO: 1221373 - RNA, 19 nt, Human
acaauagcagacaguguuu

SEQ ID NO: 1221374 - RNA, 17 nt, Human
uuaccuuuguucccaaa

SEQ ID NO: 1221375 - RNA, 13 nt, Human
uuacacacauuaa

SEQ ID NO: 1221376 - RNA, 15 nt, Human
auauauguauuuaua

SEQ ID NO: 1221377 - RNA, 23 nt, Human
caccucaaaauaccaugccauuu

SEQ ID NO: 1221378 - RNA, 15 nt, Human
ucuuuucucugccuu

SEQ ID NO: 1221379 - RNA, 23 nt, Human
caacuuugaagucugauuuuccu

SEQ ID NO: 1221380 - RNA, 19 nt, Human
uaaauauauuuaagauaau

SEQ ID NO: 1221381 - RNA, 21 nt, Human
gcccaagggugggugggguga

SEQ ID NO: 1221382 - RNA, 17 nt, Human
ggaacccaaguccaagc

SEQ ID NO: 1221383 - RNA, 16 nt, Human
ugugauuacccucugg

SEQ ID NO: 1221384 - RNA, 16 nt, Human
cauccuuccucacacc

SEQ ID NO: 1221385 - RNA, 18 nt, Human
cuccucuguccagggccc

SEQ ID NO: 1221386 - RNA, 18 nt, Human
cuuuacuguuagucauuu

SEQ ID NO: 1221387 - RNA, 15 nt, Human
gggcuugaggacuug

SEQ ID NO: 1221388 - RNA, 18 nt, Human
gaugaucuuuaaaauaca

SEQ ID NO: 1221389 - RNA, 16 nt, Human
caccacccuugccaug

SEQ ID NO: 1221390 - RNA, 12 nt, Human
aaucaauguuuc

SEQ ID NO: 1221391 - RNA, 18 nt, Human
guaauauugcaaggcaaa

SEQ ID NO: 1221392 - RNA, 19 nt, Human
cuccgucucccaaagugcu

SEQ ID NO: 1221393 - RNA, 18 nt, Human
uuuccuucucaucuguga

SEQ ID NO: 1221394 - RNA, 13 nt, Human
uacauguuuucuu

SEQ ID NO: 1221395 - RNA, 21 nt, Human
caucauaaaauaaaguauaua

SEQ ID NO: 1221396 - RNA, 16 nt, Human
ugguagggggaaaaug

SEQ ID NO: 1221397 - RNA, 17 nt, Human
uuguuagcaaaauggau

SEQ ID NO: 1221398 - RNA, 20 nt, Human
auuuuuaaauaaagaauuuu

SEQ ID NO: 1221399 - RNA, 24 nt, Human
uggugugcuggcuuaaaauguaau

SEQ ID NO: 1221400 - RNA, 13 nt, Human
cugcuaccucacu

SEQ ID NO: 1221401 - RNA, 14 nt, Human
uucuagguucuaaa

SEQ ID NO: 1221402 - RNA, 16 nt, Human
auguaagggaaacugc

SEQ ID NO: 1221403 - RNA, 16 nt, Human
ucuaguacuugggaga

SEQ ID NO: 1221404 - RNA, 20 nt, Human
uggagaaaggacccucaaga

SEQ ID NO: 1221405 - RNA, 21 nt, Human
gaccuggucgucgucuugacu

SEQ ID NO: 1221406 - RNA, 19 nt, Human
auccauggugugcuggcuu

SEQ ID NO: 1221407 - RNA, 14 nt, Human
caacacuaacauau

SEQ ID NO: 1221408 - RNA, 21 nt, Human
cauacuauagauucuuuauua

SEQ ID NO: 1221409 - RNA, 23 nt, Human
agauuaugaucucagaaauugua

SEQ ID NO: 1221410 - RNA, 15 nt, Human
gaaauucugcaagcu

SEQ ID NO: 1221411 - RNA, 22 nt, Human
agugacuuaguguacaugaaag

SEQ ID NO: 1221412 - RNA, 15 nt, Human
uaucaguccucuuuc

SEQ ID NO: 1221413 - RNA, 23 nt, Human
uauggcauauugauaauaaaauu

SEQ ID NO: 1221414 - RNA, 16 nt, Human
uguaugacgugacugg

SEQ ID NO: 1221415 - RNA, 23 nt, Human
auuagggugguauuuagucuauu

SEQ ID NO: 1221416 - RNA, 21 nt, Human
acucaucauaaaauaaaguau

SEQ ID NO: 1221417 - RNA, 20 nt, Human
uagguucuaaaaauugugau

SEQ ID NO: 1221418 - RNA, 19 nt, Human
caaagaaauguaagggaaa

SEQ ID NO: 1221419 - RNA, 20 nt, Human
uuucuagggaaaugaaagaa

SEQ ID NO: 1221420 - RNA, 19 nt, Human
acaguuagagauuuuuaaa

SEQ ID NO: 1221421 - RNA, 14 nt, Human
uaauaaaauucauu

SEQ ID NO: 1221422 - RNA, 19 nt, Human
auaauguuacauuauuauc

SEQ ID NO: 1221423 - RNA, 20 nt, Human
accagccaaccugggggcuu

SEQ ID NO: 1221424 - RNA, 18 nt, Human
cucaaaucaagaaacuua

SEQ ID NO: 1221425 - RNA, 14 nt, Human
cgcgcgccaccacg

SEQ ID NO: 1221426 - RNA, 19 nt, Human
caguuagagauuuuuaaau

SEQ ID NO: 1221427 - RNA, 15 nt, Human
aguaagcaccuuuag

SEQ ID NO: 1221428 - RNA, 12 nt, Human
cacacagugcuu

SEQ ID NO: 1221429 - RNA, 14 nt, Human
uacaccccuccccu

SEQ ID NO: 1221430 - RNA, 14 nt, Human
aaauaaauuauuau

SEQ ID NO: 1221431 - RNA, 21 nt, Human
ugccuaucagcauuuuacuac

SEQ ID NO: 1221432 - RNA, 19 nt, Human
uagagauuuuuaaauaaag

SEQ ID NO: 1221433 - RNA, 13 nt, Human
ugaaagcguaaag

SEQ ID NO: 1221434 - RNA, 14 nt, Human
auaaauauauuuaa

SEQ ID NO: 1221435 - RNA, 14 nt, Human
ucuuguuuuuccac

SEQ ID NO: 1221436 - RNA, 13 nt, Human
auuacccucuggg

SEQ ID NO: 1221437 - RNA, 23 nt, Human
gggucucccucuguugccaaggc

SEQ ID NO: 1221438 - RNA, 18 nt, Human
uuugugaagaaacauuua

SEQ ID NO: 1221439 - RNA, 16 nt, Human
uugacaguucauaugu

SEQ ID NO: 1221440 - RNA, 24 nt, Human
acauuugcgaaugguuccauucuc

SEQ ID NO: 1221441 - RNA, 20 nt, Human
auuaaggcuucucuuaaaca

SEQ ID NO: 1221442 - RNA, 19 nt, Human
gcuggagugcaguggcgca

SEQ ID NO: 1221443 - RNA, 15 nt, Human
acuggccugcuggau

SEQ ID NO: 1221444 - RNA, 13 nt, Human
uaaaauaaauuau

SEQ ID NO: 1221445 - RNA, 17 nt, Human
uucuuauuucauuucuu

SEQ ID NO: 1221446 - RNA, 22 nt, Human
aaacauuucaaaagguauuuau

SEQ ID NO: 1221447 - RNA, 16 nt, Human
cagggucaggagaggg

SEQ ID NO: 1221448 - RNA, 16 nt, Human
gaggcagacagcagcu

SEQ ID NO: 1221449 - RNA, 10 nt, Human
acaagagacu

SEQ ID NO: 1221450 - RNA, 18 nt, Human
gauaauaugagaaucaga

SEQ ID NO: 1221451 - RNA, 16 nt, Human
gauagcuuuauuuuuu

SEQ ID NO: 1221452 - RNA, 22 nt, Human
uacagaauucugcuaccucacu

SEQ ID NO: 1221453 - RNA, 13 nt, Human
aagaugugggcag

SEQ ID NO: 1221454 - RNA, 18 nt, Human
aucauauuucaaaugauu

SEQ ID NO: 1221455 - RNA, 17 nt, Human
ccucugggucucagugu

SEQ ID NO: 1221456 - RNA, 14 nt, Human
ugucuuaauuaaaa

SEQ ID NO: 1221457 - RNA, 17 nt, Human
ugacagcccaagggugg

SEQ ID NO: 1221458 - RNA, 14 nt, Human
agcagccagcucuc

SEQ ID NO: 1221459 - RNA, 15 nt, Human
gacugaauuucuaug

SEQ ID NO: 1221460 - RNA, 14 nt, Human
aaguaauuucagaa

SEQ ID NO: 1221461 - RNA, 15 nt, Human
cauguacauccaugg

SEQ ID NO: 1221462 - RNA, 14 nt, Human
aaagaauuuuaaaa

SEQ ID NO: 1221463 - RNA, 14 nt, Human
guccuggggccucg

SEQ ID NO: 1221464 - RNA, 21 nt, Human
aauggauaugacacaucucug

SEQ ID NO: 1221465 - RNA, 17 nt, Human
uuaaacuggaaauaaaa

SEQ ID NO: 1221466 - RNA, 20 nt, Human
ugaaauuuucuagaauacua

SEQ ID NO: 1221467 - RNA, 20 nt, Human
cuuuuuuuuuuuuuuaaaca

SEQ ID NO: 1221468 - RNA, 20 nt, Human
aaauaaauuauuauuuaaac

SEQ ID NO: 1221469 - RNA, 14 nt, Human
cuccaccuucuggg

SEQ ID NO: 1221470 - RNA, 12 nt, Human
ucacauacaauu

SEQ ID NO: 1221471 - RNA, 17 nt, Human
gaacuuuccacauucag

SEQ ID NO: 1221472 - RNA, 16 nt, Human
agugggacaguuccug

SEQ ID NO: 1221473 - RNA, 17 nt, Human
auagauucccugagcag

SEQ ID NO: 1221474 - RNA, 19 nt, Human
uauaggugcuacaaaaaca

SEQ ID NO: 1221475 - RNA, 15 nt, Human
gacucauuuuaaaaa

SEQ ID NO: 1221476 - RNA, 21 nt, Human
cuugaggacuugggcgggaca

SEQ ID NO: 1221477 - RNA, 20 nt, Human
ucaaauuugaugaaaucaga

SEQ ID NO: 1221478 - RNA, 16 nt, Human
aguaacggaacaguau

SEQ ID NO: 1221479 - RNA, 16 nt, Human
aacucaucauaaaaua

SEQ ID NO: 1221480 - RNA, 19 nt, Human
acucaaaucaagaaacuua

SEQ ID NO: 1221481 - RNA, 23 nt, Human
agcagugcuugaaugaaguugua

SEQ ID NO: 1221482 - RNA, 16 nt, Human
uuuccacuacugcuac

SEQ ID NO: 1221483 - RNA, 17 nt, Human
caccccuccccugcccu

SEQ ID NO: 1221484 - RNA, 17 nt, Human
ccucggagccucauccg

SEQ ID NO: 1221485 - RNA, 20 nt, Human
aguaugcacuaaucaauacu

SEQ ID NO: 1221486 - RNA, 21 nt, Human
cggagccucauccgaggcagg

SEQ ID NO: 1221487 - RNA, 11 nt, Human
aaggcuggagu

SEQ ID NO: 1221488 - RNA, 16 nt, Human
agaaagacuauucaaa

SEQ ID NO: 1221489 - RNA, 19 nt, Human
aucuguaaaauggagacac

SEQ ID NO: 1221490 - RNA, 15 nt, Human
guacuggcugaugga

SEQ ID NO: 1221491 - RNA, 14 nt, Human
aaugagcaaaaguu

SEQ ID NO: 1221492 - RNA, 20 nt, Human
cagagacgggguuugccaug

SEQ ID NO: 1221493 - RNA, 15 nt, Human
uguuuuuaaacugga

SEQ ID NO: 1221494 - RNA, 14 nt, Human
uaaaaccacagcag

SEQ ID NO: 1221495 - RNA, 17 nt, Human
ccucaguuuuaucauuu

SEQ ID NO: 1221496 - RNA, 13 nt, Human
agggucucccucu

SEQ ID NO: 1221497 - RNA, 14 nt, Human
ucauccgaggcagg

SEQ ID NO: 1221498 - RNA, 23 nt, Human
uuaucagucauaacuaaauaaag

SEQ ID NO: 1221499 - RNA, 22 nt, Human
ccucauccgaggcagggucagg

SEQ ID NO: 1221500 - RNA, 21 nt, Human
caguagcagcagcaucucuga

SEQ ID NO: 1221501 - RNA, 12 nt, Human
caggucucaugg

SEQ ID NO: 1221502 - RNA, 11 nt, Human
uuuuuaaacaa

SEQ ID NO: 1221503 - RNA, 17 nt, Human
gagggggcgcgugcagg

SEQ ID NO: 1221504 - RNA, 16 nt, Human
uauuauuuauauaugu

SEQ ID NO: 1221505 - RNA, 18 nt, Human
ucacagaggaucugcuug

SEQ ID NO: 1221506 - RNA, 14 nt, Human
uuaugaaacauuac

SEQ ID NO: 1221507 - RNA, 15 nt, Human
aaagcauuguaaaug

SEQ ID NO: 1221508 - RNA, 22 nt, Human
uguuaaaagaugaaaauauuug

SEQ ID NO: 1221509 - RNA, 17 nt, Human
ugggaaagcauuguaaa

SEQ ID NO: 1221510 - RNA, 24 nt, Human
gacccacuucacacacaggcaacu

SEQ ID NO: 1221511 - RNA, 13 nt, Human
agaauucugcuac

SEQ ID NO: 1221512 - RNA, 22 nt, Human
agacauguggugggacagggac

SEQ ID NO: 1221513 - RNA, 15 nt, Human
uuuaaagacaaagac

SEQ ID NO: 1221514 - RNA, 22 nt, Human
gcaaccuccaccuucuggguuc

SEQ ID NO: 1221515 - RNA, 17 nt, Human
cuacaagcuaaaauuag

SEQ ID NO: 1221516 - RNA, 16 nt, Human
aucauauaauaaaugu

SEQ ID NO: 1221517 - RNA, 12 nt, Human
aaugaaagaaag

SEQ ID NO: 1221518 - RNA, 21 nt, Human
gagggaauaauaccuaagccu

SEQ ID NO: 1221519 - RNA, 21 nt, Human
guuacucugaagggcaucaug

SEQ ID NO: 1221520 - RNA, 17 nt, Human
uuccuuagcuuagaccu

SEQ ID NO: 1221521 - RNA, 14 nt, Human
auauuuaagauaau

SEQ ID NO: 1221522 - RNA, 15 nt, Human
aaacuaauagaauua

SEQ ID NO: 1221523 - RNA, 22 nt, Human
gcgacaguuuuccuucucaucu

SEQ ID NO: 1221524 - RNA, 23 nt, Human
cauucucucuccuguacuuuuuc

SEQ ID NO: 1221525 - RNA, 16 nt, Human
ucaaagccaaguuuau

SEQ ID NO: 1221526 - RNA, 16 nt, Human
acuuaaaaucuaauuc

SEQ ID NO: 1221527 - RNA, 19 nt, Human
uuuaugcauacaguaauuu

SEQ ID NO: 1221528 - RNA, 18 nt, Human
uuuuuaauuauuauuuau

SEQ ID NO: 1221529 - RNA, 20 nt, Human
uuuauaacucaucauaaaau

SEQ ID NO: 1221530 - RNA, 20 nt, Human
uuuugugaagaaacauuuau

SEQ ID NO: 1221531 - RNA, 22 nt, Human
uaaaauacacacucaaaucaag

SEQ ID NO: 1221532 - RNA, 21 nt, Human
uccugagaccagccaaccugg

SEQ ID NO: 1221533 - RNA, 15 nt, Human
uucacacacaggcaa

SEQ ID NO: 1221534 - RNA, 21 nt, Human
gccgcuccugucugccagcca

SEQ ID NO: 1221535 - RNA, 20 nt, Human
ccuuagcuuagaccucagcc

SEQ ID NO: 1221536 - RNA, 21 nt, Human
uuuacacacauuaaaauguua

SEQ ID NO: 1221537 - RNA, 14 nt, Human
gccuuccccuugcc

SEQ ID NO: 1221538 - RNA, 16 nt, Human
uuuacaauugaaauga

SEQ ID NO: 1221539 - RNA, 12 nt, Human
cucuaacucaga

SEQ ID NO: 1221540 - RNA, 14 nt, Human
caucugcagcucuu

SEQ ID NO: 1221541 - RNA, 19 nt, Human
aagacucuacccauauuac

SEQ ID NO: 1221542 - RNA, 15 nt, Human
cugcuggauguggag

SEQ ID NO: 1221543 - RNA, 10 nt, Human
uguguauuuu

SEQ ID NO: 1221544 - RNA, 20 nt, Human
auugguuuaccugugaaaua

SEQ ID NO: 1221545 - RNA, 22 nt, Human
uggugggccuccucuguccagg

SEQ ID NO: 1221546 - RNA, 18 nt, Human
agugucuuaauuaaaaga

SEQ ID NO: 1221547 - RNA, 16 nt, Human
aaauuugaugaaauca

SEQ ID NO: 1221548 - RNA, 20 nt, Human
aaauguuauuuuuuaauuau

SEQ ID NO: 1221549 - RNA, 21 nt, Human
auugaaaugacuaaaaaacaa

SEQ ID NO: 1221550 - RNA, 17 nt, Human
cauggagguuaagcacu

SEQ ID NO: 1221551 - RNA, 16 nt, Human
gucuuaauuaaaagaa

SEQ ID NO: 1221552 - RNA, 15 nt, Human
guuuccuagcgcagc

SEQ ID NO: 1221553 - RNA, 21 nt, Human
aauuucucccagucauuuaau

SEQ ID NO: 1221554 - RNA, 19 nt, Human
gugauucacccugauuuua

SEQ ID NO: 1221555 - RNA, 22 nt, Human
guaauuuaagauuuuguuuuua

SEQ ID NO: 1221556 - RNA, 18 nt, Human
aauagcagacaguguuuu

SEQ ID NO: 1221557 - RNA, 23 nt, Human
ugucccuacaccccuccccugcc

SEQ ID NO: 1221558 - RNA, 16 nt, Human
aaacaucagcaaaaaa

SEQ ID NO: 1221559 - RNA, 18 nt, Human
gcacuaaagcaguggaca

SEQ ID NO: 1221560 - RNA, 21 nt, Human
gugacauguuuacaaaccuca

SEQ ID NO: 1221561 - RNA, 23 nt, Human
ugccucuaaaaggccugucccug

SEQ ID NO: 1221562 - RNA, 14 nt, Human
augaaacauuacag

SEQ ID NO: 1221563 - RNA, 14 nt, Human
auacaguaauuuua

SEQ ID NO: 1221564 - RNA, 22 nt, Human
gaagaguggguuucacaaguga

SEQ ID NO: 1221565 - RNA, 20 nt, Human
uuucagaagaaauucugcaa

SEQ ID NO: 1221566 - RNA, 19 nt, Human
cuugaaacugagaugugaa

SEQ ID NO: 1221567 - RNA, 23 nt, Human
acuuccuuggacucauuuuaaaa

SEQ ID NO: 1221568 - RNA, 16 nt, Human
ugacaagguucuuccc

SEQ ID NO: 1221569 - RNA, 15 nt, Human
acaaccugucccagc

SEQ ID NO: 1221570 - RNA, 21 nt, Human
caagggugaugggaaagcauu

SEQ ID NO: 1221571 - RNA, 21 nt, Human
cagcauuuuacuacuuuaaaa

SEQ ID NO: 1221572 - RNA, 18 nt, Human
cagccuagccgaccucag

SEQ ID NO: 1221573 - RNA, 21 nt, Human
cauuuuacuacuuuaaaaaaa

SEQ ID NO: 1221574 - RNA, 12 nt, Human
acauaagcuaga

SEQ ID NO: 1221575 - RNA, 23 nt, Human
gcuuuuuuuuuuuuucuuaaaga

SEQ ID NO: 1221576 - RNA, 15 nt, Human
gugcaggcagcagga

SEQ ID NO: 1221577 - RNA, 16 nt, Human
auuuuaaguaauuuca

SEQ ID NO: 1221578 - RNA, 16 nt, Human
aaaaauuaauucuuua

SEQ ID NO: 1221579 - RNA, 15 nt, Human
auuauuaccuuacag

SEQ ID NO: 1221580 - RNA, 15 nt, Human
ggauagagugggaca

SEQ ID NO: 1221581 - RNA, 24 nt, Human
aaaggccugucccugcagacauga

SEQ ID NO: 1221582 - RNA, 16 nt, Human
auuugcaaccccauca

SEQ ID NO: 1221583 - RNA, 15 nt, Human
cagugucaggaggaa

SEQ ID NO: 1221584 - RNA, 14 nt, Human
caucaauuuuucuu

SEQ ID NO: 1221585 - RNA, 20 nt, Human
ugagcagugcuugaaugaag

SEQ ID NO: 1221586 - RNA, 16 nt, Human
gaggcuuugcauagau

SEQ ID NO: 1221587 - RNA, 14 nt, Human
uaucuuguuuuucc

SEQ ID NO: 1221588 - RNA, 18 nt, Human
auaauguuguuauuuaaa

SEQ ID NO: 1221589 - RNA, 14 nt, Human
ugaaacaacaaaua

SEQ ID NO: 1221590 - RNA, 17 nt, Human
auuuuaauuauuauucu

SEQ ID NO: 1221591 - RNA, 17 nt, Human
aaaucacaaacucaucc

SEQ ID NO: 1221592 - RNA, 21 nt, Human
gaaucacucauuuauuuccau

SEQ ID NO: 1221593 - RNA, 13 nt, Human
acaugaagaagcu

SEQ ID NO: 1221594 - RNA, 23 nt, Human
auagcauauguuuuuguaaguuu

SEQ ID NO: 1221595 - RNA, 20 nt, Human
aagcauaccaacacgagcag

SEQ ID NO: 1221596 - RNA, 22 nt, Human
uaaacuggaaauaaaagauugu

SEQ ID NO: 1221597 - RNA, 15 nt, Human
cucauuuuaaaaaau

SEQ ID NO: 1221598 - RNA, 13 nt, Human
aauuugaugaaau

SEQ ID NO: 1221599 - RNA, 12 nt, Human
acuuguugagau

SEQ ID NO: 1221600 - RNA, 14 nt, Human
gccccgggaguggc

SEQ ID NO: 1221601 - RNA, 18 nt, Human
auuguguguuauuuaaau

SEQ ID NO: 1221602 - RNA, 16 nt, Human
aaauaugcaaagcacu

SEQ ID NO: 1221603 - RNA, 22 nt, Human
auucccugagcaggauuuuaau

SEQ ID NO: 1221604 - RNA, 14 nt, Human
gaaacauuacaguu

SEQ ID NO: 1221605 - RNA, 18 nt, Human
gccuaucagcauuuuacu

SEQ ID NO: 1221606 - RNA, 16 nt, Human
gacaaccaugagacca

SEQ ID NO: 1221607 - RNA, 11 nt, Human
uccauuguaau

SEQ ID NO: 1221608 - RNA, 15 nt, Human
acauuuaucuuugua

SEQ ID NO: 1221609 - RNA, 23 nt, Human
gcuauucacaaccacucauucaa

SEQ ID NO: 1221610 - RNA, 12 nt, Human
cagccagcagcc

SEQ ID NO: 1221611 - RNA, 17 nt, Human
uccuacaagcuaaaauu

SEQ ID NO: 1221612 - RNA, 14 nt, Human
acacauuaaaaugu

SEQ ID NO: 1221613 - RNA, 20 nt, Human
ggcaggucacacaaccuguc

SEQ ID NO: 1221614 - RNA, 15 nt, Human
guugccaaggcugga

SEQ ID NO: 1221615 - RNA, 14 nt, Human
aacugaagccagaa

SEQ ID NO: 1221616 - RNA, 22 nt, Human
aguguugacaguucauauguac

SEQ ID NO: 1221617 - RNA, 13 nt, Human
uuaugaaacauua

SEQ ID NO: 1221618 - RNA, 18 nt, Human
uuuaaaauacacacucaa

SEQ ID NO: 1221619 - RNA, 21 nt, Human
uggcuuaaaauguaauuaauc

SEQ ID NO: 1221620 - RNA, 22 nt, Human
uagcagacaguguuuucuggga

SEQ ID NO: 1221621 - RNA, 18 nt, Human
aauuaaaagaauauuuua

SEQ ID NO: 1221622 - RNA, 18 nt, Human
gccccgggaguggcgcgc

SEQ ID NO: 1221623 - RNA, 12 nt, Human
auugauaauaaa

SEQ ID NO: 1221624 - RNA, 17 nt, Human
uugaacaacucgaauca

SEQ ID NO: 1221625 - RNA, 17 nt, Human
ccuggugggccuccucu

SEQ ID NO: 1221626 - RNA, 16 nt, Human
auaaaaugagcaaaag

SEQ ID NO: 1221627 - RNA, 13 nt, Human
cuauuuaaagaca

SEQ ID NO: 1221628 - RNA, 15 nt, Human
aaucacucauuuauu

SEQ ID NO: 1221629 - RNA, 20 nt, Human
uggagccaaggguucagaga

SEQ ID NO: 1221630 - RNA, 20 nt, Human
ucauauuucaaaugauuuuc

SEQ ID NO: 1221631 - RNA, 13 nt, Human
augacccccaucc

SEQ ID NO: 1221632 - RNA, 12 nt, Human
acaucagcuugc

SEQ ID NO: 1221633 - RNA, 17 nt, Human
aaauaaagaauuuuaaa

SEQ ID NO: 1221634 - RNA, 21 nt, Human
uugagugucuuaauuaaaaga

SEQ ID NO: 1221635 - RNA, 21 nt, Human
aaugacacuagcuaauaucaa

SEQ ID NO: 1221636 - RNA, 14 nt, Human
auugauaauaaaau

SEQ ID NO: 1221637 - RNA, 23 nt, Human
uccguggcacugcauacaaucug

SEQ ID NO: 1221638 - RNA, 22 nt, Human
agcuugcccuguuaaaagauga

SEQ ID NO: 1221639 - RNA, 20 nt, Human
ccaccuucuggguucaagcg

SEQ ID NO: 1221640 - RNA, 17 nt, Human
aaaugugcuuuuaaaaa

SEQ ID NO: 1221641 - RNA, 15 nt, Human
uuuaugcauacagua

SEQ ID NO: 1221642 - RNA, 14 nt, Human
ccucagccuucccc

SEQ ID NO: 1221643 - RNA, 21 nt, Human
uucgcugauauauguguuuuu

SEQ ID NO: 1221644 - RNA, 12 nt, Human
cuuuuaaaaaaa

SEQ ID NO: 1221645 - RNA, 22 nt, Human
aaaagauuaugaucucagaaau

SEQ ID NO: 1221646 - RNA, 21 nt, Human
acuugggcgggacacaggcuc

SEQ ID NO: 1221647 - RNA, 20 nt, Human
agauucauuuuucuuucuga

SEQ ID NO: 1221648 - RNA, 23 nt, Human
cuaaauaaagcuugcaacaaaau

SEQ ID NO: 1221649 - RNA, 17 nt, Human
ugaauuuccuaucugua

SEQ ID NO: 1221650 - RNA, 19 nt, Human
acugcuggauucaagugau

SEQ ID NO: 1221651 - RNA, 16 nt, Human
cugauggguuucucca

SEQ ID NO: 1221652 - RNA, 22 nt, Human
cugaggcauccuuccucacacc

SEQ ID NO: 1221653 - RNA, 13 nt, Human
gcgugcaggcagc

SEQ ID NO: 1221654 - RNA, 19 nt, Human
gauccgcccaucuccgucu

SEQ ID NO: 1221655 - RNA, 24 nt, Human
cuugaacacugggggaggggacau

SEQ ID NO: 1221656 - RNA, 21 nt, Human
gagcucgguggacccagggau

SEQ ID NO: 1221657 - RNA, 18 nt, Human
cuuggacucauuuuaaaa

SEQ ID NO: 1221658 - RNA, 17 nt, Human
guguauuuucagcagag

SEQ ID NO: 1221659 - RNA, 21 nt, Human
uagcagacaguguuuucuggg

SEQ ID NO: 1221660 - RNA, 15 nt, Human
auuuuaacuuccuug

SEQ ID NO: 1221661 - RNA, 20 nt, Human
uuuaugaaacauuacaguua

SEQ ID NO: 1221662 - RNA, 21 nt, Human
cugaggcagacagcagcucag

SEQ ID NO: 1221663 - RNA, 22 nt, Human
aggugcuacaaaaacacagcaa

SEQ ID NO: 1221664 - RNA, 15 nt, Human
gcaaaaaaguacuua

SEQ ID NO: 1221665 - RNA, 14 nt, Human
cauuuccaaauuca

SEQ ID NO: 1221666 - RNA, 16 nt, Human
uaauuuaagauuuugu

SEQ ID NO: 1221667 - RNA, 23 nt, Human
aguguccucaucuguaaaaugga

SEQ ID NO: 1221668 - RNA, 22 nt, Human
uggugugcuggcuuaaaaugua

SEQ ID NO: 1221669 - RNA, 18 nt, Human
uggaauauguaaauagaa

SEQ ID NO: 1221670 - RNA, 15 nt, Human
caaauucuguuucuu

SEQ ID NO: 1221671 - RNA, 20 nt, Human
uuguagguaauauugcaagg

SEQ ID NO: 1221672 - RNA, 15 nt, Human
gcuacaaaaacacag

SEQ ID NO: 1221673 - RNA, 19 nt, Human
uucucuaacucagaaacau

SEQ ID NO: 1221674 - RNA, 23 nt, Human
acaguguuuucugggauaaguaa

SEQ ID NO: 1221675 - RNA, 14 nt, Human
uacaguaauuuuaa

SEQ ID NO: 1221676 - RNA, 21 nt, Human
uuauccggucggguuuuauug

SEQ ID NO: 1221677 - RNA, 13 nt, Human
cuccugucugcca

SEQ ID NO: 1221678 - RNA, 17 nt, Human
uuacacacauuaaaaug

SEQ ID NO: 1221679 - RNA, 20 nt, Human
auaguucaaagccaaguuua

SEQ ID NO: 1221680 - RNA, 21 nt, Human
aggcagcuuuuucucucccac

SEQ ID NO: 1221681 - RNA, 17 nt, Human
agaaggauguacauuuc

SEQ ID NO: 1221682 - RNA, 16 nt, Human
aacucuuaaucaaaua

SEQ ID NO: 1221683 - RNA, 16 nt, Human
gcuugccugcaggcau

SEQ ID NO: 1221684 - RNA, 12 nt, Human
uuuuuguaaguu

SEQ ID NO: 1221685 - RNA, 14 nt, Human
aucuguaugucugc

SEQ ID NO: 1221686 - RNA, 13 nt, Human
guccucuuucaaa

SEQ ID NO: 1221687 - RNA, 22 nt, Human
aaugaaagaaaggccagcaaau

SEQ ID NO: 1221688 - RNA, 14 nt, Human
ucauccucaggccu

SEQ ID NO: 1221689 - RNA, 21 nt, Human
ugcaucaauuuuucuuauuuc

SEQ ID NO: 1221690 - RNA, 16 nt, Human
aucaaauaugcaaagc

SEQ ID NO: 1221691 - RNA, 18 nt, Human
acagcuucucauccugca

SEQ ID NO: 1221692 - RNA, 17 nt, Human
aacguguauauuuuuua

SEQ ID NO: 1221693 - RNA, 14 nt, Human
auuuucccaaaacu

SEQ ID NO: 1221694 - RNA, 17 nt, Human
acaucagcaaaaaagua

SEQ ID NO: 1221695 - RNA, 11 nt, Human
cagcaaauucg

SEQ ID NO: 1221696 - RNA, 15 nt, Human
gagaaucagaucauu

SEQ ID NO: 1221697 - RNA, 15 nt, Human
cugucugccagccag

SEQ ID NO: 1221698 - RNA, 16 nt, Human
caaauaugcaaagcac

SEQ ID NO: 1221699 - RNA, 14 nt, Human
cagcagagacgggg

SEQ ID NO: 1221700 - RNA, 14 nt, Human
uguacuuuuuccag

SEQ ID NO: 1221701 - RNA, 22 nt, Human
acacagugucuggcacuuggga

SEQ ID NO: 1221702 - RNA, 21 nt, Human
uuucauuaucucaaaacugca

SEQ ID NO: 1221703 - RNA, 19 nt, Human
aauuaauggaauauguaaa

SEQ ID NO: 1221704 - RNA, 21 nt, Human
caagcuuuuuuuuuuuuucuu

SEQ ID NO: 1221705 - RNA, 21 nt, Human
agcucgguggacccagggaug

SEQ ID NO: 1221706 - RNA, 12 nt, Human
aauuuuucucua

SEQ ID NO: 1221707 - RNA, 21 nt, Human
ucucagaaauuguaucuuagu

SEQ ID NO: 1221708 - RNA, 13 nt, Human
caaauuuguauuu

SEQ ID NO: 1221709 - RNA, 20 nt, Human
gccauggagguuaagcacuu

SEQ ID NO: 1221710 - RNA, 20 nt, Human
aacuaauagaauuaauggaa

SEQ ID NO: 1221711 - RNA, 14 nt, Human
gaaggcuuacaccc

SEQ ID NO: 1221712 - RNA, 14 nt, Human
gccugucccugcag

SEQ ID NO: 1221713 - RNA, 19 nt, Human
aauucuaaaugaauguuua

SEQ ID NO: 1221714 - RNA, 22 nt, Human
ucauugcaaccuccaccuucug

SEQ ID NO: 1221715 - RNA, 22 nt, Human
auguacauuuccaaauucacaa

SEQ ID NO: 1221716 - RNA, 14 nt, Human
agacuccaaagaaa

SEQ ID NO: 1221717 - RNA, 23 nt, Human
gcccugagcucgguggacccagg

SEQ ID NO: 1221718 - RNA, 22 nt, Human
cugauauauguguuuuucacau

SEQ ID NO: 1221719 - RNA, 19 nt, Human
acuuuuuuuuuuuuuuaaa

SEQ ID NO: 1221720 - RNA, 13 nt, Human
agaauauuaaaaa

SEQ ID NO: 1221721 - RNA, 21 nt, Human
cuuuuaaguugcugaugaacu

SEQ ID NO: 1221722 - RNA, 14 nt, Human
uuucugcuuuaauu

SEQ ID NO: 1221723 - RNA, 20 nt, Human
uauauguguuuuucacauuu

SEQ ID NO: 1221724 - RNA, 21 nt, Human
ugguaauaaguacuguguaca

SEQ ID NO: 1221725 - RNA, 21 nt, Human
uuguaauucuaaaugaauguu

SEQ ID NO: 1221726 - RNA, 15 nt, Human
uguaccauguacaug

SEQ ID NO: 1221727 - RNA, 19 nt, Human
ugacuucuaaguaaaacca

SEQ ID NO: 1221728 - RNA, 15 nt, Human
cacacauuaaaaugu

SEQ ID NO: 1221729 - RNA, 14 nt, Human
aaaccacagcaguu

SEQ ID NO: 1221730 - RNA, 17 nt, Human
gacaguuccugagacca

SEQ ID NO: 1221731 - RNA, 19 nt, Human
ccuuggacucauuuuaaaa

SEQ ID NO: 1221732 - RNA, 21 nt, Human
aacagucucaggaaaucaaau

SEQ ID NO: 1221733 - RNA, 20 nt, Human
cgaccucagccuuccccuug

SEQ ID NO: 1221734 - RNA, 14 nt, Human
caaacucauccauu

SEQ ID NO: 1221735 - RNA, 14 nt, Human
auuuuaaaauaaau

SEQ ID NO: 1221736 - RNA, 19 nt, Human
auguaagggaaacugccag

SEQ ID NO: 1221737 - RNA, 12 nt, Human
guauauucaaaa

SEQ ID NO: 1221738 - RNA, 17 nt, Human
gacuuccauuuggaauc

SEQ ID NO: 1221739 - RNA, 15 nt, Human
ggcagcuuuuucucu

SEQ ID NO: 1221740 - RNA, 19 nt, Human
aucauuauuugcagagaca

SEQ ID NO: 1221741 - RNA, 13 nt, Human
aaauaaauuauua

SEQ ID NO: 1221742 - RNA, 19 nt, Human
uaagcaacaucuagcaaau

SEQ ID NO: 1221743 - RNA, 22 nt, Human
uaagcaccuuuagaauauuaaa

SEQ ID NO: 1221744 - RNA, 19 nt, Human
cagaguuuucauguauuuu

SEQ ID NO: 1221745 - RNA, 17 nt, Human
cccuagagcacacugua

SEQ ID NO: 1221746 - RNA, 13 nt, Human
ggccuggcuggga

SEQ ID NO: 1221747 - RNA, 15 nt, Human
ggaggguuagggagg

SEQ ID NO: 1221748 - RNA, 15 nt, Human
uauuagccacaaaau

SEQ ID NO: 1221749 - RNA, 21 nt, Human
uuuucucuaacucagaaacau

SEQ ID NO: 1221750 - RNA, 18 nt, Human
cauauaauaaauguacau

SEQ ID NO: 1221751 - RNA, 13 nt, Human
uagaauacuaaua

SEQ ID NO: 1221752 - RNA, 23 nt, Human
uaguaccaaucauuuuaauuauu

SEQ ID NO: 1221753 - RNA, 13 nt, Human
gcuuuaaguguaa

SEQ ID NO: 1221754 - RNA, 20 nt, Human
acaguuuucugagaaagacu

SEQ ID NO: 1221755 - RNA, 16 nt, Human
auacaguaauuuuaag

SEQ ID NO: 1221756 - RNA, 18 nt, Human
aagucugauuuuccugga

SEQ ID NO: 1221757 - RNA, 17 nt, Human
caaagcacgaaauguua

SEQ ID NO: 1221758 - RNA, 18 nt, Human
gaaacguguauauuuuuu

SEQ ID NO: 1221759 - RNA, 15 nt, Human
uguguguuauuuaaa

SEQ ID NO: 1221760 - RNA, 14 nt, Human
uagcaaauguuaug

SEQ ID NO: 1221761 - RNA, 14 nt, Human
accuucuggguuca

SEQ ID NO: 1221762 - RNA, 22 nt, Human
acaagcaggcucaacauaacau

SEQ ID NO: 1221763 - RNA, 13 nt, Human
guuacucugaagg

SEQ ID NO: 1221764 - RNA, 22 nt, Human
aucauaaaauaaaguauauaua

SEQ ID NO: 1221765 - RNA, 14 nt, Human
acacacauuaaaau

SEQ ID NO: 1221766 - RNA, 19 nt, Human
auauuuuuuaugaaacauu

SEQ ID NO: 1221767 - RNA, 16 nt, Human
aacuggacugguucaa

SEQ ID NO: 1221768 - RNA, 23 nt, Human
auaccuaucaucuuaaguaggga

SEQ ID NO: 1221769 - RNA, 16 nt, Human
ugaugaucuuuaaaau

SEQ ID NO: 1221770 - RNA, 18 nt, Human
aaacaucagcaaaaaagu

SEQ ID NO: 1221771 - RNA, 12 nt, Human
cgggaaggaggg

SEQ ID NO: 1221772 - RNA, 19 nt, Human
cuugcccuguuaaaagaug

SEQ ID NO: 1221773 - RNA, 13 nt, Human
aaucaauacuuug

SEQ ID NO: 1221774 - RNA, 15 nt, Human
uuguuauuuaaagaa

SEQ ID NO: 1221775 - RNA, 14 nt, Human
uacuguauuuuuac

SEQ ID NO: 1221776 - RNA, 23 nt, Human
acugauuuggccguuuugugaag

SEQ ID NO: 1221777 - RNA, 13 nt, Human
ucaucauaaaaua

SEQ ID NO: 1221778 - RNA, 18 nt, Human
caccuuuagaauauuaaa

SEQ ID NO: 1221779 - RNA, 23 nt, Human
agcuuuuuuuuuuuuucuuaaag

SEQ ID NO: 1221780 - RNA, 18 nt, Human
ucuccuguacuuuuucca

SEQ ID NO: 1221781 - RNA, 11 nt, Human
cuuaaaacugu

SEQ ID NO: 1221782 - RNA, 11 nt, Human
uccucuuucaa

SEQ ID NO: 1221783 - RNA, 16 nt, Human
gcaagcuuuucaaaau

SEQ ID NO: 1221784 - RNA, 17 nt, Human
aagcugaauacauucug

SEQ ID NO: 1221785 - RNA, 23 nt, Human
aguaauuuauuguuuuuccuugu

SEQ ID NO: 1221786 - RNA, 13 nt, Human
ugaaacaacaaau

SEQ ID NO: 1221787 - RNA, 14 nt, Human
gcauucucugaaga

SEQ ID NO: 1221788 - RNA, 23 nt, Human
auucuuacauguuuucuuugcuu

SEQ ID NO: 1221789 - RNA, 18 nt, Human
auauaauguuguuauuua

SEQ ID NO: 1221790 - RNA, 15 nt, Human
gggacagggacccac

SEQ ID NO: 1221791 - RNA, 15 nt, Human
uugaaauagugucug

SEQ ID NO: 1221792 - RNA, 17 nt, Human
caucagcugcugaaaca

SEQ ID NO: 1221793 - RNA, 14 nt, Human
cuuuccagagacca

SEQ ID NO: 1221794 - RNA, 13 nt, Human
gguggggugaggg

SEQ ID NO: 1221795 - RNA, 21 nt, Human
augggaaagcauuguaaaugu

SEQ ID NO: 1221796 - RNA, 18 nt, Human
cugauauauguguuuuuc

SEQ ID NO: 1221797 - RNA, 16 nt, Human
uaaauguacauuaauu

SEQ ID NO: 1221798 - RNA, 15 nt, Human
aauauaauaugcaca

SEQ ID NO: 1221799 - RNA, 13 nt, Human
cuggcuuaaaaug

SEQ ID NO: 1221800 - RNA, 18 nt, Human
guuuaugcauacaguaau

SEQ ID NO: 1221801 - RNA, 22 nt, Human
aaauauauuuaagauaauuaua

SEQ ID NO: 1221802 - RNA, 23 nt, Human
gaaacguguauauuuuuuaugaa

SEQ ID NO: 1221803 - RNA, 15 nt, Human
cacuuuaacacagug

SEQ ID NO: 1221804 - RNA, 14 nt, Human
ucucccucuguugc

SEQ ID NO: 1221805 - RNA, 17 nt, Human
cugcaggcgugaccuga

SEQ ID NO: 1221806 - RNA, 18 nt, Human
cagcuugcccuguuaaaa

SEQ ID NO: 1221807 - RNA, 16 nt, Human
uugucugaaauuuucu

SEQ ID NO: 1221808 - RNA, 12 nt, Human
uuauuauuuaua

SEQ ID NO: 1221809 - RNA, 19 nt, Human
accacagcaguugaaaaga

SEQ ID NO: 1221810 - RNA, 21 nt, Human
acuccuaguaauuuaagauuu

SEQ ID NO: 1221811 - RNA, 15 nt, Human
acuuaugaaccuuua

SEQ ID NO: 1221812 - RNA, 18 nt, Human
aggaaggcuuacacccac

SEQ ID NO: 1221813 - RNA, 15 nt, Human
aaauuauauuuugaa

SEQ ID NO: 1221814 - RNA, 11 nt, Human
ucuuuucucug

SEQ ID NO: 1221815 - RNA, 14 nt, Human
auuacaucuuucac

SEQ ID NO: 1221816 - RNA, 12 nt, Human
cagggcauggcu

SEQ ID NO: 1221817 - RNA, 13 nt, Human
aagaaacauuuau

SEQ ID NO: 1221818 - RNA, 18 nt, Human
ucuaauuuuuauuaauuu

SEQ ID NO: 1221819 - RNA, 19 nt, Human
cacagcaguugaaaagacu

SEQ ID NO: 1221820 - RNA, 19 nt, Human
ugcuuguuagcaaaaugga

SEQ ID NO: 1221821 - RNA, 16 nt, Human
uuuuaaaaaaaaauac

SEQ ID NO: 1221822 - RNA, 20 nt, Human
uuucaaauuugaugaaauca

SEQ ID NO: 1221823 - RNA, 17 nt, Human
aaaauguuagaaaaaau

SEQ ID NO: 1221824 - RNA, 16 nt, Human
aaagcaguggacacca

SEQ ID NO: 1221825 - RNA, 12 nt, Human
agcuugcaacaa

SEQ ID NO: 1221826 - RNA, 20 nt, Human
accaaucauuuuaauuauua

SEQ ID NO: 1221827 - RNA, 13 nt, Human
accgaguggcccu

SEQ ID NO: 1221828 - RNA, 16 nt, Human
uaaaaucuaauucaaa

SEQ ID NO: 1221829 - RNA, 14 nt, Human
auuauaauauacua

SEQ ID NO: 1221830 - RNA, 18 nt, Human
gccuccucuguccagggc

SEQ ID NO: 1221831 - RNA, 15 nt, Human
aauuguaucuuaguu

SEQ ID NO: 1221832 - RNA, 18 nt, Human
gauagguuaccaguaacg

SEQ ID NO: 1221833 - RNA, 16 nt, Human
gcuugcccuguuaaaa

SEQ ID NO: 1221834 - RNA, 18 nt, Human
auuucaugauuucauuuc

SEQ ID NO: 1221835 - RNA, 21 nt, Human
auguuauguauuauuauuccc

SEQ ID NO: 1221836 - RNA, 19 nt, Human
cugcuggauucaagugauc

SEQ ID NO: 1221837 - RNA, 15 nt, Human
acuacuuuaaaaaaa

SEQ ID NO: 1221838 - RNA, 18 nt, Human
gccuuccccuugcccagg

SEQ ID NO: 1221839 - RNA, 12 nt, Human
guauauauagaa

SEQ ID NO: 1221840 - RNA, 16 nt, Human
auuuuacuuuuccauu

SEQ ID NO: 1221841 - RNA, 14 nt, Human
auuccaccugcaau

SEQ ID NO: 1221842 - RNA, 16 nt, Human
uccucacaccaggcuu

SEQ ID NO: 1221843 - RNA, 18 nt, Human
caguauucccuuuugcug

SEQ ID NO: 1221844 - RNA, 16 nt, Human
acuaaagcaguggaca

SEQ ID NO: 1221845 - RNA, 14 nt, Human
acuggaaggaccau

SEQ ID NO: 1221846 - RNA, 18 nt, Human
uggccaggcuggucucga

SEQ ID NO: 1221847 - RNA, 17 nt, Human
ugaaaucagaguuuuca

SEQ ID NO: 1221848 - RNA, 18 nt, Human
uugcauagauucccugag

SEQ ID NO: 1221849 - RNA, 12 nt, Human
uacaauugaaau

SEQ ID NO: 1221850 - RNA, 14 nt, Human
uaauuauuauucuu

SEQ ID NO: 1221851 - RNA, 22 nt, Human
cauuuaaagcuuauuaaaacuc

SEQ ID NO: 1221852 - RNA, 22 nt, Human
uguaauuaaucuuguaaauaua

SEQ ID NO: 1221853 - RNA, 16 nt, Human
cagacaugagagacag

SEQ ID NO: 1221854 - RNA, 17 nt, Human
ucauccugcaggcagcu

SEQ ID NO: 1221855 - RNA, 22 nt, Human
auuuuacacacauuaaaauguu

SEQ ID NO: 1221856 - RNA, 23 nt, Human
ccuucauccucugagugugacca

SEQ ID NO: 1221857 - RNA, 12 nt, Human
cacacucaaauc

SEQ ID NO: 1221858 - RNA, 20 nt, Human
ucaugcaaaugcuguauucu

SEQ ID NO: 1221859 - RNA, 17 nt, Human
augaucuuuaaaauaca

SEQ ID NO: 1221860 - RNA, 16 nt, Human
uuaaagcuuauuaaaa

SEQ ID NO: 1221861 - RNA, 21 nt, Human
aggugcuacaaaaacacagca

SEQ ID NO: 1221862 - RNA, 13 nt, Human
aaaaguauauuca

SEQ ID NO: 1221863 - RNA, 19 nt, Human
cacaguuuucugagaaaga

SEQ ID NO: 1221864 - RNA, 12 nt, Human
uuuuuuuuaaac

SEQ ID NO: 1221865 - RNA, 21 nt, Human
caccagggccuggcugggagu

SEQ ID NO: 1221866 - RNA, 21 nt, Human
ugaagguaaaauugaaaggca

SEQ ID NO: 1221867 - RNA, 13 nt, Human
uuagaauauuaaa

SEQ ID NO: 1221868 - RNA, 18 nt, Human
ucacauuggcuauuuaaa

SEQ ID NO: 1221869 - RNA, 17 nt, Human
gucacacaaccuguccc

SEQ ID NO: 1221870 - RNA, 14 nt, Human
uuuuaauuauuauu

SEQ ID NO: 1221871 - RNA, 20 nt, Human
caugagagacagcaggucuc

SEQ ID NO: 1221872 - RNA, 17 nt, Human
auauauguauuuauaaa

SEQ ID NO: 1221873 - RNA, 16 nt, Human
uuccauauuaaaauca

SEQ ID NO: 1221874 - RNA, 14 nt, Human
cuaaagcaguggac

SEQ ID NO: 1221875 - RNA, 18 nt, Human
gagugucuuaauuaaaag

SEQ ID NO: 1221876 - RNA, 17 nt, Human
aguaauuucagaagaaa

SEQ ID NO: 1221877 - RNA, 14 nt, Human
ugagcaaaaguuga

SEQ ID NO: 1221878 - RNA, 15 nt, Human
ucuuguuuuuccacu

SEQ ID NO: 1221879 - RNA, 17 nt, Human
ugcacuaaucaauacuu

SEQ ID NO: 1221880 - RNA, 19 nt, Human
uacugagccuuguaauucu

SEQ ID NO: 1221881 - RNA, 21 nt, Human
uuuuaaguaauuucagaagaa

SEQ ID NO: 1221882 - RNA, 17 nt, Human
accagggccuggcuggg

SEQ ID NO: 1221883 - RNA, 12 nt, Human
aaggccuguccc

SEQ ID NO: 1221884 - RNA, 22 nt, Human
uuccuuggacucauuuuaaaaa

SEQ ID NO: 1221885 - RNA, 23 nt, Human
agaccauaauguuacauuauuau

SEQ ID NO: 1221886 - RNA, 15 nt, Human
ucucauccugcaggc

SEQ ID NO: 1221887 - RNA, 14 nt, Human
cugccgcaacaguu

SEQ ID NO: 1221888 - RNA, 20 nt, Human
ugcccgucuucagccuagcc

SEQ ID NO: 1221889 - RNA, 12 nt, Human
ucuuuaaaauac

SEQ ID NO: 1221890 - RNA, 18 nt, Human
augaaaucagaguuuuca

SEQ ID NO: 1221891 - RNA, 22 nt, Human
uuucugagaaagacuauucaaa

SEQ ID NO: 1221892 - RNA, 15 nt, Human
acuccaaagaaaugu

SEQ ID NO: 1221893 - RNA, 16 nt, Human
auauccaaagcugaau

SEQ ID NO: 1221894 - RNA, 19 nt, Human
caaaaguauauucaaaaau

SEQ ID NO: 1221895 - RNA, 15 nt, Human
ccacuucacuuuuuu

SEQ ID NO: 1221896 - RNA, 19 nt, Human
gauugauagaguguuauca

SEQ ID NO: 1221897 - RNA, 14 nt, Human
cagugucaggagga

SEQ ID NO: 1221898 - RNA, 17 nt, Human
uaagaaauaugcacaau

SEQ ID NO: 1221899 - RNA, 22 nt, Human
ugaagaaacauuuaucuuugua

SEQ ID NO: 1221900 - RNA, 17 nt, Human
augcacacagugcuuuc

SEQ ID NO: 1221901 - RNA, 14 nt, Human
aauacuaauaaaau

SEQ ID NO: 1221902 - RNA, 13 nt, Human
gcgggacacaggc

SEQ ID NO: 1221903 - RNA, 13 nt, Human
ccagccagcagcc

SEQ ID NO: 1221904 - RNA, 19 nt, Human
aacuauauuaucaugcaaa

SEQ ID NO: 1221905 - RNA, 17 nt, Human
cugucugccagccagca

SEQ ID NO: 1221906 - RNA, 20 nt, Human
gaaaagacuccaaagaaaug

SEQ ID NO: 1221907 - RNA, 15 nt, Human
uucuuugagugucuu

SEQ ID NO: 1221908 - RNA, 21 nt, Human
aaaauacauacuauagauucu

SEQ ID NO: 1221909 - RNA, 12 nt, Human
uacuaauaaaau

SEQ ID NO: 1221910 - RNA, 15 nt, Human
uuuccaaauucacaa

SEQ ID NO: 1221911 - RNA, 23 nt, Human
acuggacugguucaaauguuguu

SEQ ID NO: 1221912 - RNA, 17 nt, Human
ucagccuuccccuugcc

SEQ ID NO: 1221913 - RNA, 14 nt, Human
cuuaugaaccuuua

SEQ ID NO: 1221914 - RNA, 20 nt, Human
auuauuguguguuauuuaaa

SEQ ID NO: 1221915 - RNA, 16 nt, Human
auacaauuauuuuuac

SEQ ID NO: 1221916 - RNA, 12 nt, Human
gccaaggcugga

SEQ ID NO: 1221917 - RNA, 17 nt, Human
cauucaaaaguugaaau

SEQ ID NO: 1221918 - RNA, 17 nt, Human
cuaucagcauuuuacua

SEQ ID NO: 1221919 - RNA, 15 nt, Human
uccgucucccaaagu

SEQ ID NO: 1221920 - RNA, 22 nt, Human
uauauauuuauaacucaucaua

SEQ ID NO: 1221921 - RNA, 22 nt, Human
gauaauaaaauucauuccauuu

SEQ ID NO: 1221922 - RNA, 14 nt, Human
uccuaguaauuuaa

SEQ ID NO: 1221923 - RNA, 20 nt, Human
aucaaauuccagaaugauuu

SEQ ID NO: 1221924 - RNA, 18 nt, Human
auacuaauaaaauacaua

SEQ ID NO: 1221925 - RNA, 20 nt, Human
uaaagaauuuucaaaaucaa

SEQ ID NO: 1221926 - RNA, 22 nt, Human
aacaucagcaaaaaaguacuua

SEQ ID NO: 1221927 - RNA, 19 nt, Human
agagacgggguuugccaug

SEQ ID NO: 1221928 - RNA, 17 nt, Human
uuucaaaacucauuucc

SEQ ID NO: 1221929 - RNA, 16 nt, Human
uagagugggacaguuc

SEQ ID NO: 1221930 - RNA, 19 nt, Human
uaaagaacacccuauauuu

SEQ ID NO: 1221931 - RNA, 12 nt, Human
ggccccagcacu

SEQ ID NO: 1221932 - RNA, 14 nt, Human
agggccccagcacu

SEQ ID NO: 1221933 - RNA, 15 nt, Human
gaggggacauugaac

SEQ ID NO: 1221934 - RNA, 15 nt, Human
acucagggccccagc

SEQ ID NO: 1221935 - RNA, 24 nt, Human
aaagacagcuucucauccugcagg

SEQ ID NO: 1221936 - RNA, 20 nt, Human
aucagcuugcccuguuaaaa

SEQ ID NO: 1221937 - RNA, 20 nt, Human
gugagccaccaaacccggcc

SEQ ID NO: 1221938 - RNA, 16 nt, Human
ucuaauuuuuauuaau

SEQ ID NO: 1221939 - RNA, 18 nt, Human
uggcauauugauaauaaa

SEQ ID NO: 1221940 - RNA, 15 nt, Human
uuucuugaguuuugu

SEQ ID NO: 1221941 - RNA, 15 nt, Human
aaccugggggcuuua

SEQ ID NO: 1221942 - RNA, 16 nt, Human
uuaaacuggaaauaaa

SEQ ID NO: 1221943 - RNA, 14 nt, Human
uucacaagugaaaa

SEQ ID NO: 1221944 - RNA, 16 nt, Human
agcucaggcacacuuc

SEQ ID NO: 1221945 - RNA, 19 nt, Human
ggcaaggguucaccugggc

SEQ ID NO: 1221946 - RNA, 21 nt, Human
uauauauguauuuauaaauau

SEQ ID NO: 1221947 - RNA, 17 nt, Human
uguuaucagucauaacu

SEQ ID NO: 1221948 - RNA, 15 nt, Human
auuauucccauucua

SEQ ID NO: 1221949 - RNA, 15 nt, Human
acaaagacaaauucu

SEQ ID NO: 1221950 - RNA, 13 nt, Human
uuucuaucuaauu

SEQ ID NO: 1221951 - RNA, 16 nt, Human
uauauguguuuuucac

SEQ ID NO: 1221952 - RNA, 16 nt, Human
uucuggguucaagcga

SEQ ID NO: 1221953 - RNA, 12 nt, Human
uagggaccugcu

SEQ ID NO: 1221954 - RNA, 18 nt, Human
uguuauuuuuuaauuauu

SEQ ID NO: 1221955 - RNA, 19 nt, Human
aaugaaauggugaaaugca

SEQ ID NO: 1221956 - RNA, 19 nt, Human
aggucacacaaccuguccc

SEQ ID NO: 1221957 - RNA, 17 nt, Human
gucugccagccagcagc

SEQ ID NO: 1221958 - RNA, 18 nt, Human
ugcuuguuagcaaaaugg

SEQ ID NO: 1221959 - RNA, 13 nt, Human
auaauaaauguac

SEQ ID NO: 1221960 - RNA, 17 nt, Human
augcauacaguaauuuu

SEQ ID NO: 1221961 - RNA, 15 nt, Human
aaaagaauauuuuaa

SEQ ID NO: 1221962 - RNA, 19 nt, Human
auuucauaccuaucaucuu

SEQ ID NO: 1221963 - RNA, 16 nt, Human
aauuuauuaugagacu

SEQ ID NO: 1221964 - RNA, 12 nt, Human
cuggccaggcug

SEQ ID NO: 1221965 - RNA, 16 nt, Human
cugauacuuuuuucau

SEQ ID NO: 1221966 - RNA, 15 nt, Human
gauuccugagccagu

SEQ ID NO: 1221967 - RNA, 17 nt, Human
auauuuuuuaugaaaca

SEQ ID NO: 1221968 - RNA, 21 nt, Human
acuggcucccuggaagagauc

SEQ ID NO: 1221969 - RNA, 21 nt, Human
auaaaugugccuucauuuuuu

SEQ ID NO: 1221970 - RNA, 18 nt, Human
gauggguuugacaagguu

SEQ ID NO: 1221971 - RNA, 20 nt, Human
ucucuccuguacuuuuucca

SEQ ID NO: 1221972 - RNA, 14 nt, Human
uaucauuuucaaaa

SEQ ID NO: 1221973 - RNA, 14 nt, Human
auggugugcuggcu

SEQ ID NO: 1221974 - RNA, 14 nt, Human
gacuggccugcugg

SEQ ID NO: 1221975 - RNA, 18 nt, Human
uuuguacguucuucuauu

SEQ ID NO: 1221976 - RNA, 13 nt, Human
uugauaauaaaau

SEQ ID NO: 1221977 - RNA, 15 nt, Human
uauaauauacuauau

SEQ ID NO: 1221978 - RNA, 18 nt, Human
auaaaguauauauagaau

SEQ ID NO: 1221979 - RNA, 13 nt, Human
auagcauauguuu

SEQ ID NO: 1221980 - RNA, 17 nt, Human
agggauggcaagaugug

SEQ ID NO: 1221981 - RNA, 17 nt, Human
caacugaggcagacagc

SEQ ID NO: 1221982 - RNA, 13 nt, Human
gaaguugcagauu

SEQ ID NO: 1221983 - RNA, 12 nt, Human
acuaauaaaaua

SEQ ID NO: 1221984 - RNA, 23 nt, Human
aaauuaaggcuucucuuaaacac

SEQ ID NO: 1221985 - RNA, 14 nt, Human
auaaagaauuuuaa

SEQ ID NO: 1221986 - RNA, 13 nt, Human
aaaaagccaaaaa

SEQ ID NO: 1221987 - RNA, 15 nt, Human
ugccagccagcagcc

SEQ ID NO: 1221988 - RNA, 18 nt, Human
ccugcuggauguggaggg

SEQ ID NO: 1221989 - RNA, 23 nt, Human
aguucugucuggacuuuccagag

SEQ ID NO: 1221990 - RNA, 15 nt, Human
aacaucuagcaaaug

SEQ ID NO: 1221991 - RNA, 14 nt, Human
gaugaucuuuaaaa

SEQ ID NO: 1221992 - RNA, 18 nt, Human
auuaucucaaaacugcac

SEQ ID NO: 1221993 - RNA, 17 nt, Human
agcacuaaagcagugga

SEQ ID NO: 1221994 - RNA, 20 nt, Human
uggacuuuccagagaccagu

SEQ ID NO: 1221995 - RNA, 16 nt, Human
cuuaaagaauuuucaa

SEQ ID NO: 1221996 - RNA, 19 nt, Human
cuagaauacuaauaaaaua

SEQ ID NO: 1221997 - RNA, 14 nt, Human
gugagccaccaaac

SEQ ID NO: 1221998 - RNA, 13 nt, Human
agggcucagccug

SEQ ID NO: 1221999 - RNA, 23 nt, Human
aacagucucaggaaaucaaauau

SEQ ID NO: 1222000 - RNA, 18 nt, Human
auuaugaucucagaaauu

SEQ ID NO: 1222001 - RNA, 19 nt, Human
aaauaaauuauuauuuaaa

SEQ ID NO: 1222002 - RNA, 17 nt, Human
caagaagccacagaccu

SEQ ID NO: 1222003 - RNA, 15 nt, Human
gggauuagggagaga

SEQ ID NO: 1222004 - RNA, 22 nt, Human
caagaugaugaugaucuuuaaa

SEQ ID NO: 1222005 - RNA, 18 nt, Human
agaaauaugcacaauagc

SEQ ID NO: 1222006 - RNA, 17 nt, Human
agcuugcccuguuaaaa

SEQ ID NO: 1222007 - RNA, 18 nt, Human
gaacacugggggagggga

SEQ ID NO: 1222008 - RNA, 19 nt, Human
cuuuuuuuuuuuuuuaaac

SEQ ID NO: 1222009 - RNA, 20 nt, Human
auauugauaauaaaauucau

SEQ ID NO: 1222010 - RNA, 14 nt, Human
gaaaggagaaguua

SEQ ID NO: 1222011 - RNA, 14 nt, Human
ugagaccagccaac

SEQ ID NO: 1222012 - RNA, 17 nt, Human
agcccaagauaucagcc

SEQ ID NO: 1222013 - RNA, 22 nt, Human
gaccuguaaucauauaauaaau

SEQ ID NO: 1222014 - RNA, 12 nt, Human
cauuugcugagc

SEQ ID NO: 1222015 - RNA, 24 nt, Human
uuaaacaaaaaaagcauuguaacu

SEQ ID NO: 1222016 - RNA, 21 nt, Human
ugugauucacccugauuuuac

SEQ ID NO: 1222017 - RNA, 19 nt, Human
accugucccagcgagggac

SEQ ID NO: 1222018 - RNA, 19 nt, Human
auuaucuaucuaucuauuu

SEQ ID NO: 1222019 - RNA, 17 nt, Human
uuuccacauucagagcu

SEQ ID NO: 1222020 - RNA, 18 nt, Human
uccuacaagcuaaaauua

SEQ ID NO: 1222021 - RNA, 22 nt, Human
cuaaguaaaaccacagcaguug

SEQ ID NO: 1222022 - RNA, 14 nt, Human
cuuguauuuuacuu

SEQ ID NO: 1222023 - RNA, 18 nt, Human
aaauauauuuaagauaau

SEQ ID NO: 1222024 - RNA, 23 nt, Human
uagucauuugcugagcauguacu

SEQ ID NO: 1222025 - RNA, 16 nt, Human
gccucuaaaaggccug

SEQ ID NO: 1222026 - RNA, 20 nt, Human
aacucugcauucuaguacuu

SEQ ID NO: 1222027 - RNA, 14 nt, Human
cugauuuuccugga

SEQ ID NO: 1222028 - RNA, 18 nt, Human
agagauuuuuaaauaaag

SEQ ID NO: 1222029 - RNA, 11 nt, Human
ggcacuuggga

SEQ ID NO: 1222030 - RNA, 22 nt, Human
caaccaaauggagugacuuagu

SEQ ID NO: 1222031 - RNA, 18 nt, Human
aauuccaccugcaaucaa

SEQ ID NO: 1222032 - RNA, 17 nt, Human
gucauaacuaaauaaag

SEQ ID NO: 1222033 - RNA, 13 nt, Human
uggcaagaugugg

SEQ ID NO: 1222034 - RNA, 18 nt, Human
gaaagaggcagcuugaaa

SEQ ID NO: 1222035 - RNA, 13 nt, Human
aaaaaaaaauacu

SEQ ID NO: 1222036 - RNA, 19 nt, Human
aaaaagcauuguaacuuau

SEQ ID NO: 1222037 - RNA, 14 nt, Human
aaaggccugucccu

SEQ ID NO: 1222038 - RNA, 16 nt, Human
gucucccaaagugcug

SEQ ID NO: 1222039 - RNA, 16 nt, Human
agacaaauucuguuuc

SEQ ID NO: 1222040 - RNA, 19 nt, Human
ugcaccaacuuugaagucu

SEQ ID NO: 1222041 - RNA, 12 nt, Human
ccuggcugggag

SEQ ID NO: 1222042 - RNA, 13 nt, Human
uguuagcaaaaug

SEQ ID NO: 1222043 - RNA, 21 nt, Human
guauuuuuaccuuuuuccuuc

SEQ ID NO: 1222044 - RNA, 14 nt, Human
ucuacuuuuaaguu

SEQ ID NO: 1222045 - RNA, 16 nt, Human
uucacauccuguguuu

SEQ ID NO: 1222046 - RNA, 21 nt, Human
guaaucauauaauaaauguac

SEQ ID NO: 1222047 - RNA, 12 nt, Human
guacuuaaaacu

SEQ ID NO: 1222048 - RNA, 13 nt, Human
auugcauuaaaua

SEQ ID NO: 1222049 - RNA, 19 nt, Human
cggagccccuugggcaggu

SEQ ID NO: 1222050 - RNA, 16 nt, Human
uuucuuaaagaauuuu

SEQ ID NO: 1222051 - RNA, 15 nt, Human
uggcaguuuuccauu

SEQ ID NO: 1222052 - RNA, 22 nt, Human
aggaaaucaaauaugcaaagca

SEQ ID NO: 1222053 - RNA, 20 nt, Human
gaaaucaaauaugcaaagca

SEQ ID NO: 1222054 - RNA, 23 nt, Human
auucucucuccuguacuuuuucc

SEQ ID NO: 1222055 - RNA, 15 nt, Human
caggcagcuuuuucu

SEQ ID NO: 1222056 - RNA, 15 nt, Human
agaggggcagaacag

SEQ ID NO: 1222057 - RNA, 12 nt, Human
aauuagaugaac

SEQ ID NO: 1222058 - RNA, 21 nt, Human
ggcuuguaaaguacagacuuu

SEQ ID NO: 1222059 - RNA, 22 nt, Human
acuuaagguuaccuuuguuccc

SEQ ID NO: 1222060 - RNA, 21 nt, Human
ugagggcuugaggacuugggc

SEQ ID NO: 1222061 - RNA, 16 nt, Human
aguauucccuuuugcu

SEQ ID NO: 1222062 - RNA, 16 nt, Human
aucagcccaaaaguca

SEQ ID NO: 1222063 - RNA, 19 nt, Human
gaauuacaggcgugagcca

SEQ ID NO: 1222064 - RNA, 14 nt, Human
aucaugcaucuuac

SEQ ID NO: 1222065 - RNA, 21 nt, Human
acucugaagggcaucaugcau

SEQ ID NO: 1222066 - RNA, 16 nt, Human
uaugaaccuuuacauc

SEQ ID NO: 1222067 - RNA, 16 nt, Human
acacacauuaaaaugu

SEQ ID NO: 1222068 - RNA, 17 nt, Human
uagcauaaguuucuggg

SEQ ID NO: 1222069 - RNA, 17 nt, Human
uauuuuaacuuccuugg

SEQ ID NO: 1222070 - RNA, 13 nt, Human
acuagggcaggga

SEQ ID NO: 1222071 - RNA, 14 nt, Human
uagcauauguuuuu

SEQ ID NO: 1222072 - RNA, 16 nt, Human
gaugaucuuuaaaaua

SEQ ID NO: 1222073 - RNA, 13 nt, Human
cagcucucagcca

SEQ ID NO: 1222074 - RNA, 21 nt, Human
guaaaauacuucuugaagccg

SEQ ID NO: 1222075 - RNA, 13 nt, Human
acucauuuuaaaa

SEQ ID NO: 1222076 - RNA, 21 nt, Human
ucagccuuccccuugcccagg

SEQ ID NO: 1222077 - RNA, 14 nt, Human
cucuucuuuaaagg

SEQ ID NO: 1222078 - RNA, 20 nt, Human
gcacaguuuucugagaaaga

SEQ ID NO: 1222079 - RNA, 19 nt, Human
caccaacuuugaagucuga

SEQ ID NO: 1222080 - RNA, 21 nt, Human
uuuuaaauaaagaauuuuaaa

SEQ ID NO: 1222081 - RNA, 20 nt, Human
ugcauugagaacugcauaug

SEQ ID NO: 1222082 - RNA, 13 nt, Human
cugcuuucaucuu

SEQ ID NO: 1222083 - RNA, 19 nt, Human
ugaaaagacuccaaagaaa

SEQ ID NO: 1222084 - RNA, 15 nt, Human
cuacaccccuccccu

SEQ ID NO: 1222085 - RNA, 12 nt, Human
uacccucugggu

SEQ ID NO: 1222086 - RNA, 19 nt, Human
gaauuuuuuucaucuucuc

SEQ ID NO: 1222087 - RNA, 23 nt, Human
auuuaaagcuuauuaaaacucau

SEQ ID NO: 1222088 - RNA, 16 nt, Human
cuggcaguuuuccauu

SEQ ID NO: 1222089 - RNA, 12 nt, Human
gggaggggacau

SEQ ID NO: 1222090 - RNA, 15 nt, Human
uuccuucucaucugu

SEQ ID NO: 1222091 - RNA, 22 nt, Human
ucaguugauuuuacaauugaaa

SEQ ID NO: 1222092 - RNA, 16 nt, Human
ugcuccuggcuggggc

SEQ ID NO: 1222093 - RNA, 20 nt, Human
acaucucugauacuuuuuuc

SEQ ID NO: 1222094 - RNA, 18 nt, Human
cucauccugcaggcagcu

SEQ ID NO: 1222095 - RNA, 13 nt, Human
uauuucauuucuu

SEQ ID NO: 1222096 - RNA, 20 nt, Human
uaaaauucauuccauuugcu

SEQ ID NO: 1222097 - RNA, 18 nt, Human
aucauuucaaaacucauu

SEQ ID NO: 1222098 - RNA, 14 nt, Human
gagcaggcuacugu

SEQ ID NO: 1222099 - RNA, 17 nt, Human
ucccaaagugcugggaa

SEQ ID NO: 1222100 - RNA, 17 nt, Human
cuuuagggaccugcugu

SEQ ID NO: 1222101 - RNA, 22 nt, Human
gaauuaauggaauauguaaaua

SEQ ID NO: 1222102 - RNA, 23 nt, Human
cuuuggcaaaugagccggagccc

SEQ ID NO: 1222103 - RNA, 18 nt, Human
ccacauucagagcuuacu

SEQ ID NO: 1222104 - RNA, 23 nt, Human
ucacaccaggcuugccugcaggc

SEQ ID NO: 1222105 - RNA, 19 nt, Human
aaaauggagggaauaauac

SEQ ID NO: 1222106 - RNA, 19 nt, Human
agacuccaaagaaauguaa

SEQ ID NO: 1222107 - RNA, 17 nt, Human
ggcuugaggacuugggc

SEQ ID NO: 1222108 - RNA, 11 nt, Human
uuaauuaaaag

SEQ ID NO: 1222109 - RNA, 21 nt, Human
cagucucaggaaaucaaauau

SEQ ID NO: 1222110 - RNA, 22 nt, Human
uuccuagcgcagccaugugauu

SEQ ID NO: 1222111 - RNA, 22 nt, Human
caaaaacaaacaaacgaaaaac

SEQ ID NO: 1222112 - RNA, 20 nt, Human
gcaccuuuagaauauuaaaa

SEQ ID NO: 1222113 - RNA, 20 nt, Human
uggcauauugauaauaaaau

SEQ ID NO: 1222114 - RNA, 15 nt, Human
gcagagacgggguuu

SEQ ID NO: 1222115 - RNA, 17 nt, Human
ggcaacugaggcagaca

SEQ ID NO: 1222116 - RNA, 17 nt, Human
ugaucagaccauaaugu

SEQ ID NO: 1222117 - RNA, 21 nt, Human
cuuucaucuuggucacauaca

SEQ ID NO: 1222118 - RNA, 16 nt, Human
cuggauguggaggggg

SEQ ID NO: 1222119 - RNA, 21 nt, Human
cauuguaaaugugcuuuuaaa

SEQ ID NO: 1222120 - RNA, 18 nt, Human
ucacaaaaguauauucaa

SEQ ID NO: 1222121 - RNA, 13 nt, Human
aagcauuguaaau

SEQ ID NO: 1222122 - RNA, 21 nt, Human
agcuaaguugcaccaacuuug

SEQ ID NO: 1222123 - RNA, 16 nt, Human
auguauuuuaaaauaa

SEQ ID NO: 1222124 - RNA, 19 nt, Human
ugucuggcacuugggacaa

SEQ ID NO: 1222125 - RNA, 19 nt, Human
aauuguuuuuauggaggcu

SEQ ID NO: 1222126 - RNA, 16 nt, Human
augugaacacaucagc

SEQ ID NO: 1222127 - RNA, 19 nt, Human
uagcaagugaauuuuucuc

SEQ ID NO: 1222128 - RNA, 19 nt, Human
agggacaggauaagaggga

SEQ ID NO: 1222129 - RNA, 18 nt, Human
aaacuguaaauuuauuau

SEQ ID NO: 1222130 - RNA, 21 nt, Human
acaauuauuuuuacaguucuc

SEQ ID NO: 1222131 - RNA, 22 nt, Human
guuuucauuaucucaaaacugc

SEQ ID NO: 1222132 - RNA, 13 nt, Human
uuauaauauacua

SEQ ID NO: 1222133 - RNA, 20 nt, Human
agauaucccaggaaaauuaa

SEQ ID NO: 1222134 - RNA, 14 nt, Human
aguugaaaagacuc

SEQ ID NO: 1222135 - RNA, 18 nt, Human
guucaaagccaaguuuau

SEQ ID NO: 1222136 - RNA, 14 nt, Human
uacuuuguccuuuu

SEQ ID NO: 1222137 - RNA, 16 nt, Human
agccgagccucaagau

SEQ ID NO: 1222138 - RNA, 19 nt, Human
guuuuauuguuuaaaauca

SEQ ID NO: 1222139 - RNA, 18 nt, Human
uuaaacacuaaaaaggca

SEQ ID NO: 1222140 - RNA, 20 nt, Human
uauuuauaaauauauuuaag

SEQ ID NO: 1222141 - RNA, 17 nt, Human
cacaggcuccaaacugg

SEQ ID NO: 1222142 - RNA, 21 nt, Human
ugugauuacccucugggucuc

SEQ ID NO: 1222143 - RNA, 23 nt, Human
cuucuaaguaaaaccacagcagu

SEQ ID NO: 1222144 - RNA, 18 nt, Human
gucugccagccagcagcc

SEQ ID NO: 1222145 - RNA, 20 nt, Human
cuccacaauagcagacagug

SEQ ID NO: 1222146 - RNA, 18 nt, Human
ucacaaccacucauucaa

SEQ ID NO: 1222147 - RNA, 13 nt, Human
cucgaacugcugg

SEQ ID NO: 1222148 - RNA, 22 nt, Human
gcaugaauuuuuuucaucuucu

SEQ ID NO: 1222149 - RNA, 14 nt, Human
auauuaucaugcaa

SEQ ID NO: 1222150 - RNA, 18 nt, Human
agcaagggugaugggaaa

SEQ ID NO: 1222151 - RNA, 19 nt, Human
cacagcaagggugauggga

SEQ ID NO: 1222152 - RNA, 15 nt, Human
acaguucauauguac

SEQ ID NO: 1222153 - RNA, 14 nt, Human
acaucugcagcucu

SEQ ID NO: 1222154 - RNA, 15 nt, Human
uuaaagacaaagaca

SEQ ID NO: 1222155 - RNA, 14 nt, Human
aaacaaaaaaagca

SEQ ID NO: 1222156 - RNA, 12 nt, Human
cauauaauguug

SEQ ID NO: 1222157 - RNA, 13 nt, Human
uuguuuuuccuug

SEQ ID NO: 1222158 - RNA, 23 nt, Human
agccuuccccuugcccagggcuc

SEQ ID NO: 1222159 - RNA, 15 nt, Human
auacuguauuuuuac

SEQ ID NO: 1222160 - RNA, 16 nt, Human
ccuguuaaaagaugaa

SEQ ID NO: 1222161 - RNA, 18 nt, Human
aguuuaugcauacaguaa

SEQ ID NO: 1222162 - RNA, 20 nt, Human
aauuaauggaauauguaaau

SEQ ID NO: 1222163 - RNA, 18 nt, Human
gccuagccgaccucagcc

SEQ ID NO: 1222164 - RNA, 15 nt, Human
caguuuuaucauuuu

SEQ ID NO: 1222165 - RNA, 12 nt, Human
gcuauucacaac

SEQ ID NO: 1222166 - RNA, 11 nt, Human
aacugcuggau

SEQ ID NO: 1222167 - RNA, 15 nt, Human
ugagagacagcaggu

SEQ ID NO: 1222168 - RNA, 16 nt, Human
augaucuuuaaaauac

SEQ ID NO: 1222169 - RNA, 16 nt, Human
aucuuaucauauuuca

SEQ ID NO: 1222170 - RNA, 12 nt, Human
aggcuggagugc

SEQ ID NO: 1222171 - RNA, 18 nt, Human
uuucuuaaagaauuuuca

SEQ ID NO: 1222172 - RNA, 16 nt, Human
acugacaacuugaaua

SEQ ID NO: 1222173 - RNA, 20 nt, Human
uaaagcuuauuaaaacucau

SEQ ID NO: 1222174 - RNA, 15 nt, Human
uauauuuuuuaugaa

SEQ ID NO: 1222175 - RNA, 18 nt, Human
cgaccucagccuuccccu

SEQ ID NO: 1222176 - RNA, 23 nt, Human
uucucucuccuguacuuuuucca

SEQ ID NO: 1222177 - RNA, 16 nt, Human
cuuguauuuuacuuuu

SEQ ID NO: 1222178 - RNA, 14 nt, Human
ccagggcucagccu

SEQ ID NO: 1222179 - RNA, 17 nt, Human
aaaaguauaaauaaaau

SEQ ID NO: 1222180 - RNA, 18 nt, Human
uaaacaucagcaaaaaag

SEQ ID NO: 1222181 - RNA, 15 nt, Human
accaaucauuuuaau

SEQ ID NO: 1222182 - RNA, 15 nt, Human
caacauuaaaacaau

SEQ ID NO: 1222183 - RNA, 23 nt, Human
uuguaacuuaugaaccuuuacau

SEQ ID NO: 1222184 - RNA, 13 nt, Human
aggauaagaggga

SEQ ID NO: 1222185 - RNA, 18 nt, Human
agguauuuauugagcacc

SEQ ID NO: 1222186 - RNA, 14 nt, Human
cauuaucucaaaac

SEQ ID NO: 1222187 - RNA, 14 nt, Human
ggcugcuagcacuu

SEQ ID NO: 1222188 - RNA, 18 nt, Human
guauagcauauguuuuug

SEQ ID NO: 1222189 - RNA, 12 nt, Human
auuaauucuuua

SEQ ID NO: 1222190 - RNA, 18 nt, Human
auagcaagugaauuuuuc

SEQ ID NO: 1222191 - RNA, 19 nt, Human
ugaacacugggggagggga

SEQ ID NO: 1222192 - RNA, 15 nt, Human
acccacuucacacac

SEQ ID NO: 1222193 - RNA, 23 nt, Human
gacuuuuuuuuuuuuuuaaacaa

SEQ ID NO: 1222194 - RNA, 19 nt, Human
auguacauuuccaaauuca

SEQ ID NO: 1222195 - RNA, 15 nt, Human
uuuaaguaauuucag

SEQ ID NO: 1222196 - RNA, 16 nt, Human
aauaugcacaauagca

SEQ ID NO: 1222197 - RNA, 12 nt, Human
ccccuccccugc

SEQ ID NO: 1222198 - RNA, 15 nt, Human
caaaaaccaaauuug

SEQ ID NO: 1222199 - RNA, 18 nt, Human
uagugaaguaugcacuaa

SEQ ID NO: 1222200 - RNA, 24 nt, Human
guccucaucuguaaaauggagaca

SEQ ID NO: 1222201 - RNA, 14 nt, Human
uaaaaaaaaauacu

SEQ ID NO: 1222202 - RNA, 20 nt, Human
auaaaguauauauagaaucu

SEQ ID NO: 1222203 - RNA, 12 nt, Human
augagagacagc

SEQ ID NO: 1222204 - RNA, 17 nt, Human
uaaaauaaaguauauau

SEQ ID NO: 1222205 - RNA, 13 nt, Human
uuaggcuauucac

SEQ ID NO: 1222206 - RNA, 17 nt, Human
gcuugcccuguuaaaag

SEQ ID NO: 1222207 - RNA, 18 nt, Human
agcuucucauccugcagg

SEQ ID NO: 1222208 - RNA, 17 nt, Human
auucaaaaguugaaauu

SEQ ID NO: 1222209 - RNA, 13 nt, Human
uggccaggcuggu

SEQ ID NO: 1222210 - RNA, 18 nt, Human
acugauggguuucuccag

SEQ ID NO: 1222211 - RNA, 21 nt, Human
aaaagcauuguaacuuaugaa

SEQ ID NO: 1222212 - RNA, 20 nt, Human
ugaccaggcauccuccacaa

SEQ ID NO: 1222213 - RNA, 16 nt, Human
cauuguaaaugugcuu

SEQ ID NO: 1222214 - RNA, 19 nt, Human
cccugguaauaaguacugu

SEQ ID NO: 1222215 - RNA, 19 nt, Human
acaguuuuccuucucaucu

SEQ ID NO: 1222216 - RNA, 17 nt, Human
uggcgcaaucuuaacuc

SEQ ID NO: 1222217 - RNA, 15 nt, Human
agucugauuuuccug

SEQ ID NO: 1222218 - RNA, 20 nt, Human
accuuuugcuguggcaaaug

SEQ ID NO: 1222219 - RNA, 22 nt, Human
aaacucauuuuuguuuucauua

SEQ ID NO: 1222220 - RNA, 14 nt, Human
acucauuuuaaaaa

SEQ ID NO: 1222221 - RNA, 20 nt, Human
aacugcacugucaagaugau

SEQ ID NO: 1222222 - RNA, 20 nt, Human
uaauaaauguacauuaauua

SEQ ID NO: 1222223 - RNA, 14 nt, Human
uaacucagaaacau

SEQ ID NO: 1222224 - RNA, 15 nt, Human
ucaguuacucugaag

SEQ ID NO: 1222225 - RNA, 21 nt, Human
ucuuucacauuggcuauuuaa

SEQ ID NO: 1222226 - RNA, 19 nt, Human
uuauccugucccuccucca

SEQ ID NO: 1222227 - RNA, 17 nt, Human
ucugucuucacaacaga

SEQ ID NO: 1222228 - RNA, 13 nt, Human
gacucagggcccc

SEQ ID NO: 1222229 - RNA, 19 nt, Human
cagcuuuuucucucccacu

SEQ ID NO: 1222230 - RNA, 13 nt, Human
ccgggaguggcgc

SEQ ID NO: 1222231 - RNA, 18 nt, Human
cuaucuaauuuuuauuaa

SEQ ID NO: 1222232 - RNA, 16 nt, Human
aaagcauuguaacuua

SEQ ID NO: 1222233 - RNA, 18 nt, Human
agcuuagaccucagccug

SEQ ID NO: 1222234 - RNA, 15 nt, Human
cuguaugucugccua

SEQ ID NO: 1222235 - RNA, 16 nt, Human
cauucucucuccugua

SEQ ID NO: 1222236 - RNA, 13 nt, Human
gaauguaaucaau

SEQ ID NO: 1222237 - RNA, 15 nt, Human
aguacagacuuuuuu

SEQ ID NO: 1222238 - RNA, 19 nt, Human
aggcauccuccacaauagc

SEQ ID NO: 1222239 - RNA, 20 nt, Human
ucuuaauuaaaagaauauuu

SEQ ID NO: 1222240 - RNA, 16 nt, Human
uggcugggaguggcau

SEQ ID NO: 1222241 - RNA, 20 nt, Human
agcuuauuaaaacucauuuu

SEQ ID NO: 1222242 - RNA, 23 nt, Human
gcagcucaggcacacuucuucuu

SEQ ID NO: 1222243 - RNA, 18 nt, Human
uuuccuauguaacugcau

SEQ ID NO: 1222244 - RNA, 19 nt, Human
ucucuuaaacacuaaaaag

SEQ ID NO: 1222245 - RNA, 13 nt, Human
uuuugcuguggca

SEQ ID NO: 1222246 - RNA, 14 nt, Human
aaauuccagaauga

SEQ ID NO: 1222247 - RNA, 16 nt, Human
guaaucauauaauaaa

SEQ ID NO: 1222248 - RNA, 23 nt, Human
augugcuuuuaaaaaaaaauacu

SEQ ID NO: 1222249 - RNA, 14 nt, Human
agggauggcaagau

SEQ ID NO: 1222250 - RNA, 12 nt, Human
ucauuuuaauua

SEQ ID NO: 1222251 - RNA, 18 nt, Human
uacauacugcugucuaug

SEQ ID NO: 1222252 - RNA, 12 nt, Human
uauaaauaaaau

SEQ ID NO: 1222253 - RNA, 21 nt, Human
uuuccauugguuuaccuguga

SEQ ID NO: 1222254 - RNA, 14 nt, Human
aacugcacugucaa

SEQ ID NO: 1222255 - RNA, 18 nt, Human
auauauuuauaacucauc

SEQ ID NO: 1222256 - RNA, 19 nt, Human
uaaaaucauuucugcauca

SEQ ID NO: 1222257 - RNA, 16 nt, Human
ugugcuuucuaucuaa

SEQ ID NO: 1222258 - RNA, 17 nt, Human
aaacaucagcaaaaaag

SEQ ID NO: 1222259 - RNA, 12 nt, Human
agaaaaauuaga

SEQ ID NO: 1222260 - RNA, 14 nt, Human
uuucacaagugaaa

SEQ ID NO: 1222261 - RNA, 14 nt, Human
ccauuuaaagcuua

SEQ ID NO: 1222262 - RNA, 20 nt, Human
cuguauuuuuaccuuuuucc

SEQ ID NO: 1222263 - RNA, 14 nt, Human
aggugcuacaaaaa

SEQ ID NO: 1222264 - RNA, 20 nt, Human
cagcaggucucaugggggug

SEQ ID NO: 1222265 - RNA, 23 nt, Human
gcagccaugugauuacccucugg

SEQ ID NO: 1222266 - RNA, 13 nt, Human
uuaaacaaaaaaa

SEQ ID NO: 1222267 - RNA, 18 nt, Human
ccaaguuuauauacaauu

SEQ ID NO: 1222268 - RNA, 15 nt, Human
ccugucugccagcca

SEQ ID NO: 1222269 - RNA, 18 nt, Human
gaugaacucuuaaucaaa

SEQ ID NO: 1222270 - RNA, 17 nt, Human
uuuacuacuuuaaaaaa

SEQ ID NO: 1222271 - RNA, 20 nt, Human
ugugcuggcuuaaaauguaa

SEQ ID NO: 1222272 - RNA, 20 nt, Human
caccagagauaauaugagaa

SEQ ID NO: 1222273 - RNA, 16 nt, Human
uauuuuacuuuuccau

SEQ ID NO: 1222274 - RNA, 19 nt, Human
uguuacauuauuaucaaca

SEQ ID NO: 1222275 - RNA, 14 nt, Human
caaagaaauguaag

SEQ ID NO: 1222276 - RNA, 12 nt, Human
aucauuuucaaa

SEQ ID NO: 1222277 - RNA, 18 nt, Human
ccuguaaucauauaauaa

SEQ ID NO: 1222278 - RNA, 19 nt, Human
aagcgauucucuuuauuca

SEQ ID NO: 1222279 - RNA, 16 nt, Human
ucauuuugguaaaaua

SEQ ID NO: 1222280 - RNA, 20 nt, Human
aagaauuuucaaaaucaaau

SEQ ID NO: 1222281 - RNA, 23 nt, Human
ugacguaggaacgguaaauuucu

SEQ ID NO: 1222282 - RNA, 17 nt, Human
guugauagcaagugaau

SEQ ID NO: 1222283 - RNA, 17 nt, Human
agggccuggcugggagu

SEQ ID NO: 1222284 - RNA, 16 nt, Human
uuuacacacauuaaaa

SEQ ID NO: 1222285 - RNA, 13 nt, Human
uaaaugagugugu

SEQ ID NO: 1222286 - RNA, 15 nt, Human
uguuauguauuauua

SEQ ID NO: 1222287 - RNA, 21 nt, Human
gauuuuacacacauuaaaaug

SEQ ID NO: 1222288 - RNA, 16 nt, Human
aguccucuuucaaagg

SEQ ID NO: 1222289 - RNA, 17 nt, Human
gacaguguuuucuggga

SEQ ID NO: 1222290 - RNA, 16 nt, Human
agacucagggccccag

SEQ ID NO: 1222291 - RNA, 21 nt, Human
aguauacuguauuuuuaccuu

SEQ ID NO: 1222292 - RNA, 14 nt, Human
cccuugcccagggc

SEQ ID NO: 1222293 - RNA, 13 nt, Human
gggaguggcgcgc

SEQ ID NO: 1222294 - RNA, 15 nt, Human
uaauauugcaaggca

SEQ ID NO: 1222295 - RNA, 18 nt, Human
cauuuccuauguaacugc

SEQ ID NO: 1222296 - RNA, 19 nt, Human
aauacacacucaaaucaag

SEQ ID NO: 1222297 - RNA, 18 nt, Human
uguaagggaaacugccag

SEQ ID NO: 1222298 - RNA, 17 nt, Human
guuaaaagaugaaaaua

SEQ ID NO: 1222299 - RNA, 13 nt, Human
cuaauuuuuauua

SEQ ID NO: 1222300 - RNA, 12 nt, Human
cugcacugucaa

SEQ ID NO: 1222301 - RNA, 16 nt, Human
ugaaacugagauguga

SEQ ID NO: 1222302 - RNA, 18 nt, Human
gaugucacuagggcaggg

SEQ ID NO: 1222303 - RNA, 14 nt, Human
uguggcuguaucuu

SEQ ID NO: 1222304 - RNA, 16 nt, Human
augcauacaguaauuu

SEQ ID NO: 1222305 - RNA, 21 nt, Human
ucaauagaaggauguacauuu

SEQ ID NO: 1222306 - RNA, 18 nt, Human
caguuagagauuuuuaaa

SEQ ID NO: 1222307 - RNA, 15 nt, Human
uaauuauuauuuaua

SEQ ID NO: 1222308 - RNA, 21 nt, Human
aucauauuucaaaugauuuuc

SEQ ID NO: 1222309 - RNA, 19 nt, Human
uagcuuuauuuuuuaagua

SEQ ID NO: 1222310 - RNA, 19 nt, Human
uaagauuuuguuuuuaaac

SEQ ID NO: 1222311 - RNA, 16 nt, Human
ucuguauugcauuaaa

SEQ ID NO: 1222312 - RNA, 16 nt, Human
aucaaacugaagccag

SEQ ID NO: 1222313 - RNA, 21 nt, Human
ucaaucuuaucauauuucaaa

SEQ ID NO: 1222314 - RNA, 20 nt, Human
auuuucaaauuugaugaaau

SEQ ID NO: 1222315 - RNA, 17 nt, Human
gaagagcuguucacagc

SEQ ID NO: 1222316 - RNA, 17 nt, Human
cuggagugcaguggcgc

SEQ ID NO: 1222317 - RNA, 14 nt, Human
aucuuguuuuucca

SEQ ID NO: 1222318 - RNA, 17 nt, Human
guaucuuguuuuuccac

SEQ ID NO: 1222319 - RNA, 19 nt, Human
aaauguaauuaaucuugua

SEQ ID NO: 1222320 - RNA, 15 nt, Human
uacuaauaaaauaca

SEQ ID NO: 1222321 - RNA, 19 nt, Human
cuuucuaucuaauuuuuau

SEQ ID NO: 1222322 - RNA, 21 nt, Human
accaacacuaacauauaaugu

SEQ ID NO: 1222323 - RNA, 19 nt, Human
aguguuaucagucauaacu

SEQ ID NO: 1222324 - RNA, 19 nt, Human
auauugcaaggcaaagacu

SEQ ID NO: 1222325 - RNA, 19 nt, Human
auucaaaaguugaaauuaa

SEQ ID NO: 1222326 - RNA, 13 nt, Human
uucaaauuugaug

SEQ ID NO: 1222327 - RNA, 19 nt, Human
aagguauuuauugagcacc

SEQ ID NO: 1222328 - RNA, 14 nt, Human
aaucuuguaaauau

SEQ ID NO: 1222329 - RNA, 20 nt, Human
uagggacuucugucuucaca

SEQ ID NO: 1222330 - RNA, 20 nt, Human
aucauuucugcaucagcugc

SEQ ID NO: 1222331 - RNA, 12 nt, Human
acaguuuuccuu

SEQ ID NO: 1222332 - RNA, 19 nt, Human
cauauuaaaaucacaaacu

SEQ ID NO: 1222333 - RNA, 15 nt, Human
uucugucuucacaac

SEQ ID NO: 1222334 - RNA, 13 nt, Human
agcuugaaacuga

SEQ ID NO: 1222335 - RNA, 15 nt, Human
uucauguacauccau

SEQ ID NO: 1222336 - RNA, 19 nt, Human
gagugacuuaguguacaug

SEQ ID NO: 1222337 - RNA, 12 nt, Human
auuaaaaucaca

SEQ ID NO: 1222338 - RNA, 17 nt, Human
auguauuuauaaauaua

SEQ ID NO: 1222339 - RNA, 15 nt, Human
agugucuuaauuaaa

SEQ ID NO: 1222340 - RNA, 15 nt, Human
cuacaaaaacacagc

SEQ ID NO: 1222341 - RNA, 13 nt, Human
uaauuuuaaguaa

SEQ ID NO: 1222342 - RNA, 19 nt, Human
auuguguguuauuuaaaug

SEQ ID NO: 1222343 - RNA, 15 nt, Human
aaagaggcagcuuga

SEQ ID NO: 1222344 - RNA, 15 nt, Human
acauuuccaaauuca

SEQ ID NO: 1222345 - RNA, 16 nt, Human
aaaguauaaauaaaau

SEQ ID NO: 1222346 - RNA, 16 nt, Human
accaggcuugccugca

SEQ ID NO: 1222347 - RNA, 12 nt, Human
aacucagaaauu

SEQ ID NO: 1222348 - RNA, 17 nt, Human
uuccccuugcccagggc

SEQ ID NO: 1222349 - RNA, 16 nt, Human
ucuuaauuaaaagaau

SEQ ID NO: 1222350 - RNA, 18 nt, Human
agcagcucaggcacacuu

SEQ ID NO: 1222351 - RNA, 21 nt, Human
uuacaguuagagauuuuuaaa

SEQ ID NO: 1222352 - RNA, 16 nt, Human
uuuauaacucaucaua

SEQ ID NO: 1222353 - RNA, 18 nt, Human
uggagccaaggguucaga

SEQ ID NO: 1222354 - RNA, 19 nt, Human
uggagggggcgcgugcagg

SEQ ID NO: 1222355 - RNA, 17 nt, Human
agaaacguguauauuuu

SEQ ID NO: 1222356 - RNA, 20 nt, Human
uuguaaaugugcuuuuaaaa

SEQ ID NO: 1222357 - RNA, 19 nt, Human
gcacuuuaacacagugucu

SEQ ID NO: 1222358 - RNA, 20 nt, Human
auauauguguuuuucacauu

SEQ ID NO: 1222359 - RNA, 20 nt, Human
uuucauguauuuuaaaauaa

SEQ ID NO: 1222360 - RNA, 14 nt, Human
uguauuuaaauauu

SEQ ID NO: 1222361 - RNA, 14 nt, Human
aguauuuauauauu

SEQ ID NO: 1222362 - RNA, 15 nt, Human
accuguaaucauaua

SEQ ID NO: 1222363 - RNA, 22 nt, Human
aagcauaccaacacgagcaggc

SEQ ID NO: 1222364 - RNA, 13 nt, Human
agagauuccugag

SEQ ID NO: 1222365 - RNA, 15 nt, Human
aguaugcacuaauca

SEQ ID NO: 1222366 - RNA, 17 nt, Human
cuucuagguucuaaaaa

SEQ ID NO: 1222367 - RNA, 22 nt, Human
aaagacuccaaagaaauguaag

SEQ ID NO: 1222368 - RNA, 15 nt, Human
agacaccaccacccu

SEQ ID NO: 1222369 - RNA, 16 nt, Human
uuuccuuguauuuaaa

SEQ ID NO: 1222370 - RNA, 12 nt, Human
ugagaaagacua

SEQ ID NO: 1222371 - RNA, 21 nt, Human
aauuuuuuucaucuucucugg

SEQ ID NO: 1222372 - RNA, 21 nt, Human
uaaguuuaugcauacaguaau

SEQ ID NO: 1222373 - RNA, 13 nt, Human
agaagacaacauu

SEQ ID NO: 1222374 - RNA, 19 nt, Human
auuacagaugggcaaauua

SEQ ID NO: 1222375 - RNA, 17 nt, Human
aagcacugacuucuaag

SEQ ID NO: 1222376 - RNA, 18 nt, Human
uauguauuuauaaauaua

SEQ ID NO: 1222377 - RNA, 14 nt, Human
uauuaauuuguaag

SEQ ID NO: 1222378 - RNA, 12 nt, Human
auauuuugaaca

SEQ ID NO: 1222379 - RNA, 14 nt, Human
uauuuaaagacaaa

SEQ ID NO: 1222380 - RNA, 22 nt, Human
uuaauggaauauguaaauagaa

SEQ ID NO: 1222381 - RNA, 12 nt, Human
ccuguuaaaaga

SEQ ID NO: 1222382 - RNA, 17 nt, Human
acugacuucuaaguaaa

SEQ ID NO: 1222383 - RNA, 19 nt, Human
auacuauggaauuucuccc

SEQ ID NO: 1222384 - RNA, 18 nt, Human
uuaucucaaaacugcacu

SEQ ID NO: 1222385 - RNA, 20 nt, Human
auagcagggcauggcuggga

SEQ ID NO: 1222386 - RNA, 22 nt, Human
augccauuuaaagcuuauuaaa

SEQ ID NO: 1222387 - RNA, 21 nt, Human
ccaacgaguaauuuauuguuu

SEQ ID NO: 1222388 - RNA, 17 nt, Human
ggcgcgugcaggcagca

SEQ ID NO: 1222389 - RNA, 17 nt, Human
caaucuuaacucauugc

SEQ ID NO: 1222390 - RNA, 19 nt, Human
cccuacaccccuccccugc

SEQ ID NO: 1222391 - RNA, 20 nt, Human
ggagaagagcuguucacagc

SEQ ID NO: 1222392 - RNA, 22 nt, Human
agucaaucuuaucauauuucaa

SEQ ID NO: 1222393 - RNA, 11 nt, Human
cauuucucugg

SEQ ID NO: 1222394 - RNA, 22 nt, Human
cucauuuauuuccauauuaaaa

SEQ ID NO: 1222395 - RNA, 21 nt, Human
gcauauugauaauaaaauuca

SEQ ID NO: 1222396 - RNA, 22 nt, Human
aagaugaugaugaucuuuaaaa

SEQ ID NO: 1222397 - RNA, 19 nt, Human
ucuagaauacuaauaaaau

SEQ ID NO: 1222398 - RNA, 22 nt, Human
gcacaguuuucugagaaagacu

SEQ ID NO: 1222399 - RNA, 20 nt, Human
uccagagggaauugcagagu

SEQ ID NO: 1222400 - RNA, 13 nt, Human
acuguaaauuuau

SEQ ID NO: 1222401 - RNA, 16 nt, Human
aaucuaauucaaacua

SEQ ID NO: 1222402 - RNA, 11 nt, Human
uuaaaaucauu

SEQ ID NO: 1222403 - RNA, 18 nt, Human
uaaauauguuagcaaaga

SEQ ID NO: 1222404 - RNA, 13 nt, Human
caaaaaaagcauu

SEQ ID NO: 1222405 - RNA, 13 nt, Human
cuugacuuuggca

SEQ ID NO: 1222406 - RNA, 16 nt, Human
aaaauuauauuuugaa

SEQ ID NO: 1222407 - RNA, 22 nt, Human
gauggcaagaugugggcaguga

SEQ ID NO: 1222408 - RNA, 17 nt, Human
cagugcuugaaugaagu

SEQ ID NO: 1222409 - RNA, 18 nt, Human
uuauuuagggaacugcuu

SEQ ID NO: 1222410 - RNA, 17 nt, Human
ucaaaaguugaaauuaa

SEQ ID NO: 1222411 - RNA, 19 nt, Human
auuuugguaaaauacuucu

SEQ ID NO: 1222412 - RNA, 19 nt, Human
aaagggauggcaagaugug

SEQ ID NO: 1222413 - RNA, 19 nt, Human
aaagaaauguaagggaaac

SEQ ID NO: 1222414 - RNA, 19 nt, Human
aucauuuuaauuauuauuc

SEQ ID NO: 1222415 - RNA, 14 nt, Human
gacaguuuuccuuc

SEQ ID NO: 1222416 - RNA, 19 nt, Human
aaauuggacuuaaaaucua

SEQ ID NO: 1222417 - RNA, 16 nt, Human
uagcaaagaguuaaua

SEQ ID NO: 1222418 - RNA, 20 nt, Human
cacgagcaggcuacugucag

SEQ ID NO: 1222419 - RNA, 17 nt, Human
gcuccaaacuggagcuu

SEQ ID NO: 1222420 - RNA, 20 nt, Human
aauaaaugugccuucauuuu

SEQ ID NO: 1222421 - RNA, 22 nt, Human
aaucacucauuuauuuccauau

SEQ ID NO: 1222422 - RNA, 14 nt, Human
uguauuauuauucc

SEQ ID NO: 1222423 - RNA, 17 nt, Human
cuaaaauuagaugaacu

SEQ ID NO: 1222424 - RNA, 19 nt, Human
cuuagcuuagaccucagcc

SEQ ID NO: 1222425 - RNA, 18 nt, Human
cauauguaccauguacau

SEQ ID NO: 1222426 - RNA, 16 nt, Human
auuguuuaaaaucauu

SEQ ID NO: 1222427 - RNA, 19 nt, Human
gaaaauauuuguaucacaa

SEQ ID NO: 1222428 - RNA, 17 nt, Human
uaaaauguuagaaaaaa

SEQ ID NO: 1222429 - RNA, 13 nt, Human
auuauuauuuaaa

SEQ ID NO: 1222430 - RNA, 15 nt, Human
auauuucaaaugauu

SEQ ID NO: 1222431 - RNA, 23 nt, Human
gaagccgagccucaagaugaagg

SEQ ID NO: 1222432 - RNA, 20 nt, Human
gagauaucccaggaaaauua

SEQ ID NO: 1222433 - RNA, 17 nt, Human
aguuccugagaccagcc

SEQ ID NO: 1222434 - RNA, 23 nt, Human
gauguacauuuccaaauucacaa

SEQ ID NO: 1222435 - RNA, 23 nt, Human
cagaaauuuaauucauguuucuu

SEQ ID NO: 1222436 - RNA, 19 nt, Human
ucauaacaauuuuaggagg

SEQ ID NO: 1222437 - RNA, 13 nt, Human
auuuauugagcac

SEQ ID NO: 1222438 - RNA, 22 nt, Human
aauuauuauuuaaacaucagca

SEQ ID NO: 1222439 - RNA, 17 nt, Human
aaauucugcaagcuuuu

SEQ ID NO: 1222440 - RNA, 15 nt, Human
auuuuuuaaguauuu

SEQ ID NO: 1222441 - RNA, 22 nt, Human
uaaauaaagcuugcaacaaaau

SEQ ID NO: 1222442 - RNA, 20 nt, Human
ucuggauuugcaaccccauc

SEQ ID NO: 1222443 - RNA, 17 nt, Human
gaccugacuauugaagu

SEQ ID NO: 1222444 - RNA, 22 nt, Human
aauuaucuaucuaucuauuuau

SEQ ID NO: 1222445 - RNA, 16 nt, Human
uguagauaaacucaga

SEQ ID NO: 1222446 - RNA, 14 nt, Human
ggcgggacacaggc

SEQ ID NO: 1222447 - RNA, 15 nt, Human
uauguauuuauaaau

SEQ ID NO: 1222448 - RNA, 15 nt, Human
cugccucuaaaaggc

SEQ ID NO: 1222449 - RNA, 20 nt, Human
uaagaaauaugcacaauagc

SEQ ID NO: 1222450 - RNA, 22 nt, Human
aauguuauuuuuuaauuauuau

SEQ ID NO: 1222451 - RNA, 18 nt, Human
cauuauuggacuuccauu

SEQ ID NO: 1222452 - RNA, 14 nt, Human
ucauguauuuuaaa

SEQ ID NO: 1222453 - RNA, 20 nt, Human
auacauuauuggacuuccau

SEQ ID NO: 1222454 - RNA, 18 nt, Human
agagcuguucacagccag

SEQ ID NO: 1222455 - RNA, 16 nt, Human
aggaccugacuauuga

SEQ ID NO: 1222456 - RNA, 16 nt, Human
guaauucuaaaugaau

SEQ ID NO: 1222457 - RNA, 14 nt, Human
aaauuaauucuuua

SEQ ID NO: 1222458 - RNA, 22 nt, Human
auuaaggcuucucuuaaacacu

SEQ ID NO: 1222459 - RNA, 21 nt, Human
uaauuauaauauacuauauuu

SEQ ID NO: 1222460 - RNA, 18 nt, Human
uacuuuuuucauuauugg

SEQ ID NO: 1222461 - RNA, 16 nt, Human
gcacuuuaaacauuua

SEQ ID NO: 1222462 - RNA, 16 nt, Human
cauguauuuuaaaaua

SEQ ID NO: 1222463 - RNA, 16 nt, Human
aaauuuucccaaaacu

SEQ ID NO: 1222464 - RNA, 15 nt, Human
gauuaaaguuaaaua

SEQ ID NO: 1222465 - RNA, 18 nt, Human
acggagauaucccaggaa

SEQ ID NO: 1222466 - RNA, 13 nt, Human
aacucauccauua

SEQ ID NO: 1222467 - RNA, 14 nt, Human
aauacauacuauag

SEQ ID NO: 1222468 - RNA, 13 nt, Human
ucugauuuuccug

SEQ ID NO: 1222469 - RNA, 20 nt, Human
cuggacuuuccagagaccag

SEQ ID NO: 1222470 - RNA, 13 nt, Human
auccugcaggcag

SEQ ID NO: 1222471 - RNA, 22 nt, Human
cgaggcagggucaggagagggg

SEQ ID NO: 1222472 - RNA, 19 nt, Human
agucaaugaacuuuccaca

SEQ ID NO: 1222473 - RNA, 22 nt, Human
agacucuacccauauuacagau

SEQ ID NO: 1222474 - RNA, 17 nt, Human
uccugucugccagccag

SEQ ID NO: 1222475 - RNA, 19 nt, Human
gcugaaacaacaaauagga

SEQ ID NO: 1222476 - RNA, 16 nt, Human
agagggaauugcagag

SEQ ID NO: 1222477 - RNA, 14 nt, Human
aaauuuucccaaaa

SEQ ID NO: 1222478 - RNA, 16 nt, Human
caguguccucaucugu

SEQ ID NO: 1222479 - RNA, 13 nt, Human
auaauuauaauau

SEQ ID NO: 1222480 - RNA, 19 nt, Human
caauuauaucaguccucuu

SEQ ID NO: 1222481 - RNA, 12 nt, Human
uuauauacaauu

SEQ ID NO: 1222482 - RNA, 20 nt, Human
cuaagaaauaugcacaauag

SEQ ID NO: 1222483 - RNA, 16 nt, Human
aacauuuaucuuugua

SEQ ID NO: 1222484 - RNA, 16 nt, Human
ucaaaagguauuuauu

SEQ ID NO: 1222485 - RNA, 16 nt, Human
cagagacucagggccc

SEQ ID NO: 1222486 - RNA, 17 nt, Human
agaaacaucaguuacuc

SEQ ID NO: 1222487 - RNA, 15 nt, Human
ugccucuaaaaggcc

SEQ ID NO: 1222488 - RNA, 13 nt, Human
ugauaauaaaauu

SEQ ID NO: 1222489 - RNA, 13 nt, Human
aaaaaaagccaaa

SEQ ID NO: 1222490 - RNA, 22 nt, Human
cuaaauaaagcuugcaacaaaa

SEQ ID NO: 1222491 - RNA, 20 nt, Human
auuucauaccuaucaucuua

SEQ ID NO: 1222492 - RNA, 21 nt, Human
agcagcaucucugaacauuuc

SEQ ID NO: 1222493 - RNA, 13 nt, Human
cauacaguaauuu

SEQ ID NO: 1222494 - RNA, 20 nt, Human
ccaaucauuuuaauuauuau

SEQ ID NO: 1222495 - RNA, 22 nt, Human
uacaguuagagauuuuuaaaua

SEQ ID NO: 1222496 - RNA, 16 nt, Human
cagcuuuuucucuccc

SEQ ID NO: 1222497 - RNA, 20 nt, Human
uuucauuaucucaaaacugc

SEQ ID NO: 1222498 - RNA, 19 nt, Human
agaaauucugcaagcuuuu

SEQ ID NO: 1222499 - RNA, 23 nt, Human
uuuucaaaaucaaauuccagaau

SEQ ID NO: 1222500 - RNA, 15 nt, Human
aaaaaaguacuuaaa

SEQ ID NO: 1222501 - RNA, 17 nt, Human
uaaaugugcuuuuaaaa

SEQ ID NO: 1222502 - RNA, 15 nt, Human
gaccagagcuacuga

SEQ ID NO: 1222503 - RNA, 16 nt, Human
cccauucgcaauaagu

SEQ ID NO: 1222504 - RNA, 23 nt, Human
ucauuucaaaacucauuuccuau

SEQ ID NO: 1222505 - RNA, 17 nt, Human
aaggccugucccugcag

SEQ ID NO: 1222506 - RNA, 19 nt, Human
caacuggauacuagaucuu

SEQ ID NO: 1222507 - RNA, 13 nt, Human
uauuaaaacucau

SEQ ID NO: 1222508 - RNA, 17 nt, Human
gccugcuggauguggag

SEQ ID NO: 1222509 - RNA, 13 nt, Human
ccuccucugucca

SEQ ID NO: 1222510 - RNA, 16 nt, Human
auuauuuaaacaucag

SEQ ID NO: 1222511 - RNA, 19 nt, Human
ugacaagguucuucccuuu

SEQ ID NO: 1222512 - RNA, 23 nt, Human
ggagggggcgcgugcaggcagca

SEQ ID NO: 1222513 - RNA, 13 nt, Human
aucauccucaggc

SEQ ID NO: 1222514 - RNA, 21 nt, Human
cauuucaaaagguauuuauug

SEQ ID NO: 1222515 - RNA, 14 nt, Human
cacuaacauauaau

SEQ ID NO: 1222516 - RNA, 22 nt, Human
aacuuucuuuucuggaauguaa

SEQ ID NO: 1222517 - RNA, 15 nt, Human
auggugaaaugcaga

SEQ ID NO: 1222518 - RNA, 19 nt, Human
cuguauuuuuaccuuuuuc

SEQ ID NO: 1222519 - RNA, 13 nt, Human
agccuuccccuug

SEQ ID NO: 1222520 - RNA, 22 nt, Human
aaggcaaagcacgaaauguuau

SEQ ID NO: 1222521 - RNA, 15 nt, Human
uuagaauauuaaaaa

SEQ ID NO: 1222522 - RNA, 20 nt, Human
auuuuuaccuuuuuccuucc

SEQ ID NO: 1222523 - RNA, 16 nt, Human
cuagggcagggacagg

SEQ ID NO: 1222524 - RNA, 17 nt, Human
aacaucagcaaaaaagu

SEQ ID NO: 1222525 - RNA, 20 nt, Human
auauguauuuauaaauauau

SEQ ID NO: 1222526 - RNA, 18 nt, Human
uaauuauuauucuucaua

SEQ ID NO: 1222527 - RNA, 13 nt, Human
gaacauaaaauac

SEQ ID NO: 1222528 - RNA, 21 nt, Human
auguagcaaauuccaauacau

SEQ ID NO: 1222529 - RNA, 22 nt, Human
ggacccagggaugacauguccc

SEQ ID NO: 1222530 - RNA, 12 nt, Human
uuuucaaauuug

SEQ ID NO: 1222531 - RNA, 15 nt, Human
acucuuuugccauua

SEQ ID NO: 1222532 - RNA, 14 nt, Human
uauuauuuauauau

SEQ ID NO: 1222533 - RNA, 11 nt, Human
agccagcagcc

SEQ ID NO: 1222534 - RNA, 15 nt, Human
cuggccaggcugguc

SEQ ID NO: 1222535 - RNA, 18 nt, Human
uagaaggguaccuugaac

SEQ ID NO: 1222536 - RNA, 15 nt, Human
gggacaguuccugag

SEQ ID NO: 1222537 - RNA, 12 nt, Human
aaacaaaaaaag

SEQ ID NO: 1222538 - RNA, 14 nt, Human
caccaacuuugaag

SEQ ID NO: 1222539 - RNA, 22 nt, Human
gcucagccuggugggccuccuc

SEQ ID NO: 1222540 - RNA, 17 nt, Human
gcacuugaaaaugaaau

SEQ ID NO: 1222541 - RNA, 20 nt, Human
uauauagauggcgagaaccu

SEQ ID NO: 1222542 - RNA, 20 nt, Human
uaaaauguaauuaaucuugu

SEQ ID NO: 1222543 - RNA, 23 nt, Human
cuuaaagaauuuucaaaaucaaa

SEQ ID NO: 1222544 - RNA, 17 nt, Human
aaaaagcauuguaacuu

SEQ ID NO: 1222545 - RNA, 17 nt, Human
gagacaccaccacccuu

SEQ ID NO: 1222546 - RNA, 19 nt, Human
aaauggugaaaugcagagu

SEQ ID NO: 1222547 - RNA, 18 nt, Human
aaauggagaaaggacccu

SEQ ID NO: 1222548 - RNA, 19 nt, Human
gcaugggccuagcccacug

SEQ ID NO: 1222549 - RNA, 21 nt, Human
auuuauuuccauauuaaaauc

SEQ ID NO: 1222550 - RNA, 15 nt, Human
uauuucauuucuuug

SEQ ID NO: 1222551 - RNA, 19 nt, Human
auaaauuauuauuuaaaca

SEQ ID NO: 1222552 - RNA, 15 nt, Human
uucugagaaagacua

SEQ ID NO: 1222553 - RNA, 21 nt, Human
cuggagcuugaaauagugucu

SEQ ID NO: 1222554 - RNA, 16 nt, Human
ugcgaaugguuccauu

SEQ ID NO: 1222555 - RNA, 23 nt, Human
gccaaaaaccaaauuuguauuua

SEQ ID NO: 1222556 - RNA, 16 nt, Human
uacccucugggucuca

SEQ ID NO: 1222557 - RNA, 22 nt, Human
uuggucuugauaagcuauguug

SEQ ID NO: 1222558 - RNA, 23 nt, Human
auuacaucuuucacauuggcuau

SEQ ID NO: 1222559 - RNA, 22 nt, Human
uggauuugcaaccccaucaucc

SEQ ID NO: 1222560 - RNA, 17 nt, Human
ucuauuagccacaaaau

SEQ ID NO: 1222561 - RNA, 13 nt, Human
aaauaugcaaagc

SEQ ID NO: 1222562 - RNA, 14 nt, Human
aacugaggcagaca

SEQ ID NO: 1222563 - RNA, 12 nt, Human
gagagaagauag

SEQ ID NO: 1222564 - RNA, 12 nt, Human
caucuucucugg

SEQ ID NO: 1222565 - RNA, 15 nt, Human
ucauuuauuuccaua

SEQ ID NO: 1222566 - RNA, 15 nt, Human
ugugcuuuuaaaaaa

SEQ ID NO: 1222567 - RNA, 13 nt, Human
cuggccaggcugg

SEQ ID NO: 1222568 - RNA, 22 nt, Human
aguccuugcaucaauuuuucuu

SEQ ID NO: 1222569 - RNA, 20 nt, Human
aguccuacaagcuaaaauua

SEQ ID NO: 1222570 - RNA, 16 nt, Human
acuuuggcaaaugagc

SEQ ID NO: 1222571 - RNA, 14 nt, Human
uauaaauuuuccca

SEQ ID NO: 1222572 - RNA, 13 nt, Human
ucuaucuauuuau

SEQ ID NO: 1222573 - RNA, 18 nt, Human
agcugcugaaacaacaaa

SEQ ID NO: 1222574 - RNA, 12 nt, Human
uuuacuuuucca

SEQ ID NO: 1222575 - RNA, 16 nt, Human
gaaccuuuacauccag

SEQ ID NO: 1222576 - RNA, 13 nt, Human
auuuaaacaucag

SEQ ID NO: 1222577 - RNA, 12 nt, Human
cuuccucacacc

SEQ ID NO: 1222578 - RNA, 13 nt, Human
aacucuuaaucaa

SEQ ID NO: 1222579 - RNA, 15 nt, Human
ccuagccgaccucag

SEQ ID NO: 1222580 - RNA, 22 nt, Human
agcauuuuacuacuuuaaaaaa

SEQ ID NO: 1222581 - RNA, 22 nt, Human
auuucugugggagaauucuuac

SEQ ID NO: 1222582 - RNA, 21 nt, Human
guuugccaugcuggccaggcu

SEQ ID NO: 1222583 - RNA, 20 nt, Human
ucggguuuuauuguuuaaaa

SEQ ID NO: 1222584 - RNA, 14 nt, Human
uauuuuuaccuuuu

SEQ ID NO: 1222585 - RNA, 16 nt, Human
aucaauacuuugaaca

SEQ ID NO: 1222586 - RNA, 15 nt, Human
gcaggcaugagucag

SEQ ID NO: 1222587 - RNA, 21 nt, Human
auuuuuaaauaaagaauuuua

SEQ ID NO: 1222588 - RNA, 21 nt, Human
uuuuuuuaaacaaaaaaagca

SEQ ID NO: 1222589 - RNA, 17 nt, Human
cuuaaagaauuuucaaa

SEQ ID NO: 1222590 - RNA, 15 nt, Human
aauaaguacugugua

SEQ ID NO: 1222591 - RNA, 18 nt, Human
aaauuauuauuuaaacau

SEQ ID NO: 1222592 - RNA, 20 nt, Human
augaaguuguagguaauauu

SEQ ID NO: 1222593 - RNA, 17 nt, Human
ugaagguaaaauugaaa

SEQ ID NO: 1222594 - RNA, 17 nt, Human
augcuggccaggcuggu

SEQ ID NO: 1222595 - RNA, 12 nt, Human
uguaaauagaaa

SEQ ID NO: 1222596 - RNA, 17 nt, Human
uuaucucaaaacugcac

SEQ ID NO: 1222597 - RNA, 20 nt, Human
agagauuuuuaaauaaagaa

SEQ ID NO: 1222598 - RNA, 15 nt, Human
uacccuuugaaaaag

SEQ ID NO: 1222599 - RNA, 21 nt, Human
accaaucauuuuaauuauuau

SEQ ID NO: 1222600 - RNA, 17 nt, Human
uaaguugcugaugaacu

SEQ ID NO: 1222601 - RNA, 17 nt, Human
uggugaaaugcagaguc

SEQ ID NO: 1222602 - RNA, 21 nt, Human
auugaaaggcauucucugaag

SEQ ID NO: 1222603 - RNA, 22 nt, Human
gccucuaaaaggccugucccug

SEQ ID NO: 1222604 - RNA, 16 nt, Human
aacuuaagguuaccuu

SEQ ID NO: 1222605 - RNA, 13 nt, Human
uuaaaaucauuuc

SEQ ID NO: 1222606 - RNA, 13 nt, Human
uguaacuuaugaa

SEQ ID NO: 1222607 - RNA, 21 nt, Human
aaaagaauauuuuaacuuccu

SEQ ID NO: 1222608 - RNA, 15 nt, Human
augcuggccaggcug

SEQ ID NO: 1222609 - RNA, 15 nt, Human
cagacaguguuuucu

SEQ ID NO: 1222610 - RNA, 19 nt, Human
aaaacuaagaaauaugcac

SEQ ID NO: 1222611 - RNA, 16 nt, Human
gccuggcugggagugg

SEQ ID NO: 1222612 - RNA, 22 nt, Human
gggccuccucuguccagggccc

SEQ ID NO: 1222613 - RNA, 22 nt, Human
cuuguaaaguacagacuuuuuu

SEQ ID NO: 1222614 - RNA, 11 nt, Human
aaguauauaua

SEQ ID NO: 1222615 - RNA, 20 nt, Human
uugcaaccuccaccuucugg

SEQ ID NO: 1222616 - RNA, 19 nt, Human
cuugcccagggcucagccu

SEQ ID NO: 1222617 - RNA, 18 nt, Human
gcaguagcagcagcaucu

SEQ ID NO: 1222618 - RNA, 22 nt, Human
caguguccucaucuguaaaaug

SEQ ID NO: 1222619 - RNA, 20 nt, Human
uauauauguauuuauaaaua

SEQ ID NO: 1222620 - RNA, 19 nt, Human
gacucagggccccagcacu

SEQ ID NO: 1222621 - RNA, 19 nt, Human
acugaggcagacagcagcu

SEQ ID NO: 1222622 - RNA, 19 nt, Human
cuaauuuguguauuuucag

SEQ ID NO: 1222623 - RNA, 13 nt, Human
agugucuggcacu

SEQ ID NO: 1222624 - RNA, 20 nt, Human
aaguauuuauauauuuauaa

SEQ ID NO: 1222625 - RNA, 16 nt, Human
aguacuguguacagaa

SEQ ID NO: 1222626 - RNA, 19 nt, Human
ucccuacaccccuccccug

SEQ ID NO: 1222627 - RNA, 20 nt, Human
caagcauaccaacacgagca

SEQ ID NO: 1222628 - RNA, 12 nt, Human
agaaacauuuau

SEQ ID NO: 1222629 - RNA, 17 nt, Human
cuuuacuguuagucauu

SEQ ID NO: 1222630 - RNA, 15 nt, Human
ugacaacuugaauaa

SEQ ID NO: 1222631 - RNA, 15 nt, Human
uuacuacuuuaaaaa

SEQ ID NO: 1222632 - RNA, 17 nt, Human
ucagucauaacuaaaua

SEQ ID NO: 1222633 - RNA, 23 nt, Human
caucagcuugcccuguuaaaaga

SEQ ID NO: 1222634 - RNA, 21 nt, Human
aagacaacauuaaaacaauau

SEQ ID NO: 1222635 - RNA, 23 nt, Human
auuuuaaaaaauggaacauaaaa

SEQ ID NO: 1222636 - RNA, 16 nt, Human
cagcuucucauccugc

SEQ ID NO: 1222637 - RNA, 20 nt, Human
gcccaucuccgucucccaaa

SEQ ID NO: 1222638 - RNA, 19 nt, Human
uaaauuuucccaaaacuga

SEQ ID NO: 1222639 - RNA, 19 nt, Human
gguggacccagggaugaca

SEQ ID NO: 1222640 - RNA, 20 nt, Human
aaaugauuuucaaauuugau

SEQ ID NO: 1222641 - RNA, 15 nt, Human
uuacaucuuucacau

SEQ ID NO: 1222642 - RNA, 17 nt, Human
cuggcaaggguucaccu

SEQ ID NO: 1222643 - RNA, 23 nt, Human
uuugaacaacucgaaucacucau

SEQ ID NO: 1222644 - RNA, 24 nt, Human
uucaaaugauuuucaaauuugaug

SEQ ID NO: 1222645 - RNA, 18 nt, Human
ugguuccauucucucucc

SEQ ID NO: 1222646 - RNA, 19 nt, Human
aauagcauaaguuucuggg

SEQ ID NO: 1222647 - RNA, 15 nt, Human
uucacaagugaaaaa

SEQ ID NO: 1222648 - RNA, 20 nt, Human
agcucgguggacccagggau

SEQ ID NO: 1222649 - RNA, 15 nt, Human
cucgaacugcuggau

SEQ ID NO: 1222650 - RNA, 16 nt, Human
auguagauaaagcacu

SEQ ID NO: 1222651 - RNA, 15 nt, Human
aaaagucaaucuuau

SEQ ID NO: 1222652 - RNA, 20 nt, Human
cgaaauguuauuuuuuaauu

SEQ ID NO: 1222653 - RNA, 15 nt, Human
uaaaaucuaauucaa

SEQ ID NO: 1222654 - RNA, 19 nt, Human
agaccuguaaucauauaau

SEQ ID NO: 1222655 - RNA, 15 nt, Human
gcagggucaggagag

SEQ ID NO: 1222656 - RNA, 22 nt, Human
aggguccuuugggaaaggagaa

SEQ ID NO: 1222657 - RNA, 22 nt, Human
auuguuuuuccuuguauuuaaa

SEQ ID NO: 1222658 - RNA, 16 nt, Human
caaauuccagaaugau

SEQ ID NO: 1222659 - RNA, 21 nt, Human
uguucacagccagacuggcac

SEQ ID NO: 1222660 - RNA, 15 nt, Human
ugacuggccugcugg

SEQ ID NO: 1222661 - RNA, 13 nt, Human
gagaauauuagcu

SEQ ID NO: 1222662 - RNA, 17 nt, Human
agagacucagggcccca

SEQ ID NO: 1222663 - RNA, 17 nt, Human
uauagcauauguuuuug

SEQ ID NO: 1222664 - RNA, 21 nt, Human
ggcucagccuggugggccucc

SEQ ID NO: 1222665 - RNA, 16 nt, Human
uuacauguuuucuuug

SEQ ID NO: 1222666 - RNA, 19 nt, Human
uauaucaguccucuuucaa

SEQ ID NO: 1222667 - RNA, 12 nt, Human
ucuuaaagaauu

SEQ ID NO: 1222668 - RNA, 17 nt, Human
aagaagccacagaccua

SEQ ID NO: 1222669 - RNA, 22 nt, Human
acaagcuuuuuuuuuuuuucuu

SEQ ID NO: 1222670 - RNA, 22 nt, Human
aaaugugcuuuuaaaaaaaaau

SEQ ID NO: 1222671 - RNA, 17 nt, Human
cuggcugggaguggcau

SEQ ID NO: 1222672 - RNA, 15 nt, Human
aaucaaauuccagaa

SEQ ID NO: 1222673 - RNA, 20 nt, Human
aggcagggucaggagagggg

SEQ ID NO: 1222674 - RNA, 19 nt, Human
aguaauuucagaagaaauu

SEQ ID NO: 1222675 - RNA, 14 nt, Human
gcccagggcucagc

SEQ ID NO: 1222676 - RNA, 16 nt, Human
auggaggcuuugcaua

SEQ ID NO: 1222677 - RNA, 16 nt, Human
cucgaacugcuggauu

SEQ ID NO: 1222678 - RNA, 14 nt, Human
acugagaugugaac

SEQ ID NO: 1222679 - RNA, 13 nt, Human
agccagcagccag

SEQ ID NO: 1222680 - RNA, 17 nt, Human
uagaucuuacaucugca

SEQ ID NO: 1222681 - RNA, 12 nt, Human
ggacgagaauga

SEQ ID NO: 1222682 - RNA, 13 nt, Human
aucacaaaucuua

SEQ ID NO: 1222683 - RNA, 13 nt, Human
acaugagagacag

SEQ ID NO: 1222684 - RNA, 22 nt, Human
auacaauguuauguauuauuau

SEQ ID NO: 1222685 - RNA, 15 nt, Human
agaauuuuaaaacuc

SEQ ID NO: 1222686 - RNA, 18 nt, Human
cuauagauucuuuauuag

SEQ ID NO: 1222687 - RNA, 14 nt, Human
agacucagggcccc

SEQ ID NO: 1222688 - RNA, 13 nt, Human
aauacacacucaa

SEQ ID NO: 1222689 - RNA, 23 nt, Human
auugcagaguacuggcugaugga

SEQ ID NO: 1222690 - RNA, 15 nt, Human
uggaguaaaucgcua

SEQ ID NO: 1222691 - RNA, 13 nt, Human
ugcaguggcgcaa

SEQ ID NO: 1222692 - RNA, 22 nt, Human
gaagggcaucaugcaucuuacu

SEQ ID NO: 1222693 - RNA, 18 nt, Human
uccagauacacccaaagu

SEQ ID NO: 1222694 - RNA, 17 nt, Human
cugcugaaacaacaaau

SEQ ID NO: 1222695 - RNA, 22 nt, Human
auuaugaucucagaaauuguau

SEQ ID NO: 1222696 - RNA, 13 nt, Human
aauuaaucuugua

SEQ ID NO: 1222697 - RNA, 17 nt, Human
gccuagccgaccucagc

SEQ ID NO: 1222698 - RNA, 19 nt, Human
caaaucuuaacuugaagga

SEQ ID NO: 1222699 - RNA, 23 nt, Human
caguuagagauuuuuaaauaaag

SEQ ID NO: 1222700 - RNA, 16 nt, Human
ucacaagugaaaaaca

SEQ ID NO: 1222701 - RNA, 13 nt, Human
aauucuaaaugaa

SEQ ID NO: 1222702 - RNA, 18 nt, Human
cuuuuuuuuuuuuuuaaa

SEQ ID NO: 1222703 - RNA, 19 nt, Human
uaaucauauaauaaaugua

SEQ ID NO: 1222704 - RNA, 11 nt, Human
ggguuucucca

SEQ ID NO: 1222705 - RNA, 14 nt, Human
gagccaccaaaccc

SEQ ID NO: 1222706 - RNA, 12 nt, Human
aauugcagagua

SEQ ID NO: 1222707 - RNA, 15 nt, Human
caucaguuacucuga

SEQ ID NO: 1222708 - RNA, 19 nt, Human
agcaaaaaaguacuuaaaa

SEQ ID NO: 1222709 - RNA, 20 nt, Human
uaccagcccuacaccauucc

SEQ ID NO: 1222710 - RNA, 15 nt, Human
auuuauaacucauca

SEQ ID NO: 1222711 - RNA, 22 nt, Human
cagacuuuuuuuuuuuuuuaaa

SEQ ID NO: 1222712 - RNA, 11 nt, Human
cauguauuuua

SEQ ID NO: 1222713 - RNA, 14 nt, Human
auagagugggacag

SEQ ID NO: 1222714 - RNA, 20 nt, Human
uuaaaagaauauuuuaacuu

SEQ ID NO: 1222715 - RNA, 15 nt, Human
gagauuccugagcca

SEQ ID NO: 1222716 - RNA, 15 nt, Human
gcuuauuaaaacuca

SEQ ID NO: 1222717 - RNA, 17 nt, Human
agauucccugagcagga

SEQ ID NO: 1222718 - RNA, 17 nt, Human
uuagcuuuacuguuugu

SEQ ID NO: 1222719 - RNA, 15 nt, Human
gucuuaauuaaaaga

SEQ ID NO: 1222720 - RNA, 23 nt, Human
caaagcaugggccuagcccacug

SEQ ID NO: 1222721 - RNA, 14 nt, Human
uuccugagccagug

SEQ ID NO: 1222722 - RNA, 23 nt, Human
agacagcuucucauccugcaggc

SEQ ID NO: 1222723 - RNA, 13 nt, Human
ucaaacagucuca

SEQ ID NO: 1222724 - RNA, 15 nt, Human
guguacaugaaagcg

SEQ ID NO: 1222725 - RNA, 17 nt, Human
aaaugcuguauucuucu

SEQ ID NO: 1222726 - RNA, 14 nt, Human
cugagcauguacug

SEQ ID NO: 1222727 - RNA, 13 nt, Human
aauaaauguacau

SEQ ID NO: 1222728 - RNA, 13 nt, Human
aauuagaugaacu

SEQ ID NO: 1222729 - RNA, 21 nt, Human
acagccagacuggcacaguuu

SEQ ID NO: 1222730 - RNA, 18 nt, Human
aucacaaaaguauauuca

SEQ ID NO: 1222731 - RNA, 18 nt, Human
acagaccuaggauuucau

SEQ ID NO: 1222732 - RNA, 22 nt, Human
ggacuucugucuucacaacaga

SEQ ID NO: 1222733 - RNA, 19 nt, Human
agggucaggagaggggcag

SEQ ID NO: 1222734 - RNA, 23 nt, Human
guacuguguacagaauucugcua

SEQ ID NO: 1222735 - RNA, 19 nt, Human
uaaacuggaaauaaaagau

SEQ ID NO: 1222736 - RNA, 12 nt, Human
aaaacaaagaag

SEQ ID NO: 1222737 - RNA, 19 nt, Human
auucugcaagcuuuucaaa

SEQ ID NO: 1222738 - RNA, 20 nt, Human
ggcucagccuggugggccuc

SEQ ID NO: 1222739 - RNA, 16 nt, Human
cagccagcucucagcc

SEQ ID NO: 1222740 - RNA, 20 nt, Human
agcagagacgggguuugcca

SEQ ID NO: 1222741 - RNA, 23 nt, Human
uacugccuaucagcauuuuacua

SEQ ID NO: 1222742 - RNA, 14 nt, Human
guccaagcauacca

SEQ ID NO: 1222743 - RNA, 17 nt, Human
aaugacuaaaaaacaaa

SEQ ID NO: 1222744 - RNA, 17 nt, Human
ugaaaagauuaugaucu

SEQ ID NO: 1222745 - RNA, 20 nt, Human
ccacauggcuucaccugucc

SEQ ID NO: 1222746 - RNA, 18 nt, Human
acauguuuucuuugcuuu

SEQ ID NO: 1222747 - RNA, 18 nt, Human
uuccugagaccagccaac

SEQ ID NO: 1222748 - RNA, 23 nt, Human
caaucuuaucauauuucaaauga

SEQ ID NO: 1222749 - RNA, 22 nt, Human
cuaacauauaauguuguuauuu

SEQ ID NO: 1222750 - RNA, 15 nt, Human
cugaagaguggguuu

SEQ ID NO: 1222751 - RNA, 16 nt, Human
ucauuuuaaaaaaugg

SEQ ID NO: 1222752 - RNA, 16 nt, Human
cagaagaaauucugca

SEQ ID NO: 1222753 - RNA, 15 nt, Human
ugcaaccuccaccuu

SEQ ID NO: 1222754 - RNA, 20 nt, Human
aucucugauacuuuuuucau

SEQ ID NO: 1222755 - RNA, 22 nt, Human
uuaagcacuuuaacacaguguc

SEQ ID NO: 1222756 - RNA, 14 nt, Human
augcuguauucuuc

SEQ ID NO: 1222757 - RNA, 20 nt, Human
ugauucacccugauuuuaca

SEQ ID NO: 1222758 - RNA, 13 nt, Human
uuugccaugcugg

SEQ ID NO: 1222759 - RNA, 14 nt, Human
uagggaccugcugu

SEQ ID NO: 1222760 - RNA, 18 nt, Human
uuuuauuguuuaaaauca

SEQ ID NO: 1222761 - RNA, 17 nt, Human
cucagccuuccccuugc

SEQ ID NO: 1222762 - RNA, 13 nt, Human
aaagccaaaaacc

SEQ ID NO: 1222763 - RNA, 15 nt, Human
aagaaauaugcacaa

SEQ ID NO: 1222764 - RNA, 16 nt, Human
uaugacacaucucuga

SEQ ID NO: 1222765 - RNA, 13 nt, Human
cacccugauuuua

SEQ ID NO: 1222766 - RNA, 16 nt, Human
aaauuagaugacugaa

SEQ ID NO: 1222767 - RNA, 20 nt, Human
uagauaaacucagaaauuua

SEQ ID NO: 1222768 - RNA, 23 nt, Human
cugagaccagccaaccugggggc

SEQ ID NO: 1222769 - RNA, 14 nt, Human
uuuuaaaaaaugga

SEQ ID NO: 1222770 - RNA, 15 nt, Human
ggccucggagccuca

SEQ ID NO: 1222771 - RNA, 18 nt, Human
uaauucaaacuaauagaa

SEQ ID NO: 1222772 - RNA, 20 nt, Human
aaaagauuaugaucucagaa

SEQ ID NO: 1222773 - RNA, 16 nt, Human
guuacauuauuaucaa

SEQ ID NO: 1222774 - RNA, 20 nt, Human
cacuggcucccuggaagaga

SEQ ID NO: 1222775 - RNA, 14 nt, Human
agcuuagaccucag

SEQ ID NO: 1222776 - RNA, 24 nt, Human
aaaauuccuuagcuuagaccucag

SEQ ID NO: 1222777 - RNA, 21 nt, Human
aggguucaccugggcugaggc

SEQ ID NO: 1222778 - RNA, 20 nt, Human
uacaguuagagauuuuuaaa

SEQ ID NO: 1222779 - RNA, 17 nt, Human
uuuaaagcuuauuaaaa

SEQ ID NO: 1222780 - RNA, 16 nt, Human
gaguggguuucacaag

SEQ ID NO: 1222781 - RNA, 15 nt, Human
agccagcucucagcc

SEQ ID NO: 1222782 - RNA, 22 nt, Human
ccggagccccuugggcagguca

SEQ ID NO: 1222783 - RNA, 23 nt, Human
acuggcucccuggaagagaucaa

SEQ ID NO: 1222784 - RNA, 14 nt, Human
uuaaguguaacugg

SEQ ID NO: 1222785 - RNA, 17 nt, Human
uuucugcuuuaauuuca

SEQ ID NO: 1222786 - RNA, 21 nt, Human
aaaauaccaugccauuuaaag

SEQ ID NO: 1222787 - RNA, 16 nt, Human
cacuuuuuuucuuuuc

SEQ ID NO: 1222788 - RNA, 14 nt, Human
gagacucagggccc

SEQ ID NO: 1222789 - RNA, 18 nt, Human
aaaacuguaaauuuauua

SEQ ID NO: 1222790 - RNA, 15 nt, Human
uggaaauaaaagauu

SEQ ID NO: 1222791 - RNA, 15 nt, Human
ugccugcaggcauga

SEQ ID NO: 1222792 - RNA, 14 nt, Human
uguguuauuuaaau

SEQ ID NO: 1222793 - RNA, 16 nt, Human
gucacuagggcaggga

SEQ ID NO: 1222794 - RNA, 14 nt, Human
aaucacucauuuau

SEQ ID NO: 1222795 - RNA, 13 nt, Human
aauuucaugaaaa

SEQ ID NO: 1222796 - RNA, 14 nt, Human
uggacaguuuucug

SEQ ID NO: 1222797 - RNA, 13 nt, Human
aauguaagggaaa

SEQ ID NO: 1222798 - RNA, 17 nt, Human
ugaugaucuuuaaaaua

SEQ ID NO: 1222799 - RNA, 14 nt, Human
cagucugaugagaa

SEQ ID NO: 1222800 - RNA, 20 nt, Human
caggugccaguuauggcuau

SEQ ID NO: 1222801 - RNA, 14 nt, Human
aauuauaauauacu

SEQ ID NO: 1222802 - RNA, 13 nt, Human
uguaaaguacaga

SEQ ID NO: 1222803 - RNA, 19 nt, Human
cugucccagcgagggacac

SEQ ID NO: 1222804 - RNA, 21 nt, Human
ucuucuuugaauuuccuaucu

SEQ ID NO: 1222805 - RNA, 17 nt, Human
gacugguucaaauguug

SEQ ID NO: 1222806 - RNA, 17 nt, Human
auguacaugaagaagcu

SEQ ID NO: 1222807 - RNA, 20 nt, Human
gcugaaacaacaaauaggaa

SEQ ID NO: 1222808 - RNA, 15 nt, Human
uuuaccugugaaaua

SEQ ID NO: 1222809 - RNA, 15 nt, Human
acgaaauguuauuuu

SEQ ID NO: 1222810 - RNA, 23 nt, Human
uguucucuucuuuaaagggaugg

SEQ ID NO: 1222811 - RNA, 21 nt, Human
uccguggcacugcauacaauc

SEQ ID NO: 1222812 - RNA, 16 nt, Human
acuacuuuaaaaaaaa

SEQ ID NO: 1222813 - RNA, 18 nt, Human
uugaaaaaguauaaauaa

SEQ ID NO: 1222814 - RNA, 23 nt, Human
cuaaguugcaccaacuuugaagu

SEQ ID NO: 1222815 - RNA, 15 nt, Human
caggaggaaggcuua

SEQ ID NO: 1222816 - RNA, 16 nt, Human
ucuacuuuuaaguugc

SEQ ID NO: 1222817 - RNA, 16 nt, Human
agauaauuauaauaua

SEQ ID NO: 1222818 - RNA, 15 nt, Human
aggcagacagcagcu

SEQ ID NO: 1222819 - RNA, 13 nt, Human
auuuccuaucugu

SEQ ID NO: 1222820 - RNA, 19 nt, Human
uaaauuauuauuuaaacau

SEQ ID NO: 1222821 - RNA, 15 nt, Human
uauuaucaugcaaau

SEQ ID NO: 1222822 - RNA, 17 nt, Human
aaaauuggacuuaaaau

SEQ ID NO: 1222823 - RNA, 12 nt, Human
gcuggccaggcu

SEQ ID NO: 1222824 - RNA, 15 nt, Human
auuggacuuccauuu

SEQ ID NO: 1222825 - RNA, 19 nt, Human
auagauucccugagcagga

SEQ ID NO: 1222826 - RNA, 18 nt, Human
uucuggguucaagcgauu

SEQ ID NO: 1222827 - RNA, 18 nt, Human
auucacccugauuuuaca

SEQ ID NO: 1222828 - RNA, 22 nt, Human
cagaguacuggcugauggagua

SEQ ID NO: 1222829 - RNA, 13 nt, Human
uuaucauauuuca

SEQ ID NO: 1222830 - RNA, 21 nt, Human
aaacaucaguuacucugaagg

SEQ ID NO: 1222831 - RNA, 18 nt, Human
cugcaggcgugaccugac

SEQ ID NO: 1222832 - RNA, 21 nt, Human
caaacagucucaggaaaucaa

SEQ ID NO: 1222833 - RNA, 20 nt, Human
ugauccgcccaucuccgucu

SEQ ID NO: 1222834 - RNA, 16 nt, Human
gcccagggcucagccu

SEQ ID NO: 1222835 - RNA, 15 nt, Human
cagggccccagcacu

SEQ ID NO: 1222836 - RNA, 16 nt, Human
aucagucauaacuaaa

SEQ ID NO: 1222837 - RNA, 16 nt, Human
auuccaauacauuauu

SEQ ID NO: 1222838 - RNA, 20 nt, Human
acccacuucacacacaggca

SEQ ID NO: 1222839 - RNA, 14 nt, Human
uuucugaugucaaa

SEQ ID NO: 1222840 - RNA, 15 nt, Human
aaaucacaaacucau

SEQ ID NO: 1222841 - RNA, 19 nt, Human
uaaaaauuaauucuuuauc

SEQ ID NO: 1222842 - RNA, 16 nt, Human
uggagacaccaccacc

SEQ ID NO: 1222843 - RNA, 15 nt, Human
acucugagcagugcu

SEQ ID NO: 1222844 - RNA, 22 nt, Human
cuucuaaguaaaaccacagcag

SEQ ID NO: 1222845 - RNA, 22 nt, Human
cuguucacagccagacuggcac

SEQ ID NO: 1222846 - RNA, 21 nt, Human
uauguaaauagaaacguguau

SEQ ID NO: 1222847 - RNA, 17 nt, Human
cagcaggauagaguggg

SEQ ID NO: 1222848 - RNA, 14 nt, Human
ggacaguuuucugc

SEQ ID NO: 1222849 - RNA, 19 nt, Human
uuaaauggagaaaggaccc

SEQ ID NO: 1222850 - RNA, 13 nt, Human
gcaggcagcagga

SEQ ID NO: 1222851 - RNA, 13 nt, Human
gagcaccugcagg

SEQ ID NO: 1222852 - RNA, 18 nt, Human
auagaaacguguauauuu

SEQ ID NO: 1222853 - RNA, 21 nt, Human
cugugcugcccgucuucagcc

SEQ ID NO: 1222854 - RNA, 20 nt, Human
aacaaacgaaaaacauuuca

SEQ ID NO: 1222855 - RNA, 23 nt, Human
ucuggcacuugggacaaaaacaa

SEQ ID NO: 1222856 - RNA, 22 nt, Human
cugagcagugcuugaaugaagu

SEQ ID NO: 1222857 - RNA, 14 nt, Human
caacaguuuuuuau

SEQ ID NO: 1222858 - RNA, 15 nt, Human
uauuauuuauauaug

SEQ ID NO: 1222859 - RNA, 23 nt, Human
auuccuuagcuuagaccucagcc

SEQ ID NO: 1222860 - RNA, 13 nt, Human
acaucuuucacau

SEQ ID NO: 1222861 - RNA, 21 nt, Human
auuuaaacaucagcaaaaaag

SEQ ID NO: 1222862 - RNA, 17 nt, Human
caaauaugcaaagcacu

SEQ ID NO: 1222863 - RNA, 22 nt, Human
agaguggaaccaacacuaacau

SEQ ID NO: 1222864 - RNA, 19 nt, Human
cacuguagcauuacagugg

SEQ ID NO: 1222865 - RNA, 19 nt, Human
gugucuggcacuugggaca

SEQ ID NO: 1222866 - RNA, 16 nt, Human
uggacucauuuuaaaa

SEQ ID NO: 1222867 - RNA, 14 nt, Human
uuuucaaaauggag

SEQ ID NO: 1222868 - RNA, 17 nt, Human
aaauaccaugccauuua

SEQ ID NO: 1222869 - RNA, 22 nt, Human
ugaaacugagaugugaacacau

SEQ ID NO: 1222870 - RNA, 13 nt, Human
aaaguacuuaaaa

SEQ ID NO: 1222871 - RNA, 20 nt, Human
auauaauguuguuauuuaaa

SEQ ID NO: 1222872 - RNA, 11 nt, Human
ccaaggcugga

SEQ ID NO: 1222873 - RNA, 17 nt, Human
acacaaccugucccagc

SEQ ID NO: 1222874 - RNA, 14 nt, Human
cauuuucaaaaugg

SEQ ID NO: 1222875 - RNA, 21 nt, Human
uuucaaaaucaaauuccagaa

SEQ ID NO: 1222876 - RNA, 19 nt, Human
cacugacuucuaaguaaaa

SEQ ID NO: 1222877 - RNA, 23 nt, Human
cuucagccuagccgaccucagcc

SEQ ID NO: 1222878 - RNA, 20 nt, Human
gaccucagccugugcugccc

SEQ ID NO: 1222879 - RNA, 20 nt, Human
ccagauacacccaaaguauc

SEQ ID NO: 1222880 - RNA, 19 nt, Human
uaauaaaugugccuucauu

SEQ ID NO: 1222881 - RNA, 18 nt, Human
guaaauagaaacguguau

SEQ ID NO: 1222882 - RNA, 15 nt, Human
auugugaucagacca

SEQ ID NO: 1222883 - RNA, 21 nt, Human
uaaaaaggcauguaauugcuu

SEQ ID NO: 1222884 - RNA, 21 nt, Human
gggaagacuguggcugcuagc

SEQ ID NO: 1222885 - RNA, 22 nt, Human
ucaaacagucucaggaaaucaa

SEQ ID NO: 1222886 - RNA, 19 nt, Human
uccaaagcugaauacauuc

SEQ ID NO: 1222887 - RNA, 16 nt, Human
uauauuuuuuaugaaa

SEQ ID NO: 1222888 - RNA, 21 nt, Human
accugacagcccaaggguggg

SEQ ID NO: 1222889 - RNA, 19 nt, Human
ccaaucauuuuaauuauua

SEQ ID NO: 1222890 - RNA, 22 nt, Human
cuccagagggaauugcagagua

SEQ ID NO: 1222891 - RNA, 14 nt, Human
caguugaaaagacu

SEQ ID NO: 1222892 - RNA, 14 nt, Human
uugagaagagaaua

SEQ ID NO: 1222893 - RNA, 16 nt, Human
caaggguggguggggu

SEQ ID NO: 1222894 - RNA, 21 nt, Human
ucaagacaaaugacccccauc

SEQ ID NO: 1222895 - RNA, 21 nt, Human
gauaaguaaguuugauuucau

SEQ ID NO: 1222896 - RNA, 22 nt, Human
acucauuuuuguuuucauuauc

SEQ ID NO: 1222897 - RNA, 20 nt, Human
gauaucagcccaaaagucaa

SEQ ID NO: 1222898 - RNA, 20 nt, Human
caaagcacgaaauguuauuu

SEQ ID NO: 1222899 - RNA, 20 nt, Human
agacgggguuugccaugcug

SEQ ID NO: 1222900 - RNA, 15 nt, Human
acuuuggcaaaugag

SEQ ID NO: 1222901 - RNA, 21 nt, Human
uuacaggcgugagccaccaaa

SEQ ID NO: 1222902 - RNA, 14 nt, Human
aauugcagaguacu

SEQ ID NO: 1222903 - RNA, 15 nt, Human
caaagaagacaacau

SEQ ID NO: 1222904 - RNA, 20 nt, Human
auucagccccgggaguggcg

SEQ ID NO: 1222905 - RNA, 15 nt, Human
agcaaaauggauaug

SEQ ID NO: 1222906 - RNA, 18 nt, Human
acccagggaugacauguc

SEQ ID NO: 1222907 - RNA, 19 nt, Human
cauagauucccugagcagg

SEQ ID NO: 1222908 - RNA, 20 nt, Human
acuguuaucaaaacuuucuu

SEQ ID NO: 1222909 - RNA, 20 nt, Human
aagcaucauuauuugcagag

SEQ ID NO: 1222910 - RNA, 16 nt, Human
auauugauaauaaaau

SEQ ID NO: 1222911 - RNA, 15 nt, Human
cagaucauuucaaaa

SEQ ID NO: 1222912 - RNA, 13 nt, Human
cucuaacucagaa

SEQ ID NO: 1222913 - RNA, 13 nt, Human
uacuaauaaaaua

SEQ ID NO: 1222914 - RNA, 19 nt, Human
ugggcagugaugucacuag

SEQ ID NO: 1222915 - RNA, 15 nt, Human
gcgugagccaccaaa

SEQ ID NO: 1222916 - RNA, 15 nt, Human
agcauuacagugggu

SEQ ID NO: 1222917 - RNA, 16 nt, Human
uaauuucaugaaaaga

SEQ ID NO: 1222918 - RNA, 15 nt, Human
auaaauauauuuaag

SEQ ID NO: 1222919 - RNA, 13 nt, Human
uuauuaauuugua

SEQ ID NO: 1222920 - RNA, 16 nt, Human
cauaauguuacauuau

SEQ ID NO: 1222921 - RNA, 18 nt, Human
auuuuuaaauaaagaauu

SEQ ID NO: 1222922 - RNA, 18 nt, Human
caguucauauguaccaug

SEQ ID NO: 1222923 - RNA, 16 nt, Human
caaaaaccaaauuugu

SEQ ID NO: 1222924 - RNA, 17 nt, Human
uaaaauucauuccauuu

SEQ ID NO: 1222925 - RNA, 22 nt, Human
uguauuauuauucccauucuac

SEQ ID NO: 1222926 - RNA, 22 nt, Human
ugaauuuuuuucaucuucucug

SEQ ID NO: 1222927 - RNA, 22 nt, Human
aauuuucuagaauacuaauaaa

SEQ ID NO: 1222928 - RNA, 19 nt, Human
auauauuuauaacucauca

SEQ ID NO: 1222929 - RNA, 22 nt, Human
gcaacugaggcagacagcagcu

SEQ ID NO: 1222930 - RNA, 16 nt, Human
cuggccugcuggaugu

SEQ ID NO: 1222931 - RNA, 12 nt, Human
guauaaauaaaa

SEQ ID NO: 1222932 - RNA, 13 nt, Human
agccuugcuccug

SEQ ID NO: 1222933 - RNA, 17 nt, Human
ugaaauggugaaaugca

SEQ ID NO: 1222934 - RNA, 19 nt, Human
uacauucugcuuucaucuu

SEQ ID NO: 1222935 - RNA, 21 nt, Human
ucaaaauaccaugccauuuaa

SEQ ID NO: 1222936 - RNA, 22 nt, Human
guaaguuuaugcauacaguaau

SEQ ID NO: 1222937 - RNA, 17 nt, Human
uucaguugauuuuacaa

SEQ ID NO: 1222938 - RNA, 15 nt, Human
uuuuuaaacaaaaaa

SEQ ID NO: 1222939 - RNA, 20 nt, Human
acuaaaaaggcauguaauug

SEQ ID NO: 1222940 - RNA, 12 nt, Human
cauuuuaaaaaa

SEQ ID NO: 1222941 - RNA, 19 nt, Human
aacucuuaaucaaauagca

SEQ ID NO: 1222942 - RNA, 20 nt, Human
cccgggaguggcgcgcgcca

SEQ ID NO: 1222943 - RNA, 18 nt, Human
cugggaauuacaggcgug

SEQ ID NO: 1222944 - RNA, 21 nt, Human
gauaaagcacuguuuggauau

SEQ ID NO: 1222945 - RNA, 23 nt, Human
aauagugucugaugaauguuaaa

SEQ ID NO: 1222946 - RNA, 19 nt, Human
agaauacuaauaaaauaca

SEQ ID NO: 1222947 - RNA, 16 nt, Human
augauuuucaaauuug

SEQ ID NO: 1222948 - RNA, 19 nt, Human
acagucucaggaaaucaaa

SEQ ID NO: 1222949 - RNA, 21 nt, Human
acguaggaacgguaaauuucu

SEQ ID NO: 1222950 - RNA, 14 nt, Human
agcuagaaaaauua

SEQ ID NO: 1222951 - RNA, 20 nt, Human
auaaauuuucccaaaacuga

SEQ ID NO: 1222952 - RNA, 23 nt, Human
ccagagggaauugcagaguacug

SEQ ID NO: 1222953 - RNA, 20 nt, Human
auguuauuuuuuaauuauua

SEQ ID NO: 1222954 - RNA, 17 nt, Human
gcuuuauuuuuuaagua

SEQ ID NO: 1222955 - RNA, 16 nt, Human
ugggucucaguguccu

SEQ ID NO: 1222956 - RNA, 18 nt, Human
auuuuacacacauuaaaa

SEQ ID NO: 1222957 - RNA, 21 nt, Human
aaugugcuuuuaaaaaaaaau

SEQ ID NO: 1222958 - RNA, 20 nt, Human
aucuguaaaauggagacacc

SEQ ID NO: 1222959 - RNA, 16 nt, Human
gaugugggcagugaug

SEQ ID NO: 1222960 - RNA, 20 nt, Human
guuuaugcauacaguaauuu

SEQ ID NO: 1222961 - RNA, 19 nt, Human
uaauacagggcauuuuggu

SEQ ID NO: 1222962 - RNA, 15 nt, Human
caagguucuucccuu

SEQ ID NO: 1222963 - RNA, 17 nt, Human
uccuugcaucaauuuuu

SEQ ID NO: 1222964 - RNA, 14 nt, Human
cucagggccccagc

SEQ ID NO: 1222965 - RNA, 17 nt, Human
ugcuacaaaaacacagc

SEQ ID NO: 1222966 - RNA, 18 nt, Human
uauugauaauaaaauuca

SEQ ID NO: 1222967 - RNA, 18 nt, Human
acaucuagcaaauguuau

SEQ ID NO: 1222968 - RNA, 11 nt, Human
uuguuuuucca

SEQ ID NO: 1222969 - RNA, 17 nt, Human
ccuagccgaccucagcc

SEQ ID NO: 1222970 - RNA, 23 nt, Human
uuuuccuuccuuaucacugacac

SEQ ID NO: 1222971 - RNA, 16 nt, Human
auguaaucaauguuuc

SEQ ID NO: 1222972 - RNA, 12 nt, Human
cuucucuuaaac

SEQ ID NO: 1222973 - RNA, 23 nt, Human
uaaauauaauaugcacacagugc

SEQ ID NO: 1222974 - RNA, 15 nt, Human
auuucagaagaaauu

SEQ ID NO: 1222975 - RNA, 13 nt, Human
cugaggcagacag

SEQ ID NO: 1222976 - RNA, 20 nt, Human
aauguuacauuauuaucaac

SEQ ID NO: 1222977 - RNA, 13 nt, Human
cuuuaaaauacac

SEQ ID NO: 1222978 - RNA, 15 nt, Human
cacaggcuccaaacu

SEQ ID NO: 1222979 - RNA, 23 nt, Human
ccuugggcaggucacacaaccug

SEQ ID NO: 1222980 - RNA, 17 nt, Human
ucccagucauuuaauaa

SEQ ID NO: 1222981 - RNA, 15 nt, Human
auauacuauauuuau

SEQ ID NO: 1222982 - RNA, 16 nt, Human
gaauacuaauaaaaua

SEQ ID NO: 1222983 - RNA, 18 nt, Human
ggacacaggcuccaaacu

SEQ ID NO: 1222984 - RNA, 16 nt, Human
gcagggcauggcuggg

SEQ ID NO: 1222985 - RNA, 17 nt, Human
gaggcauccuuccucac

SEQ ID NO: 1222986 - RNA, 22 nt, Human
aaauccuuuacuguuagucauu

SEQ ID NO: 1222987 - RNA, 16 nt, Human
uacacacucaaaucaa

SEQ ID NO: 1222988 - RNA, 12 nt, Human
aaugacugucua

SEQ ID NO: 1222989 - RNA, 23 nt, Human
cauuuuaaaaaauggaacauaaa

SEQ ID NO: 1222990 - RNA, 16 nt, Human
uauacuguauuuuuac

SEQ ID NO: 1222991 - RNA, 16 nt, Human
uguaucacaaaucuua

SEQ ID NO: 1222992 - RNA, 21 nt, Human
uagauaaacucagaaauuuaa

SEQ ID NO: 1222993 - RNA, 13 nt, Human
cauccgaggcagg

SEQ ID NO: 1222994 - RNA, 14 nt, Human
ccacccuugccaug

SEQ ID NO: 1222995 - RNA, 17 nt, Human
uauaauaaauguacauu

SEQ ID NO: 1222996 - RNA, 15 nt, Human
gaaauguaagggaaa

SEQ ID NO: 1222997 - RNA, 19 nt, Human
cauuuaaagcuuauuaaaa

SEQ ID NO: 1222998 - RNA, 18 nt, Human
guugccaaggcuggagug

SEQ ID NO: 1222999 - RNA, 13 nt, Human
cauuuaucuuugu

SEQ ID NO: 1223000 - RNA, 12 nt, Human
guuuugugaaga

SEQ ID NO: 1223001 - RNA, 23 nt, Human
uaagggaaacugccagcaacgca

SEQ ID NO: 1223002 - RNA, 19 nt, Human
uuuuuuaugaaacauuaca

SEQ ID NO: 1223003 - RNA, 12 nt, Human
agaccucagccu

SEQ ID NO: 1223004 - RNA, 22 nt, Human
auuuuauuacaucuuucacauu

SEQ ID NO: 1223005 - RNA, 13 nt, Human
acaguaauuuuaa

SEQ ID NO: 1223006 - RNA, 13 nt, Human
ugagccaccaaac

SEQ ID NO: 1223007 - RNA, 12 nt, Human
aaaacacagcaa

SEQ ID NO: 1223008 - RNA, 21 nt, Human
cuguauuuuuaccuuuuuccu

SEQ ID NO: 1223009 - RNA, 19 nt, Human
ucagccuagccgaccucag

SEQ ID NO: 1223010 - RNA, 18 nt, Human
auauuuuaacuuccuugg

SEQ ID NO: 1223011 - RNA, 16 nt, Human
gauaauuauaauauac

SEQ ID NO: 1223012 - RNA, 13 nt, Human
acacaggcuccaa

SEQ ID NO: 1223013 - RNA, 13 nt, Human
gcauacaguaauu

SEQ ID NO: 1223014 - RNA, 18 nt, Human
gccagacuggcacaguuu

SEQ ID NO: 1223015 - RNA, 13 nt, Human
ucuguccagggcc

SEQ ID NO: 1223016 - RNA, 18 nt, Human
gugaaguaugcacuaauc

SEQ ID NO: 1223017 - RNA, 15 nt, Human
aaguuggugacagau

SEQ ID NO: 1223018 - RNA, 17 nt, Human
agcagucagaagaccug

SEQ ID NO: 1223019 - RNA, 23 nt, Human
ccucuguugccaaggcuggagug

SEQ ID NO: 1223020 - RNA, 20 nt, Human
acuuaccugggcauucuugu

SEQ ID NO: 1223021 - RNA, 19 nt, Human
aauacugauguuccuagug

SEQ ID NO: 1223022 - RNA, 14 nt, Human
aaaaucaaauucca

SEQ ID NO: 1223023 - RNA, 20 nt, Human
acagcuucucauccugcagg

SEQ ID NO: 1223024 - RNA, 18 nt, Human
cuaaaaaggcauguaauu

SEQ ID NO: 1223025 - RNA, 22 nt, Human
aaucacaaacucauccauuaau

SEQ ID NO: 1223026 - RNA, 17 nt, Human
ucauuuuaaaaaaugga

SEQ ID NO: 1223027 - RNA, 23 nt, Human
uucagccuagccgaccucagccu

SEQ ID NO: 1223028 - RNA, 20 nt, Human
aauuuaugaguuuuugauag

SEQ ID NO: 1223029 - RNA, 13 nt, Human
caacugaggcaga

SEQ ID NO: 1223030 - RNA, 14 nt, Human
cacaaaauugggaa

SEQ ID NO: 1223031 - RNA, 16 nt, Human
acuucacuuuuuuucu

SEQ ID NO: 1223032 - RNA, 20 nt, Human
acuaauagaauuaauggaau

SEQ ID NO: 1223033 - RNA, 14 nt, Human
agaugaacucaacu

SEQ ID NO: 1223034 - RNA, 12 nt, Human
aagcauuguaaa

SEQ ID NO: 1223035 - RNA, 15 nt, Human
aaucauuucugcauc

SEQ ID NO: 1223036 - RNA, 23 nt, Human
cagacuuuuuuuuuuuuuuaaac

SEQ ID NO: 1223037 - RNA, 13 nt, Human
gcucuggaaacca

SEQ ID NO: 1223038 - RNA, 14 nt, Human
guuaagcaacaucu

SEQ ID NO: 1223039 - RNA, 22 nt, Human
auuacaggcgugagccaccaaa

SEQ ID NO: 1223040 - RNA, 19 nt, Human
auuaaaacucauuuuuguu

SEQ ID NO: 1223041 - RNA, 17 nt, Human
agauagguuaccaguaa

SEQ ID NO: 1223042 - RNA, 16 nt, Human
uuauuuccauauuaaa

SEQ ID NO: 1223043 - RNA, 18 nt, Human
uaaaaugagcaaaaguug

SEQ ID NO: 1223044 - RNA, 20 nt, Human
cuuugacaaccaugagacca

SEQ ID NO: 1223045 - RNA, 16 nt, Human
agauaaagauuucuug

SEQ ID NO: 1223046 - RNA, 21 nt, Human
ccuugcccagggcucagccug

SEQ ID NO: 1223047 - RNA, 16 nt, Human
gccuaucagcauuuua

SEQ ID NO: 1223048 - RNA, 18 nt, Human
ugcugccucuaaaaggcc

SEQ ID NO: 1223049 - RNA, 12 nt, Human
uuaauuaaaaga

SEQ ID NO: 1223050 - RNA, 19 nt, Human
aaguuguuucauugacuau

SEQ ID NO: 1223051 - RNA, 23 nt, Human
uccuuaucacugacacaaaaagu

SEQ ID NO: 1223052 - RNA, 19 nt, Human
agaaagacuauucaaacag

SEQ ID NO: 1223053 - RNA, 19 nt, Human
auaucagcccaaaagucaa

SEQ ID NO: 1223054 - RNA, 18 nt, Human
aaaacacagcaaggguga

SEQ ID NO: 1223055 - RNA, 18 nt, Human
gcuugaggacuugggcgg

SEQ ID NO: 1223056 - RNA, 12 nt, Human
caaauuccagaa

SEQ ID NO: 1223057 - RNA, 18 nt, Human
cugagaugugaacacauc

SEQ ID NO: 1223058 - RNA, 19 nt, Human
acuuaaaacuguaaauuua

SEQ ID NO: 1223059 - RNA, 19 nt, Human
gguauuuauugagcaccug

SEQ ID NO: 1223060 - RNA, 23 nt, Human
auuaauggaauauguaaauagaa

SEQ ID NO: 1223061 - RNA, 17 nt, Human
ucuccuguacuuuuucc

SEQ ID NO: 1223062 - RNA, 18 nt, Human
gagaccacuguuaucaaa

SEQ ID NO: 1223063 - RNA, 14 nt, Human
uugaggacuugggc

SEQ ID NO: 1223064 - RNA, 21 nt, Human
cccugcagacaugagagacag

SEQ ID NO: 1223065 - RNA, 12 nt, Human
uuauuuuuuaau

SEQ ID NO: 1223066 - RNA, 14 nt, Human
uuggggaagacugu

SEQ ID NO: 1223067 - RNA, 13 nt, Human
ccagcucucagcc

SEQ ID NO: 1223068 - RNA, 15 nt, Human
acacaucagcuugcc

SEQ ID NO: 1223069 - RNA, 11 nt, Human
gcucucagcca

SEQ ID NO: 1223070 - RNA, 13 nt, Human
gccagacaugugg

SEQ ID NO: 1223071 - RNA, 13 nt, Human
uaaguaauuucag

SEQ ID NO: 1223072 - RNA, 13 nt, Human
ucuuuaaaauaca

SEQ ID NO: 1223073 - RNA, 22 nt, Human
gugauuacccucugggucucag

SEQ ID NO: 1223074 - RNA, 14 nt, Human
acucagaaauuuaa

SEQ ID NO: 1223075 - RNA, 18 nt, Human
aagacaacauuaaaacaa

SEQ ID NO: 1223076 - RNA, 16 nt, Human
gcucgguggacccagg

SEQ ID NO: 1223077 - RNA, 12 nt, Human
uuguuuuuccac

SEQ ID NO: 1223078 - RNA, 12 nt, Human
aacacaucagcu

SEQ ID NO: 1223079 - RNA, 21 nt, Human
gauagcagggcauggcuggga

SEQ ID NO: 1223080 - RNA, 20 nt, Human
aagaaauucugcaagcuuuu

SEQ ID NO: 1223081 - RNA, 19 nt, Human
accccuucauccucugagu

SEQ ID NO: 1223082 - RNA, 17 nt, Human
gaaucauaugggauacu

SEQ ID NO: 1223083 - RNA, 16 nt, Human
aguaagagauuccuga

SEQ ID NO: 1223084 - RNA, 17 nt, Human
uagagugggacaguucc

SEQ ID NO: 1223085 - RNA, 18 nt, Human
ugaucagaccauaauguu

SEQ ID NO: 1223086 - RNA, 15 nt, Human
cgacaguuuuccuuc

SEQ ID NO: 1223087 - RNA, 21 nt, Human
uuauaauauacuauauuuaug

SEQ ID NO: 1223088 - RNA, 16 nt, Human
cauuuugguaaaauac

SEQ ID NO: 1223089 - RNA, 16 nt, Human
gaaagacuauucaaac

SEQ ID NO: 1223090 - RNA, 13 nt, Human
uuccccuugccca

SEQ ID NO: 1223091 - RNA, 20 nt, Human
ugagaacugcauauguuucg

SEQ ID NO: 1223092 - RNA, 11 nt, Human
aaauauauuua

SEQ ID NO: 1223093 - RNA, 15 nt, Human
aaagcguaaagagga

SEQ ID NO: 1223094 - RNA, 14 nt, Human
auuuaucuuuguac

SEQ ID NO: 1223095 - RNA, 17 nt, Human
gagauaucccaggaaaa

SEQ ID NO: 1223096 - RNA, 12 nt, Human
auuccuuagcuu

SEQ ID NO: 1223097 - RNA, 17 nt, Human
gauugucugaaauuuuc

SEQ ID NO: 1223098 - RNA, 18 nt, Human
ugcuacucuguuccuuca

SEQ ID NO: 1223099 - RNA, 13 nt, Human
acuucacuuuuuu

SEQ ID NO: 1223100 - RNA, 23 nt, Human
caguucauauguaccauguacau

SEQ ID NO: 1223101 - RNA, 22 nt, Human
gcuccccucggagaagagcugu

SEQ ID NO: 1223102 - RNA, 20 nt, Human
cuuaacucauugcaaccucc

SEQ ID NO: 1223103 - RNA, 17 nt, Human
auucccuuuugcugccu

SEQ ID NO: 1223104 - RNA, 16 nt, Human
uaacucagaaacauca

SEQ ID NO: 1223105 - RNA, 15 nt, Human
aagacuauucaaaca

SEQ ID NO: 1223106 - RNA, 18 nt, Human
cugcagacaugagagaca

SEQ ID NO: 1223107 - RNA, 18 nt, Human
aauucaaacuaauagaau

SEQ ID NO: 1223108 - RNA, 19 nt, Human
ucuucuuggucuuauuuau

SEQ ID NO: 1223109 - RNA, 20 nt, Human
auuuauuuccauauuaaaau

SEQ ID NO: 1223110 - RNA, 17 nt, Human
ucagaccauaauguuac

SEQ ID NO: 1223111 - RNA, 19 nt, Human
uuguuuucauuaucucaaa

SEQ ID NO: 1223112 - RNA, 14 nt, Human
acucagaaacauca

SEQ ID NO: 1223113 - RNA, 16 nt, Human
agugauccgcccaucu

SEQ ID NO: 1223114 - RNA, 16 nt, Human
uguggcauuuucacuu

SEQ ID NO: 1223115 - RNA, 16 nt, Human
cacuguuaucaaaacu

SEQ ID NO: 1223116 - RNA, 17 nt, Human
acucuacccauauuaca

SEQ ID NO: 1223117 - RNA, 16 nt, Human
auucugcaagcuuuuc

SEQ ID NO: 1223118 - RNA, 19 nt, Human
uuaaacaaaaaaagcauug

SEQ ID NO: 1223119 - RNA, 11 nt, Human
uauuauuuaua

SEQ ID NO: 1223120 - RNA, 18 nt, Human
caccuguccccgaaacua

SEQ ID NO: 1223121 - RNA, 14 nt, Human
uguuguuauuuaaa

SEQ ID NO: 1223122 - RNA, 16 nt, Human
agacaccaccacccuu

SEQ ID NO: 1223123 - RNA, 23 nt, Human
aauagcaguugaaacaagaagcc

SEQ ID NO: 1223124 - RNA, 13 nt, Human
uuauugagcaccu

SEQ ID NO: 1223125 - RNA, 20 nt, Human
aauucuaaaugaauguuuac

SEQ ID NO: 1223126 - RNA, 22 nt, Human
gcaucagcugcugaaacaacaa

SEQ ID NO: 1223127 - RNA, 23 nt, Human
ccucagccuuccccuugcccagg

SEQ ID NO: 1223128 - RNA, 14 nt, Human
auuggacuuaaaau

SEQ ID NO: 1223129 - RNA, 19 nt, Human
ugcacugucaagaugauga

SEQ ID NO: 1223130 - RNA, 21 nt, Human
acauuaaaauguuagaaaaaa

SEQ ID NO: 1223131 - RNA, 16 nt, Human
gccccccuugccagac

SEQ ID NO: 1223132 - RNA, 18 nt, Human
cuuaguguacaugaaagc

SEQ ID NO: 1223133 - RNA, 15 nt, Human
uaccuuuuuccuucc

SEQ ID NO: 1223134 - RNA, 21 nt, Human
aaauaaagcuugcaacaaaau

SEQ ID NO: 1223135 - RNA, 18 nt, Human
gacuucuaaguaaaacca

SEQ ID NO: 1223136 - RNA, 21 nt, Human
uuucaaaacucauuuccuaug

SEQ ID NO: 1223137 - RNA, 22 nt, Human
uuugagacagggaaagggucuc

SEQ ID NO: 1223138 - RNA, 16 nt, Human
ucaguguccucaucug

SEQ ID NO: 1223139 - RNA, 18 nt, Human
uuagagauuuuuaaauaa

SEQ ID NO: 1223140 - RNA, 16 nt, Human
auaauguuacauuauu

SEQ ID NO: 1223141 - RNA, 14 nt, Human
ucuaucuauuuauu

SEQ ID NO: 1223142 - RNA, 16 nt, Human
uuuucaaaauuggacu

SEQ ID NO: 1223143 - RNA, 14 nt, Human
aucacucauuuauu

SEQ ID NO: 1223144 - RNA, 22 nt, Human
gcaggauuuuaaucuuuuucua

SEQ ID NO: 1223145 - RNA, 17 nt, Human
uuuaagauaauuauaau

SEQ ID NO: 1223146 - RNA, 20 nt, Human
aacucaucauaaaauaaagu

SEQ ID NO: 1223147 - RNA, 23 nt, Human
aaauugugaucagaccauaaugu

SEQ ID NO: 1223148 - RNA, 18 nt, Human
acucauugcaaccuccac

SEQ ID NO: 1223149 - RNA, 23 nt, Human
uguaaaugugcuuuuaaaaaaaa

SEQ ID NO: 1223150 - RNA, 14 nt, Human
ugcuuguuagcaaa

SEQ ID NO: 1223151 - RNA, 23 nt, Human
aauauugcaaggcaaagacuauu

SEQ ID NO: 1223152 - RNA, 21 nt, Human
aagcaccuuuagaauauuaaa

SEQ ID NO: 1223153 - RNA, 22 nt, Human
gaacuuuccacauucagagcuu

SEQ ID NO: 1223154 - RNA, 13 nt, Human
agauagcagggca

SEQ ID NO: 1223155 - RNA, 13 nt, Human
ugccccccuugcc

SEQ ID NO: 1223156 - RNA, 15 nt, Human
caccccuccccugcc

SEQ ID NO: 1223157 - RNA, 21 nt, Human
cggccugauuaaaguuaaaua

SEQ ID NO: 1223158 - RNA, 16 nt, Human
uugcccuguuaaaaga

SEQ ID NO: 1223159 - RNA, 16 nt, Human
caccccuccccugccc

SEQ ID NO: 1223160 - RNA, 24 nt, Human
uucacuuuuggcuuguaaaguaca

SEQ ID NO: 1223161 - RNA, 12 nt, Human
gcaguuuuccau

SEQ ID NO: 1223162 - RNA, 18 nt, Human
aaacccggccugauuaaa

SEQ ID NO: 1223163 - RNA, 21 nt, Human
aucaagccaucggagcugcua

SEQ ID NO: 1223164 - RNA, 16 nt, Human
augaaagcguaaagag

SEQ ID NO: 1223165 - RNA, 12 nt, Human
uguuuuucacau

SEQ ID NO: 1223166 - RNA, 23 nt, Human
ucauauaauaaauguacauuaau

SEQ ID NO: 1223167 - RNA, 19 nt, Human
aucggagcugcuagaguuc

SEQ ID NO: 1223168 - RNA, 14 nt, Human
cuggaauguaauca

SEQ ID NO: 1223169 - RNA, 17 nt, Human
agaugugaacacaucag

SEQ ID NO: 1223170 - RNA, 14 nt, Human
aaaaacauuucaaa

SEQ ID NO: 1223171 - RNA, 13 nt, Human
aagugcugggaau

SEQ ID NO: 1223172 - RNA, 11 nt, Human
auaauaaaauu

SEQ ID NO: 1223173 - RNA, 20 nt, Human
cuuaaaacuguaaauuuauu

SEQ ID NO: 1223174 - RNA, 12 nt, Human
aaauaaauuauu

SEQ ID NO: 1223175 - RNA, 21 nt, Human
uaccaaucauuuuaauuauua

SEQ ID NO: 1223176 - RNA, 20 nt, Human
ccauaauguuacauuauuau

SEQ ID NO: 1223177 - RNA, 14 nt, Human
uuauuuuuuaagua

SEQ ID NO: 1223178 - RNA, 23 nt, Human
uuuaguaagagauuccugagcca

SEQ ID NO: 1223179 - RNA, 23 nt, Human
ucaaacagucucaggaaaucaaa

SEQ ID NO: 1223180 - RNA, 14 nt, Human
aaauuauauuuuga

SEQ ID NO: 1223181 - RNA, 14 nt, Human
cacuguuaucaaaa

SEQ ID NO: 1223182 - RNA, 15 nt, Human
auguguggcauuuuc

SEQ ID NO: 1223183 - RNA, 14 nt, Human
agcuugaaauagug

SEQ ID NO: 1223184 - RNA, 17 nt, Human
cagcaguugaaaagacu

SEQ ID NO: 1223185 - RNA, 16 nt, Human
gcuuagaccucagccu

SEQ ID NO: 1223186 - RNA, 16 nt, Human
auaauguuguuauuua

SEQ ID NO: 1223187 - RNA, 19 nt, Human
auuuuccuggacaguuuuc

SEQ ID NO: 1223188 - RNA, 14 nt, Human
augaaccuuuacau

SEQ ID NO: 1223189 - RNA, 15 nt, Human
uagaauauuaaaaau

SEQ ID NO: 1223190 - RNA, 16 nt, Human
acacaaccugucccag

SEQ ID NO: 1223191 - RNA, 21 nt, Human
auauuuauaacucaucauaaa

SEQ ID NO: 1223192 - RNA, 13 nt, Human
uacagacuuuuuu

SEQ ID NO: 1223193 - RNA, 14 nt, Human
uuguaauucuaaau

SEQ ID NO: 1223194 - RNA, 22 nt, Human
aguacuuaaaacuguaaauuua

SEQ ID NO: 1223195 - RNA, 16 nt, Human
aacaguauccaguacu

SEQ ID NO: 1223196 - RNA, 23 nt, Human
aagugauccgcccaucuccgucu

SEQ ID NO: 1223197 - RNA, 19 nt, Human
cacaaacucauccauuaau

SEQ ID NO: 1223198 - RNA, 19 nt, Human
cuuuuaaaaaaaaauacug

SEQ ID NO: 1223199 - RNA, 19 nt, Human
cuaaaauuagaugaacuca

SEQ ID NO: 1223200 - RNA, 22 nt, Human
ccucuguccagggcccugagcu

SEQ ID NO: 1223201 - RNA, 19 nt, Human
guuagagauuuuuaaauaa

SEQ ID NO: 1223202 - RNA, 18 nt, Human
ucugcuaccucacugggg

SEQ ID NO: 1223203 - RNA, 21 nt, Human
agccuagccgaccucagccuu

SEQ ID NO: 1223204 - RNA, 20 nt, Human
aacuuccuuggacucauuuu

SEQ ID NO: 1223205 - RNA, 17 nt, Human
aaguauauucaaaaauu

SEQ ID NO: 1223206 - RNA, 12 nt, Human
auacuauauuua

SEQ ID NO: 1223207 - RNA, 13 nt, Human
gcuugccugcagg

SEQ ID NO: 1223208 - RNA, 17 nt, Human
cugggucucaguguccu

SEQ ID NO: 1223209 - RNA, 18 nt, Human
caugagaccacuguuauc

SEQ ID NO: 1223210 - RNA, 22 nt, Human
acuucacuuuuuuucuuuucuc

SEQ ID NO: 1223211 - RNA, 18 nt, Human
agcuuacuuaaaauugua

SEQ ID NO: 1223212 - RNA, 13 nt, Human
uaaucuuuuucua

SEQ ID NO: 1223213 - RNA, 21 nt, Human
ugaaauuuucuagaauacuaa

SEQ ID NO: 1223214 - RNA, 20 nt, Human
auaacucaucauaaaauaaa

SEQ ID NO: 1223215 - RNA, 14 nt, Human
gaaacaacaaauag

SEQ ID NO: 1223216 - RNA, 15 nt, Human
auggagaaaggaccc

SEQ ID NO: 1223217 - RNA, 23 nt, Human
aauagcagacaguguuuucuggg

SEQ ID NO: 1223218 - RNA, 23 nt, Human
aaguacuuaaaacuguaaauuua

SEQ ID NO: 1223219 - RNA, 15 nt, Human
ucagucauaacuaaa

SEQ ID NO: 1223220 - RNA, 19 nt, Human
auuugaugaaaucagaguu

SEQ ID NO: 1223221 - RNA, 22 nt, Human
ucuccagagggaauugcagagu

SEQ ID NO: 1223222 - RNA, 18 nt, Human
ggggcgcgugcaggcagc

SEQ ID NO: 1223223 - RNA, 18 nt, Human
uagaucuuacaucugcag

SEQ ID NO: 1223224 - RNA, 14 nt, Human
gcugggaauuacag

SEQ ID NO: 1223225 - RNA, 21 nt, Human
agcuguucacagccagacugg

SEQ ID NO: 1223226 - RNA, 15 nt, Human
gagaccacaagcagg

SEQ ID NO: 1223227 - RNA, 22 nt, Human
auucuaaaugaauguuuacacu

SEQ ID NO: 1223228 - RNA, 18 nt, Human
acagcaguugaaaagacu

SEQ ID NO: 1223229 - RNA, 15 nt, Human
augagaccacuguua

SEQ ID NO: 1223230 - RNA, 18 nt, Human
aaaagccaaaaaccaaau

SEQ ID NO: 1223231 - RNA, 18 nt, Human
aggguucagagacucagg

SEQ ID NO: 1223232 - RNA, 20 nt, Human
acaccaccacccuugccaug

SEQ ID NO: 1223233 - RNA, 19 nt, Human
cuauuuauuuauuuauuug

SEQ ID NO: 1223234 - RNA, 22 nt, Human
ugauuuuacggagauaucccag

SEQ ID NO: 1223235 - RNA, 16 nt, Human
auccuccacaauagca

SEQ ID NO: 1223236 - RNA, 14 nt, Human
cauccauuaaugua

SEQ ID NO: 1223237 - RNA, 17 nt, Human
accaugccauuuaaagc

SEQ ID NO: 1223238 - RNA, 18 nt, Human
ugcuggauucaagugauc

SEQ ID NO: 1223239 - RNA, 22 nt, Human
cgucucccaaagugcugggaau

SEQ ID NO: 1223240 - RNA, 14 nt, Human
aaauuggacuuaaa

SEQ ID NO: 1223241 - RNA, 17 nt, Human
cauucugcuuucaucuu

SEQ ID NO: 1223242 - RNA, 12 nt, Human
guguauauuuuu

SEQ ID NO: 1223243 - RNA, 14 nt, Human
auucaaaaauuaua

SEQ ID NO: 1223244 - RNA, 16 nt, Human
aaucauuuuaauuauu

SEQ ID NO: 1223245 - RNA, 17 nt, Human
uuuuccacuacugcuac

SEQ ID NO: 1223246 - RNA, 23 nt, Human
acauacuauggaauuucucccag

SEQ ID NO: 1223247 - RNA, 20 nt, Human
acagcaagggugaugggaaa

SEQ ID NO: 1223248 - RNA, 19 nt, Human
caggugccaguuauggcua

SEQ ID NO: 1223249 - RNA, 13 nt, Human
ggaaaauguguau

SEQ ID NO: 1223250 - RNA, 17 nt, Human
gaacucugagcagugcu

SEQ ID NO: 1223251 - RNA, 22 nt, Human
agugaugucacuagggcaggga

SEQ ID NO: 1223252 - RNA, 19 nt, Human
cuuugguggagauaaagau

SEQ ID NO: 1223253 - RNA, 15 nt, Human
ggucucgaacugcug

SEQ ID NO: 1223254 - RNA, 23 nt, Human
aagcaccuuuagaauauuaaaaa

SEQ ID NO: 1223255 - RNA, 16 nt, Human
uguauuaugcuaccug

SEQ ID NO: 1223256 - RNA, 17 nt, Human
caccagggccuggcugg

SEQ ID NO: 1223257 - RNA, 17 nt, Human
agcacuguuuggauaug

SEQ ID NO: 1223258 - RNA, 20 nt, Human
ugagaccacuguuaucaaaa

SEQ ID NO: 1223259 - RNA, 19 nt, Human
aaacuguaaauuuauuaug

SEQ ID NO: 1223260 - RNA, 21 nt, Human
auauacuccuaguaauuuaag

SEQ ID NO: 1223261 - RNA, 21 nt, Human
gccugauuaaaguuaaauaaa

SEQ ID NO: 1223262 - RNA, 16 nt, Human
ucacuagggcagggac

SEQ ID NO: 1223263 - RNA, 21 nt, Human
caggaaaucaaauaugcaaag

SEQ ID NO: 1223264 - RNA, 15 nt, Human
ccuagagcacacugu

SEQ ID NO: 1223265 - RNA, 22 nt, Human
cugucuggacuuuccagagacc

SEQ ID NO: 1223266 - RNA, 15 nt, Human
ccucuaaaaggccug

SEQ ID NO: 1223267 - RNA, 17 nt, Human
uuaaggcuucucuuaaa

SEQ ID NO: 1223268 - RNA, 14 nt, Human
ggcugggaguggca

SEQ ID NO: 1223269 - RNA, 17 nt, Human
uuuuuccagacacuuuu

SEQ ID NO: 1223270 - RNA, 18 nt, Human
aaauugaaaggcauucuc

SEQ ID NO: 1223271 - RNA, 22 nt, Human
gaaaauguguauuuuauuacau

SEQ ID NO: 1223272 - RNA, 14 nt, Human
caguaacggaacag

SEQ ID NO: 1223273 - RNA, 23 nt, Human
auggcuauaggugcuacaaaaac

SEQ ID NO: 1223274 - RNA, 15 nt, Human
gacgugacuggccug

SEQ ID NO: 1223275 - RNA, 15 nt, Human
cauagccaggaaacu

SEQ ID NO: 1223276 - RNA, 21 nt, Human
uguaauuaaucuuguaaauau

SEQ ID NO: 1223277 - RNA, 17 nt, Human
uucauaccuaucaucuu

SEQ ID NO: 1223278 - RNA, 19 nt, Human
auaaaguauauauagaauc

SEQ ID NO: 1223279 - RNA, 17 nt, Human
auuucaugaaaagauua

SEQ ID NO: 1223280 - RNA, 20 nt, Human
ggcuggagugcaguggcgca

SEQ ID NO: 1223281 - RNA, 19 nt, Human
agggaaacugccagcaacg

SEQ ID NO: 1223282 - RNA, 16 nt, Human
aguagauuaagagaug

SEQ ID NO: 1223283 - RNA, 21 nt, Human
ugcaggcagcuuuuucucucc

SEQ ID NO: 1223284 - RNA, 13 nt, Human
uuacaauugaaau

SEQ ID NO: 1223285 - RNA, 18 nt, Human
auggggguaauaagagca

SEQ ID NO: 1223286 - RNA, 18 nt, Human
ucuuugguggagauaaag

SEQ ID NO: 1223287 - RNA, 18 nt, Human
cauaguaccaaucauuuu

SEQ ID NO: 1223288 - RNA, 20 nt, Human
uugaacaaguuguuucauug

SEQ ID NO: 1223289 - RNA, 15 nt, Human
uuuuuaaauaaagaa

SEQ ID NO: 1223290 - RNA, 13 nt, Human
uuguauuuaaaua

SEQ ID NO: 1223291 - RNA, 13 nt, Human
auaaacucagaaa

SEQ ID NO: 1223292 - RNA, 15 nt, Human
uaauauacuauauuu

SEQ ID NO: 1223293 - RNA, 14 nt, Human
agagcaguagcagc

SEQ ID NO: 1223294 - RNA, 13 nt, Human
acacagugucugg

SEQ ID NO: 1223295 - RNA, 19 nt, Human
aagagcuguucacagccag

SEQ ID NO: 1223296 - RNA, 13 nt, Human
auugcaaggcaaa

SEQ ID NO: 1223297 - RNA, 21 nt, Human
ugaacugauggguuucuccag

SEQ ID NO: 1223298 - RNA, 20 nt, Human
gauaauaaaauucauuccau

SEQ ID NO: 1223299 - RNA, 14 nt, Human
agcacuuggagcca

SEQ ID NO: 1223300 - RNA, 21 nt, Human
cuucuuuaaagggauggcaag

SEQ ID NO: 1223301 - RNA, 21 nt, Human
aauaaaguauauauagaaucu

SEQ ID NO: 1223302 - RNA, 12 nt, Human
agcaguaacuga

SEQ ID NO: 1223303 - RNA, 17 nt, Human
acaugaaagcguaaaga

SEQ ID NO: 1223304 - RNA, 16 nt, Human
aaguaauuucagaaga

SEQ ID NO: 1223305 - RNA, 22 nt, Human
ggguucagagacucagggcccc

SEQ ID NO: 1223306 - RNA, 18 nt, Human
auauguauuuauaaauau

SEQ ID NO: 1223307 - RNA, 13 nt, Human
auuucaacuguuu

SEQ ID NO: 1223308 - RNA, 17 nt, Human
aagaaaggccagcaaau

SEQ ID NO: 1223309 - RNA, 20 nt, Human
aauuuuucuuauuucauuuc

SEQ ID NO: 1223310 - RNA, 21 nt, Human
guuugacaagguucuucccuu

SEQ ID NO: 1223311 - RNA, 21 nt, Human
uuguuuuaaaauuaaagcuaa

SEQ ID NO: 1223312 - RNA, 13 nt, Human
ccauuuaaagcuu

SEQ ID NO: 1223313 - RNA, 16 nt, Human
ugaaaugacugucuaa

SEQ ID NO: 1223314 - RNA, 19 nt, Human
uggguuucacaagugaaaa

SEQ ID NO: 1223315 - RNA, 22 nt, Human
gaaacuaccagcccuacaccau

SEQ ID NO: 1223316 - RNA, 16 nt, Human
gcaggauagaguggga

SEQ ID NO: 1223317 - RNA, 17 nt, Human
cuuguuagcaaaaugga

SEQ ID NO: 1223318 - RNA, 15 nt, Human
acccggccugauuaa

SEQ ID NO: 1223319 - RNA, 19 nt, Human
aaaacaaagaagacaacau

SEQ ID NO: 1223320 - RNA, 12 nt, Human
ucagaagaccug

SEQ ID NO: 1223321 - RNA, 16 nt, Human
ccaacacgagcaggcu

SEQ ID NO: 1223322 - RNA, 16 nt, Human
ggguccuggggccucg

SEQ ID NO: 1223323 - RNA, 22 nt, Human
gucaaucuuaucauauuucaaa

SEQ ID NO: 1223324 - RNA, 13 nt, Human
ugugcuuuuaaaa

SEQ ID NO: 1223325 - RNA, 11 nt, Human
gagaagagaau

SEQ ID NO: 1223326 - RNA, 21 nt, Human
uauaauaaauguacauuaauu

SEQ ID NO: 1223327 - RNA, 14 nt, Human
uguaacugcauuga

SEQ ID NO: 1223328 - RNA, 14 nt, Human
guuacauuauuauc

SEQ ID NO: 1223329 - RNA, 23 nt, Human
uaaguaaguuugauuucauuaau

SEQ ID NO: 1223330 - RNA, 22 nt, Human
ucccuuuugcugccucuaaaag

SEQ ID NO: 1223331 - RNA, 12 nt, Human
agaccagccaac

SEQ ID NO: 1223332 - RNA, 15 nt, Human
acauguuuucuuugc

SEQ ID NO: 1223333 - RNA, 16 nt, Human
uauuuuaaaauaaauu

SEQ ID NO: 1223334 - RNA, 17 nt, Human
aagagggauuagggaga

SEQ ID NO: 1223335 - RNA, 18 nt, Human
aaucaaauaugcaaagca

SEQ ID NO: 1223336 - RNA, 19 nt, Human
uugggaaaggaguagaaaa

SEQ ID NO: 1223337 - RNA, 20 nt, Human
gcacuugggacaaaaacaaa

SEQ ID NO: 1223338 - RNA, 16 nt, Human
ucauuuaauaaaugug

SEQ ID NO: 1223339 - RNA, 15 nt, Human
ggacaguuccugaga

SEQ ID NO: 1223340 - RNA, 13 nt, Human
ccuuccccuugcc

SEQ ID NO: 1223341 - RNA, 19 nt, Human
gaugucacuagggcaggga

SEQ ID NO: 1223342 - RNA, 18 nt, Human
agaaccuaaguuucaguu

SEQ ID NO: 1223343 - RNA, 18 nt, Human
gaagaugcuuguauuuua

SEQ ID NO: 1223344 - RNA, 16 nt, Human
aauuucagaagaaauu

SEQ ID NO: 1223345 - RNA, 11 nt, Human
guauauucaaa

SEQ ID NO: 1223346 - RNA, 21 nt, Human
cacaacuauauuaucaugcaa

SEQ ID NO: 1223347 - RNA, 17 nt, Human
gaggguuagggaggggu

SEQ ID NO: 1223348 - RNA, 17 nt, Human
cugauuaaaguuaaaua

SEQ ID NO: 1223349 - RNA, 14 nt, Human
auuugaugaaauca

SEQ ID NO: 1223350 - RNA, 13 nt, Human
auagaguguuauc

SEQ ID NO: 1223351 - RNA, 15 nt, Human
auuaaauauaauaug

SEQ ID NO: 1223352 - RNA, 20 nt, Human
uauuagcuuuacuguuuguu

SEQ ID NO: 1223353 - RNA, 16 nt, Human
caccaggagucccugg

SEQ ID NO: 1223354 - RNA, 21 nt, Human
aguuucaguugauuuuacaau

SEQ ID NO: 1223355 - RNA, 20 nt, Human
gucugccuaauuaaaaaaau

SEQ ID NO: 1223356 - RNA, 19 nt, Human
auuacaggcgugagccacc

SEQ ID NO: 1223357 - RNA, 14 nt, Human
uauaauaugcacac

SEQ ID NO: 1223358 - RNA, 19 nt, Human
aagauuaugaucucagaaa

SEQ ID NO: 1223359 - RNA, 17 nt, Human
caaaauuggacuuaaaa

SEQ ID NO: 1223360 - RNA, 20 nt, Human
gcuacucuguuccuucacau

SEQ ID NO: 1223361 - RNA, 21 nt, Human
ucucuggcgacaguuuuccuu

SEQ ID NO: 1223362 - RNA, 20 nt, Human
ucaaauaugcaaagcacuga

SEQ ID NO: 1223363 - RNA, 13 nt, Human
ugacccccauccc

SEQ ID NO: 1223364 - RNA, 15 nt, Human
acagcaguugaaaag

SEQ ID NO: 1223365 - RNA, 18 nt, Human
agaauauuaaaaauuaau

SEQ ID NO: 1223366 - RNA, 17 nt, Human
aauauugcaaggcaaag

SEQ ID NO: 1223367 - RNA, 15 nt, Human
ccuugguauagcaua

SEQ ID NO: 1223368 - RNA, 23 nt, Human
gcacaguuuucugagaaagacua

SEQ ID NO: 1223369 - RNA, 18 nt, Human
uucacaagugaaaaacau

SEQ ID NO: 1223370 - RNA, 14 nt, Human
uccuguacuuuuuc

SEQ ID NO: 1223371 - RNA, 18 nt, Human
cuguaucuuguuuuucca

SEQ ID NO: 1223372 - RNA, 19 nt, Human
uuuaaaaaaaaaaaaaaag

SEQ ID NO: 1223373 - RNA, 20 nt, Human
uuuaaagcuuauuaaaacuc

SEQ ID NO: 1223374 - RNA, 23 nt, Human
uccuagugaaagaggcagcuuga

SEQ ID NO: 1223375 - RNA, 18 nt, Human
auggugaaaugcagaguc

SEQ ID NO: 1223376 - RNA, 18 nt, Human
aaauaaauuauuauuuaa

SEQ ID NO: 1223377 - RNA, 19 nt, Human
gcuaccuuuugcuguggca

SEQ ID NO: 1223378 - RNA, 20 nt, Human
uucauugacuaucaaacuga

SEQ ID NO: 1223379 - RNA, 21 nt, Human
ucagcuugcccuguuaaaaga

SEQ ID NO: 1223380 - RNA, 16 nt, Human
cuggacuuuccagaga

SEQ ID NO: 1223381 - RNA, 19 nt, Human
acuuccuuggacucauuuu

SEQ ID NO: 1223382 - RNA, 19 nt, Human
aaccaaauuuguauuuaag

SEQ ID NO: 1223383 - RNA, 16 nt, Human
uuaaauauaauaugca

SEQ ID NO: 1223384 - RNA, 20 nt, Human
auaucaguccucuuucaaag

SEQ ID NO: 1223385 - RNA, 14 nt, Human
gcuacaaaaacaca

SEQ ID NO: 1223386 - RNA, 17 nt, Human
agucucaggaaaucaaa

SEQ ID NO: 1223387 - RNA, 14 nt, Human
ccucaucuguaaaa

SEQ ID NO: 1223388 - RNA, 14 nt, Human
auuuaugaguuuuu

SEQ ID NO: 1223389 - RNA, 23 nt, Human
guuucacaagugaaaaacaucca

SEQ ID NO: 1223390 - RNA, 23 nt, Human
caugccauuuaaagcuuauuaaa

SEQ ID NO: 1223391 - RNA, 13 nt, Human
accucaguuuuau

SEQ ID NO: 1223392 - RNA, 17 nt, Human
uggaacauaaaauacaa

SEQ ID NO: 1223393 - RNA, 18 nt, Human
ucauuuaauaaaugugcc

SEQ ID NO: 1223394 - RNA, 14 nt, Human
cauguauuuuaaaa

SEQ ID NO: 1223395 - RNA, 17 nt, Human
cugcauauguuucgcug

SEQ ID NO: 1223396 - RNA, 15 nt, Human
uagaccucagccugu

SEQ ID NO: 1223397 - RNA, 20 nt, Human
ugggaacccaaguccaagca

SEQ ID NO: 1223398 - RNA, 22 nt, Human
auuuuuuaaguauuuauauauu

SEQ ID NO: 1223399 - RNA, 14 nt, Human
aauaaaguauauau

SEQ ID NO: 1223400 - RNA, 22 nt, Human
auaaagcuugcaacaaaauucu

SEQ ID NO: 1223401 - RNA, 18 nt, Human
auuuggccguuuugugaa

SEQ ID NO: 1223402 - RNA, 13 nt, Human
gcccuguuaaaag

SEQ ID NO: 1223403 - RNA, 19 nt, Human
gcaccugcaggcgugaccu

SEQ ID NO: 1223404 - RNA, 18 nt, Human
ugucuggacuuuccagag

SEQ ID NO: 1223405 - RNA, 19 nt, Human
cuuaauuaaaagaauauuu

SEQ ID NO: 1223406 - RNA, 18 nt, Human
aauaccaugccauuuaaa

SEQ ID NO: 1223407 - RNA, 10 nt, Human
aaaauguaau

SEQ ID NO: 1223408 - RNA, 13 nt, Human
guauuuuaaaaua

SEQ ID NO: 1223409 - RNA, 13 nt, Human
aauguuacauuau

SEQ ID NO: 1223410 - RNA, 14 nt, Human
acaggcgugagcca

SEQ ID NO: 1223411 - RNA, 18 nt, Human
uggaacauaaaauacaau

SEQ ID NO: 1223412 - RNA, 22 nt, Human
uagcaguugaaacaagaagcca

SEQ ID NO: 1223413 - RNA, 20 nt, Human
gcuguaucuuguuuuuccac

SEQ ID NO: 1223414 - RNA, 21 nt, Human
cugcuggauucaagugauccg

SEQ ID NO: 1223415 - RNA, 19 nt, Human
agccuagccgaccucagcc

SEQ ID NO: 1223416 - RNA, 18 nt, Human
uaaaugugcuuuuaaaaa

SEQ ID NO: 1223417 - RNA, 12 nt, Human
auuuauauaugu

SEQ ID NO: 1223418 - RNA, 16 nt, Human
caggcuugccugcagg

SEQ ID NO: 1223419 - RNA, 15 nt, Human
aucuagcaaauguua

SEQ ID NO: 1223420 - RNA, 15 nt, Human
uaaaagaugaaaaua

SEQ ID NO: 1223421 - RNA, 20 nt, Human
ggucucaguguccucaucug

SEQ ID NO: 1223422 - RNA, 16 nt, Human
auauguaccauguaca

SEQ ID NO: 1223423 - RNA, 21 nt, Human
ucuuuucuggaauguaaucaa

SEQ ID NO: 1223424 - RNA, 19 nt, Human
acuagacaaguccagccug

SEQ ID NO: 1223425 - RNA, 14 nt, Human
auuuuaaguaauuu

SEQ ID NO: 1223426 - RNA, 14 nt, Human
gagccagugucagg

SEQ ID NO: 1223427 - RNA, 14 nt, Human
aaagacuccaaaga

SEQ ID NO: 1223428 - RNA, 14 nt, Human
acaucuuucacauu

SEQ ID NO: 1223429 - RNA, 23 nt, Human
agggaaacugccagcaacgcagg

SEQ ID NO: 1223430 - RNA, 20 nt, Human
ugcuacaaaaacacagcaag

SEQ ID NO: 1223431 - RNA, 18 nt, Human
ucauuauugguugggcug

SEQ ID NO: 1223432 - RNA, 18 nt, Human
uauuuaagguauauaaau

SEQ ID NO: 1223433 - RNA, 21 nt, Human
gugauucacccugauuuuaca

SEQ ID NO: 1223434 - RNA, 23 nt, Human
uugauagcaagugaauuuuucuc

SEQ ID NO: 1223435 - RNA, 18 nt, Human
ugagaaagacuauucaaa

SEQ ID NO: 1223436 - RNA, 17 nt, Human
aaagucaaucuuaucau

SEQ ID NO: 1223437 - RNA, 19 nt, Human
uuuaaacaucagcaaaaaa

SEQ ID NO: 1223438 - RNA, 16 nt, Human
aagaugaaaauauuug

SEQ ID NO: 1223439 - RNA, 12 nt, Human
agcucucagcca

SEQ ID NO: 1223440 - RNA, 19 nt, Human
ugauucacccugauuuuac

SEQ ID NO: 1223441 - RNA, 22 nt, Human
ugggugccccccuugccagaca

SEQ ID NO: 1223442 - RNA, 17 nt, Human
cugauggguuucuccag

SEQ ID NO: 1223443 - RNA, 18 nt, Human
agucagucugaugagaac

SEQ ID NO: 1223444 - RNA, 18 nt, Human
cuacauacuauggaauuu

SEQ ID NO: 1223445 - RNA, 15 nt, Human
auguuguuauuuaaa

SEQ ID NO: 1223446 - RNA, 18 nt, Human
agcaaauguuaugcauaa

SEQ ID NO: 1223447 - RNA, 12 nt, Human
caauacauuauu

SEQ ID NO: 1223448 - RNA, 11 nt, Human
gggggagggga

SEQ ID NO: 1223449 - RNA, 17 nt, Human
cuuuuuuuuuuuuucuu

SEQ ID NO: 1223450 - RNA, 16 nt, Human
ccuuuagaauauuaaa

SEQ ID NO: 1223451 - RNA, 21 nt, Human
aauuuuucucuaacucagaaa

SEQ ID NO: 1223452 - RNA, 20 nt, Human
aaucauauaauaaauguaca

SEQ ID NO: 1223453 - RNA, 14 nt, Human
guauucuucuuugg

SEQ ID NO: 1223454 - RNA, 17 nt, Human
uuuucauuaucucaaaa

SEQ ID NO: 1223455 - RNA, 14 nt, Human
uuaaaguuaaauaa

SEQ ID NO: 1223456 - RNA, 13 nt, Human
uggcaguuuucca

SEQ ID NO: 1223457 - RNA, 22 nt, Human
uacucugaagggcaucaugcau

SEQ ID NO: 1223458 - RNA, 22 nt, Human
ucccuacaccccuccccugccc

SEQ ID NO: 1223459 - RNA, 13 nt, Human
ccuacaccauucc

SEQ ID NO: 1223460 - RNA, 17 nt, Human
agacuccaaagaaaugu

SEQ ID NO: 1223461 - RNA, 19 nt, Human
uuucacaagugaaaaacau

SEQ ID NO: 1223462 - RNA, 22 nt, Human
cuuaccugggcauucuuguuuc

SEQ ID NO: 1223463 - RNA, 14 nt, Human
aggcagcuugaaac

SEQ ID NO: 1223464 - RNA, 15 nt, Human
aaaauacaauguuau

SEQ ID NO: 1223465 - RNA, 13 nt, Human
gcuuagaccucag

SEQ ID NO: 1223466 - RNA, 22 nt, Human
aagacuguggcugcuagcacuu

SEQ ID NO: 1223467 - RNA, 12 nt, Human
ccuugccagaca

SEQ ID NO: 1223468 - RNA, 12 nt, Human
uacaucuuucac

SEQ ID NO: 1223469 - RNA, 22 nt, Human
cuaucuaauuuuuauuaauuug

SEQ ID NO: 1223470 - RNA, 19 nt, Human
cauaagaaaacuaagaaau

SEQ ID NO: 1223471 - RNA, 19 nt, Human
caccauuccuucugcccug

SEQ ID NO: 1223472 - RNA, 20 nt, Human
gauguagauaaacucagaaa

SEQ ID NO: 1223473 - RNA, 22 nt, Human
aauaguucaaagccaaguuuau

SEQ ID NO: 1223474 - RNA, 13 nt, Human
uaaauaaagaauu

SEQ ID NO: 1223475 - RNA, 16 nt, Human
aauaaagaauuuuaaa

SEQ ID NO: 1223476 - RNA, 16 nt, Human
gacaaaaacaaacaaa

SEQ ID NO: 1223477 - RNA, 20 nt, Human
uguuaaaagaugaaaauauu

SEQ ID NO: 1223478 - RNA, 21 nt, Human
auuaucuaucuaucuauuuau

SEQ ID NO: 1223479 - RNA, 17 nt, Human
uuaaagcuuauuaaaac

SEQ ID NO: 1223480 - RNA, 17 nt, Human
ccugcaggcaugaguca

SEQ ID NO: 1223481 - RNA, 23 nt, Human
ucaggagaggggcagaacagccg

SEQ ID NO: 1223482 - RNA, 16 nt, Human
aagacuauucaaacag

SEQ ID NO: 1223483 - RNA, 21 nt, Human
gcuccugucugccagccagca

SEQ ID NO: 1223484 - RNA, 15 nt, Human
cugagcauguacuga

SEQ ID NO: 1223485 - RNA, 14 nt, Human
aaauguaagggaaa

SEQ ID NO: 1223486 - RNA, 16 nt, Human
cugcccuagagcacac

SEQ ID NO: 1223487 - RNA, 14 nt, Human
aaauggagaaagga

SEQ ID NO: 1223488 - RNA, 17 nt, Human
auguuccuagugaaaga

SEQ ID NO: 1223489 - RNA, 23 nt, Human
gcugucuauguggcuguaucuug

SEQ ID NO: 1223490 - RNA, 16 nt, Human
aaucagaguuuucaug

SEQ ID NO: 1223491 - RNA, 20 nt, Human
ugauuuuacaauugaaauga

SEQ ID NO: 1223492 - RNA, 23 nt, Human
uaucaauagaaggauguacauuu

SEQ ID NO: 1223493 - RNA, 17 nt, Human
agaaaggccagcaaauu

SEQ ID NO: 1223494 - RNA, 13 nt, Human
augaacuuuccac

SEQ ID NO: 1223495 - RNA, 22 nt, Human
uuuucauuaucucaaaacugca

SEQ ID NO: 1223496 - RNA, 21 nt, Human
agacauguggugggacaggga

SEQ ID NO: 1223497 - RNA, 23 nt, Human
uugugcuuucuaucuaauuuuua

SEQ ID NO: 1223498 - RNA, 18 nt, Human
cgggaguggcgcgcgcca

SEQ ID NO: 1223499 - RNA, 18 nt, Human
agccuggugggccuccuc

SEQ ID NO: 1223500 - RNA, 13 nt, Human
cacuuuuuuucuu

SEQ ID NO: 1223501 - RNA, 15 nt, Human
cacugucaagaugau

SEQ ID NO: 1223502 - RNA, 16 nt, Human
cuuuaacacagugucu

SEQ ID NO: 1223503 - RNA, 19 nt, Human
gaggacuugggcgggacac

SEQ ID NO: 1223504 - RNA, 20 nt, Human
gaauuauccggucggguuuu

SEQ ID NO: 1223505 - RNA, 21 nt, Human
aaucaauacuuugaacacaaa

SEQ ID NO: 1223506 - RNA, 18 nt, Human
auaauauacuauauuuau

SEQ ID NO: 1223507 - RNA, 12 nt, Human
aucuaauuuuua

SEQ ID NO: 1223508 - RNA, 15 nt, Human
agcucaggcacacuu

SEQ ID NO: 1223509 - RNA, 15 nt, Human
ucuuuugccauuaaa

SEQ ID NO: 1223510 - RNA, 19 nt, Human
ugcuacaaaaacacagcaa

SEQ ID NO: 1223511 - RNA, 16 nt, Human
aagacaaagacaaauu

SEQ ID NO: 1223512 - RNA, 15 nt, Human
gaccucagccuuccc

SEQ ID NO: 1223513 - RNA, 16 nt, Human
cucccaaagugcuggg

SEQ ID NO: 1223514 - RNA, 15 nt, Human
gauagguuaccagua

SEQ ID NO: 1223515 - RNA, 22 nt, Human
ucgucgucuugacuuuggcaaa

SEQ ID NO: 1223516 - RNA, 12 nt, Human
acagggacccac

SEQ ID NO: 1223517 - RNA, 17 nt, Human
auugagcaccugcaggc

SEQ ID NO: 1223518 - RNA, 23 nt, Human
auuugaugaaaucagaguuuuca

SEQ ID NO: 1223519 - RNA, 18 nt, Human
ccagcacuaaagcagugg

SEQ ID NO: 1223520 - RNA, 13 nt, Human
uacuauauuuaug

SEQ ID NO: 1223521 - RNA, 21 nt, Human
uucacaaccacucauucaaaa

SEQ ID NO: 1223522 - RNA, 20 nt, Human
aucaauuuuucuuauuucau

SEQ ID NO: 1223523 - RNA, 21 nt, Human
ggcccugagcucgguggaccc

SEQ ID NO: 1223524 - RNA, 21 nt, Human
caguauucccuuuugcugccu

SEQ ID NO: 1223525 - RNA, 21 nt, Human
uugccaugcuggccaggcugg

SEQ ID NO: 1223526 - RNA, 21 nt, Human
uacuuaaaacuguaaauuuau

SEQ ID NO: 1223527 - RNA, 12 nt, Human
uuuuuaaauaaa

SEQ ID NO: 1223528 - RNA, 23 nt, Human
uugccugcaggcaugagucaguc

SEQ ID NO: 1223529 - RNA, 15 nt, Human
gccagugucaggagg

SEQ ID NO: 1223530 - RNA, 15 nt, Human
cuaaaaaacaaagaa

SEQ ID NO: 1223531 - RNA, 13 nt, Human
acccucugggucu

SEQ ID NO: 1223532 - RNA, 20 nt, Human
agaccagccaaccugggggc

SEQ ID NO: 1223533 - RNA, 17 nt, Human
auuauaauauacuauau

SEQ ID NO: 1223534 - RNA, 16 nt, Human
aauuuaagauuuuguu

SEQ ID NO: 1223535 - RNA, 16 nt, Human
aggcuacugucagcuc

SEQ ID NO: 1223536 - RNA, 19 nt, Human
agugggugccccccuugcc

SEQ ID NO: 1223537 - RNA, 12 nt, Human
cccuccccugcc

SEQ ID NO: 1223538 - RNA, 16 nt, Human
uauguaccauguacau

SEQ ID NO: 1223539 - RNA, 22 nt, Human
caaaacugauacccuuugaaaa

SEQ ID NO: 1223540 - RNA, 18 nt, Human
cuggacaguuuucugcuu

SEQ ID NO: 1223541 - RNA, 19 nt, Human
ccuguaaucauauaauaaa

SEQ ID NO: 1223542 - RNA, 18 nt, Human
ggccuggcugggaguggc

SEQ ID NO: 1223543 - RNA, 16 nt, Human
agcuuagaccucagcc

SEQ ID NO: 1223544 - RNA, 18 nt, Human
gguuaagcacuuuaacac

SEQ ID NO: 1223545 - RNA, 14 nt, Human
augaucuuuaaaau

SEQ ID NO: 1223546 - RNA, 17 nt, Human
ccuccaccuucuggguu

SEQ ID NO: 1223547 - RNA, 15 nt, Human
augugcuuuuaaaaa

SEQ ID NO: 1223548 - RNA, 16 nt, Human
ucaaacugaagccaga

SEQ ID NO: 1223549 - RNA, 21 nt, Human
cuauuuauuuauuuauuugag

SEQ ID NO: 1223550 - RNA, 16 nt, Human
gaaagggucucccucu

SEQ ID NO: 1223551 - RNA, 22 nt, Human
cuggagcuugaaauagugucug

SEQ ID NO: 1223552 - RNA, 20 nt, Human
auuacaguuagagauuuuua

SEQ ID NO: 1223553 - RNA, 20 nt, Human
gucagcuccccucggagaag

SEQ ID NO: 1223554 - RNA, 21 nt, Human
auauuuaagauaauuauaaua

SEQ ID NO: 1223555 - RNA, 21 nt, Human
uugccaaggcuggagugcagu

SEQ ID NO: 1223556 - RNA, 16 nt, Human
aaaauguuagaaaaaa

SEQ ID NO: 1223557 - RNA, 21 nt, Human
aaagaauauuuuaacuuccuu

SEQ ID NO: 1223558 - RNA, 20 nt, Human
uaacugcauugagaacugca

SEQ ID NO: 1223559 - RNA, 18 nt, Human
gauuaugaucucagaaau

SEQ ID NO: 1223560 - RNA, 21 nt, Human
caacugaggcagacagcagcu

SEQ ID NO: 1223561 - RNA, 16 nt, Human
caucuagcaaauguua

SEQ ID NO: 1223562 - RNA, 21 nt, Human
cuggucucgaacugcuggauu

SEQ ID NO: 1223563 - RNA, 14 nt, Human
uaaaauaaauuauu

SEQ ID NO: 1223564 - RNA, 13 nt, Human
ucaagaaacuuaa

SEQ ID NO: 1223565 - RNA, 21 nt, Human
cgggguuugccaugcuggcca

SEQ ID NO: 1223566 - RNA, 21 nt, Human
uuaucagucauaacuaaauaa

SEQ ID NO: 1223567 - RNA, 16 nt, Human
auuuaagguauauaaa

SEQ ID NO: 1223568 - RNA, 16 nt, Human
cuguaaauuuauuaug

SEQ ID NO: 1223569 - RNA, 17 nt, Human
uucuagguucuaaaaau

SEQ ID NO: 1223570 - RNA, 12 nt, Human
auuccaauacau

SEQ ID NO: 1223571 - RNA, 22 nt, Human
uccaaacuggagcuugaaauag

SEQ ID NO: 1223572 - RNA, 21 nt, Human
ccaaucauuuuaauuauuauu

SEQ ID NO: 1223573 - RNA, 16 nt, Human
accuguaaucauauaa

SEQ ID NO: 1223574 - RNA, 12 nt, Human
acuguaaauuua

SEQ ID NO: 1223575 - RNA, 22 nt, Human
acuggccugcuggauguggagg

SEQ ID NO: 1223576 - RNA, 16 nt, Human
ucuucccuuuuacaua

SEQ ID NO: 1223577 - RNA, 16 nt, Human
ccuacaccccuccccu

SEQ ID NO: 1223578 - RNA, 15 nt, Human
uauuuaaauauuaaa

SEQ ID NO: 1223579 - RNA, 17 nt, Human
aaauuugaugaaaucag

SEQ ID NO: 1223580 - RNA, 18 nt, Human
gagugacauguuuacaaa

SEQ ID NO: 1223581 - RNA, 18 nt, Human
cagauagguuaccaguaa

SEQ ID NO: 1223582 - RNA, 22 nt, Human
aucagcuugcccuguuaaaaga

SEQ ID NO: 1223583 - RNA, 22 nt, Human
gucucccucuguugccaaggcu

SEQ ID NO: 1223584 - RNA, 24 nt, Human
ucccugcagacaugagagacagca

SEQ ID NO: 1223585 - RNA, 22 nt, Human
acucauuuccuauguaacugca

SEQ ID NO: 1223586 - RNA, 14 nt, Human
uuaauuauuauucu

SEQ ID NO: 1223587 - RNA, 12 nt, Human
aauuauuauuua

SEQ ID NO: 1223588 - RNA, 22 nt, Human
gaggcagacagcagcucaggca

SEQ ID NO: 1223589 - RNA, 17 nt, Human
agggagagaagauagca

SEQ ID NO: 1223590 - RNA, 17 nt, Human
agaaagacuauucaaac

SEQ ID NO: 1223591 - RNA, 17 nt, Human
ucccuacaccccucccc

SEQ ID NO: 1223592 - RNA, 24 nt, Human
aaucugaggccuccucucucaguu

SEQ ID NO: 1223593 - RNA, 14 nt, Human
ccaaauuuguauuu

SEQ ID NO: 1223594 - RNA, 19 nt, Human
agggaauugcagaguacug

SEQ ID NO: 1223595 - RNA, 19 nt, Human
aaaauugugaucagaccau

SEQ ID NO: 1223596 - RNA, 22 nt, Human
cagccgcuccugucugccagcc

SEQ ID NO: 1223597 - RNA, 18 nt, Human
cuugcccuguuaaaagau

SEQ ID NO: 1223598 - RNA, 19 nt, Human
ugaguuuuugauagcuuua

SEQ ID NO: 1223599 - RNA, 15 nt, Human
acaaaucuuaacuug

SEQ ID NO: 1223600 - RNA, 17 nt, Human
ucucauccugcaggcag

SEQ ID NO: 1223601 - RNA, 19 nt, Human
uuaaagcuaaaguaucugu

SEQ ID NO: 1223602 - RNA, 14 nt, Human
ugccccccuugcca

SEQ ID NO: 1223603 - RNA, 15 nt, Human
gccucggagccucau

SEQ ID NO: 1223604 - RNA, 23 nt, Human
caaaagguauuuauugagcaccu

SEQ ID NO: 1223605 - RNA, 23 nt, Human
cagaaugauuuuacggagauauc

SEQ ID NO: 1223606 - RNA, 23 nt, Human
aggcaugagucagucugaugaga

SEQ ID NO: 1223607 - RNA, 13 nt, Human
uguauugcauuaa

SEQ ID NO: 1223608 - RNA, 19 nt, Human
gagggaauugcagaguacu

SEQ ID NO: 1223609 - RNA, 23 nt, Human
uguuauagguuguuggauaaauc

SEQ ID NO: 1223610 - RNA, 17 nt, Human
auucacaaccacucauu

SEQ ID NO: 1223611 - RNA, 13 nt, Human
cacauuaaaaugu

SEQ ID NO: 1223612 - RNA, 19 nt, Human
aaucacucauuuauuucca

SEQ ID NO: 1223613 - RNA, 12 nt, Human
aacugagaugug

SEQ ID NO: 1223614 - RNA, 23 nt, Human
auuuuucuuauuucauuucuuug

SEQ ID NO: 1223615 - RNA, 14 nt, Human
auagugucugauga

SEQ ID NO: 1223616 - RNA, 19 nt, Human
agcuugaaauagugucuga

SEQ ID NO: 1223617 - RNA, 15 nt, Human
uaaaaugagcaaaag

SEQ ID NO: 1223618 - RNA, 18 nt, Human
aaaaauggaacauaaaau

SEQ ID NO: 1223619 - RNA, 14 nt, Human
gccagcucucagcc

SEQ ID NO: 1223620 - RNA, 18 nt, Human
acaguuuucugagaaaga

SEQ ID NO: 1223621 - RNA, 17 nt, Human
cugaagggcaucaugca

SEQ ID NO: 1223622 - RNA, 19 nt, Human
gagccaaggguucagagac

SEQ ID NO: 1223623 - RNA, 16 nt, Human
guucucuucuuuaaag

SEQ ID NO: 1223624 - RNA, 19 nt, Human
acuuaagguuaccuuuguu

SEQ ID NO: 1223625 - RNA, 21 nt, Human
accacccuugccauggagguu

SEQ ID NO: 1223626 - RNA, 22 nt, Human
acugauguuccuagugaaagag

SEQ ID NO: 1223627 - RNA, 19 nt, Human
aucucugauacuuuuuuca

SEQ ID NO: 1223628 - RNA, 16 nt, Human
ucaccugggcugaggc

SEQ ID NO: 1223629 - RNA, 12 nt, Human
cugauuuuccug

SEQ ID NO: 1223630 - RNA, 19 nt, Human
ggcuuuagggaccugcugu

SEQ ID NO: 1223631 - RNA, 17 nt, Human
agcuuauuaaaacucau

SEQ ID NO: 1223632 - RNA, 16 nt, Human
accuuuagaauauuaa

SEQ ID NO: 1223633 - RNA, 16 nt, Human
ggcagcuuuuucucuc

SEQ ID NO: 1223634 - RNA, 20 nt, Human
caauuauuuuuacaguucuc

SEQ ID NO: 1223635 - RNA, 21 nt, Human
ugugcugcccgucuucagccu

SEQ ID NO: 1223636 - RNA, 19 nt, Human
uuagcuuagaccucagccu

SEQ ID NO: 1223637 - RNA, 22 nt, Human
ggugccccccuugccagacaug

SEQ ID NO: 1223638 - RNA, 24 nt, Human
uugccaaggcuggagugcaguggc

SEQ ID NO: 1223639 - RNA, 16 nt, Human
gucucaggaaaucaaa

SEQ ID NO: 1223640 - RNA, 19 nt, Human
gccuagccgaccucagccu

SEQ ID NO: 1223641 - RNA, 18 nt, Human
ucagccuuccccuugccc

SEQ ID NO: 1223642 - RNA, 22 nt, Human
aaccaugagaccacuguuauca

SEQ ID NO: 1223643 - RNA, 18 nt, Human
augucacuagggcaggga

SEQ ID NO: 1223644 - RNA, 13 nt, Human
cauacuauggaau

SEQ ID NO: 1223645 - RNA, 13 nt, Human
acuaaaaaacaaa

SEQ ID NO: 1223646 - RNA, 15 nt, Human
aagcacgaaauguua

SEQ ID NO: 1223647 - RNA, 14 nt, Human
agugugaccaggca

SEQ ID NO: 1223648 - RNA, 15 nt, Human
agucugaugagaacu

SEQ ID NO: 1223649 - RNA, 15 nt, Human
aucacaaaucuuaac

SEQ ID NO: 1223650 - RNA, 18 nt, Human
aaaagacuccaaagaaau

SEQ ID NO: 1223651 - RNA, 17 nt, Human
ugguaaaauacuucuug

SEQ ID NO: 1223652 - RNA, 17 nt, Human
agcaguugaaaagacuc

SEQ ID NO: 1223653 - RNA, 11 nt, Human
guuuuaucauu

SEQ ID NO: 1223654 - RNA, 16 nt, Human
ucugcuuuaauuucau

SEQ ID NO: 1223655 - RNA, 17 nt, Human
gauuuuuaaauaaagaa

SEQ ID NO: 1223656 - RNA, 16 nt, Human
gaucucagaaauugua

SEQ ID NO: 1223657 - RNA, 14 nt, Human
uccuucacauccug

SEQ ID NO: 1223658 - RNA, 17 nt, Human
ugaucuuuaaaauacac

SEQ ID NO: 1223659 - RNA, 14 nt, Human
uugccugcaggcau

SEQ ID NO: 1223660 - RNA, 19 nt, Human
aaguccuacaagcuaaaau

SEQ ID NO: 1223661 - RNA, 21 nt, Human
ucuagcaaauguuaugcauaa

SEQ ID NO: 1223662 - RNA, 15 nt, Human
gcaaccuccaccuuc

SEQ ID NO: 1223663 - RNA, 17 nt, Human
uuuuaaaaaaaaauacu

SEQ ID NO: 1223664 - RNA, 20 nt, Human
acaguuagagauuuuuaaau

SEQ ID NO: 1223665 - RNA, 16 nt, Human
uaaaugugcuuuuaaa

SEQ ID NO: 1223666 - RNA, 13 nt, Human
ugaaaugcagagu

SEQ ID NO: 1223667 - RNA, 15 nt, Human
cuccugguuccuagg

SEQ ID NO: 1223668 - RNA, 16 nt, Human
auuucaugauuucauu

SEQ ID NO: 1223669 - RNA, 16 nt, Human
cugggucucagugucc

SEQ ID NO: 1223670 - RNA, 20 nt, Human
auuuugguaaaauacuucuu

SEQ ID NO: 1223671 - RNA, 12 nt, Human
aucaacaauagu

SEQ ID NO: 1223672 - RNA, 19 nt, Human
cucagccuuccccuugccc

SEQ ID NO: 1223673 - RNA, 19 nt, Human
caguggacaccaggagucc

SEQ ID NO: 1223674 - RNA, 17 nt, Human
uuuuaucauuuucaaaa

SEQ ID NO: 1223675 - RNA, 21 nt, Human
uaaaauaaaguauauauagaa

SEQ ID NO: 1223676 - RNA, 15 nt, Human
ggauggcaagaugug

SEQ ID NO: 1223677 - RNA, 20 nt, Human
ucagcaaaaaaguacuuaaa

SEQ ID NO: 1223678 - RNA, 19 nt, Human
cagccuggugggccuccuc

SEQ ID NO: 1223679 - RNA, 21 nt, Human
aaaauggaacauaaaauacaa

SEQ ID NO: 1223680 - RNA, 15 nt, Human
aauaaaauacauacu

SEQ ID NO: 1223681 - RNA, 13 nt, Human
ugccaaggcugga

SEQ ID NO: 1223682 - RNA, 21 nt, Human
cuguuuguuauggcuuaauga

SEQ ID NO: 1223683 - RNA, 23 nt, Human
uuacauuauuaucaacaauagug

SEQ ID NO: 1223684 - RNA, 18 nt, Human
guaauuucagaagaaauu

SEQ ID NO: 1223685 - RNA, 20 nt, Human
acaguggaaagacagcuucu

SEQ ID NO: 1223686 - RNA, 18 nt, Human
auaaauuauuauuuaaac

SEQ ID NO: 1223687 - RNA, 15 nt, Human
uccuugcaucaauuu

SEQ ID NO: 1223688 - RNA, 20 nt, Human
uucgugaaguauacuguauu

SEQ ID NO: 1223689 - RNA, 16 nt, Human
gacuggccugcuggau

SEQ ID NO: 1223690 - RNA, 13 nt, Human
cauuuuaaaaaau

SEQ ID NO: 1223691 - RNA, 19 nt, Human
gaaccuuuacauccagaua

SEQ ID NO: 1223692 - RNA, 21 nt, Human
auugcuuguuagcaaaaugga

SEQ ID NO: 1223693 - RNA, 17 nt, Human
gaucuuuaaaauacaca

SEQ ID NO: 1223694 - RNA, 17 nt, Human
cgaccucagccuucccc

SEQ ID NO: 1223695 - RNA, 13 nt, Human
uagauucuuuauu

SEQ ID NO: 1223696 - RNA, 13 nt, Human
cuggccugcugga

SEQ ID NO: 1223697 - RNA, 13 nt, Human
aagaauauuuuaa

SEQ ID NO: 1223698 - RNA, 13 nt, Human
ccugagcaggauu

SEQ ID NO: 1223699 - RNA, 22 nt, Human
cauuaaaacaauauuguuucua

SEQ ID NO: 1223700 - RNA, 11 nt, Human
ucauuuuaaaa

SEQ ID NO: 1223701 - RNA, 20 nt, Human
uggucucgaacugcuggauu

SEQ ID NO: 1223702 - RNA, 14 nt, Human
uagcagcagcaucu

SEQ ID NO: 1223703 - RNA, 17 nt, Human
gucucccaaagugcugg

SEQ ID NO: 1223704 - RNA, 14 nt, Human
uaaagaauuuuaaa

SEQ ID NO: 1223705 - RNA, 14 nt, Human
guauacuguauuuu

SEQ ID NO: 1223706 - RNA, 15 nt, Human
ucucccagucauuua

SEQ ID NO: 1223707 - RNA, 23 nt, Human
auuguuuuuccuuguauuuaaau

SEQ ID NO: 1223708 - RNA, 20 nt, Human
augucccuacaccccucccc

SEQ ID NO: 1223709 - RNA, 21 nt, Human
gacauguggugggacagggac

SEQ ID NO: 1223710 - RNA, 17 nt, Human
cccccuugccagacaug

SEQ ID NO: 1223711 - RNA, 17 nt, Human
auuuuuaccuuuuuccu

SEQ ID NO: 1223712 - RNA, 21 nt, Human
gugcuuaucccauagccagga

SEQ ID NO: 1223713 - RNA, 13 nt, Human
uggacuuccauuu

SEQ ID NO: 1223714 - RNA, 15 nt, Human
cuuaaaauguaauua

SEQ ID NO: 1223715 - RNA, 23 nt, Human
ggucggguuuuauuguuuaaaau

SEQ ID NO: 1223716 - RNA, 16 nt, Human
agccuggugggccucc

SEQ ID NO: 1223717 - RNA, 12 nt, Human
uaacuuaugaac

SEQ ID NO: 1223718 - RNA, 20 nt, Human
acaucagcaaaaaaguacuu

SEQ ID NO: 1223719 - RNA, 17 nt, Human
gaaaaauuagaugacug

SEQ ID NO: 1223720 - RNA, 19 nt, Human
auaaaauaaaguauauaua

SEQ ID NO: 1223721 - RNA, 20 nt, Human
gccaaggcuggagugcagug

SEQ ID NO: 1223722 - RNA, 19 nt, Human
aaagaagacaacauuaaaa

SEQ ID NO: 1223723 - RNA, 14 nt, Human
uuucauuucuuuga

SEQ ID NO: 1223724 - RNA, 22 nt, Human
agaguuuucauguauuuuaaaa

SEQ ID NO: 1223725 - RNA, 15 nt, Human
auauugauaauaaaa

SEQ ID NO: 1223726 - RNA, 18 nt, Human
cuuguaauucuaaaugaa

SEQ ID NO: 1223727 - RNA, 22 nt, Human
aaacuggaaauaaaagauugua

SEQ ID NO: 1223728 - RNA, 14 nt, Human
auaauuauaauaua

SEQ ID NO: 1223729 - RNA, 19 nt, Human
uauaauauacuauauuuau

SEQ ID NO: 1223730 - RNA, 13 nt, Human
uguaauucuaaau

SEQ ID NO: 1223731 - RNA, 19 nt, Human
agaaacaucaguuacucug

SEQ ID NO: 1223732 - RNA, 20 nt, Human
aauuaccuugagccaguaau

SEQ ID NO: 1223733 - RNA, 16 nt, Human
aagaaauguaagggaa

SEQ ID NO: 1223734 - RNA, 19 nt, Human
uguuaugcauaaagucagu

SEQ ID NO: 1223735 - RNA, 15 nt, Human
caucauaaaauaaag

SEQ ID NO: 1223736 - RNA, 23 nt, Human
cuucacuuuuuuucuuuucucug

SEQ ID NO: 1223737 - RNA, 20 nt, Human
ccaggcauccuccacaauag

SEQ ID NO: 1223738 - RNA, 15 nt, Human
accugggcugaggca

SEQ ID NO: 1223739 - RNA, 16 nt, Human
auuuccauauuaaaau

SEQ ID NO: 1223740 - RNA, 15 nt, Human
uccagacacuuuuuu

SEQ ID NO: 1223741 - RNA, 15 nt, Human
aguauuuauauauuu

SEQ ID NO: 1223742 - RNA, 12 nt, Human
aaagaauauuuu

SEQ ID NO: 1223743 - RNA, 18 nt, Human
auucuuacauguuuucuu

SEQ ID NO: 1223744 - RNA, 15 nt, Human
uuuguccuuuuuguu

SEQ ID NO: 1223745 - RNA, 21 nt, Human
uaaaaaauggaacauaaaaua

SEQ ID NO: 1223746 - RNA, 18 nt, Human
uaaggcuucucuuaaaca

SEQ ID NO: 1223747 - RNA, 16 nt, Human
aacagauuauuaccuu

SEQ ID NO: 1223748 - RNA, 22 nt, Human
ccuugcccagggcucagccugg

SEQ ID NO: 1223749 - RNA, 16 nt, Human
agcauauguuuuugua

SEQ ID NO: 1223750 - RNA, 16 nt, Human
gacucagggccccagc

SEQ ID NO: 1223751 - RNA, 20 nt, Human
auaaauuauuauuuaaacau

SEQ ID NO: 1223752 - RNA, 16 nt, Human
ccacuguuaucaaaac

SEQ ID NO: 1223753 - RNA, 21 nt, Human
cucauuuuuguuuucauuauc

SEQ ID NO: 1223754 - RNA, 17 nt, Human
cuccuguacuuuuucca

SEQ ID NO: 1223755 - RNA, 19 nt, Human
ucucagccaacgaguaauu

SEQ ID NO: 1223756 - RNA, 17 nt, Human
uucuaaaugaauguuua

SEQ ID NO: 1223757 - RNA, 15 nt, Human
uaaagaauuuucaaa

SEQ ID NO: 1223758 - RNA, 21 nt, Human
ucaauuuuucuuauuucauuu

SEQ ID NO: 1223759 - RNA, 15 nt, Human
ugggccuccucuguc

SEQ ID NO: 1223760 - RNA, 16 nt, Human
auuuugguaaaauacu

SEQ ID NO: 1223761 - RNA, 16 nt, Human
aacugcuggauucaag

SEQ ID NO: 1223762 - RNA, 18 nt, Human
uuugacaagguucuuccc

SEQ ID NO: 1223763 - RNA, 13 nt, Human
cucgguggaccca

SEQ ID NO: 1223764 - RNA, 17 nt, Human
uaauuuaugaguuuuug

SEQ ID NO: 1223765 - RNA, 19 nt, Human
ugagcaccugcaggcguga

SEQ ID NO: 1223766 - RNA, 19 nt, Human
uacauguuuucuuugcuuu

SEQ ID NO: 1223767 - RNA, 14 nt, Human
aacugcuggauuca

SEQ ID NO: 1223768 - RNA, 19 nt, Human
ccgcuccugucugccagcc

SEQ ID NO: 1223769 - RNA, 19 nt, Human
auuaaaaucacaaacucau

SEQ ID NO: 1223770 - RNA, 16 nt, Human
uguacaugaagaagcu

SEQ ID NO: 1223771 - RNA, 16 nt, Human
cuuguaauucuaaaug

SEQ ID NO: 1223772 - RNA, 21 nt, Human
cauauguuuuuguaaguuuau

SEQ ID NO: 1223773 - RNA, 17 nt, Human
cgaaagcaucauuauuu

SEQ ID NO: 1223774 - RNA, 14 nt, Human
uuaauuauuauuua

SEQ ID NO: 1223775 - RNA, 15 nt, Human
agaauacuaauaaaa

SEQ ID NO: 1223776 - RNA, 19 nt, Human
acaacucgaaucacucauu

SEQ ID NO: 1223777 - RNA, 13 nt, Human
ugggacaguuccu

SEQ ID NO: 1223778 - RNA, 19 nt, Human
ccuggucgucgucuugacu

SEQ ID NO: 1223779 - RNA, 13 nt, Human
cagucugaugaga

SEQ ID NO: 1223780 - RNA, 13 nt, Human
ugccugcaggcau

SEQ ID NO: 1223781 - RNA, 18 nt, Human
gauucauuuuucuuucug

SEQ ID NO: 1223782 - RNA, 15 nt, Human
auauuaaaaauuaau

SEQ ID NO: 1223783 - RNA, 16 nt, Human
cauauugauaauaaaa

SEQ ID NO: 1223784 - RNA, 19 nt, Human
cuguucacagccagacugg

SEQ ID NO: 1223785 - RNA, 15 nt, Human
uuccugagaccagcc

SEQ ID NO: 1223786 - RNA, 17 nt, Human
aaauuauuauuuaaaca

SEQ ID NO: 1223787 - RNA, 24 nt, Human
accugcuguuuccuagcgcagcca

SEQ ID NO: 1223788 - RNA, 12 nt, Human
auuuucaaaaug

SEQ ID NO: 1223789 - RNA, 12 nt, Human
aaacacagcaag

SEQ ID NO: 1223790 - RNA, 21 nt, Human
gaacuuuccacauucagagcu

SEQ ID NO: 1223791 - RNA, 22 nt, Human
auuucuugaguuuuguuuuaaa

SEQ ID NO: 1223792 - RNA, 20 nt, Human
uuaaguaauuucagaagaaa

SEQ ID NO: 1223793 - RNA, 18 nt, Human
guagccacuucacuuuuu

SEQ ID NO: 1223794 - RNA, 19 nt, Human
ugaaacauuacaguuagag

SEQ ID NO: 1223795 - RNA, 23 nt, Human
cacagcaguugaaaagacuccaa

SEQ ID NO: 1223796 - RNA, 20 nt, Human
ugcauacaguaauuuuaagu

SEQ ID NO: 1223797 - RNA, 15 nt, Human
ucugcccugcuuuug

SEQ ID NO: 1223798 - RNA, 17 nt, Human
acaccagagauaauaug

SEQ ID NO: 1223799 - RNA, 17 nt, Human
aucaagaaacuuaaggu

SEQ ID NO: 1223800 - RNA, 14 nt, Human
uuagaauauuaaaa

SEQ ID NO: 1223801 - RNA, 21 nt, Human
gucagcuccccucggagaaga

SEQ ID NO: 1223802 - RNA, 15 nt, Human
uauuuccauauuaaa

SEQ ID NO: 1223803 - RNA, 17 nt, Human
gcuucucauccugcagg

SEQ ID NO: 1223804 - RNA, 15 nt, Human
gcuuuucaaaauugg

SEQ ID NO: 1223805 - RNA, 20 nt, Human
gcugauauauguguuuuuca

SEQ ID NO: 1223806 - RNA, 23 nt, Human
aucagcauuuuacuacuuuaaaa

SEQ ID NO: 1223807 - RNA, 19 nt, Human
uaaaugugcuuuuaaaaaa

SEQ ID NO: 1223808 - RNA, 19 nt, Human
aauauuuuaacuuccuugg

SEQ ID NO: 1223809 - RNA, 16 nt, Human
uucuaaguaaaaccac

SEQ ID NO: 1223810 - RNA, 21 nt, Human
uucacaagugaaaaacaucca

SEQ ID NO: 1223811 - RNA, 15 nt, Human
aggaaaucaaauaug

SEQ ID NO: 1223812 - RNA, 16 nt, Human
uggugggacagggacc

SEQ ID NO: 1223813 - RNA, 18 nt, Human
gaacucugagcagugcuu

SEQ ID NO: 1223814 - RNA, 17 nt, Human
acucaacgagagcacuu

SEQ ID NO: 1223815 - RNA, 13 nt, Human
ggucucccucugu

SEQ ID NO: 1223816 - RNA, 15 nt, Human
ucaaccaaauggagu

SEQ ID NO: 1223817 - RNA, 22 nt, Human
uuuauaacucaucauaaaauaa

SEQ ID NO: 1223818 - RNA, 14 nt, Human
agcuuuucaaaauu

SEQ ID NO: 1223819 - RNA, 11 nt, Human
aucaauuuuuc

SEQ ID NO: 1223820 - RNA, 14 nt, Human
aacugcauugagaa

SEQ ID NO: 1223821 - RNA, 14 nt, Human
agguucuucccuuu

SEQ ID NO: 1223822 - RNA, 18 nt, Human
uucauguauuuuaaaaua

SEQ ID NO: 1223823 - RNA, 19 nt, Human
uccagccuggcaaggguuc

SEQ ID NO: 1223824 - RNA, 15 nt, Human
accugggcauucuug

SEQ ID NO: 1223825 - RNA, 18 nt, Human
aaucauauaauaaaugua

SEQ ID NO: 1223826 - RNA, 18 nt, Human
agaaaacuaagaaauaug

SEQ ID NO: 1223827 - RNA, 13 nt, Human
uagaccucagccu

SEQ ID NO: 1223828 - RNA, 16 nt, Human
ggaaagggucucccuc

SEQ ID NO: 1223829 - RNA, 18 nt, Human
uauuguguguuauuuaaa

SEQ ID NO: 1223830 - RNA, 11 nt, Human
gcucaggcaca

SEQ ID NO: 1223831 - RNA, 20 nt, Human
ggaaaucaaauaugcaaagc

SEQ ID NO: 1223832 - RNA, 13 nt, Human
ucauccugcaggc

SEQ ID NO: 1223833 - RNA, 19 nt, Human
accucaguuuuaucauuuu

SEQ ID NO: 1223834 - RNA, 18 nt, Human
cugccagccagcagccag

SEQ ID NO: 1223835 - RNA, 19 nt, Human
agucauuuaauaaaugugc

SEQ ID NO: 1223836 - RNA, 23 nt, Human
accuuuguagccacuucacuuuu

SEQ ID NO: 1223837 - RNA, 13 nt, Human
uaauaaaauucau

SEQ ID NO: 1223838 - RNA, 20 nt, Human
gacucauuuuaaaaaaugga

SEQ ID NO: 1223839 - RNA, 21 nt, Human
cagugaugucacuagggcagg

SEQ ID NO: 1223840 - RNA, 15 nt, Human
cuacaagcuaaaauu

SEQ ID NO: 1223841 - RNA, 15 nt, Human
ucacaaacucaucca

SEQ ID NO: 1223842 - RNA, 19 nt, Human
uaucauauuucaaaugauu

SEQ ID NO: 1223843 - RNA, 18 nt, Human
agcaacaucuagcaaaug

SEQ ID NO: 1223844 - RNA, 15 nt, Human
ccucauccgaggcag

SEQ ID NO: 1223845 - RNA, 19 nt, Human
aaaaguauaaauaaaauga

SEQ ID NO: 1223846 - RNA, 14 nt, Human
aaauacauacuaua

SEQ ID NO: 1223847 - RNA, 14 nt, Human
gaggcagggucagg

SEQ ID NO: 1223848 - RNA, 22 nt, Human
aggcaacugaggcagacagcag

SEQ ID NO: 1223849 - RNA, 14 nt, Human
gacagcaggucuca

SEQ ID NO: 1223850 - RNA, 14 nt, Human
cuggcuuaaaaugu

SEQ ID NO: 1223851 - RNA, 12 nt, Human
uugcccagggcu

SEQ ID NO: 1223852 - RNA, 16 nt, Human
acgggguuugccaugc

SEQ ID NO: 1223853 - RNA, 14 nt, Human
uccuauguaacugc

SEQ ID NO: 1223854 - RNA, 12 nt, Human
caguugaaaaga

SEQ ID NO: 1223855 - RNA, 18 nt, Human
uucccauucuacauacua

SEQ ID NO: 1223856 - RNA, 22 nt, Human
aguugguaucaaccaaauggag

SEQ ID NO: 1223857 - RNA, 16 nt, Human
cagccuggugggccuc

SEQ ID NO: 1223858 - RNA, 21 nt, Human
acucaaaucaagaaacuuaag

SEQ ID NO: 1223859 - RNA, 12 nt, Human
cgaccucagccu

SEQ ID NO: 1223860 - RNA, 15 nt, Human
uuaccuuuuuccuuc

SEQ ID NO: 1223861 - RNA, 17 nt, Human
aaacaaaaaaagcauug

SEQ ID NO: 1223862 - RNA, 17 nt, Human
gagggauuagggagaga

SEQ ID NO: 1223863 - RNA, 23 nt, Human
augcuaaucagggaggucauuuu

SEQ ID NO: 1223864 - RNA, 16 nt, Human
uugggcugagcaguca

SEQ ID NO: 1223865 - RNA, 22 nt, Human
uugaauaauacaccagagauaa

SEQ ID NO: 1223866 - RNA, 15 nt, Human
acugcuggauucaag

SEQ ID NO: 1223867 - RNA, 22 nt, Human
gaaagcaucauuauuugcagag

SEQ ID NO: 1223868 - RNA, 23 nt, Human
cacuuggagccaaggguucagag

SEQ ID NO: 1223869 - RNA, 16 nt, Human
aaacuggaaauaaaag

SEQ ID NO: 1223870 - RNA, 16 nt, Human
uuaaagaauuuucaaa

SEQ ID NO: 1223871 - RNA, 14 nt, Human
caugagucagucug

SEQ ID NO: 1223872 - RNA, 14 nt, Human
uguuucuuaaaugg

SEQ ID NO: 1223873 - RNA, 14 nt, Human
uuagaccucagccu

SEQ ID NO: 1223874 - RNA, 19 nt, Human
cauuuuacuacuuuaaaaa

SEQ ID NO: 1223875 - RNA, 14 nt, Human
uuaugaaccuuuac

SEQ ID NO: 1223876 - RNA, 13 nt, Human
aaauuauuauuua

SEQ ID NO: 1223877 - RNA, 23 nt, Human
ugagcaccugcaggcgugaccug

SEQ ID NO: 1223878 - RNA, 21 nt, Human
ugugaucagaccauaauguua

SEQ ID NO: 1223879 - RNA, 14 nt, Human
augaagaagcuaaa

SEQ ID NO: 1223880 - RNA, 15 nt, Human
gaaauaguucaaagc

SEQ ID NO: 1223881 - RNA, 15 nt, Human
ccuuccccuugccca

SEQ ID NO: 1223882 - RNA, 12 nt, Human
agcuaaaguauc

SEQ ID NO: 1223883 - RNA, 14 nt, Human
caaaaauuauauuu

SEQ ID NO: 1223884 - RNA, 18 nt, Human
gccuagcccacuggcucc

SEQ ID NO: 1223885 - RNA, 17 nt, Human
cacacauuaaaauguua

SEQ ID NO: 1223886 - RNA, 21 nt, Human
ucagccuggugggccuccucu

SEQ ID NO: 1223887 - RNA, 22 nt, Human
aagcacugacuucuaaguaaaa

SEQ ID NO: 1223888 - RNA, 20 nt, Human
aaauuaaggcauaagaaaac

SEQ ID NO: 1223889 - RNA, 14 nt, Human
gcucaggcacacuu

SEQ ID NO: 1223890 - RNA, 19 nt, Human
uauaacucaucauaaaaua

SEQ ID NO: 1223891 - RNA, 20 nt, Human
cuaauucaaacuaauagaau

SEQ ID NO: 1223892 - RNA, 15 nt, Human
agaauuaauggaaua

SEQ ID NO: 1223893 - RNA, 13 nt, Human
caguauccaguac

SEQ ID NO: 1223894 - RNA, 22 nt, Human
aaagggucucccucuguugcca

SEQ ID NO: 1223895 - RNA, 14 nt, Human
cuuuauuagugaag

SEQ ID NO: 1223896 - RNA, 16 nt, Human
cucaguguccucaucu

SEQ ID NO: 1223897 - RNA, 22 nt, Human
ccuguugaagaugcuuguauuu

SEQ ID NO: 1223898 - RNA, 21 nt, Human
cacuguagcauuacagugggu

SEQ ID NO: 1223899 - RNA, 10 nt, Human
acaccaccac

SEQ ID NO: 1223900 - RNA, 15 nt, Human
accacuguuaucaaa

SEQ ID NO: 1223901 - RNA, 21 nt, Human
uacauuauuaucaacaauagu

SEQ ID NO: 1223902 - RNA, 16 nt, Human
uaccuuuugcuguggc

SEQ ID NO: 1223903 - RNA, 17 nt, Human
uaaaaaaaaaaaaaaag

SEQ ID NO: 1223904 - RNA, 21 nt, Human
aagcacugacuucuaaguaaa

SEQ ID NO: 1223905 - RNA, 20 nt, Human
agauuuuuaaauaaagaauu

SEQ ID NO: 1223906 - RNA, 21 nt, Human
uaauaaguacuguguacagaa

SEQ ID NO: 1223907 - RNA, 23 nt, Human
gauuuuguuuuuaaacuggaaau

SEQ ID NO: 1223908 - RNA, 23 nt, Human
caaggcuggagugcaguggcgca

SEQ ID NO: 1223909 - RNA, 21 nt, Human
aauuucagaagaaauucugca

SEQ ID NO: 1223910 - RNA, 10 nt, Human
uauaacucau

SEQ ID NO: 1223911 - RNA, 21 nt, Human
ucaaauuccagaaugauuuua

SEQ ID NO: 1223912 - RNA, 20 nt, Human
aucaaguccuacaagcuaaa

SEQ ID NO: 1223913 - RNA, 18 nt, Human
agacauguggugggacag

SEQ ID NO: 1223914 - RNA, 15 nt, Human
aauguuacauuauua

SEQ ID NO: 1223915 - RNA, 21 nt, Human
caaucugaggccuccucucuc

SEQ ID NO: 1223916 - RNA, 18 nt, Human
gaaacugccagcaacgca

SEQ ID NO: 1223917 - RNA, 15 nt, Human
aucuuaucauauuuc

SEQ ID NO: 1223918 - RNA, 19 nt, Human
gauuuuacaauugaaauga

SEQ ID NO: 1223919 - RNA, 18 nt, Human
guuuccuagcgcagccau

SEQ ID NO: 1223920 - RNA, 19 nt, Human
uagaaaaagcaguaacuga

SEQ ID NO: 1223921 - RNA, 16 nt, Human
augccauuuaaagcuu

SEQ ID NO: 1223922 - RNA, 20 nt, Human
aguuuaugcauacaguaauu

SEQ ID NO: 1223923 - RNA, 19 nt, Human
gaccugacagcccaagggu

SEQ ID NO: 1223924 - RNA, 15 nt, Human
ucucugccuugguau

SEQ ID NO: 1223925 - RNA, 14 nt, Human
acacucaaaucaag

SEQ ID NO: 1223926 - RNA, 13 nt, Human
aaauaaaguauau

SEQ ID NO: 1223927 - RNA, 13 nt, Human
cauuuucacuuuu

SEQ ID NO: 1223928 - RNA, 19 nt, Human
uucuagggaaaugaaagaa

SEQ ID NO: 1223929 - RNA, 19 nt, Human
ugacuuaguguacaugaaa

SEQ ID NO: 1223930 - RNA, 21 nt, Human
auuuuaguaagagauuccuga

SEQ ID NO: 1223931 - RNA, 20 nt, Human
uuuguuauggcuuaaugaca

SEQ ID NO: 1223932 - RNA, 20 nt, Human
ugagaaagacuauucaaaca

SEQ ID NO: 1223933 - RNA, 14 nt, Human
aacauaaaauacaa

SEQ ID NO: 1223934 - RNA, 20 nt, Human
gggagagaagauagcagggc

SEQ ID NO: 1223935 - RNA, 17 nt, Human
cugcuaccucacugggg

SEQ ID NO: 1223936 - RNA, 19 nt, Human
auguuagcaaagaguuaau

SEQ ID NO: 1223937 - RNA, 16 nt, Human
cuugccugcaggcaug

SEQ ID NO: 1223938 - RNA, 18 nt, Human
uaaaauggagacaccacc

SEQ ID NO: 1223939 - RNA, 16 nt, Human
auaauuauaauauacu

SEQ ID NO: 1223940 - RNA, 15 nt, Human
acacuaacauauaau

SEQ ID NO: 1223941 - RNA, 13 nt, Human
uuguauuuuacuu

SEQ ID NO: 1223942 - RNA, 16 nt, Human
gauaaacucagaaauu

SEQ ID NO: 1223943 - RNA, 12 nt, Human
acuccaaagaaa

SEQ ID NO: 1223944 - RNA, 23 nt, Human
auuaaagcuaaaguaucuguauu

SEQ ID NO: 1223945 - RNA, 16 nt, Human
gagaccuguaaucaua

SEQ ID NO: 1223946 - RNA, 18 nt, Human
ugaaaagacuccaaagaa

SEQ ID NO: 1223947 - RNA, 13 nt, Human
cccugagcaggau

SEQ ID NO: 1223948 - RNA, 14 nt, Human
uaauuucaugaaaa

SEQ ID NO: 1223949 - RNA, 20 nt, Human
uauaauaaauguacauuaau

SEQ ID NO: 1223950 - RNA, 22 nt, Human
gaaaggagaaguuaagcaacau

SEQ ID NO: 1223951 - RNA, 19 nt, Human
uauuauucuucauaacaau

SEQ ID NO: 1223952 - RNA, 21 nt, Human
accagggccuggcugggagug

SEQ ID NO: 1223953 - RNA, 12 nt, Human
ucagaaauuuaa

SEQ ID NO: 1223954 - RNA, 23 nt, Human
aggcuuacacccacaguggaaag

SEQ ID NO: 1223955 - RNA, 16 nt, Human
auguuauuuuuuaauu

SEQ ID NO: 1223956 - RNA, 20 nt, Human
gacuguggcugcuagcacuu

SEQ ID NO: 1223957 - RNA, 13 nt, Human
cgaggcaggguca

SEQ ID NO: 1223958 - RNA, 12 nt, Human
cagacagcagcu

SEQ ID NO: 1223959 - RNA, 13 nt, Human
accaaauggagug

SEQ ID NO: 1223960 - RNA, 17 nt, Human
uauaggugcuacaaaaa

SEQ ID NO: 1223961 - RNA, 13 nt, Human
ugaucuuuaaaau

SEQ ID NO: 1223962 - RNA, 12 nt, Human
aaguuucuggga

SEQ ID NO: 1223963 - RNA, 16 nt, Human
ucuguuccuucacauc

SEQ ID NO: 1223964 - RNA, 20 nt, Human
uacaguaauuuuaaguaauu

SEQ ID NO: 1223965 - RNA, 16 nt, Human
uuacaucuuucacauu

SEQ ID NO: 1223966 - RNA, 18 nt, Human
ugagugucuuaauuaaaa

SEQ ID NO: 1223967 - RNA, 19 nt, Human
uauccaaagcugaauacau

SEQ ID NO: 1223968 - RNA, 18 nt, Human
cuuugaagucugauuuuc

SEQ ID NO: 1223969 - RNA, 20 nt, Human
uuguuucauugacuaucaaa

SEQ ID NO: 1223970 - RNA, 21 nt, Human
cagggccccagcacuaaagca

SEQ ID NO: 1223971 - RNA, 19 nt, Human
cagcuucucauccugcagg

SEQ ID NO: 1223972 - RNA, 17 nt, Human
ugagaagagaauauuag

SEQ ID NO: 1223973 - RNA, 19 nt, Human
uacaauuauuuuuacaguu

SEQ ID NO: 1223974 - RNA, 19 nt, Human
ugacacuagcuaauaucaa

SEQ ID NO: 1223975 - RNA, 15 nt, Human
gaaacauuacaguua

SEQ ID NO: 1223976 - RNA, 22 nt, Human
gcagagacgggguuugccaugc

SEQ ID NO: 1223977 - RNA, 13 nt, Human
acacucaaaucaa

SEQ ID NO: 1223978 - RNA, 18 nt, Human
auguguggcauuuucacu

SEQ ID NO: 1223979 - RNA, 16 nt, Human
aaacaaacgaaaaaca

SEQ ID NO: 1223980 - RNA, 15 nt, Human
ggugccccccuugcc

SEQ ID NO: 1223981 - RNA, 17 nt, Human
acuuuuaaguugcugau

SEQ ID NO: 1223982 - RNA, 14 nt, Human
cuauagauucuuua

SEQ ID NO: 1223983 - RNA, 21 nt, Human
uggcuguaucuuguuuuucca

SEQ ID NO: 1223984 - RNA, 20 nt, Human
ucuuaacucauugcaaccuc

SEQ ID NO: 1223985 - RNA, 21 nt, Human
auaguaccaaucauuuuaauu

SEQ ID NO: 1223986 - RNA, 23 nt, Human
agacuccaaagaaauguaaggga

SEQ ID NO: 1223987 - RNA, 17 nt, Human
auuuuacaauugaaaug

SEQ ID NO: 1223988 - RNA, 18 nt, Human
uggacucauuuuaaaaaa

SEQ ID NO: 1223989 - RNA, 15 nt, Human
ugacuucuaaguaaa

SEQ ID NO: 1223990 - RNA, 17 nt, Human
aacaaauaggaauuguu

SEQ ID NO: 1223991 - RNA, 15 nt, Human
ucaguccucuuucaa

SEQ ID NO: 1223992 - RNA, 12 nt, Human
uccauauuaaaa

SEQ ID NO: 1223993 - RNA, 23 nt, Human
cgggguuugccaugcuggccagg

SEQ ID NO: 1223994 - RNA, 12 nt, Human
gagugggacagu

SEQ ID NO: 1223995 - RNA, 18 nt, Human
ucugccagccagcagcca

SEQ ID NO: 1223996 - RNA, 15 nt, Human
ggccguuuugugaag

SEQ ID NO: 1223997 - RNA, 16 nt, Human
ugucuuaauuaaaaga

SEQ ID NO: 1223998 - RNA, 13 nt, Human
uugcaaccuccac

SEQ ID NO: 1223999 - RNA, 20 nt, Human
ccgaccucagccuuccccuu

SEQ ID NO: 1224000 - RNA, 16 nt, Human
uuuaacacagugucug

SEQ ID NO: 1224001 - RNA, 21 nt, Human
auuuauauauuuauaacucau

SEQ ID NO: 1224002 - RNA, 18 nt, Human
agauuaugaucucagaaa

SEQ ID NO: 1224003 - RNA, 22 nt, Human
caagcauaccaacacgagcagg

SEQ ID NO: 1224004 - RNA, 20 nt, Human
cugaagggcaucaugcaucu

SEQ ID NO: 1224005 - RNA, 13 nt, Human
agggaccugcugu

SEQ ID NO: 1224006 - RNA, 13 nt, Human
aaaugacuaaaaa

SEQ ID NO: 1224007 - RNA, 14 nt, Human
cagagacaggaccu

SEQ ID NO: 1224008 - RNA, 22 nt, Human
gagacgggguuugccaugcugg

SEQ ID NO: 1224009 - RNA, 17 nt, Human
gaugaugaucuuuaaaa

SEQ ID NO: 1224010 - RNA, 13 nt, Human
aaucauauaauaa

SEQ ID NO: 1224011 - RNA, 21 nt, Human
ugaauuuuucucuaacucaga

SEQ ID NO: 1224012 - RNA, 14 nt, Human
guuacucugaaggg

SEQ ID NO: 1224013 - RNA, 13 nt, Human
uuuuuuuuuuucu

SEQ ID NO: 1224014 - RNA, 14 nt, Human
cuagcgcagccaug

SEQ ID NO: 1224015 - RNA, 12 nt, Human
aguuuuccuucu

SEQ ID NO: 1224016 - RNA, 16 nt, Mycobacterium leprae
uuuugaacuuucggcg

SEQ ID NO: 1224017 - RNA, 12 nt, Mycobacterium leprae
uuugggccaggu

SEQ ID NO: 1224018 - RNA, 17 nt, Mycobacterium leprae
uugguuauucuaggcga

SEQ ID NO: 1224019 - RNA, 15 nt, Mycobacterium leprae
uugguuuuguuguug

SEQ ID NO: 1224020 - RNA, 16 nt, Mycobacterium leprae
uugguccgcuacauug

SEQ ID NO: 1224021 - RNA, 18 nt, Mycobacterium leprae
uuggguggugguguugug

SEQ ID NO: 1224022 - RNA, 15 nt, Mycobacterium leprae
uugggugguguugug

SEQ ID NO: 1224023 - RNA, 22 nt, Mycobacterium leprae
uugggcgguguugcgcggcgcc

SEQ ID NO: 1224024 - RNA, 23 nt, Mycobacterium leprae
uuggcgaguaucgaaucggugau

SEQ ID NO: 1224025 - RNA, 15 nt, Mycobacterium leprae
uugugggcaggucag

SEQ ID NO: 1224026 - RNA, 13 nt, Mycobacterium leprae
uuuauacacgcgg

SEQ ID NO: 1224027 - RNA, 16 nt, Mycobacterium leprae
uuuaagcaaucccacg

SEQ ID NO: 1224028 - RNA, 18 nt, Mycobacterium leprae
uuccuacuucugggucgc

SEQ ID NO: 1224029 - RNA, 22 nt, Mycobacterium leprae
uugaacuacgugugcucgcugc

SEQ ID NO: 1224030 - RNA, 14 nt, Mycobacterium leprae
uugacaccgccggc

SEQ ID NO: 1224031 - RNA, 18 nt, Mycobacterium leprae
uugaccagccgcagcacc

SEQ ID NO: 1224032 - RNA, 18 nt, Mycobacterium leprae
uugacgaccggcugcacc

SEQ ID NO: 1224033 - RNA, 22 nt, Mycobacterium leprae
uugaucgggcccagcacccggc

SEQ ID NO: 1224034 - RNA, 22 nt, Mycobacterium leprae
uugaugcugcgaguucguuccu

SEQ ID NO: 1224035 - RNA, 18 nt, Mycobacterium leprae
uugcaugcaccgacggug

SEQ ID NO: 1224036 - RNA, 17 nt, Mycobacterium leprae
uugccaugcacgccggc

SEQ ID NO: 1224037 - RNA, 19 nt, Mycobacterium leprae
uugccagauagucgagggc

SEQ ID NO: 1224038 - RNA, 19 nt, Mycobacterium leprae
uuggacccgaucgacggca

SEQ ID NO: 1224039 - RNA, 17 nt, Mycobacterium leprae
uuggaccgcgccgcgug

SEQ ID NO: 1224040 - RNA, 18 nt, Mycobacterium leprae
uuggccagcagcgggacc

SEQ ID NO: 1224041 - RNA, 22 nt, Mycobacterium leprae
uugcugacugcgauccggcaca

SEQ ID NO: 1224042 - RNA, 13 nt, Mycobacterium leprae
uugcuccgcagca

SEQ ID NO: 1224043 - RNA, 15 nt, Mycobacterium leprae
uugcuccgcagcacc

SEQ ID NO: 1224044 - RNA, 17 nt, Mycobacterium leprae
uugcgaucaaacucgcu

SEQ ID NO: 1224045 - RNA, 20 nt, Mycobacterium leprae
uugcgaucaaacucgcugaa

SEQ ID NO: 1224046 - RNA, 18 nt, Mycobacterium leprae
uugcgcacugcccgggug

SEQ ID NO: 1224047 - RNA, 19 nt, Mycobacterium leprae
uugcgguucgcggccacgu

SEQ ID NO: 1224048 - RNA, 15 nt, Mycobacterium leprae
uguugcuuguugccg

SEQ ID NO: 1224049 - RNA, 23 nt, Mycobacterium leprae
uucacguaucggcgagaugcgcu

SEQ ID NO: 1224050 - RNA, 14 nt, Mycobacterium leprae
uucacaaccaucgc

SEQ ID NO: 1224051 - RNA, 16 nt, Mycobacterium leprae
uuccaauccugucacc

SEQ ID NO: 1224052 - RNA, 20 nt, Mycobacterium leprae
uuccacugccagagaugcgu

SEQ ID NO: 1224053 - RNA, 18 nt, Mycobacterium leprae
uuccaggacaacggcggc

SEQ ID NO: 1224054 - RNA, 19 nt, Mycobacterium leprae
uuccggcgaccagcgagca

SEQ ID NO: 1224055 - RNA, 16 nt, Mycobacterium leprae
uuccggaacaacagac

SEQ ID NO: 1224056 - RNA, 14 nt, Mycobacterium leprae
uguacaacgccagu

SEQ ID NO: 1224057 - RNA, 14 nt, Mycobacterium leprae
ugguugacagcaga

SEQ ID NO: 1224058 - RNA, 12 nt, Mycobacterium leprae
uggugggcuggu

SEQ ID NO: 1224059 - RNA, 13 nt, Mycobacterium leprae
ugucaccugaaag

SEQ ID NO: 1224060 - RNA, 12 nt, Mycobacterium leprae
ugucacgccggu

SEQ ID NO: 1224061 - RNA, 21 nt, Mycobacterium leprae
uguagaccaagcagcauccac

SEQ ID NO: 1224062 - RNA, 16 nt, Mycobacterium leprae
uguagcaggucgccga

SEQ ID NO: 1224063 - RNA, 23 nt, Mycobacterium leprae
uguccaccaaggccgugucggua

SEQ ID NO: 1224064 - RNA, 12 nt, Mycobacterium leprae
ugucaucgaacc

SEQ ID NO: 1224065 - RNA, 22 nt, Mycobacterium leprae
uguccacugcggcaaagcacac

SEQ ID NO: 1224066 - RNA, 15 nt, Mycobacterium leprae
uguccaccgaaccca

SEQ ID NO: 1224067 - RNA, 15 nt, Mycobacterium leprae
uguccacucggacac

SEQ ID NO: 1224068 - RNA, 20 nt, Mycobacterium leprae
uguccgauuaaucuacccac

SEQ ID NO: 1224069 - RNA, 20 nt, Mycobacterium leprae
ugucgacgggaagugguggc

SEQ ID NO: 1224070 - RNA, 11 nt, Mycobacterium leprae
uguugcagugu

SEQ ID NO: 1224071 - RNA, 19 nt, Mycobacterium leprae
uguugagugcgaccugaac

SEQ ID NO: 1224072 - RNA, 16 nt, Mycobacterium leprae
uguucugcgcuggcca

SEQ ID NO: 1224073 - RNA, 23 nt, Mycobacterium leprae
ugugccacaacguagggaugauc

SEQ ID NO: 1224074 - RNA, 13 nt, Mycobacterium leprae
ugugcaccacuau

SEQ ID NO: 1224075 - RNA, 14 nt, Mycobacterium leprae
ugugugcuggccaa

SEQ ID NO: 1224076 - RNA, 19 nt, Mycobacterium leprae
ugugaacuagccgccgggu

SEQ ID NO: 1224077 - RNA, 18 nt, Mycobacterium leprae
ugugaccgugcagcugcc

SEQ ID NO: 1224078 - RNA, 20 nt, Mycobacterium leprae
ugugaccagccauccgaaac

SEQ ID NO: 1224079 - RNA, 17 nt, Mycobacterium leprae
ugucgagcuggcugugc

SEQ ID NO: 1224080 - RNA, 14 nt, Mycobacterium leprae
ugucgauacggcca

SEQ ID NO: 1224081 - RNA, 21 nt, Mycobacterium leprae
uggauguuccgcagcggcgau

SEQ ID NO: 1224082 - RNA, 19 nt, Mycobacterium leprae
uggauuuguauggcgcggu

SEQ ID NO: 1224083 - RNA, 22 nt, Mycobacterium leprae
uggaucgguaccagcggcagcg

SEQ ID NO: 1224084 - RNA, 13 nt, Mycobacterium leprae
uggaugcgguggu

SEQ ID NO: 1224085 - RNA, 19 nt, Mycobacterium leprae
uggauggcgaucgccuugu

SEQ ID NO: 1224086 - RNA, 15 nt, Mycobacterium leprae
uggaugaccauaaug

SEQ ID NO: 1224087 - RNA, 17 nt, Mycobacterium leprae
uggagcaccuggucuau

SEQ ID NO: 1224088 - RNA, 18 nt, Mycobacterium leprae
uggacuucugcgcgcacc

SEQ ID NO: 1224089 - RNA, 16 nt, Mycobacterium leprae
uggaggugcggcuggc

SEQ ID NO: 1224090 - RNA, 18 nt, Mycobacterium leprae
uggaagcugaauggucau

SEQ ID NO: 1224091 - RNA, 19 nt, Mycobacterium leprae
uggacgcagugaacacgcu

SEQ ID NO: 1224092 - RNA, 21 nt, Mycobacterium leprae
uggacgcagugaacacgcuga

SEQ ID NO: 1224093 - RNA, 15 nt, Mycobacterium leprae
uggaccgcgccgcgu

SEQ ID NO: 1224094 - RNA, 18 nt, Mycobacterium leprae
uggaccgcgccgcguggg

SEQ ID NO: 1224095 - RNA, 20 nt, Mycobacterium leprae
uggcagcccuugcagcaaca

SEQ ID NO: 1224096 - RNA, 23 nt, Mycobacterium leprae
uggcaccuaaggccgucgcgggc

SEQ ID NO: 1224097 - RNA, 20 nt, Mycobacterium leprae
uggcaucagauauccuaggc

SEQ ID NO: 1224098 - RNA, 18 nt, Mycobacterium leprae
uggccaagcggaaaugac

SEQ ID NO: 1224099 - RNA, 13 nt, Mycobacterium leprae
uggccagccgucc

SEQ ID NO: 1224100 - RNA, 17 nt, Mycobacterium leprae
uggccaucgcaccgauc

SEQ ID NO: 1224101 - RNA, 22 nt, Mycobacterium leprae
uggcccgcgucgccuuagccga

SEQ ID NO: 1224102 - RNA, 23 nt, Mycobacterium leprae
ugggugagcugugccggaggcga

SEQ ID NO: 1224103 - RNA, 16 nt, Mycobacterium leprae
uggccgaaccugugcg

SEQ ID NO: 1224104 - RNA, 17 nt, Mycobacterium leprae
uggccgaggucgaggau

SEQ ID NO: 1224105 - RNA, 17 nt, Mycobacterium leprae
ugaaucaugccgcagca

SEQ ID NO: 1224106 - RNA, 12 nt, Mycobacterium leprae
ugacaacgccgc

SEQ ID NO: 1224107 - RNA, 14 nt, Mycobacterium leprae
ugacaacacgaucg

SEQ ID NO: 1224108 - RNA, 16 nt, Mycobacterium leprae
ugaagguuaucgacac

SEQ ID NO: 1224109 - RNA, 22 nt, Mycobacterium leprae
ugaacgaucgggauguccuucg

SEQ ID NO: 1224110 - RNA, 19 nt, Mycobacterium leprae
ugaacugcgguauccaucc

SEQ ID NO: 1224111 - RNA, 14 nt, Mycobacterium leprae
ugacaucgacccgu

SEQ ID NO: 1224112 - RNA, 18 nt, Mycobacterium leprae
ugacaucagucagcaucg

SEQ ID NO: 1224113 - RNA, 12 nt, Mycobacterium leprae
ugacaccgccgg

SEQ ID NO: 1224114 - RNA, 22 nt, Mycobacterium leprae
ugacaggcgcguuugucggcgu

SEQ ID NO: 1224115 - RNA, 21 nt, Mycobacterium leprae
ugacagugcugcaagcaguuc

SEQ ID NO: 1224116 - RNA, 14 nt, Mycobacterium leprae
ugacccuguccgag

SEQ ID NO: 1224117 - RNA, 16 nt, Mycobacterium leprae
ugaccacucgcgacga

SEQ ID NO: 1224118 - RNA, 14 nt, Mycobacterium leprae
ugaccagggucauu

SEQ ID NO: 1224119 - RNA, 17 nt, Mycobacterium leprae
ugaccagugugccuguc

SEQ ID NO: 1224120 - RNA, 16 nt, Mycobacterium leprae
ugaccgcccuggaccg

SEQ ID NO: 1224121 - RNA, 22 nt, Mycobacterium leprae
ugaccgccgccauccuugccga

SEQ ID NO: 1224122 - RNA, 20 nt, Mycobacterium leprae
ugaggucaccggccaccggc

SEQ ID NO: 1224123 - RNA, 15 nt, Mycobacterium leprae
ugaucgacggcuggc

SEQ ID NO: 1224124 - RNA, 21 nt, Mycobacterium leprae
ugaucguuaccgacaccgccg

SEQ ID NO: 1224125 - RNA, 17 nt, Mycobacterium leprae
ugaucgcucacccgcgc

SEQ ID NO: 1224126 - RNA, 16 nt, Mycobacterium leprae
ugaucggugacuuggc

SEQ ID NO: 1224127 - RNA, 15 nt, Mycobacterium leprae
ugaucgggcccagca

SEQ ID NO: 1224128 - RNA, 21 nt, Mycobacterium leprae
ugcacaaguaccggcucacac

SEQ ID NO: 1224129 - RNA, 17 nt, Mycobacterium leprae
ugcacccggccgucgcu

SEQ ID NO: 1224130 - RNA, 15 nt, Mycobacterium leprae
ugagcggccaucucu

SEQ ID NO: 1224131 - RNA, 17 nt, Mycobacterium leprae
ugacgcgggcgccgcag

SEQ ID NO: 1224132 - RNA, 15 nt, Mycobacterium leprae
ugacgcgacgccggc

SEQ ID NO: 1224133 - RNA, 13 nt, Mycobacterium leprae
ugccugcauugcu

SEQ ID NO: 1224134 - RNA, 14 nt, Mycobacterium leprae
ugccggugaccggg

SEQ ID NO: 1224135 - RNA, 13 nt, Mycobacterium leprae
ugcgacgaccucc

SEQ ID NO: 1224136 - RNA, 17 nt, Mycobacterium leprae
ugccugguaggugucgc

SEQ ID NO: 1224137 - RNA, 15 nt, Mycobacterium leprae
ugcgacacuugccgc

SEQ ID NO: 1224138 - RNA, 13 nt, Mycobacterium leprae
ugcggcagcugcc

SEQ ID NO: 1224139 - RNA, 21 nt, Mycobacterium leprae
ugcggcauucgcaaagcggca

SEQ ID NO: 1224140 - RNA, 19 nt, Mycobacterium leprae
ugcauccgacaaagcagca

SEQ ID NO: 1224141 - RNA, 19 nt, Mycobacterium leprae
ugcaccguggcaacgacca

SEQ ID NO: 1224142 - RNA, 20 nt, Mycobacterium leprae
ugcccagaugaauucgcuga

SEQ ID NO: 1224143 - RNA, 23 nt, Mycobacterium leprae
ugcccaagacucagugaagacca

SEQ ID NO: 1224144 - RNA, 19 nt, Mycobacterium leprae
ugccgagguguucuggcac

SEQ ID NO: 1224145 - RNA, 22 nt, Mycobacterium leprae
ugccgaccgccucgaugugcuu

SEQ ID NO: 1224146 - RNA, 14 nt, Mycobacterium leprae
ugcccggccguuuc

SEQ ID NO: 1224147 - RNA, 19 nt, Mycobacterium leprae
ugcccgaaaaguucggcca

SEQ ID NO: 1224148 - RNA, 14 nt, Mycobacterium leprae
ucgaguugguuaau

SEQ ID NO: 1224149 - RNA, 16 nt, Mycobacterium leprae
ucgauaaugccggugg

SEQ ID NO: 1224150 - RNA, 16 nt, Mycobacterium leprae
ucgauaagcagcagcg

SEQ ID NO: 1224151 - RNA, 22 nt, Mycobacterium leprae
ucgaugauccggccgucggcgg

SEQ ID NO: 1224152 - RNA, 18 nt, Mycobacterium leprae
ucgauccucgacggguca

SEQ ID NO: 1224153 - RNA, 23 nt, Mycobacterium leprae
ucgaucggcagugguaaucgaca

SEQ ID NO: 1224154 - RNA, 13 nt, Mycobacterium leprae
ucgaucggcagcc

SEQ ID NO: 1224155 - RNA, 19 nt, Mycobacterium leprae
ucgcacagcaggucgccga

SEQ ID NO: 1224156 - RNA, 23 nt, Mycobacterium leprae
ucgcaccggcugcacccgucgcu

SEQ ID NO: 1224157 - RNA, 13 nt, Mycobacterium leprae
ucgaugcgaugcg

SEQ ID NO: 1224158 - RNA, 14 nt, Mycobacterium leprae
ucgacuuccggccc

SEQ ID NO: 1224159 - RNA, 18 nt, Mycobacterium leprae
ucgacuucgcagccaccg

SEQ ID NO: 1224160 - RNA, 20 nt, Mycobacterium leprae
ucgacuucgcagccaccgac

SEQ ID NO: 1224161 - RNA, 21 nt, Mycobacterium leprae
ucgacguugcgcacugcccgg

SEQ ID NO: 1224162 - RNA, 15 nt, Mycobacterium leprae
ucgacucaccgcggc

SEQ ID NO: 1224163 - RNA, 20 nt, Mycobacterium leprae
uccgggucaccucguauggc

SEQ ID NO: 1224164 - RNA, 15 nt, Mycobacterium leprae
ucgacgguaaguuuu

SEQ ID NO: 1224165 - RNA, 17 nt, Mycobacterium leprae
ucgacgguaaguuuuca

SEQ ID NO: 1224166 - RNA, 15 nt, Mycobacterium leprae
ucgaggccagauggc

SEQ ID NO: 1224167 - RNA, 19 nt, Mycobacterium leprae
ucgcagagguaaaucuggc

SEQ ID NO: 1224168 - RNA, 15 nt, Mycobacterium leprae
ucgcagccaccgacg

SEQ ID NO: 1224169 - RNA, 14 nt, Mycobacterium leprae
ucgcacugcguugu

SEQ ID NO: 1224170 - RNA, 19 nt, Mycobacterium leprae
ucgcagccuaggugaucgu

SEQ ID NO: 1224171 - RNA, 15 nt, Mycobacterium leprae
ucgcauugccaacgu

SEQ ID NO: 1224172 - RNA, 16 nt, Mycobacterium leprae
ucgcaugugauacugc

SEQ ID NO: 1224173 - RNA, 17 nt, Mycobacterium leprae
ucgccaccuggucacca

SEQ ID NO: 1224174 - RNA, 20 nt, Mycobacterium leprae
ucgccaccgaccgccuuguc

SEQ ID NO: 1224175 - RNA, 13 nt, Mycobacterium leprae
ucgccccaacuac

SEQ ID NO: 1224176 - RNA, 20 nt, Mycobacterium leprae
ucgccagugccuucgucaau

SEQ ID NO: 1224177 - RNA, 19 nt, Mycobacterium leprae
ucgccuaaagcggcaagca

SEQ ID NO: 1224178 - RNA, 20 nt, Mycobacterium leprae
ucgcgcaacgacuguggcac

SEQ ID NO: 1224179 - RNA, 21 nt, Mycobacterium leprae
ucgcgcaacgacuguggcacc

SEQ ID NO: 1224180 - RNA, 16 nt, Mycobacterium leprae
ucgcgcgcaccccguu

SEQ ID NO: 1224181 - RNA, 22 nt, Mycobacterium leprae
ucgcgccguuuccagcgcucgc

SEQ ID NO: 1224182 - RNA, 14 nt, Mycobacterium leprae
ucuagccaagcucc

SEQ ID NO: 1224183 - RNA, 15 nt, Mycobacterium leprae
ucucagcuccgaagc

SEQ ID NO: 1224184 - RNA, 11 nt, Mycobacterium leprae
ucuccaagguu

SEQ ID NO: 1224185 - RNA, 15 nt, Mycobacterium leprae
ucguugucggucgac

SEQ ID NO: 1224186 - RNA, 23 nt, Mycobacterium leprae
ucgugcuguugucagcagaccac

SEQ ID NO: 1224187 - RNA, 19 nt, Mycobacterium leprae
ucguggcaagcgcgugauc

SEQ ID NO: 1224188 - RNA, 22 nt, Mycobacterium leprae
ucguggguuugaggcgcgcgag

SEQ ID NO: 1224189 - RNA, 19 nt, Mycobacterium leprae
ucgucgugcugaucaccgg

SEQ ID NO: 1224190 - RNA, 12 nt, Mycobacterium leprae
ucgucggccgga

SEQ ID NO: 1224191 - RNA, 22 nt, Mycobacterium leprae
ucgguaccagcggcagcggcgg

SEQ ID NO: 1224192 - RNA, 14 nt, Mycobacterium leprae
ucguagcgcccagu

SEQ ID NO: 1224193 - RNA, 19 nt, Mycobacterium leprae
ucgucaauucggcgauauc

SEQ ID NO: 1224194 - RNA, 23 nt, Mycobacterium leprae
ucguauaaugucgaagggcuggu

SEQ ID NO: 1224195 - RNA, 19 nt, Mycobacterium leprae
ucgucacgcuacugcgggc

SEQ ID NO: 1224196 - RNA, 18 nt, Mycobacterium leprae
ucgucagauccggccguu

SEQ ID NO: 1224197 - RNA, 21 nt, Mycobacterium leprae
ucgguaucggcauauccgccc

SEQ ID NO: 1224198 - RNA, 16 nt, Mycobacterium leprae
ucgguggcagccggcu

SEQ ID NO: 1224199 - RNA, 16 nt, Mycobacterium leprae
ucgguguuguuuggca

SEQ ID NO: 1224200 - RNA, 17 nt, Mycobacterium leprae
ucgguguucgcuccgcc

SEQ ID NO: 1224201 - RNA, 21 nt, Mycobacterium leprae
ucgguguugaucgaccgcuga

SEQ ID NO: 1224202 - RNA, 21 nt, Mycobacterium leprae
ucggcgccucacccaugccuc

SEQ ID NO: 1224203 - RNA, 19 nt, Mycobacterium leprae
ucggcgauauccgccggcc

SEQ ID NO: 1224204 - RNA, 16 nt, Mycobacterium leprae
ucggcgugcacggcga

SEQ ID NO: 1224205 - RNA, 19 nt, Mycobacterium leprae
ucgggaccuaccgcaucgg

SEQ ID NO: 1224206 - RNA, 15 nt, Mycobacterium leprae
ucgcugcugcuggcc

SEQ ID NO: 1224207 - RNA, 18 nt, Mycobacterium leprae
ucgcuaguuuacuaggcc

SEQ ID NO: 1224208 - RNA, 18 nt, Mycobacterium leprae
ucgcggaaguaacgucga

SEQ ID NO: 1224209 - RNA, 19 nt, Mycobacterium leprae
ucgcggaaguaacgucgaa

SEQ ID NO: 1224210 - RNA, 19 nt, Mycobacterium leprae
ucggcaugugcauccaguc

SEQ ID NO: 1224211 - RNA, 19 nt, Mycobacterium leprae
ucggccagcgcaucagcca

SEQ ID NO: 1224212 - RNA, 23 nt, Mycobacterium leprae
ucggccgaggcgcaaagucgacg

SEQ ID NO: 1224213 - RNA, 22 nt, Mycobacterium leprae
ucggcccacgagaaugucgcac

SEQ ID NO: 1224214 - RNA, 23 nt, Mycobacterium leprae
uccauacccaggguagcugacgg

SEQ ID NO: 1224215 - RNA, 16 nt, Mycobacterium leprae
uccaucagcaccgaga

SEQ ID NO: 1224216 - RNA, 17 nt, Mycobacterium leprae
ucccagccuaaauccgg

SEQ ID NO: 1224217 - RNA, 18 nt, Mycobacterium leprae
ucccagaaucgucggcua

SEQ ID NO: 1224218 - RNA, 23 nt, Mycobacterium leprae
ucccaggggggcgcggucgccga

SEQ ID NO: 1224219 - RNA, 18 nt, Mycobacterium leprae
ucccgaaagccaccauau

SEQ ID NO: 1224220 - RNA, 20 nt, Mycobacterium leprae
uccggauuuuccugcgcgaa

SEQ ID NO: 1224221 - RNA, 21 nt, Mycobacterium leprae
uccgcgucacucuaccucggu

SEQ ID NO: 1224222 - RNA, 13 nt, Mycobacterium leprae
uccgcgugugccg

SEQ ID NO: 1224223 - RNA, 16 nt, Mycobacterium leprae
uccgcgggagcggugc

SEQ ID NO: 1224224 - RNA, 19 nt, Mycobacterium leprae
uccgcgggagcggugccgc

SEQ ID NO: 1224225 - RNA, 22 nt, Mycobacterium leprae
uccgcgccggcgucggccagua

SEQ ID NO: 1224226 - RNA, 19 nt, Mycobacterium leprae
uccgccguuuuaccccgga

SEQ ID NO: 1224227 - RNA, 15 nt, Mycobacterium leprae
uccgacaaagcagca

SEQ ID NO: 1224228 - RNA, 16 nt, Mycobacterium leprae
ucccgggggccagcgu

SEQ ID NO: 1224229 - RNA, 13 nt, Mycobacterium leprae
uccgaucgcaccg

SEQ ID NO: 1224230 - RNA, 19 nt, Mycobacterium leprae
uccaguggcugcaccggcu

SEQ ID NO: 1224231 - RNA, 14 nt, Mycobacterium leprae
uccagucgcauccu

SEQ ID NO: 1224232 - RNA, 15 nt, Mycobacterium leprae
uccagcagaccgcua

SEQ ID NO: 1224233 - RNA, 16 nt, Mycobacterium leprae
uccaccauacagcuaa

SEQ ID NO: 1224234 - RNA, 19 nt, Mycobacterium leprae
uccaccagccggccggguc

SEQ ID NO: 1224235 - RNA, 19 nt, Mycobacterium leprae
ucaucuaucuccaccagcc

SEQ ID NO: 1224236 - RNA, 15 nt, Mycobacterium leprae
ucaucgacucgaaac

SEQ ID NO: 1224237 - RNA, 12 nt, Mycobacterium leprae
ucaguaaguccc

SEQ ID NO: 1224238 - RNA, 24 nt, Mycobacterium leprae
ucacaaucacaaggagccaacgau

SEQ ID NO: 1224239 - RNA, 16 nt, Mycobacterium leprae
ucacccaccuuggcgu

SEQ ID NO: 1224240 - RNA, 20 nt, Mycobacterium leprae
ucacccaccuuggcgucgau

SEQ ID NO: 1224241 - RNA, 22 nt, Mycobacterium leprae
ucaccgcggcguuauccacgcc

SEQ ID NO: 1224242 - RNA, 12 nt, Mycobacterium leprae
ucacccgcggua

SEQ ID NO: 1224243 - RNA, 18 nt, Mycobacterium leprae
ucacccgucguggccgag

SEQ ID NO: 1224244 - RNA, 21 nt, Mycobacterium leprae
ucacgcgaccaacgccgagcc

SEQ ID NO: 1224245 - RNA, 19 nt, Mycobacterium leprae
ucaccugcgacagccgugc

SEQ ID NO: 1224246 - RNA, 14 nt, Mycobacterium leprae
ucagccgucgcugu

SEQ ID NO: 1224247 - RNA, 17 nt, Mycobacterium leprae
ucagccuaugauggcgu

SEQ ID NO: 1224248 - RNA, 22 nt, Mycobacterium leprae
ucagagacaccguccucggcgg

SEQ ID NO: 1224249 - RNA, 17 nt, Mycobacterium leprae
ucagcaccgcgccgguc

SEQ ID NO: 1224250 - RNA, 22 nt, Mycobacterium leprae
ucagcacucgacucaccgcggc

SEQ ID NO: 1224251 - RNA, 15 nt, Mycobacterium leprae
ucaacggcgccgaca

SEQ ID NO: 1224252 - RNA, 20 nt, Mycobacterium leprae
ucaagcaauagagauagcgc

SEQ ID NO: 1224253 - RNA, 13 nt, Mycobacterium leprae
ucaacaaaaccau

SEQ ID NO: 1224254 - RNA, 13 nt, Mycobacterium leprae
ucaaagucgcggg

SEQ ID NO: 1224255 - RNA, 21 nt, Mycobacterium leprae
ucaaagcuagccaccaaguac

SEQ ID NO: 1224256 - RNA, 18 nt, Mycobacterium leprae
ucaacauuguaaucagcc

SEQ ID NO: 1224257 - RNA, 14 nt, Mycobacterium leprae
ucaaccaaaugcua

SEQ ID NO: 1224258 - RNA, 17 nt, Mycobacterium leprae
ucaacauggaccaccgu

SEQ ID NO: 1224259 - RNA, 15 nt, Mycobacterium leprae
ucaaccgugucggcc

SEQ ID NO: 1224260 - RNA, 14 nt, Mycobacterium leprae
uagcggcggcggcc

SEQ ID NO: 1224261 - RNA, 19 nt, Mycobacterium leprae
uagcggccuaggacgccgc

SEQ ID NO: 1224262 - RNA, 20 nt, Mycobacterium leprae
uagcggccuaggacgccgcc

SEQ ID NO: 1224263 - RNA, 17 nt, Mycobacterium leprae
uaucgcuaaggcugcug

SEQ ID NO: 1224264 - RNA, 14 nt, Mycobacterium leprae
uacugaugggcagc

SEQ ID NO: 1224265 - RNA, 20 nt, Mycobacterium leprae
uagacgagggugacgguggc

SEQ ID NO: 1224266 - RNA, 18 nt, Mycobacterium leprae
uacuugcguugcggcuua

SEQ ID NO: 1224267 - RNA, 23 nt, Mycobacterium leprae
uacuugugauucagcgcugauau

SEQ ID NO: 1224268 - RNA, 12 nt, Mycobacterium leprae
uagcaacgucac

SEQ ID NO: 1224269 - RNA, 22 nt, Mycobacterium leprae
uagcaaucuuugccuucgugau

SEQ ID NO: 1224270 - RNA, 19 nt, Mycobacterium leprae
uagcaacaaauucgccgcg

SEQ ID NO: 1224271 - RNA, 19 nt, Mycobacterium leprae
uagagugcagcacaagacu

SEQ ID NO: 1224272 - RNA, 20 nt, Mycobacterium leprae
uagcauguacuuaccugcgc

SEQ ID NO: 1224273 - RNA, 14 nt, Mycobacterium leprae
uagcaucgaccacg

SEQ ID NO: 1224274 - RNA, 16 nt, Mycobacterium leprae
uagcaucgaccacguc

SEQ ID NO: 1224275 - RNA, 16 nt, Mycobacterium leprae
uagccaacaccgcggc

SEQ ID NO: 1224276 - RNA, 16 nt, Mycobacterium leprae
uagcgauguagccaac

SEQ ID NO: 1224277 - RNA, 22 nt, Mycobacterium leprae
uaccgucuaguggcgcggcacg

SEQ ID NO: 1224278 - RNA, 17 nt, Mycobacterium leprae
uaccgguguuccgccca

SEQ ID NO: 1224279 - RNA, 19 nt, Mycobacterium leprae
uaccgucgggccugagugg

SEQ ID NO: 1224280 - RNA, 18 nt, Mycobacterium leprae
uaccgacaccgccgacga

SEQ ID NO: 1224281 - RNA, 13 nt, Mycobacterium leprae
uaccccccaucug

SEQ ID NO: 1224282 - RNA, 18 nt, Mycobacterium leprae
uacccacgaggaccccga

SEQ ID NO: 1224283 - RNA, 19 nt, Mycobacterium leprae
uaccccgagauacagccau

SEQ ID NO: 1224284 - RNA, 18 nt, Mycobacterium leprae
uacccguggucagccuag

SEQ ID NO: 1224285 - RNA, 20 nt, Mycobacterium leprae
uacauccaggauagccgauu

SEQ ID NO: 1224286 - RNA, 21 nt, Mycobacterium leprae
uaacugccuaucugcccagag

SEQ ID NO: 1224287 - RNA, 20 nt, Mycobacterium leprae
uaauaguugccuaucagacg

SEQ ID NO: 1224288 - RNA, 14 nt, Mycobacterium leprae
uaacaacuugacga

SEQ ID NO: 1224289 - RNA, 23 nt, Mycobacterium leprae
uaaccaacgcccccgcaagugcg

SEQ ID NO: 1224290 - RNA, 12 nt, Mycobacterium leprae
uaaccuugccgg

SEQ ID NO: 1224291 - RNA, 17 nt, Mycobacterium leprae
guguuucauagguggug

SEQ ID NO: 1224292 - RNA, 15 nt, Mycobacterium leprae
guguuguccgucagc

SEQ ID NO: 1224293 - RNA, 16 nt, Mycobacterium leprae
guguuguccgucagcc

SEQ ID NO: 1224294 - RNA, 17 nt, Mycobacterium leprae
guguucuacccaggccu

SEQ ID NO: 1224295 - RNA, 14 nt, Mycobacterium leprae
gugugcucgcugcu

SEQ ID NO: 1224296 - RNA, 15 nt, Mycobacterium leprae
gugugcgcgccgccc

SEQ ID NO: 1224297 - RNA, 19 nt, Mycobacterium leprae
gugucgagcuggcugugcc

SEQ ID NO: 1224298 - RNA, 11 nt, Mycobacterium leprae
gugucgaccga

SEQ ID NO: 1224299 - RNA, 15 nt, Mycobacterium leprae
guguaaggccagcgc

SEQ ID NO: 1224300 - RNA, 15 nt, Mycobacterium leprae
gugguugaucauggc

SEQ ID NO: 1224301 - RNA, 17 nt, Mycobacterium leprae
guguacucgcgauggca

SEQ ID NO: 1224302 - RNA, 16 nt, Mycobacterium leprae
gugguguugucgccga

SEQ ID NO: 1224303 - RNA, 13 nt, Mycobacterium leprae
gugcuaaccgauc

SEQ ID NO: 1224304 - RNA, 23 nt, Mycobacterium leprae
gugcguugacgaccggcugcacc

SEQ ID NO: 1224305 - RNA, 16 nt, Mycobacterium leprae
guucagugcguugucg

SEQ ID NO: 1224306 - RNA, 21 nt, Mycobacterium leprae
guuacaauaguaaguggccaa

SEQ ID NO: 1224307 - RNA, 13 nt, Mycobacterium leprae
guuaccagcgcca

SEQ ID NO: 1224308 - RNA, 19 nt, Mycobacterium leprae
guuacgauccaugccgagu

SEQ ID NO: 1224309 - RNA, 16 nt, Mycobacterium leprae
guuaccgguguuccgc

SEQ ID NO: 1224310 - RNA, 17 nt, Mycobacterium leprae
guuaccgagccggucga

SEQ ID NO: 1224311 - RNA, 16 nt, Mycobacterium leprae
guuagagugacaucgc

SEQ ID NO: 1224312 - RNA, 16 nt, Mycobacterium leprae
guuagaugucgcagcg

SEQ ID NO: 1224313 - RNA, 21 nt, Mycobacterium leprae
guuagcgcagcaugguggcca

SEQ ID NO: 1224314 - RNA, 13 nt, Mycobacterium leprae
guuagcgccgaga

SEQ ID NO: 1224315 - RNA, 18 nt, Mycobacterium leprae
guuaucuagcccagaagc

SEQ ID NO: 1224316 - RNA, 13 nt, Mycobacterium leprae
guuaucgagguga

SEQ ID NO: 1224317 - RNA, 17 nt, Mycobacterium leprae
guucuuggcuugcuguc

SEQ ID NO: 1224318 - RNA, 21 nt, Mycobacterium leprae
guucggcuacugcgacagcag

SEQ ID NO: 1224319 - RNA, 17 nt, Mycobacterium leprae
guucggcuaugagacga

SEQ ID NO: 1224320 - RNA, 15 nt, Mycobacterium leprae
guuccuggcuggcca

SEQ ID NO: 1224321 - RNA, 23 nt, Mycobacterium leprae
guucgacauacaggacgaucggg

SEQ ID NO: 1224322 - RNA, 21 nt, Mycobacterium leprae
guucgaugccccaucucaucu

SEQ ID NO: 1224323 - RNA, 13 nt, Mycobacterium leprae
guucgaucggcag

SEQ ID NO: 1224324 - RNA, 16 nt, Mycobacterium leprae
guucgaucggcagcca

SEQ ID NO: 1224325 - RNA, 13 nt, Mycobacterium leprae
guucgauucugcc

SEQ ID NO: 1224326 - RNA, 14 nt, Mycobacterium leprae
guuccucccacgac

SEQ ID NO: 1224327 - RNA, 18 nt, Mycobacterium leprae
guuccgucucucaggccg

SEQ ID NO: 1224328 - RNA, 14 nt, Mycobacterium leprae
guuguuuggcaacg

SEQ ID NO: 1224329 - RNA, 10 nt, Mycobacterium leprae
guuguggugg

SEQ ID NO: 1224330 - RNA, 15 nt, Mycobacterium leprae
guuggguaucagcgc

SEQ ID NO: 1224331 - RNA, 14 nt, Mycobacterium leprae
guugguagcuggcu

SEQ ID NO: 1224332 - RNA, 17 nt, Mycobacterium leprae
guugucggucgacacga

SEQ ID NO: 1224333 - RNA, 20 nt, Mycobacterium leprae
guuggcgacgugaucgacga

SEQ ID NO: 1224334 - RNA, 14 nt, Mycobacterium leprae
gucgcgguagcgca

SEQ ID NO: 1224335 - RNA, 16 nt, Mycobacterium leprae
gucgcguugaggacga

SEQ ID NO: 1224336 - RNA, 15 nt, Mycobacterium leprae
gucgcgccugcgcag

SEQ ID NO: 1224337 - RNA, 16 nt, Mycobacterium leprae
gucgcgcgauacccgc

SEQ ID NO: 1224338 - RNA, 16 nt, Mycobacterium leprae
gucgcgggguuggcca

SEQ ID NO: 1224339 - RNA, 15 nt, Mycobacterium leprae
gucgcgagcugaaca

SEQ ID NO: 1224340 - RNA, 19 nt, Mycobacterium leprae
gucgccagagccggcgggu

SEQ ID NO: 1224341 - RNA, 21 nt, Mycobacterium leprae
gucgagacacagaucgagcga

SEQ ID NO: 1224342 - RNA, 14 nt, Mycobacterium leprae
gucgaggugccgcg

SEQ ID NO: 1224343 - RNA, 16 nt, Mycobacterium leprae
gucgacuucgcagcca

SEQ ID NO: 1224344 - RNA, 16 nt, Mycobacterium leprae
gucgacguguucacgc

SEQ ID NO: 1224345 - RNA, 21 nt, Mycobacterium leprae
gucgacguguucacgcaguca

SEQ ID NO: 1224346 - RNA, 23 nt, Mycobacterium leprae
gucgacguguucacgcagucauc

SEQ ID NO: 1224347 - RNA, 20 nt, Mycobacterium leprae
gucgaccgccgaagcagcca

SEQ ID NO: 1224348 - RNA, 14 nt, Mycobacterium leprae
gucacgguugcccg

SEQ ID NO: 1224349 - RNA, 20 nt, Mycobacterium leprae
gucccgaacaaauugugggg

SEQ ID NO: 1224350 - RNA, 17 nt, Mycobacterium leprae
guccagguuugcgguca

SEQ ID NO: 1224351 - RNA, 14 nt, Mycobacterium leprae
gucccugacgcgca

SEQ ID NO: 1224352 - RNA, 17 nt, Mycobacterium leprae
guccgcuacauugcucc

SEQ ID NO: 1224353 - RNA, 19 nt, Mycobacterium leprae
guccugacagauacucagc

SEQ ID NO: 1224354 - RNA, 20 nt, Mycobacterium leprae
guccucgaaucggaugcgau

SEQ ID NO: 1224355 - RNA, 19 nt, Mycobacterium leprae
gucgaaacgucaucgacag

SEQ ID NO: 1224356 - RNA, 13 nt, Mycobacterium leprae
guccugccggugc

SEQ ID NO: 1224357 - RNA, 19 nt, Mycobacterium leprae
gucgaaggugagucgacag

SEQ ID NO: 1224358 - RNA, 20 nt, Mycobacterium leprae
gucgaaggugagucgacagc

SEQ ID NO: 1224359 - RNA, 17 nt, Mycobacterium leprae
gucuggcggcccacaag

SEQ ID NO: 1224360 - RNA, 22 nt, Mycobacterium leprae
gucuggcgggugguguacucgc

SEQ ID NO: 1224361 - RNA, 13 nt, Mycobacterium leprae
gucuggcuggccu

SEQ ID NO: 1224362 - RNA, 14 nt, Mycobacterium leprae
gucguuagcgccga

SEQ ID NO: 1224363 - RNA, 14 nt, Mycobacterium leprae
gucgugaaucaugc

SEQ ID NO: 1224364 - RNA, 20 nt, Mycobacterium leprae
gucuucuccgggcugggacg

SEQ ID NO: 1224365 - RNA, 12 nt, Mycobacterium leprae
gucugguugcac

SEQ ID NO: 1224366 - RNA, 21 nt, Mycobacterium leprae
gugaacuugaaaccggccgcg

SEQ ID NO: 1224367 - RNA, 23 nt, Mycobacterium leprae
gucggcugaaccgcugugacagc

SEQ ID NO: 1224368 - RNA, 22 nt, Mycobacterium leprae
gucggcuuugcgguugagcucg

SEQ ID NO: 1224369 - RNA, 13 nt, Mycobacterium leprae
gucggugccgcca

SEQ ID NO: 1224370 - RNA, 19 nt, Mycobacterium leprae
gugacgcgggcgccgcagu

SEQ ID NO: 1224371 - RNA, 20 nt, Mycobacterium leprae
gugacguguuggucgccagu

SEQ ID NO: 1224372 - RNA, 16 nt, Mycobacterium leprae
gugacucaacauaaca

SEQ ID NO: 1224373 - RNA, 17 nt, Mycobacterium leprae
gugacgacauacucgac

SEQ ID NO: 1224374 - RNA, 14 nt, Mycobacterium leprae
gugauucagcgcug

SEQ ID NO: 1224375 - RNA, 16 nt, Mycobacterium leprae
gugauucagcgcugau

SEQ ID NO: 1224376 - RNA, 22 nt, Mycobacterium leprae
gugaggugugaccgugcagcug

SEQ ID NO: 1224377 - RNA, 15 nt, Mycobacterium leprae
gugagguguugccga

SEQ ID NO: 1224378 - RNA, 18 nt, Mycobacterium leprae
gugauaaauucuuuugca

SEQ ID NO: 1224379 - RNA, 23 nt, Mycobacterium leprae
gugaucguaggucgcccggugac

SEQ ID NO: 1224380 - RNA, 20 nt, Mycobacterium leprae
gugcgcagcaauugacgccg

SEQ ID NO: 1224381 - RNA, 17 nt, Mycobacterium leprae
gugcguauucggcguca

SEQ ID NO: 1224382 - RNA, 19 nt, Mycobacterium leprae
gugcgcguauuucgagcgu

SEQ ID NO: 1224383 - RNA, 19 nt, Mycobacterium leprae
gugcgcuauacuugcugca

SEQ ID NO: 1224384 - RNA, 14 nt, Mycobacterium leprae
guaagauacugcaa

SEQ ID NO: 1224385 - RNA, 20 nt, Mycobacterium leprae
guaagauuccaaugucccac

SEQ ID NO: 1224386 - RNA, 18 nt, Mycobacterium leprae
guaaugcaggugaccggc

SEQ ID NO: 1224387 - RNA, 19 nt, Mycobacterium leprae
guacaaggcuucgccgagc

SEQ ID NO: 1224388 - RNA, 18 nt, Mycobacterium leprae
guacaacgggaucgacaa

SEQ ID NO: 1224389 - RNA, 22 nt, Mycobacterium leprae
guacaccaagaacuucaagcuc

SEQ ID NO: 1224390 - RNA, 22 nt, Mycobacterium leprae
guacaccauggugcggcgccgc

SEQ ID NO: 1224391 - RNA, 19 nt, Mycobacterium leprae
guaccacucacacguucgg

SEQ ID NO: 1224392 - RNA, 19 nt, Mycobacterium leprae
guaaaucucgggcagcugc

SEQ ID NO: 1224393 - RNA, 16 nt, Mycobacterium leprae
gguuugaucugcgucg

SEQ ID NO: 1224394 - RNA, 14 nt, Mycobacterium leprae
gguuuuaucugcaa

SEQ ID NO: 1224395 - RNA, 13 nt, Mycobacterium leprae
gguuggacgaacg

SEQ ID NO: 1224396 - RNA, 14 nt, Mycobacterium leprae
gguuggccaacugu

SEQ ID NO: 1224397 - RNA, 15 nt, Mycobacterium leprae
gguuccgauuggugu

SEQ ID NO: 1224398 - RNA, 19 nt, Mycobacterium leprae
gguucgaagcguucgacgu

SEQ ID NO: 1224399 - RNA, 20 nt, Mycobacterium leprae
gguuacgcgcucgccggggu

SEQ ID NO: 1224400 - RNA, 13 nt, Mycobacterium leprae
gguuacggcuacc

SEQ ID NO: 1224401 - RNA, 19 nt, Mycobacterium leprae
gguuacguccgcggcagcu

SEQ ID NO: 1224402 - RNA, 20 nt, Mycobacterium leprae
gguuaaagucaugccccgcg

SEQ ID NO: 1224403 - RNA, 17 nt, Mycobacterium leprae
gguguuguuuggcaacg

SEQ ID NO: 1224404 - RNA, 20 nt, Mycobacterium leprae
gguguuucacaaccaucgcu

SEQ ID NO: 1224405 - RNA, 21 nt, Mycobacterium leprae
ggugugaccgugcagcugcca

SEQ ID NO: 1224406 - RNA, 23 nt, Mycobacterium leprae
ggugucgagcuucgguuuuggcg

SEQ ID NO: 1224407 - RNA, 15 nt, Mycobacterium leprae
ggugggcgcagacgu

SEQ ID NO: 1224408 - RNA, 21 nt, Mycobacterium leprae
ggugcguaaucgccgguggca

SEQ ID NO: 1224409 - RNA, 23 nt, Mycobacterium leprae
ggugcguugugcggugagagcuu

SEQ ID NO: 1224410 - RNA, 14 nt, Mycobacterium leprae
ggugcgugaggugu

SEQ ID NO: 1224411 - RNA, 19 nt, Mycobacterium leprae
gguggcagccacagcgacg

SEQ ID NO: 1224412 - RNA, 20 nt, Mycobacterium leprae
guacuccagcagcgugguca

SEQ ID NO: 1224413 - RNA, 22 nt, Mycobacterium leprae
guagccuggaagaugacucggc

SEQ ID NO: 1224414 - RNA, 14 nt, Mycobacterium leprae
guagcggcggcggc

SEQ ID NO: 1224415 - RNA, 22 nt, Mycobacterium leprae
guacgaaaugaacgucaucguc

SEQ ID NO: 1224416 - RNA, 17 nt, Mycobacterium leprae
guaccuccagccgcggg

SEQ ID NO: 1224417 - RNA, 20 nt, Mycobacterium leprae
guaccgucuaguggcgcggc

SEQ ID NO: 1224418 - RNA, 19 nt, Mycobacterium leprae
guacuccaccacacgucga

SEQ ID NO: 1224419 - RNA, 14 nt, Mycobacterium leprae
guaccggucaacgc

SEQ ID NO: 1224420 - RNA, 22 nt, Mycobacterium leprae
guaguuacuaacuuaguuuaga

SEQ ID NO: 1224421 - RNA, 17 nt, Mycobacterium leprae
guaguuguuagcgccgc

SEQ ID NO: 1224422 - RNA, 13 nt, Mycobacterium leprae
guaucgaccagcc

SEQ ID NO: 1224423 - RNA, 14 nt, Mycobacterium leprae
guaugugccgccga

SEQ ID NO: 1224424 - RNA, 21 nt, Mycobacterium leprae
gucaaccuugguugccgcggu

SEQ ID NO: 1224425 - RNA, 17 nt, Mycobacterium leprae
gucaaccuuugucgcca

SEQ ID NO: 1224426 - RNA, 20 nt, Mycobacterium leprae
gucaccaagcgcagaugauc

SEQ ID NO: 1224427 - RNA, 19 nt, Mycobacterium leprae
gucacgccggucgaaguga

SEQ ID NO: 1224428 - RNA, 19 nt, Mycobacterium leprae
gucacccuccucgcggcgg

SEQ ID NO: 1224429 - RNA, 20 nt, Mycobacterium leprae
gucacccuccucgcggcggu

SEQ ID NO: 1224430 - RNA, 21 nt, Mycobacterium leprae
gucacccggggugagacaguc

SEQ ID NO: 1224431 - RNA, 19 nt, Mycobacterium leprae
gguaagguuguugacgaug

SEQ ID NO: 1224432 - RNA, 19 nt, Mycobacterium leprae
gguaacuaauccagacauc

SEQ ID NO: 1224433 - RNA, 15 nt, Mycobacterium leprae
gguaaugcugccugc

SEQ ID NO: 1224434 - RNA, 19 nt, Mycobacterium leprae
gguaaugcugccugcguca

SEQ ID NO: 1224435 - RNA, 18 nt, Mycobacterium leprae
gguaaucaguaaucgacg

SEQ ID NO: 1224436 - RNA, 19 nt, Mycobacterium leprae
gguaaacaccuuggugcgg

SEQ ID NO: 1224437 - RNA, 21 nt, Mycobacterium leprae
ggguguugcaccauaccgacg

SEQ ID NO: 1224438 - RNA, 19 nt, Mycobacterium leprae
ggguguucucguaguucgc

SEQ ID NO: 1224439 - RNA, 21 nt, Mycobacterium leprae
ggguguuuugucggugguggg

SEQ ID NO: 1224440 - RNA, 12 nt, Mycobacterium leprae
gggugucgagcu

SEQ ID NO: 1224441 - RNA, 16 nt, Mycobacterium leprae
ggguggcgucaacgua

SEQ ID NO: 1224442 - RNA, 17 nt, Mycobacterium leprae
ggguggggguggggauc

SEQ ID NO: 1224443 - RNA, 12 nt, Mycobacterium leprae
gggugcguaauc

SEQ ID NO: 1224444 - RNA, 15 nt, Mycobacterium leprae
gggugcuacacggcc

SEQ ID NO: 1224445 - RNA, 14 nt, Mycobacterium leprae
gguauuggacccga

SEQ ID NO: 1224446 - RNA, 17 nt, Mycobacterium leprae
ggucaagugucgggugg

SEQ ID NO: 1224447 - RNA, 16 nt, Mycobacterium leprae
ggucaccaaccggccg

SEQ ID NO: 1224448 - RNA, 21 nt, Mycobacterium leprae
ggucaacauugccaucgaacg

SEQ ID NO: 1224449 - RNA, 13 nt, Mycobacterium leprae
ggucaacgggacu

SEQ ID NO: 1224450 - RNA, 16 nt, Mycobacterium leprae
gguagugaguacacca

SEQ ID NO: 1224451 - RNA, 20 nt, Mycobacterium leprae
gguagcugcaucggcaggcu

SEQ ID NO: 1224452 - RNA, 19 nt, Mycobacterium leprae
gguacucggaauggcggca

SEQ ID NO: 1224453 - RNA, 14 nt, Mycobacterium leprae
gguacgugguggcu

SEQ ID NO: 1224454 - RNA, 17 nt, Mycobacterium leprae
gguaccgucuaguggcg

SEQ ID NO: 1224455 - RNA, 15 nt, Mycobacterium leprae
ggugacggucgugcu

SEQ ID NO: 1224456 - RNA, 19 nt, Mycobacterium leprae
ggugaccgggccggccgcg

SEQ ID NO: 1224457 - RNA, 15 nt, Mycobacterium leprae
ggugaagccggcgca

SEQ ID NO: 1224458 - RNA, 18 nt, Mycobacterium leprae
ggucuacauguugaugau

SEQ ID NO: 1224459 - RNA, 17 nt, Mycobacterium leprae
ggucuggcggguggugu

SEQ ID NO: 1224460 - RNA, 17 nt, Mycobacterium leprae
ggucguuagcgccgaga

SEQ ID NO: 1224461 - RNA, 22 nt, Mycobacterium leprae
ggucgauagccgugaccgacag

SEQ ID NO: 1224462 - RNA, 18 nt, Mycobacterium leprae
ggucgcugcuacccacug

SEQ ID NO: 1224463 - RNA, 21 nt, Mycobacterium leprae
gguccaauucacgaacaacag

SEQ ID NO: 1224464 - RNA, 20 nt, Mycobacterium leprae
ggucgaacaaggguacgcca

SEQ ID NO: 1224465 - RNA, 16 nt, Mycobacterium leprae
gguccuuaugcgguca

SEQ ID NO: 1224466 - RNA, 23 nt, Mycobacterium leprae
gguccgcguuccguugauggugu

SEQ ID NO: 1224467 - RNA, 17 nt, Mycobacterium leprae
ggucagcaugucggcca

SEQ ID NO: 1224468 - RNA, 22 nt, Mycobacterium leprae
ggcaacugaagauuuggcgagu

SEQ ID NO: 1224469 - RNA, 16 nt, Mycobacterium leprae
ggcaccuuaccgucca

SEQ ID NO: 1224470 - RNA, 23 nt, Mycobacterium leprae
ggcacggguuggguuauacgcuc

SEQ ID NO: 1224471 - RNA, 20 nt, Mycobacterium leprae
ggcacccguugaagccguug

SEQ ID NO: 1224472 - RNA, 17 nt, Mycobacterium leprae
ggcacaucgaaccgacg

SEQ ID NO: 1224473 - RNA, 17 nt, Mycobacterium leprae
ggcacagugccugacca

SEQ ID NO: 1224474 - RNA, 20 nt, Mycobacterium leprae
ggcacccacgcugcgcggcu

SEQ ID NO: 1224475 - RNA, 18 nt, Mycobacterium leprae
ggcacuugaaauuugcuc

SEQ ID NO: 1224476 - RNA, 21 nt, Mycobacterium leprae
ggcacugagaguacugaccga

SEQ ID NO: 1224477 - RNA, 22 nt, Mycobacterium leprae
ggcagucuuucagugccgaccu

SEQ ID NO: 1224478 - RNA, 19 nt, Mycobacterium leprae
ggcagucggcaagaccgag

SEQ ID NO: 1224479 - RNA, 23 nt, Mycobacterium leprae
ggcauccagaaaguacugaccgg

SEQ ID NO: 1224480 - RNA, 19 nt, Mycobacterium leprae
ggccaaagagcgggcggca

SEQ ID NO: 1224481 - RNA, 20 nt, Mycobacterium leprae
ggccaacacgucacgacuca

SEQ ID NO: 1224482 - RNA, 14 nt, Mycobacterium leprae
ggccaaccacagca

SEQ ID NO: 1224483 - RNA, 14 nt, Mycobacterium leprae
ggccaccggugaug

SEQ ID NO: 1224484 - RNA, 13 nt, Mycobacterium leprae
ggccaccgccacc

SEQ ID NO: 1224485 - RNA, 12 nt, Mycobacterium leprae
ggccagcacuug

SEQ ID NO: 1224486 - RNA, 16 nt, Mycobacterium leprae
ggccacuacgacguug

SEQ ID NO: 1224487 - RNA, 19 nt, Mycobacterium leprae
ggcccgaggagaggcaggg

SEQ ID NO: 1224488 - RNA, 20 nt, Mycobacterium leprae
ggcccuguuccucgcgggcg

SEQ ID NO: 1224489 - RNA, 21 nt, Mycobacterium leprae
ggccgaacgugagcgacagcu

SEQ ID NO: 1224490 - RNA, 16 nt, Mycobacterium leprae
ggccuguucauggugu

SEQ ID NO: 1224491 - RNA, 14 nt, Mycobacterium leprae
ggcgaaacguucau

SEQ ID NO: 1224492 - RNA, 21 nt, Mycobacterium leprae
ggccuccaggugaagccggcg

SEQ ID NO: 1224493 - RNA, 20 nt, Mycobacterium leprae
ggccucaccugcgacagccg

SEQ ID NO: 1224494 - RNA, 14 nt, Mycobacterium leprae
ggccgucggcggca

SEQ ID NO: 1224495 - RNA, 15 nt, Mycobacterium leprae
ggcucuuaggugccu

SEQ ID NO: 1224496 - RNA, 19 nt, Mycobacterium leprae
ggcucugucgucgaaacca

SEQ ID NO: 1224497 - RNA, 19 nt, Mycobacterium leprae
ggcugcaccggcucgucga

SEQ ID NO: 1224498 - RNA, 15 nt, Mycobacterium leprae
ggcugcccguaugca

SEQ ID NO: 1224499 - RNA, 22 nt, Mycobacterium leprae
ggcugcgauggcauugaucgcu

SEQ ID NO: 1224500 - RNA, 22 nt, Mycobacterium leprae
ggcugcuuguagcguucguaga

SEQ ID NO: 1224501 - RNA, 20 nt, Mycobacterium leprae
ggcuggccaucgcaccgauc

SEQ ID NO: 1224502 - RNA, 15 nt, Mycobacterium leprae
ggcgucguuuuggcg

SEQ ID NO: 1224503 - RNA, 18 nt, Mycobacterium leprae
ggcggugaccgaacugug

SEQ ID NO: 1224504 - RNA, 15 nt, Mycobacterium leprae
ggcucaagucgacga

SEQ ID NO: 1224505 - RNA, 13 nt, Mycobacterium leprae
ggcucaccgacug

SEQ ID NO: 1224506 - RNA, 20 nt, Mycobacterium leprae
ggcuaugacaagaccaccgu

SEQ ID NO: 1224507 - RNA, 22 nt, Mycobacterium leprae
ggcuacucugcguaggccaggu

SEQ ID NO: 1224508 - RNA, 20 nt, Mycobacterium leprae
ggcguuccgauguacuccga

SEQ ID NO: 1224509 - RNA, 13 nt, Mycobacterium leprae
ggcguuccggccu

SEQ ID NO: 1224510 - RNA, 16 nt, Mycobacterium leprae
ggcuugucacgccggu

SEQ ID NO: 1224511 - RNA, 14 nt, Mycobacterium leprae
gggaaggccaagcg

SEQ ID NO: 1224512 - RNA, 22 nt, Mycobacterium leprae
ggcugguuaacuuaaucgccgg

SEQ ID NO: 1224513 - RNA, 16 nt, Mycobacterium leprae
ggcugguggccgaggu

SEQ ID NO: 1224514 - RNA, 17 nt, Mycobacterium leprae
gggacgugaugcagcau

SEQ ID NO: 1224515 - RNA, 21 nt, Mycobacterium leprae
gggacgccggcggccaccgcg

SEQ ID NO: 1224516 - RNA, 14 nt, Mycobacterium leprae
gggcagccuggacg

SEQ ID NO: 1224517 - RNA, 18 nt, Mycobacterium leprae
gggccguuauccacagca

SEQ ID NO: 1224518 - RNA, 19 nt, Mycobacterium leprae
ggcgcaacagucagccgcg

SEQ ID NO: 1224519 - RNA, 22 nt, Mycobacterium leprae
ggcgcagaccucuuccgccgcu

SEQ ID NO: 1224520 - RNA, 23 nt, Mycobacterium leprae
ggcgccauauccucgaccaccag

SEQ ID NO: 1224521 - RNA, 22 nt, Mycobacterium leprae
ggcggguuucccagagcucccg

SEQ ID NO: 1224522 - RNA, 17 nt, Mycobacterium leprae
ggcggccggcaagaagu

SEQ ID NO: 1224523 - RNA, 14 nt, Mycobacterium leprae
ggcggagucaccgc

SEQ ID NO: 1224524 - RNA, 22 nt, Mycobacterium leprae
ggcggagucaccgcagccggag

SEQ ID NO: 1224525 - RNA, 13 nt, Mycobacterium leprae
ggcgcguaggccu

SEQ ID NO: 1224526 - RNA, 16 nt, Mycobacterium leprae
ggcgcggucgucaagu

SEQ ID NO: 1224527 - RNA, 16 nt, Mycobacterium leprae
gcgacaguaucgacca

SEQ ID NO: 1224528 - RNA, 23 nt, Mycobacterium leprae
gcgacaguaucgaccagccacgc

SEQ ID NO: 1224529 - RNA, 21 nt, Mycobacterium leprae
gcgacauacaaucgcggcaca

SEQ ID NO: 1224530 - RNA, 19 nt, Mycobacterium leprae
gcgacacagccggccggca

SEQ ID NO: 1224531 - RNA, 21 nt, Mycobacterium leprae
gcgaguaucgaaucggugauc

SEQ ID NO: 1224532 - RNA, 22 nt, Mycobacterium leprae
gcgauaccggcgaaucggucug

SEQ ID NO: 1224533 - RNA, 14 nt, Mycobacterium leprae
gcgagugcugacgc

SEQ ID NO: 1224534 - RNA, 15 nt, Mycobacterium leprae
gcgaguuugcgccga

SEQ ID NO: 1224535 - RNA, 21 nt, Mycobacterium leprae
gcgaguucguuccuggcuggc

SEQ ID NO: 1224536 - RNA, 17 nt, Mycobacterium leprae
gcgacuguuguggucaa

SEQ ID NO: 1224537 - RNA, 22 nt, Mycobacterium leprae
gcgacugugcuaaccgggccaa

SEQ ID NO: 1224538 - RNA, 14 nt, Mycobacterium leprae
gcgaacaacaaaaa

SEQ ID NO: 1224539 - RNA, 17 nt, Mycobacterium leprae
gcgaacuaguguucggc

SEQ ID NO: 1224540 - RNA, 14 nt, Mycobacterium leprae
gccuucagcacagc

SEQ ID NO: 1224541 - RNA, 17 nt, Mycobacterium leprae
gccuggcgucaucgaca

SEQ ID NO: 1224542 - RNA, 20 nt, Mycobacterium leprae
gccugucgauuaccacugcc

SEQ ID NO: 1224543 - RNA, 18 nt, Mycobacterium leprae
gccuggcccauccgggcc

SEQ ID NO: 1224544 - RNA, 12 nt, Mycobacterium leprae
gccugcuggccg

SEQ ID NO: 1224545 - RNA, 13 nt, Mycobacterium leprae
gccgugaccgaca

SEQ ID NO: 1224546 - RNA, 18 nt, Mycobacterium leprae
gccgugaccgacagcucg

SEQ ID NO: 1224547 - RNA, 22 nt, Mycobacterium leprae
gccguccacugcagggcgagcu

SEQ ID NO: 1224548 - RNA, 18 nt, Mycobacterium leprae
gccuaugcggccagccag

SEQ ID NO: 1224549 - RNA, 20 nt, Mycobacterium leprae
gccuaugcggguucgguggu

SEQ ID NO: 1224550 - RNA, 20 nt, Mycobacterium leprae
gccuagcaacgucacgucga

SEQ ID NO: 1224551 - RNA, 14 nt, Mycobacterium leprae
gccguuguuggagc

SEQ ID NO: 1224552 - RNA, 21 nt, Mycobacterium leprae
gccucaaugcagacacgccgc

SEQ ID NO: 1224553 - RNA, 13 nt, Mycobacterium leprae
gccggucgaucgc

SEQ ID NO: 1224554 - RNA, 19 nt, Mycobacterium leprae
gccggggaaccuggaccga

SEQ ID NO: 1224555 - RNA, 16 nt, Mycobacterium leprae
gccggggccaagcugu

SEQ ID NO: 1224556 - RNA, 14 nt, Mycobacterium leprae
gccggggcucgcgu

SEQ ID NO: 1224557 - RNA, 19 nt, Mycobacterium leprae
gcgcuguuguuggucggcg

SEQ ID NO: 1224558 - RNA, 17 nt, Mycobacterium leprae
gcgcugauaucggcgau

SEQ ID NO: 1224559 - RNA, 16 nt, Mycobacterium leprae
gcgcugaucgggcugc

SEQ ID NO: 1224560 - RNA, 15 nt, Mycobacterium leprae
gcgcucgucgaugcg

SEQ ID NO: 1224561 - RNA, 19 nt, Mycobacterium leprae
gcgcucgucgaugcgcaga

SEQ ID NO: 1224562 - RNA, 14 nt, Mycobacterium leprae
gcgcgugaucuccg

SEQ ID NO: 1224563 - RNA, 14 nt, Mycobacterium leprae
gcgcggguccgcgu

SEQ ID NO: 1224564 - RNA, 23 nt, Mycobacterium leprae
gcgcgcuaguucgacaccggcca

SEQ ID NO: 1224565 - RNA, 19 nt, Mycobacterium leprae
gcgcgccugcgcuuucagu

SEQ ID NO: 1224566 - RNA, 16 nt, Mycobacterium leprae
gcgcgccgcccagcag

SEQ ID NO: 1224567 - RNA, 14 nt, Mycobacterium leprae
gcgccguucgucga

SEQ ID NO: 1224568 - RNA, 14 nt, Mycobacterium leprae
gcgccuguuuuugg

SEQ ID NO: 1224569 - RNA, 14 nt, Mycobacterium leprae
gcgcagacgucguc

SEQ ID NO: 1224570 - RNA, 22 nt, Mycobacterium leprae
gcgcagacgucgucgucaucgu

SEQ ID NO: 1224571 - RNA, 15 nt, Mycobacterium leprae
gcgcagacuagucga

SEQ ID NO: 1224572 - RNA, 16 nt, Mycobacterium leprae
gcgcacguaagcaugu

SEQ ID NO: 1224573 - RNA, 14 nt, Mycobacterium leprae
gcgcagcaaucaau

SEQ ID NO: 1224574 - RNA, 17 nt, Mycobacterium leprae
gcgcacgcugauggcac

SEQ ID NO: 1224575 - RNA, 13 nt, Mycobacterium leprae
gcgcaccucgcug

SEQ ID NO: 1224576 - RNA, 20 nt, Mycobacterium leprae
gcgcaccugccacggccccg

SEQ ID NO: 1224577 - RNA, 19 nt, Mycobacterium leprae
gcgauaucgaugcaggcgu

SEQ ID NO: 1224578 - RNA, 15 nt, Mycobacterium leprae
gcgauauccgccggc

SEQ ID NO: 1224579 - RNA, 15 nt, Mycobacterium leprae
gcgcacccauccgau

SEQ ID NO: 1224580 - RNA, 21 nt, Mycobacterium leprae
gcgcaucaucgcccaccgcaa

SEQ ID NO: 1224581 - RNA, 17 nt, Mycobacterium leprae
gcgcaucagccaacacc

SEQ ID NO: 1224582 - RNA, 15 nt, Mycobacterium leprae
gcgccgaagccgggc

SEQ ID NO: 1224583 - RNA, 19 nt, Mycobacterium leprae
gcgccaggacucgguuggc

SEQ ID NO: 1224584 - RNA, 23 nt, Mycobacterium leprae
gcgccagcgacacagccggccgg

SEQ ID NO: 1224585 - RNA, 17 nt, Mycobacterium leprae
gcgccacuguagagcuu

SEQ ID NO: 1224586 - RNA, 15 nt, Mycobacterium leprae
gcuaaucgcgggcaa

SEQ ID NO: 1224587 - RNA, 18 nt, Mycobacterium leprae
gcuacacugcagcgguca

SEQ ID NO: 1224588 - RNA, 13 nt, Mycobacterium leprae
gcuacaucgacaa

SEQ ID NO: 1224589 - RNA, 21 nt, Mycobacterium leprae
gcuaccaguguccgucgacgu

SEQ ID NO: 1224590 - RNA, 23 nt, Mycobacterium leprae
gcuccauuugucaucggcgugcc

SEQ ID NO: 1224591 - RNA, 20 nt, Mycobacterium leprae
gcucccgggucgagcagcca

SEQ ID NO: 1224592 - RNA, 16 nt, Mycobacterium leprae
gcucgacgcggagugu

SEQ ID NO: 1224593 - RNA, 18 nt, Mycobacterium leprae
gcucgacgguuaccggaa

SEQ ID NO: 1224594 - RNA, 19 nt, Mycobacterium leprae
gcuccguggcccaaaccgu

SEQ ID NO: 1224595 - RNA, 18 nt, Mycobacterium leprae
gcucgcacacaacgccga

SEQ ID NO: 1224596 - RNA, 15 nt, Mycobacterium leprae
gcucgcaauaugauc

SEQ ID NO: 1224597 - RNA, 20 nt, Mycobacterium leprae
gcucgaugggguuguggacc

SEQ ID NO: 1224598 - RNA, 13 nt, Mycobacterium leprae
gcucgaugccucg

SEQ ID NO: 1224599 - RNA, 20 nt, Mycobacterium leprae
gcucgaggaagcgcagcucg

SEQ ID NO: 1224600 - RNA, 14 nt, Mycobacterium leprae
gcucgccgcccgcu

SEQ ID NO: 1224601 - RNA, 19 nt, Mycobacterium leprae
gcucgccgcccgcuggauc

SEQ ID NO: 1224602 - RNA, 14 nt, Mycobacterium leprae
gcucgccggggugu

SEQ ID NO: 1224603 - RNA, 21 nt, Mycobacterium leprae
gcucgccggggugucgagcuu

SEQ ID NO: 1224604 - RNA, 20 nt, Mycobacterium leprae
gcucgcagcgguacccgcca

SEQ ID NO: 1224605 - RNA, 12 nt, Mycobacterium leprae
gcucggacaaga

SEQ ID NO: 1224606 - RNA, 14 nt, Mycobacterium leprae
gcucgcggugggcu

SEQ ID NO: 1224607 - RNA, 21 nt, Mycobacterium leprae
gcugacaaaaccgcggagcuu

SEQ ID NO: 1224608 - RNA, 13 nt, Mycobacterium leprae
gcugacacuguca

SEQ ID NO: 1224609 - RNA, 13 nt, Mycobacterium leprae
gcugaaccgcugu

SEQ ID NO: 1224610 - RNA, 18 nt, Mycobacterium leprae
gcugaaccgcgucggcgu

SEQ ID NO: 1224611 - RNA, 13 nt, Mycobacterium leprae
gcugaugcgguca

SEQ ID NO: 1224612 - RNA, 18 nt, Mycobacterium leprae
gcugaugucuuggcugac

SEQ ID NO: 1224613 - RNA, 18 nt, Mycobacterium leprae
gcugcagcauaacccgau

SEQ ID NO: 1224614 - RNA, 12 nt, Mycobacterium leprae
gcugcaccgagc

SEQ ID NO: 1224615 - RNA, 16 nt, Mycobacterium leprae
gcugcacccgucgcug

SEQ ID NO: 1224616 - RNA, 17 nt, Mycobacterium leprae
gcugcacccgucgcuga

SEQ ID NO: 1224617 - RNA, 18 nt, Mycobacterium leprae
gcugcacccgucgcugau

SEQ ID NO: 1224618 - RNA, 15 nt, Mycobacterium leprae
gcugauaucggcgau

SEQ ID NO: 1224619 - RNA, 16 nt, Mycobacterium leprae
gcugauaucggcgaug

SEQ ID NO: 1224620 - RNA, 14 nt, Mycobacterium leprae
gcugauggccgcca

SEQ ID NO: 1224621 - RNA, 17 nt, Mycobacterium leprae
gcugacugcgauccggc

SEQ ID NO: 1224622 - RNA, 22 nt, Mycobacterium leprae
gcugaggguggcgccggcgugc

SEQ ID NO: 1224623 - RNA, 11 nt, Mycobacterium leprae
gcugccgucga

SEQ ID NO: 1224624 - RNA, 13 nt, Mycobacterium leprae
gcugccgcaguaa

SEQ ID NO: 1224625 - RNA, 19 nt, Mycobacterium leprae
gcugccagcuucgcagaca

SEQ ID NO: 1224626 - RNA, 14 nt, Mycobacterium leprae
gcugcgugccuggu

SEQ ID NO: 1224627 - RNA, 23 nt, Mycobacterium leprae
gcugcgugccugguugggcaucg

SEQ ID NO: 1224628 - RNA, 23 nt, Mycobacterium leprae
gcugcgugaagcagguacggauc

SEQ ID NO: 1224629 - RNA, 12 nt, Mycobacterium leprae
gcugcggcgccc

SEQ ID NO: 1224630 - RNA, 15 nt, Mycobacterium leprae
gcugcucaaccaugc

SEQ ID NO: 1224631 - RNA, 17 nt, Mycobacterium leprae
gcugcuacgugacugcg

SEQ ID NO: 1224632 - RNA, 18 nt, Mycobacterium leprae
gcugcuacccacuggugg

SEQ ID NO: 1224633 - RNA, 21 nt, Mycobacterium leprae
gcuuugccgcaguggacacga

SEQ ID NO: 1224634 - RNA, 23 nt, Mycobacterium leprae
gcuuugggaucuuuugaccagca

SEQ ID NO: 1224635 - RNA, 18 nt, Mycobacterium leprae
ggaacagcguucgaccca

SEQ ID NO: 1224636 - RNA, 19 nt, Mycobacterium leprae
ggaagcccucccagccauc

SEQ ID NO: 1224637 - RNA, 16 nt, Mycobacterium leprae
ggaauuuacuggccgg

SEQ ID NO: 1224638 - RNA, 22 nt, Mycobacterium leprae
ggaauuuauuguccacgucggu

SEQ ID NO: 1224639 - RNA, 14 nt, Mycobacterium leprae
ggacaggccguagc

SEQ ID NO: 1224640 - RNA, 18 nt, Mycobacterium leprae
ggaccggugcugcagcca

SEQ ID NO: 1224641 - RNA, 17 nt, Mycobacterium leprae
ggacuaccgagauggcg

SEQ ID NO: 1224642 - RNA, 18 nt, Mycobacterium leprae
ggacuaccgagauggcgu

SEQ ID NO: 1224643 - RNA, 20 nt, Mycobacterium leprae
gcuucagagugcaccggugu

SEQ ID NO: 1224644 - RNA, 16 nt, Mycobacterium leprae
gcuuacggacugacac

SEQ ID NO: 1224645 - RNA, 14 nt, Mycobacterium leprae
gcuuagcccgcugc

SEQ ID NO: 1224646 - RNA, 20 nt, Mycobacterium leprae
gcuuccucgacagucaacau

SEQ ID NO: 1224647 - RNA, 23 nt, Mycobacterium leprae
gcugguucuuggcuugcugucgu

SEQ ID NO: 1224648 - RNA, 13 nt, Mycobacterium leprae
gcuguucggugac

SEQ ID NO: 1224649 - RNA, 19 nt, Mycobacterium leprae
gcuguccuugccggcgccg

SEQ ID NO: 1224650 - RNA, 23 nt, Mycobacterium leprae
gcuggcugagggccggucaacaa

SEQ ID NO: 1224651 - RNA, 13 nt, Mycobacterium leprae
gcugcugcuggcc

SEQ ID NO: 1224652 - RNA, 14 nt, Mycobacterium leprae
gcugcugcagaccg

SEQ ID NO: 1224653 - RNA, 12 nt, Mycobacterium leprae
gcugggcagccg

SEQ ID NO: 1224654 - RNA, 19 nt, Mycobacterium leprae
gcguaaucgccgguggcaa

SEQ ID NO: 1224655 - RNA, 16 nt, Mycobacterium leprae
gcggugcugagucggc

SEQ ID NO: 1224656 - RNA, 15 nt, Mycobacterium leprae
gcguaguuccaccgu

SEQ ID NO: 1224657 - RNA, 23 nt, Mycobacterium leprae
gcguaggcgcacgcugauggcac

SEQ ID NO: 1224658 - RNA, 13 nt, Mycobacterium leprae
gcuaaagugcugc

SEQ ID NO: 1224659 - RNA, 15 nt, Mycobacterium leprae
gcuaacuucccgacg

SEQ ID NO: 1224660 - RNA, 22 nt, Mycobacterium leprae
gcuaaggugcguugugcgguga

SEQ ID NO: 1224661 - RNA, 18 nt, Mycobacterium leprae
gcguugcgauugaugcac

SEQ ID NO: 1224662 - RNA, 15 nt, Mycobacterium leprae
gcguuggcucgacgu

SEQ ID NO: 1224663 - RNA, 15 nt, Mycobacterium leprae
gcguuuagucaccgc

SEQ ID NO: 1224664 - RNA, 16 nt, Mycobacterium leprae
gcguuguugauggugu

SEQ ID NO: 1224665 - RNA, 18 nt, Mycobacterium leprae
gcguuguugauggugucg

SEQ ID NO: 1224666 - RNA, 17 nt, Mycobacterium leprae
gcgugcggauauugauc

SEQ ID NO: 1224667 - RNA, 23 nt, Mycobacterium leprae
gcgugcggauauugaucguugcu

SEQ ID NO: 1224668 - RNA, 23 nt, Mycobacterium leprae
gcguggauggcuuccacaucgau

SEQ ID NO: 1224669 - RNA, 16 nt, Mycobacterium leprae
gcgucgcccucgccgg

SEQ ID NO: 1224670 - RNA, 23 nt, Mycobacterium leprae
gcgucggugacucugaccgacag

SEQ ID NO: 1224671 - RNA, 23 nt, Mycobacterium leprae
gcgugagccggucggcggcgccg

SEQ ID NO: 1224672 - RNA, 22 nt, Mycobacterium leprae
gcgggcgaugccaucgggccag

SEQ ID NO: 1224673 - RNA, 15 nt, Mycobacterium leprae
gcggcggccuuggca

SEQ ID NO: 1224674 - RNA, 14 nt, Mycobacterium leprae
gcggcggccgugau

SEQ ID NO: 1224675 - RNA, 15 nt, Mycobacterium leprae
gcggcaucgucggca

SEQ ID NO: 1224676 - RNA, 20 nt, Mycobacterium leprae
gcggccacauugaccacgcc

SEQ ID NO: 1224677 - RNA, 15 nt, Mycobacterium leprae
gcggcauucccaacc

SEQ ID NO: 1224678 - RNA, 19 nt, Mycobacterium leprae
gcggcauucccaaccgcga

SEQ ID NO: 1224679 - RNA, 17 nt, Mycobacterium leprae
gcggcaguccgcgucac

SEQ ID NO: 1224680 - RNA, 21 nt, Mycobacterium leprae
gcggccgugauuuucauuggc

SEQ ID NO: 1224681 - RNA, 21 nt, Mycobacterium leprae
uuccgagccgacaaucgagca

SEQ ID NO: 1224682 - RNA, 19 nt, Mycobacterium leprae
uuccaguggcugcaccggc

SEQ ID NO: 1224683 - RNA, 13 nt, Mycobacterium leprae
uuccaugaugguu

SEQ ID NO: 1224684 - RNA, 18 nt, Mycobacterium leprae
uucagagcugcaggucag

SEQ ID NO: 1224685 - RNA, 13 nt, Mycobacterium leprae
uucggagaucgac

SEQ ID NO: 1224686 - RNA, 17 nt, Mycobacterium leprae
uucggauucggaucguu

SEQ ID NO: 1224687 - RNA, 21 nt, Mycobacterium leprae
aaucagcaucgacagcaccca

SEQ ID NO: 1224688 - RNA, 18 nt, Mycobacterium leprae
aaucagcccaacgcugcc

SEQ ID NO: 1224689 - RNA, 16 nt, Mycobacterium leprae
aaucagaugaccggcu

SEQ ID NO: 1224690 - RNA, 17 nt, Mycobacterium leprae
uucuccguucacagugc

SEQ ID NO: 1224691 - RNA, 14 nt, Mycobacterium leprae
uucguuaacagcgg

SEQ ID NO: 1224692 - RNA, 23 nt, Mycobacterium leprae
uucggcuacugcgacagcagcca

SEQ ID NO: 1224693 - RNA, 21 nt, Mycobacterium leprae
uuagcaacgacgccacagcgg

SEQ ID NO: 1224694 - RNA, 16 nt, Mycobacterium leprae
uuagcccgccgcggcg

SEQ ID NO: 1224695 - RNA, 12 nt, Mycobacterium leprae
uguugaucgacg

SEQ ID NO: 1224696 - RNA, 17 nt, Mycobacterium leprae
ugugggcagugccuggc

SEQ ID NO: 1224697 - RNA, 23 nt, Mycobacterium leprae
uguggccguggauaccacugacg

SEQ ID NO: 1224698 - RNA, 19 nt, Mycobacterium leprae
uguggguguuuugucggug

SEQ ID NO: 1224699 - RNA, 13 nt, Mycobacterium leprae
ugugccgccgacg

SEQ ID NO: 1224700 - RNA, 20 nt, Mycobacterium leprae
ugugcucccugaacuggugg

SEQ ID NO: 1224701 - RNA, 20 nt, Mycobacterium leprae
ugucaagcacugcaguaacc

SEQ ID NO: 1224702 - RNA, 15 nt, Mycobacterium leprae
ugucugggcuggccc

SEQ ID NO: 1224703 - RNA, 12 nt, Mycobacterium leprae
ugugcagcagcu

SEQ ID NO: 1224704 - RNA, 15 nt, Mycobacterium leprae
ugugaacgacaccac

SEQ ID NO: 1224705 - RNA, 15 nt, Mycobacterium leprae
ugugaggucauuaac

SEQ ID NO: 1224706 - RNA, 18 nt, Mycobacterium leprae
aauguccuugagcuaaca

SEQ ID NO: 1224707 - RNA, 14 nt, Mycobacterium leprae
aaucgguguugucc

SEQ ID NO: 1224708 - RNA, 16 nt, Mycobacterium leprae
aaucguaaaugccgaa

SEQ ID NO: 1224709 - RNA, 12 nt, Mycobacterium leprae
aaucguccgcgu

SEQ ID NO: 1224710 - RNA, 18 nt, Mycobacterium leprae
aaucgguggcagccggcu

SEQ ID NO: 1224711 - RNA, 21 nt, Mycobacterium leprae
aaucgccuaaagcggcaagca

SEQ ID NO: 1224712 - RNA, 14 nt, Mycobacterium leprae
aaucgcggcacaug

SEQ ID NO: 1224713 - RNA, 20 nt, Mycobacterium leprae
uuugcugcaaugccggacug

SEQ ID NO: 1224714 - RNA, 17 nt, Mycobacterium leprae
uugugcggaccguggug

SEQ ID NO: 1224715 - RNA, 23 nt, Mycobacterium leprae
aaucgauguuguagguugaugag

SEQ ID NO: 1224716 - RNA, 13 nt, Mycobacterium leprae
uuguccgucgcag

SEQ ID NO: 1224717 - RNA, 15 nt, Mycobacterium leprae
uugucagcggacaaa

SEQ ID NO: 1224718 - RNA, 13 nt, Mycobacterium leprae
uugucaucggcgu

SEQ ID NO: 1224719 - RNA, 12 nt, Mycobacterium leprae
uuguaaucagcc

SEQ ID NO: 1224720 - RNA, 13 nt, Mycobacterium leprae
uugucacgccggu

SEQ ID NO: 1224721 - RNA, 12 nt, Mycobacterium leprae
aauccagccgag

SEQ ID NO: 1224722 - RNA, 19 nt, Mycobacterium leprae
aauccccgauccagacagc

SEQ ID NO: 1224723 - RNA, 19 nt, Mycobacterium leprae
uuggguuugggugguggug

SEQ ID NO: 1224724 - RNA, 13 nt, Mycobacterium leprae
uugggugguggug

SEQ ID NO: 1224725 - RNA, 18 nt, Mycobacterium leprae
uuggucuacauguugaug

SEQ ID NO: 1224726 - RNA, 24 nt, Mycobacterium leprae
aauccgccucgguguucgacaugg

SEQ ID NO: 1224727 - RNA, 13 nt, Mycobacterium leprae
aaucaucgcugcc

SEQ ID NO: 1224728 - RNA, 19 nt, Mycobacterium leprae
uugcccccgcuaccgcggg

SEQ ID NO: 1224729 - RNA, 16 nt, Mycobacterium leprae
uugccaucgacgccgc

SEQ ID NO: 1224730 - RNA, 18 nt, Mycobacterium leprae
uugcccaaugcagcaacg

SEQ ID NO: 1224731 - RNA, 17 nt, Mycobacterium leprae
uugccguaguacccggc

SEQ ID NO: 1224732 - RNA, 15 nt, Mycobacterium leprae
uugcaggcuucguca

SEQ ID NO: 1224733 - RNA, 15 nt, Mycobacterium leprae
uugcacuucgacggu

SEQ ID NO: 1224734 - RNA, 18 nt, Mycobacterium leprae
uucuggcacccacgcugc

SEQ ID NO: 1224735 - RNA, 15 nt, Mycobacterium leprae
uucuguuauuucugg

SEQ ID NO: 1224736 - RNA, 22 nt, Mycobacterium leprae
uugauggugucgaugaugcgcu

SEQ ID NO: 1224737 - RNA, 18 nt, Mycobacterium leprae
aauauacuugacugccga

SEQ ID NO: 1224738 - RNA, 15 nt, Mycobacterium leprae
ugcugauggccggcc

SEQ ID NO: 1224739 - RNA, 19 nt, Mycobacterium leprae
ugcugaucaccggccagcc

SEQ ID NO: 1224740 - RNA, 23 nt, Mycobacterium leprae
ugcuuuggggguugcacugauuc

SEQ ID NO: 1224741 - RNA, 14 nt, Mycobacterium leprae
uggaacaaccggua

SEQ ID NO: 1224742 - RNA, 20 nt, Mycobacterium leprae
ugcuugggcauuuucggcua

SEQ ID NO: 1224743 - RNA, 17 nt, Mycobacterium leprae
ugcuugcuggcugaggg

SEQ ID NO: 1224744 - RNA, 23 nt, Mycobacterium leprae
ugcuuaccucagugucagcagca

SEQ ID NO: 1224745 - RNA, 18 nt, Mycobacterium leprae
ugcuuagcauagcggccg

SEQ ID NO: 1224746 - RNA, 16 nt, Mycobacterium leprae
ugcugcggcgcccuag

SEQ ID NO: 1224747 - RNA, 16 nt, Mycobacterium leprae
ugcugcggaucggugc

SEQ ID NO: 1224748 - RNA, 12 nt, Mycobacterium leprae
ugcggcgguggg

SEQ ID NO: 1224749 - RNA, 14 nt, Mycobacterium leprae
ugcgaugcuggccg

SEQ ID NO: 1224750 - RNA, 17 nt, Mycobacterium leprae
aauagcugccaagcuga

SEQ ID NO: 1224751 - RNA, 13 nt, Mycobacterium leprae
ugcgcagacccgg

SEQ ID NO: 1224752 - RNA, 17 nt, Mycobacterium leprae
ugcgccaggggaaccau

SEQ ID NO: 1224753 - RNA, 23 nt, Mycobacterium leprae
ugccggugcggucccaucgcuga

SEQ ID NO: 1224754 - RNA, 14 nt, Mycobacterium leprae
ugccgaaaucguga

SEQ ID NO: 1224755 - RNA, 15 nt, Mycobacterium leprae
ugccgcugaccaguc

SEQ ID NO: 1224756 - RNA, 14 nt, Mycobacterium leprae
ugccgcugucgaug

SEQ ID NO: 1224757 - RNA, 21 nt, Mycobacterium leprae
ugccgcugguaucggugucgg

SEQ ID NO: 1224758 - RNA, 14 nt, Mycobacterium leprae
ugggcggcguuggc

SEQ ID NO: 1224759 - RNA, 15 nt, Mycobacterium leprae
ugggcuuccagcaga

SEQ ID NO: 1224760 - RNA, 15 nt, Mycobacterium leprae
ugggugguguucccc

SEQ ID NO: 1224761 - RNA, 21 nt, Mycobacterium leprae
ugggggucuaauuuuugccga

SEQ ID NO: 1224762 - RNA, 17 nt, Mycobacterium leprae
uggggguguuggcccaa

SEQ ID NO: 1224763 - RNA, 21 nt, Mycobacterium leprae
uggggucgcuuguggaucagc

SEQ ID NO: 1224764 - RNA, 14 nt, Mycobacterium leprae
uguaaucggccgau

SEQ ID NO: 1224765 - RNA, 23 nt, Mycobacterium leprae
ugguuuccagggcgaguacgucc

SEQ ID NO: 1224766 - RNA, 23 nt, Mycobacterium leprae
ugguuggucggccacucguaggg

SEQ ID NO: 1224767 - RNA, 16 nt, Mycobacterium leprae
aaucaccguacgcauu

SEQ ID NO: 1224768 - RNA, 20 nt, Mycobacterium leprae
uggugacaacgccgccaagu

SEQ ID NO: 1224769 - RNA, 20 nt, Mycobacterium leprae
uggugcccgacagccaccac

SEQ ID NO: 1224770 - RNA, 13 nt, Mycobacterium leprae
uggugcugcccga

SEQ ID NO: 1224771 - RNA, 19 nt, Mycobacterium leprae
ugguccgcuacauugcucc

SEQ ID NO: 1224772 - RNA, 20 nt, Mycobacterium leprae
uggucaagugucgggugguc

SEQ ID NO: 1224773 - RNA, 20 nt, Mycobacterium leprae
uggccgggaucggcggcacc

SEQ ID NO: 1224774 - RNA, 22 nt, Mycobacterium leprae
uggcccacgaauaugcccagca

SEQ ID NO: 1224775 - RNA, 16 nt, Mycobacterium leprae
uggccgccaggucagc

SEQ ID NO: 1224776 - RNA, 12 nt, Mycobacterium leprae
uggccagcaagu

SEQ ID NO: 1224777 - RNA, 15 nt, Mycobacterium leprae
uggccauauaugaac

SEQ ID NO: 1224778 - RNA, 14 nt, Mycobacterium leprae
uggccaacgccggg

SEQ ID NO: 1224779 - RNA, 13 nt, Mycobacterium leprae
uggccaccgccac

SEQ ID NO: 1224780 - RNA, 22 nt, Mycobacterium leprae
uggacagaacaccccgcggagu

SEQ ID NO: 1224781 - RNA, 22 nt, Mycobacterium leprae
uggcauuuugggaguggugcuc

SEQ ID NO: 1224782 - RNA, 15 nt, Mycobacterium leprae
uggcauuguccagcg

SEQ ID NO: 1224783 - RNA, 18 nt, Mycobacterium leprae
acgaucuaucugacgacu

SEQ ID NO: 1224784 - RNA, 20 nt, Mycobacterium leprae
acgauuacgcacgccuugca

SEQ ID NO: 1224785 - RNA, 17 nt, Mycobacterium leprae
acgccccuaccccgcgg

SEQ ID NO: 1224786 - RNA, 18 nt, Mycobacterium leprae
acgccccuaccccgcggc

SEQ ID NO: 1224787 - RNA, 13 nt, Mycobacterium leprae
acgcccgaccagu

SEQ ID NO: 1224788 - RNA, 15 nt, Mycobacterium leprae
acgcaguuggccacu

SEQ ID NO: 1224789 - RNA, 23 nt, Mycobacterium leprae
acgccgcggcugggcagccgagg

SEQ ID NO: 1224790 - RNA, 20 nt, Mycobacterium leprae
acgccgauaucgaccagcca

SEQ ID NO: 1224791 - RNA, 22 nt, Mycobacterium leprae
acgccgauaucgaccagccaag

SEQ ID NO: 1224792 - RNA, 15 nt, Mycobacterium leprae
acgaaucgcauucgu

SEQ ID NO: 1224793 - RNA, 16 nt, Mycobacterium leprae
accuugggcgccucgu

SEQ ID NO: 1224794 - RNA, 22 nt, Mycobacterium leprae
acgaccgucuggaacacgaucg

SEQ ID NO: 1224795 - RNA, 18 nt, Mycobacterium leprae
acgaccuccucgggggug

SEQ ID NO: 1224796 - RNA, 23 nt, Mycobacterium leprae
acgaccggcugcaccuguugcuc

SEQ ID NO: 1224797 - RNA, 11 nt, Mycobacterium leprae
acgacgcauag

SEQ ID NO: 1224798 - RNA, 15 nt, Mycobacterium leprae
acgacgccacagcgg

SEQ ID NO: 1224799 - RNA, 21 nt, Mycobacterium leprae
accuugccgcguauaccggcu

SEQ ID NO: 1224800 - RNA, 17 nt, Mycobacterium leprae
accugcugaucgaauug

SEQ ID NO: 1224801 - RNA, 17 nt, Mycobacterium leprae
accugcgagaucggguu

SEQ ID NO: 1224802 - RNA, 23 nt, Mycobacterium leprae
accucacgaauccuacauccacg

SEQ ID NO: 1224803 - RNA, 22 nt, Mycobacterium leprae
accucaccaucuuugacauccg

SEQ ID NO: 1224804 - RNA, 14 nt, Mycobacterium leprae
accuccagccgcgg

SEQ ID NO: 1224805 - RNA, 15 nt, Mycobacterium leprae
accuccagccgcggg

SEQ ID NO: 1224806 - RNA, 15 nt, Mycobacterium leprae
accuccgcagcaucg

SEQ ID NO: 1224807 - RNA, 18 nt, Mycobacterium leprae
accuccgcagcaucggca

SEQ ID NO: 1224808 - RNA, 18 nt, Mycobacterium leprae
accugcauggacgauauc

SEQ ID NO: 1224809 - RNA, 16 nt, Mycobacterium leprae
accugccuagcaacgu

SEQ ID NO: 1224810 - RNA, 18 nt, Mycobacterium leprae
acucgaacaucccugggc

SEQ ID NO: 1224811 - RNA, 17 nt, Mycobacterium leprae
acuacguuggccagcac

SEQ ID NO: 1224812 - RNA, 15 nt, Mycobacterium leprae
acuauauaguccgac

SEQ ID NO: 1224813 - RNA, 21 nt, Mycobacterium leprae
acugaauuaaggggacggugu

SEQ ID NO: 1224814 - RNA, 21 nt, Mycobacterium leprae
acugccgaagacuucuucgau

SEQ ID NO: 1224815 - RNA, 17 nt, Mycobacterium leprae
acgugcugaggguggcg

SEQ ID NO: 1224816 - RNA, 13 nt, Mycobacterium leprae
acgugcgccgcgc

SEQ ID NO: 1224817 - RNA, 14 nt, Mycobacterium leprae
acgugcgccgcgcu

SEQ ID NO: 1224818 - RNA, 22 nt, Mycobacterium leprae
acguucggaucauugcucgcgu

SEQ ID NO: 1224819 - RNA, 15 nt, Mycobacterium leprae
acgugcgaguucucc

SEQ ID NO: 1224820 - RNA, 14 nt, Mycobacterium leprae
acguuuguggugcu

SEQ ID NO: 1224821 - RNA, 16 nt, Mycobacterium leprae
acuaacguucggugac

SEQ ID NO: 1224822 - RNA, 23 nt, Mycobacterium leprae
acguugcugggacauccgcugau

SEQ ID NO: 1224823 - RNA, 21 nt, Mycobacterium leprae
acgguauuugcugucguggcu

SEQ ID NO: 1224824 - RNA, 13 nt, Mycobacterium leprae
acggucaacggcc

SEQ ID NO: 1224825 - RNA, 23 nt, Mycobacterium leprae
acggucuuucgcagaagaccgug

SEQ ID NO: 1224826 - RNA, 15 nt, Mycobacterium leprae
acguauagcgaaaau

SEQ ID NO: 1224827 - RNA, 16 nt, Mycobacterium leprae
acgucgaucucgacgc

SEQ ID NO: 1224828 - RNA, 17 nt, Mycobacterium leprae
acgggcucacggggcug

SEQ ID NO: 1224829 - RNA, 21 nt, Mycobacterium leprae
acgggugguuagaaucgccug

SEQ ID NO: 1224830 - RNA, 15 nt, Mycobacterium leprae
acgggugucugaacu

SEQ ID NO: 1224831 - RNA, 22 nt, Mycobacterium leprae
acggguuaccugaccgaaccga

SEQ ID NO: 1224832 - RNA, 19 nt, Mycobacterium leprae
acgguaacugaccaagaag

SEQ ID NO: 1224833 - RNA, 21 nt, Mycobacterium leprae
acgguaauaaggcgucaagca

SEQ ID NO: 1224834 - RNA, 16 nt, Mycobacterium leprae
acgggccgcucgacca

SEQ ID NO: 1224835 - RNA, 22 nt, Mycobacterium leprae
acgggcaugcaguacguguggu

SEQ ID NO: 1224836 - RNA, 16 nt, Mycobacterium leprae
acggcuuugcugucga

SEQ ID NO: 1224837 - RNA, 16 nt, Mycobacterium leprae
acggcgggugaugauc

SEQ ID NO: 1224838 - RNA, 13 nt, Mycobacterium leprae
acggcggccgcca

SEQ ID NO: 1224839 - RNA, 13 nt, Mycobacterium leprae
acggcgcggcugc

SEQ ID NO: 1224840 - RNA, 17 nt, Mycobacterium leprae
acggcgcggcugcuugu

SEQ ID NO: 1224841 - RNA, 18 nt, Mycobacterium leprae
acggcagcgucaccaagc

SEQ ID NO: 1224842 - RNA, 21 nt, Mycobacterium leprae
acggcagugagcucaccggcg

SEQ ID NO: 1224843 - RNA, 17 nt, Mycobacterium leprae
acggcagguggaucguc

SEQ ID NO: 1224844 - RNA, 18 nt, Mycobacterium leprae
acgcugcgugaagcaggu

SEQ ID NO: 1224845 - RNA, 11 nt, Mycobacterium leprae
acgcugcuugc

SEQ ID NO: 1224846 - RNA, 14 nt, Mycobacterium leprae
acggcacgccgaac

SEQ ID NO: 1224847 - RNA, 18 nt, Mycobacterium leprae
acauagucauugccuagu

SEQ ID NO: 1224848 - RNA, 19 nt, Mycobacterium leprae
acauccucgguaucgucaa

SEQ ID NO: 1224849 - RNA, 14 nt, Mycobacterium leprae
acaucguguggugu

SEQ ID NO: 1224850 - RNA, 22 nt, Mycobacterium leprae
acaguggucugguuaucgauuu

SEQ ID NO: 1224851 - RNA, 22 nt, Mycobacterium leprae
acagcggucauuaucgagauug

SEQ ID NO: 1224852 - RNA, 21 nt, Mycobacterium leprae
acagucagccgcggguaaccu

SEQ ID NO: 1224853 - RNA, 15 nt, Mycobacterium leprae
acaguaucgaccagc

SEQ ID NO: 1224854 - RNA, 21 nt, Mycobacterium leprae
acaguaucgaccagccacgca

SEQ ID NO: 1224855 - RNA, 14 nt, Mycobacterium leprae
acaguaggccagcc

SEQ ID NO: 1224856 - RNA, 19 nt, Mycobacterium leprae
accaagaaguuaccgagcc

SEQ ID NO: 1224857 - RNA, 24 nt, Mycobacterium leprae
accaaacuggacuucuaccgcgaa

SEQ ID NO: 1224858 - RNA, 16 nt, Mycobacterium leprae
accacgucgggcagca

SEQ ID NO: 1224859 - RNA, 19 nt, Mycobacterium leprae
accacgucgggcagcaacc

SEQ ID NO: 1224860 - RNA, 21 nt, Mycobacterium leprae
accacgucgggcagcaaccgc

SEQ ID NO: 1224861 - RNA, 13 nt, Mycobacterium leprae
accacugacgggu

SEQ ID NO: 1224862 - RNA, 18 nt, Mycobacterium leprae
accacuuuggcaacgggu

SEQ ID NO: 1224863 - RNA, 20 nt, Mycobacterium leprae
accagcucacccgcagcacc

SEQ ID NO: 1224864 - RNA, 18 nt, Mycobacterium leprae
accaccgcggugagcggu

SEQ ID NO: 1224865 - RNA, 15 nt, Mycobacterium leprae
accaccaccgccacc

SEQ ID NO: 1224866 - RNA, 20 nt, Mycobacterium leprae
accaccguggagacgaucgc

SEQ ID NO: 1224867 - RNA, 12 nt, Mycobacterium leprae
accacggcgggu

SEQ ID NO: 1224868 - RNA, 20 nt, Mycobacterium leprae
acaaugugucaggcugccaa

SEQ ID NO: 1224869 - RNA, 22 nt, Mycobacterium leprae
acaagcagugucugggccgggc

SEQ ID NO: 1224870 - RNA, 16 nt, Mycobacterium leprae
acaaggaauugcugcg

SEQ ID NO: 1224871 - RNA, 12 nt, Mycobacterium leprae
acaagcgaucgg

SEQ ID NO: 1224872 - RNA, 15 nt, Mycobacterium leprae
aaugugccacgucga

SEQ ID NO: 1224873 - RNA, 13 nt, Mycobacterium leprae
aauguggccgcac

SEQ ID NO: 1224874 - RNA, 14 nt, Mycobacterium leprae
acaacaagcgacuu

SEQ ID NO: 1224875 - RNA, 16 nt, Mycobacterium leprae
acaaaggugcccacca

SEQ ID NO: 1224876 - RNA, 17 nt, Mycobacterium leprae
acaaacguuucgccgca

SEQ ID NO: 1224877 - RNA, 17 nt, Mycobacterium leprae
acaaccucggccgaggc

SEQ ID NO: 1224878 - RNA, 23 nt, Mycobacterium leprae
acacccgguuggccaacugucgg

SEQ ID NO: 1224879 - RNA, 23 nt, Mycobacterium leprae
acacccgcacaguuaccacgacg

SEQ ID NO: 1224880 - RNA, 12 nt, Mycobacterium leprae
acacgccgcggc

SEQ ID NO: 1224881 - RNA, 23 nt, Mycobacterium leprae
acacgccguuaguuucgggccuc

SEQ ID NO: 1224882 - RNA, 13 nt, Mycobacterium leprae
acacggccgucgc

SEQ ID NO: 1224883 - RNA, 22 nt, Mycobacterium leprae
acacgagcguuuagucaccgcc

SEQ ID NO: 1224884 - RNA, 16 nt, Mycobacterium leprae
acacgauuagcgcggc

SEQ ID NO: 1224885 - RNA, 20 nt, Mycobacterium leprae
acacgauuagcgcggcgcac

SEQ ID NO: 1224886 - RNA, 18 nt, Mycobacterium leprae
acagccgugccucgcugu

SEQ ID NO: 1224887 - RNA, 13 nt, Mycobacterium leprae
acacugcggcugc

SEQ ID NO: 1224888 - RNA, 17 nt, Mycobacterium leprae
acacugcggcugcggaa

SEQ ID NO: 1224889 - RNA, 16 nt, Mycobacterium leprae
acccgccagggcggca

SEQ ID NO: 1224890 - RNA, 20 nt, Mycobacterium leprae
acccgccucguugcguaccg

SEQ ID NO: 1224891 - RNA, 20 nt, Mycobacterium leprae
acccggccacaacgcggccu

SEQ ID NO: 1224892 - RNA, 20 nt, Mycobacterium leprae
acccgucgaugaucuaaccg

SEQ ID NO: 1224893 - RNA, 14 nt, Mycobacterium leprae
acccgugucgaccg

SEQ ID NO: 1224894 - RNA, 16 nt, Mycobacterium leprae
acccgugucgaccgac

SEQ ID NO: 1224895 - RNA, 12 nt, Mycobacterium leprae
acccggcggcau

SEQ ID NO: 1224896 - RNA, 15 nt, Mycobacterium leprae
accgaacccagacgc

SEQ ID NO: 1224897 - RNA, 13 nt, Mycobacterium leprae
accgaaagccgca

SEQ ID NO: 1224898 - RNA, 23 nt, Mycobacterium leprae
accccaggcuacugugaucgcau

SEQ ID NO: 1224899 - RNA, 22 nt, Mycobacterium leprae
accccgaguucucagucgcaag

SEQ ID NO: 1224900 - RNA, 13 nt, Mycobacterium leprae
accccgcggcgcu

SEQ ID NO: 1224901 - RNA, 18 nt, Mycobacterium leprae
acccagacgcgaccgcca

SEQ ID NO: 1224902 - RNA, 14 nt, Mycobacterium leprae
accggcggcgagca

SEQ ID NO: 1224903 - RNA, 19 nt, Mycobacterium leprae
accggcugcacccgucgcu

SEQ ID NO: 1224904 - RNA, 10 nt, Mycobacterium leprae
accggcugcg

SEQ ID NO: 1224905 - RNA, 17 nt, Mycobacterium leprae
accgggccggccgcgga

SEQ ID NO: 1224906 - RNA, 23 nt, Mycobacterium leprae
accgggggucguagggucgagau

SEQ ID NO: 1224907 - RNA, 21 nt, Mycobacterium leprae
accgacgcaaucuacuggaug

SEQ ID NO: 1224908 - RNA, 18 nt, Mycobacterium leprae
accgcauccggcgccagc

SEQ ID NO: 1224909 - RNA, 12 nt, Mycobacterium leprae
accgcgacgcca

SEQ ID NO: 1224910 - RNA, 16 nt, Mycobacterium leprae
accgccuugucggcaa

SEQ ID NO: 1224911 - RNA, 18 nt, Mycobacterium leprae
ugauaaggucuggcaccg

SEQ ID NO: 1224912 - RNA, 19 nt, Mycobacterium leprae
ugaguuuugaacuuucggc

SEQ ID NO: 1224913 - RNA, 17 nt, Mycobacterium leprae
ugacgguguugguguca

SEQ ID NO: 1224914 - RNA, 15 nt, Mycobacterium leprae
ugacucugaccgaca

SEQ ID NO: 1224915 - RNA, 22 nt, Mycobacterium leprae
ugaggaauucgaaucgguaccg

SEQ ID NO: 1224916 - RNA, 16 nt, Mycobacterium leprae
ugagcgacagcucagc

SEQ ID NO: 1224917 - RNA, 22 nt, Mycobacterium leprae
ugaucguuaccgacaccgccga

SEQ ID NO: 1224918 - RNA, 20 nt, Mycobacterium leprae
ugaucggugacuuggcuggu

SEQ ID NO: 1224919 - RNA, 13 nt, Mycobacterium leprae
ugaucaccaucgu

SEQ ID NO: 1224920 - RNA, 14 nt, Mycobacterium leprae
ugaucagacggcga

SEQ ID NO: 1224921 - RNA, 18 nt, Mycobacterium leprae
ugacgaggugucggcgau

SEQ ID NO: 1224922 - RNA, 20 nt, Mycobacterium leprae
ugacgacauugugggccgcu

SEQ ID NO: 1224923 - RNA, 11 nt, Mycobacterium leprae
ugacgccgacc

SEQ ID NO: 1224924 - RNA, 14 nt, Mycobacterium leprae
ugacgaaacggcgu

SEQ ID NO: 1224925 - RNA, 20 nt, Mycobacterium leprae
ugaccggccaaaauggcacg

SEQ ID NO: 1224926 - RNA, 16 nt, Mycobacterium leprae
ugaccgccugugcugu

SEQ ID NO: 1224927 - RNA, 18 nt, Mycobacterium leprae
ugcagaaauucagcgcca

SEQ ID NO: 1224928 - RNA, 22 nt, Mycobacterium leprae
ugcacucgcaucaacgccgaga

SEQ ID NO: 1224929 - RNA, 18 nt, Mycobacterium leprae
ugcacgaauaucgagcua

SEQ ID NO: 1224930 - RNA, 15 nt, Mycobacterium leprae
ugcacgcgcgccugg

SEQ ID NO: 1224931 - RNA, 16 nt, Mycobacterium leprae
ugaugguccuggcugc

SEQ ID NO: 1224932 - RNA, 14 nt, Mycobacterium leprae
ugauggcgcguggu

SEQ ID NO: 1224933 - RNA, 22 nt, Mycobacterium leprae
ugaugcggacgacgcugagagg

SEQ ID NO: 1224934 - RNA, 16 nt, Mycobacterium leprae
ugaugcuaucgccggu

SEQ ID NO: 1224935 - RNA, 15 nt, Mycobacterium leprae
ugaugcuguggugug

SEQ ID NO: 1224936 - RNA, 19 nt, Mycobacterium leprae
ugaugcuguggugugcguu

SEQ ID NO: 1224937 - RNA, 13 nt, Mycobacterium leprae
ugaugcugugucg

SEQ ID NO: 1224938 - RNA, 16 nt, Mycobacterium leprae
ugcaccauaccgacga

SEQ ID NO: 1224939 - RNA, 17 nt, Mycobacterium leprae
ugcacauucaaccagcc

SEQ ID NO: 1224940 - RNA, 19 nt, Mycobacterium leprae
ugcacauucaaccagccaa

SEQ ID NO: 1224941 - RNA, 15 nt, Mycobacterium leprae
ugcagagcaucgggc

SEQ ID NO: 1224942 - RNA, 14 nt, Mycobacterium leprae
ugcagacacgccgc

SEQ ID NO: 1224943 - RNA, 20 nt, Mycobacterium leprae
ugcagccacgaaaaucuggc

SEQ ID NO: 1224944 - RNA, 18 nt, Mycobacterium leprae
ugcagcccugagcaccau

SEQ ID NO: 1224945 - RNA, 14 nt, Mycobacterium leprae
ugcaggaccgugcu

SEQ ID NO: 1224946 - RNA, 22 nt, Mycobacterium leprae
ugcagcuaauuuuccacaggca

SEQ ID NO: 1224947 - RNA, 15 nt, Mycobacterium leprae
ugcagcugggauagc

SEQ ID NO: 1224948 - RNA, 21 nt, Mycobacterium leprae
ugcagcuuguuggccaucggg

SEQ ID NO: 1224949 - RNA, 21 nt, Mycobacterium leprae
ugccacggccccggaugcgug

SEQ ID NO: 1224950 - RNA, 18 nt, Mycobacterium leprae
ugccacugugucacgcga

SEQ ID NO: 1224951 - RNA, 21 nt, Mycobacterium leprae
ugccacugugucacgcgacca

SEQ ID NO: 1224952 - RNA, 16 nt, Mycobacterium leprae
ugccaugcacgccggc

SEQ ID NO: 1224953 - RNA, 22 nt, Mycobacterium leprae
ugccaucgggccagagcugcga

SEQ ID NO: 1224954 - RNA, 15 nt, Mycobacterium leprae
ugccauccggugcug

SEQ ID NO: 1224955 - RNA, 15 nt, Mycobacterium leprae
ugccaucgacgccgc

SEQ ID NO: 1224956 - RNA, 20 nt, Mycobacterium leprae
ugccaucgacgccgccguug

SEQ ID NO: 1224957 - RNA, 22 nt, Mycobacterium leprae
ugccaucgacgccgccguugcc

SEQ ID NO: 1224958 - RNA, 19 nt, Mycobacterium leprae
ugccaucgacgccgucucc

SEQ ID NO: 1224959 - RNA, 15 nt, Mycobacterium leprae
ugcccugggugacca

SEQ ID NO: 1224960 - RNA, 21 nt, Mycobacterium leprae
ugcccgcagaggacgggcggc

SEQ ID NO: 1224961 - RNA, 16 nt, Mycobacterium leprae
ucuuggcuugcugucg

SEQ ID NO: 1224962 - RNA, 17 nt, Mycobacterium leprae
ucuuggggacgccggcg

SEQ ID NO: 1224963 - RNA, 18 nt, Mycobacterium leprae
ucuuggggacgccggcgg

SEQ ID NO: 1224964 - RNA, 19 nt, Mycobacterium leprae
ugaacacgcuuaaucgacu

SEQ ID NO: 1224965 - RNA, 21 nt, Mycobacterium leprae
ucuggaacucuguguugccgu

SEQ ID NO: 1224966 - RNA, 18 nt, Mycobacterium leprae
ucuggauggccgccagca

SEQ ID NO: 1224967 - RNA, 18 nt, Mycobacterium leprae
ucuggauggcgcucacga

SEQ ID NO: 1224968 - RNA, 18 nt, Mycobacterium leprae
ucucaccaauagccgacc

SEQ ID NO: 1224969 - RNA, 14 nt, Mycobacterium leprae
ucguggagcaccuc

SEQ ID NO: 1224970 - RNA, 14 nt, Mycobacterium leprae
ucucacgcccgacg

SEQ ID NO: 1224971 - RNA, 13 nt, Mycobacterium leprae
ucucgagcggcgc

SEQ ID NO: 1224972 - RNA, 23 nt, Mycobacterium leprae
ucucgcgucgugcguuguugaug

SEQ ID NO: 1224973 - RNA, 23 nt, Mycobacterium leprae
ucucgugaaacgagauugccgac

SEQ ID NO: 1224974 - RNA, 22 nt, Mycobacterium leprae
ucugcaccucuucgacaccgag

SEQ ID NO: 1224975 - RNA, 17 nt, Mycobacterium leprae
ucugccucgucgauguc

SEQ ID NO: 1224976 - RNA, 16 nt, Mycobacterium leprae
ucguaggucgcccggu

SEQ ID NO: 1224977 - RNA, 22 nt, Mycobacterium leprae
ucgguguuguuuggcaacgcac

SEQ ID NO: 1224978 - RNA, 20 nt, Mycobacterium leprae
ucgguuguuguggugugcgc

SEQ ID NO: 1224979 - RNA, 12 nt, Mycobacterium leprae
ucggucgauggc

SEQ ID NO: 1224980 - RNA, 20 nt, Mycobacterium leprae
ucggucgccgagcugaucgu

SEQ ID NO: 1224981 - RNA, 15 nt, Mycobacterium leprae
ucgucuucgcagccu

SEQ ID NO: 1224982 - RNA, 20 nt, Mycobacterium leprae
ucgugaggugugaccgugca

SEQ ID NO: 1224983 - RNA, 16 nt, Mycobacterium leprae
ucgucgugauggucau

SEQ ID NO: 1224984 - RNA, 15 nt, Mycobacterium leprae
ucgucgucagcugcu

SEQ ID NO: 1224985 - RNA, 20 nt, Mycobacterium leprae
ucgucgaugcgcagacccgg

SEQ ID NO: 1224986 - RNA, 10 nt, Mycobacterium leprae
ucgucgacga

SEQ ID NO: 1224987 - RNA, 13 nt, Mycobacterium leprae
ucgucggcgguuc

SEQ ID NO: 1224988 - RNA, 17 nt, Mycobacterium leprae
ucggucaccugugggac

SEQ ID NO: 1224989 - RNA, 19 nt, Mycobacterium leprae
ucgggccucgccguugcua

SEQ ID NO: 1224990 - RNA, 17 nt, Mycobacterium leprae
ucgggcagcugcaacac

SEQ ID NO: 1224991 - RNA, 15 nt, Mycobacterium leprae
ucggcuugccgauau

SEQ ID NO: 1224992 - RNA, 18 nt, Mycobacterium leprae
uccgaacggggcggcacc

SEQ ID NO: 1224993 - RNA, 12 nt, Mycobacterium leprae
uccgaagcagcc

SEQ ID NO: 1224994 - RNA, 17 nt, Mycobacterium leprae
uccgccgacgaugcgug

SEQ ID NO: 1224995 - RNA, 12 nt, Mycobacterium leprae
ucccuucgccga

SEQ ID NO: 1224996 - RNA, 12 nt, Mycobacterium leprae
uccgcgccggcg

SEQ ID NO: 1224997 - RNA, 14 nt, Mycobacterium leprae
uccgcucaccgcgg

SEQ ID NO: 1224998 - RNA, 22 nt, Mycobacterium leprae
uccggcaccaauguugcccgca

SEQ ID NO: 1224999 - RNA, 22 nt, Mycobacterium leprae
uccggcguuaaacgcgaucgga

SEQ ID NO: 1225000 - RNA, 11 nt, Mycobacterium leprae
uccagggcgag

SEQ ID NO: 1225001 - RNA, 16 nt, Mycobacterium leprae
ucccgcgacggccggc

SEQ ID NO: 1225002 - RNA, 19 nt, Mycobacterium leprae
ucccugacuguuuccgcgg

SEQ ID NO: 1225003 - RNA, 13 nt, Mycobacterium leprae
uccucgucgguga

SEQ ID NO: 1225004 - RNA, 15 nt, Mycobacterium leprae
uccugacucgccggu

SEQ ID NO: 1225005 - RNA, 18 nt, Mycobacterium leprae
uccugagacaucgccacc

SEQ ID NO: 1225006 - RNA, 21 nt, Mycobacterium leprae
uccugagacaucgccaccgac

SEQ ID NO: 1225007 - RNA, 14 nt, Mycobacterium leprae
uccugacaaccguu

SEQ ID NO: 1225008 - RNA, 19 nt, Mycobacterium leprae
uccucuucgcguaggugcg

SEQ ID NO: 1225009 - RNA, 16 nt, Mycobacterium leprae
ucgaagggcugguggc

SEQ ID NO: 1225010 - RNA, 19 nt, Mycobacterium leprae
uccuugccggcgccgcugc

SEQ ID NO: 1225011 - RNA, 20 nt, Mycobacterium leprae
ucgacuggcuugucaccaga

SEQ ID NO: 1225012 - RNA, 16 nt, Mycobacterium leprae
ucgacucgaaacgcga

SEQ ID NO: 1225013 - RNA, 22 nt, Mycobacterium leprae
ucgacgaguuagacaccccccg

SEQ ID NO: 1225014 - RNA, 19 nt, Mycobacterium leprae
ucgaccagccaagccgcca

SEQ ID NO: 1225015 - RNA, 17 nt, Mycobacterium leprae
ucgauccagugccggaa

SEQ ID NO: 1225016 - RNA, 14 nt, Mycobacterium leprae
ucgaucggcagcca

SEQ ID NO: 1225017 - RNA, 17 nt, Mycobacterium leprae
ucgagauaguccgacca

SEQ ID NO: 1225018 - RNA, 19 nt, Mycobacterium leprae
ucgagaucaacguuuugcc

SEQ ID NO: 1225019 - RNA, 20 nt, Mycobacterium leprae
ucgcgggugggucgaugaug

SEQ ID NO: 1225020 - RNA, 12 nt, Mycobacterium leprae
ucgcgcgcaccc

SEQ ID NO: 1225021 - RNA, 12 nt, Mycobacterium leprae
ucgcgucgcgcc

SEQ ID NO: 1225022 - RNA, 15 nt, Mycobacterium leprae
ucgcuaacuucccga

SEQ ID NO: 1225023 - RNA, 18 nt, Mycobacterium leprae
ucgcucgguaagcuggcu

SEQ ID NO: 1225024 - RNA, 19 nt, Mycobacterium leprae
ucgcucgccgcccgcugga

SEQ ID NO: 1225025 - RNA, 13 nt, Mycobacterium leprae
ucgcuagcgauuc

SEQ ID NO: 1225026 - RNA, 19 nt, Mycobacterium leprae
ucgcuacccuugagcaccc

SEQ ID NO: 1225027 - RNA, 17 nt, Mycobacterium leprae
ucgcgugccagcgcugc

SEQ ID NO: 1225028 - RNA, 21 nt, Mycobacterium leprae
ucgcuuugcuggcaagcucgg

SEQ ID NO: 1225029 - RNA, 16 nt, Mycobacterium leprae
ucgcugaacucgucgu

SEQ ID NO: 1225030 - RNA, 20 nt, Mycobacterium leprae
ucggcgaagucaagaugauc

SEQ ID NO: 1225031 - RNA, 22 nt, Mycobacterium leprae
ucggcaugacuguguacgaagc

SEQ ID NO: 1225032 - RNA, 21 nt, Mycobacterium leprae
ucggcagaugcccuuugcggu

SEQ ID NO: 1225033 - RNA, 13 nt, Mycobacterium leprae
ucggcaacggcgu

SEQ ID NO: 1225034 - RNA, 19 nt, Mycobacterium leprae
ucggacugucaaccauggu

SEQ ID NO: 1225035 - RNA, 19 nt, Mycobacterium leprae
ucggacgugguccgaucgc

SEQ ID NO: 1225036 - RNA, 19 nt, Mycobacterium leprae
ucggccaguaccuccagcc

SEQ ID NO: 1225037 - RNA, 21 nt, Mycobacterium leprae
ucgcaggaucggguagcugca

SEQ ID NO: 1225038 - RNA, 12 nt, Mycobacterium leprae
ucgcccaccgca

SEQ ID NO: 1225039 - RNA, 22 nt, Mycobacterium leprae
ucgccuggucauggcuucguca

SEQ ID NO: 1225040 - RNA, 22 nt, Mycobacterium leprae
ucgccuuggugcuuaacgccgc

SEQ ID NO: 1225041 - RNA, 16 nt, Mycobacterium leprae
ucagcacaaucaacca

SEQ ID NO: 1225042 - RNA, 20 nt, Mycobacterium leprae
ucacgucgacggcggccgcc

SEQ ID NO: 1225043 - RNA, 12 nt, Mycobacterium leprae
ucacgucggcgu

SEQ ID NO: 1225044 - RNA, 17 nt, Mycobacterium leprae
ucacgccuaaucuagcc

SEQ ID NO: 1225045 - RNA, 20 nt, Mycobacterium leprae
ucagcaccggcauggccgcu

SEQ ID NO: 1225046 - RNA, 15 nt, Mycobacterium leprae
ucaccguggccggcc

SEQ ID NO: 1225047 - RNA, 24 nt, Mycobacterium leprae
ucaccucauauuuagcgaccggcc

SEQ ID NO: 1225048 - RNA, 12 nt, Mycobacterium leprae
ucaccggccacc

SEQ ID NO: 1225049 - RNA, 17 nt, Mycobacterium leprae
ucaccggccaccggcgc

SEQ ID NO: 1225050 - RNA, 20 nt, Mycobacterium leprae
ucaccggccagccuagccac

SEQ ID NO: 1225051 - RNA, 15 nt, Mycobacterium leprae
ucacccgcagcaccu

SEQ ID NO: 1225052 - RNA, 13 nt, Mycobacterium leprae
ucaccccagacgu

SEQ ID NO: 1225053 - RNA, 14 nt, Mycobacterium leprae
ucacccgcgccgcc

SEQ ID NO: 1225054 - RNA, 13 nt, Mycobacterium leprae
ucaccaaccggcc

SEQ ID NO: 1225055 - RNA, 17 nt, Mycobacterium leprae
ucacaccuggugugcgc

SEQ ID NO: 1225056 - RNA, 14 nt, Mycobacterium leprae
ucacacggcgcgau

SEQ ID NO: 1225057 - RNA, 12 nt, Mycobacterium leprae
ucaacgccagca

SEQ ID NO: 1225058 - RNA, 12 nt, Mycobacterium leprae
ucaacgccgcga

SEQ ID NO: 1225059 - RNA, 17 nt, Mycobacterium leprae
ucaacgugauggacgac

SEQ ID NO: 1225060 - RNA, 17 nt, Mycobacterium leprae
ucaccacuuuggcaacg

SEQ ID NO: 1225061 - RNA, 21 nt, Mycobacterium leprae
ucaccagauuggaaaucgcuc

SEQ ID NO: 1225062 - RNA, 19 nt, Mycobacterium leprae
ucaccacgaucaccgcggc

SEQ ID NO: 1225063 - RNA, 18 nt, Mycobacterium leprae
ucaccaauccagccaaca

SEQ ID NO: 1225064 - RNA, 14 nt, Mycobacterium leprae
uccaacacgccgau

SEQ ID NO: 1225065 - RNA, 19 nt, Mycobacterium leprae
ucauggccuugaggugucg

SEQ ID NO: 1225066 - RNA, 17 nt, Mycobacterium leprae
uccaccaaggccguguc

SEQ ID NO: 1225067 - RNA, 14 nt, Mycobacterium leprae
uccaccagccggcc

SEQ ID NO: 1225068 - RNA, 22 nt, Mycobacterium leprae
uccacccaaggauucagccaag

SEQ ID NO: 1225069 - RNA, 15 nt, Mycobacterium leprae
uccaccgagacguug

SEQ ID NO: 1225070 - RNA, 22 nt, Mycobacterium leprae
uccacgccgauaucgaccagcc

SEQ ID NO: 1225071 - RNA, 16 nt, Mycobacterium leprae
ucaguucacgcuggcc

SEQ ID NO: 1225072 - RNA, 16 nt, Mycobacterium leprae
ucagugcguugucgaa

SEQ ID NO: 1225073 - RNA, 21 nt, Mycobacterium leprae
ucagucaggcacguugaugaa

SEQ ID NO: 1225074 - RNA, 13 nt, Mycobacterium leprae
ucaguaaucgacg

SEQ ID NO: 1225075 - RNA, 23 nt, Mycobacterium leprae
ucaucgcccaccgcaacgccucc

SEQ ID NO: 1225076 - RNA, 14 nt, Mycobacterium leprae
ucagguccuugcuc

SEQ ID NO: 1225077 - RNA, 14 nt, Mycobacterium leprae
uacccacgacaucu

SEQ ID NO: 1225078 - RNA, 18 nt, Mycobacterium leprae
uacaaaaucguccgcgua

SEQ ID NO: 1225079 - RNA, 18 nt, Mycobacterium leprae
uaccagggucggccgggc

SEQ ID NO: 1225080 - RNA, 11 nt, Mycobacterium leprae
uaccgcaucgg

SEQ ID NO: 1225081 - RNA, 14 nt, Mycobacterium leprae
uaccgacuugccga

SEQ ID NO: 1225082 - RNA, 20 nt, Mycobacterium leprae
uaccgacuuggccgcaacuu

SEQ ID NO: 1225083 - RNA, 20 nt, Mycobacterium leprae
uaccgaaaacacgggcacca

SEQ ID NO: 1225084 - RNA, 17 nt, Mycobacterium leprae
uaccgaaguccaccgga

SEQ ID NO: 1225085 - RNA, 16 nt, Mycobacterium leprae
uacccgcggugacgcu

SEQ ID NO: 1225086 - RNA, 18 nt, Mycobacterium leprae
uaccccccaucugcuugu

SEQ ID NO: 1225087 - RNA, 22 nt, Mycobacterium leprae
uaccgcgggauugcaugcaccg

SEQ ID NO: 1225088 - RNA, 22 nt, Mycobacterium leprae
uaccgcggcggccaacuguugc

SEQ ID NO: 1225089 - RNA, 16 nt, Mycobacterium leprae
uaccgggcucggugaa

SEQ ID NO: 1225090 - RNA, 18 nt, Mycobacterium leprae
uaccggcgaagacgccgc

SEQ ID NO: 1225091 - RNA, 18 nt, Mycobacterium leprae
uaccgguacgcugcauga

SEQ ID NO: 1225092 - RNA, 13 nt, Mycobacterium leprae
uaccugggccagg

SEQ ID NO: 1225093 - RNA, 20 nt, Mycobacterium leprae
uaccugcgaccuggugucgc

SEQ ID NO: 1225094 - RNA, 17 nt, Mycobacterium leprae
uagaggcugcaccggcu

SEQ ID NO: 1225095 - RNA, 19 nt, Mycobacterium leprae
uagaggaucugcacaacac

SEQ ID NO: 1225096 - RNA, 16 nt, Mycobacterium leprae
uagcggccuaggacgc

SEQ ID NO: 1225097 - RNA, 15 nt, Mycobacterium leprae
uagcggccgccagca

SEQ ID NO: 1225098 - RNA, 23 nt, Mycobacterium leprae
uagcaucccgaagugaucggcga

SEQ ID NO: 1225099 - RNA, 14 nt, Mycobacterium leprae
uagcaguguggcau

SEQ ID NO: 1225100 - RNA, 20 nt, Mycobacterium leprae
uagcaguguggcauccgcca

SEQ ID NO: 1225101 - RNA, 20 nt, Mycobacterium leprae
uaucaaucacgcccagcgca

SEQ ID NO: 1225102 - RNA, 17 nt, Mycobacterium leprae
uaguucgacaccggcca

SEQ ID NO: 1225103 - RNA, 20 nt, Mycobacterium leprae
uagucggccggcucgcaucc

SEQ ID NO: 1225104 - RNA, 19 nt, Mycobacterium leprae
uagucgguuacaucgucaa

SEQ ID NO: 1225105 - RNA, 20 nt, Mycobacterium leprae
uaguccgcagaaugugcucu

SEQ ID NO: 1225106 - RNA, 15 nt, Mycobacterium leprae
ucaaauucaaccgga

SEQ ID NO: 1225107 - RNA, 23 nt, Mycobacterium leprae
ucaacauugccaucgaacggcgg

SEQ ID NO: 1225108 - RNA, 18 nt, Mycobacterium leprae
ucaacagcgcagugugcu

SEQ ID NO: 1225109 - RNA, 20 nt, Mycobacterium leprae
uaugguccaacgugguuggc

SEQ ID NO: 1225110 - RNA, 17 nt, Mycobacterium leprae
uauggcuaagcuaggcg

SEQ ID NO: 1225111 - RNA, 19 nt, Mycobacterium leprae
uaucgaugcuaccgaacuu

SEQ ID NO: 1225112 - RNA, 16 nt, Mycobacterium leprae
uaucgcccaggugcug

SEQ ID NO: 1225113 - RNA, 12 nt, Mycobacterium leprae
uaucgaccagcc

SEQ ID NO: 1225114 - RNA, 22 nt, Mycobacterium leprae
uaucgaccagccacgcaaacga

SEQ ID NO: 1225115 - RNA, 15 nt, Mycobacterium leprae
uaucggcauauccgc

SEQ ID NO: 1225116 - RNA, 22 nt, Mycobacterium leprae
uaugcgucguacucuggcuggu

SEQ ID NO: 1225117 - RNA, 15 nt, Mycobacterium leprae
guuaagcaucggcag

SEQ ID NO: 1225118 - RNA, 21 nt, Mycobacterium leprae
guguucuggcacccacgcugc

SEQ ID NO: 1225119 - RNA, 14 nt, Mycobacterium leprae
guucaaaagccaca

SEQ ID NO: 1225120 - RNA, 21 nt, Mycobacterium leprae
guucaaaagccacacgcgacg

SEQ ID NO: 1225121 - RNA, 12 nt, Mycobacterium leprae
guuacaucacag

SEQ ID NO: 1225122 - RNA, 15 nt, Mycobacterium leprae
guuacgauccaugcc

SEQ ID NO: 1225123 - RNA, 13 nt, Mycobacterium leprae
gugucagcagcag

SEQ ID NO: 1225124 - RNA, 16 nt, Mycobacterium leprae
gugucacgcgaccaac

SEQ ID NO: 1225125 - RNA, 11 nt, Mycobacterium leprae
gugucacccgg

SEQ ID NO: 1225126 - RNA, 22 nt, Mycobacterium leprae
gugucaccuguuucagcguggc

SEQ ID NO: 1225127 - RNA, 22 nt, Mycobacterium leprae
guggcuauacccccugucuauc

SEQ ID NO: 1225128 - RNA, 20 nt, Mycobacterium leprae
guggcgagugcugacgccgg

SEQ ID NO: 1225129 - RNA, 21 nt, Mycobacterium leprae
guggcggagcgcggagcuggu

SEQ ID NO: 1225130 - RNA, 13 nt, Mycobacterium leprae
guggcgcgagcgu

SEQ ID NO: 1225131 - RNA, 15 nt, Mycobacterium leprae
gugcugcugcggcgc

SEQ ID NO: 1225132 - RNA, 15 nt, Mycobacterium leprae
aagugcugcggcgcc

SEQ ID NO: 1225133 - RNA, 16 nt, Mycobacterium leprae
aagucuucaauccgcg

SEQ ID NO: 1225134 - RNA, 17 nt, Mycobacterium leprae
gugccgcugcauccgca

SEQ ID NO: 1225135 - RNA, 20 nt, Mycobacterium leprae
gugccgcugcauccgcagca

SEQ ID NO: 1225136 - RNA, 15 nt, Mycobacterium leprae
gugccggccucgugc

SEQ ID NO: 1225137 - RNA, 22 nt, Mycobacterium leprae
gugccggccucgugcugcgugc

SEQ ID NO: 1225138 - RNA, 23 nt, Mycobacterium leprae
gugccggccucgugcugcgugcc

SEQ ID NO: 1225139 - RNA, 13 nt, Mycobacterium leprae
gugcgccaacacu

SEQ ID NO: 1225140 - RNA, 17 nt, Mycobacterium leprae
gugcguugacgaccggc

SEQ ID NO: 1225141 - RNA, 15 nt, Mycobacterium leprae
gugcuaaccgauccg

SEQ ID NO: 1225142 - RNA, 21 nt, Mycobacterium leprae
gugcggugaucgcugccggcg

SEQ ID NO: 1225143 - RNA, 22 nt, Mycobacterium leprae
gugcggucccaucgcugaccgg

SEQ ID NO: 1225144 - RNA, 17 nt, Mycobacterium leprae
gugcccaggugaaucgg

SEQ ID NO: 1225145 - RNA, 22 nt, Mycobacterium leprae
gugcauccagucguugacgaua

SEQ ID NO: 1225146 - RNA, 14 nt, Mycobacterium leprae
gugaugaucggcaa

SEQ ID NO: 1225147 - RNA, 15 nt, Mycobacterium leprae
gugauugccgcgguc

SEQ ID NO: 1225148 - RNA, 15 nt, Mycobacterium leprae
gugauccgucgcacg

SEQ ID NO: 1225149 - RNA, 20 nt, Mycobacterium leprae
gucggcguugagcgcagcca

SEQ ID NO: 1225150 - RNA, 16 nt, Mycobacterium leprae
uaaacuugguccgacg

SEQ ID NO: 1225151 - RNA, 12 nt, Mycobacterium leprae
guuucaucgacg

SEQ ID NO: 1225152 - RNA, 19 nt, Mycobacterium leprae
uaaccgggaaauacggcac

SEQ ID NO: 1225153 - RNA, 15 nt, Mycobacterium leprae
uaaccucacgccuaa

SEQ ID NO: 1225154 - RNA, 21 nt, Mycobacterium leprae
uaacacucauuggacccagcc

SEQ ID NO: 1225155 - RNA, 15 nt, Mycobacterium leprae
uaacgacaucgcagg

SEQ ID NO: 1225156 - RNA, 22 nt, Mycobacterium leprae
uaaccuucugcgaacacugagu

SEQ ID NO: 1225157 - RNA, 13 nt, Mycobacterium leprae
uaagagauugucc

SEQ ID NO: 1225158 - RNA, 21 nt, Mycobacterium leprae
uaaugccgggcugcaccgagc

SEQ ID NO: 1225159 - RNA, 13 nt, Mycobacterium leprae
uaaugcaagcgcu

SEQ ID NO: 1225160 - RNA, 19 nt, Mycobacterium leprae
uaaucguuccuaccggcca

SEQ ID NO: 1225161 - RNA, 19 nt, Mycobacterium leprae
guuuaccauuuccgcuaau

SEQ ID NO: 1225162 - RNA, 12 nt, Mycobacterium leprae
guuuaccgauuc

SEQ ID NO: 1225163 - RNA, 21 nt, Mycobacterium leprae
guugugccgcugcauccgcag

SEQ ID NO: 1225164 - RNA, 13 nt, Mycobacterium leprae
guugucgucggcc

SEQ ID NO: 1225165 - RNA, 21 nt, Mycobacterium leprae
guuggacaacacguuucugca

SEQ ID NO: 1225166 - RNA, 17 nt, Mycobacterium leprae
guuggcccgucgacccu

SEQ ID NO: 1225167 - RNA, 15 nt, Mycobacterium leprae
guugcuuguugccgc

SEQ ID NO: 1225168 - RNA, 17 nt, Mycobacterium leprae
guugcuuguugccgccg

SEQ ID NO: 1225169 - RNA, 16 nt, Mycobacterium leprae
guugccguaugugccg

SEQ ID NO: 1225170 - RNA, 17 nt, Mycobacterium leprae
guugagacaacccgacg

SEQ ID NO: 1225171 - RNA, 13 nt, Mycobacterium leprae
guucuacccaggc

SEQ ID NO: 1225172 - RNA, 14 nt, Mycobacterium leprae
guucgugaucgacg

SEQ ID NO: 1225173 - RNA, 20 nt, Mycobacterium leprae
guucguaaccuuguugcagc

SEQ ID NO: 1225174 - RNA, 15 nt, Mycobacterium leprae
guucggugacuucgg

SEQ ID NO: 1225175 - RNA, 23 nt, Mycobacterium leprae
guugacaaagcccacgccuagcu

SEQ ID NO: 1225176 - RNA, 15 nt, Mycobacterium leprae
agcgguaacuggcuc

SEQ ID NO: 1225177 - RNA, 12 nt, Mycobacterium leprae
agcggccgccag

SEQ ID NO: 1225178 - RNA, 19 nt, Mycobacterium leprae
agcggaccugcgagaucgg

SEQ ID NO: 1225179 - RNA, 23 nt, Mycobacterium leprae
agcgaugacauggaagccgccgu

SEQ ID NO: 1225180 - RNA, 19 nt, Mycobacterium leprae
agcgcugauccucucccga

SEQ ID NO: 1225181 - RNA, 18 nt, Mycobacterium leprae
agccggaggguugccgac

SEQ ID NO: 1225182 - RNA, 14 nt, Mycobacterium leprae
agccgccgggucga

SEQ ID NO: 1225183 - RNA, 15 nt, Mycobacterium leprae
agccgcaggucucac

SEQ ID NO: 1225184 - RNA, 16 nt, Mycobacterium leprae
agccgcaaggucacga

SEQ ID NO: 1225185 - RNA, 15 nt, Mycobacterium leprae
agccgaagccgccag

SEQ ID NO: 1225186 - RNA, 18 nt, Mycobacterium leprae
agccgaagccgccagguu

SEQ ID NO: 1225187 - RNA, 23 nt, Mycobacterium leprae
agccgacgguccugguggcaacg

SEQ ID NO: 1225188 - RNA, 16 nt, Mycobacterium leprae
agcgacgguaagcucg

SEQ ID NO: 1225189 - RNA, 12 nt, Mycobacterium leprae
agcgacuggcug

SEQ ID NO: 1225190 - RNA, 14 nt, Mycobacterium leprae
agccucgaaccgau

SEQ ID NO: 1225191 - RNA, 23 nt, Mycobacterium leprae
agccuagacugacccaagcgcca

SEQ ID NO: 1225192 - RNA, 14 nt, Mycobacterium leprae
agccuggucgcgua

SEQ ID NO: 1225193 - RNA, 21 nt, Mycobacterium leprae
agccugcacuuuacgugcgua

SEQ ID NO: 1225194 - RNA, 21 nt, Mycobacterium leprae
agaaguggcuugucacgccgg

SEQ ID NO: 1225195 - RNA, 21 nt, Mycobacterium leprae
agaauaaaugccggugcagcu

SEQ ID NO: 1225196 - RNA, 21 nt, Mycobacterium leprae
agaauguuguuagugcugcug

SEQ ID NO: 1225197 - RNA, 14 nt, Mycobacterium leprae
acugcuugggcgcu

SEQ ID NO: 1225198 - RNA, 18 nt, Mycobacterium leprae
agaaccuauucaaccggu

SEQ ID NO: 1225199 - RNA, 20 nt, Mycobacterium leprae
agaagcagcuauagggcacg

SEQ ID NO: 1225200 - RNA, 13 nt, Mycobacterium leprae
agacuucagcgag

SEQ ID NO: 1225201 - RNA, 20 nt, Mycobacterium leprae
agauaacccgugucgaccga

SEQ ID NO: 1225202 - RNA, 14 nt, Mycobacterium leprae
agaccacggcagcg

SEQ ID NO: 1225203 - RNA, 16 nt, Mycobacterium leprae
agaccaugagcacacg

SEQ ID NO: 1225204 - RNA, 19 nt, Mycobacterium leprae
agaccaugagcacacgcug

SEQ ID NO: 1225205 - RNA, 13 nt, Mycobacterium leprae
agaccugccggug

SEQ ID NO: 1225206 - RNA, 14 nt, Mycobacterium leprae
agacgcgaccgcca

SEQ ID NO: 1225207 - RNA, 20 nt, Mycobacterium leprae
agacgcgaccgccaccagau

SEQ ID NO: 1225208 - RNA, 19 nt, Mycobacterium leprae
agcaucuggccgugcggcg

SEQ ID NO: 1225209 - RNA, 16 nt, Mycobacterium leprae
agcauagcggccgcca

SEQ ID NO: 1225210 - RNA, 15 nt, Mycobacterium leprae
agccacccgcaucgu

SEQ ID NO: 1225211 - RNA, 17 nt, Mycobacterium leprae
agcaugugaggucauua

SEQ ID NO: 1225212 - RNA, 14 nt, Mycobacterium leprae
agcaggucgccgac

SEQ ID NO: 1225213 - RNA, 20 nt, Mycobacterium leprae
agcagcuauagggcacgcug

SEQ ID NO: 1225214 - RNA, 21 nt, Mycobacterium leprae
agcagcuauagggcacgcugu

SEQ ID NO: 1225215 - RNA, 14 nt, Mycobacterium leprae
agcagcucgggcuc

SEQ ID NO: 1225216 - RNA, 17 nt, Mycobacterium leprae
agauccggccguugaga

SEQ ID NO: 1225217 - RNA, 21 nt, Mycobacterium leprae
agauugcagcccugagcacca

SEQ ID NO: 1225218 - RNA, 17 nt, Mycobacterium leprae
agauugcaguccaccag

SEQ ID NO: 1225219 - RNA, 21 nt, Mycobacterium leprae
agauugacgucgguguggugc

SEQ ID NO: 1225220 - RNA, 13 nt, Mycobacterium leprae
agcaagccgccag

SEQ ID NO: 1225221 - RNA, 17 nt, Mycobacterium leprae
agcacaaaauucucgcg

SEQ ID NO: 1225222 - RNA, 14 nt, Mycobacterium leprae
agcacuucgcccug

SEQ ID NO: 1225223 - RNA, 17 nt, Mycobacterium leprae
agcacugcaguaaccga

SEQ ID NO: 1225224 - RNA, 13 nt, Mycobacterium leprae
agcacgaugacau

SEQ ID NO: 1225225 - RNA, 18 nt, Mycobacterium leprae
agcaccaagucuucgaug

SEQ ID NO: 1225226 - RNA, 15 nt, Mycobacterium leprae
agcaccgcgccgguc

SEQ ID NO: 1225227 - RNA, 23 nt, Mycobacterium leprae
auauaccugcgucgcuucaucgu

SEQ ID NO: 1225228 - RNA, 21 nt, Mycobacterium leprae
auaguuguuagcgccgcgggg

SEQ ID NO: 1225229 - RNA, 14 nt, Mycobacterium leprae
auagggcacgcugu

SEQ ID NO: 1225230 - RNA, 18 nt, Mycobacterium leprae
auacgguuauugacguga

SEQ ID NO: 1225231 - RNA, 23 nt, Mycobacterium leprae
auaacccccaacugguugaagcg

SEQ ID NO: 1225232 - RNA, 19 nt, Mycobacterium leprae
auaccguggucggugccga

SEQ ID NO: 1225233 - RNA, 18 nt, Mycobacterium leprae
auaccggcgaaucggucu

SEQ ID NO: 1225234 - RNA, 20 nt, Mycobacterium leprae
auaccggugaugucggcguc

SEQ ID NO: 1225235 - RNA, 15 nt, Mycobacterium leprae
agugggcccucacgu

SEQ ID NO: 1225236 - RNA, 21 nt, Mycobacterium leprae
aguggcugaugucuuggcuga

SEQ ID NO: 1225237 - RNA, 17 nt, Mycobacterium leprae
aguggcugcaccggcuc

SEQ ID NO: 1225238 - RNA, 15 nt, Mycobacterium leprae
agugcgccagcgaca

SEQ ID NO: 1225239 - RNA, 15 nt, Mycobacterium leprae
agugcuagcggcgcc

SEQ ID NO: 1225240 - RNA, 13 nt, Mycobacterium leprae
agugauggcggaa

SEQ ID NO: 1225241 - RNA, 11 nt, Mycobacterium leprae
agugacugcgu

SEQ ID NO: 1225242 - RNA, 14 nt, Mycobacterium leprae
agugccgcggucua

SEQ ID NO: 1225243 - RNA, 23 nt, Mycobacterium leprae
agugccgaccuagcuucgaucca

SEQ ID NO: 1225244 - RNA, 18 nt, Mycobacterium leprae
agucuugaacucaucguc

SEQ ID NO: 1225245 - RNA, 18 nt, Mycobacterium leprae
agucggcuuugcgguuga

SEQ ID NO: 1225246 - RNA, 21 nt, Mycobacterium leprae
agucgggcuuggccucgaggu

SEQ ID NO: 1225247 - RNA, 15 nt, Mycobacterium leprae
agucguggagcaccu

SEQ ID NO: 1225248 - RNA, 22 nt, Mycobacterium leprae
agucgcgucuuugcuggucagc

SEQ ID NO: 1225249 - RNA, 15 nt, Mycobacterium leprae
agucggagugucucu

SEQ ID NO: 1225250 - RNA, 16 nt, Mycobacterium leprae
agucgccuacaccagc

SEQ ID NO: 1225251 - RNA, 14 nt, Mycobacterium leprae
aguccgcucaggug

SEQ ID NO: 1225252 - RNA, 14 nt, Mycobacterium leprae
agucagcaucgggu

SEQ ID NO: 1225253 - RNA, 17 nt, Mycobacterium leprae
aguaguucacggucacc

SEQ ID NO: 1225254 - RNA, 18 nt, Mycobacterium leprae
aguacggcggcgauccuc

SEQ ID NO: 1225255 - RNA, 15 nt, Mycobacterium leprae
aguagcaagccgcca

SEQ ID NO: 1225256 - RNA, 16 nt, Mycobacterium leprae
aggucgcgcugccgga

SEQ ID NO: 1225257 - RNA, 23 nt, Mycobacterium leprae
aggcuguccuugccggcgccgcu

SEQ ID NO: 1225258 - RNA, 15 nt, Mycobacterium leprae
aggcguccucauccc

SEQ ID NO: 1225259 - RNA, 18 nt, Mycobacterium leprae
aggcgucaagcagcacca

SEQ ID NO: 1225260 - RNA, 16 nt, Mycobacterium leprae
aggccuggucguucau

SEQ ID NO: 1225261 - RNA, 18 nt, Mycobacterium leprae
agguaagauuccaauguc

SEQ ID NO: 1225262 - RNA, 21 nt, Mycobacterium leprae
agggcugguggccgaggucga

SEQ ID NO: 1225263 - RNA, 18 nt, Mycobacterium leprae
aggcacaacaucaccacg

SEQ ID NO: 1225264 - RNA, 14 nt, Mycobacterium leprae
aggcagcgccugcc

SEQ ID NO: 1225265 - RNA, 17 nt, Mycobacterium leprae
aggcauacagugcaccg

SEQ ID NO: 1225266 - RNA, 16 nt, Mycobacterium leprae
agcuuccucgugugcu

SEQ ID NO: 1225267 - RNA, 13 nt, Mycobacterium leprae
aggaagauauccg

SEQ ID NO: 1225268 - RNA, 21 nt, Mycobacterium leprae
aggaacgacggauaaguccac

SEQ ID NO: 1225269 - RNA, 20 nt, Mycobacterium leprae
agcgucccaaccaaucuccg

SEQ ID NO: 1225270 - RNA, 13 nt, Mycobacterium leprae
agcuggccaagcg

SEQ ID NO: 1225271 - RNA, 16 nt, Mycobacterium leprae
agcugugccgacacca

SEQ ID NO: 1225272 - RNA, 13 nt, Mycobacterium leprae
caauucacgaaca

SEQ ID NO: 1225273 - RNA, 15 nt, Mycobacterium leprae
caauucucagcggaa

SEQ ID NO: 1225274 - RNA, 20 nt, Mycobacterium leprae
caauucgccgacucgcgauc

SEQ ID NO: 1225275 - RNA, 24 nt, Mycobacterium leprae
caauucggcgauauccgccggccg

SEQ ID NO: 1225276 - RNA, 17 nt, Mycobacterium leprae
caaucuuuacgcgcgcc

SEQ ID NO: 1225277 - RNA, 15 nt, Mycobacterium leprae
caaggucggugggca

SEQ ID NO: 1225278 - RNA, 20 nt, Mycobacterium leprae
caaggucguuagcgccgaga

SEQ ID NO: 1225279 - RNA, 13 nt, Mycobacterium leprae
cacaaccaucgcu

SEQ ID NO: 1225280 - RNA, 22 nt, Mycobacterium leprae
cacacgacagccgcaaucgccg

SEQ ID NO: 1225281 - RNA, 16 nt, Mycobacterium leprae
cacagcaucaacgcgu

SEQ ID NO: 1225282 - RNA, 14 nt, Mycobacterium leprae
cacagcaggcgagu

SEQ ID NO: 1225283 - RNA, 20 nt, Mycobacterium leprae
cacagauucguaccgcgcaa

SEQ ID NO: 1225284 - RNA, 22 nt, Mycobacterium leprae
cacagcaagauuacccgcggug

SEQ ID NO: 1225285 - RNA, 16 nt, Mycobacterium leprae
cacagcaagcagaucg

SEQ ID NO: 1225286 - RNA, 17 nt, Mycobacterium leprae
cacagagcgcucggcgu

SEQ ID NO: 1225287 - RNA, 17 nt, Mycobacterium leprae
cacauugaccacgccga

SEQ ID NO: 1225288 - RNA, 14 nt, Mycobacterium leprae
caccaaacccgccg

SEQ ID NO: 1225289 - RNA, 15 nt, Mycobacterium leprae
caccaagucuucgau

SEQ ID NO: 1225290 - RNA, 14 nt, Mycobacterium leprae
caccaauccagcca

SEQ ID NO: 1225291 - RNA, 15 nt, Mycobacterium leprae
cacaguuguuggccu

SEQ ID NO: 1225292 - RNA, 21 nt, Mycobacterium leprae
cacaugcaacuaugcggcggg

SEQ ID NO: 1225293 - RNA, 22 nt, Mycobacterium leprae
cacaggaauuuagaggcugcac

SEQ ID NO: 1225294 - RNA, 15 nt, Mycobacterium leprae
caccaguaaccacgc

SEQ ID NO: 1225295 - RNA, 16 nt, Mycobacterium leprae
caccaguaaccacgca

SEQ ID NO: 1225296 - RNA, 20 nt, Mycobacterium leprae
caccaguggcucgccgcgca

SEQ ID NO: 1225297 - RNA, 14 nt, Mycobacterium leprae
caccauaccgacga

SEQ ID NO: 1225298 - RNA, 17 nt, Mycobacterium leprae
caccauccacaacguca

SEQ ID NO: 1225299 - RNA, 18 nt, Mycobacterium leprae
caccaugcggcggacgau

SEQ ID NO: 1225300 - RNA, 15 nt, Mycobacterium leprae
caccauggugaacaa

SEQ ID NO: 1225301 - RNA, 19 nt, Mycobacterium leprae
caccauggugaacaacgca

SEQ ID NO: 1225302 - RNA, 17 nt, Mycobacterium leprae
cacccggcggcaugccu

SEQ ID NO: 1225303 - RNA, 18 nt, Mycobacterium leprae
caccauuucugccgcugg

SEQ ID NO: 1225304 - RNA, 18 nt, Mycobacterium leprae
caccccgggcacagcggu

SEQ ID NO: 1225305 - RNA, 16 nt, Mycobacterium leprae
caccgcaacgccucca

SEQ ID NO: 1225306 - RNA, 17 nt, Mycobacterium leprae
caccgcaacgccuccac

SEQ ID NO: 1225307 - RNA, 22 nt, Mycobacterium leprae
caccgagcgaccugacccgacg

SEQ ID NO: 1225308 - RNA, 18 nt, Mycobacterium leprae
caccgaugugcucgguca

SEQ ID NO: 1225309 - RNA, 15 nt, Mycobacterium leprae
caccgauuccggugg

SEQ ID NO: 1225310 - RNA, 20 nt, Mycobacterium leprae
caccgcgaagcugaccacuc

SEQ ID NO: 1225311 - RNA, 16 nt, Mycobacterium leprae
caccgcgaacgccucg

SEQ ID NO: 1225312 - RNA, 19 nt, Mycobacterium leprae
caccgccgagcgcaccaac

SEQ ID NO: 1225313 - RNA, 19 nt, Mycobacterium leprae
caagcgguuguccggcgcg

SEQ ID NO: 1225314 - RNA, 16 nt, Mycobacterium leprae
caacugaguagcggcg

SEQ ID NO: 1225315 - RNA, 15 nt, Mycobacterium leprae
caacggcgccgacaa

SEQ ID NO: 1225316 - RNA, 15 nt, Mycobacterium leprae
caacgggugucugaa

SEQ ID NO: 1225317 - RNA, 21 nt, Mycobacterium leprae
caacgggugucugaacuggug

SEQ ID NO: 1225318 - RNA, 17 nt, Mycobacterium leprae
caacggugagcggcaga

SEQ ID NO: 1225319 - RNA, 12 nt, Mycobacterium leprae
caagacugcacc

SEQ ID NO: 1225320 - RNA, 18 nt, Mycobacterium leprae
caaagucgcgggcuugcu

SEQ ID NO: 1225321 - RNA, 21 nt, Mycobacterium leprae
caacacgugcugaggguggcg

SEQ ID NO: 1225322 - RNA, 12 nt, Mycobacterium leprae
caaccagccaau

SEQ ID NO: 1225323 - RNA, 18 nt, Mycobacterium leprae
caaccagccaaucuuuac

SEQ ID NO: 1225324 - RNA, 13 nt, Mycobacterium leprae
caacgaccagcgc

SEQ ID NO: 1225325 - RNA, 13 nt, Mycobacterium leprae
caacgcggcggcg

SEQ ID NO: 1225326 - RNA, 15 nt, Mycobacterium leprae
auuuucuugugaguu

SEQ ID NO: 1225327 - RNA, 20 nt, Mycobacterium leprae
caaacaccggcgggccgaug

SEQ ID NO: 1225328 - RNA, 19 nt, Mycobacterium leprae
caaaacgucgaucucgacg

SEQ ID NO: 1225329 - RNA, 13 nt, Mycobacterium leprae
caaacgaccggau

SEQ ID NO: 1225330 - RNA, 16 nt, Mycobacterium leprae
caaacgcugcgcgcag

SEQ ID NO: 1225331 - RNA, 13 nt, Mycobacterium leprae
caaagcagcauau

SEQ ID NO: 1225332 - RNA, 16 nt, Mycobacterium leprae
auuugcacgcugguug

SEQ ID NO: 1225333 - RNA, 21 nt, Mycobacterium leprae
auuucgacggcaacggcacca

SEQ ID NO: 1225334 - RNA, 14 nt, Mycobacterium leprae
auuucggacgugga

SEQ ID NO: 1225335 - RNA, 15 nt, Mycobacterium leprae
auuaccucggucacc

SEQ ID NO: 1225336 - RNA, 13 nt, Mycobacterium leprae
augcucgaccagg

SEQ ID NO: 1225337 - RNA, 14 nt, Mycobacterium leprae
augcucugcugauc

SEQ ID NO: 1225338 - RNA, 11 nt, Mycobacterium leprae
auggccgccag

SEQ ID NO: 1225339 - RNA, 17 nt, Mycobacterium leprae
auggccgccaggucagc

SEQ ID NO: 1225340 - RNA, 15 nt, Mycobacterium leprae
auggcggcagcgcca

SEQ ID NO: 1225341 - RNA, 19 nt, Mycobacterium leprae
auggugccgagcgcaucgg

SEQ ID NO: 1225342 - RNA, 17 nt, Mycobacterium leprae
auggugccauugguggg

SEQ ID NO: 1225343 - RNA, 15 nt, Mycobacterium leprae
auggucgucgcugcu

SEQ ID NO: 1225344 - RNA, 17 nt, Mycobacterium leprae
auggucauuuggugguu

SEQ ID NO: 1225345 - RNA, 19 nt, Mycobacterium leprae
augguccaacgugguuggc

SEQ ID NO: 1225346 - RNA, 12 nt, Mycobacterium leprae
augucgaagggc

SEQ ID NO: 1225347 - RNA, 16 nt, Mycobacterium leprae
augucgauggcggugu

SEQ ID NO: 1225348 - RNA, 21 nt, Mycobacterium leprae
augucgcgauggggggcagca

SEQ ID NO: 1225349 - RNA, 23 nt, Mycobacterium leprae
augcgaucgcagucaucaccccg

SEQ ID NO: 1225350 - RNA, 14 nt, Mycobacterium leprae
augccgugguaguc

SEQ ID NO: 1225351 - RNA, 21 nt, Mycobacterium leprae
augcguugucgucggccgcgg

SEQ ID NO: 1225352 - RNA, 22 nt, Mycobacterium leprae
augcgcuaagguggagcgaccg

SEQ ID NO: 1225353 - RNA, 19 nt, Mycobacterium leprae
augccggauuccgaacgac

SEQ ID NO: 1225354 - RNA, 14 nt, Mycobacterium leprae
augagcaucgagga

SEQ ID NO: 1225355 - RNA, 21 nt, Mycobacterium leprae
aucugaugacgcgacgccggc

SEQ ID NO: 1225356 - RNA, 17 nt, Mycobacterium leprae
augacgucccggcaccg

SEQ ID NO: 1225357 - RNA, 15 nt, Mycobacterium leprae
augcaacuaugcggc

SEQ ID NO: 1225358 - RNA, 19 nt, Mycobacterium leprae
augcacgccggcgucgcac

SEQ ID NO: 1225359 - RNA, 17 nt, Mycobacterium leprae
augccaucgggccagag

SEQ ID NO: 1225360 - RNA, 17 nt, Mycobacterium leprae
augccaucagaagacca

SEQ ID NO: 1225361 - RNA, 14 nt, Mycobacterium leprae
augcccaugccagc

SEQ ID NO: 1225362 - RNA, 16 nt, Mycobacterium leprae
augcccugggccagcg

SEQ ID NO: 1225363 - RNA, 12 nt, Mycobacterium leprae
aucgcggcugcc

SEQ ID NO: 1225364 - RNA, 14 nt, Mycobacterium leprae
aucgcggcgcgcuc

SEQ ID NO: 1225365 - RNA, 16 nt, Mycobacterium leprae
aucgcguuugcaguga

SEQ ID NO: 1225366 - RNA, 14 nt, Mycobacterium leprae
aucgcuuaucaugc

SEQ ID NO: 1225367 - RNA, 22 nt, Mycobacterium leprae
aucgcgucggcauaucgaccgc

SEQ ID NO: 1225368 - RNA, 22 nt, Mycobacterium leprae
aucgcgucgcaucgguggcacg

SEQ ID NO: 1225369 - RNA, 17 nt, Mycobacterium leprae
aucgcacacagcggcca

SEQ ID NO: 1225370 - RNA, 21 nt, Mycobacterium leprae
aucgcaacccuuuugcccaau

SEQ ID NO: 1225371 - RNA, 23 nt, Mycobacterium leprae
aucgcaaaacaacguaccuaagc

SEQ ID NO: 1225372 - RNA, 22 nt, Mycobacterium leprae
aucgaucccacugacgccgauu

SEQ ID NO: 1225373 - RNA, 15 nt, Mycobacterium leprae
aucgcaccggcugca

SEQ ID NO: 1225374 - RNA, 15 nt, Mycobacterium leprae
aucgcagugcguauu

SEQ ID NO: 1225375 - RNA, 14 nt, Mycobacterium leprae
aucgcauucgugag

SEQ ID NO: 1225376 - RNA, 19 nt, Mycobacterium leprae
aucgguaccagcggcagcg

SEQ ID NO: 1225377 - RNA, 14 nt, Mycobacterium leprae
aucgguccuugacc

SEQ ID NO: 1225378 - RNA, 18 nt, Mycobacterium leprae
aucggcauauccgccccg

SEQ ID NO: 1225379 - RNA, 14 nt, Mycobacterium leprae
aucucaucgucucg

SEQ ID NO: 1225380 - RNA, 22 nt, Mycobacterium leprae
aucucaacauggaccaccguug

SEQ ID NO: 1225381 - RNA, 15 nt, Mycobacterium leprae
aucguaggucgcccg

SEQ ID NO: 1225382 - RNA, 20 nt, Mycobacterium leprae
aucguauagcacacgaccgu

SEQ ID NO: 1225383 - RNA, 23 nt, Mycobacterium leprae
auccacgccgauaucgaccagcc

SEQ ID NO: 1225384 - RNA, 16 nt, Mycobacterium leprae
aucaucgaucagaccc

SEQ ID NO: 1225385 - RNA, 15 nt, Mycobacterium leprae
auccgccggccgcac

SEQ ID NO: 1225386 - RNA, 16 nt, Mycobacterium leprae
auccgccggccgcacc

SEQ ID NO: 1225387 - RNA, 22 nt, Mycobacterium leprae
auccgccggccgcacccggcag

SEQ ID NO: 1225388 - RNA, 23 nt, Mycobacterium leprae
auccacugcgaacuaguguucgg

SEQ ID NO: 1225389 - RNA, 18 nt, Mycobacterium leprae
aucccacugacgccgauu

SEQ ID NO: 1225390 - RNA, 17 nt, Mycobacterium leprae
ccauauagcgucccagc

SEQ ID NO: 1225391 - RNA, 21 nt, Mycobacterium leprae
ccagugcggcgauccagcgaa

SEQ ID NO: 1225392 - RNA, 12 nt, Mycobacterium leprae
ccaggcgacguc

SEQ ID NO: 1225393 - RNA, 18 nt, Mycobacterium leprae
ccaggauggugccauccg

SEQ ID NO: 1225394 - RNA, 12 nt, Mycobacterium leprae
cccacaacgcca

SEQ ID NO: 1225395 - RNA, 22 nt, Mycobacterium leprae
ccaucuggcgacucggcgccau

SEQ ID NO: 1225396 - RNA, 23 nt, Mycobacterium leprae
ccaugccucuagcaaggcgcggu

SEQ ID NO: 1225397 - RNA, 23 nt, Mycobacterium leprae
cccaggggggcgcggucgccgau

SEQ ID NO: 1225398 - RNA, 20 nt, Mycobacterium leprae
cccaguucgugauggucgaa

SEQ ID NO: 1225399 - RNA, 14 nt, Mycobacterium leprae
cccaucggcggcca

SEQ ID NO: 1225400 - RNA, 13 nt, Mycobacterium leprae
cccagcaguuacu

SEQ ID NO: 1225401 - RNA, 14 nt, Mycobacterium leprae
cccacagcugcgca

SEQ ID NO: 1225402 - RNA, 13 nt, Mycobacterium leprae
cccacucggcggu

SEQ ID NO: 1225403 - RNA, 13 nt, Mycobacterium leprae
cccagaacugguc

SEQ ID NO: 1225404 - RNA, 21 nt, Mycobacterium leprae
cccgaccggcccgaaagaugc

SEQ ID NO: 1225405 - RNA, 19 nt, Mycobacterium leprae
cccgaaaaccccacacuga

SEQ ID NO: 1225406 - RNA, 13 nt, Mycobacterium leprae
cccgcuggugcgu

SEQ ID NO: 1225407 - RNA, 11 nt, Mycobacterium leprae
cccgcgacggc

SEQ ID NO: 1225408 - RNA, 13 nt, Mycobacterium leprae
ccgaagccgccag

SEQ ID NO: 1225409 - RNA, 12 nt, Mycobacterium leprae
ccgaaccgggca

SEQ ID NO: 1225410 - RNA, 14 nt, Mycobacterium leprae
cccuggccggcaca

SEQ ID NO: 1225411 - RNA, 14 nt, Mycobacterium leprae
ccgaaaccagggua

SEQ ID NO: 1225412 - RNA, 20 nt, Mycobacterium leprae
ccgaaaacacgggcaccaga

SEQ ID NO: 1225413 - RNA, 15 nt, Mycobacterium leprae
cccugcgaacugcgc

SEQ ID NO: 1225414 - RNA, 18 nt, Mycobacterium leprae
cccucuuugaucagcaag

SEQ ID NO: 1225415 - RNA, 15 nt, Mycobacterium leprae
cccucccagccaucg

SEQ ID NO: 1225416 - RNA, 17 nt, Mycobacterium leprae
cccggacggcccagcac

SEQ ID NO: 1225417 - RNA, 16 nt, Mycobacterium leprae
cccggauacagcacgg

SEQ ID NO: 1225418 - RNA, 21 nt, Mycobacterium leprae
cccggcggccaauucgccgac

SEQ ID NO: 1225419 - RNA, 15 nt, Mycobacterium leprae
cccgggucgagcagc

SEQ ID NO: 1225420 - RNA, 20 nt, Mycobacterium leprae
cccggugacaucaccggaug

SEQ ID NO: 1225421 - RNA, 22 nt, Mycobacterium leprae
cccguagaacacguucuugcca

SEQ ID NO: 1225422 - RNA, 17 nt, Mycobacterium leprae
ccaacccgggucauaca

SEQ ID NO: 1225423 - RNA, 20 nt, Mycobacterium leprae
ccaaaccgaagaucaccgcc

SEQ ID NO: 1225424 - RNA, 16 nt, Mycobacterium leprae
cauuugucaucggcgu

SEQ ID NO: 1225425 - RNA, 14 nt, Mycobacterium leprae
cauuugcgcggcgu

SEQ ID NO: 1225426 - RNA, 20 nt, Mycobacterium leprae
cauugccaucgaacggcggg

SEQ ID NO: 1225427 - RNA, 21 nt, Mycobacterium leprae
cauugccggugauuucggcgg

SEQ ID NO: 1225428 - RNA, 18 nt, Mycobacterium leprae
cauuggacccagccgucg

SEQ ID NO: 1225429 - RNA, 15 nt, Mycobacterium leprae
cauuggcucgacauu

SEQ ID NO: 1225430 - RNA, 18 nt, Mycobacterium leprae
cauugggucaucggcguc

SEQ ID NO: 1225431 - RNA, 21 nt, Mycobacterium leprae
cauucgugagccuaugcggcc

SEQ ID NO: 1225432 - RNA, 16 nt, Mycobacterium leprae
caugucgaacaaccga

SEQ ID NO: 1225433 - RNA, 15 nt, Mycobacterium leprae
caugucccggugcug

SEQ ID NO: 1225434 - RNA, 18 nt, Mycobacterium leprae
ccaacgugaccagcuccg

SEQ ID NO: 1225435 - RNA, 16 nt, Mycobacterium leprae
ccaacuagucgcccgg

SEQ ID NO: 1225436 - RNA, 13 nt, Mycobacterium leprae
ccaacgcgcaccu

SEQ ID NO: 1225437 - RNA, 15 nt, Mycobacterium leprae
ccacaucaucgauca

SEQ ID NO: 1225438 - RNA, 21 nt, Mycobacterium leprae
ccaccaguggcucgccgcgca

SEQ ID NO: 1225439 - RNA, 15 nt, Mycobacterium leprae
cauggcacugccgau

SEQ ID NO: 1225440 - RNA, 13 nt, Mycobacterium leprae
cauggaagccgcc

SEQ ID NO: 1225441 - RNA, 21 nt, Mycobacterium leprae
cauggacaaccugggcggcau

SEQ ID NO: 1225442 - RNA, 21 nt, Mycobacterium leprae
cauggacgauaucgcuaaggc

SEQ ID NO: 1225443 - RNA, 21 nt, Mycobacterium leprae
caugccgaucagccgcaacaa

SEQ ID NO: 1225444 - RNA, 17 nt, Mycobacterium leprae
caugcgccuccagcucg

SEQ ID NO: 1225445 - RNA, 22 nt, Mycobacterium leprae
caugguagugcacacggccgug

SEQ ID NO: 1225446 - RNA, 16 nt, Mycobacterium leprae
caugcccugggccagc

SEQ ID NO: 1225447 - RNA, 20 nt, Mycobacterium leprae
caugcccugggccagcgauc

SEQ ID NO: 1225448 - RNA, 16 nt, Mycobacterium leprae
caugagccggucggag

SEQ ID NO: 1225449 - RNA, 18 nt, Mycobacterium leprae
caugagccgaaucgguac

SEQ ID NO: 1225450 - RNA, 16 nt, Mycobacterium leprae
caugauccagcuguca

SEQ ID NO: 1225451 - RNA, 16 nt, Mycobacterium leprae
caucugauugaucggu

SEQ ID NO: 1225452 - RNA, 20 nt, Mycobacterium leprae
caucuuuucucaagcgggca

SEQ ID NO: 1225453 - RNA, 21 nt, Mycobacterium leprae
caucgucgggugcgcagcaau

SEQ ID NO: 1225454 - RNA, 15 nt, Mycobacterium leprae
cauccguccaccccg

SEQ ID NO: 1225455 - RNA, 21 nt, Mycobacterium leprae
cauccggcguuaaacgcgauc

SEQ ID NO: 1225456 - RNA, 13 nt, Mycobacterium leprae
cauccgggccaga

SEQ ID NO: 1225457 - RNA, 13 nt, Mycobacterium leprae
cauccgggccagu

SEQ ID NO: 1225458 - RNA, 15 nt, Mycobacterium leprae
caucgguaucggcau

SEQ ID NO: 1225459 - RNA, 14 nt, Mycobacterium leprae
caucgggccagagc

SEQ ID NO: 1225460 - RNA, 13 nt, Mycobacterium leprae
ccacgucgccggu

SEQ ID NO: 1225461 - RNA, 23 nt, Mycobacterium leprae
ccacgucgccgguagcagcggua

SEQ ID NO: 1225462 - RNA, 23 nt, Mycobacterium leprae
ccagauccaucggacaagccguu

SEQ ID NO: 1225463 - RNA, 19 nt, Mycobacterium leprae
ccagacaucggaaucgccg

SEQ ID NO: 1225464 - RNA, 18 nt, Mycobacterium leprae
ccagacgcgaccgccacc

SEQ ID NO: 1225465 - RNA, 20 nt, Mycobacterium leprae
ccaccgucgguacuguuggu

SEQ ID NO: 1225466 - RNA, 23 nt, Mycobacterium leprae
ccaccugcauggacgauaucgcu

SEQ ID NO: 1225467 - RNA, 17 nt, Mycobacterium leprae
ccaccuggucaccaacc

SEQ ID NO: 1225468 - RNA, 14 nt, Mycobacterium leprae
ccacgacaucguug

SEQ ID NO: 1225469 - RNA, 15 nt, Mycobacterium leprae
ccagcccggcgugca

SEQ ID NO: 1225470 - RNA, 16 nt, Mycobacterium leprae
ccagccagaccaacau

SEQ ID NO: 1225471 - RNA, 21 nt, Mycobacterium leprae
ccagccaacauagucauugcc

SEQ ID NO: 1225472 - RNA, 13 nt, Mycobacterium leprae
ccagccaacggga

SEQ ID NO: 1225473 - RNA, 19 nt, Mycobacterium leprae
ccagcaguggucggcgaag

SEQ ID NO: 1225474 - RNA, 19 nt, Mycobacterium leprae
ccagcaucaacgccagcaa

SEQ ID NO: 1225475 - RNA, 12 nt, Mycobacterium leprae
ccagaugccguu

SEQ ID NO: 1225476 - RNA, 16 nt, Mycobacterium leprae
ccagauggcgccaaga

SEQ ID NO: 1225477 - RNA, 18 nt, Mycobacterium leprae
ccagcguaaacgugaugc

SEQ ID NO: 1225478 - RNA, 15 nt, Mycobacterium leprae
ccagccgcagcaccc

SEQ ID NO: 1225479 - RNA, 11 nt, Mycobacterium leprae
ccagcgcaccc

SEQ ID NO: 1225480 - RNA, 14 nt, Mycobacterium leprae
ccagcgcagcccgc

SEQ ID NO: 1225481 - RNA, 17 nt, Mycobacterium leprae
ccagcgcaucagccaac

SEQ ID NO: 1225482 - RNA, 17 nt, Mycobacterium leprae
cagugggggugcggcag

SEQ ID NO: 1225483 - RNA, 19 nt, Mycobacterium leprae
caguugcucgucaucgacg

SEQ ID NO: 1225484 - RNA, 22 nt, Mycobacterium leprae
cagucgccagagccggcggguu

SEQ ID NO: 1225485 - RNA, 15 nt, Mycobacterium leprae
cauacuggcacgcca

SEQ ID NO: 1225486 - RNA, 23 nt, Mycobacterium leprae
cauaguccagucgcgcaccgcga

SEQ ID NO: 1225487 - RNA, 14 nt, Mycobacterium leprae
cauccaccgccgag

SEQ ID NO: 1225488 - RNA, 13 nt, Mycobacterium leprae
caucccugggccg

SEQ ID NO: 1225489 - RNA, 21 nt, Mycobacterium leprae
caucccgaagugaucggcgac

SEQ ID NO: 1225490 - RNA, 13 nt, Mycobacterium leprae
caucagucagcau

SEQ ID NO: 1225491 - RNA, 23 nt, Mycobacterium leprae
caucagauucacagucggcgcag

SEQ ID NO: 1225492 - RNA, 15 nt, Mycobacterium leprae
cauaucgcgcaacga

SEQ ID NO: 1225493 - RNA, 14 nt, Mycobacterium leprae
caucacacggcgcg

SEQ ID NO: 1225494 - RNA, 15 nt, Mycobacterium leprae
cagucagucaccacu

SEQ ID NO: 1225495 - RNA, 20 nt, Mycobacterium leprae
cagucaguuuggcgcugcug

SEQ ID NO: 1225496 - RNA, 23 nt, Mycobacterium leprae
cagguuguggcaccagucgcgca

SEQ ID NO: 1225497 - RNA, 14 nt, Mycobacterium leprae
cagguccaacgcgg

SEQ ID NO: 1225498 - RNA, 19 nt, Mycobacterium leprae
cagggcuguuuggccucca

SEQ ID NO: 1225499 - RNA, 22 nt, Mycobacterium leprae
cagggcuguuuggccuccaagu

SEQ ID NO: 1225500 - RNA, 13 nt, Mycobacterium leprae
caggguacucagc

SEQ ID NO: 1225501 - RNA, 15 nt, Mycobacterium leprae
cagggccgaagcagc

SEQ ID NO: 1225502 - RNA, 21 nt, Mycobacterium leprae
cagggccgaagcagccggggu

SEQ ID NO: 1225503 - RNA, 11 nt, Mycobacterium leprae
cagggcgcccc

SEQ ID NO: 1225504 - RNA, 19 nt, Mycobacterium leprae
cagggugacauguacggaa

SEQ ID NO: 1225505 - RNA, 21 nt, Mycobacterium leprae
caggaugcugucgcggagcuc

SEQ ID NO: 1225506 - RNA, 18 nt, Mycobacterium leprae
cagcuguugacugcgaaa

SEQ ID NO: 1225507 - RNA, 20 nt, Mycobacterium leprae
caggccaucagauccggugg

SEQ ID NO: 1225508 - RNA, 18 nt, Mycobacterium leprae
cagcucaggauagcgacu

SEQ ID NO: 1225509 - RNA, 15 nt, Mycobacterium leprae
cagcuccgaagcacc

SEQ ID NO: 1225510 - RNA, 15 nt, Mycobacterium leprae
cagcgucggacgccg

SEQ ID NO: 1225511 - RNA, 18 nt, Mycobacterium leprae
cagcgucggacgccggac

SEQ ID NO: 1225512 - RNA, 16 nt, Mycobacterium leprae
cagcgucccaaccaau

SEQ ID NO: 1225513 - RNA, 17 nt, Mycobacterium leprae
cagcgucccaaccaauc

SEQ ID NO: 1225514 - RNA, 22 nt, Mycobacterium leprae
cagcgucgcucacggccaccau

SEQ ID NO: 1225515 - RNA, 18 nt, Mycobacterium leprae
cagcggcccaacccggcc

SEQ ID NO: 1225516 - RNA, 18 nt, Mycobacterium leprae
cagcggcagcggcggccg

SEQ ID NO: 1225517 - RNA, 17 nt, Mycobacterium leprae
cagcggcuaugacccga

SEQ ID NO: 1225518 - RNA, 19 nt, Mycobacterium leprae
cagcgcggcaucgucggca

SEQ ID NO: 1225519 - RNA, 16 nt, Mycobacterium leprae
cagcgagaagccccau

SEQ ID NO: 1225520 - RNA, 13 nt, Mycobacterium leprae
cagcgacuggauc

SEQ ID NO: 1225521 - RNA, 21 nt, Mycobacterium leprae
cagauggcuccccgagccgcu

SEQ ID NO: 1225522 - RNA, 16 nt, Mycobacterium leprae
cagauguugcagcagu

SEQ ID NO: 1225523 - RNA, 15 nt, Mycobacterium leprae
cagcaaugugcgcug

SEQ ID NO: 1225524 - RNA, 14 nt, Mycobacterium leprae
cagcaaucugcguc

SEQ ID NO: 1225525 - RNA, 18 nt, Mycobacterium leprae
cagcaaucugcgucaucg

SEQ ID NO: 1225526 - RNA, 21 nt, Mycobacterium leprae
cagcaaucugcgucaucgacu

SEQ ID NO: 1225527 - RNA, 15 nt, Mycobacterium leprae
cagcaauuguucgac

SEQ ID NO: 1225528 - RNA, 16 nt, Mycobacterium leprae
cagcaccacagcgcca

SEQ ID NO: 1225529 - RNA, 19 nt, Mycobacterium leprae
cagcaccauccggcgggcg

SEQ ID NO: 1225530 - RNA, 21 nt, Mycobacterium leprae
cagcaccauggaacagcguuc

SEQ ID NO: 1225531 - RNA, 21 nt, Mycobacterium leprae
cagcaccucgaaucagcaucg

SEQ ID NO: 1225532 - RNA, 16 nt, Mycobacterium leprae
cagcaccugccgcagc

SEQ ID NO: 1225533 - RNA, 21 nt, Mycobacterium leprae
cagcagcguggucaccgcugu

SEQ ID NO: 1225534 - RNA, 21 nt, Mycobacterium leprae
cagcagaaauuuuucggacgg

SEQ ID NO: 1225535 - RNA, 14 nt, Mycobacterium leprae
cagcauucagccgc

SEQ ID NO: 1225536 - RNA, 22 nt, Mycobacterium leprae
cagcauggcgaugcgcagccgc

SEQ ID NO: 1225537 - RNA, 17 nt, Mycobacterium leprae
cagcauuauccgggcug

SEQ ID NO: 1225538 - RNA, 22 nt, Mycobacterium leprae
cagcauauggaaagucagcauc

SEQ ID NO: 1225539 - RNA, 17 nt, Mycobacterium leprae
cagcauccaccaccgac

SEQ ID NO: 1225540 - RNA, 16 nt, Mycobacterium leprae
cagcccgcgccgccgu

SEQ ID NO: 1225541 - RNA, 21 nt, Mycobacterium leprae
cagccgcgggcgaugccaucg

SEQ ID NO: 1225542 - RNA, 14 nt, Mycobacterium leprae
cagccgcgguaacg

SEQ ID NO: 1225543 - RNA, 18 nt, Mycobacterium leprae
cagccggaggguugccga

SEQ ID NO: 1225544 - RNA, 23 nt, Mycobacterium leprae
cagccggaggguugccgacggcc

SEQ ID NO: 1225545 - RNA, 22 nt, Mycobacterium leprae
cagccuccgaaaagcugagccg

SEQ ID NO: 1225546 - RNA, 17 nt, Mycobacterium leprae
cagcgacacagccggcc

SEQ ID NO: 1225547 - RNA, 15 nt, Mycobacterium leprae
cagcgacggcaagcu

SEQ ID NO: 1225548 - RNA, 15 nt, Mycobacterium leprae
cacgacagccgcaau

SEQ ID NO: 1225549 - RNA, 22 nt, Mycobacterium leprae
cacgaccgucuggaacacgauc

SEQ ID NO: 1225550 - RNA, 21 nt, Mycobacterium leprae
caccuggugugcgcgccgccc

SEQ ID NO: 1225551 - RNA, 19 nt, Mycobacterium leprae
caccuggugcccgacagcc

SEQ ID NO: 1225552 - RNA, 16 nt, Mycobacterium leprae
caccuguuucagcgug

SEQ ID NO: 1225553 - RNA, 20 nt, Mycobacterium leprae
caccucgcugcagcauaacc

SEQ ID NO: 1225554 - RNA, 18 nt, Mycobacterium leprae
cacgauacugcugcaccc

SEQ ID NO: 1225555 - RNA, 14 nt, Mycobacterium leprae
cacgagcggccuca

SEQ ID NO: 1225556 - RNA, 23 nt, Mycobacterium leprae
cacgagcggccucagcagcaggc

SEQ ID NO: 1225557 - RNA, 12 nt, Mycobacterium leprae
cacgagccgcau

SEQ ID NO: 1225558 - RNA, 11 nt, Mycobacterium leprae
cacgcaaccaa

SEQ ID NO: 1225559 - RNA, 23 nt, Mycobacterium leprae
cacgcacacgacagccgcaaucg

SEQ ID NO: 1225560 - RNA, 14 nt, Mycobacterium leprae
cacuguccacucgg

SEQ ID NO: 1225561 - RNA, 22 nt, Mycobacterium leprae
cacugucgcgaccaacccggcg

SEQ ID NO: 1225562 - RNA, 18 nt, Mycobacterium leprae
cacugggcugagccgccg

SEQ ID NO: 1225563 - RNA, 20 nt, Mycobacterium leprae
cacuggugcugucauccuca

SEQ ID NO: 1225564 - RNA, 19 nt, Mycobacterium leprae
cacuggcaaguucgucggc

SEQ ID NO: 1225565 - RNA, 14 nt, Mycobacterium leprae
cagaaccgcgguaa

SEQ ID NO: 1225566 - RNA, 13 nt, Mycobacterium leprae
cagaacaccccgc

SEQ ID NO: 1225567 - RNA, 15 nt, Mycobacterium leprae
cacugcagggcgagc

SEQ ID NO: 1225568 - RNA, 21 nt, Mycobacterium leprae
cacugacaugccgagguggca

SEQ ID NO: 1225569 - RNA, 14 nt, Mycobacterium leprae
cacugaucgaucug

SEQ ID NO: 1225570 - RNA, 16 nt, Mycobacterium leprae
cacugcucaggucgac

SEQ ID NO: 1225571 - RNA, 23 nt, Mycobacterium leprae
cacugcucaggucgacgaacgag

SEQ ID NO: 1225572 - RNA, 22 nt, Mycobacterium leprae
cacugcgaguaacuaaggugac

SEQ ID NO: 1225573 - RNA, 15 nt, Mycobacterium leprae
cacucuggcuagccg

SEQ ID NO: 1225574 - RNA, 14 nt, Mycobacterium leprae
cacucgacucaccg

SEQ ID NO: 1225575 - RNA, 17 nt, Mycobacterium leprae
cacgugcacaucagcgc

SEQ ID NO: 1225576 - RNA, 21 nt, Mycobacterium leprae
cacgguguugacccacuggug

SEQ ID NO: 1225577 - RNA, 14 nt, Mycobacterium leprae
cacgucgcugcguc

SEQ ID NO: 1225578 - RNA, 13 nt, Mycobacterium leprae
cacguccucggcc

SEQ ID NO: 1225579 - RNA, 18 nt, Mycobacterium leprae
cacgucgccguuuccgcu

SEQ ID NO: 1225580 - RNA, 13 nt, Mycobacterium leprae
cacggugcaguca

SEQ ID NO: 1225581 - RNA, 23 nt, Mycobacterium leprae
cacggcugacuccguacucacgu

SEQ ID NO: 1225582 - RNA, 21 nt, Mycobacterium leprae
cacggcuuaaguaggcgguca

SEQ ID NO: 1225583 - RNA, 20 nt, Mycobacterium leprae
cacggcgggugaugaucacc

SEQ ID NO: 1225584 - RNA, 12 nt, Mycobacterium leprae
cacggcacaauc

SEQ ID NO: 1225585 - RNA, 19 nt, Mycobacterium leprae
cacgcgaccaacgccgagc

SEQ ID NO: 1225586 - RNA, 14 nt, Mycobacterium leprae
cgacuaagccgccg

SEQ ID NO: 1225587 - RNA, 16 nt, Mycobacterium leprae
cgacucaccgguacac

SEQ ID NO: 1225588 - RNA, 20 nt, Mycobacterium leprae
cgacucaccgguacacaccg

SEQ ID NO: 1225589 - RNA, 21 nt, Mycobacterium leprae
cgacuguggcacccacucggc

SEQ ID NO: 1225590 - RNA, 23 nt, Mycobacterium leprae
cgacuguggcacccacucggcgg

SEQ ID NO: 1225591 - RNA, 18 nt, Mycobacterium leprae
cgacuguauugccguaga

SEQ ID NO: 1225592 - RNA, 18 nt, Mycobacterium leprae
cgacuugccgaagccggg

SEQ ID NO: 1225593 - RNA, 23 nt, Mycobacterium leprae
cgagaagccccauggcacggcga

SEQ ID NO: 1225594 - RNA, 20 nt, Mycobacterium leprae
cgacguagcccacguccuga

SEQ ID NO: 1225595 - RNA, 22 nt, Mycobacterium leprae
cgagcggccucagcagcaggcu

SEQ ID NO: 1225596 - RNA, 18 nt, Mycobacterium leprae
cgagcagccgaccgcccg

SEQ ID NO: 1225597 - RNA, 19 nt, Mycobacterium leprae
cgagaucacaguccugccc

SEQ ID NO: 1225598 - RNA, 21 nt, Mycobacterium leprae
cgagaauuuugugcugcgcgg

SEQ ID NO: 1225599 - RNA, 21 nt, Mycobacterium leprae
cgagaccagggguguugcacc

SEQ ID NO: 1225600 - RNA, 18 nt, Mycobacterium leprae
cgagaccaguugcacauc

SEQ ID NO: 1225601 - RNA, 17 nt, Mycobacterium leprae
cgaccgcuuuuccuucu

SEQ ID NO: 1225602 - RNA, 16 nt, Mycobacterium leprae
cgaccggaccaucguc

SEQ ID NO: 1225603 - RNA, 11 nt, Mycobacterium leprae
cgacaucgcag

SEQ ID NO: 1225604 - RNA, 14 nt, Mycobacterium leprae
cgacaucgcaggug

SEQ ID NO: 1225605 - RNA, 19 nt, Mycobacterium leprae
cgacaucuugaccugccgu

SEQ ID NO: 1225606 - RNA, 14 nt, Mycobacterium leprae
cgaccgcaccggcg

SEQ ID NO: 1225607 - RNA, 15 nt, Mycobacterium leprae
cgaccgacugcagaa

SEQ ID NO: 1225608 - RNA, 15 nt, Mycobacterium leprae
cgaccgaaagccgca

SEQ ID NO: 1225609 - RNA, 14 nt, Mycobacterium leprae
cgacgaucaccgcc

SEQ ID NO: 1225610 - RNA, 17 nt, Mycobacterium leprae
cgaccuugucgagguaa

SEQ ID NO: 1225611 - RNA, 16 nt, Mycobacterium leprae
cgaccuggugacgucg

SEQ ID NO: 1225612 - RNA, 15 nt, Mycobacterium leprae
cgaccugucgauacg

SEQ ID NO: 1225613 - RNA, 15 nt, Mycobacterium leprae
cgaccuucgcgaugu

SEQ ID NO: 1225614 - RNA, 23 nt, Mycobacterium leprae
cgaccgucuggaacacgaucggc

SEQ ID NO: 1225615 - RNA, 15 nt, Mycobacterium leprae
cgaccgucgauaacg

SEQ ID NO: 1225616 - RNA, 20 nt, Mycobacterium leprae
cgacgacucaguggcgggcu

SEQ ID NO: 1225617 - RNA, 14 nt, Mycobacterium leprae
cgaaucagcaucga

SEQ ID NO: 1225618 - RNA, 18 nt, Mycobacterium leprae
cgaaucaugucgaacaac

SEQ ID NO: 1225619 - RNA, 18 nt, Mycobacterium leprae
cgaauaugcccagcagau

SEQ ID NO: 1225620 - RNA, 18 nt, Mycobacterium leprae
cgaauagccgguggccac

SEQ ID NO: 1225621 - RNA, 23 nt, Mycobacterium leprae
cgaauagccgguggccaccgcca

SEQ ID NO: 1225622 - RNA, 22 nt, Mycobacterium leprae
cgaauugaucgggcccagcacc

SEQ ID NO: 1225623 - RNA, 12 nt, Mycobacterium leprae
cgaauucaucga

SEQ ID NO: 1225624 - RNA, 18 nt, Mycobacterium leprae
cgacacuugccgcguucg

SEQ ID NO: 1225625 - RNA, 17 nt, Mycobacterium leprae
cgacagcacccagcuca

SEQ ID NO: 1225626 - RNA, 23 nt, Mycobacterium leprae
cgacagcagguagacgcgcuaaa

SEQ ID NO: 1225627 - RNA, 16 nt, Mycobacterium leprae
cgacaucaccggcggu

SEQ ID NO: 1225628 - RNA, 20 nt, Mycobacterium leprae
cgaaccugacgaacucgccg

SEQ ID NO: 1225629 - RNA, 19 nt, Mycobacterium leprae
cgaacuauccaagacaucg

SEQ ID NO: 1225630 - RNA, 16 nt, Mycobacterium leprae
ccuugaggugucggcg

SEQ ID NO: 1225631 - RNA, 15 nt, Mycobacterium leprae
ccuugaccaccaccg

SEQ ID NO: 1225632 - RNA, 18 nt, Mycobacterium leprae
ccuuccaacgcggccgca

SEQ ID NO: 1225633 - RNA, 13 nt, Mycobacterium leprae
cgaaaaccucacg

SEQ ID NO: 1225634 - RNA, 17 nt, Mycobacterium leprae
cgaaaacccgcgcgugc

SEQ ID NO: 1225635 - RNA, 14 nt, Mycobacterium leprae
ccuugcuggugauc

SEQ ID NO: 1225636 - RNA, 21 nt, Mycobacterium leprae
cgaaaucgacguuugcaggug

SEQ ID NO: 1225637 - RNA, 15 nt, Mycobacterium leprae
cgaaaggguagccgu

SEQ ID NO: 1225638 - RNA, 18 nt, Mycobacterium leprae
ccugguugggcaucgccg

SEQ ID NO: 1225639 - RNA, 13 nt, Mycobacterium leprae
ccugguagguguc

SEQ ID NO: 1225640 - RNA, 18 nt, Mycobacterium leprae
ccugccgccacagcaagu

SEQ ID NO: 1225641 - RNA, 15 nt, Mycobacterium leprae
ccugccuagcaacgu

SEQ ID NO: 1225642 - RNA, 20 nt, Mycobacterium leprae
ccuggcucaggacgaacgcu

SEQ ID NO: 1225643 - RNA, 17 nt, Mycobacterium leprae
ccuggcuggccaucgca

SEQ ID NO: 1225644 - RNA, 15 nt, Mycobacterium leprae
ccuggcugggcugcu

SEQ ID NO: 1225645 - RNA, 14 nt, Mycobacterium leprae
ccuggcgauuuucu

SEQ ID NO: 1225646 - RNA, 23 nt, Mycobacterium leprae
cgauucucgagcggcgcaugcca

SEQ ID NO: 1225647 - RNA, 22 nt, Mycobacterium leprae
cgauguuguagguugaugaggg

SEQ ID NO: 1225648 - RNA, 17 nt, Mycobacterium leprae
cgauuaccacugccgau

SEQ ID NO: 1225649 - RNA, 23 nt, Mycobacterium leprae
cgauuacguuguggcgcgagcgu

SEQ ID NO: 1225650 - RNA, 13 nt, Mycobacterium leprae
cgauuagccgguc

SEQ ID NO: 1225651 - RNA, 12 nt, Mycobacterium leprae
cgauuagcgcgg

SEQ ID NO: 1225652 - RNA, 14 nt, Mycobacterium leprae
cgauuagcgcggcg

SEQ ID NO: 1225653 - RNA, 16 nt, Mycobacterium leprae
cgauuugcucagugac

SEQ ID NO: 1225654 - RNA, 14 nt, Mycobacterium leprae
cgcaaaggccaauc

SEQ ID NO: 1225655 - RNA, 14 nt, Mycobacterium leprae
cgauguacuccgaa

SEQ ID NO: 1225656 - RNA, 14 nt, Mycobacterium leprae
cgaugugcucgguc

SEQ ID NO: 1225657 - RNA, 14 nt, Mycobacterium leprae
cgaugugcagcagc

SEQ ID NO: 1225658 - RNA, 23 nt, Mycobacterium leprae
cgaugugcuuagcauagcggccg

SEQ ID NO: 1225659 - RNA, 23 nt, Mycobacterium leprae
cgaugaccuugaaagcgcgagau

SEQ ID NO: 1225660 - RNA, 12 nt, Mycobacterium leprae
cgaucugcccag

SEQ ID NO: 1225661 - RNA, 19 nt, Mycobacterium leprae
cgaucuggggaaugucgau

SEQ ID NO: 1225662 - RNA, 18 nt, Mycobacterium leprae
cgaucuggucccacggcg

SEQ ID NO: 1225663 - RNA, 21 nt, Mycobacterium leprae
cgaucgcaaauauaauccggc

SEQ ID NO: 1225664 - RNA, 17 nt, Mycobacterium leprae
cgaucgcaccggcugca

SEQ ID NO: 1225665 - RNA, 14 nt, Mycobacterium leprae
cgaucgcacucacc

SEQ ID NO: 1225666 - RNA, 23 nt, Mycobacterium leprae
cgaucguucuuacccgagcugac

SEQ ID NO: 1225667 - RNA, 14 nt, Mycobacterium leprae
cgaucucgacggca

SEQ ID NO: 1225668 - RNA, 15 nt, Mycobacterium leprae
cgaguggcgaacggg

SEQ ID NO: 1225669 - RNA, 20 nt, Mycobacterium leprae
cgaguccgcuaaggcagccc

SEQ ID NO: 1225670 - RNA, 20 nt, Mycobacterium leprae
cgaguacguccgcgccggcg

SEQ ID NO: 1225671 - RNA, 23 nt, Mycobacterium leprae
cgaggugggccccugcggcuaac

SEQ ID NO: 1225672 - RNA, 17 nt, Mycobacterium leprae
cgaguaaugcaggugac

SEQ ID NO: 1225673 - RNA, 19 nt, Mycobacterium leprae
cgaggugucggcgauaacg

SEQ ID NO: 1225674 - RNA, 15 nt, Mycobacterium leprae
cgauacugcugcacc

SEQ ID NO: 1225675 - RNA, 17 nt, Mycobacterium leprae
cgauauucgccggacac

SEQ ID NO: 1225676 - RNA, 21 nt, Mycobacterium leprae
cgaguuggccgagcgucgaau

SEQ ID NO: 1225677 - RNA, 21 nt, Mycobacterium leprae
cgaguugggccaugcagucgc

SEQ ID NO: 1225678 - RNA, 22 nt, Mycobacterium leprae
cgaguuguggcggccgaccaac

SEQ ID NO: 1225679 - RNA, 13 nt, Mycobacterium leprae
cgauacgcaaauc

SEQ ID NO: 1225680 - RNA, 21 nt, Mycobacterium leprae
cgauccgcgugaugauggccu

SEQ ID NO: 1225681 - RNA, 14 nt, Mycobacterium leprae
cgaucagacccuug

SEQ ID NO: 1225682 - RNA, 15 nt, Mycobacterium leprae
cgcauuggucggggu

SEQ ID NO: 1225683 - RNA, 12 nt, Mycobacterium leprae
cgccaagaccua

SEQ ID NO: 1225684 - RNA, 16 nt, Mycobacterium leprae
cgccacaugugcgcca

SEQ ID NO: 1225685 - RNA, 23 nt, Mycobacterium leprae
cgccacagagaagcaaugccaaa

SEQ ID NO: 1225686 - RNA, 15 nt, Mycobacterium leprae
cgcaucgguggcacg

SEQ ID NO: 1225687 - RNA, 16 nt, Mycobacterium leprae
cgcaucgauaagcagc

SEQ ID NO: 1225688 - RNA, 22 nt, Mycobacterium leprae
cgcaguaauccaguccggugcu

SEQ ID NO: 1225689 - RNA, 16 nt, Mycobacterium leprae
cgccaccgaccgccuu

SEQ ID NO: 1225690 - RNA, 13 nt, Mycobacterium leprae
cgccaccgccggu

SEQ ID NO: 1225691 - RNA, 14 nt, Mycobacterium leprae
cgcagaacacgacg

SEQ ID NO: 1225692 - RNA, 16 nt, Mycobacterium leprae
cgcagcaccugccgca

SEQ ID NO: 1225693 - RNA, 21 nt, Mycobacterium leprae
cgcaccgcuucagagugcacc

SEQ ID NO: 1225694 - RNA, 12 nt, Mycobacterium leprae
cgcaccgcguaa

SEQ ID NO: 1225695 - RNA, 15 nt, Mycobacterium leprae
cgcaagcgcgccgag

SEQ ID NO: 1225696 - RNA, 18 nt, Mycobacterium leprae
cgcacguuagacgacggc

SEQ ID NO: 1225697 - RNA, 16 nt, Mycobacterium leprae
ccgagguuaccagcgc

SEQ ID NO: 1225698 - RNA, 11 nt, Mycobacterium leprae
ccgaggucgag

SEQ ID NO: 1225699 - RNA, 21 nt, Mycobacterium leprae
ccgaggagaggcagggcuggg

SEQ ID NO: 1225700 - RNA, 15 nt, Mycobacterium leprae
ccgagccggucgauc

SEQ ID NO: 1225701 - RNA, 19 nt, Mycobacterium leprae
ccgagcaugaccgagcugg

SEQ ID NO: 1225702 - RNA, 17 nt, Mycobacterium leprae
ccgacgucuucaauacc

SEQ ID NO: 1225703 - RNA, 15 nt, Mycobacterium leprae
ccgacgucucgcggu

SEQ ID NO: 1225704 - RNA, 21 nt, Mycobacterium leprae
ccgagaaaacucgaucgaggu

SEQ ID NO: 1225705 - RNA, 19 nt, Mycobacterium leprae
ccgacuggugggcgcagac

SEQ ID NO: 1225706 - RNA, 14 nt, Mycobacterium leprae
ccgacggaugccca

SEQ ID NO: 1225707 - RNA, 16 nt, Mycobacterium leprae
ccgacggcgccgcaca

SEQ ID NO: 1225708 - RNA, 18 nt, Mycobacterium leprae
ccgacggcgccgcacagc

SEQ ID NO: 1225709 - RNA, 23 nt, Mycobacterium leprae
ccgacgcgguugccggcggaagu

SEQ ID NO: 1225710 - RNA, 19 nt, Mycobacterium leprae
ccgcauacuggcacgccag

SEQ ID NO: 1225711 - RNA, 11 nt, Mycobacterium leprae
ccgcaucaccg

SEQ ID NO: 1225712 - RNA, 18 nt, Mycobacterium leprae
ccgccagcgucaucgucu

SEQ ID NO: 1225713 - RNA, 16 nt, Mycobacterium leprae
ccgccagaccggcgau

SEQ ID NO: 1225714 - RNA, 17 nt, Mycobacterium leprae
ccgccagaugccgaucu

SEQ ID NO: 1225715 - RNA, 12 nt, Mycobacterium leprae
ccgccacgacca

SEQ ID NO: 1225716 - RNA, 18 nt, Mycobacterium leprae
ccgcaaccgauacgccag

SEQ ID NO: 1225717 - RNA, 17 nt, Mycobacterium leprae
ccgauucgguggcgauc

SEQ ID NO: 1225718 - RNA, 17 nt, Mycobacterium leprae
ccgcacagcaccaugga

SEQ ID NO: 1225719 - RNA, 15 nt, Mycobacterium leprae
ccgaugaugguuggu

SEQ ID NO: 1225720 - RNA, 12 nt, Mycobacterium leprae
ccgauuccaccu

SEQ ID NO: 1225721 - RNA, 14 nt, Mycobacterium leprae
ccgaucgacauagu

SEQ ID NO: 1225722 - RNA, 24 nt, Mycobacterium leprae
ccgauccggcggccggcaagaagu

SEQ ID NO: 1225723 - RNA, 12 nt, Mycobacterium leprae
ccgaucgcccgc

SEQ ID NO: 1225724 - RNA, 22 nt, Mycobacterium leprae
ccgaucaucgagguggcggcga

SEQ ID NO: 1225725 - RNA, 15 nt, Mycobacterium leprae
ccgauauggcgauca

SEQ ID NO: 1225726 - RNA, 15 nt, Mycobacterium leprae
ccgauaucgaccagc

SEQ ID NO: 1225727 - RNA, 21 nt, Mycobacterium leprae
ccgauaucgaccagccaagcc

SEQ ID NO: 1225728 - RNA, 16 nt, Mycobacterium leprae
ccgcggauuccagagc

SEQ ID NO: 1225729 - RNA, 12 nt, Mycobacterium leprae
ccgcgucggcgu

SEQ ID NO: 1225730 - RNA, 13 nt, Mycobacterium leprae
ccgcggugacgcu

SEQ ID NO: 1225731 - RNA, 16 nt, Mycobacterium leprae
ccgcggcuaucgccgc

SEQ ID NO: 1225732 - RNA, 16 nt, Mycobacterium leprae
ccgcucgaccauguga

SEQ ID NO: 1225733 - RNA, 19 nt, Mycobacterium leprae
ccgcucgaccaugugaccg

SEQ ID NO: 1225734 - RNA, 16 nt, Mycobacterium leprae
ccgccgagcgcaccaa

SEQ ID NO: 1225735 - RNA, 22 nt, Mycobacterium leprae
ccgccggucaucgcuucguggu

SEQ ID NO: 1225736 - RNA, 18 nt, Mycobacterium leprae
ccgcgaagcugaccacuc

SEQ ID NO: 1225737 - RNA, 16 nt, Mycobacterium leprae
ccgccucaggguacga

SEQ ID NO: 1225738 - RNA, 14 nt, Mycobacterium leprae
ccgggcucggugaa

SEQ ID NO: 1225739 - RNA, 14 nt, Mycobacterium leprae
ccgggcuucgccac

SEQ ID NO: 1225740 - RNA, 20 nt, Mycobacterium leprae
ccgggaaauacggcacgccg

SEQ ID NO: 1225741 - RNA, 21 nt, Mycobacterium leprae
ccggcgguauugacguggugg

SEQ ID NO: 1225742 - RNA, 19 nt, Mycobacterium leprae
ccggaaucccacgcaacca

SEQ ID NO: 1225743 - RNA, 14 nt, Mycobacterium leprae
ccucauugaccgca

SEQ ID NO: 1225744 - RNA, 20 nt, Mycobacterium leprae
ccucagugucagcagcaguu

SEQ ID NO: 1225745 - RNA, 20 nt, Mycobacterium leprae
ccuaggaucagaaccgcggu

SEQ ID NO: 1225746 - RNA, 15 nt, Mycobacterium leprae
ccuacuuuuccaccc

SEQ ID NO: 1225747 - RNA, 17 nt, Mycobacterium leprae
ccguucaguggccaagc

SEQ ID NO: 1225748 - RNA, 17 nt, Mycobacterium leprae
ccucgaucagcaacacu

SEQ ID NO: 1225749 - RNA, 19 nt, Mycobacterium leprae
ccuccguugucccgcccgg

SEQ ID NO: 1225750 - RNA, 21 nt, Mycobacterium leprae
ccuccguugucccgcccggcc

SEQ ID NO: 1225751 - RNA, 13 nt, Mycobacterium leprae
ccucgacuuccgg

SEQ ID NO: 1225752 - RNA, 14 nt, Mycobacterium leprae
ccucuuccgccgcu

SEQ ID NO: 1225753 - RNA, 19 nt, Mycobacterium leprae
ccugauugucaacaaccga

SEQ ID NO: 1225754 - RNA, 22 nt, Mycobacterium leprae
ccugcacuugcacuucgacggu

SEQ ID NO: 1225755 - RNA, 19 nt, Mycobacterium leprae
ccguaaaucggcaugaugu

SEQ ID NO: 1225756 - RNA, 18 nt, Mycobacterium leprae
ccguaaaucguaaaugcc

SEQ ID NO: 1225757 - RNA, 15 nt, Mycobacterium leprae
ccgguggccaccgcc

SEQ ID NO: 1225758 - RNA, 18 nt, Mycobacterium leprae
ccgguggccaccgccacc

SEQ ID NO: 1225759 - RNA, 13 nt, Mycobacterium leprae
ccgguguggagug

SEQ ID NO: 1225760 - RNA, 17 nt, Mycobacterium leprae
ccgugcuuccauucgcg

SEQ ID NO: 1225761 - RNA, 21 nt, Mycobacterium leprae
ccgugucggccccccggggcu

SEQ ID NO: 1225762 - RNA, 15 nt, Mycobacterium leprae
ccgugucgucuuccg

SEQ ID NO: 1225763 - RNA, 17 nt, Mycobacterium leprae
cggaucuaugguuuugg

SEQ ID NO: 1225764 - RNA, 14 nt, Mycobacterium leprae
cggaucggugcaug

SEQ ID NO: 1225765 - RNA, 19 nt, Mycobacterium leprae
cggaggguugccgacggcc

SEQ ID NO: 1225766 - RNA, 15 nt, Mycobacterium leprae
cggacugcuagccgg

SEQ ID NO: 1225767 - RNA, 20 nt, Mycobacterium leprae
cggagccaguggcguggccg

SEQ ID NO: 1225768 - RNA, 18 nt, Mycobacterium leprae
cggaauguccaccagccg

SEQ ID NO: 1225769 - RNA, 13 nt, Mycobacterium leprae
cggaauggcggca

SEQ ID NO: 1225770 - RNA, 18 nt, Mycobacterium leprae
cggacaucauugcgacga

SEQ ID NO: 1225771 - RNA, 17 nt, Mycobacterium leprae
cggacaguccaccgcca

SEQ ID NO: 1225772 - RNA, 16 nt, Mycobacterium leprae
cggacggcccagcacc

SEQ ID NO: 1225773 - RNA, 17 nt, Mycobacterium leprae
cggacggcccagcacca

SEQ ID NO: 1225774 - RNA, 13 nt, Mycobacterium leprae
cggaccgugguga

SEQ ID NO: 1225775 - RNA, 13 nt, Mycobacterium leprae
cggaugccuuugu

SEQ ID NO: 1225776 - RNA, 14 nt, Mycobacterium leprae
cggcaagcugcccg

SEQ ID NO: 1225777 - RNA, 15 nt, Mycobacterium leprae
cggcaagcugcccgg

SEQ ID NO: 1225778 - RNA, 19 nt, Mycobacterium leprae
cggcaagcugcccggcgaa

SEQ ID NO: 1225779 - RNA, 20 nt, Mycobacterium leprae
cggcauccauguacaacacc

SEQ ID NO: 1225780 - RNA, 22 nt, Mycobacterium leprae
cggcauccauguacaacaccag

SEQ ID NO: 1225781 - RNA, 17 nt, Mycobacterium leprae
cggcaucccagugugcu

SEQ ID NO: 1225782 - RNA, 16 nt, Mycobacterium leprae
cggcauugccggggcu

SEQ ID NO: 1225783 - RNA, 17 nt, Mycobacterium leprae
cggcauugccggggcug

SEQ ID NO: 1225784 - RNA, 17 nt, Mycobacterium leprae
cggccaccauagcaccc

SEQ ID NO: 1225785 - RNA, 22 nt, Mycobacterium leprae
cggcagguggaucgucggccgg

SEQ ID NO: 1225786 - RNA, 19 nt, Mycobacterium leprae
cggcaguccuuuccagcca

SEQ ID NO: 1225787 - RNA, 13 nt, Mycobacterium leprae
cggcgagcaagcg

SEQ ID NO: 1225788 - RNA, 22 nt, Mycobacterium leprae
cggcgauauccgccggccgcac

SEQ ID NO: 1225789 - RNA, 15 nt, Mycobacterium leprae
cggcgauugccacca

SEQ ID NO: 1225790 - RNA, 19 nt, Mycobacterium leprae
cggcgauugccaccaccac

SEQ ID NO: 1225791 - RNA, 22 nt, Mycobacterium leprae
cggcgaugugacguucgaugcc

SEQ ID NO: 1225792 - RNA, 18 nt, Mycobacterium leprae
cggccucacaguaggcca

SEQ ID NO: 1225793 - RNA, 23 nt, Mycobacterium leprae
cggcccgaauucaucgaauaccu

SEQ ID NO: 1225794 - RNA, 21 nt, Mycobacterium leprae
cggccccuuucacgucggcgu

SEQ ID NO: 1225795 - RNA, 16 nt, Mycobacterium leprae
cggcccuggccggcac

SEQ ID NO: 1225796 - RNA, 13 nt, Mycobacterium leprae
cggccgaacuugg

SEQ ID NO: 1225797 - RNA, 14 nt, Mycobacterium leprae
cggccgcggacaag

SEQ ID NO: 1225798 - RNA, 15 nt, Mycobacterium leprae
cggccgcggacaaga

SEQ ID NO: 1225799 - RNA, 17 nt, Mycobacterium leprae
cggcuuugcugucgaau

SEQ ID NO: 1225800 - RNA, 22 nt, Mycobacterium leprae
cgggaaaaauccgcgcaacacc

SEQ ID NO: 1225801 - RNA, 15 nt, Mycobacterium leprae
cggcugggcagccga

SEQ ID NO: 1225802 - RNA, 16 nt, Mycobacterium leprae
cggcuggugcggcggu

SEQ ID NO: 1225803 - RNA, 14 nt, Mycobacterium leprae
cggcucccaucggc

SEQ ID NO: 1225804 - RNA, 17 nt, Mycobacterium leprae
cggcugcguuaccggcg

SEQ ID NO: 1225805 - RNA, 17 nt, Mycobacterium leprae
cggcugcgcucaccucg

SEQ ID NO: 1225806 - RNA, 12 nt, Mycobacterium leprae
cggcugccgcac

SEQ ID NO: 1225807 - RNA, 15 nt, Mycobacterium leprae
cggcuagucggccgg

SEQ ID NO: 1225808 - RNA, 20 nt, Mycobacterium leprae
cggcuagccgugcagccuca

SEQ ID NO: 1225809 - RNA, 21 nt, Mycobacterium leprae
cggcuaugcucaaccgugcug

SEQ ID NO: 1225810 - RNA, 21 nt, Mycobacterium leprae
cggcguguuuacgcucgguaa

SEQ ID NO: 1225811 - RNA, 19 nt, Mycobacterium leprae
cggcguugagcgcagccac

SEQ ID NO: 1225812 - RNA, 21 nt, Mycobacterium leprae
cggcgucgcuguuugccgagu

SEQ ID NO: 1225813 - RNA, 18 nt, Mycobacterium leprae
cggcgucauucacccgcg

SEQ ID NO: 1225814 - RNA, 19 nt, Mycobacterium leprae
cggcgucauucacccgcgu

SEQ ID NO: 1225815 - RNA, 21 nt, Mycobacterium leprae
cggcggcacgguguugaccca

SEQ ID NO: 1225816 - RNA, 22 nt, Mycobacterium leprae
cggcggccccuuucacgucggc

SEQ ID NO: 1225817 - RNA, 21 nt, Mycobacterium leprae
cggcggccuuggcagccgcug

SEQ ID NO: 1225818 - RNA, 13 nt, Mycobacterium leprae
cggcgcgguggcu

SEQ ID NO: 1225819 - RNA, 17 nt, Mycobacterium leprae
cggcgcucaccgacgga

SEQ ID NO: 1225820 - RNA, 21 nt, Mycobacterium leprae
cggcgcucaccgacggaugcc

SEQ ID NO: 1225821 - RNA, 18 nt, Mycobacterium leprae
cgguauugcgucggcuga

SEQ ID NO: 1225822 - RNA, 16 nt, Mycobacterium leprae
cgguauugacguggug

SEQ ID NO: 1225823 - RNA, 22 nt, Mycobacterium leprae
cgguauuugcugucguggcugc

SEQ ID NO: 1225824 - RNA, 15 nt, Mycobacterium leprae
cggucaccccgagcu

SEQ ID NO: 1225825 - RNA, 16 nt, Mycobacterium leprae
cgguagcagcgguacc

SEQ ID NO: 1225826 - RNA, 19 nt, Mycobacterium leprae
cgguaucucaauccguugu

SEQ ID NO: 1225827 - RNA, 12 nt, Mycobacterium leprae
cgguaucgccga

SEQ ID NO: 1225828 - RNA, 22 nt, Mycobacterium leprae
cgguaucgaugccguggugaug

SEQ ID NO: 1225829 - RNA, 12 nt, Mycobacterium leprae
cgggugguccgg

SEQ ID NO: 1225830 - RNA, 21 nt, Mycobacterium leprae
cgggucuggauaacggggcua

SEQ ID NO: 1225831 - RNA, 21 nt, Mycobacterium leprae
cgggucuuucguuguuuguca

SEQ ID NO: 1225832 - RNA, 15 nt, Mycobacterium leprae
cggggcuaugccgcg

SEQ ID NO: 1225833 - RNA, 22 nt, Mycobacterium leprae
cggggugucaacagcggacgua

SEQ ID NO: 1225834 - RNA, 12 nt, Mycobacterium leprae
cggggcugcccg

SEQ ID NO: 1225835 - RNA, 19 nt, Mycobacterium leprae
cggguaaguucuaccgacu

SEQ ID NO: 1225836 - RNA, 17 nt, Mycobacterium leprae
cgggguuuuuguuggug

SEQ ID NO: 1225837 - RNA, 16 nt, Mycobacterium leprae
cgggguuugacaccgc

SEQ ID NO: 1225838 - RNA, 22 nt, Mycobacterium leprae
cggguaccccauucagcggcga

SEQ ID NO: 1225839 - RNA, 17 nt, Mycobacterium leprae
cggguagacgaugaucg

SEQ ID NO: 1225840 - RNA, 11 nt, Mycobacterium leprae
cgggucgcggg

SEQ ID NO: 1225841 - RNA, 14 nt, Mycobacterium leprae
cgggcgcaagcgug

SEQ ID NO: 1225842 - RNA, 16 nt, Mycobacterium leprae
cgggcgaugccaucgg

SEQ ID NO: 1225843 - RNA, 23 nt, Mycobacterium leprae
cgggcgagcuggggcggccgccg

SEQ ID NO: 1225844 - RNA, 23 nt, Mycobacterium leprae
cgggccgcuaugaguuucggcgc

SEQ ID NO: 1225845 - RNA, 13 nt, Mycobacterium leprae
cgggccggccgcg

SEQ ID NO: 1225846 - RNA, 18 nt, Mycobacterium leprae
cgcccaccgcaacgccuc

SEQ ID NO: 1225847 - RNA, 22 nt, Mycobacterium leprae
cgcccagcaguuacugguggca

SEQ ID NO: 1225848 - RNA, 15 nt, Mycobacterium leprae
cgcccaagcgaagcc

SEQ ID NO: 1225849 - RNA, 19 nt, Mycobacterium leprae
cgcccgcuggaucggugcu

SEQ ID NO: 1225850 - RNA, 17 nt, Mycobacterium leprae
cgcccagugacgucgga

SEQ ID NO: 1225851 - RNA, 13 nt, Mycobacterium leprae
cgcccggccagua

SEQ ID NO: 1225852 - RNA, 14 nt, Mycobacterium leprae
cgcccggucugcgu

SEQ ID NO: 1225853 - RNA, 15 nt, Mycobacterium leprae
cgccgaaaucgacgu

SEQ ID NO: 1225854 - RNA, 20 nt, Mycobacterium leprae
cgccgaaaucgacguuugca

SEQ ID NO: 1225855 - RNA, 17 nt, Mycobacterium leprae
cgccgcccucucacggc

SEQ ID NO: 1225856 - RNA, 13 nt, Mycobacterium leprae
cgccuuagccgaa

SEQ ID NO: 1225857 - RNA, 14 nt, Mycobacterium leprae
cgccgucuccgccg

SEQ ID NO: 1225858 - RNA, 14 nt, Mycobacterium leprae
cgccgccguugcca

SEQ ID NO: 1225859 - RNA, 17 nt, Mycobacterium leprae
cgccgggguguggcacg

SEQ ID NO: 1225860 - RNA, 17 nt, Mycobacterium leprae
cgccggcggccaccgcg

SEQ ID NO: 1225861 - RNA, 13 nt, Mycobacterium leprae
cgcguguuugcgg

SEQ ID NO: 1225862 - RNA, 13 nt, Mycobacterium leprae
cgcgguaggccag

SEQ ID NO: 1225863 - RNA, 13 nt, Mycobacterium leprae
cgcgggcuugcuc

SEQ ID NO: 1225864 - RNA, 23 nt, Mycobacterium leprae
cgcguauuucgagcgugacgaca

SEQ ID NO: 1225865 - RNA, 16 nt, Mycobacterium leprae
cgcgguuuccgcggca

SEQ ID NO: 1225866 - RNA, 14 nt, Mycobacterium leprae
cgcuggaucggugc

SEQ ID NO: 1225867 - RNA, 17 nt, Mycobacterium leprae
cgcugcuuccugaacaa

SEQ ID NO: 1225868 - RNA, 21 nt, Mycobacterium leprae
cgcugggacaugaagccguug

SEQ ID NO: 1225869 - RNA, 21 nt, Mycobacterium leprae
cgcugaucgcgauaccggcga

SEQ ID NO: 1225870 - RNA, 22 nt, Mycobacterium leprae
cgcugauaaggucuggcaccgc

SEQ ID NO: 1225871 - RNA, 15 nt, Mycobacterium leprae
cgcguuugucggcgu

SEQ ID NO: 1225872 - RNA, 15 nt, Mycobacterium leprae
cgcucgaaagccucg

SEQ ID NO: 1225873 - RNA, 14 nt, Mycobacterium leprae
cgcgcaucaucgcc

SEQ ID NO: 1225874 - RNA, 15 nt, Mycobacterium leprae
cgcgcaucaucgccc

SEQ ID NO: 1225875 - RNA, 19 nt, Mycobacterium leprae
cgcgcaggcugcgacauuc

SEQ ID NO: 1225876 - RNA, 15 nt, Mycobacterium leprae
cgcgaccgccaccag

SEQ ID NO: 1225877 - RNA, 20 nt, Mycobacterium leprae
cgcggcaacaacggaucggc

SEQ ID NO: 1225878 - RNA, 12 nt, Mycobacterium leprae
cgcggaccgucg

SEQ ID NO: 1225879 - RNA, 15 nt, Mycobacterium leprae
cgcggccgcagcgcg

SEQ ID NO: 1225880 - RNA, 14 nt, Mycobacterium leprae
cgcgcgcucacagc

SEQ ID NO: 1225881 - RNA, 15 nt, Mycobacterium leprae
cgcgcugaaugguca

SEQ ID NO: 1225882 - RNA, 12 nt, Mycobacterium leprae
gccaauaccgaa

SEQ ID NO: 1225883 - RNA, 16 nt, Mycobacterium leprae
gccaauccagccgagg

SEQ ID NO: 1225884 - RNA, 20 nt, Mycobacterium leprae
gccaaggucguuagcgccga

SEQ ID NO: 1225885 - RNA, 17 nt, Mycobacterium leprae
gccaaugcugcagcugg

SEQ ID NO: 1225886 - RNA, 20 nt, Mycobacterium leprae
gccaaucuaauugcgaugca

SEQ ID NO: 1225887 - RNA, 22 nt, Mycobacterium leprae
gccaaucgccugugucgagcug

SEQ ID NO: 1225888 - RNA, 23 nt, Mycobacterium leprae
gccaaucguguaucgucgcaacg

SEQ ID NO: 1225889 - RNA, 20 nt, Mycobacterium leprae
gccacauccucgguaucguc

SEQ ID NO: 1225890 - RNA, 17 nt, Mycobacterium leprae
gccacauugaccacgcc

SEQ ID NO: 1225891 - RNA, 13 nt, Mycobacterium leprae
gccaccggcgcuu

SEQ ID NO: 1225892 - RNA, 14 nt, Mycobacterium leprae
gccaccgccaccga

SEQ ID NO: 1225893 - RNA, 21 nt, Mycobacterium leprae
gccaccgccggucaucgcuuc

SEQ ID NO: 1225894 - RNA, 23 nt, Mycobacterium leprae
gccacugagauuaucccgauagc

SEQ ID NO: 1225895 - RNA, 19 nt, Mycobacterium leprae
gccacugcacgaccacacu

SEQ ID NO: 1225896 - RNA, 19 nt, Mycobacterium leprae
gccacucguagggaccgcu

SEQ ID NO: 1225897 - RNA, 20 nt, Mycobacterium leprae
gccacucggcagagcguucg

SEQ ID NO: 1225898 - RNA, 15 nt, Mycobacterium leprae
gccacgaccaaaccu

SEQ ID NO: 1225899 - RNA, 17 nt, Mycobacterium leprae
gccagagcugcgacgga

SEQ ID NO: 1225900 - RNA, 23 nt, Mycobacterium leprae
gccagcuucgcagacacagccgu

SEQ ID NO: 1225901 - RNA, 21 nt, Mycobacterium leprae
gccagcgcaucagccaacacc

SEQ ID NO: 1225902 - RNA, 15 nt, Mycobacterium leprae
gccagcccggcgugc

SEQ ID NO: 1225903 - RNA, 23 nt, Mycobacterium leprae
gccauaaaucaucgcugccaucg

SEQ ID NO: 1225904 - RNA, 23 nt, Mycobacterium leprae
gccaucgaacggcggggcgucgc

SEQ ID NO: 1225905 - RNA, 12 nt, Mycobacterium leprae
gccaucgguugu

SEQ ID NO: 1225906 - RNA, 20 nt, Mycobacterium leprae
gccaucgacgccgccguugc

SEQ ID NO: 1225907 - RNA, 17 nt, Mycobacterium leprae
gccaucgacgccgucuc

SEQ ID NO: 1225908 - RNA, 15 nt, Mycobacterium leprae
gccaugcacgccggc

SEQ ID NO: 1225909 - RNA, 20 nt, Mycobacterium leprae
gccaugcacgccggcgucgc

SEQ ID NO: 1225910 - RNA, 13 nt, Mycobacterium leprae
gccagugaucgcc

SEQ ID NO: 1225911 - RNA, 22 nt, Mycobacterium leprae
gccagucggucugcucggcgaa

SEQ ID NO: 1225912 - RNA, 19 nt, Mycobacterium leprae
gcccagaagcucacugaca

SEQ ID NO: 1225913 - RNA, 20 nt, Mycobacterium leprae
gcccagaccgaaaaccacaa

SEQ ID NO: 1225914 - RNA, 20 nt, Mycobacterium leprae
gcccgcaaagagucgaccug

SEQ ID NO: 1225915 - RNA, 21 nt, Mycobacterium leprae
gcccgcaacaccguacugaac

SEQ ID NO: 1225916 - RNA, 12 nt, Mycobacterium leprae
gcccgacggcgu

SEQ ID NO: 1225917 - RNA, 15 nt, Mycobacterium leprae
gcccgacggcgucgu

SEQ ID NO: 1225918 - RNA, 23 nt, Mycobacterium leprae
gcccgagucucuggugcgccaac

SEQ ID NO: 1225919 - RNA, 20 nt, Mycobacterium leprae
gccccuggcaucaucaacau

SEQ ID NO: 1225920 - RNA, 18 nt, Mycobacterium leprae
gcccauaucgacuucggu

SEQ ID NO: 1225921 - RNA, 18 nt, Mycobacterium leprae
gcccuuagagguuagcga

SEQ ID NO: 1225922 - RNA, 22 nt, Mycobacterium leprae
gccgaaaaccuacgcgguccug

SEQ ID NO: 1225923 - RNA, 13 nt, Mycobacterium leprae
gcccugcacuuca

SEQ ID NO: 1225924 - RNA, 15 nt, Mycobacterium leprae
gcccguuaucgaucu

SEQ ID NO: 1225925 - RNA, 20 nt, Mycobacterium leprae
gcccguuaucgaucuaccug

SEQ ID NO: 1225926 - RNA, 15 nt, Mycobacterium leprae
gcccuccuggcgagu

SEQ ID NO: 1225927 - RNA, 21 nt, Mycobacterium leprae
gcccuccggaaauacggcagu

SEQ ID NO: 1225928 - RNA, 13 nt, Mycobacterium leprae
gcccgguugccgu

SEQ ID NO: 1225929 - RNA, 21 nt, Mycobacterium leprae
gccgcaccugaacaggcacgu

SEQ ID NO: 1225930 - RNA, 15 nt, Mycobacterium leprae
gccgaguccgcuaag

SEQ ID NO: 1225931 - RNA, 21 nt, Mycobacterium leprae
gccgauauguucgguagucgu

SEQ ID NO: 1225932 - RNA, 17 nt, Mycobacterium leprae
gccgauaucuccgugau

SEQ ID NO: 1225933 - RNA, 18 nt, Mycobacterium leprae
gccgaucccggcgcuguc

SEQ ID NO: 1225934 - RNA, 15 nt, Mycobacterium leprae
gccgaagccgccagg

SEQ ID NO: 1225935 - RNA, 20 nt, Mycobacterium leprae
gccggcaagaagugcgacga

SEQ ID NO: 1225936 - RNA, 22 nt, Mycobacterium leprae
gccgcggguaaccuugccggcc

SEQ ID NO: 1225937 - RNA, 19 nt, Mycobacterium leprae
gccgcgggcgaugccaucg

SEQ ID NO: 1225938 - RNA, 18 nt, Mycobacterium leprae
gccgcggcaacaacggau

SEQ ID NO: 1225939 - RNA, 15 nt, Mycobacterium leprae
gccgcgcgccugcgc

SEQ ID NO: 1225940 - RNA, 17 nt, Mycobacterium leprae
gccgccgaagccgcgca

SEQ ID NO: 1225941 - RNA, 21 nt, Mycobacterium leprae
gccgccgaacaguucgcacga

SEQ ID NO: 1225942 - RNA, 22 nt, Mycobacterium leprae
gccgccgacaccgauaccagcg

SEQ ID NO: 1225943 - RNA, 15 nt, Mycobacterium leprae
gccgcgaauggacag

SEQ ID NO: 1225944 - RNA, 18 nt, Mycobacterium leprae
gcaaugcucugcugauca

SEQ ID NO: 1225945 - RNA, 21 nt, Mycobacterium leprae
gcaauccguggagagcaugga

SEQ ID NO: 1225946 - RNA, 14 nt, Mycobacterium leprae
gcaaucgauccggc

SEQ ID NO: 1225947 - RNA, 15 nt, Mycobacterium leprae
gcacacgacagccgc

SEQ ID NO: 1225948 - RNA, 17 nt, Mycobacterium leprae
gcacagcaggucgccga

SEQ ID NO: 1225949 - RNA, 19 nt, Mycobacterium leprae
gcacagccagcaaggcaac

SEQ ID NO: 1225950 - RNA, 18 nt, Mycobacterium leprae
gcaccacgcacacgacag

SEQ ID NO: 1225951 - RNA, 20 nt, Mycobacterium leprae
gcaccaagucuucgaugcuc

SEQ ID NO: 1225952 - RNA, 21 nt, Mycobacterium leprae
gcaccagcaguggucggcgaa

SEQ ID NO: 1225953 - RNA, 14 nt, Mycobacterium leprae
gcaccauccggcgg

SEQ ID NO: 1225954 - RNA, 17 nt, Mycobacterium leprae
gcaccagugugccagcg

SEQ ID NO: 1225955 - RNA, 14 nt, Mycobacterium leprae
gcacgagcgggugu

SEQ ID NO: 1225956 - RNA, 22 nt, Mycobacterium leprae
gcaccuuacgauuacgcacgcc

SEQ ID NO: 1225957 - RNA, 23 nt, Mycobacterium leprae
gcaccuguacuugauagcucgcg

SEQ ID NO: 1225958 - RNA, 15 nt, Mycobacterium leprae
gcacgcaaccgccgg

SEQ ID NO: 1225959 - RNA, 13 nt, Mycobacterium leprae
gcacggaucgacc

SEQ ID NO: 1225960 - RNA, 18 nt, Mycobacterium leprae
gcacgggaggcguugcac

SEQ ID NO: 1225961 - RNA, 22 nt, Mycobacterium leprae
gcaccggcugcacccgucgcug

SEQ ID NO: 1225962 - RNA, 17 nt, Mycobacterium leprae
gcacccauccgaucaau

SEQ ID NO: 1225963 - RNA, 16 nt, Mycobacterium leprae
gcacccacucggcggu

SEQ ID NO: 1225964 - RNA, 23 nt, Mycobacterium leprae
gcauccagaaaguacugaccggc

SEQ ID NO: 1225965 - RNA, 12 nt, Mycobacterium leprae
gcauaugagcau

SEQ ID NO: 1225966 - RNA, 18 nt, Mycobacterium leprae
gcauauaaucgcuucggc

SEQ ID NO: 1225967 - RNA, 13 nt, Mycobacterium leprae
gcauauccgcccc

SEQ ID NO: 1225968 - RNA, 15 nt, Mycobacterium leprae
gcauacagugcaccg

SEQ ID NO: 1225969 - RNA, 17 nt, Mycobacterium leprae
gcagugggccaguggcu

SEQ ID NO: 1225970 - RNA, 21 nt, Mycobacterium leprae
gcaguccuuuccagccacggc

SEQ ID NO: 1225971 - RNA, 19 nt, Mycobacterium leprae
gcagucaguuuggcgcugc

SEQ ID NO: 1225972 - RNA, 15 nt, Mycobacterium leprae
gcagguugcugucgu

SEQ ID NO: 1225973 - RNA, 14 nt, Mycobacterium leprae
gcagguuguugacg

SEQ ID NO: 1225974 - RNA, 21 nt, Mycobacterium leprae
gcaguaaccgauauggcgauc

SEQ ID NO: 1225975 - RNA, 19 nt, Mycobacterium leprae
gcaguaucuaccuauccga

SEQ ID NO: 1225976 - RNA, 21 nt, Mycobacterium leprae
gcaguaucuaccuauccgagu

SEQ ID NO: 1225977 - RNA, 23 nt, Mycobacterium leprae
gcagcugguuguccacggcagcu

SEQ ID NO: 1225978 - RNA, 15 nt, Mycobacterium leprae
gcaggaucggguagc

SEQ ID NO: 1225979 - RNA, 18 nt, Mycobacterium leprae
gcaggagagcgccgcugu

SEQ ID NO: 1225980 - RNA, 14 nt, Mycobacterium leprae
gcagccaccgacga

SEQ ID NO: 1225981 - RNA, 13 nt, Mycobacterium leprae
gcagcaguucauc

SEQ ID NO: 1225982 - RNA, 16 nt, Mycobacterium leprae
gcagaucgaucucgac

SEQ ID NO: 1225983 - RNA, 17 nt, Mycobacterium leprae
gcagaucgaucucgacg

SEQ ID NO: 1225984 - RNA, 19 nt, Mycobacterium leprae
gcagaucgaucucgacggc

SEQ ID NO: 1225985 - RNA, 17 nt, Mycobacterium leprae
gcagcaauugacgccga

SEQ ID NO: 1225986 - RNA, 22 nt, Mycobacterium leprae
gcagcaauugacgccgaccgcg

SEQ ID NO: 1225987 - RNA, 23 nt, Mycobacterium leprae
gcagcaauugacgccgaccgcga

SEQ ID NO: 1225988 - RNA, 14 nt, Mycobacterium leprae
gcagcaccacagcg

SEQ ID NO: 1225989 - RNA, 22 nt, Mycobacterium leprae
gcagcugccauuggccgcuggu

SEQ ID NO: 1225990 - RNA, 14 nt, Mycobacterium leprae
gcagcugcagucga

SEQ ID NO: 1225991 - RNA, 19 nt, Mycobacterium leprae
gcagcuggaaagucgggau

SEQ ID NO: 1225992 - RNA, 15 nt, Mycobacterium leprae
gcagcguggucaccg

SEQ ID NO: 1225993 - RNA, 17 nt, Mycobacterium leprae
gcagcguggucaccgcu

SEQ ID NO: 1225994 - RNA, 20 nt, Mycobacterium leprae
gcagcguggucaccgcugug

SEQ ID NO: 1225995 - RNA, 12 nt, Mycobacterium leprae
gcagcgucacca

SEQ ID NO: 1225996 - RNA, 19 nt, Mycobacterium leprae
gcagcgguacccgccagga

SEQ ID NO: 1225997 - RNA, 16 nt, Mycobacterium leprae
gcagcgaggccguggc

SEQ ID NO: 1225998 - RNA, 16 nt, Mycobacterium leprae
gcagcgaguguccgca

SEQ ID NO: 1225999 - RNA, 22 nt, Mycobacterium leprae
gcagcgauaccagcgucgcuca

SEQ ID NO: 1226000 - RNA, 14 nt, Mycobacterium leprae
gauugaucggugac

SEQ ID NO: 1226001 - RNA, 17 nt, Mycobacterium leprae
gauuggacauguucaca

SEQ ID NO: 1226002 - RNA, 12 nt, Mycobacterium leprae
gauugacgucgg

SEQ ID NO: 1226003 - RNA, 16 nt, Mycobacterium leprae
gaugguuuccagggcg

SEQ ID NO: 1226004 - RNA, 19 nt, Mycobacterium leprae
gauggcgucuugaucgacc

SEQ ID NO: 1226005 - RNA, 20 nt, Mycobacterium leprae
gauggcgucuugaucgaccu

SEQ ID NO: 1226006 - RNA, 19 nt, Mycobacterium leprae
gauggcgucaccgugcagc

SEQ ID NO: 1226007 - RNA, 16 nt, Mycobacterium leprae
gauggccagccguccc

SEQ ID NO: 1226008 - RNA, 14 nt, Mycobacterium leprae
gauggccgaggagu

SEQ ID NO: 1226009 - RNA, 17 nt, Mycobacterium leprae
gaugcugugucgguugc

SEQ ID NO: 1226010 - RNA, 20 nt, Mycobacterium leprae
gaugcugugucgguugcauc

SEQ ID NO: 1226011 - RNA, 21 nt, Mycobacterium leprae
gaugcgaugagauucgagcgg

SEQ ID NO: 1226012 - RNA, 19 nt, Mycobacterium leprae
gaugccgggaagcgaccgg

SEQ ID NO: 1226013 - RNA, 14 nt, Mycobacterium leprae
gaucgacggcuacu

SEQ ID NO: 1226014 - RNA, 14 nt, Mycobacterium leprae
gaucgacggcagcg

SEQ ID NO: 1226015 - RNA, 23 nt, Mycobacterium leprae
gaucgaccucgaauccgccucgg

SEQ ID NO: 1226016 - RNA, 17 nt, Mycobacterium leprae
gauccucgugacaucga

SEQ ID NO: 1226017 - RNA, 17 nt, Mycobacterium leprae
gauccggugccggccaa

SEQ ID NO: 1226018 - RNA, 20 nt, Mycobacterium leprae
gaucccgguuacguccgcgg

SEQ ID NO: 1226019 - RNA, 21 nt, Mycobacterium leprae
gaucccgaaagugccguuggc

SEQ ID NO: 1226020 - RNA, 18 nt, Mycobacterium leprae
gaucguugucggucgaca

SEQ ID NO: 1226021 - RNA, 22 nt, Mycobacterium leprae
gaucguuaccgacaccgccgac

SEQ ID NO: 1226022 - RNA, 22 nt, Mycobacterium leprae
gaucgugaagauaggucgccga

SEQ ID NO: 1226023 - RNA, 15 nt, Mycobacterium leprae
gaugacucggcgugc

SEQ ID NO: 1226024 - RNA, 15 nt, Mycobacterium leprae
gaugagauucgagcg

SEQ ID NO: 1226025 - RNA, 16 nt, Mycobacterium leprae
gaugauuacaucaucc

SEQ ID NO: 1226026 - RNA, 16 nt, Mycobacterium leprae
gaugauuucgccguaa

SEQ ID NO: 1226027 - RNA, 19 nt, Mycobacterium leprae
gaugcagcuggugguccug

SEQ ID NO: 1226028 - RNA, 18 nt, Mycobacterium leprae
gaugauccacucgccgcg

SEQ ID NO: 1226029 - RNA, 23 nt, Mycobacterium leprae
gaugauccggccgucggcggcac

SEQ ID NO: 1226030 - RNA, 13 nt, Mycobacterium leprae
gaugaugcgaacg

SEQ ID NO: 1226031 - RNA, 17 nt, Mycobacterium leprae
gagcguuuagucaccgc

SEQ ID NO: 1226032 - RNA, 19 nt, Mycobacterium leprae
gagcgugacgacaugacgc

SEQ ID NO: 1226033 - RNA, 18 nt, Mycobacterium leprae
gagcggccucagcagcag

SEQ ID NO: 1226034 - RNA, 20 nt, Mycobacterium leprae
gagcggugccgcacguugac

SEQ ID NO: 1226035 - RNA, 22 nt, Mycobacterium leprae
gagcggugguacaaucccacca

SEQ ID NO: 1226036 - RNA, 14 nt, Mycobacterium leprae
gagcgggcggcagc

SEQ ID NO: 1226037 - RNA, 15 nt, Mycobacterium leprae
gagcgcagccaccac

SEQ ID NO: 1226038 - RNA, 23 nt, Mycobacterium leprae
gagccacgcuggcacuccgaccg

SEQ ID NO: 1226039 - RNA, 21 nt, Mycobacterium leprae
gauaaugccaccguauccugg

SEQ ID NO: 1226040 - RNA, 22 nt, Mycobacterium leprae
gauaagcaaaaaauagcugcca

SEQ ID NO: 1226041 - RNA, 13 nt, Mycobacterium leprae
gauaacccguguc

SEQ ID NO: 1226042 - RNA, 14 nt, Mycobacterium leprae
gaguugaugugauc

SEQ ID NO: 1226043 - RNA, 19 nt, Mycobacterium leprae
gaguugagcgguucaucga

SEQ ID NO: 1226044 - RNA, 20 nt, Mycobacterium leprae
gauacguuagucuggcuggc

SEQ ID NO: 1226045 - RNA, 11 nt, Mycobacterium leprae
gaucaaccaaa

SEQ ID NO: 1226046 - RNA, 17 nt, Mycobacterium leprae
gaucacaucagugcugu

SEQ ID NO: 1226047 - RNA, 15 nt, Mycobacterium leprae
gaucaauaccacaau

SEQ ID NO: 1226048 - RNA, 18 nt, Mycobacterium leprae
gaguacguccgcgccggc

SEQ ID NO: 1226049 - RNA, 21 nt, Mycobacterium leprae
gaggcacaacaucaccacgau

SEQ ID NO: 1226050 - RNA, 16 nt, Mycobacterium leprae
gagcugggcgaaaaca

SEQ ID NO: 1226051 - RNA, 21 nt, Mycobacterium leprae
gaggauaguuguuagcgccgc

SEQ ID NO: 1226052 - RNA, 22 nt, Mycobacterium leprae
gaggaucgucucgggcgguuga

SEQ ID NO: 1226053 - RNA, 21 nt, Mycobacterium leprae
gaggauuugcuggcugccgcc

SEQ ID NO: 1226054 - RNA, 18 nt, Mycobacterium leprae
gaaugucugggcuggccc

SEQ ID NO: 1226055 - RNA, 11 nt, Mycobacterium leprae
gaauucaucga

SEQ ID NO: 1226056 - RNA, 19 nt, Mycobacterium leprae
gaauucguggugguggcca

SEQ ID NO: 1226057 - RNA, 20 nt, Mycobacterium leprae
gaauucguggugguggccac

SEQ ID NO: 1226058 - RNA, 14 nt, Mycobacterium leprae
gaauaucaucgcca

SEQ ID NO: 1226059 - RNA, 18 nt, Mycobacterium leprae
gaaucgguacauuugcgg

SEQ ID NO: 1226060 - RNA, 15 nt, Mycobacterium leprae
gaagugcuugggcac

SEQ ID NO: 1226061 - RNA, 23 nt, Mycobacterium leprae
gaagugcuugggcacgcuggccg

SEQ ID NO: 1226062 - RNA, 22 nt, Mycobacterium leprae
gaaguauggcuccauagaacac

SEQ ID NO: 1226063 - RNA, 16 nt, Mycobacterium leprae
gaauugguggucgcgg

SEQ ID NO: 1226064 - RNA, 17 nt, Mycobacterium leprae
gacacgauuagcgcggc

SEQ ID NO: 1226065 - RNA, 18 nt, Mycobacterium leprae
gacacggcguggauggcu

SEQ ID NO: 1226066 - RNA, 16 nt, Mycobacterium leprae
gacagcaagacggggg

SEQ ID NO: 1226067 - RNA, 21 nt, Mycobacterium leprae
gacagcaagacgggggaugcu

SEQ ID NO: 1226068 - RNA, 13 nt, Mycobacterium leprae
gacauagaacauc

SEQ ID NO: 1226069 - RNA, 17 nt, Mycobacterium leprae
gacaucgguaucggcau

SEQ ID NO: 1226070 - RNA, 20 nt, Mycobacterium leprae
gacaggaucggugauaucga

SEQ ID NO: 1226071 - RNA, 22 nt, Mycobacterium leprae
gacaugcuuacgugcgccgcgc

SEQ ID NO: 1226072 - RNA, 16 nt, Mycobacterium leprae
gacauggaagccgccg

SEQ ID NO: 1226073 - RNA, 22 nt, Mycobacterium leprae
gacaugccgagguggcagcugg

SEQ ID NO: 1226074 - RNA, 23 nt, Mycobacterium leprae
gacaugauugcagauguugcagc

SEQ ID NO: 1226075 - RNA, 16 nt, Mycobacterium leprae
gacauuucgccaacuc

SEQ ID NO: 1226076 - RNA, 20 nt, Mycobacterium leprae
gaagcaagucccaggacaua

SEQ ID NO: 1226077 - RNA, 23 nt, Mycobacterium leprae
gaagauguuccggcgaccagcga

SEQ ID NO: 1226078 - RNA, 20 nt, Mycobacterium leprae
gaagcagccaaugcugcagc

SEQ ID NO: 1226079 - RNA, 16 nt, Mycobacterium leprae
gaagcccucccagcca

SEQ ID NO: 1226080 - RNA, 16 nt, Mycobacterium leprae
gaagccuggucgcgua

SEQ ID NO: 1226081 - RNA, 13 nt, Mycobacterium leprae
gaagccgccacga

SEQ ID NO: 1226082 - RNA, 23 nt, Mycobacterium leprae
gaagcguccgcuaccugguccgu

SEQ ID NO: 1226083 - RNA, 20 nt, Mycobacterium leprae
gaagcgguugaucuggugga

SEQ ID NO: 1226084 - RNA, 18 nt, Mycobacterium leprae
gaagcguuguaaggucac

SEQ ID NO: 1226085 - RNA, 13 nt, Mycobacterium leprae
gaaacgccucugc

SEQ ID NO: 1226086 - RNA, 20 nt, Mycobacterium leprae
gaaacggguggacgaaccgg

SEQ ID NO: 1226087 - RNA, 13 nt, Mycobacterium leprae
gaacgagaagcag

SEQ ID NO: 1226088 - RNA, 21 nt, Mycobacterium leprae
gaacgacuugaccagccgcag

SEQ ID NO: 1226089 - RNA, 22 nt, Mycobacterium leprae
gaacgagagguuuuugccgagc

SEQ ID NO: 1226090 - RNA, 15 nt, Mycobacterium leprae
gaagacauucgacga

SEQ ID NO: 1226091 - RNA, 23 nt, Mycobacterium leprae
gaacuuuuccaugcugccgucga

SEQ ID NO: 1226092 - RNA, 14 nt, Mycobacterium leprae
gacggcccagcacc

SEQ ID NO: 1226093 - RNA, 20 nt, Mycobacterium leprae
gacgccgccggagcgaagca

SEQ ID NO: 1226094 - RNA, 18 nt, Mycobacterium leprae
gacgccuagagagugcgg

SEQ ID NO: 1226095 - RNA, 16 nt, Mycobacterium leprae
gacgcgacgccggccg

SEQ ID NO: 1226096 - RNA, 16 nt, Mycobacterium leprae
gacgcgaacgugcugc

SEQ ID NO: 1226097 - RNA, 13 nt, Mycobacterium leprae
gacgcgaccgcca

SEQ ID NO: 1226098 - RNA, 15 nt, Mycobacterium leprae
gacgcgaccgccacc

SEQ ID NO: 1226099 - RNA, 17 nt, Mycobacterium leprae
gacgcgaccgccaccag

SEQ ID NO: 1226100 - RNA, 18 nt, Mycobacterium leprae
gacgauuugcgaucaacu

SEQ ID NO: 1226101 - RNA, 22 nt, Mycobacterium leprae
gacgaugcgugccccggccgcc

SEQ ID NO: 1226102 - RNA, 19 nt, Mycobacterium leprae
gaccucccugacgcacacc

SEQ ID NO: 1226103 - RNA, 21 nt, Mycobacterium leprae
gaccuccgcagcaucggcauc

SEQ ID NO: 1226104 - RNA, 22 nt, Mycobacterium leprae
gaccugccgucccucggccauc

SEQ ID NO: 1226105 - RNA, 17 nt, Mycobacterium leprae
gaccgcuggggucgcgg

SEQ ID NO: 1226106 - RNA, 16 nt, Mycobacterium leprae
gaccgucaugcugcuc

SEQ ID NO: 1226107 - RNA, 15 nt, Mycobacterium leprae
gacgaaccggacagc

SEQ ID NO: 1226108 - RNA, 14 nt, Mycobacterium leprae
gacgacggcgggcc

SEQ ID NO: 1226109 - RNA, 15 nt, Mycobacterium leprae
gaccauucagugcgu

SEQ ID NO: 1226110 - RNA, 13 nt, Mycobacterium leprae
gacccagccgucg

SEQ ID NO: 1226111 - RNA, 21 nt, Mycobacterium leprae
gacccagcgauaucaagcugc

SEQ ID NO: 1226112 - RNA, 16 nt, Mycobacterium leprae
gacccgcgguagcgga

SEQ ID NO: 1226113 - RNA, 17 nt, Mycobacterium leprae
gaccgccagacgaucca

SEQ ID NO: 1226114 - RNA, 20 nt, Mycobacterium leprae
gaccgccccgcuguaucguc

SEQ ID NO: 1226115 - RNA, 17 nt, Mycobacterium leprae
cuuugugaacgaucggg

SEQ ID NO: 1226116 - RNA, 18 nt, Mycobacterium leprae
gaaaacacuuacaccaac

SEQ ID NO: 1226117 - RNA, 14 nt, Mycobacterium leprae
gaaaccggccgcgg

SEQ ID NO: 1226118 - RNA, 15 nt, Mycobacterium leprae
gaaacauuguucugc

SEQ ID NO: 1226119 - RNA, 18 nt, Mycobacterium leprae
gaaacccuucacaagugg

SEQ ID NO: 1226120 - RNA, 13 nt, Mycobacterium leprae
cuugucacgccgg

SEQ ID NO: 1226121 - RNA, 15 nt, Mycobacterium leprae
cuuucacgucggcgu

SEQ ID NO: 1226122 - RNA, 16 nt, Mycobacterium leprae
cuuuccagccacggcg

SEQ ID NO: 1226123 - RNA, 17 nt, Mycobacterium leprae
cuuucagcucgauggug

SEQ ID NO: 1226124 - RNA, 17 nt, Mycobacterium leprae
cuuucgcggccgcagcg

SEQ ID NO: 1226125 - RNA, 14 nt, Mycobacterium leprae
cuuggucacgggug

SEQ ID NO: 1226126 - RNA, 14 nt, Mycobacterium leprae
cuugggugguggug

SEQ ID NO: 1226127 - RNA, 22 nt, Mycobacterium leprae
cuugggagaccagagauuucgc

SEQ ID NO: 1226128 - RNA, 17 nt, Mycobacterium leprae
cuuggccuuguccgcag

SEQ ID NO: 1226129 - RNA, 18 nt, Mycobacterium leprae
cuugaccaccaccgccac

SEQ ID NO: 1226130 - RNA, 21 nt, Mycobacterium leprae
cuugauccgagaaaacucgau

SEQ ID NO: 1226131 - RNA, 20 nt, Mycobacterium leprae
cuugcaagccacauccgagc

SEQ ID NO: 1226132 - RNA, 21 nt, Mycobacterium leprae
cuugcagcgaggccguggccg

SEQ ID NO: 1226133 - RNA, 18 nt, Mycobacterium leprae
cuucaccaauccagccaa

SEQ ID NO: 1226134 - RNA, 13 nt, Mycobacterium leprae
cuuccacaucgau

SEQ ID NO: 1226135 - RNA, 15 nt, Mycobacterium leprae
cuucgaccgacauca

SEQ ID NO: 1226136 - RNA, 18 nt, Mycobacterium leprae
cuucugcgcgcacccaag

SEQ ID NO: 1226137 - RNA, 15 nt, Mycobacterium leprae
cuucgguaacgcuga

SEQ ID NO: 1226138 - RNA, 13 nt, Mycobacterium leprae
cuucgguuccgaa

SEQ ID NO: 1226139 - RNA, 16 nt, Mycobacterium leprae
cuucgguuccgaagcc

SEQ ID NO: 1226140 - RNA, 22 nt, Mycobacterium leprae
cuucaagggcaucgccguggug

SEQ ID NO: 1226141 - RNA, 13 nt, Mycobacterium leprae
cuuaacgccgccu

SEQ ID NO: 1226142 - RNA, 22 nt, Mycobacterium leprae
cuguuguuggucggcgcuggcg

SEQ ID NO: 1226143 - RNA, 17 nt, Mycobacterium leprae
cuuaaguaggcggucau

SEQ ID NO: 1226144 - RNA, 18 nt, Mycobacterium leprae
cugucauccucacgaccg

SEQ ID NO: 1226145 - RNA, 15 nt, Mycobacterium leprae
cugucgugcccagau

SEQ ID NO: 1226146 - RNA, 12 nt, Mycobacterium leprae
cugucgucgaaa

SEQ ID NO: 1226147 - RNA, 13 nt, Mycobacterium leprae
cugucgauacggc

SEQ ID NO: 1226148 - RNA, 14 nt, Mycobacterium leprae
cugugggucgaccc

SEQ ID NO: 1226149 - RNA, 14 nt, Mycobacterium leprae
cugugugcagcuug

SEQ ID NO: 1226150 - RNA, 17 nt, Mycobacterium leprae
cugcgucaucgacucga

SEQ ID NO: 1226151 - RNA, 22 nt, Mycobacterium leprae
cugcguaacaccgucgaaauug

SEQ ID NO: 1226152 - RNA, 20 nt, Mycobacterium leprae
cugcguacggaccccgccac

SEQ ID NO: 1226153 - RNA, 21 nt, Mycobacterium leprae
cugcguagcaagguguugcgg

SEQ ID NO: 1226154 - RNA, 13 nt, Mycobacterium leprae
cugcgguguccgu

SEQ ID NO: 1226155 - RNA, 15 nt, Mycobacterium leprae
cugcgguaucgccga

SEQ ID NO: 1226156 - RNA, 17 nt, Mycobacterium leprae
cugcugaauagucggca

SEQ ID NO: 1226157 - RNA, 22 nt, Mycobacterium leprae
cugcugagcguggcugcucaac

SEQ ID NO: 1226158 - RNA, 16 nt, Mycobacterium leprae
cugcucaaccaugccg

SEQ ID NO: 1226159 - RNA, 15 nt, Mycobacterium leprae
cugcaccugaucuag

SEQ ID NO: 1226160 - RNA, 21 nt, Mycobacterium leprae
cugcacgaccacacugugccu

SEQ ID NO: 1226161 - RNA, 20 nt, Mycobacterium leprae
cugcaccucuucgacaccga

SEQ ID NO: 1226162 - RNA, 23 nt, Mycobacterium leprae
cugcgccuuucguccaaacaccg

SEQ ID NO: 1226163 - RNA, 21 nt, Mycobacterium leprae
cugcgcugagagugccaccgc

SEQ ID NO: 1226164 - RNA, 14 nt, Mycobacterium leprae
cuggaacacgaucg

SEQ ID NO: 1226165 - RNA, 18 nt, Mycobacterium leprae
cugcuggaauccggcaac

SEQ ID NO: 1226166 - RNA, 19 nt, Mycobacterium leprae
cuggcacccacgcugcgcg

SEQ ID NO: 1226167 - RNA, 22 nt, Mycobacterium leprae
cuggcaccgcgguaggccaggu

SEQ ID NO: 1226168 - RNA, 14 nt, Mycobacterium leprae
cuggauuagcggga

SEQ ID NO: 1226169 - RNA, 14 nt, Mycobacterium leprae
cuggcauuacgcga

SEQ ID NO: 1226170 - RNA, 15 nt, Mycobacterium leprae
cuggcggaugcgggc

SEQ ID NO: 1226171 - RNA, 16 nt, Mycobacterium leprae
cugguauguccgcccu

SEQ ID NO: 1226172 - RNA, 15 nt, Mycobacterium leprae
cugguccgccagcga

SEQ ID NO: 1226173 - RNA, 18 nt, Mycobacterium leprae
cuggucauggcuucguca

SEQ ID NO: 1226174 - RNA, 23 nt, Mycobacterium leprae
cuggguaagguuguugacgauga

SEQ ID NO: 1226175 - RNA, 19 nt, Mycobacterium leprae
cuggcugagggccggucaa

SEQ ID NO: 1226176 - RNA, 13 nt, Mycobacterium leprae
cuggcugccgcca

SEQ ID NO: 1226177 - RNA, 14 nt, Mycobacterium leprae
cuccaaguggcugc

SEQ ID NO: 1226178 - RNA, 15 nt, Mycobacterium leprae
cucauaccuuuucca

SEQ ID NO: 1226179 - RNA, 22 nt, Mycobacterium leprae
cuccaguuuugugggcagguca

SEQ ID NO: 1226180 - RNA, 19 nt, Mycobacterium leprae
cuccacggucauggucgaa

SEQ ID NO: 1226181 - RNA, 18 nt, Mycobacterium leprae
cucacccaagggcuucca

SEQ ID NO: 1226182 - RNA, 14 nt, Mycobacterium leprae
cuauucgggccagu

SEQ ID NO: 1226183 - RNA, 18 nt, Mycobacterium leprae
cuauugacgguaacugac

SEQ ID NO: 1226184 - RNA, 16 nt, Mycobacterium leprae
cucaccgcggccgacu

SEQ ID NO: 1226185 - RNA, 16 nt, Mycobacterium leprae
cucacccgcgaucucg

SEQ ID NO: 1226186 - RNA, 15 nt, Mycobacterium leprae
cucagcuccgaagca

SEQ ID NO: 1226187 - RNA, 18 nt, Mycobacterium leprae
cucaccugcgacagccgu

SEQ ID NO: 1226188 - RNA, 18 nt, Mycobacterium leprae
cuaggagcgcaucgcgca

SEQ ID NO: 1226189 - RNA, 17 nt, Mycobacterium leprae
cuaugucgugcugacca

SEQ ID NO: 1226190 - RNA, 20 nt, Mycobacterium leprae
cuaguguacagaccgucgaa

SEQ ID NO: 1226191 - RNA, 15 nt, Mycobacterium leprae
cuaauccagacaucg

SEQ ID NO: 1226192 - RNA, 17 nt, Mycobacterium leprae
cuaauugggaucgacac

SEQ ID NO: 1226193 - RNA, 16 nt, Mycobacterium leprae
cuaauuuuugccgaug

SEQ ID NO: 1226194 - RNA, 14 nt, Mycobacterium leprae
cuaccaugccaccu

SEQ ID NO: 1226195 - RNA, 20 nt, Mycobacterium leprae
cuacccagaaaccaccggca

SEQ ID NO: 1226196 - RNA, 16 nt, Mycobacterium leprae
cuaccgguacgcugca

SEQ ID NO: 1226197 - RNA, 13 nt, Mycobacterium leprae
cuaccucggccgu

SEQ ID NO: 1226198 - RNA, 18 nt, Mycobacterium leprae
cguucgucggaagcugcc

SEQ ID NO: 1226199 - RNA, 21 nt, Mycobacterium leprae
cguuccuggcuggccaucgca

SEQ ID NO: 1226200 - RNA, 15 nt, Mycobacterium leprae
cguuccuaccggcca

SEQ ID NO: 1226201 - RNA, 21 nt, Mycobacterium leprae
cgugcugucgugcccagauga

SEQ ID NO: 1226202 - RNA, 22 nt, Mycobacterium leprae
cguugaccgcccuggaccgcag

SEQ ID NO: 1226203 - RNA, 18 nt, Mycobacterium leprae
cguugaccgccgccaucc

SEQ ID NO: 1226204 - RNA, 15 nt, Mycobacterium leprae
cguucucgcgcaggu

SEQ ID NO: 1226205 - RNA, 14 nt, Mycobacterium leprae
cguuggccagcacg

SEQ ID NO: 1226206 - RNA, 17 nt, Mycobacterium leprae
cguuggccagcacggcg

SEQ ID NO: 1226207 - RNA, 14 nt, Mycobacterium leprae
cguuggcaacgugg

SEQ ID NO: 1226208 - RNA, 15 nt, Mycobacterium leprae
cuaaacugcgugauc

SEQ ID NO: 1226209 - RNA, 19 nt, Mycobacterium leprae
cuaaagucuucaauccgcg

SEQ ID NO: 1226210 - RNA, 19 nt, Mycobacterium leprae
cguuuagucaccgccgaag

SEQ ID NO: 1226211 - RNA, 23 nt, Mycobacterium leprae
cguugucggcuccuccagcaucg

SEQ ID NO: 1226212 - RNA, 19 nt, Mycobacterium leprae
cguuguaguagaccuugac

SEQ ID NO: 1226213 - RNA, 14 nt, Mycobacterium leprae
cucucgaguugccg

SEQ ID NO: 1226214 - RNA, 16 nt, Mycobacterium leprae
cucugucgacgggaag

SEQ ID NO: 1226215 - RNA, 13 nt, Mycobacterium leprae
cucucaggccguc

SEQ ID NO: 1226216 - RNA, 13 nt, Mycobacterium leprae
cucgucggccagc

SEQ ID NO: 1226217 - RNA, 16 nt, Mycobacterium leprae
cucgucggccagcacu

SEQ ID NO: 1226218 - RNA, 19 nt, Mycobacterium leprae
cucguggguacgugccaac

SEQ ID NO: 1226219 - RNA, 16 nt, Mycobacterium leprae
cucgucaagaucgacu

SEQ ID NO: 1226220 - RNA, 16 nt, Mycobacterium leprae
cucguaguucgccgag

SEQ ID NO: 1226221 - RNA, 12 nt, Mycobacterium leprae
cugauggccgcc

SEQ ID NO: 1226222 - RNA, 20 nt, Mycobacterium leprae
cugauaauuuggcgccagac

SEQ ID NO: 1226223 - RNA, 17 nt, Mycobacterium leprae
cugauacaacuggaagu

SEQ ID NO: 1226224 - RNA, 22 nt, Mycobacterium leprae
cugagguguugggagcgaagac

SEQ ID NO: 1226225 - RNA, 17 nt, Mycobacterium leprae
cugcacaacgauacguu

SEQ ID NO: 1226226 - RNA, 19 nt, Mycobacterium leprae
cugcaaggugggcgaucag

SEQ ID NO: 1226227 - RNA, 13 nt, Mycobacterium leprae
cugaugguaaccg

SEQ ID NO: 1226228 - RNA, 15 nt, Mycobacterium leprae
cugagagugccaccg

SEQ ID NO: 1226229 - RNA, 22 nt, Mycobacterium leprae
cugacucucgcacgaguuggau

SEQ ID NO: 1226230 - RNA, 17 nt, Mycobacterium leprae
cuccugagacaucgcca

SEQ ID NO: 1226231 - RNA, 21 nt, Mycobacterium leprae
cuccugagacaucgccaccga

SEQ ID NO: 1226232 - RNA, 23 nt, Mycobacterium leprae
cuccguucacagugccgaaagcc

SEQ ID NO: 1226233 - RNA, 19 nt, Mycobacterium leprae
cucccgauuuucgauccgc

SEQ ID NO: 1226234 - RNA, 21 nt, Mycobacterium leprae
cucgcgcagcaaucaaugugc

SEQ ID NO: 1226235 - RNA, 21 nt, Mycobacterium leprae
cucggacgugguccgaucgca

SEQ ID NO: 1226236 - RNA, 13 nt, Mycobacterium leprae
cucggcgaucggc

SEQ ID NO: 1226237 - RNA, 13 nt, Mycobacterium leprae
cgucucacgcacc

SEQ ID NO: 1226238 - RNA, 21 nt, Mycobacterium leprae
cgucucacgcaccugaucggu

SEQ ID NO: 1226239 - RNA, 15 nt, Mycobacterium leprae
cgucguccggcaauc

SEQ ID NO: 1226240 - RNA, 15 nt, Mycobacterium leprae
cgucuggaucaacuu

SEQ ID NO: 1226241 - RNA, 16 nt, Mycobacterium leprae
cgucggccgcggcgac

SEQ ID NO: 1226242 - RNA, 21 nt, Mycobacterium leprae
cgucggugagguguucgggau

SEQ ID NO: 1226243 - RNA, 15 nt, Mycobacterium leprae
cgugaugaacuucgg

SEQ ID NO: 1226244 - RNA, 15 nt, Mycobacterium leprae
cgugccuugcggcag

SEQ ID NO: 1226245 - RNA, 19 nt, Mycobacterium leprae
cgucgcugugugcgcgccg

SEQ ID NO: 1226246 - RNA, 21 nt, Mycobacterium leprae
cgucggagucaucgacuugcu

SEQ ID NO: 1226247 - RNA, 23 nt, Mycobacterium leprae
cgucggccaguaccuccagccgc

SEQ ID NO: 1226248 - RNA, 13 nt, Mycobacterium leprae
cgucggccagcac

SEQ ID NO: 1226249 - RNA, 17 nt, Mycobacterium leprae
cgucggcauaucgaccg

SEQ ID NO: 1226250 - RNA, 22 nt, Mycobacterium leprae
cgucgcagguucugcaccccag

SEQ ID NO: 1226251 - RNA, 15 nt, Mycobacterium leprae
cgucgcaucggugau

SEQ ID NO: 1226252 - RNA, 19 nt, Mycobacterium leprae
cgucgcaccgauauccggc

SEQ ID NO: 1226253 - RNA, 14 nt, Mycobacterium leprae
cgucgaucucgacg

SEQ ID NO: 1226254 - RNA, 13 nt, Mycobacterium leprae
cgucgagccgauu

SEQ ID NO: 1226255 - RNA, 16 nt, Mycobacterium leprae
cgucgccuuagccgaa

SEQ ID NO: 1226256 - RNA, 18 nt, Mycobacterium leprae
cgucgccuuagccgaacu

SEQ ID NO: 1226257 - RNA, 19 nt, Mycobacterium leprae
cguccuccaccuuuuucgg

SEQ ID NO: 1226258 - RNA, 14 nt, Mycobacterium leprae
cguccucggcggca

SEQ ID NO: 1226259 - RNA, 20 nt, Mycobacterium leprae
cgucccagguuuccguguca

SEQ ID NO: 1226260 - RNA, 18 nt, Mycobacterium leprae
cgucaguaucgcgacggc

SEQ ID NO: 1226261 - RNA, 19 nt, Mycobacterium leprae
cgucacgucgacggcggcc

SEQ ID NO: 1226262 - RNA, 14 nt, Mycobacterium leprae
cguagaacaagugc

SEQ ID NO: 1226263 - RNA, 18 nt, Mycobacterium leprae
cgguuacgcgcucgccgg

SEQ ID NO: 1226264 - RNA, 20 nt, Mycobacterium leprae
cgguuacguccgcggcagcu

SEQ ID NO: 1226265 - RNA, 20 nt, Mycobacterium leprae
cgguuccgcaauuucggcgu

SEQ ID NO: 1226266 - RNA, 15 nt, Mycobacterium leprae
cguaauuccugcagc

SEQ ID NO: 1226267 - RNA, 17 nt, Mycobacterium leprae
cgguuugauccagccga

SEQ ID NO: 1226268 - RNA, 13 nt, Mycobacterium leprae
cgguucggugacg

SEQ ID NO: 1226269 - RNA, 21 nt, Mycobacterium leprae
cgguucuauuuguguuggccg

SEQ ID NO: 1226270 - RNA, 20 nt, Mycobacterium leprae
cggugcuuuagcccgccgcg

SEQ ID NO: 1226271 - RNA, 19 nt, Mycobacterium leprae
cggugggcaauucgccaau

SEQ ID NO: 1226272 - RNA, 13 nt, Mycobacterium leprae
cggugcgucaggu

SEQ ID NO: 1226273 - RNA, 18 nt, Mycobacterium leprae
cggugcugauggccggcc

SEQ ID NO: 1226274 - RNA, 15 nt, Mycobacterium leprae
cggugcugcagccac

SEQ ID NO: 1226275 - RNA, 22 nt, Mycobacterium leprae
cggugccuauuucacuggcccg

SEQ ID NO: 1226276 - RNA, 20 nt, Mycobacterium leprae
cggugcagcucguccaucgc

SEQ ID NO: 1226277 - RNA, 19 nt, Mycobacterium leprae
cggugccgaauucgcccga

SEQ ID NO: 1226278 - RNA, 16 nt, Mycobacterium leprae
cggugccgccauugcc

SEQ ID NO: 1226279 - RNA, 12 nt, Mycobacterium leprae
cggugccgccau

SEQ ID NO: 1226280 - RNA, 22 nt, Mycobacterium leprae
cggugagguguucgggauccug

SEQ ID NO: 1226281 - RNA, 15 nt, Mycobacterium leprae
cggugauauggccga

SEQ ID NO: 1226282 - RNA, 14 nt, Mycobacterium leprae
cggugaugacgaaa

SEQ ID NO: 1226283 - RNA, 17 nt, Mycobacterium leprae
cgucaagcagcaccaca

SEQ ID NO: 1226284 - RNA, 22 nt, Mycobacterium leprae
aacccggggguaguaguucacg

SEQ ID NO: 1226285 - RNA, 15 nt, Mycobacterium leprae
cguauaccggcugaa

SEQ ID NO: 1226286 - RNA, 23 nt, Mycobacterium leprae
cguauggcgccguggaggugcgg

SEQ ID NO: 1226287 - RNA, 13 nt, Mycobacterium leprae
cguaagcaugucg

SEQ ID NO: 1226288 - RNA, 20 nt, Mycobacterium leprae
cguaaggaagaugacaccga

SEQ ID NO: 1226289 - RNA, 18 nt, Mycobacterium leprae
cgucaaguccagcacgau

SEQ ID NO: 1226290 - RNA, 17 nt, Mycobacterium leprae
cgucacgucgacggcgg

SEQ ID NO: 1226291 - RNA, 14 nt, Mycobacterium leprae
cgucacggucgacu

SEQ ID NO: 1226292 - RNA, 21 nt, Mycobacterium leprae
cgucacucuaccucggucggc

SEQ ID NO: 1226293 - RNA, 16 nt, Mycobacterium leprae
cgucccucggccaucu

SEQ ID NO: 1226294 - RNA, 13 nt, Mycobacterium leprae
cguccacgucgcc

SEQ ID NO: 1226295 - RNA, 18 nt, Mycobacterium leprae
cgucaucgacaucccagc

SEQ ID NO: 1226296 - RNA, 18 nt, Mycobacterium leprae
cguccaguaugucgucaa

SEQ ID NO: 1226297 - RNA, 13 nt, Mycobacterium leprae
cgucgugaaucau

SEQ ID NO: 1226298 - RNA, 20 nt, Mycobacterium leprae
cgucgugaaucaugccgcag

SEQ ID NO: 1226299 - RNA, 14 nt, Mycobacterium leprae
cgucguccggcaau

SEQ ID NO: 1226300 - RNA, 19 nt, Mycobacterium leprae
cgucguaggcugucugcgg

SEQ ID NO: 1226301 - RNA, 12 nt, Mycobacterium leprae
cgucgucagcug

SEQ ID NO: 1226302 - RNA, 17 nt, Mycobacterium leprae
cgucgucagcugcugaa

SEQ ID NO: 1226303 - RNA, 18 nt, Mycobacterium leprae
cgucgggugcuacacggc

SEQ ID NO: 1226304 - RNA, 19 nt, Mycobacterium leprae
cgucggaaacacagcaagc

SEQ ID NO: 1226305 - RNA, 15 nt, Mycobacterium leprae
cgucgcugugccaag

SEQ ID NO: 1226306 - RNA, 21 nt, Mycobacterium leprae
cgucgcaucggugaucguggu

SEQ ID NO: 1226307 - RNA, 15 nt, Mycobacterium leprae
cgucgcccucgccgg

SEQ ID NO: 1226308 - RNA, 19 nt, Mycobacterium leprae
cgucgcccucgccggcggu

SEQ ID NO: 1226309 - RNA, 17 nt, Mycobacterium leprae
cgguuuccaugaugguu

SEQ ID NO: 1226310 - RNA, 17 nt, Mycobacterium leprae
cgguuuauggcuaagcu

SEQ ID NO: 1226311 - RNA, 16 nt, Mycobacterium leprae
cgguugcguggcugcu

SEQ ID NO: 1226312 - RNA, 14 nt, Mycobacterium leprae
cgguguugcgcggc

SEQ ID NO: 1226313 - RNA, 15 nt, Mycobacterium leprae
cgguuccagucgaag

SEQ ID NO: 1226314 - RNA, 21 nt, Mycobacterium leprae
cggugucccauuacuacgcua

SEQ ID NO: 1226315 - RNA, 13 nt, Mycobacterium leprae
cgguguggugcuc

SEQ ID NO: 1226316 - RNA, 19 nt, Mycobacterium leprae
cggugugcgucggaugugc

SEQ ID NO: 1226317 - RNA, 12 nt, Mycobacterium leprae
cggugucacccg

SEQ ID NO: 1226318 - RNA, 18 nt, Mycobacterium leprae
cggugcugagucggcgcu

SEQ ID NO: 1226319 - RNA, 12 nt, Mycobacterium leprae
cgguggauucca

SEQ ID NO: 1226320 - RNA, 12 nt, Mycobacterium leprae
cgguggcugugu

SEQ ID NO: 1226321 - RNA, 15 nt, Mycobacterium leprae
cgguggcagccggcu

SEQ ID NO: 1226322 - RNA, 19 nt, Mycobacterium leprae
cggugcccuagaacaaacg

SEQ ID NO: 1226323 - RNA, 14 nt, Mycobacterium leprae
cggugagcggcaga

SEQ ID NO: 1226324 - RNA, 14 nt, Mycobacterium leprae
cggugaucguggug

SEQ ID NO: 1226325 - RNA, 19 nt, Mycobacterium leprae
cggucggggaaggccaagc

SEQ ID NO: 1226326 - RNA, 23 nt, Mycobacterium leprae
cggucugccuugauugccgucgg

SEQ ID NO: 1226327 - RNA, 14 nt, Mycobacterium leprae
cggucgugcugcug

SEQ ID NO: 1226328 - RNA, 23 nt, Mycobacterium leprae
cggucugauaguguaagccauca

SEQ ID NO: 1226329 - RNA, 15 nt, Mycobacterium leprae
cggucugcucggcga

SEQ ID NO: 1226330 - RNA, 16 nt, Mycobacterium leprae
cuaacgugcagcuggc

SEQ ID NO: 1226331 - RNA, 17 nt, Mycobacterium leprae
cguugugccgcugcauc

SEQ ID NO: 1226332 - RNA, 16 nt, Mycobacterium leprae
cguugucgucggccgc

SEQ ID NO: 1226333 - RNA, 22 nt, Mycobacterium leprae
cuacccaaaucagcaccauccg

SEQ ID NO: 1226334 - RNA, 15 nt, Mycobacterium leprae
cuacgcagcucugga

SEQ ID NO: 1226335 - RNA, 15 nt, Mycobacterium leprae
cuaccucggucggca

SEQ ID NO: 1226336 - RNA, 18 nt, Mycobacterium leprae
cuaccgaguuguccagau

SEQ ID NO: 1226337 - RNA, 21 nt, Mycobacterium leprae
cuagacgggaggaagauaucc

SEQ ID NO: 1226338 - RNA, 14 nt, Mycobacterium leprae
cuacucucugcaag

SEQ ID NO: 1226339 - RNA, 15 nt, Mycobacterium leprae
cuagcuggcagucgg

SEQ ID NO: 1226340 - RNA, 18 nt, Mycobacterium leprae
cuaggauagauccaccau

SEQ ID NO: 1226341 - RNA, 17 nt, Mycobacterium leprae
cuaggccacugggcuga

SEQ ID NO: 1226342 - RNA, 17 nt, Mycobacterium leprae
cguggcccaaaccguug

SEQ ID NO: 1226343 - RNA, 21 nt, Mycobacterium leprae
cguggauggcuuccacaucga

SEQ ID NO: 1226344 - RNA, 15 nt, Mycobacterium leprae
cguggcaccuaaggc

SEQ ID NO: 1226345 - RNA, 18 nt, Mycobacterium leprae
cgugcuaugaccucgccg

SEQ ID NO: 1226346 - RNA, 23 nt, Mycobacterium leprae
cgugcgcguauuucgagcgugac

SEQ ID NO: 1226347 - RNA, 20 nt, Mycobacterium leprae
cguggguacgugguggcugc

SEQ ID NO: 1226348 - RNA, 14 nt, Mycobacterium leprae
cgugguccgaucgc

SEQ ID NO: 1226349 - RNA, 22 nt, Mycobacterium leprae
cguuaguuucgggccucgccgu

SEQ ID NO: 1226350 - RNA, 18 nt, Mycobacterium leprae
cguucauccucgggcagu

SEQ ID NO: 1226351 - RNA, 17 nt, Mycobacterium leprae
cgugucuucgaccgaca

SEQ ID NO: 1226352 - RNA, 17 nt, Mycobacterium leprae
cgugugcuuugccgcag

SEQ ID NO: 1226353 - RNA, 14 nt, Mycobacterium leprae
cguucaguggccaa

SEQ ID NO: 1226354 - RNA, 20 nt, Mycobacterium leprae
cguuaccgacaccgccgacg

SEQ ID NO: 1226355 - RNA, 14 nt, Mycobacterium leprae
cuccgaucacuugg

SEQ ID NO: 1226356 - RNA, 19 nt, Mycobacterium leprae
cuccagccgcgggcgaugc

SEQ ID NO: 1226357 - RNA, 14 nt, Mycobacterium leprae
cuccguccagcugg

SEQ ID NO: 1226358 - RNA, 13 nt, Mycobacterium leprae
cucgccaaggucg

SEQ ID NO: 1226359 - RNA, 22 nt, Mycobacterium leprae
cucgcgccguuuccagcgcucg

SEQ ID NO: 1226360 - RNA, 17 nt, Mycobacterium leprae
cucgcggugggcuucca

SEQ ID NO: 1226361 - RNA, 17 nt, Mycobacterium leprae
cucgcuccaacaacggc

SEQ ID NO: 1226362 - RNA, 21 nt, Mycobacterium leprae
cucggcguguauuugaugaca

SEQ ID NO: 1226363 - RNA, 18 nt, Mycobacterium leprae
cucggggguugauccucc

SEQ ID NO: 1226364 - RNA, 14 nt, Mycobacterium leprae
cucggcgccaucga

SEQ ID NO: 1226365 - RNA, 13 nt, Mycobacterium leprae
cucggucgauggc

SEQ ID NO: 1226366 - RNA, 14 nt, Mycobacterium leprae
cucggucaggugcg

SEQ ID NO: 1226367 - RNA, 20 nt, Mycobacterium leprae
cucgguguucgcuccgccca

SEQ ID NO: 1226368 - RNA, 19 nt, Mycobacterium leprae
cucguagcggcggcggcca

SEQ ID NO: 1226369 - RNA, 22 nt, Mycobacterium leprae
cucgugcguuauauuugagugg

SEQ ID NO: 1226370 - RNA, 14 nt, Mycobacterium leprae
cucgugggcggcgg

SEQ ID NO: 1226371 - RNA, 21 nt, Mycobacterium leprae
cucgucggugagguguucggg

SEQ ID NO: 1226372 - RNA, 19 nt, Mycobacterium leprae
cucucgaggauuaucgccg

SEQ ID NO: 1226373 - RNA, 17 nt, Mycobacterium leprae
aacgaaaccaugccgcc

SEQ ID NO: 1226374 - RNA, 18 nt, Mycobacterium leprae
gaauguuguuagugcugc

SEQ ID NO: 1226375 - RNA, 14 nt, Mycobacterium leprae
gaauguccaccagc

SEQ ID NO: 1226376 - RNA, 20 nt, Mycobacterium leprae
aacgacuugaccagccgcag

SEQ ID NO: 1226377 - RNA, 14 nt, Mycobacterium leprae
gacauucgacgagu

SEQ ID NO: 1226378 - RNA, 22 nt, Mycobacterium leprae
aacgcaccggcguuccggccuc

SEQ ID NO: 1226379 - RNA, 15 nt, Mycobacterium leprae
gaccaccaccgccac

SEQ ID NO: 1226380 - RNA, 19 nt, Mycobacterium leprae
gaccacccacaacgccaaa

SEQ ID NO: 1226381 - RNA, 12 nt, Mycobacterium leprae
gaccaccaccgc

SEQ ID NO: 1226382 - RNA, 15 nt, Mycobacterium leprae
gaccaguucgacugg

SEQ ID NO: 1226383 - RNA, 20 nt, Mycobacterium leprae
gaccauaguuacgacgucgc

SEQ ID NO: 1226384 - RNA, 16 nt, Mycobacterium leprae
gacgaacaugcaguac

SEQ ID NO: 1226385 - RNA, 22 nt, Mycobacterium leprae
gaccugaccguugcgucgcugu

SEQ ID NO: 1226386 - RNA, 16 nt, Mycobacterium leprae
gaccguugcgucgcug

SEQ ID NO: 1226387 - RNA, 15 nt, Mycobacterium leprae
gaccuauuuuuccgc

SEQ ID NO: 1226388 - RNA, 14 nt, Mycobacterium leprae
gaccgucuggaaca

SEQ ID NO: 1226389 - RNA, 12 nt, Mycobacterium leprae
aacggcggggcg

SEQ ID NO: 1226390 - RNA, 19 nt, Mycobacterium leprae
gaccgucgaagugcgccag

SEQ ID NO: 1226391 - RNA, 20 nt, Mycobacterium leprae
gaccgucgaagugcgccagc

SEQ ID NO: 1226392 - RNA, 17 nt, Mycobacterium leprae
gaccgacggcgccgcac

SEQ ID NO: 1226393 - RNA, 18 nt, Mycobacterium leprae
gaccgaacuguggaucgu

SEQ ID NO: 1226394 - RNA, 21 nt, Mycobacterium leprae
gaccgaacuguggaucguuga

SEQ ID NO: 1226395 - RNA, 13 nt, Mycobacterium leprae
gaccgaaccccga

SEQ ID NO: 1226396 - RNA, 13 nt, Mycobacterium leprae
aacgcuggcggcg

SEQ ID NO: 1226397 - RNA, 16 nt, Mycobacterium leprae
aacgcuggucggaugg

SEQ ID NO: 1226398 - RNA, 23 nt, Mycobacterium leprae
aacggccuguucgggcgcccggu

SEQ ID NO: 1226399 - RNA, 13 nt, Mycobacterium leprae
gaccgcuaugcgg

SEQ ID NO: 1226400 - RNA, 17 nt, Mycobacterium leprae
gaaucaugccgcagcau

SEQ ID NO: 1226401 - RNA, 15 nt, Mycobacterium leprae
gaaucagcaucgaca

SEQ ID NO: 1226402 - RNA, 23 nt, Mycobacterium leprae
gaagugauucgaaggcggugauc

SEQ ID NO: 1226403 - RNA, 14 nt, Mycobacterium leprae
gaagugaucggcga

SEQ ID NO: 1226404 - RNA, 16 nt, Mycobacterium leprae
gaaucguuccacccga

SEQ ID NO: 1226405 - RNA, 17 nt, Mycobacterium leprae
gaauccacuugagcggc

SEQ ID NO: 1226406 - RNA, 17 nt, Mycobacterium leprae
gaaggccuagcuggcag

SEQ ID NO: 1226407 - RNA, 18 nt, Mycobacterium leprae
gaaggcgauaucgaugca

SEQ ID NO: 1226408 - RNA, 22 nt, Mycobacterium leprae
gaagucgacgccgcggcugccg

SEQ ID NO: 1226409 - RNA, 18 nt, Mycobacterium leprae
gaaggugagucgacagcg

SEQ ID NO: 1226410 - RNA, 16 nt, Mycobacterium leprae
gaagcugaauggucau

SEQ ID NO: 1226411 - RNA, 18 nt, Mycobacterium leprae
gaagaguuucugcugccg

SEQ ID NO: 1226412 - RNA, 22 nt, Mycobacterium leprae
gaagauccuauccggaaaucga

SEQ ID NO: 1226413 - RNA, 16 nt, Mycobacterium leprae
gaagauguuccggcga

SEQ ID NO: 1226414 - RNA, 14 nt, Mycobacterium leprae
gaacgccaggcgcc

SEQ ID NO: 1226415 - RNA, 14 nt, Mycobacterium leprae
gaaccugccaucca

SEQ ID NO: 1226416 - RNA, 17 nt, Mycobacterium leprae
gaacuggugagacauuu

SEQ ID NO: 1226417 - RNA, 16 nt, Mycobacterium leprae
gaacucgucguccggc

SEQ ID NO: 1226418 - RNA, 15 nt, Mycobacterium leprae
gaacuucaagcucau

SEQ ID NO: 1226419 - RNA, 13 nt, Mycobacterium leprae
cuuguuagccguu

SEQ ID NO: 1226420 - RNA, 16 nt, Mycobacterium leprae
cuuguuaucgaagcuu

SEQ ID NO: 1226421 - RNA, 17 nt, Mycobacterium leprae
gaaaguaggcacagccc

SEQ ID NO: 1226422 - RNA, 17 nt, Mycobacterium leprae
gaaagcuucugguccgu

SEQ ID NO: 1226423 - RNA, 15 nt, Mycobacterium leprae
gaaagcucaagcuug

SEQ ID NO: 1226424 - RNA, 19 nt, Mycobacterium leprae
gaacagugggggugcggca

SEQ ID NO: 1226425 - RNA, 24 nt, Mycobacterium leprae
gaacaucgcgaaugacguucagug

SEQ ID NO: 1226426 - RNA, 21 nt, Mycobacterium leprae
gaacagcauccucggcacagu

SEQ ID NO: 1226427 - RNA, 22 nt, Mycobacterium leprae
gaaaucgagaauuuaccggcgu

SEQ ID NO: 1226428 - RNA, 14 nt, Mycobacterium leprae
cuggauggccgcca

SEQ ID NO: 1226429 - RNA, 23 nt, Mycobacterium leprae
cuggacccguggaauccgcugca

SEQ ID NO: 1226430 - RNA, 16 nt, Mycobacterium leprae
cuggccaucgcaccga

SEQ ID NO: 1226431 - RNA, 13 nt, Mycobacterium leprae
cugcugcuggccu

SEQ ID NO: 1226432 - RNA, 23 nt, Mycobacterium leprae
cugcugggaaugccggauuccga

SEQ ID NO: 1226433 - RNA, 20 nt, Mycobacterium leprae
cugcuggccuggauugucga

SEQ ID NO: 1226434 - RNA, 14 nt, Mycobacterium leprae
cugcugguggagua

SEQ ID NO: 1226435 - RNA, 19 nt, Mycobacterium leprae
cugcugguggaguacuggg

SEQ ID NO: 1226436 - RNA, 12 nt, Mycobacterium leprae
cugcucggcgaa

SEQ ID NO: 1226437 - RNA, 14 nt, Mycobacterium leprae
cugcugcagaccgg

SEQ ID NO: 1226438 - RNA, 13 nt, Mycobacterium leprae
cugcugcggcgcc

SEQ ID NO: 1226439 - RNA, 13 nt, Mycobacterium leprae
cugcucucagcac

SEQ ID NO: 1226440 - RNA, 20 nt, Mycobacterium leprae
cugcugauauagcgcucaac

SEQ ID NO: 1226441 - RNA, 18 nt, Mycobacterium leprae
cugcggugugugggucgc

SEQ ID NO: 1226442 - RNA, 15 nt, Mycobacterium leprae
cugcggugguggccg

SEQ ID NO: 1226443 - RNA, 19 nt, Mycobacterium leprae
cugcuaugguuggucggcc

SEQ ID NO: 1226444 - RNA, 14 nt, Mycobacterium leprae
cugcgugucgaccc

SEQ ID NO: 1226445 - RNA, 14 nt, Mycobacterium leprae
cugccucgucgaug

SEQ ID NO: 1226446 - RNA, 14 nt, Mycobacterium leprae
cugccgucccucgg

SEQ ID NO: 1226447 - RNA, 13 nt, Mycobacterium leprae
cugccggugaccg

SEQ ID NO: 1226448 - RNA, 14 nt, Mycobacterium leprae
cugcgacaucucgg

SEQ ID NO: 1226449 - RNA, 19 nt, Mycobacterium leprae
cugcgauccggcacaucga

SEQ ID NO: 1226450 - RNA, 24 nt, Mycobacterium leprae
cugcgauccggcacaucgaaccga

SEQ ID NO: 1226451 - RNA, 13 nt, Mycobacterium leprae
cugcgacguccca

SEQ ID NO: 1226452 - RNA, 18 nt, Mycobacterium leprae
cugcgaccgaccaaccgu

SEQ ID NO: 1226453 - RNA, 16 nt, Mycobacterium leprae
cugcgaccuggugucg

SEQ ID NO: 1226454 - RNA, 18 nt, Mycobacterium leprae
cugcgccguuugggccac

SEQ ID NO: 1226455 - RNA, 15 nt, Mycobacterium leprae
cugcgcucaccucgg

SEQ ID NO: 1226456 - RNA, 20 nt, Mycobacterium leprae
cugcgcugagagugccaccg

SEQ ID NO: 1226457 - RNA, 15 nt, Mycobacterium leprae
cuuccguacgccgcu

SEQ ID NO: 1226458 - RNA, 17 nt, Mycobacterium leprae
cuuccugcggugguggc

SEQ ID NO: 1226459 - RNA, 14 nt, Mycobacterium leprae
cuucggccagcgca

SEQ ID NO: 1226460 - RNA, 22 nt, Mycobacterium leprae
cuuguacagugaugcggacgac

SEQ ID NO: 1226461 - RNA, 19 nt, Mycobacterium leprae
cuugguuagguugguggug

SEQ ID NO: 1226462 - RNA, 13 nt, Mycobacterium leprae
cuugccgucgauu

SEQ ID NO: 1226463 - RNA, 17 nt, Mycobacterium leprae
cuugccccguugugguc

SEQ ID NO: 1226464 - RNA, 20 nt, Mycobacterium leprae
cuugcccucguugacgcccu

SEQ ID NO: 1226465 - RNA, 23 nt, Mycobacterium leprae
cuugacgggaggaacuccgugac

SEQ ID NO: 1226466 - RNA, 19 nt, Mycobacterium leprae
cuguuggugugugaggauc

SEQ ID NO: 1226467 - RNA, 20 nt, Mycobacterium leprae
cuuagcacguccucggccca

SEQ ID NO: 1226468 - RNA, 20 nt, Mycobacterium leprae
cuuagccaacaccgcggcga

SEQ ID NO: 1226469 - RNA, 15 nt, Mycobacterium leprae
cuuacgugcgccgcg

SEQ ID NO: 1226470 - RNA, 16 nt, Mycobacterium leprae
cuuagcuaugcaguga

SEQ ID NO: 1226471 - RNA, 16 nt, Mycobacterium leprae
cuucacacgagccgca

SEQ ID NO: 1226472 - RNA, 23 nt, Mycobacterium leprae
cugguuggcgcgcuuucggagau

SEQ ID NO: 1226473 - RNA, 12 nt, Mycobacterium leprae
cuguccgcacaa

SEQ ID NO: 1226474 - RNA, 22 nt, Mycobacterium leprae
cuguccgcacaaacuucgacga

SEQ ID NO: 1226475 - RNA, 22 nt, Mycobacterium leprae
cugucgaaaaccucacgaaucc

SEQ ID NO: 1226476 - RNA, 14 nt, Mycobacterium leprae
cugucguggcugca

SEQ ID NO: 1226477 - RNA, 16 nt, Mycobacterium leprae
cugucgugagaaucgg

SEQ ID NO: 1226478 - RNA, 16 nt, Mycobacterium leprae
cugucggugccgccau

SEQ ID NO: 1226479 - RNA, 21 nt, Mycobacterium leprae
cuguugaauauacgaaucccg

SEQ ID NO: 1226480 - RNA, 23 nt, Mycobacterium leprae
cuguugaauauacgaaucccgcu

SEQ ID NO: 1226481 - RNA, 22 nt, Mycobacterium leprae
cugugacagcgugccgaagugu

SEQ ID NO: 1226482 - RNA, 19 nt, Mycobacterium leprae
cuggugcguggcgaccgca

SEQ ID NO: 1226483 - RNA, 18 nt, Mycobacterium leprae
cuggugugcgcgccgccc

SEQ ID NO: 1226484 - RNA, 16 nt, Mycobacterium leprae
cugguuguccacggca

SEQ ID NO: 1226485 - RNA, 12 nt, Mycobacterium leprae
cugggcaccacc

SEQ ID NO: 1226486 - RNA, 21 nt, Mycobacterium leprae
cugggcggcuagucggccggc

SEQ ID NO: 1226487 - RNA, 15 nt, Mycobacterium leprae
gauuuggauggucgg

SEQ ID NO: 1226488 - RNA, 17 nt, Mycobacterium leprae
gauuccgccgucgaucu

SEQ ID NO: 1226489 - RNA, 14 nt, Mycobacterium leprae
gauuuggugcugcc

SEQ ID NO: 1226490 - RNA, 20 nt, Mycobacterium leprae
gcaaaacgucgaucucgacg

SEQ ID NO: 1226491 - RNA, 16 nt, Mycobacterium leprae
gcaaagagucgaccug

SEQ ID NO: 1226492 - RNA, 16 nt, Mycobacterium leprae
gcaaauugccgagcug

SEQ ID NO: 1226493 - RNA, 19 nt, Mycobacterium leprae
gcaaccaacuucacuggcu

SEQ ID NO: 1226494 - RNA, 20 nt, Mycobacterium leprae
gauggcgucaccgugcagcg

SEQ ID NO: 1226495 - RNA, 22 nt, Mycobacterium leprae
gauggugucgaugaugcgcugu

SEQ ID NO: 1226496 - RNA, 14 nt, Mycobacterium leprae
gaugucuuggcuga

SEQ ID NO: 1226497 - RNA, 19 nt, Mycobacterium leprae
gaugcggucaugcgucugu

SEQ ID NO: 1226498 - RNA, 14 nt, Mycobacterium leprae
gaucuggauggccg

SEQ ID NO: 1226499 - RNA, 17 nt, Mycobacterium leprae
gaugcgugccccggccg

SEQ ID NO: 1226500 - RNA, 15 nt, Mycobacterium leprae
gaugcugcguucagc

SEQ ID NO: 1226501 - RNA, 23 nt, Mycobacterium leprae
gaugcuguggugugcguugccug

SEQ ID NO: 1226502 - RNA, 20 nt, Mycobacterium leprae
gaugcuggccguguugcugc

SEQ ID NO: 1226503 - RNA, 18 nt, Mycobacterium leprae
gcaagugcaccaucugcu

SEQ ID NO: 1226504 - RNA, 14 nt, Mycobacterium leprae
gcaagugcggcgcc

SEQ ID NO: 1226505 - RNA, 23 nt, Mycobacterium leprae
gcaaggucguguugccaccgaca

SEQ ID NO: 1226506 - RNA, 17 nt, Mycobacterium leprae
gcaagguguugcgguga

SEQ ID NO: 1226507 - RNA, 16 nt, Mycobacterium leprae
gcaaguaaaacugaca

SEQ ID NO: 1226508 - RNA, 17 nt, Mycobacterium leprae
gcaaguaaaacugacac

SEQ ID NO: 1226509 - RNA, 18 nt, Mycobacterium leprae
gcacaaguaccggcucac

SEQ ID NO: 1226510 - RNA, 21 nt, Mycobacterium leprae
gcacacugucacgucggccug

SEQ ID NO: 1226511 - RNA, 14 nt, Mycobacterium leprae
gcaaugucgccggg

SEQ ID NO: 1226512 - RNA, 21 nt, Mycobacterium leprae
gcaacucaucggcucccaucg

SEQ ID NO: 1226513 - RNA, 14 nt, Mycobacterium leprae
gcaacucgaccuau

SEQ ID NO: 1226514 - RNA, 21 nt, Mycobacterium leprae
gcaacugaagauuuggcgagu

SEQ ID NO: 1226515 - RNA, 14 nt, Mycobacterium leprae
gcaagcucgggugu

SEQ ID NO: 1226516 - RNA, 19 nt, Mycobacterium leprae
gcaagcgagccaucgcaau

SEQ ID NO: 1226517 - RNA, 22 nt, Mycobacterium leprae
gcaagcccgguuaguccgaccg

SEQ ID NO: 1226518 - RNA, 20 nt, Mycobacterium leprae
gcaagcaggcaugccgccgg

SEQ ID NO: 1226519 - RNA, 15 nt, Mycobacterium leprae
gcaacgcuguugacc

SEQ ID NO: 1226520 - RNA, 19 nt, Mycobacterium leprae
gcaacgaccaccgaucgaa

SEQ ID NO: 1226521 - RNA, 16 nt, Mycobacterium leprae
gcagacucgagucccg

SEQ ID NO: 1226522 - RNA, 19 nt, Mycobacterium leprae
gcagacucgagucccgaaa

SEQ ID NO: 1226523 - RNA, 22 nt, Mycobacterium leprae
gcagaaguuguucgucgggugc

SEQ ID NO: 1226524 - RNA, 15 nt, Mycobacterium leprae
gcagaucgacagcgg

SEQ ID NO: 1226525 - RNA, 15 nt, Mycobacterium leprae
gcagaucgaucucga

SEQ ID NO: 1226526 - RNA, 19 nt, Mycobacterium leprae
gcagcagcggagcgaacgg

SEQ ID NO: 1226527 - RNA, 22 nt, Mycobacterium leprae
gcagcauauggaaagucagcau

SEQ ID NO: 1226528 - RNA, 14 nt, Mycobacterium leprae
gcagcauccaccac

SEQ ID NO: 1226529 - RNA, 20 nt, Mycobacterium leprae
gcagccgagguucccggcgg

SEQ ID NO: 1226530 - RNA, 17 nt, Mycobacterium leprae
gcagccgaucggcugcc

SEQ ID NO: 1226531 - RNA, 21 nt, Mycobacterium leprae
gcagccugguguggacagcgu

SEQ ID NO: 1226532 - RNA, 16 nt, Mycobacterium leprae
gcagcgccacgccgga

SEQ ID NO: 1226533 - RNA, 14 nt, Mycobacterium leprae
gcaccagucgcgca

SEQ ID NO: 1226534 - RNA, 16 nt, Mycobacterium leprae
gcacagagcccagcac

SEQ ID NO: 1226535 - RNA, 19 nt, Mycobacterium leprae
gcacagagcccagcacgcg

SEQ ID NO: 1226536 - RNA, 18 nt, Mycobacterium leprae
gcacccugcacacugacu

SEQ ID NO: 1226537 - RNA, 16 nt, Mycobacterium leprae
gcaccguacaugcugg

SEQ ID NO: 1226538 - RNA, 16 nt, Mycobacterium leprae
gcaccuugggcgccuc

SEQ ID NO: 1226539 - RNA, 14 nt, Mycobacterium leprae
gcaccugccgcagc

SEQ ID NO: 1226540 - RNA, 16 nt, Mycobacterium leprae
gcaccuacaugucggu

SEQ ID NO: 1226541 - RNA, 16 nt, Mycobacterium leprae
gcacgauggccgguga

SEQ ID NO: 1226542 - RNA, 14 nt, Mycobacterium leprae
gcacggagcggccg

SEQ ID NO: 1226543 - RNA, 22 nt, Mycobacterium leprae
gcacggcguaugaccgcggucg

SEQ ID NO: 1226544 - RNA, 24 nt, Mycobacterium leprae
gcacggcguaugaccgcggucggc

SEQ ID NO: 1226545 - RNA, 20 nt, Mycobacterium leprae
gaucgcugccggcggcagau

SEQ ID NO: 1226546 - RNA, 23 nt, Mycobacterium leprae
gaucggcauggcguucggggugu

SEQ ID NO: 1226547 - RNA, 22 nt, Mycobacterium leprae
gaucuaugguuuuggccgcggu

SEQ ID NO: 1226548 - RNA, 20 nt, Mycobacterium leprae
gaucgugccccucgaagucg

SEQ ID NO: 1226549 - RNA, 20 nt, Mycobacterium leprae
gaucguacgaaagaugcugc

SEQ ID NO: 1226550 - RNA, 23 nt, Mycobacterium leprae
gaucggguugacgcugcuugcuc

SEQ ID NO: 1226551 - RNA, 15 nt, Mycobacterium leprae
gaucggugcaugcac

SEQ ID NO: 1226552 - RNA, 20 nt, Mycobacterium leprae
gaucggugcaugcacaucgc

SEQ ID NO: 1226553 - RNA, 15 nt, Mycobacterium leprae
gaucgggcccagcac

SEQ ID NO: 1226554 - RNA, 22 nt, Mycobacterium leprae
gaucccagaauuuucggcggca

SEQ ID NO: 1226555 - RNA, 20 nt, Mycobacterium leprae
gaucagcaacacuggcgacc

SEQ ID NO: 1226556 - RNA, 16 nt, Mycobacterium leprae
gaucgcacuaauaagc

SEQ ID NO: 1226557 - RNA, 15 nt, Mycobacterium leprae
gaucgagcgauugug

SEQ ID NO: 1226558 - RNA, 14 nt, Mycobacterium leprae
gaguugacccacaa

SEQ ID NO: 1226559 - RNA, 19 nt, Mycobacterium leprae
gaucaaagcgguuccuccc

SEQ ID NO: 1226560 - RNA, 14 nt, Mycobacterium leprae
gaucaacgccgcga

SEQ ID NO: 1226561 - RNA, 16 nt, Mycobacterium leprae
gaucaacgccgcgaac

SEQ ID NO: 1226562 - RNA, 16 nt, Mycobacterium leprae
gaucaccgccaccacg

SEQ ID NO: 1226563 - RNA, 18 nt, Mycobacterium leprae
gauauccgccggccgcac

SEQ ID NO: 1226564 - RNA, 21 nt, Mycobacterium leprae
gaguguagcaggucgccgagg

SEQ ID NO: 1226565 - RNA, 16 nt, Mycobacterium leprae
gagugugauaccgacu

SEQ ID NO: 1226566 - RNA, 14 nt, Mycobacterium leprae
gagugcuggucaac

SEQ ID NO: 1226567 - RNA, 15 nt, Mycobacterium leprae
gagucggcgugcgga

SEQ ID NO: 1226568 - RNA, 24 nt, Mycobacterium leprae
gagucggauuuauuugucgcugga

SEQ ID NO: 1226569 - RNA, 23 nt, Mycobacterium leprae
gaguaucgaaucggugaucaacg

SEQ ID NO: 1226570 - RNA, 23 nt, Mycobacterium leprae
gaggauuccagcaauuguucgac

SEQ ID NO: 1226571 - RNA, 13 nt, Mycobacterium leprae
gagcuuuuccagc

SEQ ID NO: 1226572 - RNA, 20 nt, Mycobacterium leprae
gaggaagcucgguucgguga

SEQ ID NO: 1226573 - RNA, 18 nt, Mycobacterium leprae
aacuagccgaagcggccg

SEQ ID NO: 1226574 - RNA, 18 nt, Mycobacterium leprae
gagaaagucacuuacgac

SEQ ID NO: 1226575 - RNA, 13 nt, Mycobacterium leprae
gacuugaccagcc

SEQ ID NO: 1226576 - RNA, 14 nt, Mycobacterium leprae
gacuguagagacgu

SEQ ID NO: 1226577 - RNA, 21 nt, Mycobacterium leprae
gacuguagagacguaccacuc

SEQ ID NO: 1226578 - RNA, 23 nt, Mycobacterium leprae
gacugcacccggccgucgcucgg

SEQ ID NO: 1226579 - RNA, 22 nt, Mycobacterium leprae
gacucaucgccaaccgucggga

SEQ ID NO: 1226580 - RNA, 18 nt, Mycobacterium leprae
gacucagcaaugcucugc

SEQ ID NO: 1226581 - RNA, 14 nt, Mycobacterium leprae
gacucaaacgucga

SEQ ID NO: 1226582 - RNA, 21 nt, Mycobacterium leprae
gacuagucgucgugcugauca

SEQ ID NO: 1226583 - RNA, 18 nt, Mycobacterium leprae
gacguguucacgcaguca

SEQ ID NO: 1226584 - RNA, 14 nt, Mycobacterium leprae
gacgucgcuuguga

SEQ ID NO: 1226585 - RNA, 23 nt, Mycobacterium leprae
gacgucgguguggugcucuaucg

SEQ ID NO: 1226586 - RNA, 21 nt, Mycobacterium leprae
gacgucacgcugcucgagcag

SEQ ID NO: 1226587 - RNA, 21 nt, Mycobacterium leprae
gagcagugcugacaucaucgc

SEQ ID NO: 1226588 - RNA, 18 nt, Mycobacterium leprae
gagccaacgauacugaug

SEQ ID NO: 1226589 - RNA, 16 nt, Mycobacterium leprae
aacuccagagccgcgc

SEQ ID NO: 1226590 - RNA, 17 nt, Mycobacterium leprae
gagcaugaccgagcugg

SEQ ID NO: 1226591 - RNA, 21 nt, Mycobacterium leprae
gagcccgacgcaacugcugga

SEQ ID NO: 1226592 - RNA, 23 nt, Mycobacterium leprae
gagcgauacacagccguugcugc

SEQ ID NO: 1226593 - RNA, 15 nt, Mycobacterium leprae
gagcgaagucgacgc

SEQ ID NO: 1226594 - RNA, 16 nt, Mycobacterium leprae
gagcgacagcucagcg

SEQ ID NO: 1226595 - RNA, 15 nt, Mycobacterium leprae
gagccgccagacugg

SEQ ID NO: 1226596 - RNA, 13 nt, Mycobacterium leprae
gagacaucgccac

SEQ ID NO: 1226597 - RNA, 17 nt, Mycobacterium leprae
gagacaucgccaccgac

SEQ ID NO: 1226598 - RNA, 13 nt, Mycobacterium leprae
gagacgaucgcaa

SEQ ID NO: 1226599 - RNA, 21 nt, Mycobacterium leprae
gagaucacaguccugcccgga

SEQ ID NO: 1226600 - RNA, 16 nt, Mycobacterium leprae
gagcaauccucagagu

SEQ ID NO: 1226601 - RNA, 14 nt, Mycobacterium leprae
gagauuucagccgg

SEQ ID NO: 1226602 - RNA, 15 nt, Mycobacterium leprae
gagaugucuucgacg

SEQ ID NO: 1226603 - RNA, 20 nt, Mycobacterium leprae
gcccgaagugcuugggcacg

SEQ ID NO: 1226604 - RNA, 23 nt, Mycobacterium leprae
gcccggaauccuguugacguguu

SEQ ID NO: 1226605 - RNA, 16 nt, Mycobacterium leprae
gcccggauugauggau

SEQ ID NO: 1226606 - RNA, 20 nt, Mycobacterium leprae
gcccgguuuuagcgugcugu

SEQ ID NO: 1226607 - RNA, 21 nt, Mycobacterium leprae
gcccggucaagacguugugac

SEQ ID NO: 1226608 - RNA, 13 nt, Mycobacterium leprae
gcccgguaccguc

SEQ ID NO: 1226609 - RNA, 15 nt, Mycobacterium leprae
gcccgggaugacguu

SEQ ID NO: 1226610 - RNA, 19 nt, Mycobacterium leprae
gcccgucacuacguuggcc

SEQ ID NO: 1226611 - RNA, 20 nt, Mycobacterium leprae
aagaugacaccgaacagcuc

SEQ ID NO: 1226612 - RNA, 18 nt, Mycobacterium leprae
aagaugacucggcgugcc

SEQ ID NO: 1226613 - RNA, 21 nt, Mycobacterium leprae
gccgacgcgguugccggcgga

SEQ ID NO: 1226614 - RNA, 15 nt, Mycobacterium leprae
aagaugaucgucaua

SEQ ID NO: 1226615 - RNA, 16 nt, Mycobacterium leprae
gccgaccucggcgcug

SEQ ID NO: 1226616 - RNA, 14 nt, Mycobacterium leprae
gccgaagcagccgg

SEQ ID NO: 1226617 - RNA, 22 nt, Mycobacterium leprae
gccgaacguaccaccgcgguga

SEQ ID NO: 1226618 - RNA, 20 nt, Mycobacterium leprae
gccgaaaucgguggcagccg

SEQ ID NO: 1226619 - RNA, 21 nt, Mycobacterium leprae
gccgaaaucgguggcagccgg

SEQ ID NO: 1226620 - RNA, 14 nt, Mycobacterium leprae
gccgagcgcaucgg

SEQ ID NO: 1226621 - RNA, 19 nt, Mycobacterium leprae
gccgauaucgaccagccaa

SEQ ID NO: 1226622 - RNA, 13 nt, Mycobacterium leprae
gccgaucccgaaa

SEQ ID NO: 1226623 - RNA, 22 nt, Mycobacterium leprae
gccgagugcaggauugcguuga

SEQ ID NO: 1226624 - RNA, 13 nt, Mycobacterium leprae
gccgccagugcgc

SEQ ID NO: 1226625 - RNA, 13 nt, Mycobacterium leprae
gccgccgaacaag

SEQ ID NO: 1226626 - RNA, 16 nt, Mycobacterium leprae
gccgccgaacaagcca

SEQ ID NO: 1226627 - RNA, 12 nt, Mycobacterium leprae
gccgaucgguau

SEQ ID NO: 1226628 - RNA, 14 nt, Mycobacterium leprae
gccgaucgguauug

SEQ ID NO: 1226629 - RNA, 13 nt, Mycobacterium leprae
gccaugaccgacc

SEQ ID NO: 1226630 - RNA, 13 nt, Mycobacterium leprae
gccaucgcaccga

SEQ ID NO: 1226631 - RNA, 23 nt, Mycobacterium leprae
gccaucggcagaucgaucucgac

SEQ ID NO: 1226632 - RNA, 12 nt, Mycobacterium leprae
gccaucgacgcc

SEQ ID NO: 1226633 - RNA, 21 nt, Mycobacterium leprae
gccauauccucgaccaccagg

SEQ ID NO: 1226634 - RNA, 13 nt, Mycobacterium leprae
gccauaucguucc

SEQ ID NO: 1226635 - RNA, 12 nt, Mycobacterium leprae
gccaggucggcu

SEQ ID NO: 1226636 - RNA, 15 nt, Mycobacterium leprae
gccaggcgccgcagc

SEQ ID NO: 1226637 - RNA, 14 nt, Mycobacterium leprae
gccacugcacgacc

SEQ ID NO: 1226638 - RNA, 23 nt, Mycobacterium leprae
gccagacacugccaccgcuacgg

SEQ ID NO: 1226639 - RNA, 15 nt, Mycobacterium leprae
gccagccaggaugcg

SEQ ID NO: 1226640 - RNA, 16 nt, Mycobacterium leprae
gcaucgaugauccggc

SEQ ID NO: 1226641 - RNA, 13 nt, Mycobacterium leprae
gcaucggcaacgc

SEQ ID NO: 1226642 - RNA, 13 nt, Mycobacterium leprae
gcaucgacgaggu

SEQ ID NO: 1226643 - RNA, 13 nt, Mycobacterium leprae
gcaucgacagcac

SEQ ID NO: 1226644 - RNA, 18 nt, Mycobacterium leprae
gcaucgaagcaaccagcc

SEQ ID NO: 1226645 - RNA, 14 nt, Mycobacterium leprae
gcauccagucguug

SEQ ID NO: 1226646 - RNA, 22 nt, Mycobacterium leprae
gcaucaucgcccaccgcaacgc

SEQ ID NO: 1226647 - RNA, 18 nt, Mycobacterium leprae
gcaucaggaaggagccga

SEQ ID NO: 1226648 - RNA, 19 nt, Mycobacterium leprae
gcauacugcgaacaucgaa

SEQ ID NO: 1226649 - RNA, 15 nt, Mycobacterium leprae
gcauagcggccgcca

SEQ ID NO: 1226650 - RNA, 19 nt, Mycobacterium leprae
gcauacagugcaccggugg

SEQ ID NO: 1226651 - RNA, 15 nt, Mycobacterium leprae
gcaucaacgccgaga

SEQ ID NO: 1226652 - RNA, 14 nt, Mycobacterium leprae
gcaucacuucagcg

SEQ ID NO: 1226653 - RNA, 15 nt, Mycobacterium leprae
gcauaacccgaucac

SEQ ID NO: 1226654 - RNA, 21 nt, Mycobacterium leprae
gcaguuuccaacaaacuacug

SEQ ID NO: 1226655 - RNA, 17 nt, Mycobacterium leprae
gcaguuggauucggugu

SEQ ID NO: 1226656 - RNA, 23 nt, Mycobacterium leprae
gcaguugaccggagcgacaucga

SEQ ID NO: 1226657 - RNA, 18 nt, Mycobacterium leprae
gcaguugauccgucgcgu

SEQ ID NO: 1226658 - RNA, 12 nt, Mycobacterium leprae
gcagugcgguga

SEQ ID NO: 1226659 - RNA, 22 nt, Mycobacterium leprae
gcagugaucacaucagugcugu

SEQ ID NO: 1226660 - RNA, 13 nt, Mycobacterium leprae
gcagcgcgaacag

SEQ ID NO: 1226661 - RNA, 16 nt, Mycobacterium leprae
gcaugugugaacgaca

SEQ ID NO: 1226662 - RNA, 19 nt, Mycobacterium leprae
gcauucccaaccgcgacgc

SEQ ID NO: 1226663 - RNA, 13 nt, Mycobacterium leprae
gcaugucgguggu

SEQ ID NO: 1226664 - RNA, 23 nt, Mycobacterium leprae
gcauggcgaugcgcagccgcggu

SEQ ID NO: 1226665 - RNA, 21 nt, Mycobacterium leprae
gcauggaauuguucugcgcug

SEQ ID NO: 1226666 - RNA, 13 nt, Mycobacterium leprae
gcaugccgccggg

SEQ ID NO: 1226667 - RNA, 16 nt, Mycobacterium leprae
gcaugccgccgggugc

SEQ ID NO: 1226668 - RNA, 21 nt, Mycobacterium leprae
gcaugcgcugaggcagcagcu

SEQ ID NO: 1226669 - RNA, 19 nt, Mycobacterium leprae
gcaucugguagccguucgg

SEQ ID NO: 1226670 - RNA, 18 nt, Mycobacterium leprae
gccaacgggaacagcggc

SEQ ID NO: 1226671 - RNA, 21 nt, Mycobacterium leprae
gccaacgauacugaugggcag

SEQ ID NO: 1226672 - RNA, 23 nt, Mycobacterium leprae
gccaacccuacgggaacacgucg

SEQ ID NO: 1226673 - RNA, 18 nt, Mycobacterium leprae
gcauugaucuuggugaug

SEQ ID NO: 1226674 - RNA, 17 nt, Mycobacterium leprae
gcauuuaccgagaucga

SEQ ID NO: 1226675 - RNA, 15 nt, Mycobacterium leprae
gccaacacgucacga

SEQ ID NO: 1226676 - RNA, 16 nt, Mycobacterium leprae
gcggcgggaucgccga

SEQ ID NO: 1226677 - RNA, 21 nt, Mycobacterium leprae
gcggcgaucauggugguguuc

SEQ ID NO: 1226678 - RNA, 20 nt, Mycobacterium leprae
gcggcauugcggcguucgug

SEQ ID NO: 1226679 - RNA, 13 nt, Mycobacterium leprae
gcggccgccagca

SEQ ID NO: 1226680 - RNA, 19 nt, Mycobacterium leprae
gcgguaccgucuaguggcg

SEQ ID NO: 1226681 - RNA, 19 nt, Mycobacterium leprae
gcgguaugcggccgcaaaa

SEQ ID NO: 1226682 - RNA, 14 nt, Mycobacterium leprae
gcgggugcaguugu

SEQ ID NO: 1226683 - RNA, 15 nt, Mycobacterium leprae
gcggguacgacgccu

SEQ ID NO: 1226684 - RNA, 19 nt, Mycobacterium leprae
gcgggguuuuuguuggugg

SEQ ID NO: 1226685 - RNA, 20 nt, Mycobacterium leprae
gcgggacgugcacugguggu

SEQ ID NO: 1226686 - RNA, 17 nt, Mycobacterium leprae
gcggcuuguugaccggc

SEQ ID NO: 1226687 - RNA, 15 nt, Mycobacterium leprae
gcggcuuguuuguug

SEQ ID NO: 1226688 - RNA, 12 nt, Mycobacterium leprae
gcggcucaccga

SEQ ID NO: 1226689 - RNA, 17 nt, Mycobacterium leprae
aagcugguccgccucga

SEQ ID NO: 1226690 - RNA, 22 nt, Mycobacterium leprae
gcggcuacucugcguaggccag

SEQ ID NO: 1226691 - RNA, 22 nt, Mycobacterium leprae
gcggcaccuuaccguccaccga

SEQ ID NO: 1226692 - RNA, 23 nt, Mycobacterium leprae
aagccuggucgcguaguuccacc

SEQ ID NO: 1226693 - RNA, 20 nt, Mycobacterium leprae
aagccucgaaccgauccagc

SEQ ID NO: 1226694 - RNA, 18 nt, Mycobacterium leprae
aagccgcgcccggccagu

SEQ ID NO: 1226695 - RNA, 15 nt, Mycobacterium leprae
aagccgcgcaucugc

SEQ ID NO: 1226696 - RNA, 20 nt, Mycobacterium leprae
aagccgcuggaagucggucu

SEQ ID NO: 1226697 - RNA, 16 nt, Mycobacterium leprae
gcggauccuguugacu

SEQ ID NO: 1226698 - RNA, 22 nt, Mycobacterium leprae
gcggaugaauaucaucgccaac

SEQ ID NO: 1226699 - RNA, 23 nt, Mycobacterium leprae
gcggaucgcagugcguauucggc

SEQ ID NO: 1226700 - RNA, 20 nt, Mycobacterium leprae
gcggacauacugcugcccgc

SEQ ID NO: 1226701 - RNA, 22 nt, Mycobacterium leprae
gcggagaaauuaucguugaccg

SEQ ID NO: 1226702 - RNA, 14 nt, Mycobacterium leprae
gcggagacccccgu

SEQ ID NO: 1226703 - RNA, 16 nt, Mycobacterium leprae
gcggacugcuagccgg

SEQ ID NO: 1226704 - RNA, 16 nt, Mycobacterium leprae
gcgcugauaucggcga

SEQ ID NO: 1226705 - RNA, 16 nt, Mycobacterium leprae
gcgcgcagcuggccaa

SEQ ID NO: 1226706 - RNA, 17 nt, Mycobacterium leprae
gcggaagccgcucuacg

SEQ ID NO: 1226707 - RNA, 16 nt, Mycobacterium leprae
gcgcuuucaguuggau

SEQ ID NO: 1226708 - RNA, 20 nt, Mycobacterium leprae
gcggaaacguuuguggugcu

SEQ ID NO: 1226709 - RNA, 16 nt, Mycobacterium leprae
gcucguggcagucucg

SEQ ID NO: 1226710 - RNA, 17 nt, Mycobacterium leprae
gcugaacucagcgguaa

SEQ ID NO: 1226711 - RNA, 21 nt, Mycobacterium leprae
gcugaccgacuucaacggucg

SEQ ID NO: 1226712 - RNA, 18 nt, Mycobacterium leprae
gcucgguauuugcggugg

SEQ ID NO: 1226713 - RNA, 16 nt, Mycobacterium leprae
gcucgucacucgcgga

SEQ ID NO: 1226714 - RNA, 12 nt, Mycobacterium leprae
gcucgccgcgca

SEQ ID NO: 1226715 - RNA, 17 nt, Mycobacterium leprae
gcucaccggcggcgagc

SEQ ID NO: 1226716 - RNA, 20 nt, Mycobacterium leprae
gcuggacaucggcugugguu

SEQ ID NO: 1226717 - RNA, 14 nt, Mycobacterium leprae
gcuggagaucgacg

SEQ ID NO: 1226718 - RNA, 22 nt, Mycobacterium leprae
gcuggagcgcuauuaagucggc

SEQ ID NO: 1226719 - RNA, 15 nt, Mycobacterium leprae
gcugcugcgaccgac

SEQ ID NO: 1226720 - RNA, 20 nt, Mycobacterium leprae
gcugcugcggaucggugcau

SEQ ID NO: 1226721 - RNA, 15 nt, Mycobacterium leprae
gcugcugcuggugga

SEQ ID NO: 1226722 - RNA, 21 nt, Mycobacterium leprae
gcugcugcagaccggauacag

SEQ ID NO: 1226723 - RNA, 18 nt, Mycobacterium leprae
gcugcugagcguggcugc

SEQ ID NO: 1226724 - RNA, 15 nt, Mycobacterium leprae
gcugcuucaaucaac

SEQ ID NO: 1226725 - RNA, 18 nt, Mycobacterium leprae
gcuggccgugcuagucgu

SEQ ID NO: 1226726 - RNA, 17 nt, Mycobacterium leprae
gcuggccggcagggaug

SEQ ID NO: 1226727 - RNA, 17 nt, Mycobacterium leprae
gcuggcgacaguguguu

SEQ ID NO: 1226728 - RNA, 17 nt, Mycobacterium leprae
gcuggccaucgcaccga

SEQ ID NO: 1226729 - RNA, 17 nt, Mycobacterium leprae
gcuggccccggacccga

SEQ ID NO: 1226730 - RNA, 18 nt, Mycobacterium leprae
gcugaugcgaucccgaaa

SEQ ID NO: 1226731 - RNA, 12 nt, Mycobacterium leprae
gcugaugcugcc

SEQ ID NO: 1226732 - RNA, 14 nt, Mycobacterium leprae
gcugacgguugcuc

SEQ ID NO: 1226733 - RNA, 18 nt, Mycobacterium leprae
gcugccagggcucgacca

SEQ ID NO: 1226734 - RNA, 15 nt, Mycobacterium leprae
gcugcagugcuacga

SEQ ID NO: 1226735 - RNA, 19 nt, Mycobacterium leprae
gcugcacggcugcguuggc

SEQ ID NO: 1226736 - RNA, 22 nt, Mycobacterium leprae
gcugccggugaccgggccggcc

SEQ ID NO: 1226737 - RNA, 18 nt, Mycobacterium leprae
gcugcgacggacaggccg

SEQ ID NO: 1226738 - RNA, 15 nt, Mycobacterium leprae
gcugcgacaacaccu

SEQ ID NO: 1226739 - RNA, 14 nt, Mycobacterium leprae
gcugcgcaagguug

SEQ ID NO: 1226740 - RNA, 18 nt, Mycobacterium leprae
gcugcggcgccugcaucg

SEQ ID NO: 1226741 - RNA, 16 nt, Mycobacterium leprae
gcgugccccggccgcc

SEQ ID NO: 1226742 - RNA, 22 nt, Mycobacterium leprae
gcgugcgauauauaccuacgau

SEQ ID NO: 1226743 - RNA, 18 nt, Mycobacterium leprae
gcgucgugaccgcggggc

SEQ ID NO: 1226744 - RNA, 16 nt, Mycobacterium leprae
gcgucgugacggguca

SEQ ID NO: 1226745 - RNA, 13 nt, Mycobacterium leprae
gcgucguuuuggc

SEQ ID NO: 1226746 - RNA, 12 nt, Mycobacterium leprae
gcgucacggucg

SEQ ID NO: 1226747 - RNA, 23 nt, Mycobacterium leprae
gcgucaguaucgcgacggcaagu

SEQ ID NO: 1226748 - RNA, 16 nt, Mycobacterium leprae
gcgucaaagucgcggg

SEQ ID NO: 1226749 - RNA, 18 nt, Mycobacterium leprae
gcguaugaccgcggucgg

SEQ ID NO: 1226750 - RNA, 14 nt, Mycobacterium leprae
gcguaggcgcacgc

SEQ ID NO: 1226751 - RNA, 16 nt, Mycobacterium leprae
gcgguccuguccaggu

SEQ ID NO: 1226752 - RNA, 19 nt, Mycobacterium leprae
gcgguccuguccaggugcg

SEQ ID NO: 1226753 - RNA, 20 nt, Mycobacterium leprae
gcuagacgucugucacccgu

SEQ ID NO: 1226754 - RNA, 17 nt, Mycobacterium leprae
gcuauagcacaccaggg

SEQ ID NO: 1226755 - RNA, 13 nt, Mycobacterium leprae
gcuaccagggucg

SEQ ID NO: 1226756 - RNA, 18 nt, Mycobacterium leprae
gcuaccaguguccgucga

SEQ ID NO: 1226757 - RNA, 18 nt, Mycobacterium leprae
gcuacgauuuugcaacgg

SEQ ID NO: 1226758 - RNA, 17 nt, Mycobacterium leprae
gcuauccaauucgccga

SEQ ID NO: 1226759 - RNA, 18 nt, Mycobacterium leprae
gcuaucaccgcggugcug

SEQ ID NO: 1226760 - RNA, 15 nt, Mycobacterium leprae
gcucaaucagcgacu

SEQ ID NO: 1226761 - RNA, 13 nt, Mycobacterium leprae
gcucacagcaguc

SEQ ID NO: 1226762 - RNA, 14 nt, Mycobacterium leprae
gcucacagcagucc

SEQ ID NO: 1226763 - RNA, 23 nt, Mycobacterium leprae
gcucaccgacggaugcccagcca

SEQ ID NO: 1226764 - RNA, 20 nt, Mycobacterium leprae
gcguugucuugugguugauc

SEQ ID NO: 1226765 - RNA, 19 nt, Mycobacterium leprae
gcguuuagucaccgccgaa

SEQ ID NO: 1226766 - RNA, 19 nt, Mycobacterium leprae
gcguuugaugucguggugc

SEQ ID NO: 1226767 - RNA, 19 nt, Mycobacterium leprae
gcuaacaaggugaugccca

SEQ ID NO: 1226768 - RNA, 15 nt, Mycobacterium leprae
gcgugugcaaccgcg

SEQ ID NO: 1226769 - RNA, 20 nt, Mycobacterium leprae
gcguguuauaccgguagcgu

SEQ ID NO: 1226770 - RNA, 14 nt, Mycobacterium leprae
gccggccgcggaca

SEQ ID NO: 1226771 - RNA, 14 nt, Mycobacterium leprae
gccggcacaucguc

SEQ ID NO: 1226772 - RNA, 17 nt, Mycobacterium leprae
gccggcacaucgucggc

SEQ ID NO: 1226773 - RNA, 17 nt, Mycobacterium leprae
gccgcugguaucggugu

SEQ ID NO: 1226774 - RNA, 23 nt, Mycobacterium leprae
aagccauugcucgguauuugcgg

SEQ ID NO: 1226775 - RNA, 18 nt, Mycobacterium leprae
gccugcgacacuugccgc

SEQ ID NO: 1226776 - RNA, 13 nt, Mycobacterium leprae
gccugcguccacg

SEQ ID NO: 1226777 - RNA, 23 nt, Mycobacterium leprae
gccugcuugcuggcugagggccg

SEQ ID NO: 1226778 - RNA, 18 nt, Mycobacterium leprae
gccgugguagucagcaca

SEQ ID NO: 1226779 - RNA, 22 nt, Mycobacterium leprae
gccguggggcucggccaggugu

SEQ ID NO: 1226780 - RNA, 23 nt, Mycobacterium leprae
gccgugggucuggaagcgcugau

SEQ ID NO: 1226781 - RNA, 20 nt, Mycobacterium leprae
gccgugcuuccauucgcgau

SEQ ID NO: 1226782 - RNA, 18 nt, Mycobacterium leprae
gccguaugugccgccgac

SEQ ID NO: 1226783 - RNA, 19 nt, Mycobacterium leprae
gccguaugugccgccgacg

SEQ ID NO: 1226784 - RNA, 17 nt, Mycobacterium leprae
gccgguguacacgugcu

SEQ ID NO: 1226785 - RNA, 15 nt, Mycobacterium leprae
gccgguggcaaccga

SEQ ID NO: 1226786 - RNA, 14 nt, Mycobacterium leprae
gccggugaugacga

SEQ ID NO: 1226787 - RNA, 15 nt, Mycobacterium leprae
gcgaucgcagucauc

SEQ ID NO: 1226788 - RNA, 12 nt, Mycobacterium leprae
gcgauccggcac

SEQ ID NO: 1226789 - RNA, 15 nt, Mycobacterium leprae
gcgaucagaucgcgu

SEQ ID NO: 1226790 - RNA, 18 nt, Mycobacterium leprae
gcgaucggcucgauggga

SEQ ID NO: 1226791 - RNA, 18 nt, Mycobacterium leprae
gcgauugggaucguacga

SEQ ID NO: 1226792 - RNA, 18 nt, Mycobacterium leprae
gcgacuaucgugugcuga

SEQ ID NO: 1226793 - RNA, 17 nt, Mycobacterium leprae
gcgacguuucacgguca

SEQ ID NO: 1226794 - RNA, 14 nt, Mycobacterium leprae
gcgacuucgaugcg

SEQ ID NO: 1226795 - RNA, 19 nt, Mycobacterium leprae
gcgacuucgaugcgaugcg

SEQ ID NO: 1226796 - RNA, 23 nt, Mycobacterium leprae
gcgagccacuccgguugcggcga

SEQ ID NO: 1226797 - RNA, 21 nt, Mycobacterium leprae
gcgagcaucuggccgugcggc

SEQ ID NO: 1226798 - RNA, 17 nt, Mycobacterium leprae
gcgauauccgccggccg

SEQ ID NO: 1226799 - RNA, 21 nt, Mycobacterium leprae
gcgauauccgccggccgcacc

SEQ ID NO: 1226800 - RNA, 15 nt, Mycobacterium leprae
gcgaccgagcgcgac

SEQ ID NO: 1226801 - RNA, 23 nt, Mycobacterium leprae
gcgacacagagcgcucggcgugc

SEQ ID NO: 1226802 - RNA, 13 nt, Mycobacterium leprae
gcgacacagccgg

SEQ ID NO: 1226803 - RNA, 15 nt, Mycobacterium leprae
gcgacacagccggcc

SEQ ID NO: 1226804 - RNA, 12 nt, Mycobacterium leprae
gcgacaccacca

SEQ ID NO: 1226805 - RNA, 20 nt, Mycobacterium leprae
gcgacaccaccacgguggca

SEQ ID NO: 1226806 - RNA, 22 nt, Mycobacterium leprae
gcgacaccaccacgguggcacc

SEQ ID NO: 1226807 - RNA, 20 nt, Mycobacterium leprae
gcgacaguaucgaccagcca

SEQ ID NO: 1226808 - RNA, 19 nt, Mycobacterium leprae
gcgacauacaaucgcggca

SEQ ID NO: 1226809 - RNA, 18 nt, Mycobacterium leprae
gcgcgacaguaucgacca

SEQ ID NO: 1226810 - RNA, 21 nt, Mycobacterium leprae
gcgcgacaguaucgaccagcc

SEQ ID NO: 1226811 - RNA, 20 nt, Mycobacterium leprae
gcgccucccgauuuucgauc

SEQ ID NO: 1226812 - RNA, 23 nt, Mycobacterium leprae
gcgcccugacgguuucgggaaag

SEQ ID NO: 1226813 - RNA, 21 nt, Mycobacterium leprae
gucaaucagguugacaaucga

SEQ ID NO: 1226814 - RNA, 22 nt, Mycobacterium leprae
gucaaccuugguugccgcgguu

SEQ ID NO: 1226815 - RNA, 15 nt, Mycobacterium leprae
gucaacucgucggca

SEQ ID NO: 1226816 - RNA, 14 nt, Mycobacterium leprae
guauugguugccga

SEQ ID NO: 1226817 - RNA, 19 nt, Mycobacterium leprae
guauugggcgguguugcgc

SEQ ID NO: 1226818 - RNA, 23 nt, Mycobacterium leprae
gucagauggaacaagcgaucgga

SEQ ID NO: 1226819 - RNA, 15 nt, Mycobacterium leprae
gucacuccacgauuc

SEQ ID NO: 1226820 - RNA, 16 nt, Mycobacterium leprae
gucacgguugcccgcu

SEQ ID NO: 1226821 - RNA, 12 nt, Mycobacterium leprae
gucaccgcagcc

SEQ ID NO: 1226822 - RNA, 19 nt, Mycobacterium leprae
gucaccugugggacgacaa

SEQ ID NO: 1226823 - RNA, 21 nt, Mycobacterium leprae
gucagcgauuugugauaccgu

SEQ ID NO: 1226824 - RNA, 16 nt, Mycobacterium leprae
gucagcaucggguaaa

SEQ ID NO: 1226825 - RNA, 18 nt, Mycobacterium leprae
guaagaauaagguaccac

SEQ ID NO: 1226826 - RNA, 17 nt, Mycobacterium leprae
guaaaucuggcaagugc

SEQ ID NO: 1226827 - RNA, 17 nt, Mycobacterium leprae
gguggauuccagcuacc

SEQ ID NO: 1226828 - RNA, 21 nt, Mycobacterium leprae
guacaccacccaagauagcgc

SEQ ID NO: 1226829 - RNA, 16 nt, Mycobacterium leprae
guacaaugucuucguc

SEQ ID NO: 1226830 - RNA, 21 nt, Mycobacterium leprae
guacggcggcgauccucaacc

SEQ ID NO: 1226831 - RNA, 21 nt, Mycobacterium leprae
guaccugauaagggucaucca

SEQ ID NO: 1226832 - RNA, 17 nt, Mycobacterium leprae
guaccccagucgagcca

SEQ ID NO: 1226833 - RNA, 16 nt, Mycobacterium leprae
guaccguccguccugc

SEQ ID NO: 1226834 - RNA, 22 nt, Mycobacterium leprae
guacugaccgacucaccgguac

SEQ ID NO: 1226835 - RNA, 12 nt, Mycobacterium leprae
guacugucuacc

SEQ ID NO: 1226836 - RNA, 13 nt, Mycobacterium leprae
guacuggcggccg

SEQ ID NO: 1226837 - RNA, 24 nt, Mycobacterium leprae
guagcgagcgcaucaagucggucg

SEQ ID NO: 1226838 - RNA, 12 nt, Mycobacterium leprae
guagcgccgagc

SEQ ID NO: 1226839 - RNA, 21 nt, Mycobacterium leprae
aaguccagcacgauggccggu

SEQ ID NO: 1226840 - RNA, 15 nt, Mycobacterium leprae
aagucaugcagaugc

SEQ ID NO: 1226841 - RNA, 21 nt, Mycobacterium leprae
guagcuguucggguuggucgu

SEQ ID NO: 1226842 - RNA, 12 nt, Mycobacterium leprae
guaucacgaugu

SEQ ID NO: 1226843 - RNA, 18 nt, Mycobacterium leprae
gucccaucgcugaccggu

SEQ ID NO: 1226844 - RNA, 22 nt, Mycobacterium leprae
gucccagguuuccgugucaagu

SEQ ID NO: 1226845 - RNA, 15 nt, Mycobacterium leprae
gucccgaaacgccuc

SEQ ID NO: 1226846 - RNA, 12 nt, Mycobacterium leprae
gucccgcagccg

SEQ ID NO: 1226847 - RNA, 12 nt, Mycobacterium leprae
gucccgcccggc

SEQ ID NO: 1226848 - RNA, 21 nt, Mycobacterium leprae
gucaucccagaacugguccgc

SEQ ID NO: 1226849 - RNA, 13 nt, Mycobacterium leprae
gucauccacugcg

SEQ ID NO: 1226850 - RNA, 15 nt, Mycobacterium leprae
gucaucagaaauguc

SEQ ID NO: 1226851 - RNA, 22 nt, Mycobacterium leprae
gucaucagauucacagucggcg

SEQ ID NO: 1226852 - RNA, 13 nt, Mycobacterium leprae
gucccuucgccga

SEQ ID NO: 1226853 - RNA, 16 nt, Mycobacterium leprae
guccgcccugaugguu

SEQ ID NO: 1226854 - RNA, 13 nt, Mycobacterium leprae
guccgcggcggcc

SEQ ID NO: 1226855 - RNA, 18 nt, Mycobacterium leprae
guccgcggcuaucgccgc

SEQ ID NO: 1226856 - RNA, 23 nt, Mycobacterium leprae
guccgugaucggcaucugguagc

SEQ ID NO: 1226857 - RNA, 18 nt, Mycobacterium leprae
gucgacgguaaguuuuca

SEQ ID NO: 1226858 - RNA, 16 nt, Mycobacterium leprae
gucgagcuggcugugc

SEQ ID NO: 1226859 - RNA, 20 nt, Mycobacterium leprae
gucgagugguccccuguagc

SEQ ID NO: 1226860 - RNA, 14 nt, Mycobacterium leprae
gucgacugaccagc

SEQ ID NO: 1226861 - RNA, 18 nt, Mycobacterium leprae
gucgacugaccagcgauc

SEQ ID NO: 1226862 - RNA, 20 nt, Mycobacterium leprae
gucgacguguucacgcaguc

SEQ ID NO: 1226863 - RNA, 14 nt, Mycobacterium leprae
gucgaauucuuaag

SEQ ID NO: 1226864 - RNA, 23 nt, Mycobacterium leprae
gucgaagggcugguggccgaggu

SEQ ID NO: 1226865 - RNA, 20 nt, Mycobacterium leprae
guccuccaguuguaugcgcu

SEQ ID NO: 1226866 - RNA, 12 nt, Mycobacterium leprae
gucggacgucga

SEQ ID NO: 1226867 - RNA, 14 nt, Mycobacterium leprae
gucggacgucgaca

SEQ ID NO: 1226868 - RNA, 21 nt, Mycobacterium leprae
gucggauuuaauuacaucggc

SEQ ID NO: 1226869 - RNA, 13 nt, Mycobacterium leprae
gucggauccccuc

SEQ ID NO: 1226870 - RNA, 22 nt, Mycobacterium leprae
gucggaucuaugguuuuggccg

SEQ ID NO: 1226871 - RNA, 17 nt, Mycobacterium leprae
gucgcuguuugccgagu

SEQ ID NO: 1226872 - RNA, 18 nt, Mycobacterium leprae
gucggcgauaacggcguc

SEQ ID NO: 1226873 - RNA, 13 nt, Mycobacterium leprae
gucgcccgacggc

SEQ ID NO: 1226874 - RNA, 15 nt, Mycobacterium leprae
gucgcagguucugca

SEQ ID NO: 1226875 - RNA, 19 nt, Mycobacterium leprae
gucgauagaaaucacggag

SEQ ID NO: 1226876 - RNA, 14 nt, Mycobacterium leprae
gucgcggaccgucg

SEQ ID NO: 1226877 - RNA, 17 nt, Mycobacterium leprae
gucgcgggccuggauua

SEQ ID NO: 1226878 - RNA, 23 nt, Mycobacterium leprae
gucgcgucuuugcuggucagcgu

SEQ ID NO: 1226879 - RNA, 15 nt, Mycobacterium leprae
ggugaccacccacaa

SEQ ID NO: 1226880 - RNA, 23 nt, Mycobacterium leprae
ggugagacauuucgacaggcugu

SEQ ID NO: 1226881 - RNA, 23 nt, Mycobacterium leprae
ggugcaccagcucacccgcagca

SEQ ID NO: 1226882 - RNA, 16 nt, Mycobacterium leprae
ggugaugucggcgucc

SEQ ID NO: 1226883 - RNA, 20 nt, Mycobacterium leprae
ggugaucgcugccggcggca

SEQ ID NO: 1226884 - RNA, 22 nt, Mycobacterium leprae
ggucguguugcuugcugugacc

SEQ ID NO: 1226885 - RNA, 14 nt, Mycobacterium leprae
gguggcagccgcca

SEQ ID NO: 1226886 - RNA, 18 nt, Mycobacterium leprae
ggugcgguaaucccagcg

SEQ ID NO: 1226887 - RNA, 15 nt, Mycobacterium leprae
ggugcggcgccgccc

SEQ ID NO: 1226888 - RNA, 23 nt, Mycobacterium leprae
ggugcgugagguguugccgaggg

SEQ ID NO: 1226889 - RNA, 22 nt, Mycobacterium leprae
ggugccguaagacacuuccugg

SEQ ID NO: 1226890 - RNA, 15 nt, Mycobacterium leprae
ggugccgaucccggc

SEQ ID NO: 1226891 - RNA, 22 nt, Mycobacterium leprae
ggugccgagcgcaucggcggcg

SEQ ID NO: 1226892 - RNA, 20 nt, Mycobacterium leprae
ggugcccgacagccaccacg

SEQ ID NO: 1226893 - RNA, 23 nt, Mycobacterium leprae
ggugcccgguuuuagcgugcugu

SEQ ID NO: 1226894 - RNA, 14 nt, Mycobacterium leprae
aaguacugaccggc

SEQ ID NO: 1226895 - RNA, 14 nt, Mycobacterium leprae
aaguagacggcucc

SEQ ID NO: 1226896 - RNA, 15 nt, Mycobacterium leprae
gggugggucgaugau

SEQ ID NO: 1226897 - RNA, 11 nt, Mycobacterium leprae
gguaaacagug

SEQ ID NO: 1226898 - RNA, 16 nt, Mycobacterium leprae
gguaccccagucgagc

SEQ ID NO: 1226899 - RNA, 19 nt, Mycobacterium leprae
gguaccagcggcagcggcg

SEQ ID NO: 1226900 - RNA, 22 nt, Mycobacterium leprae
gguaccagcggcagcggcggcc

SEQ ID NO: 1226901 - RNA, 15 nt, Mycobacterium leprae
ggucaacggccucac

SEQ ID NO: 1226902 - RNA, 19 nt, Mycobacterium leprae
ggucaacguuugucguguu

SEQ ID NO: 1226903 - RNA, 19 nt, Mycobacterium leprae
gguauccauccguggcgag

SEQ ID NO: 1226904 - RNA, 19 nt, Mycobacterium leprae
gguaucggugucggcggcu

SEQ ID NO: 1226905 - RNA, 14 nt, Mycobacterium leprae
gguaucaaagcgau

SEQ ID NO: 1226906 - RNA, 16 nt, Mycobacterium leprae
ggucgaggaaggaagc

SEQ ID NO: 1226907 - RNA, 19 nt, Mycobacterium leprae
ggucgacgacugccgaccg

SEQ ID NO: 1226908 - RNA, 16 nt, Mycobacterium leprae
gguccagccaacggga

SEQ ID NO: 1226909 - RNA, 12 nt, Mycobacterium leprae
ggucccgcagcc

SEQ ID NO: 1226910 - RNA, 16 nt, Mycobacterium leprae
ggucagcauggcgaug

SEQ ID NO: 1226911 - RNA, 12 nt, Mycobacterium leprae
gguccacccgcg

SEQ ID NO: 1226912 - RNA, 15 nt, Mycobacterium leprae
gguccaaccgacgau

SEQ ID NO: 1226913 - RNA, 18 nt, Mycobacterium leprae
ggucaguuucaucgacga

SEQ ID NO: 1226914 - RNA, 15 nt, Mycobacterium leprae
gggcgaugucgaccu

SEQ ID NO: 1226915 - RNA, 20 nt, Mycobacterium leprae
gggcgaugccaucgggccag

SEQ ID NO: 1226916 - RNA, 16 nt, Mycobacterium leprae
gggcgcucagcggcca

SEQ ID NO: 1226917 - RNA, 13 nt, Mycobacterium leprae
gggggaucgaugu

SEQ ID NO: 1226918 - RNA, 15 nt, Mycobacterium leprae
ggggaaccaucgcac

SEQ ID NO: 1226919 - RNA, 11 nt, Mycobacterium leprae
gggcggcggcc

SEQ ID NO: 1226920 - RNA, 23 nt, Mycobacterium leprae
gggcuagaaucuucacgcggaag

SEQ ID NO: 1226921 - RNA, 24 nt, Mycobacterium leprae
gggcuauccucgggugcgcacgga

SEQ ID NO: 1226922 - RNA, 18 nt, Mycobacterium leprae
gggaugcugggucagcau

SEQ ID NO: 1226923 - RNA, 22 nt, Mycobacterium leprae
gggauggccaagccgcccggcc

SEQ ID NO: 1226924 - RNA, 18 nt, Mycobacterium leprae
gggaugaugauugccgcc

SEQ ID NO: 1226925 - RNA, 13 nt, Mycobacterium leprae
gggaucggcggca

SEQ ID NO: 1226926 - RNA, 18 nt, Mycobacterium leprae
gggcacgagggcggugcc

SEQ ID NO: 1226927 - RNA, 19 nt, Mycobacterium leprae
gggagugcuagcggcgcca

SEQ ID NO: 1226928 - RNA, 18 nt, Mycobacterium leprae
gggauaacaucaggugcg

SEQ ID NO: 1226929 - RNA, 13 nt, Mycobacterium leprae
gggaggucaccaa

SEQ ID NO: 1226930 - RNA, 16 nt, Mycobacterium leprae
gggagaaugccacagg

SEQ ID NO: 1226931 - RNA, 14 nt, Mycobacterium leprae
ggcguaugaccgcg

SEQ ID NO: 1226932 - RNA, 15 nt, Mycobacterium leprae
gggacgccggcggcc

SEQ ID NO: 1226933 - RNA, 12 nt, Mycobacterium leprae
gggccacuucgc

SEQ ID NO: 1226934 - RNA, 14 nt, Mycobacterium leprae
gggcagcgccacgc

SEQ ID NO: 1226935 - RNA, 15 nt, Mycobacterium leprae
gggccgaagcagccg

SEQ ID NO: 1226936 - RNA, 21 nt, Mycobacterium leprae
ggacagcacccccggccaggu

SEQ ID NO: 1226937 - RNA, 16 nt, Mycobacterium leprae
ggacagaacaccccgc

SEQ ID NO: 1226938 - RNA, 18 nt, Mycobacterium leprae
ggacauccgcugauuggc

SEQ ID NO: 1226939 - RNA, 14 nt, Mycobacterium leprae
ggacagcguaucuc

SEQ ID NO: 1226940 - RNA, 17 nt, Mycobacterium leprae
ggacgauuugcgaucaa

SEQ ID NO: 1226941 - RNA, 19 nt, Mycobacterium leprae
ggacgacgugccgcaggca

SEQ ID NO: 1226942 - RNA, 17 nt, Mycobacterium leprae
ggaccgucgcgcgugcc

SEQ ID NO: 1226943 - RNA, 15 nt, Mycobacterium leprae
ggaccgaacagguca

SEQ ID NO: 1226944 - RNA, 21 nt, Mycobacterium leprae
ggaagcgaugggugaaucgcu

SEQ ID NO: 1226945 - RNA, 15 nt, Mycobacterium leprae
ggaaggagccgaggc

SEQ ID NO: 1226946 - RNA, 14 nt, Mycobacterium leprae
ggagaucggcgugc

SEQ ID NO: 1226947 - RNA, 14 nt, Mycobacterium leprae
ggagaaguuuugcg

SEQ ID NO: 1226948 - RNA, 20 nt, Mycobacterium leprae
ggagcgaugucgagcggacc

SEQ ID NO: 1226949 - RNA, 21 nt, Mycobacterium leprae
ggagcgaugucgagcggacca

SEQ ID NO: 1226950 - RNA, 19 nt, Mycobacterium leprae
ggagucuugaugccaaccu

SEQ ID NO: 1226951 - RNA, 13 nt, Mycobacterium leprae
ggagugcgaucaa

SEQ ID NO: 1226952 - RNA, 20 nt, Mycobacterium leprae
ggagugaggcaugggugcgu

SEQ ID NO: 1226953 - RNA, 22 nt, Mycobacterium leprae
ggauacguagcgucggcgguca

SEQ ID NO: 1226954 - RNA, 15 nt, Mycobacterium leprae
ggaucccgacagcau

SEQ ID NO: 1226955 - RNA, 16 nt, Mycobacterium leprae
ggaucccgacagcaug

SEQ ID NO: 1226956 - RNA, 18 nt, Mycobacterium leprae
ggcaaggucggugggcaa

SEQ ID NO: 1226957 - RNA, 22 nt, Mycobacterium leprae
ggcaauccuugaugcugcgagu

SEQ ID NO: 1226958 - RNA, 21 nt, Mycobacterium leprae
ggcaagcgguuguccggcgcg

SEQ ID NO: 1226959 - RNA, 17 nt, Mycobacterium leprae
ggcaacgcugcccacca

SEQ ID NO: 1226960 - RNA, 20 nt, Mycobacterium leprae
ggcaacggguuaccugaccg

SEQ ID NO: 1226961 - RNA, 22 nt, Mycobacterium leprae
ggcaccacgcacacgacagccg

SEQ ID NO: 1226962 - RNA, 13 nt, Mycobacterium leprae
ggcaccggccgua

SEQ ID NO: 1226963 - RNA, 22 nt, Mycobacterium leprae
ggcaccgacguauccaagguga

SEQ ID NO: 1226964 - RNA, 18 nt, Mycobacterium leprae
ggcauccaacacgccgau

SEQ ID NO: 1226965 - RNA, 22 nt, Mycobacterium leprae
ggcagcauccgccgacgaugcg

SEQ ID NO: 1226966 - RNA, 17 nt, Mycobacterium leprae
ggccaugggacuaccgg

SEQ ID NO: 1226967 - RNA, 15 nt, Mycobacterium leprae
ggccauggcagccga

SEQ ID NO: 1226968 - RNA, 17 nt, Mycobacterium leprae
ggccauuggcaccguug

SEQ ID NO: 1226969 - RNA, 19 nt, Mycobacterium leprae
ggcccagauccaucggaca

SEQ ID NO: 1226970 - RNA, 23 nt, Mycobacterium leprae
ggccaucagauccgguggcgaca

SEQ ID NO: 1226971 - RNA, 16 nt, Mycobacterium leprae
ggccaggucggcuagc

SEQ ID NO: 1226972 - RNA, 17 nt, Mycobacterium leprae
ggccagccgucccacgc

SEQ ID NO: 1226973 - RNA, 20 nt, Mycobacterium leprae
ggccagccuagccacaagua

SEQ ID NO: 1226974 - RNA, 20 nt, Mycobacterium leprae
ggccacauugaccacgccga

SEQ ID NO: 1226975 - RNA, 12 nt, Mycobacterium leprae
ggcaugccgccg

SEQ ID NO: 1226976 - RNA, 15 nt, Mycobacterium leprae
ggccacgucgugcug

SEQ ID NO: 1226977 - RNA, 14 nt, Mycobacterium leprae
ggccacgacaucgu

SEQ ID NO: 1226978 - RNA, 22 nt, Mycobacterium leprae
ggccacgagacccagccguggu

SEQ ID NO: 1226979 - RNA, 22 nt, Mycobacterium leprae
ggcgaaucggucuggaaccggu

SEQ ID NO: 1226980 - RNA, 19 nt, Mycobacterium leprae
ggcgaccaguuuacaucgg

SEQ ID NO: 1226981 - RNA, 20 nt, Mycobacterium leprae
ggcgaccagcgagcaaccua

SEQ ID NO: 1226982 - RNA, 16 nt, Mycobacterium leprae
ggcgacgugaucgacg

SEQ ID NO: 1226983 - RNA, 10 nt, Mycobacterium leprae
ggcgagcaag

SEQ ID NO: 1226984 - RNA, 21 nt, Mycobacterium leprae
ggcgacgaccuccgcagcauc

SEQ ID NO: 1226985 - RNA, 16 nt, Mycobacterium leprae
aaggcgauaucgaugc

SEQ ID NO: 1226986 - RNA, 20 nt, Mycobacterium leprae
ggcgaaaacccgcgcgugca

SEQ ID NO: 1226987 - RNA, 18 nt, Mycobacterium leprae
ggccggucaacaagccgc

SEQ ID NO: 1226988 - RNA, 22 nt, Mycobacterium leprae
ggccggucaacaagccgccgac

SEQ ID NO: 1226989 - RNA, 15 nt, Mycobacterium leprae
aagguguugcgguga

SEQ ID NO: 1226990 - RNA, 13 nt, Mycobacterium leprae
ggcgcgcgaggcg

SEQ ID NO: 1226991 - RNA, 15 nt, Mycobacterium leprae
ggcguacuggucaac

SEQ ID NO: 1226992 - RNA, 19 nt, Mycobacterium leprae
ggcgguuacgcgcucgccg

SEQ ID NO: 1226993 - RNA, 18 nt, Mycobacterium leprae
ggcggugucggcuaccaa

SEQ ID NO: 1226994 - RNA, 20 nt, Mycobacterium leprae
ggcggugacugaaaucauug

SEQ ID NO: 1226995 - RNA, 12 nt, Mycobacterium leprae
ggcgggcgugcu

SEQ ID NO: 1226996 - RNA, 21 nt, Mycobacterium leprae
ggcggccacgugcacaucagc

SEQ ID NO: 1226997 - RNA, 15 nt, Mycobacterium leprae
ggcgcucagugauca

SEQ ID NO: 1226998 - RNA, 15 nt, Mycobacterium leprae
ggcggaggcugggca

SEQ ID NO: 1226999 - RNA, 14 nt, Mycobacterium leprae
ggcggcggccagcu

SEQ ID NO: 1227000 - RNA, 12 nt, Mycobacterium leprae
ggcggcguuggc

SEQ ID NO: 1227001 - RNA, 16 nt, Mycobacterium leprae
aacaugaacgucacug

SEQ ID NO: 1227002 - RNA, 20 nt, Mycobacterium leprae
cgggagaggaucagcgcugc

SEQ ID NO: 1227003 - RNA, 22 nt, Mycobacterium leprae
cggcugacuucgucagacgaaa

SEQ ID NO: 1227004 - RNA, 17 nt, Mycobacterium leprae
cggcugggcagccgagg

SEQ ID NO: 1227005 - RNA, 21 nt, Mycobacterium leprae
cggcuggcuaauggcgggcug

SEQ ID NO: 1227006 - RNA, 20 nt, Mycobacterium leprae
cggcuggcuccauccugccu

SEQ ID NO: 1227007 - RNA, 13 nt, Mycobacterium leprae
cggcugcacccgu

SEQ ID NO: 1227008 - RNA, 15 nt, Mycobacterium leprae
cggcuuuucgacauu

SEQ ID NO: 1227009 - RNA, 16 nt, Mycobacterium leprae
cggcuuuucgacauug

SEQ ID NO: 1227010 - RNA, 22 nt, Mycobacterium leprae
cggggauucaaucagacacgga

SEQ ID NO: 1227011 - RNA, 14 nt, Mycobacterium leprae
cggggcgaugucga

SEQ ID NO: 1227012 - RNA, 15 nt, Mycobacterium leprae
cgggggccagcguug

SEQ ID NO: 1227013 - RNA, 18 nt, Mycobacterium leprae
cgggguuggccacuggug

SEQ ID NO: 1227014 - RNA, 19 nt, Mycobacterium leprae
cgggcgcucagcggccaga

SEQ ID NO: 1227015 - RNA, 13 nt, Mycobacterium leprae
cgggcuugaccug

SEQ ID NO: 1227016 - RNA, 16 nt, Mycobacterium leprae
cgggcuugaccuggau

SEQ ID NO: 1227017 - RNA, 15 nt, Mycobacterium leprae
cgggcucacggggcu

SEQ ID NO: 1227018 - RNA, 19 nt, Mycobacterium leprae
cgggcggccaggcaggauc

SEQ ID NO: 1227019 - RNA, 15 nt, Mycobacterium leprae
cggcgucgugacggg

SEQ ID NO: 1227020 - RNA, 22 nt, Mycobacterium leprae
cggcguaaccgggaaauacggc

SEQ ID NO: 1227021 - RNA, 17 nt, Mycobacterium leprae
cggcggguagucggcgc

SEQ ID NO: 1227022 - RNA, 15 nt, Mycobacterium leprae
cggcggucaggauac

SEQ ID NO: 1227023 - RNA, 21 nt, Mycobacterium leprae
cggcggccgccacgccgugcu

SEQ ID NO: 1227024 - RNA, 18 nt, Mycobacterium leprae
cggcgcgaucuuccacca

SEQ ID NO: 1227025 - RNA, 19 nt, Mycobacterium leprae
cggcgcuggggcgcuggcg

SEQ ID NO: 1227026 - RNA, 18 nt, Mycobacterium leprae
cggcggcagauguuggcc

SEQ ID NO: 1227027 - RNA, 21 nt, Mycobacterium leprae
cggcggcagauguuggcccgu

SEQ ID NO: 1227028 - RNA, 15 nt, Mycobacterium leprae
cggcgaugaccggac

SEQ ID NO: 1227029 - RNA, 20 nt, Mycobacterium leprae
cggauuuugacuccguuugc

SEQ ID NO: 1227030 - RNA, 17 nt, Mycobacterium leprae
cggauuugcagagcauc

SEQ ID NO: 1227031 - RNA, 18 nt, Mycobacterium leprae
cggaugaauaucaucgcc

SEQ ID NO: 1227032 - RNA, 17 nt, Mycobacterium leprae
cggaugauagccguagu

SEQ ID NO: 1227033 - RNA, 18 nt, Mycobacterium leprae
cggcaagaagugcgacga

SEQ ID NO: 1227034 - RNA, 12 nt, Mycobacterium leprae
cggcaaccgcaa

SEQ ID NO: 1227035 - RNA, 18 nt, Mycobacterium leprae
cggcaagcagauucgagc

SEQ ID NO: 1227036 - RNA, 18 nt, Mycobacterium leprae
cggcaauccuugaugcug

SEQ ID NO: 1227037 - RNA, 12 nt, Mycobacterium leprae
cggcacaccgug

SEQ ID NO: 1227038 - RNA, 20 nt, Mycobacterium leprae
cggcaccaauguugcccgca

SEQ ID NO: 1227039 - RNA, 21 nt, Mycobacterium leprae
cggcaccaauguugcccgcaa

SEQ ID NO: 1227040 - RNA, 22 nt, Mycobacterium leprae
cggcaccgcgaagccguugaug

SEQ ID NO: 1227041 - RNA, 19 nt, Mycobacterium leprae
cgcugaccgccggucgggg

SEQ ID NO: 1227042 - RNA, 14 nt, Mycobacterium leprae
cggacccguugagc

SEQ ID NO: 1227043 - RNA, 18 nt, Mycobacterium leprae
cggaccccauagcgccuc

SEQ ID NO: 1227044 - RNA, 11 nt, Mycobacterium leprae
cggacgugguc

SEQ ID NO: 1227045 - RNA, 20 nt, Mycobacterium leprae
cggacucuccccacugcagg

SEQ ID NO: 1227046 - RNA, 14 nt, Mycobacterium leprae
cggacugacaccgc

SEQ ID NO: 1227047 - RNA, 19 nt, Mycobacterium leprae
cggacgcugaaacgguaaa

SEQ ID NO: 1227048 - RNA, 16 nt, Mycobacterium leprae
cggacgucgacaucau

SEQ ID NO: 1227049 - RNA, 19 nt, Mycobacterium leprae
cggacgacgcugagaggcg

SEQ ID NO: 1227050 - RNA, 16 nt, Mycobacterium leprae
cggaguucuucacacg

SEQ ID NO: 1227051 - RNA, 16 nt, Mycobacterium leprae
cggaggccaaucgcaa

SEQ ID NO: 1227052 - RNA, 21 nt, Mycobacterium leprae
cggagcgauccgguaggccga

SEQ ID NO: 1227053 - RNA, 16 nt, Mycobacterium leprae
cggagaucggcgugca

SEQ ID NO: 1227054 - RNA, 23 nt, Mycobacterium leprae
cggagcaagcgcuaugccaucca

SEQ ID NO: 1227055 - RNA, 20 nt, Mycobacterium leprae
cggcagggcguugccguccc

SEQ ID NO: 1227056 - RNA, 19 nt, Mycobacterium leprae
cggcagcugguuguccacg

SEQ ID NO: 1227057 - RNA, 19 nt, Mycobacterium leprae
cggcacgauaggcagugcu

SEQ ID NO: 1227058 - RNA, 14 nt, Mycobacterium leprae
aacagucagccgcg

SEQ ID NO: 1227059 - RNA, 15 nt, Mycobacterium leprae
cggccacauugacca

SEQ ID NO: 1227060 - RNA, 13 nt, Mycobacterium leprae
cggccaccggccg

SEQ ID NO: 1227061 - RNA, 18 nt, Mycobacterium leprae
cggcauucccaaccgcga

SEQ ID NO: 1227062 - RNA, 22 nt, Mycobacterium leprae
cggcauggccgcuggggcaagu

SEQ ID NO: 1227063 - RNA, 15 nt, Mycobacterium leprae
cggccacgucgccgu

SEQ ID NO: 1227064 - RNA, 16 nt, Mycobacterium leprae
cggccacugcacgacc

SEQ ID NO: 1227065 - RNA, 17 nt, Mycobacterium leprae
cggccagacacuggcgg

SEQ ID NO: 1227066 - RNA, 16 nt, Mycobacterium leprae
cggccguaaucaagau

SEQ ID NO: 1227067 - RNA, 15 nt, Mycobacterium leprae
cggccgucggcggca

SEQ ID NO: 1227068 - RNA, 14 nt, Mycobacterium leprae
cggccgucgcucgg

SEQ ID NO: 1227069 - RNA, 19 nt, Mycobacterium leprae
cggccggcucgcauccgca

SEQ ID NO: 1227070 - RNA, 13 nt, Mycobacterium leprae
cggccucgugcug

SEQ ID NO: 1227071 - RNA, 15 nt, Mycobacterium leprae
cggccuuaucgucuu

SEQ ID NO: 1227072 - RNA, 19 nt, Mycobacterium leprae
cggccggcgucgcgucauc

SEQ ID NO: 1227073 - RNA, 21 nt, Mycobacterium leprae
cggccgcggcgaccuggucga

SEQ ID NO: 1227074 - RNA, 14 nt, Mycobacterium leprae
cggccgaucauggc

SEQ ID NO: 1227075 - RNA, 17 nt, Mycobacterium leprae
cggccgaucauggcugg

SEQ ID NO: 1227076 - RNA, 18 nt, Mycobacterium leprae
cgcgauggcauugcuggu

SEQ ID NO: 1227077 - RNA, 22 nt, Mycobacterium leprae
cgcgccaaacacggccagcgcg

SEQ ID NO: 1227078 - RNA, 18 nt, Mycobacterium leprae
cgcgccgaccucggcgcu

SEQ ID NO: 1227079 - RNA, 22 nt, Mycobacterium leprae
cgcgcgcuaguucgacaccggc

SEQ ID NO: 1227080 - RNA, 15 nt, Mycobacterium leprae
cgcgccggucgugca

SEQ ID NO: 1227081 - RNA, 22 nt, Mycobacterium leprae
cgcgcuuucggagaucgacuug

SEQ ID NO: 1227082 - RNA, 14 nt, Mycobacterium leprae
cgcgcgucguagcu

SEQ ID NO: 1227083 - RNA, 14 nt, Mycobacterium leprae
cgcgcgugccacca

SEQ ID NO: 1227084 - RNA, 14 nt, Mycobacterium leprae
cgcgcuacggcggu

SEQ ID NO: 1227085 - RNA, 22 nt, Mycobacterium leprae
cgcgcgguucuugccaaggucg

SEQ ID NO: 1227086 - RNA, 23 nt, Mycobacterium leprae
cgcggcgggcaagccauugcucg

SEQ ID NO: 1227087 - RNA, 20 nt, Mycobacterium leprae
cgcggcguuauccacgccga

SEQ ID NO: 1227088 - RNA, 14 nt, Mycobacterium leprae
cgcucgguaagcug

SEQ ID NO: 1227089 - RNA, 14 nt, Mycobacterium leprae
cgcugaccagcaga

SEQ ID NO: 1227090 - RNA, 19 nt, Mycobacterium leprae
cgcugaaccgcgucggcgu

SEQ ID NO: 1227091 - RNA, 21 nt, Mycobacterium leprae
cgcucugcguaaccgccaucg

SEQ ID NO: 1227092 - RNA, 19 nt, Mycobacterium leprae
cgcucgauucucgagcggc

SEQ ID NO: 1227093 - RNA, 22 nt, Mycobacterium leprae
cgcuaucauagccacucgccac

SEQ ID NO: 1227094 - RNA, 23 nt, Mycobacterium leprae
cgcuacggcgguguuucucgccg

SEQ ID NO: 1227095 - RNA, 16 nt, Mycobacterium leprae
cgcuaugccauccacc

SEQ ID NO: 1227096 - RNA, 16 nt, Mycobacterium leprae
cgcuauggauacucaa

SEQ ID NO: 1227097 - RNA, 19 nt, Mycobacterium leprae
cgcuaugugcaaucgaucc

SEQ ID NO: 1227098 - RNA, 21 nt, Mycobacterium leprae
cgcuaugugcaaucgauccgg

SEQ ID NO: 1227099 - RNA, 17 nt, Mycobacterium leprae
cgcucaaagccugcguc

SEQ ID NO: 1227100 - RNA, 16 nt, Mycobacterium leprae
cgcucauccgacggcu

SEQ ID NO: 1227101 - RNA, 22 nt, Mycobacterium leprae
cgcucacagcaggcgaguggcg

SEQ ID NO: 1227102 - RNA, 15 nt, Mycobacterium leprae
aacacuggcgaccgc

SEQ ID NO: 1227103 - RNA, 17 nt, Mycobacterium leprae
cgccuaaucuagccucg

SEQ ID NO: 1227104 - RNA, 20 nt, Mycobacterium leprae
cgccucugccagggguucca

SEQ ID NO: 1227105 - RNA, 13 nt, Mycobacterium leprae
aacagagugcacc

SEQ ID NO: 1227106 - RNA, 12 nt, Mycobacterium leprae
cgccgguggcaa

SEQ ID NO: 1227107 - RNA, 20 nt, Mycobacterium leprae
cgccggucgugcaugcggau

SEQ ID NO: 1227108 - RNA, 15 nt, Mycobacterium leprae
cgccgggacgcguca

SEQ ID NO: 1227109 - RNA, 23 nt, Mycobacterium leprae
cgccgggcacuugggucaccgcc

SEQ ID NO: 1227110 - RNA, 19 nt, Mycobacterium leprae
cgccgcuacacugcagcgg

SEQ ID NO: 1227111 - RNA, 16 nt, Mycobacterium leprae
cgccggcuacuggacg

SEQ ID NO: 1227112 - RNA, 12 nt, Mycobacterium leprae
cgccgcgcuaau

SEQ ID NO: 1227113 - RNA, 15 nt, Mycobacterium leprae
cgccaccgccgguca

SEQ ID NO: 1227114 - RNA, 16 nt, Mycobacterium leprae
cgccccccagugguga

SEQ ID NO: 1227115 - RNA, 21 nt, Mycobacterium leprae
cgcccgaccaguucgacuggc

SEQ ID NO: 1227116 - RNA, 17 nt, Mycobacterium leprae
cgccgaagccgcgcauc

SEQ ID NO: 1227117 - RNA, 21 nt, Mycobacterium leprae
cgcccugcuuaugcgugcuga

SEQ ID NO: 1227118 - RNA, 16 nt, Mycobacterium leprae
cgcccuccuggcgagu

SEQ ID NO: 1227119 - RNA, 21 nt, Mycobacterium leprae
cgcccuccuggcgaguggcua

SEQ ID NO: 1227120 - RNA, 20 nt, Mycobacterium leprae
cgcccucgccggcgguacug

SEQ ID NO: 1227121 - RNA, 14 nt, Mycobacterium leprae
cgcccuagacggga

SEQ ID NO: 1227122 - RNA, 18 nt, Mycobacterium leprae
cgcccggucaagacguug

SEQ ID NO: 1227123 - RNA, 14 nt, Mycobacterium leprae
cgccgacgcgaacg

SEQ ID NO: 1227124 - RNA, 17 nt, Mycobacterium leprae
cgccgacgaugcgugcc

SEQ ID NO: 1227125 - RNA, 14 nt, Mycobacterium leprae
cgccgacaccucaa

SEQ ID NO: 1227126 - RNA, 14 nt, Mycobacterium leprae
cgccgacggccgga

SEQ ID NO: 1227127 - RNA, 13 nt, Mycobacterium leprae
cgccgagucgcug

SEQ ID NO: 1227128 - RNA, 16 nt, Mycobacterium leprae
cgccgagcugaucgug

SEQ ID NO: 1227129 - RNA, 18 nt, Mycobacterium leprae
cgccgaggaugccguaga

SEQ ID NO: 1227130 - RNA, 15 nt, Mycobacterium leprae
cgcaucagccaacac

SEQ ID NO: 1227131 - RNA, 18 nt, Mycobacterium leprae
cgcauacuggcacgccag

SEQ ID NO: 1227132 - RNA, 13 nt, Mycobacterium leprae
cgcagucgguuga

SEQ ID NO: 1227133 - RNA, 13 nt, Mycobacterium leprae
cgcagucaucacc

SEQ ID NO: 1227134 - RNA, 15 nt, Mycobacterium leprae
cgcagggacgauagu

SEQ ID NO: 1227135 - RNA, 14 nt, Mycobacterium leprae
cgcagggcgcgcag

SEQ ID NO: 1227136 - RNA, 24 nt, Mycobacterium leprae
cgcaggcacccguugaagccguug

SEQ ID NO: 1227137 - RNA, 18 nt, Mycobacterium leprae
cgcaucggugaucguggu

SEQ ID NO: 1227138 - RNA, 20 nt, Mycobacterium leprae
cgcaucuucgcccagcacgc

SEQ ID NO: 1227139 - RNA, 15 nt, Mycobacterium leprae
cgcaugacacccccg

SEQ ID NO: 1227140 - RNA, 15 nt, Mycobacterium leprae
cgccaacacuagcgg

SEQ ID NO: 1227141 - RNA, 23 nt, Mycobacterium leprae
cgcauuauuuuuuagauccaacg

SEQ ID NO: 1227142 - RNA, 19 nt, Mycobacterium leprae
cgcaagugcggcgcccagc

SEQ ID NO: 1227143 - RNA, 22 nt, Mycobacterium leprae
cgcaagugcggcgcccagcacc

SEQ ID NO: 1227144 - RNA, 22 nt, Mycobacterium leprae
cgcacauggggcuaaucguucc

SEQ ID NO: 1227145 - RNA, 16 nt, Mycobacterium leprae
cgcacacgacagccgc

SEQ ID NO: 1227146 - RNA, 18 nt, Mycobacterium leprae
cgcacagagcccagcacg

SEQ ID NO: 1227147 - RNA, 20 nt, Mycobacterium leprae
cgcacagcaggucgccgacg

SEQ ID NO: 1227148 - RNA, 22 nt, Mycobacterium leprae
cgcacaaacuucgacgaucacc

SEQ ID NO: 1227149 - RNA, 14 nt, Mycobacterium leprae
cgcaacgggacaag

SEQ ID NO: 1227150 - RNA, 23 nt, Mycobacterium leprae
cgcaagcaaauuuuuugacgggu

SEQ ID NO: 1227151 - RNA, 15 nt, Mycobacterium leprae
cgaugcuaccgaacu

SEQ ID NO: 1227152 - RNA, 21 nt, Mycobacterium leprae
cgauuuggauggucggcagcu

SEQ ID NO: 1227153 - RNA, 20 nt, Mycobacterium leprae
cgcaccucgcugcagcauaa

SEQ ID NO: 1227154 - RNA, 12 nt, Mycobacterium leprae
cgcaccggcugc

SEQ ID NO: 1227155 - RNA, 15 nt, Mycobacterium leprae
cgcaccggcugcacc

SEQ ID NO: 1227156 - RNA, 16 nt, Mycobacterium leprae
cgcagcaucagggcug

SEQ ID NO: 1227157 - RNA, 18 nt, Mycobacterium leprae
cgcagaccucuuccgccg

SEQ ID NO: 1227158 - RNA, 16 nt, Mycobacterium leprae
cgauagaaaucacgga

SEQ ID NO: 1227159 - RNA, 17 nt, Mycobacterium leprae
cgaucaacuggucgagu

SEQ ID NO: 1227160 - RNA, 15 nt, Mycobacterium leprae
cgaguacugccgacg

SEQ ID NO: 1227161 - RNA, 17 nt, Mycobacterium leprae
cgaucagacccuugguc

SEQ ID NO: 1227162 - RNA, 22 nt, Mycobacterium leprae
cgagcuguuccucuugacggga

SEQ ID NO: 1227163 - RNA, 13 nt, Mycobacterium leprae
cgagcucggccua

SEQ ID NO: 1227164 - RNA, 20 nt, Mycobacterium leprae
cgaugaucuaaccgacgaaa

SEQ ID NO: 1227165 - RNA, 18 nt, Mycobacterium leprae
cgaugccaucgggccaga

SEQ ID NO: 1227166 - RNA, 21 nt, Mycobacterium leprae
cgaugcgcaccucgcugcagc

SEQ ID NO: 1227167 - RNA, 20 nt, Mycobacterium leprae
cgaucucgucgcucauaucg

SEQ ID NO: 1227168 - RNA, 19 nt, Mycobacterium leprae
cgaucucggugcgaggacc

SEQ ID NO: 1227169 - RNA, 19 nt, Mycobacterium leprae
cgaucuacgccaucguuca

SEQ ID NO: 1227170 - RNA, 16 nt, Mycobacterium leprae
cgaucuaucugacgac

SEQ ID NO: 1227171 - RNA, 18 nt, Mycobacterium leprae
cgaucgcagccgcaaggu

SEQ ID NO: 1227172 - RNA, 14 nt, Mycobacterium leprae
cgaucgcaccggcu

SEQ ID NO: 1227173 - RNA, 13 nt, Mycobacterium leprae
cgauccagcauuc

SEQ ID NO: 1227174 - RNA, 17 nt, Mycobacterium leprae
cgaucccaggaucccug

SEQ ID NO: 1227175 - RNA, 17 nt, Mycobacterium leprae
cgaucccaucggcugca

SEQ ID NO: 1227176 - RNA, 19 nt, Mycobacterium leprae
cgaucccaucggcugcacc

SEQ ID NO: 1227177 - RNA, 22 nt, Mycobacterium leprae
cgaucaguucuucgauagccau

SEQ ID NO: 1227178 - RNA, 22 nt, Mycobacterium leprae
cgaucccgguuacguccgcggc

SEQ ID NO: 1227179 - RNA, 18 nt, Mycobacterium leprae
cgauccggaucgucagau

SEQ ID NO: 1227180 - RNA, 19 nt, Mycobacterium leprae
cgauccucgugacaucgac

SEQ ID NO: 1227181 - RNA, 13 nt, Mycobacterium leprae
cgauccggcggcu

SEQ ID NO: 1227182 - RNA, 13 nt, Mycobacterium leprae
cgauccgucguag

SEQ ID NO: 1227183 - RNA, 17 nt, Mycobacterium leprae
cgaacaguucgauaccg

SEQ ID NO: 1227184 - RNA, 14 nt, Mycobacterium leprae
cgaaccuccaccac

SEQ ID NO: 1227185 - RNA, 22 nt, Mycobacterium leprae
cgaacgagugcgcugcagcaac

SEQ ID NO: 1227186 - RNA, 21 nt, Mycobacterium leprae
cgaacaucccugggccggcac

SEQ ID NO: 1227187 - RNA, 23 nt, Mycobacterium leprae
cgaacaugacggucgcacgaccu

SEQ ID NO: 1227188 - RNA, 19 nt, Mycobacterium leprae
cgaauaguuauaccgugca

SEQ ID NO: 1227189 - RNA, 18 nt, Mycobacterium leprae
cgaagccuggucgcguag

SEQ ID NO: 1227190 - RNA, 15 nt, Mycobacterium leprae
cgaagccucaucgaa

SEQ ID NO: 1227191 - RNA, 20 nt, Mycobacterium leprae
cgaagccgggaccuuucccg

SEQ ID NO: 1227192 - RNA, 23 nt, Mycobacterium leprae
cgaaaccacauaugccgccaugu

SEQ ID NO: 1227193 - RNA, 13 nt, Mycobacterium leprae
cgaaaccaagcca

SEQ ID NO: 1227194 - RNA, 17 nt, Mycobacterium leprae
ccuuggcgucgaucagg

SEQ ID NO: 1227195 - RNA, 15 nt, Mycobacterium leprae
ccuuggcgucggugg

SEQ ID NO: 1227196 - RNA, 17 nt, Mycobacterium leprae
ccuugaggugucggcgu

SEQ ID NO: 1227197 - RNA, 13 nt, Mycobacterium leprae
ccuguugcggcca

SEQ ID NO: 1227198 - RNA, 18 nt, Mycobacterium leprae
ccuguuauauagugcgcu

SEQ ID NO: 1227199 - RNA, 24 nt, Mycobacterium leprae
ccugugcaggucgagcgauggcug

SEQ ID NO: 1227200 - RNA, 23 nt, Mycobacterium leprae
ccugucuaucacauccgauuugu

SEQ ID NO: 1227201 - RNA, 22 nt, Mycobacterium leprae
cgaccaacccggcgauugccac

SEQ ID NO: 1227202 - RNA, 15 nt, Mycobacterium leprae
cgaccggaugaacac

SEQ ID NO: 1227203 - RNA, 21 nt, Mycobacterium leprae
cgaccggacucaaacgucgaa

SEQ ID NO: 1227204 - RNA, 18 nt, Mycobacterium leprae
cgaccggccagugcaacc

SEQ ID NO: 1227205 - RNA, 19 nt, Mycobacterium leprae
cgaccgcuggggucgcgga

SEQ ID NO: 1227206 - RNA, 21 nt, Mycobacterium leprae
cgaccuccuugaccaccaccg

SEQ ID NO: 1227207 - RNA, 24 nt, Mycobacterium leprae
cgacgaugcgugccccggccgccg

SEQ ID NO: 1227208 - RNA, 17 nt, Mycobacterium leprae
cgagaucaacguuuugc

SEQ ID NO: 1227209 - RNA, 20 nt, Mycobacterium leprae
cgacuggcuugucaccagau

SEQ ID NO: 1227210 - RNA, 22 nt, Mycobacterium leprae
cgacuguuguggucaacgggac

SEQ ID NO: 1227211 - RNA, 14 nt, Mycobacterium leprae
cgacugcaacucga

SEQ ID NO: 1227212 - RNA, 12 nt, Mycobacterium leprae
cgagaagcagcu

SEQ ID NO: 1227213 - RNA, 19 nt, Mycobacterium leprae
aacaaggugaugcccauca

SEQ ID NO: 1227214 - RNA, 13 nt, Mycobacterium leprae
cgacuaagccgcc

SEQ ID NO: 1227215 - RNA, 17 nt, Mycobacterium leprae
cgacuaagccgccgaac

SEQ ID NO: 1227216 - RNA, 21 nt, Mycobacterium leprae
cgacguuguuuccggguacgg

SEQ ID NO: 1227217 - RNA, 21 nt, Mycobacterium leprae
cgacguugaugucccuggcga

SEQ ID NO: 1227218 - RNA, 13 nt, Mycobacterium leprae
cgacucggcgcca

SEQ ID NO: 1227219 - RNA, 15 nt, Mycobacterium leprae
cgacucggcgccauc

SEQ ID NO: 1227220 - RNA, 16 nt, Mycobacterium leprae
cgacucggcgccaucg

SEQ ID NO: 1227221 - RNA, 18 nt, Mycobacterium leprae
cgacgguauugcgucggc

SEQ ID NO: 1227222 - RNA, 18 nt, Mycobacterium leprae
cgacgguccugguggcaa

SEQ ID NO: 1227223 - RNA, 16 nt, Mycobacterium leprae
cgacggugcggcuggc

SEQ ID NO: 1227224 - RNA, 20 nt, Mycobacterium leprae
cgacggugcugauggccggc

SEQ ID NO: 1227225 - RNA, 14 nt, Mycobacterium leprae
cgacggcuggcagc

SEQ ID NO: 1227226 - RNA, 12 nt, Mycobacterium leprae
ccggcugcagug

SEQ ID NO: 1227227 - RNA, 20 nt, Mycobacterium leprae
ccggcuguagugggacacuc

SEQ ID NO: 1227228 - RNA, 22 nt, Mycobacterium leprae
ccggcuguagugggacacucga

SEQ ID NO: 1227229 - RNA, 15 nt, Mycobacterium leprae
ccgggcaaaccacuu

SEQ ID NO: 1227230 - RNA, 23 nt, Mycobacterium leprae
ccgggaugacguugcuggacauc

SEQ ID NO: 1227231 - RNA, 23 nt, Mycobacterium leprae
ccggggcaggccugaucuccaac

SEQ ID NO: 1227232 - RNA, 24 nt, Mycobacterium leprae
ccggcguguggggguccgcgcacg

SEQ ID NO: 1227233 - RNA, 23 nt, Mycobacterium leprae
ccggcgugcggucuuagcaacgu

SEQ ID NO: 1227234 - RNA, 15 nt, Mycobacterium leprae
ccggccuccggugcc

SEQ ID NO: 1227235 - RNA, 15 nt, Mycobacterium leprae
ccggccaccggcgcu

SEQ ID NO: 1227236 - RNA, 15 nt, Mycobacterium leprae
ccggccaaaauggca

SEQ ID NO: 1227237 - RNA, 14 nt, Mycobacterium leprae
ccggcgccgcugcu

SEQ ID NO: 1227238 - RNA, 19 nt, Mycobacterium leprae
ccggcggccaauucgccga

SEQ ID NO: 1227239 - RNA, 20 nt, Mycobacterium leprae
ccggcggccaauucgccgac

SEQ ID NO: 1227240 - RNA, 15 nt, Mycobacterium leprae
ccggcggccaccgcg

SEQ ID NO: 1227241 - RNA, 14 nt, Mycobacterium leprae
ccggcgcuguccac

SEQ ID NO: 1227242 - RNA, 20 nt, Mycobacterium leprae
ccuagggugccuugacuucu

SEQ ID NO: 1227243 - RNA, 19 nt, Mycobacterium leprae
ccucauauuuagcgaccgg

SEQ ID NO: 1227244 - RNA, 20 nt, Mycobacterium leprae
ccucgaaucagcaucgacag

SEQ ID NO: 1227245 - RNA, 17 nt, Mycobacterium leprae
ccucgaauccgccucgg

SEQ ID NO: 1227246 - RNA, 13 nt, Mycobacterium leprae
ccuacagcagugu

SEQ ID NO: 1227247 - RNA, 15 nt, Mycobacterium leprae
ccuaccgcaucggca

SEQ ID NO: 1227248 - RNA, 18 nt, Mycobacterium leprae
ccguuguggucggacgau

SEQ ID NO: 1227249 - RNA, 19 nt, Mycobacterium leprae
ccguuauccacagcaucaa

SEQ ID NO: 1227250 - RNA, 18 nt, Mycobacterium leprae
ccguuaacuguagucggu

SEQ ID NO: 1227251 - RNA, 12 nt, Mycobacterium leprae
ccgugucgguag

SEQ ID NO: 1227252 - RNA, 15 nt, Mycobacterium leprae
ccguugagcugcaug

SEQ ID NO: 1227253 - RNA, 20 nt, Mycobacterium leprae
ccgugcagcugccaaccggu

SEQ ID NO: 1227254 - RNA, 14 nt, Mycobacterium leprae
ccgugacucaacau

SEQ ID NO: 1227255 - RNA, 19 nt, Mycobacterium leprae
ccgucgcguugaggacgau

SEQ ID NO: 1227256 - RNA, 20 nt, Mycobacterium leprae
ccggucggcggcgccgaucc

SEQ ID NO: 1227257 - RNA, 22 nt, Mycobacterium leprae
ccggugaugucggcguccucgg

SEQ ID NO: 1227258 - RNA, 12 nt, Mycobacterium leprae
ccggugaaccgu

SEQ ID NO: 1227259 - RNA, 21 nt, Mycobacterium leprae
ccggugcagcucguccaucgc

SEQ ID NO: 1227260 - RNA, 22 nt, Mycobacterium leprae
ccggugcagcucguccaucgcg

SEQ ID NO: 1227261 - RNA, 15 nt, Mycobacterium leprae
ccgguggccagcgca

SEQ ID NO: 1227262 - RNA, 17 nt, Mycobacterium leprae
ccgguggccaccgccac

SEQ ID NO: 1227263 - RNA, 13 nt, Mycobacterium leprae
aaauggguuuggu

SEQ ID NO: 1227264 - RNA, 21 nt, Mycobacterium leprae
ccgccguucucccgccacucg

SEQ ID NO: 1227265 - RNA, 13 nt, Mycobacterium leprae
ccgccggcaagcc

SEQ ID NO: 1227266 - RNA, 13 nt, Mycobacterium leprae
ccgcccggccugc

SEQ ID NO: 1227267 - RNA, 18 nt, Mycobacterium leprae
ccgcgcaucaucgcccac

SEQ ID NO: 1227268 - RNA, 21 nt, Mycobacterium leprae
ccgcgaucucgucgacaaggc

SEQ ID NO: 1227269 - RNA, 23 nt, Mycobacterium leprae
ccgccucgaucagcaacacuggc

SEQ ID NO: 1227270 - RNA, 17 nt, Mycobacterium leprae
ccgcggcugggcagccg

SEQ ID NO: 1227271 - RNA, 21 nt, Mycobacterium leprae
ccgcggcguuauccacgccga

SEQ ID NO: 1227272 - RNA, 13 nt, Mycobacterium leprae
ccgcggcgcuaac

SEQ ID NO: 1227273 - RNA, 23 nt, Mycobacterium leprae
ccgcugugacagcgugccgaagu

SEQ ID NO: 1227274 - RNA, 23 nt, Mycobacterium leprae
ccgcgucggcgucgacaucaccg

SEQ ID NO: 1227275 - RNA, 19 nt, Mycobacterium leprae
ccgcacaaacuucgacgau

SEQ ID NO: 1227276 - RNA, 16 nt, Mycobacterium leprae
ccgcacagagcccagc

SEQ ID NO: 1227277 - RNA, 20 nt, Mycobacterium leprae
ccgcacagagcccagcacgc

SEQ ID NO: 1227278 - RNA, 19 nt, Mycobacterium leprae
ccgcacaguuaccacgacg

SEQ ID NO: 1227279 - RNA, 12 nt, Mycobacterium leprae
ccgcaccggcga

SEQ ID NO: 1227280 - RNA, 20 nt, Mycobacterium leprae
ccgcacgggaggcguugcac

SEQ ID NO: 1227281 - RNA, 15 nt, Mycobacterium leprae
ccgccaucggcuggu

SEQ ID NO: 1227282 - RNA, 15 nt, Mycobacterium leprae
ccgauacccaucacg

SEQ ID NO: 1227283 - RNA, 15 nt, Mycobacterium leprae
ccgauagaccgcuac

SEQ ID NO: 1227284 - RNA, 14 nt, Mycobacterium leprae
ccgauauguucggu

SEQ ID NO: 1227285 - RNA, 17 nt, Mycobacterium leprae
ccgauauguucgguagu

SEQ ID NO: 1227286 - RNA, 17 nt, Mycobacterium leprae
ccgaucaauggcagcca

SEQ ID NO: 1227287 - RNA, 22 nt, Mycobacterium leprae
ccgaucaccuagaacagcaucg

SEQ ID NO: 1227288 - RNA, 12 nt, Mycobacterium leprae
ccgaucgacaua

SEQ ID NO: 1227289 - RNA, 16 nt, Mycobacterium leprae
ccgaucccaucggcug

SEQ ID NO: 1227290 - RNA, 15 nt, Mycobacterium leprae
ccgaucauggcugga

SEQ ID NO: 1227291 - RNA, 20 nt, Mycobacterium leprae
ccgaucauggcuggacagaa

SEQ ID NO: 1227292 - RNA, 16 nt, Mycobacterium leprae
ccgaucgcaccggcug

SEQ ID NO: 1227293 - RNA, 14 nt, Mycobacterium leprae
ccgaucggcugccg

SEQ ID NO: 1227294 - RNA, 22 nt, Mycobacterium leprae
ccgauguuguagaccaucacga

SEQ ID NO: 1227295 - RNA, 22 nt, Mycobacterium leprae
ccgaugcgcuguuggguucggu

SEQ ID NO: 1227296 - RNA, 16 nt, Mycobacterium leprae
ccgaugauggccgacc

SEQ ID NO: 1227297 - RNA, 21 nt, Mycobacterium leprae
ccgaacagccgcgccaacagc

SEQ ID NO: 1227298 - RNA, 22 nt, Mycobacterium leprae
ccgaaacgcuauggauacucaa

SEQ ID NO: 1227299 - RNA, 21 nt, Mycobacterium leprae
ccgagcuggccggggccaagc

SEQ ID NO: 1227300 - RNA, 17 nt, Mycobacterium leprae
ccgagcucuggucuggu

SEQ ID NO: 1227301 - RNA, 21 nt, Mycobacterium leprae
ccgagcgcccgcacagcacca

SEQ ID NO: 1227302 - RNA, 21 nt, Mycobacterium leprae
ccgaggaugccguagaucucg

SEQ ID NO: 1227303 - RNA, 19 nt, Mycobacterium leprae
ccgaggggccgucggcaac

SEQ ID NO: 1227304 - RNA, 21 nt, Mycobacterium leprae
ccgaguugggccaugcagucg

SEQ ID NO: 1227305 - RNA, 12 nt, Mycobacterium leprae
ccaucggacaag

SEQ ID NO: 1227306 - RNA, 23 nt, Mycobacterium leprae
ccaucggcagaucgaucucgacg

SEQ ID NO: 1227307 - RNA, 19 nt, Mycobacterium leprae
ccaugccgccgaagccgcg

SEQ ID NO: 1227308 - RNA, 22 nt, Mycobacterium leprae
ccaugggaguuuaucgguggau

SEQ ID NO: 1227309 - RNA, 17 nt, Mycobacterium leprae
ccaucuggcgacucggc

SEQ ID NO: 1227310 - RNA, 20 nt, Mycobacterium leprae
ccaucuuguuggccggugcu

SEQ ID NO: 1227311 - RNA, 12 nt, Mycobacterium leprae
cccaaugcagca

SEQ ID NO: 1227312 - RNA, 16 nt, Mycobacterium leprae
cccaauugccuggcga

SEQ ID NO: 1227313 - RNA, 23 nt, Mycobacterium leprae
cccacuuaugagcaaaaauccgc

SEQ ID NO: 1227314 - RNA, 19 nt, Mycobacterium leprae
cccaccgugcauccugcgu

SEQ ID NO: 1227315 - RNA, 19 nt, Mycobacterium leprae
cccagaaccaucccaaaac

SEQ ID NO: 1227316 - RNA, 19 nt, Mycobacterium leprae
ccaguaaguggaggugauc

SEQ ID NO: 1227317 - RNA, 20 nt, Mycobacterium leprae
ccaggucuugggaguuuccg

SEQ ID NO: 1227318 - RNA, 21 nt, Mycobacterium leprae
ccagcgcuaaaucuggccaac

SEQ ID NO: 1227319 - RNA, 14 nt, Mycobacterium leprae
ccaucaauucgcug

SEQ ID NO: 1227320 - RNA, 14 nt, Mycobacterium leprae
ccagucagucacca

SEQ ID NO: 1227321 - RNA, 20 nt, Mycobacterium leprae
ccagucggucugcucggcga

SEQ ID NO: 1227322 - RNA, 20 nt, Mycobacterium leprae
ccagugugcugcauccgaca

SEQ ID NO: 1227323 - RNA, 17 nt, Mycobacterium leprae
ccaguggcucgccgcgc

SEQ ID NO: 1227324 - RNA, 20 nt, Mycobacterium leprae
ccaguggcucgccgcgcauc

SEQ ID NO: 1227325 - RNA, 13 nt, Mycobacterium leprae
ccaguggcugcac

SEQ ID NO: 1227326 - RNA, 19 nt, Mycobacterium leprae
cccgauagggguucgccgc

SEQ ID NO: 1227327 - RNA, 15 nt, Mycobacterium leprae
cccgacggcacaccg

SEQ ID NO: 1227328 - RNA, 10 nt, Mycobacterium leprae
cccgacggcg

SEQ ID NO: 1227329 - RNA, 13 nt, Mycobacterium leprae
cccccucggcgau

SEQ ID NO: 1227330 - RNA, 23 nt, Mycobacterium leprae
cccgcuggugcguggcgaccgca

SEQ ID NO: 1227331 - RNA, 22 nt, Mycobacterium leprae
cccgcuuaaccaucagaaaacc

SEQ ID NO: 1227332 - RNA, 12 nt, Mycobacterium leprae
cccgcgccgccu

SEQ ID NO: 1227333 - RNA, 15 nt, Mycobacterium leprae
cccgauuuucgaucc

SEQ ID NO: 1227334 - RNA, 21 nt, Mycobacterium leprae
cccuuacgaucucagccagga

SEQ ID NO: 1227335 - RNA, 22 nt, Mycobacterium leprae
cccuguuccucgcgggcggcgu

SEQ ID NO: 1227336 - RNA, 15 nt, Mycobacterium leprae
cccugggccggcaca

SEQ ID NO: 1227337 - RNA, 18 nt, Mycobacterium leprae
cccgguuggccaacuguc

SEQ ID NO: 1227338 - RNA, 17 nt, Mycobacterium leprae
cccgucgcugcuggaug

SEQ ID NO: 1227339 - RNA, 22 nt, Mycobacterium leprae
cccuaggcugaugcggucaugc

SEQ ID NO: 1227340 - RNA, 18 nt, Mycobacterium leprae
cccggcagcauccgccga

SEQ ID NO: 1227341 - RNA, 18 nt, Mycobacterium leprae
ccagcacgcaaccgccgg

SEQ ID NO: 1227342 - RNA, 16 nt, Mycobacterium leprae
ccagcaccacugcggu

SEQ ID NO: 1227343 - RNA, 21 nt, Mycobacterium leprae
ccagcgaucuaccucgccaac

SEQ ID NO: 1227344 - RNA, 16 nt, Mycobacterium leprae
ccacuugggcaacacc

SEQ ID NO: 1227345 - RNA, 11 nt, Mycobacterium leprae
ccacgucgauc

SEQ ID NO: 1227346 - RNA, 17 nt, Mycobacterium leprae
ccagcaacgcuacgcac

SEQ ID NO: 1227347 - RNA, 19 nt, Mycobacterium leprae
ccaccguuguggaucgacc

SEQ ID NO: 1227348 - RNA, 21 nt, Mycobacterium leprae
ccaccgaacccagacgcgacc

SEQ ID NO: 1227349 - RNA, 17 nt, Mycobacterium leprae
ccaccguaagucagaug

SEQ ID NO: 1227350 - RNA, 20 nt, Mycobacterium leprae
ccaccgugguguugucgccg

SEQ ID NO: 1227351 - RNA, 13 nt, Mycobacterium leprae
ccaccgaccgccu

SEQ ID NO: 1227352 - RNA, 21 nt, Mycobacterium leprae
aaauacggcacgccgaacagc

SEQ ID NO: 1227353 - RNA, 20 nt, Mycobacterium leprae
ccacggcgggugaugaucac

SEQ ID NO: 1227354 - RNA, 16 nt, Mycobacterium leprae
ccacgccgugcuucca

SEQ ID NO: 1227355 - RNA, 10 nt, Mycobacterium leprae
ccacgccgga

SEQ ID NO: 1227356 - RNA, 23 nt, Mycobacterium leprae
ccaaguuggugucaacagucgcc

SEQ ID NO: 1227357 - RNA, 21 nt, Mycobacterium leprae
ccaauucucagcggaagcgcu

SEQ ID NO: 1227358 - RNA, 15 nt, Mycobacterium leprae
ccacagcaucaacgc

SEQ ID NO: 1227359 - RNA, 19 nt, Mycobacterium leprae
ccacauugaccacgccgac

SEQ ID NO: 1227360 - RNA, 15 nt, Mycobacterium leprae
ccaccaugcggcgga

SEQ ID NO: 1227361 - RNA, 21 nt, Mycobacterium leprae
ccaaaccguugaagagcgaaa

SEQ ID NO: 1227362 - RNA, 18 nt, Mycobacterium leprae
ccaaaccucugcaaccga

SEQ ID NO: 1227363 - RNA, 13 nt, Mycobacterium leprae
ccaacaccgcggc

SEQ ID NO: 1227364 - RNA, 17 nt, Mycobacterium leprae
ccaacuguugcuugccc

SEQ ID NO: 1227365 - RNA, 22 nt, Mycobacterium leprae
ccaacuccuaggaucagaaccg

SEQ ID NO: 1227366 - RNA, 22 nt, Mycobacterium leprae
ccaacuaugcuggcuaagacgc

SEQ ID NO: 1227367 - RNA, 13 nt, Mycobacterium leprae
cauuuguggcgau

SEQ ID NO: 1227368 - RNA, 21 nt, Mycobacterium leprae
cauuuguggcgauacgcgcuu

SEQ ID NO: 1227369 - RNA, 21 nt, Mycobacterium leprae
cauuugcggaugacgauuuga

SEQ ID NO: 1227370 - RNA, 23 nt, Mycobacterium leprae
cauuugcgcggcguaaacguuga

SEQ ID NO: 1227371 - RNA, 22 nt, Mycobacterium leprae
cauuggccgcugguagguguuc

SEQ ID NO: 1227372 - RNA, 17 nt, Mycobacterium leprae
cauugcguuugaugucg

SEQ ID NO: 1227373 - RNA, 21 nt, Mycobacterium leprae
caugugcauccagucguugac

SEQ ID NO: 1227374 - RNA, 18 nt, Mycobacterium leprae
cauguagaccaagcagca

SEQ ID NO: 1227375 - RNA, 21 nt, Mycobacterium leprae
caugucaugaacguagccguc

SEQ ID NO: 1227376 - RNA, 13 nt, Mycobacterium leprae
cauguuccgcuga

SEQ ID NO: 1227377 - RNA, 14 nt, Mycobacterium leprae
caugcgaccgccgg

SEQ ID NO: 1227378 - RNA, 22 nt, Mycobacterium leprae
caugcgcugaggcagcagcucg

SEQ ID NO: 1227379 - RNA, 15 nt, Mycobacterium leprae
cauggaaucguugac

SEQ ID NO: 1227380 - RNA, 20 nt, Mycobacterium leprae
caugcuuacgugcgccgcgc

SEQ ID NO: 1227381 - RNA, 16 nt, Mycobacterium leprae
caugcuggcaguggca

SEQ ID NO: 1227382 - RNA, 16 nt, Mycobacterium leprae
caugcugccgucgauc

SEQ ID NO: 1227383 - RNA, 15 nt, Mycobacterium leprae
caugcugcgcagagc

SEQ ID NO: 1227384 - RNA, 21 nt, Mycobacterium leprae
caugcgugaaguauggcucca

SEQ ID NO: 1227385 - RNA, 22 nt, Mycobacterium leprae
caugguggccacgauuccggcu

SEQ ID NO: 1227386 - RNA, 14 nt, Mycobacterium leprae
caugguagugcaca

SEQ ID NO: 1227387 - RNA, 17 nt, Mycobacterium leprae
cauggcuucgucacccg

SEQ ID NO: 1227388 - RNA, 21 nt, Mycobacterium leprae
cauggcuuuacauaucgcgaa

SEQ ID NO: 1227389 - RNA, 23 nt, Mycobacterium leprae
cauggcauaagauagcguuaggc

SEQ ID NO: 1227390 - RNA, 13 nt, Mycobacterium leprae
cauggauuaccua

SEQ ID NO: 1227391 - RNA, 13 nt, Mycobacterium leprae
cauggcacugccg

SEQ ID NO: 1227392 - RNA, 16 nt, Mycobacterium leprae
caguucacgcuggccg

SEQ ID NO: 1227393 - RNA, 18 nt, Mycobacterium leprae
caguucaccacaucaucg

SEQ ID NO: 1227394 - RNA, 21 nt, Mycobacterium leprae
caguuccagugccuugggcac

SEQ ID NO: 1227395 - RNA, 23 nt, Mycobacterium leprae
caguuccuguguugccaucgacg

SEQ ID NO: 1227396 - RNA, 18 nt, Mycobacterium leprae
caguggggcuggugccga

SEQ ID NO: 1227397 - RNA, 24 nt, Mycobacterium leprae
caguggggggcauggcacugccga

SEQ ID NO: 1227398 - RNA, 22 nt, Mycobacterium leprae
cagugggggugcggcagcugcc

SEQ ID NO: 1227399 - RNA, 17 nt, Mycobacterium leprae
caguggcaacugaagau

SEQ ID NO: 1227400 - RNA, 23 nt, Mycobacterium leprae
cagugccuucgucaauucggcga

SEQ ID NO: 1227401 - RNA, 14 nt, Mycobacterium leprae
caguucgauugcga

SEQ ID NO: 1227402 - RNA, 18 nt, Mycobacterium leprae
caguaagucccgucagga

SEQ ID NO: 1227403 - RNA, 15 nt, Mycobacterium leprae
cagucccuucgccga

SEQ ID NO: 1227404 - RNA, 13 nt, Mycobacterium leprae
cagugccgccgau

SEQ ID NO: 1227405 - RNA, 15 nt, Mycobacterium leprae
caggugaagccggcg

SEQ ID NO: 1227406 - RNA, 17 nt, Mycobacterium leprae
caggucucacacccgca

SEQ ID NO: 1227407 - RNA, 17 nt, Mycobacterium leprae
cagguagcuacgugguc

SEQ ID NO: 1227408 - RNA, 21 nt, Mycobacterium leprae
cagguauaaguucggaccgca

SEQ ID NO: 1227409 - RNA, 19 nt, Mycobacterium leprae
caggucaacgucuccaaau

SEQ ID NO: 1227410 - RNA, 19 nt, Mycobacterium leprae
cauauagcgucccagcucc

SEQ ID NO: 1227411 - RNA, 17 nt, Mycobacterium leprae
cauaucaaaccaguacc

SEQ ID NO: 1227412 - RNA, 14 nt, Mycobacterium leprae
caucaacgugcgca

SEQ ID NO: 1227413 - RNA, 13 nt, Mycobacterium leprae
cauaugcagcugc

SEQ ID NO: 1227414 - RNA, 23 nt, Mycobacterium leprae
cauagcgguuuccggcaccaaug

SEQ ID NO: 1227415 - RNA, 16 nt, Mycobacterium leprae
cauaagcgggugccgc

SEQ ID NO: 1227416 - RNA, 14 nt, Mycobacterium leprae
caucgacagcaccc

SEQ ID NO: 1227417 - RNA, 18 nt, Mycobacterium leprae
caucgacagcacccagcu

SEQ ID NO: 1227418 - RNA, 23 nt, Mycobacterium leprae
caucgccaacccgggagucgaca

SEQ ID NO: 1227419 - RNA, 11 nt, Mycobacterium leprae
caucaucaccg

SEQ ID NO: 1227420 - RNA, 13 nt, Mycobacterium leprae
cauccaccaccga

SEQ ID NO: 1227421 - RNA, 14 nt, Mycobacterium leprae
caucauugcgacga

SEQ ID NO: 1227422 - RNA, 16 nt, Mycobacterium leprae
caucauuuucaacgcc

SEQ ID NO: 1227423 - RNA, 18 nt, Mycobacterium leprae
caucccgaagugaucggc

SEQ ID NO: 1227424 - RNA, 20 nt, Mycobacterium leprae
caucccgaagugaucggcga

SEQ ID NO: 1227425 - RNA, 12 nt, Mycobacterium leprae
caggccaccggu

SEQ ID NO: 1227426 - RNA, 18 nt, Mycobacterium leprae
caggagaagcgcugcagc

SEQ ID NO: 1227427 - RNA, 12 nt, Mycobacterium leprae
caggcgugugcu

SEQ ID NO: 1227428 - RNA, 13 nt, Mycobacterium leprae
caggcgugugcua

SEQ ID NO: 1227429 - RNA, 17 nt, Mycobacterium leprae
cagcuucaaaccggcca

SEQ ID NO: 1227430 - RNA, 20 nt, Mycobacterium leprae
cagcugcugagcguggcugc

SEQ ID NO: 1227431 - RNA, 17 nt, Mycobacterium leprae
cagcuggccgggaucgg

SEQ ID NO: 1227432 - RNA, 22 nt, Mycobacterium leprae
cagcucguccaucgcgucgucu

SEQ ID NO: 1227433 - RNA, 21 nt, Mycobacterium leprae
cagcugccauuggccgcuggu

SEQ ID NO: 1227434 - RNA, 19 nt, Mycobacterium leprae
cagcuaaucccaugggagu

SEQ ID NO: 1227435 - RNA, 22 nt, Mycobacterium leprae
cagcuacaccuuggccgccggc

SEQ ID NO: 1227436 - RNA, 16 nt, Mycobacterium leprae
cagcuagacccgaacc

SEQ ID NO: 1227437 - RNA, 21 nt, Mycobacterium leprae
cagcgugaauuacucgucggu

SEQ ID NO: 1227438 - RNA, 17 nt, Mycobacterium leprae
cagcgccucaccaaauc

SEQ ID NO: 1227439 - RNA, 15 nt, Mycobacterium leprae
cagcgggggugggcu

SEQ ID NO: 1227440 - RNA, 21 nt, Mycobacterium leprae
cagcaccacagcgccaacaac

SEQ ID NO: 1227441 - RNA, 23 nt, Mycobacterium leprae
cagcacgcaaccgccggcaagcc

SEQ ID NO: 1227442 - RNA, 17 nt, Mycobacterium leprae
cagcauagucgguggug

SEQ ID NO: 1227443 - RNA, 21 nt, Mycobacterium leprae
cagcaucggcaucccagugug

SEQ ID NO: 1227444 - RNA, 12 nt, Mycobacterium leprae
cagccaagccgc

SEQ ID NO: 1227445 - RNA, 20 nt, Mycobacterium leprae
cagccaaucguguaucgucg

SEQ ID NO: 1227446 - RNA, 23 nt, Mycobacterium leprae
cagccaaucguguaucgucgcaa

SEQ ID NO: 1227447 - RNA, 22 nt, Mycobacterium leprae
cagccaccacucucaucgcggc

SEQ ID NO: 1227448 - RNA, 17 nt, Mycobacterium leprae
cagccaggagaagcgcu

SEQ ID NO: 1227449 - RNA, 17 nt, Mycobacterium leprae
cagccgcgcuagcgaug

SEQ ID NO: 1227450 - RNA, 13 nt, Mycobacterium leprae
cagccgcgggcga

SEQ ID NO: 1227451 - RNA, 19 nt, Mycobacterium leprae
cagccgaggggccgucggc

SEQ ID NO: 1227452 - RNA, 21 nt, Mycobacterium leprae
cagccgagguucccggcggcc

SEQ ID NO: 1227453 - RNA, 17 nt, Mycobacterium leprae
cagcccgcuagcaucga

SEQ ID NO: 1227454 - RNA, 18 nt, Mycobacterium leprae
cagcccgcuagcaucgac

SEQ ID NO: 1227455 - RNA, 15 nt, Mycobacterium leprae
cagcccgcgccgccg

SEQ ID NO: 1227456 - RNA, 13 nt, Mycobacterium leprae
cagcgcaucagcc

SEQ ID NO: 1227457 - RNA, 21 nt, Mycobacterium leprae
cagccuagcagcaucgcgucu

SEQ ID NO: 1227458 - RNA, 22 nt, Mycobacterium leprae
cagccguugcugcugccccccg

SEQ ID NO: 1227459 - RNA, 20 nt, Mycobacterium leprae
cagccuuucacgccaggcga

SEQ ID NO: 1227460 - RNA, 22 nt, Mycobacterium leprae
cacgggauggccaagccgcccg

SEQ ID NO: 1227461 - RNA, 15 nt, Mycobacterium leprae
cacggguggugccca

SEQ ID NO: 1227462 - RNA, 17 nt, Mycobacterium leprae
cacggucaacggccuca

SEQ ID NO: 1227463 - RNA, 16 nt, Mycobacterium leprae
aaacugguuagcgagg

SEQ ID NO: 1227464 - RNA, 20 nt, Mycobacterium leprae
cacggccgucgcgggugggu

SEQ ID NO: 1227465 - RNA, 18 nt, Mycobacterium leprae
cacgcgcgacaguaucga

SEQ ID NO: 1227466 - RNA, 19 nt, Mycobacterium leprae
cacggcagcgucaccaagc

SEQ ID NO: 1227467 - RNA, 18 nt, Mycobacterium leprae
cacggcacaaucgucgcc

SEQ ID NO: 1227468 - RNA, 23 nt, Mycobacterium leprae
cacggaagcccucccagccaucg

SEQ ID NO: 1227469 - RNA, 13 nt, Mycobacterium leprae
cacgcugcgcggc

SEQ ID NO: 1227470 - RNA, 20 nt, Mycobacterium leprae
cacugugucacgcgaccaac

SEQ ID NO: 1227471 - RNA, 21 nt, Mycobacterium leprae
cacuguuacuaccguacaggc

SEQ ID NO: 1227472 - RNA, 16 nt, Mycobacterium leprae
cacuguuuuaagcgaa

SEQ ID NO: 1227473 - RNA, 15 nt, Mycobacterium leprae
cacuggugguggccu

SEQ ID NO: 1227474 - RNA, 15 nt, Mycobacterium leprae
cacugucacgucggc

SEQ ID NO: 1227475 - RNA, 16 nt, Mycobacterium leprae
cacugucacgucggcc

SEQ ID NO: 1227476 - RNA, 13 nt, Mycobacterium leprae
cacuggguggcac

SEQ ID NO: 1227477 - RNA, 15 nt, Mycobacterium leprae
cagacccacagcugc

SEQ ID NO: 1227478 - RNA, 15 nt, Mycobacterium leprae
cagagcaagccgcac

SEQ ID NO: 1227479 - RNA, 16 nt, Mycobacterium leprae
aaagaacgcgaccugu

SEQ ID NO: 1227480 - RNA, 21 nt, Mycobacterium leprae
cagagccggcauagaauccgu

SEQ ID NO: 1227481 - RNA, 15 nt, Mycobacterium leprae
cagagcccagcacgc

SEQ ID NO: 1227482 - RNA, 17 nt, Mycobacterium leprae
cagagcccagcacgcgc

SEQ ID NO: 1227483 - RNA, 19 nt, Mycobacterium leprae
cacguucgaucggcagcca

SEQ ID NO: 1227484 - RNA, 23 nt, Mycobacterium leprae
cacugcccgggugaacgccaggc

SEQ ID NO: 1227485 - RNA, 23 nt, Mycobacterium leprae
cacugcgaacuaguguucggcac

SEQ ID NO: 1227486 - RNA, 13 nt, Mycobacterium leprae
cacugggcugcuc

SEQ ID NO: 1227487 - RNA, 14 nt, Mycobacterium leprae
cacugaguaccgaa

SEQ ID NO: 1227488 - RNA, 15 nt, Mycobacterium leprae
cacugccgaucgaca

SEQ ID NO: 1227489 - RNA, 15 nt, Mycobacterium leprae
caaaugcgguggcua

SEQ ID NO: 1227490 - RNA, 14 nt, Mycobacterium leprae
caacaccgcggcga

SEQ ID NO: 1227491 - RNA, 19 nt, Mycobacterium leprae
auuuagcgaccggccagug

SEQ ID NO: 1227492 - RNA, 16 nt, Mycobacterium leprae
auuuagaggcugcacc

SEQ ID NO: 1227493 - RNA, 17 nt, Mycobacterium leprae
caaccaaggcucccaag

SEQ ID NO: 1227494 - RNA, 17 nt, Mycobacterium leprae
caacaccuugcgccccg

SEQ ID NO: 1227495 - RNA, 16 nt, Mycobacterium leprae
caacacgaucgcagcc

SEQ ID NO: 1227496 - RNA, 11 nt, Mycobacterium leprae
caacagcggac

SEQ ID NO: 1227497 - RNA, 13 nt, Mycobacterium leprae
caacgacuggaug

SEQ ID NO: 1227498 - RNA, 14 nt, Mycobacterium leprae
caacgaacagcggg

SEQ ID NO: 1227499 - RNA, 22 nt, Mycobacterium leprae
caacgcucaacuguucggcuau

SEQ ID NO: 1227500 - RNA, 17 nt, Mycobacterium leprae
caacgcggcggcggcca

SEQ ID NO: 1227501 - RNA, 16 nt, Mycobacterium leprae
caaccccacgucgccg

SEQ ID NO: 1227502 - RNA, 21 nt, Mycobacterium leprae
caacccguugucaagcacugc

SEQ ID NO: 1227503 - RNA, 22 nt, Mycobacterium leprae
caacccguugucaagcacugca

SEQ ID NO: 1227504 - RNA, 22 nt, Mycobacterium leprae
caaccugcgcggcugccgcacc

SEQ ID NO: 1227505 - RNA, 14 nt, Mycobacterium leprae
caaccuggaggcca

SEQ ID NO: 1227506 - RNA, 15 nt, Mycobacterium leprae
caaccguccccgugg

SEQ ID NO: 1227507 - RNA, 13 nt, Mycobacterium leprae
caaccggccggcc

SEQ ID NO: 1227508 - RNA, 20 nt, Mycobacterium leprae
caaucuaauugcgaugcacu

SEQ ID NO: 1227509 - RNA, 15 nt, Mycobacterium leprae
caaucucacguccga

SEQ ID NO: 1227510 - RNA, 17 nt, Mycobacterium leprae
caauucuucgcucagca

SEQ ID NO: 1227511 - RNA, 16 nt, Mycobacterium leprae
caauucggcgagcacu

SEQ ID NO: 1227512 - RNA, 21 nt, Mycobacterium leprae
caagguguugcggugaguaaa

SEQ ID NO: 1227513 - RNA, 16 nt, Mycobacterium leprae
caagucaaaaccagcc

SEQ ID NO: 1227514 - RNA, 21 nt, Mycobacterium leprae
caaucgaauuaggaguugaca

SEQ ID NO: 1227515 - RNA, 20 nt, Mycobacterium leprae
caauccguacugguucgcga

SEQ ID NO: 1227516 - RNA, 12 nt, Mycobacterium leprae
caauccguuugc

SEQ ID NO: 1227517 - RNA, 19 nt, Mycobacterium leprae
caacguuuugccgagcaag

SEQ ID NO: 1227518 - RNA, 21 nt, Mycobacterium leprae
caacguuuuggcguaccuggg

SEQ ID NO: 1227519 - RNA, 12 nt, Mycobacterium leprae
caacugagcgcg

SEQ ID NO: 1227520 - RNA, 16 nt, Mycobacterium leprae
caacgucacgucgacg

SEQ ID NO: 1227521 - RNA, 22 nt, Mycobacterium leprae
caacgucagaagcugguggccc

SEQ ID NO: 1227522 - RNA, 20 nt, Mycobacterium leprae
caacgguuacugccacaacg

SEQ ID NO: 1227523 - RNA, 20 nt, Mycobacterium leprae
caacgugaccagcuccgaag

SEQ ID NO: 1227524 - RNA, 21 nt, Mycobacterium leprae
caacgugggcgauucgggccg

SEQ ID NO: 1227525 - RNA, 14 nt, Mycobacterium leprae
caacggcaccaaac

SEQ ID NO: 1227526 - RNA, 23 nt, Mycobacterium leprae
caacggccucacaguaggccagc

SEQ ID NO: 1227527 - RNA, 16 nt, Mycobacterium leprae
caacgggaacagcggc

SEQ ID NO: 1227528 - RNA, 17 nt, Mycobacterium leprae
caacggcgccgacaacg

SEQ ID NO: 1227529 - RNA, 22 nt, Mycobacterium leprae
caagcuuacuuggucaagguga

SEQ ID NO: 1227530 - RNA, 19 nt, Mycobacterium leprae
caagcuagaucaacagcgc

SEQ ID NO: 1227531 - RNA, 13 nt, Mycobacterium leprae
caagccggucggg

SEQ ID NO: 1227532 - RNA, 17 nt, Mycobacterium leprae
caagacaggcgcggucg

SEQ ID NO: 1227533 - RNA, 17 nt, Mycobacterium leprae
cacaugucccggugcug

SEQ ID NO: 1227534 - RNA, 13 nt, Mycobacterium leprae
caccaccaccccu

SEQ ID NO: 1227535 - RNA, 20 nt, Mycobacterium leprae
cacaaacuccagagccgcgc

SEQ ID NO: 1227536 - RNA, 15 nt, Mycobacterium leprae
cacagcccaggugcc

SEQ ID NO: 1227537 - RNA, 14 nt, Mycobacterium leprae
cacagccgucaggg

SEQ ID NO: 1227538 - RNA, 15 nt, Mycobacterium leprae
cacauaugccgccau

SEQ ID NO: 1227539 - RNA, 18 nt, Mycobacterium leprae
cacaucaguaucagugcc

SEQ ID NO: 1227540 - RNA, 17 nt, Mycobacterium leprae
cacagugccugaccauc

SEQ ID NO: 1227541 - RNA, 17 nt, Mycobacterium leprae
caccaguggcucgccgc

SEQ ID NO: 1227542 - RNA, 13 nt, Mycobacterium leprae
cacccgcagcacc

SEQ ID NO: 1227543 - RNA, 14 nt, Mycobacterium leprae
cacccgcagcaccu

SEQ ID NO: 1227544 - RNA, 17 nt, Mycobacterium leprae
caccauuuccggaacaa

SEQ ID NO: 1227545 - RNA, 17 nt, Mycobacterium leprae
caccgucuuugcuaaca

SEQ ID NO: 1227546 - RNA, 13 nt, Mycobacterium leprae
caccgugucgucu

SEQ ID NO: 1227547 - RNA, 16 nt, Mycobacterium leprae
caccgcgaagccguug

SEQ ID NO: 1227548 - RNA, 21 nt, Mycobacterium leprae
caccgcgaacgccucggcaag

SEQ ID NO: 1227549 - RNA, 14 nt, Mycobacterium leprae
caccgcuguggcag

SEQ ID NO: 1227550 - RNA, 16 nt, Mycobacterium leprae
caccggcacacccaau

SEQ ID NO: 1227551 - RNA, 14 nt, Mycobacterium leprae
caccgccgacgaau

SEQ ID NO: 1227552 - RNA, 13 nt, Mycobacterium leprae
caccgaucacggu

SEQ ID NO: 1227553 - RNA, 13 nt, Mycobacterium leprae
cacccggcagcau

SEQ ID NO: 1227554 - RNA, 16 nt, Mycobacterium leprae
cacccgucguggccga

SEQ ID NO: 1227555 - RNA, 12 nt, Mycobacterium leprae
caccgaacuguc

SEQ ID NO: 1227556 - RNA, 13 nt, Mycobacterium leprae
cacccuccucgcg

SEQ ID NO: 1227557 - RNA, 15 nt, Mycobacterium leprae
augugcagcagcucg

SEQ ID NO: 1227558 - RNA, 18 nt, Mycobacterium leprae
auguggcgcgucgguaga

SEQ ID NO: 1227559 - RNA, 20 nt, Mycobacterium leprae
auuaaguagcaagccgccag

SEQ ID NO: 1227560 - RNA, 19 nt, Mycobacterium leprae
auucaugaaaaucgccgac

SEQ ID NO: 1227561 - RNA, 13 nt, Mycobacterium leprae
auucuguugcagg

SEQ ID NO: 1227562 - RNA, 18 nt, Mycobacterium leprae
auucugcuggagaucgac

SEQ ID NO: 1227563 - RNA, 21 nt, Mycobacterium leprae
auugacgucgguguggugcuc

SEQ ID NO: 1227564 - RNA, 21 nt, Mycobacterium leprae
auugaccgcaucaccgaucac

SEQ ID NO: 1227565 - RNA, 13 nt, Mycobacterium leprae
auugacaacacga

SEQ ID NO: 1227566 - RNA, 19 nt, Mycobacterium leprae
auucggggggucggcugca

SEQ ID NO: 1227567 - RNA, 17 nt, Mycobacterium leprae
auucgguggcgaucggc

SEQ ID NO: 1227568 - RNA, 18 nt, Mycobacterium leprae
auucggcgauauccgccg

SEQ ID NO: 1227569 - RNA, 12 nt, Mycobacterium leprae
auucgacaccaa

SEQ ID NO: 1227570 - RNA, 20 nt, Mycobacterium leprae
auugcuuagcuaugcaguga

SEQ ID NO: 1227571 - RNA, 13 nt, Mycobacterium leprae
auuggacccgauc

SEQ ID NO: 1227572 - RNA, 16 nt, Mycobacterium leprae
auuggacccgaucgac

SEQ ID NO: 1227573 - RNA, 19 nt, Mycobacterium leprae
auuggacccgaucgacggc

SEQ ID NO: 1227574 - RNA, 14 nt, Mycobacterium leprae
auugguggucgcgg

SEQ ID NO: 1227575 - RNA, 15 nt, Mycobacterium leprae
auuguucugcgcugg

SEQ ID NO: 1227576 - RNA, 17 nt, Mycobacterium leprae
auugcaauccgccgauc

SEQ ID NO: 1227577 - RNA, 22 nt, Mycobacterium leprae
augaugccaggggcugggcacc

SEQ ID NO: 1227578 - RNA, 19 nt, Mycobacterium leprae
augaucuuggcccggcucc

SEQ ID NO: 1227579 - RNA, 18 nt, Mycobacterium leprae
augccgcagcaucagggc

SEQ ID NO: 1227580 - RNA, 23 nt, Mycobacterium leprae
augccuacccuagagucgaccgc

SEQ ID NO: 1227581 - RNA, 20 nt, Mycobacterium leprae
augcuguucggugacuucgg

SEQ ID NO: 1227582 - RNA, 21 nt, Mycobacterium leprae
augcuugggucgaucgcuggu

SEQ ID NO: 1227583 - RNA, 14 nt, Mycobacterium leprae
augcguccaccgag

SEQ ID NO: 1227584 - RNA, 21 nt, Mycobacterium leprae
augcgucguacucuggcuggu

SEQ ID NO: 1227585 - RNA, 12 nt, Mycobacterium leprae
augcggccagcc

SEQ ID NO: 1227586 - RNA, 20 nt, Mycobacterium leprae
augcgcuguuguuggucggc

SEQ ID NO: 1227587 - RNA, 19 nt, Mycobacterium leprae
augccugcuugcuggcuga

SEQ ID NO: 1227588 - RNA, 17 nt, Mycobacterium leprae
auggaacagcguucgac

SEQ ID NO: 1227589 - RNA, 17 nt, Mycobacterium leprae
auggacccacugggcaa

SEQ ID NO: 1227590 - RNA, 16 nt, Mycobacterium leprae
auggcguuuguuauug

SEQ ID NO: 1227591 - RNA, 20 nt, Mycobacterium leprae
augguguaaggccaggaugg

SEQ ID NO: 1227592 - RNA, 22 nt, Mycobacterium leprae
auggugugcaguaacaucacgc

SEQ ID NO: 1227593 - RNA, 15 nt, Mycobacterium leprae
augucguggugccgu

SEQ ID NO: 1227594 - RNA, 17 nt, Mycobacterium leprae
aucgaggccagccugcg

SEQ ID NO: 1227595 - RNA, 13 nt, Mycobacterium leprae
aucgaccucgaau

SEQ ID NO: 1227596 - RNA, 20 nt, Mycobacterium leprae
aucgaccagccaagccgcca

SEQ ID NO: 1227597 - RNA, 14 nt, Mycobacterium leprae
aucgaccagccacg

SEQ ID NO: 1227598 - RNA, 16 nt, Mycobacterium leprae
aucgaccagccacgca

SEQ ID NO: 1227599 - RNA, 16 nt, Mycobacterium leprae
aucgacgaggucgccg

SEQ ID NO: 1227600 - RNA, 15 nt, Mycobacterium leprae
aucgacgcugcgccg

SEQ ID NO: 1227601 - RNA, 19 nt, Mycobacterium leprae
aucgacgccgucuccgccg

SEQ ID NO: 1227602 - RNA, 14 nt, Mycobacterium leprae
aucgacggcuggca

SEQ ID NO: 1227603 - RNA, 17 nt, Mycobacterium leprae
aucgacggcuggcagca

SEQ ID NO: 1227604 - RNA, 13 nt, Mycobacterium leprae
aucgacggcagcg

SEQ ID NO: 1227605 - RNA, 19 nt, Mycobacterium leprae
aucgacauagugcaagugc

SEQ ID NO: 1227606 - RNA, 19 nt, Mycobacterium leprae
aucgacaggcaaccgcccg

SEQ ID NO: 1227607 - RNA, 17 nt, Mycobacterium leprae
aucgauguggccgcacg

SEQ ID NO: 1227608 - RNA, 21 nt, Mycobacterium leprae
aucgaugccguggugaugcgg

SEQ ID NO: 1227609 - RNA, 18 nt, Mycobacterium leprae
aucgaucucgacggcagu

SEQ ID NO: 1227610 - RNA, 16 nt, Mycobacterium leprae
aucgcaccgauccggc

SEQ ID NO: 1227611 - RNA, 17 nt, Mycobacterium leprae
aucgcaccgauccggcg

SEQ ID NO: 1227612 - RNA, 17 nt, Mycobacterium leprae
aucgcaccggcugcacc

SEQ ID NO: 1227613 - RNA, 13 nt, Mycobacterium leprae
aucgcagcccaga

SEQ ID NO: 1227614 - RNA, 14 nt, Mycobacterium leprae
aucgcagucaucac

SEQ ID NO: 1227615 - RNA, 19 nt, Mycobacterium leprae
aucgcagugcguauucggc

SEQ ID NO: 1227616 - RNA, 13 nt, Mycobacterium leprae
aucgcccgcccaa

SEQ ID NO: 1227617 - RNA, 17 nt, Mycobacterium leprae
aucggaaucgccgcgac

SEQ ID NO: 1227618 - RNA, 18 nt, Mycobacterium leprae
aucggaaucgccgcgacg

SEQ ID NO: 1227619 - RNA, 20 nt, Mycobacterium leprae
aucgcuugagacaucgucgc

SEQ ID NO: 1227620 - RNA, 17 nt, Mycobacterium leprae
aucgcugccggcggcag

SEQ ID NO: 1227621 - RNA, 22 nt, Mycobacterium leprae
aucgccgcguggguccguucgu

SEQ ID NO: 1227622 - RNA, 20 nt, Mycobacterium leprae
aucgccuucagcacagccca

SEQ ID NO: 1227623 - RNA, 20 nt, Mycobacterium leprae
aucgccgugguggcucgcgu

SEQ ID NO: 1227624 - RNA, 21 nt, Mycobacterium leprae
aucuacacuagggaggucacc

SEQ ID NO: 1227625 - RNA, 15 nt, Mycobacterium leprae
aucguugcgaccggc

SEQ ID NO: 1227626 - RNA, 23 nt, Mycobacterium leprae
aucguugaccgcccuggaccgca

SEQ ID NO: 1227627 - RNA, 20 nt, Mycobacterium leprae
aucgugaagauaggucgccg

SEQ ID NO: 1227628 - RNA, 15 nt, Mycobacterium leprae
aucguccucaugccc

SEQ ID NO: 1227629 - RNA, 15 nt, Mycobacterium leprae
aucgucuucgcagcc

SEQ ID NO: 1227630 - RNA, 20 nt, Mycobacterium leprae
aucggggcuacaaagcgacc

SEQ ID NO: 1227631 - RNA, 12 nt, Mycobacterium leprae
aucgggguccgc

SEQ ID NO: 1227632 - RNA, 20 nt, Mycobacterium leprae
aucgguacauuugcggauga

SEQ ID NO: 1227633 - RNA, 16 nt, Mycobacterium leprae
aucgguaguggccggc

SEQ ID NO: 1227634 - RNA, 21 nt, Mycobacterium leprae
aucggcuacaucgacaaaaac

SEQ ID NO: 1227635 - RNA, 16 nt, Mycobacterium leprae
aucggcgugcacggcg

SEQ ID NO: 1227636 - RNA, 20 nt, Mycobacterium leprae
aucggcggcggagcgcaccg

SEQ ID NO: 1227637 - RNA, 15 nt, Mycobacterium leprae
aucugcuacgcuggc

SEQ ID NO: 1227638 - RNA, 22 nt, Mycobacterium leprae
aucuucucuuguaguagcaggu

SEQ ID NO: 1227639 - RNA, 21 nt, Mycobacterium leprae
augacguugcucgacaggggc

SEQ ID NO: 1227640 - RNA, 16 nt, Mycobacterium leprae
augaccgcaccgaucu

SEQ ID NO: 1227641 - RNA, 15 nt, Mycobacterium leprae
aucacguuggccggc

SEQ ID NO: 1227642 - RNA, 23 nt, Mycobacterium leprae
aucagaucgcgucgcaucggugg

SEQ ID NO: 1227643 - RNA, 16 nt, Mycobacterium leprae
aucaacgugcgcagcg

SEQ ID NO: 1227644 - RNA, 17 nt, Mycobacterium leprae
aucaacgugcgcagcgu

SEQ ID NO: 1227645 - RNA, 16 nt, Mycobacterium leprae
aucaauggcagccacc

SEQ ID NO: 1227646 - RNA, 21 nt, Mycobacterium leprae
aucacaguccugcccggacaa

SEQ ID NO: 1227647 - RNA, 18 nt, Mycobacterium leprae
aucacauccgauuugucg

SEQ ID NO: 1227648 - RNA, 18 nt, Mycobacterium leprae
aucaacggcugcgugucg

SEQ ID NO: 1227649 - RNA, 14 nt, Mycobacterium leprae
aucaacaacugcgg

SEQ ID NO: 1227650 - RNA, 15 nt, Mycobacterium leprae
auagcgacuguugug

SEQ ID NO: 1227651 - RNA, 17 nt, Mycobacterium leprae
auagccgugaccgacag

SEQ ID NO: 1227652 - RNA, 17 nt, Mycobacterium leprae
auagggagaaugccaca

SEQ ID NO: 1227653 - RNA, 19 nt, Mycobacterium leprae
auaguuguuagcgccgcgg

SEQ ID NO: 1227654 - RNA, 18 nt, Mycobacterium leprae
auaucgcacacagcggcc

SEQ ID NO: 1227655 - RNA, 14 nt, Mycobacterium leprae
auagacucgaucgu

SEQ ID NO: 1227656 - RNA, 17 nt, Mycobacterium leprae
auacugaugggcagcac

SEQ ID NO: 1227657 - RNA, 14 nt, Mycobacterium leprae
aguuuggcgcugcu

SEQ ID NO: 1227658 - RNA, 17 nt, Mycobacterium leprae
auaacguugcagcgacg

SEQ ID NO: 1227659 - RNA, 20 nt, Mycobacterium leprae
auaaccuuugcccugcgcgg

SEQ ID NO: 1227660 - RNA, 16 nt, Mycobacterium leprae
agucaagaugaucguc

SEQ ID NO: 1227661 - RNA, 16 nt, Mycobacterium leprae
agucuuggacaucacu

SEQ ID NO: 1227662 - RNA, 21 nt, Mycobacterium leprae
agucuugugcguagucgaccg

SEQ ID NO: 1227663 - RNA, 12 nt, Mycobacterium leprae
agugacgucgga

SEQ ID NO: 1227664 - RNA, 14 nt, Mycobacterium leprae
agugacgucggagu

SEQ ID NO: 1227665 - RNA, 22 nt, Mycobacterium leprae
agugccuugggcacggagcggc

SEQ ID NO: 1227666 - RNA, 23 nt, Mycobacterium leprae
agugagcucaccggcggcgagca

SEQ ID NO: 1227667 - RNA, 21 nt, Mycobacterium leprae
agugcucgggugguccggguu

SEQ ID NO: 1227668 - RNA, 15 nt, Mycobacterium leprae
agugcuagcagcgcg

SEQ ID NO: 1227669 - RNA, 16 nt, Mycobacterium leprae
aguucgacaccggcca

SEQ ID NO: 1227670 - RNA, 21 nt, Mycobacterium leprae
aguugauccgucgcguugagg

SEQ ID NO: 1227671 - RNA, 22 nt, Mycobacterium leprae
aguacgcuagagucaucccgcg

SEQ ID NO: 1227672 - RNA, 14 nt, Mycobacterium leprae
aguacguguggugu

SEQ ID NO: 1227673 - RNA, 19 nt, Mycobacterium leprae
aguagaccagaagcuguug

SEQ ID NO: 1227674 - RNA, 22 nt, Mycobacterium leprae
aguaucgcguugacagccgucc

SEQ ID NO: 1227675 - RNA, 13 nt, Mycobacterium leprae
aguaucgaccagc

SEQ ID NO: 1227676 - RNA, 13 nt, Mycobacterium leprae
aggugcccaccau

SEQ ID NO: 1227677 - RNA, 20 nt, Mycobacterium leprae
aggugccagugaucgccgau

SEQ ID NO: 1227678 - RNA, 22 nt, Mycobacterium leprae
aggugcaaucccauuaguucga

SEQ ID NO: 1227679 - RNA, 22 nt, Mycobacterium leprae
aggucacgagaccacggcagcg

SEQ ID NO: 1227680 - RNA, 18 nt, Mycobacterium leprae
agggugacgguggcgcac

SEQ ID NO: 1227681 - RNA, 17 nt, Mycobacterium leprae
aggucauuaacgcuggu

SEQ ID NO: 1227682 - RNA, 13 nt, Mycobacterium leprae
aggucaugccagg

SEQ ID NO: 1227683 - RNA, 22 nt, Mycobacterium leprae
aggucgguaaaugccucgcuau

SEQ ID NO: 1227684 - RNA, 19 nt, Mycobacterium leprae
agguccuggaugccgaccg

SEQ ID NO: 1227685 - RNA, 24 nt, Mycobacterium leprae
aggucgagugcgagccacuccggu

SEQ ID NO: 1227686 - RNA, 14 nt, Mycobacterium leprae
aggcggugacugaa

SEQ ID NO: 1227687 - RNA, 13 nt, Mycobacterium leprae
aggggacuggaua

SEQ ID NO: 1227688 - RNA, 22 nt, Mycobacterium leprae
agggucgagaucgccacucggu

SEQ ID NO: 1227689 - RNA, 17 nt, Mycobacterium leprae
aggggccaacacgucac

SEQ ID NO: 1227690 - RNA, 17 nt, Mycobacterium leprae
aggcuuagcuuccgggu

SEQ ID NO: 1227691 - RNA, 20 nt, Mycobacterium leprae
agggcgaguacguccgcgcc

SEQ ID NO: 1227692 - RNA, 21 nt, Mycobacterium leprae
agggccgaaacuaaauccggg

SEQ ID NO: 1227693 - RNA, 16 nt, Mycobacterium leprae
aggcauuaagauguua

SEQ ID NO: 1227694 - RNA, 16 nt, Mycobacterium leprae
aggcaugccgccgggu

SEQ ID NO: 1227695 - RNA, 22 nt, Mycobacterium leprae
aggcaugccgccgggugcagca

SEQ ID NO: 1227696 - RNA, 21 nt, Mycobacterium leprae
aggccagcgcacccauccgau

SEQ ID NO: 1227697 - RNA, 14 nt, Mycobacterium leprae
aggcagcagcucga

SEQ ID NO: 1227698 - RNA, 22 nt, Mycobacterium leprae
aggccguggacgaacuggguga

SEQ ID NO: 1227699 - RNA, 18 nt, Mycobacterium leprae
agcacggcgcucaccgac

SEQ ID NO: 1227700 - RNA, 12 nt, Mycobacterium leprae
agcaccugccgc

SEQ ID NO: 1227701 - RNA, 15 nt, Mycobacterium leprae
agcacgaugacauac

SEQ ID NO: 1227702 - RNA, 13 nt, Mycobacterium leprae
aaaccggccgcgg

SEQ ID NO: 1227703 - RNA, 12 nt, Mycobacterium leprae
agcaaucugcgu

SEQ ID NO: 1227704 - RNA, 23 nt, Mycobacterium leprae
agcacaaaauucucgcgccaccg

SEQ ID NO: 1227705 - RNA, 21 nt, Mycobacterium leprae
agcaacacuggcgaccgcacg

SEQ ID NO: 1227706 - RNA, 17 nt, Mycobacterium leprae
agcaaacuuugucagcg

SEQ ID NO: 1227707 - RNA, 13 nt, Mycobacterium leprae
agcacccggccac

SEQ ID NO: 1227708 - RNA, 21 nt, Mycobacterium leprae
agcaccgagaauaaaugccgg

SEQ ID NO: 1227709 - RNA, 17 nt, Mycobacterium leprae
agcacaugaaaaccguc

SEQ ID NO: 1227710 - RNA, 13 nt, Mycobacterium leprae
aaaccuuccggcg

SEQ ID NO: 1227711 - RNA, 17 nt, Mycobacterium leprae
agccgacugacaacacu

SEQ ID NO: 1227712 - RNA, 16 nt, Mycobacterium leprae
agccgaagcggccgga

SEQ ID NO: 1227713 - RNA, 16 nt, Mycobacterium leprae
agccagggucacaaac

SEQ ID NO: 1227714 - RNA, 13 nt, Mycobacterium leprae
agcccggcgugca

SEQ ID NO: 1227715 - RNA, 16 nt, Mycobacterium leprae
agcccgggaugacguu

SEQ ID NO: 1227716 - RNA, 17 nt, Mycobacterium leprae
agcaugucgguggugga

SEQ ID NO: 1227717 - RNA, 17 nt, Mycobacterium leprae
agcaugucggugguggg

SEQ ID NO: 1227718 - RNA, 19 nt, Mycobacterium leprae
agcauuccuuucagcucga

SEQ ID NO: 1227719 - RNA, 15 nt, Mycobacterium leprae
agccaauucguccgg

SEQ ID NO: 1227720 - RNA, 20 nt, Mycobacterium leprae
agccacacgcgacgccgcca

SEQ ID NO: 1227721 - RNA, 23 nt, Mycobacterium leprae
agccacuccgguugcggcgagcu

SEQ ID NO: 1227722 - RNA, 15 nt, Mycobacterium leprae
agcagccgaccgccc

SEQ ID NO: 1227723 - RNA, 18 nt, Mycobacterium leprae
agcucaauuggcagagca

SEQ ID NO: 1227724 - RNA, 20 nt, Mycobacterium leprae
agcucguuggguaucagcgc

SEQ ID NO: 1227725 - RNA, 15 nt, Mycobacterium leprae
agcugaccacucgcg

SEQ ID NO: 1227726 - RNA, 17 nt, Mycobacterium leprae
agcggucgcagcgcauu

SEQ ID NO: 1227727 - RNA, 12 nt, Mycobacterium leprae
agcgcugugauu

SEQ ID NO: 1227728 - RNA, 14 nt, Mycobacterium leprae
agcggagacccccg

SEQ ID NO: 1227729 - RNA, 19 nt, Mycobacterium leprae
agcgacacagccggccggc

SEQ ID NO: 1227730 - RNA, 17 nt, Mycobacterium leprae
agccgguggccaccgcc

SEQ ID NO: 1227731 - RNA, 19 nt, Mycobacterium leprae
agccgguggccaccgccac

SEQ ID NO: 1227732 - RNA, 23 nt, Mycobacterium leprae
agccgguggccaccgccaccgaa

SEQ ID NO: 1227733 - RNA, 19 nt, Mycobacterium leprae
agccguggggcucggccag

SEQ ID NO: 1227734 - RNA, 20 nt, Mycobacterium leprae
agccguucggguugcgguca

SEQ ID NO: 1227735 - RNA, 15 nt, Mycobacterium leprae
agccuguugcaagcg

SEQ ID NO: 1227736 - RNA, 20 nt, Mycobacterium leprae
agcgccugagcgggccagca

SEQ ID NO: 1227737 - RNA, 22 nt, Mycobacterium leprae
acgaugcgugccccggccgccg

SEQ ID NO: 1227738 - RNA, 13 nt, Mycobacterium leprae
accugggcggcau

SEQ ID NO: 1227739 - RNA, 16 nt, Mycobacterium leprae
accuucuaaccgguca

SEQ ID NO: 1227740 - RNA, 14 nt, Mycobacterium leprae
acgcgugcggcgcc

SEQ ID NO: 1227741 - RNA, 14 nt, Mycobacterium leprae
acgcuaaucgcggg

SEQ ID NO: 1227742 - RNA, 16 nt, Mycobacterium leprae
acgcuaguguggucga

SEQ ID NO: 1227743 - RNA, 14 nt, Mycobacterium leprae
acgcugaaccgcgu

SEQ ID NO: 1227744 - RNA, 16 nt, Mycobacterium leprae
acgcgaucgccgaaau

SEQ ID NO: 1227745 - RNA, 24 nt, Mycobacterium leprae
acgcgaucgccgaaaucgguggca

SEQ ID NO: 1227746 - RNA, 15 nt, Mycobacterium leprae
acgcgacgccgccau

SEQ ID NO: 1227747 - RNA, 24 nt, Mycobacterium leprae
acgcgcgacaguaucgaccagcca

SEQ ID NO: 1227748 - RNA, 14 nt, Mycobacterium leprae
acgccgauaucgac

SEQ ID NO: 1227749 - RNA, 16 nt, Mycobacterium leprae
acgccgauaucgacca

SEQ ID NO: 1227750 - RNA, 22 nt, Mycobacterium leprae
acgccgaucgugccccucgaag

SEQ ID NO: 1227751 - RNA, 19 nt, Mycobacterium leprae
acgccgagaacaucgcggu

SEQ ID NO: 1227752 - RNA, 22 nt, Mycobacterium leprae
acgccggucgaagugaccucca

SEQ ID NO: 1227753 - RNA, 16 nt, Mycobacterium leprae
acgccguagcgcacca

SEQ ID NO: 1227754 - RNA, 22 nt, Mycobacterium leprae
acgccgcggcugggcagccgag

SEQ ID NO: 1227755 - RNA, 19 nt, Mycobacterium leprae
acgccgcucgauucucgag

SEQ ID NO: 1227756 - RNA, 17 nt, Mycobacterium leprae
acgccuagcuagccgac

SEQ ID NO: 1227757 - RNA, 15 nt, Mycobacterium leprae
acgccugggaaccca

SEQ ID NO: 1227758 - RNA, 23 nt, Mycobacterium leprae
acgccgugccgagcuaacagaac

SEQ ID NO: 1227759 - RNA, 16 nt, Mycobacterium leprae
acggcgaccgacuggc

SEQ ID NO: 1227760 - RNA, 13 nt, Mycobacterium leprae
acggggagaucga

SEQ ID NO: 1227761 - RNA, 14 nt, Mycobacterium leprae
acggcuggcagcaa

SEQ ID NO: 1227762 - RNA, 22 nt, Mycobacterium leprae
acggcugacuccguacucacgu

SEQ ID NO: 1227763 - RNA, 16 nt, Mycobacterium leprae
acggcgcucaccgacg

SEQ ID NO: 1227764 - RNA, 19 nt, Mycobacterium leprae
acgucagaagcugguggcc

SEQ ID NO: 1227765 - RNA, 20 nt, Mycobacterium leprae
acgucacgucgacggcggcc

SEQ ID NO: 1227766 - RNA, 13 nt, Mycobacterium leprae
acguccgcggcag

SEQ ID NO: 1227767 - RNA, 21 nt, Mycobacterium leprae
acguccaucuuguuggccggu

SEQ ID NO: 1227768 - RNA, 21 nt, Mycobacterium leprae
acguccacauaauagcgcggu

SEQ ID NO: 1227769 - RNA, 23 nt, Mycobacterium leprae
acgucaucgacagaugcgaucgc

SEQ ID NO: 1227770 - RNA, 17 nt, Mycobacterium leprae
acgguuuuguccugugg

SEQ ID NO: 1227771 - RNA, 20 nt, Mycobacterium leprae
acggugccgaauucgcccga

SEQ ID NO: 1227772 - RNA, 14 nt, Mycobacterium leprae
acguaccaccgcgg

SEQ ID NO: 1227773 - RNA, 15 nt, Mycobacterium leprae
acguaccggaucgac

SEQ ID NO: 1227774 - RNA, 22 nt, Mycobacterium leprae
acgugacugcggcucaccgacu

SEQ ID NO: 1227775 - RNA, 20 nt, Mycobacterium leprae
acgugacuugaacgguguug

SEQ ID NO: 1227776 - RNA, 15 nt, Mycobacterium leprae
acguggugguagcca

SEQ ID NO: 1227777 - RNA, 14 nt, Mycobacterium leprae
acgugguggcugca

SEQ ID NO: 1227778 - RNA, 15 nt, Mycobacterium leprae
acguccucggcccau

SEQ ID NO: 1227779 - RNA, 23 nt, Mycobacterium leprae
acgucgaugucagcgucguggcu

SEQ ID NO: 1227780 - RNA, 16 nt, Mycobacterium leprae
acucaaauucaugacg

SEQ ID NO: 1227781 - RNA, 22 nt, Mycobacterium leprae
acguugaugcaucaagcuguga

SEQ ID NO: 1227782 - RNA, 19 nt, Mycobacterium leprae
acucaccgguacacaccgc

SEQ ID NO: 1227783 - RNA, 20 nt, Mycobacterium leprae
acucacgcgcagugcaagug

SEQ ID NO: 1227784 - RNA, 15 nt, Mycobacterium leprae
acucagcaaugcucu

SEQ ID NO: 1227785 - RNA, 21 nt, Mycobacterium leprae
acuccagcagcguggucaccg

SEQ ID NO: 1227786 - RNA, 13 nt, Mycobacterium leprae
acucggcagagcg

SEQ ID NO: 1227787 - RNA, 22 nt, Mycobacterium leprae
acucggcgccaucgaauccucg

SEQ ID NO: 1227788 - RNA, 17 nt, Mycobacterium leprae
acucgucggcaagccaa

SEQ ID NO: 1227789 - RNA, 21 nt, Mycobacterium leprae
acucgggguuugacaccgcag

SEQ ID NO: 1227790 - RNA, 16 nt, Mycobacterium leprae
acucgaccuugccgaa

SEQ ID NO: 1227791 - RNA, 13 nt, Mycobacterium leprae
acucgagucgcga

SEQ ID NO: 1227792 - RNA, 16 nt, Mycobacterium leprae
acucgaguggcgaacg

SEQ ID NO: 1227793 - RNA, 23 nt, Mycobacterium leprae
acuccgggcccggacggcccagc

SEQ ID NO: 1227794 - RNA, 18 nt, Mycobacterium leprae
acuugacggucgagcugg

SEQ ID NO: 1227795 - RNA, 20 nt, Mycobacterium leprae
acuucgguccgcucaccgcg

SEQ ID NO: 1227796 - RNA, 20 nt, Mycobacterium leprae
acuuuagcaacgacgccaca

SEQ ID NO: 1227797 - RNA, 15 nt, Mycobacterium leprae
acuuggucaagguga

SEQ ID NO: 1227798 - RNA, 18 nt, Mycobacterium leprae
acuucggcaacggcgucu

SEQ ID NO: 1227799 - RNA, 19 nt, Mycobacterium leprae
acuucgguaacgcugacca

SEQ ID NO: 1227800 - RNA, 20 nt, Mycobacterium leprae
acugucgcccgacggcgucg

SEQ ID NO: 1227801 - RNA, 15 nt, Mycobacterium leprae
acuucaaccaagccg

SEQ ID NO: 1227802 - RNA, 15 nt, Mycobacterium leprae
acuggacguggcggu

SEQ ID NO: 1227803 - RNA, 15 nt, Mycobacterium leprae
acugcuucggccagc

SEQ ID NO: 1227804 - RNA, 16 nt, Mycobacterium leprae
acugcuucggccagcg

SEQ ID NO: 1227805 - RNA, 16 nt, Mycobacterium leprae
acugcugcccgcgggg

SEQ ID NO: 1227806 - RNA, 13 nt, Mycobacterium leprae
acucucaucgcgg

SEQ ID NO: 1227807 - RNA, 15 nt, Mycobacterium leprae
acugcgaacaucgaa

SEQ ID NO: 1227808 - RNA, 22 nt, Mycobacterium leprae
acugcguuguagaccaugagca

SEQ ID NO: 1227809 - RNA, 16 nt, Mycobacterium leprae
acugcguuucaugacg

SEQ ID NO: 1227810 - RNA, 13 nt, Mycobacterium leprae
acugcuagccggc

SEQ ID NO: 1227811 - RNA, 18 nt, Mycobacterium leprae
acccggcagcauccgccg

SEQ ID NO: 1227812 - RNA, 20 nt, Mycobacterium leprae
acccggcagcauccgccgac

SEQ ID NO: 1227813 - RNA, 14 nt, Mycobacterium leprae
acccggccgucgcu

SEQ ID NO: 1227814 - RNA, 17 nt, Mycobacterium leprae
acccggccagauccagc

SEQ ID NO: 1227815 - RNA, 21 nt, Mycobacterium leprae
acccuuggcgucgguggcggu

SEQ ID NO: 1227816 - RNA, 14 nt, Mycobacterium leprae
acccuugagcaccc

SEQ ID NO: 1227817 - RNA, 19 nt, Mycobacterium leprae
accgaaaucaaagcccgca

SEQ ID NO: 1227818 - RNA, 16 nt, Mycobacterium leprae
accgaacaacgaacag

SEQ ID NO: 1227819 - RNA, 15 nt, Mycobacterium leprae
accgacggaugccca

SEQ ID NO: 1227820 - RNA, 16 nt, Mycobacterium leprae
accgacggcgccgcac

SEQ ID NO: 1227821 - RNA, 23 nt, Mycobacterium leprae
accgacuucaacggucgcucgga

SEQ ID NO: 1227822 - RNA, 16 nt, Mycobacterium leprae
accgacuuggccgcaa

SEQ ID NO: 1227823 - RNA, 21 nt, Mycobacterium leprae
acccggucgucuccguccagc

SEQ ID NO: 1227824 - RNA, 16 nt, Mycobacterium leprae
acccguggucagccua

SEQ ID NO: 1227825 - RNA, 19 nt, Mycobacterium leprae
acccguggucagccuagca

SEQ ID NO: 1227826 - RNA, 17 nt, Mycobacterium leprae
acccguuggaucucgcc

SEQ ID NO: 1227827 - RNA, 15 nt, Mycobacterium leprae
acccgacacaaagcu

SEQ ID NO: 1227828 - RNA, 22 nt, Mycobacterium leprae
accccuacccaaaucagcacca

SEQ ID NO: 1227829 - RNA, 17 nt, Mycobacterium leprae
acccaggccuguugcgg

SEQ ID NO: 1227830 - RNA, 18 nt, Mycobacterium leprae
acccaggccuguugcggc

SEQ ID NO: 1227831 - RNA, 18 nt, Mycobacterium leprae
acccaguucgugaugguc

SEQ ID NO: 1227832 - RNA, 15 nt, Mycobacterium leprae
accccacgucgccgg

SEQ ID NO: 1227833 - RNA, 17 nt, Mycobacterium leprae
accgcucgauggccagc

SEQ ID NO: 1227834 - RNA, 17 nt, Mycobacterium leprae
accgcgaacgccucggc

SEQ ID NO: 1227835 - RNA, 14 nt, Mycobacterium leprae
accgccuugucggc

SEQ ID NO: 1227836 - RNA, 20 nt, Mycobacterium leprae
accgccccgcuguaucgucc

SEQ ID NO: 1227837 - RNA, 17 nt, Mycobacterium leprae
accgagauuaucgcauc

SEQ ID NO: 1227838 - RNA, 19 nt, Mycobacterium leprae
accgagaucgacgcugcgc

SEQ ID NO: 1227839 - RNA, 22 nt, Mycobacterium leprae
accggcguuuccaaaacccacu

SEQ ID NO: 1227840 - RNA, 13 nt, Mycobacterium leprae
accggcguucgau

SEQ ID NO: 1227841 - RNA, 23 nt, Mycobacterium leprae
accggccguaaucaagaucggcc

SEQ ID NO: 1227842 - RNA, 20 nt, Mycobacterium leprae
accggccaaaagccuugcgu

SEQ ID NO: 1227843 - RNA, 21 nt, Mycobacterium leprae
accggacagcacccccggcca

SEQ ID NO: 1227844 - RNA, 24 nt, Mycobacterium leprae
accggaauguccaccagccgcagg

SEQ ID NO: 1227845 - RNA, 14 nt, Mycobacterium leprae
accggaauuccgac

SEQ ID NO: 1227846 - RNA, 18 nt, Mycobacterium leprae
accggaccaucgucaguc

SEQ ID NO: 1227847 - RNA, 16 nt, Mycobacterium leprae
accaauccagccaaca

SEQ ID NO: 1227848 - RNA, 15 nt, Mycobacterium leprae
accaauagccgacca

SEQ ID NO: 1227849 - RNA, 15 nt, Mycobacterium leprae
accaaccgcgcagca

SEQ ID NO: 1227850 - RNA, 18 nt, Mycobacterium leprae
accaacaccccgauucca

SEQ ID NO: 1227851 - RNA, 16 nt, Mycobacterium leprae
acauuucgacaggcug

SEQ ID NO: 1227852 - RNA, 15 nt, Mycobacterium leprae
acaucgccaccgacc

SEQ ID NO: 1227853 - RNA, 16 nt, Mycobacterium leprae
acaucgacccguuguu

SEQ ID NO: 1227854 - RNA, 20 nt, Mycobacterium leprae
acaucgaaucgaguggccgu

SEQ ID NO: 1227855 - RNA, 18 nt, Mycobacterium leprae
acaucgucggcccaggga

SEQ ID NO: 1227856 - RNA, 22 nt, Mycobacterium leprae
acauggacaaccugggcggcau

SEQ ID NO: 1227857 - RNA, 17 nt, Mycobacterium leprae
acaugaagccguugggc

SEQ ID NO: 1227858 - RNA, 15 nt, Mycobacterium leprae
acaugacgccuggga

SEQ ID NO: 1227859 - RNA, 20 nt, Mycobacterium leprae
acaaaaucucacgcccgacg

SEQ ID NO: 1227860 - RNA, 19 nt, Mycobacterium leprae
acagggguccugaccgccu

SEQ ID NO: 1227861 - RNA, 15 nt, Mycobacterium leprae
acagucagccgcggg

SEQ ID NO: 1227862 - RNA, 14 nt, Mycobacterium leprae
acaguccaccgcca

SEQ ID NO: 1227863 - RNA, 20 nt, Mycobacterium leprae
acaucaccggcggugucggc

SEQ ID NO: 1227864 - RNA, 16 nt, Mycobacterium leprae
acauaucuaauuggga

SEQ ID NO: 1227865 - RNA, 23 nt, Mycobacterium leprae
acauauuguacgacaaaauuuuc

SEQ ID NO: 1227866 - RNA, 22 nt, Mycobacterium leprae
acauagguagauaaacaucgag

SEQ ID NO: 1227867 - RNA, 12 nt, Mycobacterium leprae
accagcgucgcu

SEQ ID NO: 1227868 - RNA, 17 nt, Mycobacterium leprae
accagccaagccgccag

SEQ ID NO: 1227869 - RNA, 23 nt, Mycobacterium leprae
accacugcggugugugggucgcc

SEQ ID NO: 1227870 - RNA, 18 nt, Mycobacterium leprae
accacuucuugugcaccg

SEQ ID NO: 1227871 - RNA, 20 nt, Mycobacterium leprae
accagauuggaaaucgcucg

SEQ ID NO: 1227872 - RNA, 16 nt, Mycobacterium leprae
accaccgaaccgggca

SEQ ID NO: 1227873 - RNA, 13 nt, Mycobacterium leprae
accaccaccgcca

SEQ ID NO: 1227874 - RNA, 16 nt, Mycobacterium leprae
accacauaugccgcca

SEQ ID NO: 1227875 - RNA, 20 nt, Mycobacterium leprae
accacgcacacgacagccgc

SEQ ID NO: 1227876 - RNA, 18 nt, Mycobacterium leprae
accacgcaaugucgccgg

SEQ ID NO: 1227877 - RNA, 14 nt, Mycobacterium leprae
accacgaagcgaug

SEQ ID NO: 1227878 - RNA, 22 nt, Mycobacterium leprae
aaucagcgucggacgccggacc

SEQ ID NO: 1227879 - RNA, 14 nt, Mycobacterium leprae
aauaguaaguggcc

SEQ ID NO: 1227880 - RNA, 22 nt, Mycobacterium leprae
aaucccccaggucaacagcauc

SEQ ID NO: 1227881 - RNA, 23 nt, Mycobacterium leprae
aaucaucgcugccaucgacgccg

SEQ ID NO: 1227882 - RNA, 12 nt, Mycobacterium leprae
aaucgcggcaca

SEQ ID NO: 1227883 - RNA, 14 nt, Mycobacterium leprae
aaucgccggcguug

SEQ ID NO: 1227884 - RNA, 13 nt, Mycobacterium leprae
aaucgacgcagca

SEQ ID NO: 1227885 - RNA, 16 nt, Mycobacterium leprae
aaucgagcacggcaca

SEQ ID NO: 1227886 - RNA, 21 nt, Mycobacterium leprae
aauccuagcguugguggcuac

SEQ ID NO: 1227887 - RNA, 12 nt, Mycobacterium leprae
aauccguucgau

SEQ ID NO: 1227888 - RNA, 22 nt, Mycobacterium leprae
aauuuagaggcugcaccggcuu

SEQ ID NO: 1227889 - RNA, 16 nt, Mycobacterium leprae
aauugaauccgcugcc

SEQ ID NO: 1227890 - RNA, 22 nt, Mycobacterium leprae
aaugugggcuuuccuucagugc

SEQ ID NO: 1227891 - RNA, 19 nt, Mycobacterium leprae
aaugucaauaacguuugcu

SEQ ID NO: 1227892 - RNA, 19 nt, Mycobacterium leprae
aagucgaggggacuggaua

SEQ ID NO: 1227893 - RNA, 14 nt, Mycobacterium leprae
aagucaucggcgca

SEQ ID NO: 1227894 - RNA, 16 nt, Mycobacterium leprae
aauaccuaucgacauc

SEQ ID NO: 1227895 - RNA, 17 nt, Mycobacterium leprae
aauagagcagugcugac

SEQ ID NO: 1227896 - RNA, 13 nt, Mycobacterium leprae
aauagaccagcgu

SEQ ID NO: 1227897 - RNA, 16 nt, Mycobacterium leprae
aaguacugaccggcua

SEQ ID NO: 1227898 - RNA, 20 nt, Mycobacterium leprae
aaggacgcauccaucgcauc

SEQ ID NO: 1227899 - RNA, 22 nt, Mycobacterium leprae
aaggaagcaaaguccucgaauc

SEQ ID NO: 1227900 - RNA, 12 nt, Mycobacterium leprae
aagcugugagug

SEQ ID NO: 1227901 - RNA, 14 nt, Mycobacterium leprae
aagauccggugguc

SEQ ID NO: 1227902 - RNA, 17 nt, Mycobacterium leprae
aagaugacucggcgugc

SEQ ID NO: 1227903 - RNA, 20 nt, Mycobacterium leprae
aagcagcauccaccaccgac

SEQ ID NO: 1227904 - RNA, 13 nt, Mycobacterium leprae
aagcagccggggu

SEQ ID NO: 1227905 - RNA, 22 nt, Mycobacterium leprae
aagcaccagcaguggucggcga

SEQ ID NO: 1227906 - RNA, 13 nt, Mycobacterium leprae
aagcaacugcagc

SEQ ID NO: 1227907 - RNA, 16 nt, Mycobacterium leprae
aagcaaaguccucgaa

SEQ ID NO: 1227908 - RNA, 16 nt, Mycobacterium leprae
aacgugcagcuggccg

SEQ ID NO: 1227909 - RNA, 13 nt, Mycobacterium leprae
aacuacggggcua

SEQ ID NO: 1227910 - RNA, 19 nt, Mycobacterium leprae
aagagccgcggguuucccg

SEQ ID NO: 1227911 - RNA, 23 nt, Mycobacterium leprae
aacuacuguugucaguggcgaca

SEQ ID NO: 1227912 - RNA, 18 nt, Mycobacterium leprae
aagcggauaguaugccuc

SEQ ID NO: 1227913 - RNA, 23 nt, Mycobacterium leprae
aacgcacugguuucggucgucau

SEQ ID NO: 1227914 - RNA, 13 nt, Mycobacterium leprae
aacgccggccggu

SEQ ID NO: 1227915 - RNA, 16 nt, Mycobacterium leprae
aaccuuugucgccagu

SEQ ID NO: 1227916 - RNA, 22 nt, Mycobacterium leprae
aaccgcucgauggccagccguc

SEQ ID NO: 1227917 - RNA, 19 nt, Mycobacterium leprae
aacgucgaucucgacgcga

SEQ ID NO: 1227918 - RNA, 19 nt, Mycobacterium leprae
aacggaauaaucacagccu

SEQ ID NO: 1227919 - RNA, 13 nt, Mycobacterium leprae
aacggaauacagc

SEQ ID NO: 1227920 - RNA, 11 nt, Mycobacterium leprae
aacgcgcaccu

SEQ ID NO: 1227921 - RNA, 19 nt, Mycobacterium leprae
aacgcgaccuguuggugag

SEQ ID NO: 1227922 - RNA, 21 nt, Mycobacterium leprae
aacggcugcgugucgacccgu

SEQ ID NO: 1227923 - RNA, 13 nt, Mycobacterium leprae
aacggcgguggca

SEQ ID NO: 1227924 - RNA, 17 nt, Mycobacterium leprae
aacggcgucgaauuccg

SEQ ID NO: 1227925 - RNA, 13 nt, Mycobacterium leprae
aacauagccagca

SEQ ID NO: 1227926 - RNA, 16 nt, Mycobacterium leprae
aacauggacaaccugg

SEQ ID NO: 1227927 - RNA, 21 nt, Mycobacterium leprae
aaccacacccuggcugggcug

SEQ ID NO: 1227928 - RNA, 21 nt, Mycobacterium leprae
aaccgcacagagcccagcacg

SEQ ID NO: 1227929 - RNA, 20 nt, Mycobacterium leprae
aaccgaccucuuggauuucg

SEQ ID NO: 1227930 - RNA, 16 nt, Mycobacterium leprae
aaccaugccgcgcgcc

SEQ ID NO: 1227931 - RNA, 21 nt, Mycobacterium leprae
aaaucacggagaucggcgugc

SEQ ID NO: 1227932 - RNA, 18 nt, Mycobacterium leprae
aacagagcaagccgcaca

SEQ ID NO: 1227933 - RNA, 15 nt, Mycobacterium leprae
aacaaccuggugugc

SEQ ID NO: 1227934 - RNA, 20 nt, Mycobacterium leprae
aacagcauccucggcacagu

SEQ ID NO: 1227935 - RNA, 20 nt, Mycobacterium leprae
aacaggcauauaaucgcuuc

SEQ ID NO: 1227936 - RNA, 20 nt, Mycobacterium leprae
aaacgaccuggugacgucgu

SEQ ID NO: 1227937 - RNA, 16 nt, Mycobacterium leprae
aaacuucgacgagaca

SEQ ID NO: 1227938 - RNA, 18 nt, Mycobacterium leprae
aaacuccagagccgcgcg

SEQ ID NO: 1227939 - RNA, 18 nt, Mycobacterium leprae
aaacugcugcgcaagguu

SEQ ID NO: 1227940 - RNA, 23 nt, Mycobacterium leprae
aaauacuacagaugacagcgcga

SEQ ID NO: 1227941 - RNA, 23 nt, Mycobacterium leprae
aaagcagaauauugcgacaucca

SEQ ID NO: 1227942 - RNA, 19 nt, Mycobacterium leprae
uuuccgccucaggguacga

SEQ ID NO: 1227943 - RNA, 19 nt, Mycobacterium leprae
uuggcgcgcuuucggagau

SEQ ID NO: 1227944 - RNA, 14 nt, Mycobacterium leprae
uugggagcauacga

SEQ ID NO: 1227945 - RNA, 22 nt, Mycobacterium leprae
uugggaguuuccgccucagggu

SEQ ID NO: 1227946 - RNA, 22 nt, Mycobacterium leprae
uuguuggccggguacggacauc

SEQ ID NO: 1227947 - RNA, 21 nt, Mycobacterium leprae
uugucgucggccgcggcgacc

SEQ ID NO: 1227948 - RNA, 21 nt, Mycobacterium leprae
uucgacaagcccccgcggauc

SEQ ID NO: 1227949 - RNA, 13 nt, Mycobacterium leprae
uuccucgcgggcg

SEQ ID NO: 1227950 - RNA, 20 nt, Mycobacterium leprae
uucgccgcacgggaggcguu

SEQ ID NO: 1227951 - RNA, 15 nt, Mycobacterium leprae
uucgguuuccucauu

SEQ ID NO: 1227952 - RNA, 22 nt, Mycobacterium leprae
uucucaagcgggcaacaggcgg

SEQ ID NO: 1227953 - RNA, 20 nt, Mycobacterium leprae
uucugcgguaucaucaagca

SEQ ID NO: 1227954 - RNA, 17 nt, Mycobacterium leprae
uucuucagcuacagcgg

SEQ ID NO: 1227955 - RNA, 13 nt, Mycobacterium leprae
uuagcgccgcggg

SEQ ID NO: 1227956 - RNA, 19 nt, Mycobacterium leprae
uuacgcgaucuaccccggc

SEQ ID NO: 1227957 - RNA, 15 nt, Mycobacterium leprae
uguugucgccgaaac

SEQ ID NO: 1227958 - RNA, 18 nt, Mycobacterium leprae
ugugcugaaggcgauauc

SEQ ID NO: 1227959 - RNA, 18 nt, Mycobacterium leprae
uguggcacccacucggcg

SEQ ID NO: 1227960 - RNA, 21 nt, Mycobacterium leprae
ugugcgccaggggaaccaucg

SEQ ID NO: 1227961 - RNA, 22 nt, Mycobacterium leprae
uucccaccgugguguugucgcc

SEQ ID NO: 1227962 - RNA, 21 nt, Mycobacterium leprae
uucagcguggcuaggccagug

SEQ ID NO: 1227963 - RNA, 13 nt, Mycobacterium leprae
ugucugucggcua

SEQ ID NO: 1227964 - RNA, 15 nt, Mycobacterium leprae
ugucuaccagcaccc

SEQ ID NO: 1227965 - RNA, 19 nt, Mycobacterium leprae
ugucggaaaaacggcuggc

SEQ ID NO: 1227966 - RNA, 21 nt, Mycobacterium leprae
ugucggaccacucuggcuagc

SEQ ID NO: 1227967 - RNA, 13 nt, Mycobacterium leprae
ugucggacgucga

SEQ ID NO: 1227968 - RNA, 22 nt, Mycobacterium leprae
ugucgucgaaaccauggucuua

SEQ ID NO: 1227969 - RNA, 16 nt, Mycobacterium leprae
uguccuugccggcgcc

SEQ ID NO: 1227970 - RNA, 22 nt, Mycobacterium leprae
uguaacggucaucccagaacug

SEQ ID NO: 1227971 - RNA, 18 nt, Mycobacterium leprae
uguaaguaggcgaagagc

SEQ ID NO: 1227972 - RNA, 13 nt, Mycobacterium leprae
uguaaggccagca

SEQ ID NO: 1227973 - RNA, 15 nt, Mycobacterium leprae
uguaaggccagcagu

SEQ ID NO: 1227974 - RNA, 14 nt, Mycobacterium leprae
ugucaagcacugca

SEQ ID NO: 1227975 - RNA, 13 nt, Mycobacterium leprae
uguauccggaggc

SEQ ID NO: 1227976 - RNA, 20 nt, Mycobacterium leprae
uggucacgguugcccgcugc

SEQ ID NO: 1227977 - RNA, 18 nt, Mycobacterium leprae
uggucgauauccccgacg

SEQ ID NO: 1227978 - RNA, 19 nt, Mycobacterium leprae
uggucgagcagcuccagcu

SEQ ID NO: 1227979 - RNA, 11 nt, Mycobacterium leprae
uggucgccgcg

SEQ ID NO: 1227980 - RNA, 12 nt, Mycobacterium leprae
uggucggauggc

SEQ ID NO: 1227981 - RNA, 22 nt, Mycobacterium leprae
ugguguccuagguccacuugac

SEQ ID NO: 1227982 - RNA, 15 nt, Mycobacterium leprae
uggccggaacagcau

SEQ ID NO: 1227983 - RNA, 13 nt, Mycobacterium leprae
uggcgacaguguu

SEQ ID NO: 1227984 - RNA, 23 nt, Mycobacterium leprae
uggcgcgucuuacuguacgguug

SEQ ID NO: 1227985 - RNA, 17 nt, Mycobacterium leprae
uggcgcuccaauuugga

SEQ ID NO: 1227986 - RNA, 11 nt, Mycobacterium leprae
uggcgccgagu

SEQ ID NO: 1227987 - RNA, 18 nt, Mycobacterium leprae
uggcgauuuucuugccgu

SEQ ID NO: 1227988 - RNA, 18 nt, Mycobacterium leprae
ugggucuggaagcgcuga

SEQ ID NO: 1227989 - RNA, 20 nt, Mycobacterium leprae
ugggucgaucgcuggucagu

SEQ ID NO: 1227990 - RNA, 14 nt, Mycobacterium leprae
ugggucaccacuga

SEQ ID NO: 1227991 - RNA, 15 nt, Mycobacterium leprae
uggguaaaaccgguu

SEQ ID NO: 1227992 - RNA, 17 nt, Mycobacterium leprae
uggggaaugucgauggc

SEQ ID NO: 1227993 - RNA, 20 nt, Mycobacterium leprae
uggggaaaaguucaccggca

SEQ ID NO: 1227994 - RNA, 20 nt, Mycobacterium leprae
ugggccgguguacacgugcu

SEQ ID NO: 1227995 - RNA, 15 nt, Mycobacterium leprae
ugggcaacaccagcg

SEQ ID NO: 1227996 - RNA, 21 nt, Mycobacterium leprae
ugggcacaaugggugugacac

SEQ ID NO: 1227997 - RNA, 18 nt, Mycobacterium leprae
uggcugucgggcaccugg

SEQ ID NO: 1227998 - RNA, 18 nt, Mycobacterium leprae
ugcuauccaauucgccga

SEQ ID NO: 1227999 - RNA, 23 nt, Mycobacterium leprae
ugcuaucgcccaggugcuggcug

SEQ ID NO: 1228000 - RNA, 14 nt, Mycobacterium leprae
ugcuagcggcgcca

SEQ ID NO: 1228001 - RNA, 18 nt, Mycobacterium leprae
ugcuaccaguguccgucg

SEQ ID NO: 1228002 - RNA, 20 nt, Mycobacterium leprae
ugcuacccacuggugguggc

SEQ ID NO: 1228003 - RNA, 14 nt, Mycobacterium leprae
ugcucaggucgacg

SEQ ID NO: 1228004 - RNA, 14 nt, Mycobacterium leprae
ugcucauggcaccg

SEQ ID NO: 1228005 - RNA, 18 nt, Mycobacterium leprae
ugcguaaccgccaucggu

SEQ ID NO: 1228006 - RNA, 22 nt, Mycobacterium leprae
ugcguaccggaauguccaccag

SEQ ID NO: 1228007 - RNA, 15 nt, Mycobacterium leprae
ugcguaauggccggc

SEQ ID NO: 1228008 - RNA, 18 nt, Mycobacterium leprae
ugcguuaacgcgucgggg

SEQ ID NO: 1228009 - RNA, 21 nt, Mycobacterium leprae
ugcgugccccggccgccgucc

SEQ ID NO: 1228010 - RNA, 21 nt, Mycobacterium leprae
ugcugccacauguuuccggca

SEQ ID NO: 1228011 - RNA, 21 nt, Mycobacterium leprae
ugcugccgcguucguugcuga

SEQ ID NO: 1228012 - RNA, 15 nt, Mycobacterium leprae
ugcugcugcuggugg

SEQ ID NO: 1228013 - RNA, 20 nt, Mycobacterium leprae
ugcucguauaguaccgcuga

SEQ ID NO: 1228014 - RNA, 16 nt, Mycobacterium leprae
ugcucguagcggcggc

SEQ ID NO: 1228015 - RNA, 15 nt, Mycobacterium leprae
ugcugacaucggcua

SEQ ID NO: 1228016 - RNA, 20 nt, Mycobacterium leprae
ugcugacagacauggcugua

SEQ ID NO: 1228017 - RNA, 19 nt, Mycobacterium leprae
ugcugaggguggcgccggc

SEQ ID NO: 1228018 - RNA, 14 nt, Mycobacterium leprae
ugcugagucggcgc

SEQ ID NO: 1228019 - RNA, 13 nt, Mycobacterium leprae
ugcugacgccggg

SEQ ID NO: 1228020 - RNA, 14 nt, Mycobacterium leprae
ugcugacgccgggc

SEQ ID NO: 1228021 - RNA, 21 nt, Mycobacterium leprae
ugcuguucggugucguuacgu

SEQ ID NO: 1228022 - RNA, 15 nt, Mycobacterium leprae
ugcuguguugcgggg

SEQ ID NO: 1228023 - RNA, 19 nt, Mycobacterium leprae
ugcuugggcgcuucaccga

SEQ ID NO: 1228024 - RNA, 13 nt, Mycobacterium leprae
ugcuggcaagcuc

SEQ ID NO: 1228025 - RNA, 13 nt, Mycobacterium leprae
ugcuggccguguu

SEQ ID NO: 1228026 - RNA, 18 nt, Mycobacterium leprae
ugcgauauauaccuacga

SEQ ID NO: 1228027 - RNA, 14 nt, Mycobacterium leprae
ugcgcaccggcuga

SEQ ID NO: 1228028 - RNA, 20 nt, Mycobacterium leprae
ugcgcaccggcugaggcggc

SEQ ID NO: 1228029 - RNA, 15 nt, Mycobacterium leprae
ugcgagucucaccca

SEQ ID NO: 1228030 - RNA, 15 nt, Mycobacterium leprae
ugcgcagccgcggua

SEQ ID NO: 1228031 - RNA, 22 nt, Mycobacterium leprae
ugccuuguguucggcaagccaa

SEQ ID NO: 1228032 - RNA, 21 nt, Mycobacterium leprae
ugccguuccugagugugaugc

SEQ ID NO: 1228033 - RNA, 15 nt, Mycobacterium leprae
ugccgcggcugcgcu

SEQ ID NO: 1228034 - RNA, 17 nt, Mycobacterium leprae
ugccgcgggugcaguug

SEQ ID NO: 1228035 - RNA, 16 nt, Mycobacterium leprae
ugccgugguagucagc

SEQ ID NO: 1228036 - RNA, 21 nt, Mycobacterium leprae
ugcggacggacacuguccacu

SEQ ID NO: 1228037 - RNA, 16 nt, Mycobacterium leprae
ugcgcgccgcccagca

SEQ ID NO: 1228038 - RNA, 16 nt, Mycobacterium leprae
ugccgccgaucgguau

SEQ ID NO: 1228039 - RNA, 12 nt, Mycobacterium leprae
ugccaugccagu

SEQ ID NO: 1228040 - RNA, 18 nt, Mycobacterium leprae
ugccaucgaacggcgggg

SEQ ID NO: 1228041 - RNA, 16 nt, Mycobacterium leprae
ugccauccggugcuga

SEQ ID NO: 1228042 - RNA, 16 nt, Mycobacterium leprae
ugccauccaccgccga

SEQ ID NO: 1228043 - RNA, 19 nt, Mycobacterium leprae
ugcagauugcgugaccgcg

SEQ ID NO: 1228044 - RNA, 17 nt, Mycobacterium leprae
ugcagcggcaguccgcg

SEQ ID NO: 1228045 - RNA, 19 nt, Mycobacterium leprae
ugcagcggcaguccgcguc

SEQ ID NO: 1228046 - RNA, 18 nt, Mycobacterium leprae
ugcagcuggccgcacguu

SEQ ID NO: 1228047 - RNA, 20 nt, Mycobacterium leprae
ugcagcucguccaucgcguc

SEQ ID NO: 1228048 - RNA, 17 nt, Mycobacterium leprae
ugcagcugccaaccggu

SEQ ID NO: 1228049 - RNA, 21 nt, Mycobacterium leprae
ugcauugcaauccgccgaucc

SEQ ID NO: 1228050 - RNA, 16 nt, Mycobacterium leprae
ugccaaucagcacucg

SEQ ID NO: 1228051 - RNA, 19 nt, Mycobacterium leprae
ugccacugaacguggcacc

SEQ ID NO: 1228052 - RNA, 23 nt, Mycobacterium leprae
ugccacugacgaggugucggcga

SEQ ID NO: 1228053 - RNA, 14 nt, Mycobacterium leprae
ugccacugucgcga

SEQ ID NO: 1228054 - RNA, 17 nt, Mycobacterium leprae
ugccagugaucgccgau

SEQ ID NO: 1228055 - RNA, 15 nt, Mycobacterium leprae
ugauagcgaccaucg

SEQ ID NO: 1228056 - RNA, 17 nt, Mycobacterium leprae
ugauagcgaccaucgaa

SEQ ID NO: 1228057 - RNA, 17 nt, Mycobacterium leprae
ugagugaucugcucggc

SEQ ID NO: 1228058 - RNA, 17 nt, Mycobacterium leprae
ugagcgacagcucagcg

SEQ ID NO: 1228059 - RNA, 15 nt, Mycobacterium leprae
ugagaugucuucgac

SEQ ID NO: 1228060 - RNA, 18 nt, Mycobacterium leprae
ugagacaucgccaccgac

SEQ ID NO: 1228061 - RNA, 18 nt, Mycobacterium leprae
ugagagugccaccgcuga

SEQ ID NO: 1228062 - RNA, 14 nt, Mycobacterium leprae
ugcacauugggauc

SEQ ID NO: 1228063 - RNA, 23 nt, Mycobacterium leprae
ugcaccagcucacccgcagcacc

SEQ ID NO: 1228064 - RNA, 13 nt, Mycobacterium leprae
ugcagaucaccaa

SEQ ID NO: 1228065 - RNA, 16 nt, Mycobacterium leprae
ugcacggggucagcgg

SEQ ID NO: 1228066 - RNA, 16 nt, Mycobacterium leprae
ugaucacccgcgguag

SEQ ID NO: 1228067 - RNA, 19 nt, Mycobacterium leprae
ugaucaacuugucgggcau

SEQ ID NO: 1228068 - RNA, 13 nt, Mycobacterium leprae
ugaugacccguag

SEQ ID NO: 1228069 - RNA, 15 nt, Mycobacterium leprae
ugaugguuuggcugc

SEQ ID NO: 1228070 - RNA, 16 nt, Mycobacterium leprae
ugaugucuuggcugac

SEQ ID NO: 1228071 - RNA, 22 nt, Mycobacterium leprae
ugaugccgugguagucagcaca

SEQ ID NO: 1228072 - RNA, 22 nt, Mycobacterium leprae
ugauggcauccaacacgccgau

SEQ ID NO: 1228073 - RNA, 14 nt, Mycobacterium leprae
ucuuggugaugucg

SEQ ID NO: 1228074 - RNA, 21 nt, Mycobacterium leprae
ucuugugcguagucgaccgga

SEQ ID NO: 1228075 - RNA, 13 nt, Mycobacterium leprae
ucuugccaagguc

SEQ ID NO: 1228076 - RNA, 21 nt, Mycobacterium leprae
ucuugcagcgaggccguggcc

SEQ ID NO: 1228077 - RNA, 19 nt, Mycobacterium leprae
ucuucgacaccgagcagcc

SEQ ID NO: 1228078 - RNA, 14 nt, Mycobacterium leprae
ucuucaauccgcgc

SEQ ID NO: 1228079 - RNA, 18 nt, Mycobacterium leprae
ucuguccagaaggggcug

SEQ ID NO: 1228080 - RNA, 21 nt, Mycobacterium leprae
ucuggugcgccaacacuagcg

SEQ ID NO: 1228081 - RNA, 15 nt, Mycobacterium leprae
ucuggcgacucggcg

SEQ ID NO: 1228082 - RNA, 17 nt, Mycobacterium leprae
ucucuucgugcagcacu

SEQ ID NO: 1228083 - RNA, 20 nt, Mycobacterium leprae
ucugaugacgcgacgccggc

SEQ ID NO: 1228084 - RNA, 17 nt, Mycobacterium leprae
ucugcgcgcacccaagc

SEQ ID NO: 1228085 - RNA, 21 nt, Mycobacterium leprae
ucguugccguaguacccggcc

SEQ ID NO: 1228086 - RNA, 20 nt, Mycobacterium leprae
ucuacccuuuuugucacuga

SEQ ID NO: 1228087 - RNA, 15 nt, Mycobacterium leprae
ucguugaaaacgguu

SEQ ID NO: 1228088 - RNA, 17 nt, Mycobacterium leprae
ucgugguccacggcuga

SEQ ID NO: 1228089 - RNA, 13 nt, Mycobacterium leprae
ucguguggaucaa

SEQ ID NO: 1228090 - RNA, 22 nt, Mycobacterium leprae
ucguguagcuagaccgaaucgu

SEQ ID NO: 1228091 - RNA, 17 nt, Mycobacterium leprae
ucgucgggugcgcagca

SEQ ID NO: 1228092 - RNA, 15 nt, Mycobacterium leprae
ucucacguccgauaa

SEQ ID NO: 1228093 - RNA, 14 nt, Mycobacterium leprae
ucucaaugaccgca

SEQ ID NO: 1228094 - RNA, 18 nt, Mycobacterium leprae
ucucgcgccaccgccggu

SEQ ID NO: 1228095 - RNA, 22 nt, Mycobacterium leprae
ucucgcuugguugcggguacga

SEQ ID NO: 1228096 - RNA, 21 nt, Mycobacterium leprae
ucguaacgcugauugccaacu

SEQ ID NO: 1228097 - RNA, 21 nt, Mycobacterium leprae
ucgguggugggugcugcuugg

SEQ ID NO: 1228098 - RNA, 20 nt, Mycobacterium leprae
ucgucgauaaugccgguggc

SEQ ID NO: 1228099 - RNA, 13 nt, Mycobacterium leprae
ucggugccgccau

SEQ ID NO: 1228100 - RNA, 17 nt, Mycobacterium leprae
ucggucugcucggcgaa

SEQ ID NO: 1228101 - RNA, 20 nt, Mycobacterium leprae
ucggcguggucaauguggcc

SEQ ID NO: 1228102 - RNA, 22 nt, Mycobacterium leprae
ucggcuacugcgacagcagcca

SEQ ID NO: 1228103 - RNA, 16 nt, Mycobacterium leprae
ucggguaccggcaaac

SEQ ID NO: 1228104 - RNA, 17 nt, Mycobacterium leprae
ucggguagacgaugauc

SEQ ID NO: 1228105 - RNA, 20 nt, Mycobacterium leprae
ucggucaccccgagcucggc

SEQ ID NO: 1228106 - RNA, 20 nt, Mycobacterium leprae
ucgcuggcucugucgucgaa

SEQ ID NO: 1228107 - RNA, 14 nt, Mycobacterium leprae
ucgcugaccggugc

SEQ ID NO: 1228108 - RNA, 19 nt, Mycobacterium leprae
ucgcguagugauggcggaa

SEQ ID NO: 1228109 - RNA, 23 nt, Mycobacterium leprae
ucgcgucgagaaguuaccgacgc

SEQ ID NO: 1228110 - RNA, 18 nt, Mycobacterium leprae
ucgcgucgcaucgguggc

SEQ ID NO: 1228111 - RNA, 16 nt, Mycobacterium leprae
ucgcgucguugcgcug

SEQ ID NO: 1228112 - RNA, 19 nt, Mycobacterium leprae
ucgcgugcuaugaccucgc

SEQ ID NO: 1228113 - RNA, 12 nt, Mycobacterium leprae
ucgcuguauuga

SEQ ID NO: 1228114 - RNA, 20 nt, Mycobacterium leprae
ucgcugugugcgcgccgacc

SEQ ID NO: 1228115 - RNA, 16 nt, Mycobacterium leprae
ucggauggcagucgau

SEQ ID NO: 1228116 - RNA, 22 nt, Mycobacterium leprae
ucggcacagugccugaccaucg

SEQ ID NO: 1228117 - RNA, 22 nt, Mycobacterium leprae
ucggcggcggagcgcaccgcgg

SEQ ID NO: 1228118 - RNA, 19 nt, Mycobacterium leprae
ucggcgcuggggcgcuggc

SEQ ID NO: 1228119 - RNA, 21 nt, Mycobacterium leprae
ucggccguggcuuccucgaca

SEQ ID NO: 1228120 - RNA, 14 nt, Mycobacterium leprae
ucggccaggugugc

SEQ ID NO: 1228121 - RNA, 19 nt, Mycobacterium leprae
ucgcccaacguaucggcga

SEQ ID NO: 1228122 - RNA, 15 nt, Mycobacterium leprae
ucgcccagcagguug

SEQ ID NO: 1228123 - RNA, 13 nt, Mycobacterium leprae
ucgcccaggugcu

SEQ ID NO: 1228124 - RNA, 17 nt, Mycobacterium leprae
ucgcgccaccgccgguc

SEQ ID NO: 1228125 - RNA, 22 nt, Mycobacterium leprae
ucgcgcagcaaucaaugugcgg

SEQ ID NO: 1228126 - RNA, 20 nt, Mycobacterium leprae
ucgcgauccaucagcaccga

SEQ ID NO: 1228127 - RNA, 19 nt, Mycobacterium leprae
ucgcgguaggaguuuuuca

SEQ ID NO: 1228128 - RNA, 23 nt, Mycobacterium leprae
ucgcgggcaagcccugcccggcc

SEQ ID NO: 1228129 - RNA, 20 nt, Mycobacterium leprae
uccuguucuacauccaccca

SEQ ID NO: 1228130 - RNA, 15 nt, Mycobacterium leprae
uccuucuaugacaac

SEQ ID NO: 1228131 - RNA, 17 nt, Mycobacterium leprae
uccuggcuggccaucgc

SEQ ID NO: 1228132 - RNA, 15 nt, Mycobacterium leprae
uccuuuucgccggcg

SEQ ID NO: 1228133 - RNA, 16 nt, Mycobacterium leprae
uccucgugacaucgac

SEQ ID NO: 1228134 - RNA, 17 nt, Mycobacterium leprae
uccucgacuuccggccc

SEQ ID NO: 1228135 - RNA, 21 nt, Mycobacterium leprae
uccugagugugaugccgaagc

SEQ ID NO: 1228136 - RNA, 12 nt, Mycobacterium leprae
ucgacaaggucg

SEQ ID NO: 1228137 - RNA, 18 nt, Mycobacterium leprae
ucgaaucagcaucgacag

SEQ ID NO: 1228138 - RNA, 13 nt, Mycobacterium leprae
ucgacaucaccgg

SEQ ID NO: 1228139 - RNA, 17 nt, Mycobacterium leprae
ucgaccucgaauccgcc

SEQ ID NO: 1228140 - RNA, 22 nt, Mycobacterium leprae
ucgaccgcuggggucgcggacc

SEQ ID NO: 1228141 - RNA, 22 nt, Mycobacterium leprae
ucgacgagacacugacguuggc

SEQ ID NO: 1228142 - RNA, 17 nt, Mycobacterium leprae
ucgacgaggucgccgcc

SEQ ID NO: 1228143 - RNA, 15 nt, Mycobacterium leprae
uccggaaauacggca

SEQ ID NO: 1228144 - RNA, 14 nt, Mycobacterium leprae
uccggcuucuccag

SEQ ID NO: 1228145 - RNA, 15 nt, Mycobacterium leprae
uccguugccaucggu

SEQ ID NO: 1228146 - RNA, 19 nt, Mycobacterium leprae
uccguugucccgcccggcc

SEQ ID NO: 1228147 - RNA, 19 nt, Mycobacterium leprae
uccguggcgagacacccgg

SEQ ID NO: 1228148 - RNA, 22 nt, Mycobacterium leprae
uccuacagcaguguucaggcca

SEQ ID NO: 1228149 - RNA, 14 nt, Mycobacterium leprae
uccucacacucacg

SEQ ID NO: 1228150 - RNA, 13 nt, Mycobacterium leprae
uccucgacccacc

SEQ ID NO: 1228151 - RNA, 17 nt, Mycobacterium leprae
uccucgaccaccagggc

SEQ ID NO: 1228152 - RNA, 18 nt, Mycobacterium leprae
uccuccggggaccauugc

SEQ ID NO: 1228153 - RNA, 15 nt, Mycobacterium leprae
uccguccagcuggcc

SEQ ID NO: 1228154 - RNA, 20 nt, Mycobacterium leprae
uccgucggacugucaaccau

SEQ ID NO: 1228155 - RNA, 13 nt, Mycobacterium leprae
uccgguugcgugg

SEQ ID NO: 1228156 - RNA, 18 nt, Mycobacterium leprae
uccauuucaaagcugccg

SEQ ID NO: 1228157 - RNA, 18 nt, Mycobacterium leprae
uccaugccacugucgcga

SEQ ID NO: 1228158 - RNA, 22 nt, Mycobacterium leprae
uccgccgaucccgaaagugccg

SEQ ID NO: 1228159 - RNA, 13 nt, Mycobacterium leprae
uccgccgacgaug

SEQ ID NO: 1228160 - RNA, 20 nt, Mycobacterium leprae
uccgcaggacaaagucagcu

SEQ ID NO: 1228161 - RNA, 22 nt, Mycobacterium leprae
uccgacggcuggcugcugcaga

SEQ ID NO: 1228162 - RNA, 18 nt, Mycobacterium leprae
uccgcaagcgcgccgagu

SEQ ID NO: 1228163 - RNA, 15 nt, Mycobacterium leprae
uccgaacggggcggc

SEQ ID NO: 1228164 - RNA, 17 nt, Mycobacterium leprae
ucccugacuguuuccgc

SEQ ID NO: 1228165 - RNA, 14 nt, Mycobacterium leprae
uccauccguggcga

SEQ ID NO: 1228166 - RNA, 22 nt, Mycobacterium leprae
uccaccacacgucgagccuguc

SEQ ID NO: 1228167 - RNA, 17 nt, Mycobacterium leprae
uccacuugacggucgag

SEQ ID NO: 1228168 - RNA, 17 nt, Mycobacterium leprae
uccacugucgcccgacg

SEQ ID NO: 1228169 - RNA, 22 nt, Mycobacterium leprae
uccacugucgcccgacggcguc

SEQ ID NO: 1228170 - RNA, 16 nt, Mycobacterium leprae
uccacugcagggcgag

SEQ ID NO: 1228171 - RNA, 22 nt, Mycobacterium leprae
uccacugcagggcgagcugcgc

SEQ ID NO: 1228172 - RNA, 11 nt, Mycobacterium leprae
ucagugcggaa

SEQ ID NO: 1228173 - RNA, 21 nt, Mycobacterium leprae
ucagugcgugaucgacaucgu

SEQ ID NO: 1228174 - RNA, 15 nt, Mycobacterium leprae
ucagguccaacgcgg

SEQ ID NO: 1228175 - RNA, 23 nt, Mycobacterium leprae
ucagguccaacgcggcggcggcc

SEQ ID NO: 1228176 - RNA, 15 nt, Mycobacterium leprae
ucagugucagcagca

SEQ ID NO: 1228177 - RNA, 17 nt, Mycobacterium leprae
ucaguucgugcgcgcau

SEQ ID NO: 1228178 - RNA, 19 nt, Mycobacterium leprae
ucaugaucgcaggcaccac

SEQ ID NO: 1228179 - RNA, 22 nt, Mycobacterium leprae
ucaugacgggccgcguuugaga

SEQ ID NO: 1228180 - RNA, 14 nt, Mycobacterium leprae
ucaccggcgguguc

SEQ ID NO: 1228181 - RNA, 17 nt, Mycobacterium leprae
ucaccgaccuucgcgau

SEQ ID NO: 1228182 - RNA, 13 nt, Mycobacterium leprae
ucaccgcagccgg

SEQ ID NO: 1228183 - RNA, 18 nt, Mycobacterium leprae
ucacuuccggcuucucca

SEQ ID NO: 1228184 - RNA, 17 nt, Mycobacterium leprae
ucacugaucccagaauu

SEQ ID NO: 1228185 - RNA, 21 nt, Mycobacterium leprae
ucagcaacacuggcgaccgca

SEQ ID NO: 1228186 - RNA, 17 nt, Mycobacterium leprae
ucacgcuggccgccggg

SEQ ID NO: 1228187 - RNA, 17 nt, Mycobacterium leprae
ucacgucgacggcggcc

SEQ ID NO: 1228188 - RNA, 18 nt, Mycobacterium leprae
ucagcgucggacgccgga

SEQ ID NO: 1228189 - RNA, 19 nt, Mycobacterium leprae
ucagcgucggacgccggac

SEQ ID NO: 1228190 - RNA, 20 nt, Mycobacterium leprae
ucaggacgaacgcuggcggc

SEQ ID NO: 1228191 - RNA, 17 nt, Mycobacterium leprae
ucagcggcauuucgcag

SEQ ID NO: 1228192 - RNA, 21 nt, Mycobacterium leprae
uauaacgcgaugcgcaccucg

SEQ ID NO: 1228193 - RNA, 20 nt, Mycobacterium leprae
uauagaugccaguuuuggug

SEQ ID NO: 1228194 - RNA, 19 nt, Mycobacterium leprae
uaguguacagaccgucgaa

SEQ ID NO: 1228195 - RNA, 11 nt, Mycobacterium leprae
uaguguuccgg

SEQ ID NO: 1228196 - RNA, 17 nt, Mycobacterium leprae
uagucugcacgucggcc

SEQ ID NO: 1228197 - RNA, 17 nt, Mycobacterium leprae
uaguccgaccgcaucga

SEQ ID NO: 1228198 - RNA, 22 nt, Mycobacterium leprae
uaguccucugcgguaucgccga

SEQ ID NO: 1228199 - RNA, 17 nt, Mycobacterium leprae
uagguugauguauccag

SEQ ID NO: 1228200 - RNA, 16 nt, Mycobacterium leprae
uaggucaguucucgcc

SEQ ID NO: 1228201 - RNA, 19 nt, Mycobacterium leprae
uauggcuccaaguggcugc

SEQ ID NO: 1228202 - RNA, 20 nt, Mycobacterium leprae
uaugagcaaaaauccgcugc

SEQ ID NO: 1228203 - RNA, 18 nt, Mycobacterium leprae
uaugacccaauccaagac

SEQ ID NO: 1228204 - RNA, 16 nt, Mycobacterium leprae
uauuaaucuggcuggg

SEQ ID NO: 1228205 - RNA, 16 nt, Mycobacterium leprae
uauucgcuacgcccga

SEQ ID NO: 1228206 - RNA, 13 nt, Mycobacterium leprae
uauugcugugucg

SEQ ID NO: 1228207 - RNA, 19 nt, Mycobacterium leprae
uaucaaucacgcccagcgc

SEQ ID NO: 1228208 - RNA, 12 nt, Mycobacterium leprae
uaucaucgccaa

SEQ ID NO: 1228209 - RNA, 17 nt, Mycobacterium leprae
uaucggcgagaugcgcu

SEQ ID NO: 1228210 - RNA, 19 nt, Mycobacterium leprae
uaucggcgauagcgcagac

SEQ ID NO: 1228211 - RNA, 19 nt, Mycobacterium leprae
uagauugacaccgccggcg

SEQ ID NO: 1228212 - RNA, 15 nt, Mycobacterium leprae
uagaucaacagcgca

SEQ ID NO: 1228213 - RNA, 21 nt, Mycobacterium leprae
uagaucuguaggcacaagccg

SEQ ID NO: 1228214 - RNA, 19 nt, Mycobacterium leprae
uagaucuugcagcuggcgg

SEQ ID NO: 1228215 - RNA, 12 nt, Mycobacterium leprae
uagccucggcgc

SEQ ID NO: 1228216 - RNA, 15 nt, Mycobacterium leprae
uagcuagaccgaauc

SEQ ID NO: 1228217 - RNA, 15 nt, Mycobacterium leprae
uagcgguuuccggca

SEQ ID NO: 1228218 - RNA, 23 nt, Mycobacterium leprae
uagcgccgggguguggcacguug

SEQ ID NO: 1228219 - RNA, 15 nt, Mycobacterium leprae
uaggcgugagccggu

SEQ ID NO: 1228220 - RNA, 22 nt, Mycobacterium leprae
uacugaccggcuaccggcccga

SEQ ID NO: 1228221 - RNA, 16 nt, Mycobacterium leprae
uacgucgaggaccgcc

SEQ ID NO: 1228222 - RNA, 17 nt, Mycobacterium leprae
uacgucgaggaccgcca

SEQ ID NO: 1228223 - RNA, 22 nt, Mycobacterium leprae
uacguccgcgccggcgucggcc

SEQ ID NO: 1228224 - RNA, 22 nt, Mycobacterium leprae
uacggcggcgauccucaaccag

SEQ ID NO: 1228225 - RNA, 20 nt, Mycobacterium leprae
uacggagccaguggcguggc

SEQ ID NO: 1228226 - RNA, 21 nt, Mycobacterium leprae
uacgacgacucaguggcgggc

SEQ ID NO: 1228227 - RNA, 14 nt, Mycobacterium leprae
uacgacgucgccga

SEQ ID NO: 1228228 - RNA, 21 nt, Mycobacterium leprae
uaaaaccgguuugauccagcc

SEQ ID NO: 1228229 - RNA, 12 nt, Mycobacterium leprae
uaacaccgugcc

SEQ ID NO: 1228230 - RNA, 13 nt, Mycobacterium leprae
uaacggcgguggc

SEQ ID NO: 1228231 - RNA, 16 nt, Mycobacterium leprae
uaacgugcagcuggcc

SEQ ID NO: 1228232 - RNA, 20 nt, Mycobacterium leprae
uaaccgggaaauacggcacg

SEQ ID NO: 1228233 - RNA, 17 nt, Mycobacterium leprae
uaaugccgguggccagc

SEQ ID NO: 1228234 - RNA, 17 nt, Mycobacterium leprae
uacaacgggaucgacaa

SEQ ID NO: 1228235 - RNA, 18 nt, Mycobacterium leprae
uacagcgugaaccaaagc

SEQ ID NO: 1228236 - RNA, 14 nt, Mycobacterium leprae
guuuugucgguggu

SEQ ID NO: 1228237 - RNA, 19 nt, Mycobacterium leprae
guuugucagauaacgggug

SEQ ID NO: 1228238 - RNA, 17 nt, Mycobacterium leprae
guuugugucuguggcgg

SEQ ID NO: 1228239 - RNA, 17 nt, Mycobacterium leprae
guuucguggcaagcgcg

SEQ ID NO: 1228240 - RNA, 11 nt, Mycobacterium leprae
guuuaccgcau

SEQ ID NO: 1228241 - RNA, 14 nt, Mycobacterium leprae
guuucccagagcuc

SEQ ID NO: 1228242 - RNA, 14 nt, Mycobacterium leprae
guuggugucaacag

SEQ ID NO: 1228243 - RNA, 19 nt, Mycobacterium leprae
guuggcccaccgccggacg

SEQ ID NO: 1228244 - RNA, 14 nt, Mycobacterium leprae
guugucccgcccgg

SEQ ID NO: 1228245 - RNA, 21 nt, Mycobacterium leprae
guugguuucauaggugguggg

SEQ ID NO: 1228246 - RNA, 19 nt, Mycobacterium leprae
guugcuuuggggguugcac

SEQ ID NO: 1228247 - RNA, 16 nt, Mycobacterium leprae
guggucuccaagguua

SEQ ID NO: 1228248 - RNA, 20 nt, Mycobacterium leprae
guggucuugauucucgagcg

SEQ ID NO: 1228249 - RNA, 21 nt, Mycobacterium leprae
guggucuugauucucgagcga

SEQ ID NO: 1228250 - RNA, 13 nt, Mycobacterium leprae
guucugccaugcc

SEQ ID NO: 1228251 - RNA, 20 nt, Mycobacterium leprae
guugacuuuaacgacaucgc

SEQ ID NO: 1228252 - RNA, 14 nt, Mycobacterium leprae
guugacugggaaca

SEQ ID NO: 1228253 - RNA, 14 nt, Mycobacterium leprae
gguucgccgccggc

SEQ ID NO: 1228254 - RNA, 14 nt, Mycobacterium leprae
guaagcacugcacg

SEQ ID NO: 1228255 - RNA, 17 nt, Mycobacterium leprae
guaaagccgcgcccggc

SEQ ID NO: 1228256 - RNA, 16 nt, Mycobacterium leprae
gguuuccaugaugguu

SEQ ID NO: 1228257 - RNA, 19 nt, Mycobacterium leprae
ggugcuuuagcccgccgcg

SEQ ID NO: 1228258 - RNA, 21 nt, Mycobacterium leprae
ggugcggccacauugaccacg

SEQ ID NO: 1228259 - RNA, 16 nt, Mycobacterium leprae
ggugcggcgccgcccg

SEQ ID NO: 1228260 - RNA, 13 nt, Mycobacterium leprae
ggugguggaugcu

SEQ ID NO: 1228261 - RNA, 17 nt, Mycobacterium leprae
ggugguguggcccgacg

SEQ ID NO: 1228262 - RNA, 15 nt, Mycobacterium leprae
ggugguguuccccgu

SEQ ID NO: 1228263 - RNA, 22 nt, Mycobacterium leprae
ggugcccgggaaacuagcgggc

SEQ ID NO: 1228264 - RNA, 21 nt, Mycobacterium leprae
ggugccauuggugggaugagu

SEQ ID NO: 1228265 - RNA, 16 nt, Mycobacterium leprae
ggugccaggcagcugu

SEQ ID NO: 1228266 - RNA, 12 nt, Mycobacterium leprae
ggugccgcgucc

SEQ ID NO: 1228267 - RNA, 22 nt, Mycobacterium leprae
ggucucaaugaccgcaccgauc

SEQ ID NO: 1228268 - RNA, 15 nt, Mycobacterium leprae
ggucuccggacuacc

SEQ ID NO: 1228269 - RNA, 22 nt, Mycobacterium leprae
ggucucccaauccuggaugugu

SEQ ID NO: 1228270 - RNA, 16 nt, Mycobacterium leprae
ggucggcaucugcuac

SEQ ID NO: 1228271 - RNA, 16 nt, Mycobacterium leprae
ggugagcguugugggc

SEQ ID NO: 1228272 - RNA, 18 nt, Mycobacterium leprae
ggugaccgaacuguggau

SEQ ID NO: 1228273 - RNA, 16 nt, Mycobacterium leprae
ggucugcgguuugggc

SEQ ID NO: 1228274 - RNA, 21 nt, Mycobacterium leprae
ggugcauggaucaguuugccg

SEQ ID NO: 1228275 - RNA, 20 nt, Mycobacterium leprae
ggucaucggcgucgguggca

SEQ ID NO: 1228276 - RNA, 22 nt, Mycobacterium leprae
ggucagguccaacgcggcggcg

SEQ ID NO: 1228277 - RNA, 12 nt, Mycobacterium leprae
ggucauggcgag

SEQ ID NO: 1228278 - RNA, 22 nt, Mycobacterium leprae
gguccagccaacgggaacagcg

SEQ ID NO: 1228279 - RNA, 19 nt, Mycobacterium leprae
ggucccaucgcugaccggu

SEQ ID NO: 1228280 - RNA, 14 nt, Mycobacterium leprae
ggucgauggcuacc

SEQ ID NO: 1228281 - RNA, 21 nt, Mycobacterium leprae
ggucgauuugcaauccccagu

SEQ ID NO: 1228282 - RNA, 21 nt, Mycobacterium leprae
ggucgcacagcaggucgccga

SEQ ID NO: 1228283 - RNA, 14 nt, Mycobacterium leprae
ggucgccgaggcga

SEQ ID NO: 1228284 - RNA, 11 nt, Mycobacterium leprae
ggucgccgaug

SEQ ID NO: 1228285 - RNA, 15 nt, Mycobacterium leprae
gguccggaccuggac

SEQ ID NO: 1228286 - RNA, 16 nt, Mycobacterium leprae
gguccggaccuggacc

SEQ ID NO: 1228287 - RNA, 19 nt, Mycobacterium leprae
guacggcaaauccgaacag

SEQ ID NO: 1228288 - RNA, 17 nt, Mycobacterium leprae
guacgcguugauggccg

SEQ ID NO: 1228289 - RNA, 22 nt, Mycobacterium leprae
guagaccaugagcacacgcugc

SEQ ID NO: 1228290 - RNA, 12 nt, Mycobacterium leprae
guacugaccggc

SEQ ID NO: 1228291 - RNA, 14 nt, Mycobacterium leprae
guaggaguuuuuca

SEQ ID NO: 1228292 - RNA, 14 nt, Mycobacterium leprae
guagcucaauuggc

SEQ ID NO: 1228293 - RNA, 15 nt, Mycobacterium leprae
guagcuaaccacgcg

SEQ ID NO: 1228294 - RNA, 13 nt, Mycobacterium leprae
guagaugcaacug

SEQ ID NO: 1228295 - RNA, 13 nt, Mycobacterium leprae
guaggccugacgc

SEQ ID NO: 1228296 - RNA, 17 nt, Mycobacterium leprae
gucaccccgagcucggc

SEQ ID NO: 1228297 - RNA, 15 nt, Mycobacterium leprae
gucagccuagcagca

SEQ ID NO: 1228298 - RNA, 18 nt, Mycobacterium leprae
gucagccuagcagcaucg

SEQ ID NO: 1228299 - RNA, 12 nt, Mycobacterium leprae
gucagccgcggg

SEQ ID NO: 1228300 - RNA, 19 nt, Mycobacterium leprae
guauuggacccgaucgacg

SEQ ID NO: 1228301 - RNA, 18 nt, Mycobacterium leprae
guauuuuauuugcgucgu

SEQ ID NO: 1228302 - RNA, 14 nt, Mycobacterium leprae
gucaagaugaucgu

SEQ ID NO: 1228303 - RNA, 17 nt, Mycobacterium leprae
guagguugaugagggga

SEQ ID NO: 1228304 - RNA, 21 nt, Mycobacterium leprae
guagggucgagaucgccacuc

SEQ ID NO: 1228305 - RNA, 15 nt, Mycobacterium leprae
guccaccgccaggcu

SEQ ID NO: 1228306 - RNA, 12 nt, Mycobacterium leprae
guccacgucggu

SEQ ID NO: 1228307 - RNA, 22 nt, Mycobacterium leprae
gucccggugugcccucgcugcc

SEQ ID NO: 1228308 - RNA, 17 nt, Mycobacterium leprae
gucccggugcugccugc

SEQ ID NO: 1228309 - RNA, 18 nt, Mycobacterium leprae
guccgagaaucaggccgc

SEQ ID NO: 1228310 - RNA, 18 nt, Mycobacterium leprae
guccauuuucguggcgag

SEQ ID NO: 1228311 - RNA, 19 nt, Mycobacterium leprae
guccaugccacugucgcga

SEQ ID NO: 1228312 - RNA, 19 nt, Mycobacterium leprae
guccagcgguaacuggcuc

SEQ ID NO: 1228313 - RNA, 20 nt, Mycobacterium leprae
gucauuggaaaggggccaac

SEQ ID NO: 1228314 - RNA, 19 nt, Mycobacterium leprae
gucauuaucgagauuggcg

SEQ ID NO: 1228315 - RNA, 13 nt, Mycobacterium leprae
gucauuaacgcug

SEQ ID NO: 1228316 - RNA, 18 nt, Mycobacterium leprae
gucauggcuucgucaccc

SEQ ID NO: 1228317 - RNA, 13 nt, Mycobacterium leprae
gucaucggcgucg

SEQ ID NO: 1228318 - RNA, 13 nt, Mycobacterium leprae
gucaguggcgaca

SEQ ID NO: 1228319 - RNA, 19 nt, Mycobacterium leprae
gucaguggcgacacuacug

SEQ ID NO: 1228320 - RNA, 13 nt, Mycobacterium leprae
gucaguggcgacg

SEQ ID NO: 1228321 - RNA, 19 nt, Mycobacterium leprae
gucaucgacagaugcgauc

SEQ ID NO: 1228322 - RNA, 14 nt, Mycobacterium leprae
gucaguacgcuaga

SEQ ID NO: 1228323 - RNA, 21 nt, Mycobacterium leprae
gucagguggcuugaguuuuga

SEQ ID NO: 1228324 - RNA, 20 nt, Mycobacterium leprae
gugccguugcauucgacgga

SEQ ID NO: 1228325 - RNA, 13 nt, Mycobacterium leprae
gugccgcugacca

SEQ ID NO: 1228326 - RNA, 13 nt, Mycobacterium leprae
gugcgcauccucg

SEQ ID NO: 1228327 - RNA, 19 nt, Mycobacterium leprae
gugccuccggcguuuacug

SEQ ID NO: 1228328 - RNA, 20 nt, Mycobacterium leprae
gugcgacaucuuuucucaag

SEQ ID NO: 1228329 - RNA, 23 nt, Mycobacterium leprae
gugccuugcggcagggcguugcc

SEQ ID NO: 1228330 - RNA, 14 nt, Mycobacterium leprae
gugcuacacggccg

SEQ ID NO: 1228331 - RNA, 12 nt, Mycobacterium leprae
gugcucggucag

SEQ ID NO: 1228332 - RNA, 16 nt, Mycobacterium leprae
gugaugaucacccgcg

SEQ ID NO: 1228333 - RNA, 18 nt, Mycobacterium leprae
gugaugaacuucggaauc

SEQ ID NO: 1228334 - RNA, 17 nt, Mycobacterium leprae
gugaucgacggcuggca

SEQ ID NO: 1228335 - RNA, 18 nt, Mycobacterium leprae
gugagcucaccggcggcg

SEQ ID NO: 1228336 - RNA, 18 nt, Mycobacterium leprae
gugagccggucggcggcg

SEQ ID NO: 1228337 - RNA, 18 nt, Mycobacterium leprae
gugcauguucuguugugg

SEQ ID NO: 1228338 - RNA, 13 nt, Mycobacterium leprae
gugccagcucguc

SEQ ID NO: 1228339 - RNA, 21 nt, Mycobacterium leprae
gugcuuggcagcccuugcagc

SEQ ID NO: 1228340 - RNA, 15 nt, Mycobacterium leprae
gugcuuaacgccgcc

SEQ ID NO: 1228341 - RNA, 21 nt, Mycobacterium leprae
guggauccgaaugacaacggu

SEQ ID NO: 1228342 - RNA, 15 nt, Mycobacterium leprae
guggcacccacucgg

SEQ ID NO: 1228343 - RNA, 20 nt, Mycobacterium leprae
guggacgaaccggacagcac

SEQ ID NO: 1228344 - RNA, 17 nt, Mycobacterium leprae
guggccuagucgggcag

SEQ ID NO: 1228345 - RNA, 22 nt, Mycobacterium leprae
guggccuagucgggcagaucuu

SEQ ID NO: 1228346 - RNA, 20 nt, Mycobacterium leprae
guggcaucgucuggacucgg

SEQ ID NO: 1228347 - RNA, 19 nt, Mycobacterium leprae
guggccaagcuaucggucc

SEQ ID NO: 1228348 - RNA, 13 nt, Mycobacterium leprae
guggcagcugggu

SEQ ID NO: 1228349 - RNA, 12 nt, Mycobacterium leprae
guggcgaucggc

SEQ ID NO: 1228350 - RNA, 15 nt, Mycobacterium leprae
guggguuugaggcgc

SEQ ID NO: 1228351 - RNA, 23 nt, Mycobacterium leprae
guggguguuuugucggugguggg

SEQ ID NO: 1228352 - RNA, 21 nt, Mycobacterium leprae
guggucggcgaaggagcggug

SEQ ID NO: 1228353 - RNA, 22 nt, Mycobacterium leprae
gugguaucugcaccucuucgac

SEQ ID NO: 1228354 - RNA, 23 nt, Mycobacterium leprae
guggucgagacacagaucgagcg

SEQ ID NO: 1228355 - RNA, 16 nt, Mycobacterium leprae
gucuguuaucggugaa

SEQ ID NO: 1228356 - RNA, 17 nt, Mycobacterium leprae
gucuucgacgacuucga

SEQ ID NO: 1228357 - RNA, 21 nt, Mycobacterium leprae
gucugaaccaggggucggcgu

SEQ ID NO: 1228358 - RNA, 16 nt, Mycobacterium leprae
gucucugugcgacauc

SEQ ID NO: 1228359 - RNA, 17 nt, Mycobacterium leprae
gucucucaggccgucgu

SEQ ID NO: 1228360 - RNA, 18 nt, Mycobacterium leprae
gucuccguccagcuggcc

SEQ ID NO: 1228361 - RNA, 15 nt, Mycobacterium leprae
gucuaucccggcucc

SEQ ID NO: 1228362 - RNA, 22 nt, Mycobacterium leprae
gucguuggcaacguggccacac

SEQ ID NO: 1228363 - RNA, 13 nt, Mycobacterium leprae
gucggugguggau

SEQ ID NO: 1228364 - RNA, 13 nt, Mycobacterium leprae
gucgucgcugcuu

SEQ ID NO: 1228365 - RNA, 22 nt, Mycobacterium leprae
gucgugcacuaacgugcagcug

SEQ ID NO: 1228366 - RNA, 13 nt, Mycobacterium leprae
gucggccccccgg

SEQ ID NO: 1228367 - RNA, 14 nt, Mycobacterium leprae
gucgcuguuggugu

SEQ ID NO: 1228368 - RNA, 15 nt, Mycobacterium leprae
gucggauggcagucg

SEQ ID NO: 1228369 - RNA, 16 nt, Mycobacterium leprae
gucggaaccgcagcug

SEQ ID NO: 1228370 - RNA, 16 nt, Mycobacterium leprae
gucggccacucguagg

SEQ ID NO: 1228371 - RNA, 19 nt, Mycobacterium leprae
gucgcguuaacguucuacc

SEQ ID NO: 1228372 - RNA, 18 nt, Mycobacterium leprae
gucgcggaccgucgcgcg

SEQ ID NO: 1228373 - RNA, 16 nt, Mycobacterium leprae
gucgcggaauucaguu

SEQ ID NO: 1228374 - RNA, 20 nt, Mycobacterium leprae
gucgauucaccgaucgacaa

SEQ ID NO: 1228375 - RNA, 21 nt, Mycobacterium leprae
gucgcacccugccgccacagc

SEQ ID NO: 1228376 - RNA, 23 nt, Mycobacterium leprae
gucgaucggcagugguaaucgac

SEQ ID NO: 1228377 - RNA, 14 nt, Mycobacterium leprae
gucgaucgcagccg

SEQ ID NO: 1228378 - RNA, 13 nt, Mycobacterium leprae
guccgcaaccgau

SEQ ID NO: 1228379 - RNA, 20 nt, Mycobacterium leprae
guccgcacaaacuucgacga

SEQ ID NO: 1228380 - RNA, 13 nt, Mycobacterium leprae
gucgagcuucggu

SEQ ID NO: 1228381 - RNA, 15 nt, Mycobacterium leprae
gucgagccuguccgg

SEQ ID NO: 1228382 - RNA, 22 nt, Mycobacterium leprae
gggagugcuagcggcgccaggc

SEQ ID NO: 1228383 - RNA, 15 nt, Mycobacterium leprae
gggaguggcaucguc

SEQ ID NO: 1228384 - RNA, 19 nt, Mycobacterium leprae
gggaucuuuugaccagcac

SEQ ID NO: 1228385 - RNA, 22 nt, Mycobacterium leprae
ggcuuccucuccuagggugccu

SEQ ID NO: 1228386 - RNA, 20 nt, Mycobacterium leprae
ggcuguagugggacacucga

SEQ ID NO: 1228387 - RNA, 16 nt, Mycobacterium leprae
gggcaagcccggauac

SEQ ID NO: 1228388 - RNA, 22 nt, Mycobacterium leprae
gggcccagauccaucggacaag

SEQ ID NO: 1228389 - RNA, 18 nt, Mycobacterium leprae
gggccacuaauggcgucc

SEQ ID NO: 1228390 - RNA, 15 nt, Mycobacterium leprae
gggcgcccggucaag

SEQ ID NO: 1228391 - RNA, 21 nt, Mycobacterium leprae
gggcgaaaacauucaggaugc

SEQ ID NO: 1228392 - RNA, 18 nt, Mycobacterium leprae
gggucggaacgacacuga

SEQ ID NO: 1228393 - RNA, 20 nt, Mycobacterium leprae
gggucgauagccgugaccga

SEQ ID NO: 1228394 - RNA, 12 nt, Mycobacterium leprae
gggguggugaug

SEQ ID NO: 1228395 - RNA, 14 nt, Mycobacterium leprae
ggguacgugguggc

SEQ ID NO: 1228396 - RNA, 20 nt, Mycobacterium leprae
ggggaucgauguagcgcauc

SEQ ID NO: 1228397 - RNA, 12 nt, Mycobacterium leprae
ggggacgccggc

SEQ ID NO: 1228398 - RNA, 19 nt, Mycobacterium leprae
gggcucggccaggugugcc

SEQ ID NO: 1228399 - RNA, 14 nt, Mycobacterium leprae
gggcucgaccaacg

SEQ ID NO: 1228400 - RNA, 15 nt, Mycobacterium leprae
gggcuaugccgcgcg

SEQ ID NO: 1228401 - RNA, 16 nt, Mycobacterium leprae
gggcuaugccgcgcgu

SEQ ID NO: 1228402 - RNA, 11 nt, Mycobacterium leprae
ggcgucaccgu

SEQ ID NO: 1228403 - RNA, 17 nt, Mycobacterium leprae
ggcgucgacaucaccgg

SEQ ID NO: 1228404 - RNA, 13 nt, Mycobacterium leprae
ggcgggcuugacc

SEQ ID NO: 1228405 - RNA, 19 nt, Mycobacterium leprae
ggcgguucacauucgucga

SEQ ID NO: 1228406 - RNA, 14 nt, Mycobacterium leprae
ggcuacccgagagu

SEQ ID NO: 1228407 - RNA, 14 nt, Mycobacterium leprae
ggcucgcauccgca

SEQ ID NO: 1228408 - RNA, 15 nt, Mycobacterium leprae
ggcucgcauccgcaa

SEQ ID NO: 1228409 - RNA, 17 nt, Mycobacterium leprae
ggcguuauccacgccga

SEQ ID NO: 1228410 - RNA, 22 nt, Mycobacterium leprae
ggcuaaguccggccugcccgca

SEQ ID NO: 1228411 - RNA, 15 nt, Mycobacterium leprae
ggcuaauggcgggcu

SEQ ID NO: 1228412 - RNA, 14 nt, Mycobacterium leprae
ggcggccgccggcu

SEQ ID NO: 1228413 - RNA, 19 nt, Mycobacterium leprae
ggcggcauucccaaccgcg

SEQ ID NO: 1228414 - RNA, 19 nt, Mycobacterium leprae
ggcgcguuaggucuccugg

SEQ ID NO: 1228415 - RNA, 18 nt, Mycobacterium leprae
ggcgcgaucuuccaccau

SEQ ID NO: 1228416 - RNA, 14 nt, Mycobacterium leprae
ggcauucgucgagu

SEQ ID NO: 1228417 - RNA, 19 nt, Mycobacterium leprae
ggcaugucaauacccacga

SEQ ID NO: 1228418 - RNA, 18 nt, Mycobacterium leprae
ggccaauccagccgaggg

SEQ ID NO: 1228419 - RNA, 21 nt, Mycobacterium leprae
ggccacauugaccacgccgac

SEQ ID NO: 1228420 - RNA, 14 nt, Mycobacterium leprae
ggccacuucgcccg

SEQ ID NO: 1228421 - RNA, 13 nt, Mycobacterium leprae
ggccagacaccau

SEQ ID NO: 1228422 - RNA, 17 nt, Mycobacterium leprae
ggcagcgccaauuccuc

SEQ ID NO: 1228423 - RNA, 23 nt, Mycobacterium leprae
ggcagcuguauaacaaaucauag

SEQ ID NO: 1228424 - RNA, 20 nt, Mycobacterium leprae
ggcagcuaagaagcugcccu

SEQ ID NO: 1228425 - RNA, 17 nt, Mycobacterium leprae
ggcagcauccgccgacg

SEQ ID NO: 1228426 - RNA, 16 nt, Mycobacterium leprae
ggcagcauccgccgac

SEQ ID NO: 1228427 - RNA, 13 nt, Mycobacterium leprae
ggcagccaccauc

SEQ ID NO: 1228428 - RNA, 12 nt, Mycobacterium leprae
ggcagccgaggu

SEQ ID NO: 1228429 - RNA, 18 nt, Mycobacterium leprae
ggcagaguagucccgagc

SEQ ID NO: 1228430 - RNA, 22 nt, Mycobacterium leprae
ggauggggccacgucgugcugu

SEQ ID NO: 1228431 - RNA, 22 nt, Mycobacterium leprae
ggcccaaaccguugaagagcga

SEQ ID NO: 1228432 - RNA, 20 nt, Mycobacterium leprae
ggccauuggcaccguuggcg

SEQ ID NO: 1228433 - RNA, 21 nt, Mycobacterium leprae
ggccauuggcaccguuggcga

SEQ ID NO: 1228434 - RNA, 17 nt, Mycobacterium leprae
ggccagugucggugccg

SEQ ID NO: 1228435 - RNA, 22 nt, Mycobacterium leprae
ggccagggggcgucaaguccag

SEQ ID NO: 1228436 - RNA, 16 nt, Mycobacterium leprae
ggccagcgcacccauc

SEQ ID NO: 1228437 - RNA, 13 nt, Mycobacterium leprae
ggccgaggucgag

SEQ ID NO: 1228438 - RNA, 16 nt, Mycobacterium leprae
ggcgagcaucuggccg

SEQ ID NO: 1228439 - RNA, 15 nt, Mycobacterium leprae
ggcgacgucacgcug

SEQ ID NO: 1228440 - RNA, 16 nt, Mycobacterium leprae
ggcgauuuucuugccg

SEQ ID NO: 1228441 - RNA, 15 nt, Mycobacterium leprae
ggcgauugccaccac

SEQ ID NO: 1228442 - RNA, 20 nt, Mycobacterium leprae
ggccgugauuuucauuggca

SEQ ID NO: 1228443 - RNA, 15 nt, Mycobacterium leprae
ggccgucguugccga

SEQ ID NO: 1228444 - RNA, 17 nt, Mycobacterium leprae
ggccguggacgaacugg

SEQ ID NO: 1228445 - RNA, 15 nt, Mycobacterium leprae
ggccuagucgggcag

SEQ ID NO: 1228446 - RNA, 14 nt, Mycobacterium leprae
gcuugccgaagucc

SEQ ID NO: 1228447 - RNA, 21 nt, Mycobacterium leprae
gcuugcgaucaaacucgcuga

SEQ ID NO: 1228448 - RNA, 18 nt, Mycobacterium leprae
gcuugcugugaccaucau

SEQ ID NO: 1228449 - RNA, 16 nt, Mycobacterium leprae
gcuugcucuagccggg

SEQ ID NO: 1228450 - RNA, 18 nt, Mycobacterium leprae
gcuuggcgcauuggucgg

SEQ ID NO: 1228451 - RNA, 19 nt, Mycobacterium leprae
ggaacgauaugagcuccac

SEQ ID NO: 1228452 - RNA, 18 nt, Mycobacterium leprae
ggaacgacuugaccagcc

SEQ ID NO: 1228453 - RNA, 23 nt, Mycobacterium leprae
ggaacguccaucuuguuggccgg

SEQ ID NO: 1228454 - RNA, 13 nt, Mycobacterium leprae
ggaacucgugcgu

SEQ ID NO: 1228455 - RNA, 10 nt, Mycobacterium leprae
ggaccaccgu

SEQ ID NO: 1228456 - RNA, 19 nt, Mycobacterium leprae
ggacagauucccgcugagc

SEQ ID NO: 1228457 - RNA, 21 nt, Mycobacterium leprae
ggacacgauuagcgcggcgca

SEQ ID NO: 1228458 - RNA, 16 nt, Mycobacterium leprae
ggacacgagcggccuc

SEQ ID NO: 1228459 - RNA, 18 nt, Mycobacterium leprae
ggacacgagcggccucag

SEQ ID NO: 1228460 - RNA, 22 nt, Mycobacterium leprae
ggaccgucgcgcgugccaccag

SEQ ID NO: 1228461 - RNA, 13 nt, Mycobacterium leprae
ggagguggucaag

SEQ ID NO: 1228462 - RNA, 21 nt, Mycobacterium leprae
ggagagucgggcuuggccgga

SEQ ID NO: 1228463 - RNA, 13 nt, Mycobacterium leprae
ggaucagcgcugc

SEQ ID NO: 1228464 - RNA, 15 nt, Mycobacterium leprae
ggaucgagggaucca

SEQ ID NO: 1228465 - RNA, 21 nt, Mycobacterium leprae
ggaucggggauucaaucagac

SEQ ID NO: 1228466 - RNA, 20 nt, Mycobacterium leprae
gcucgguaaguugcuuaacg

SEQ ID NO: 1228467 - RNA, 15 nt, Mycobacterium leprae
gcucgggugguccgg

SEQ ID NO: 1228468 - RNA, 17 nt, Mycobacterium leprae
gcucgggugguccgggu

SEQ ID NO: 1228469 - RNA, 23 nt, Mycobacterium leprae
gcucuguucugguggggauacag

SEQ ID NO: 1228470 - RNA, 14 nt, Mycobacterium leprae
gcucugguggccac

SEQ ID NO: 1228471 - RNA, 16 nt, Mycobacterium leprae
gcucugguggccaccg

SEQ ID NO: 1228472 - RNA, 21 nt, Mycobacterium leprae
gcucugcugaucagacggcga

SEQ ID NO: 1228473 - RNA, 13 nt, Mycobacterium leprae
gcucguagcggcg

SEQ ID NO: 1228474 - RNA, 20 nt, Mycobacterium leprae
gcugaucgaauugaccgacg

SEQ ID NO: 1228475 - RNA, 17 nt, Mycobacterium leprae
gcugaggcagcagcucg

SEQ ID NO: 1228476 - RNA, 20 nt, Mycobacterium leprae
gcugcccgacgaggcgguga

SEQ ID NO: 1228477 - RNA, 22 nt, Mycobacterium leprae
gcugccgaaccuccaccacucg

SEQ ID NO: 1228478 - RNA, 22 nt, Mycobacterium leprae
gcugcccugcaacgcuucgugc

SEQ ID NO: 1228479 - RNA, 16 nt, Mycobacterium leprae
gcugcagaccggauac

SEQ ID NO: 1228480 - RNA, 22 nt, Mycobacterium leprae
gcugcacggcugcguuggcauc

SEQ ID NO: 1228481 - RNA, 16 nt, Mycobacterium leprae
gcugcaccggcucguc

SEQ ID NO: 1228482 - RNA, 18 nt, Mycobacterium leprae
gcugcauuacgacgacuc

SEQ ID NO: 1228483 - RNA, 22 nt, Mycobacterium leprae
gcugcauccgacaaagcagcau

SEQ ID NO: 1228484 - RNA, 16 nt, Mycobacterium leprae
gcugcggugacggucg

SEQ ID NO: 1228485 - RNA, 19 nt, Mycobacterium leprae
gcuggccuguucauggugu

SEQ ID NO: 1228486 - RNA, 17 nt, Mycobacterium leprae
gcuggugcuggcgucgu

SEQ ID NO: 1228487 - RNA, 22 nt, Mycobacterium leprae
gcugugauaacgcugaaccgcg

SEQ ID NO: 1228488 - RNA, 14 nt, Mycobacterium leprae
gcugucguggcugc

SEQ ID NO: 1228489 - RNA, 22 nt, Mycobacterium leprae
gcugucguugccguaguacccg

SEQ ID NO: 1228490 - RNA, 21 nt, Mycobacterium leprae
gcugucauccucacgaccguu

SEQ ID NO: 1228491 - RNA, 12 nt, Mycobacterium leprae
gcugucaguguc

SEQ ID NO: 1228492 - RNA, 14 nt, Mycobacterium leprae
gcuguaucguccuc

SEQ ID NO: 1228493 - RNA, 13 nt, Mycobacterium leprae
gcuagacagcucg

SEQ ID NO: 1228494 - RNA, 14 nt, Mycobacterium leprae
gcuagacccgaacc

SEQ ID NO: 1228495 - RNA, 14 nt, Mycobacterium leprae
gcuagcaucgacca

SEQ ID NO: 1228496 - RNA, 17 nt, Mycobacterium leprae
gcuacugcgacagcagc

SEQ ID NO: 1228497 - RNA, 22 nt, Mycobacterium leprae
gcuaccguacucauagcggcga

SEQ ID NO: 1228498 - RNA, 23 nt, Mycobacterium leprae
gcuacggcgguguuucucgccga

SEQ ID NO: 1228499 - RNA, 22 nt, Mycobacterium leprae
gcuacggcgguuacgcgcucgc

SEQ ID NO: 1228500 - RNA, 23 nt, Mycobacterium leprae
gcuaugguucuguuaugcgucgu

SEQ ID NO: 1228501 - RNA, 14 nt, Mycobacterium leprae
gcucaaucgcccgc

SEQ ID NO: 1228502 - RNA, 18 nt, Mycobacterium leprae
gcucaaugucacugcgac

SEQ ID NO: 1228503 - RNA, 17 nt, Mycobacterium leprae
gcucacagcaggcgagu

SEQ ID NO: 1228504 - RNA, 20 nt, Mycobacterium leprae
gcucacccgcgccgccugcu

SEQ ID NO: 1228505 - RNA, 14 nt, Mycobacterium leprae
gcucacccgcagca

SEQ ID NO: 1228506 - RNA, 14 nt, Mycobacterium leprae
gcuagucggccggc

SEQ ID NO: 1228507 - RNA, 15 nt, Mycobacterium leprae
gcuccaaguggcugc

SEQ ID NO: 1228508 - RNA, 20 nt, Mycobacterium leprae
gcucagugacguguuggucg

SEQ ID NO: 1228509 - RNA, 22 nt, Mycobacterium leprae
gcucaucucguugaaaacgguu

SEQ ID NO: 1228510 - RNA, 22 nt, Mycobacterium leprae
gcucauuuucgagcaacgcggu

SEQ ID NO: 1228511 - RNA, 13 nt, Mycobacterium leprae
gcucagcagaucg

SEQ ID NO: 1228512 - RNA, 16 nt, Mycobacterium leprae
gcguuaccggcgucug

SEQ ID NO: 1228513 - RNA, 13 nt, Mycobacterium leprae
gcguggucgagga

SEQ ID NO: 1228514 - RNA, 17 nt, Mycobacterium leprae
gcgucucgcgcauacac

SEQ ID NO: 1228515 - RNA, 17 nt, Mycobacterium leprae
gcgugcucuuccaccgu

SEQ ID NO: 1228516 - RNA, 17 nt, Mycobacterium leprae
gcgguguuucucgccga

SEQ ID NO: 1228517 - RNA, 16 nt, Mycobacterium leprae
gcgucgacaucaccgg

SEQ ID NO: 1228518 - RNA, 19 nt, Mycobacterium leprae
gcgucgucuuuuucgcgga

SEQ ID NO: 1228519 - RNA, 20 nt, Mycobacterium leprae
gcgucgcucacggccaccau

SEQ ID NO: 1228520 - RNA, 15 nt, Mycobacterium leprae
gcgucgcuucaucgu

SEQ ID NO: 1228521 - RNA, 17 nt, Mycobacterium leprae
gcgguaaccugcugauc

SEQ ID NO: 1228522 - RNA, 17 nt, Mycobacterium leprae
gcggguuucccgccaaa

SEQ ID NO: 1228523 - RNA, 17 nt, Mycobacterium leprae
gcggguucggugguauc

SEQ ID NO: 1228524 - RNA, 13 nt, Mycobacterium leprae
gcggggcgguggc

SEQ ID NO: 1228525 - RNA, 20 nt, Mycobacterium leprae
gcgggguuuuuguugguggg

SEQ ID NO: 1228526 - RNA, 20 nt, Mycobacterium leprae
gcgggcuagguacucaacgu

SEQ ID NO: 1228527 - RNA, 22 nt, Mycobacterium leprae
gcggugugugcagauugcguga

SEQ ID NO: 1228528 - RNA, 20 nt, Mycobacterium leprae
gcggugacugaaaucauugc

SEQ ID NO: 1228529 - RNA, 17 nt, Mycobacterium leprae
gcgguaggaaucaccgg

SEQ ID NO: 1228530 - RNA, 22 nt, Mycobacterium leprae
gcgggcacgccaucguugcgac

SEQ ID NO: 1228531 - RNA, 18 nt, Mycobacterium leprae
gcggcugggcagccgagg

SEQ ID NO: 1228532 - RNA, 14 nt, Mycobacterium leprae
gcggcuuguggcua

SEQ ID NO: 1228533 - RNA, 14 nt, Mycobacterium leprae
gcggcuuguugacc

SEQ ID NO: 1228534 - RNA, 15 nt, Mycobacterium leprae
gcggcggacgaucga

SEQ ID NO: 1228535 - RNA, 14 nt, Mycobacterium leprae
gcggcugccacugu

SEQ ID NO: 1228536 - RNA, 18 nt, Mycobacterium leprae
gcggcgaucaugguggug

SEQ ID NO: 1228537 - RNA, 14 nt, Mycobacterium leprae
gcggcgccgcccgg

SEQ ID NO: 1228538 - RNA, 16 nt, Mycobacterium leprae
gcggcagcugccauug

SEQ ID NO: 1228539 - RNA, 18 nt, Mycobacterium leprae
gcggaccauggcgcucaa

SEQ ID NO: 1228540 - RNA, 16 nt, Mycobacterium leprae
gcggaaguaacgucga

SEQ ID NO: 1228541 - RNA, 20 nt, Mycobacterium leprae
gcggaagcgcuaccguacuc

SEQ ID NO: 1228542 - RNA, 19 nt, Mycobacterium leprae
gcgcggcguaaacguugac

SEQ ID NO: 1228543 - RNA, 20 nt, Mycobacterium leprae
gcgcauuggucggggugcug

SEQ ID NO: 1228544 - RNA, 20 nt, Mycobacterium leprae
gcgccaacacuagcggcuaa

SEQ ID NO: 1228545 - RNA, 18 nt, Mycobacterium leprae
gcgccaacuggaucggua

SEQ ID NO: 1228546 - RNA, 17 nt, Mycobacterium leprae
gcgccaauuccuccgcu

SEQ ID NO: 1228547 - RNA, 22 nt, Mycobacterium leprae
gcgccaucgaauccucgauggc

SEQ ID NO: 1228548 - RNA, 16 nt, Mycobacterium leprae
gcgccgagugguacaa

SEQ ID NO: 1228549 - RNA, 21 nt, Mycobacterium leprae
gcgccugaacuggaucgguca

SEQ ID NO: 1228550 - RNA, 23 nt, Mycobacterium leprae
gcgcgacaguaucgaccagccac

SEQ ID NO: 1228551 - RNA, 14 nt, Mycobacterium leprae
gcgacacgcgcgac

SEQ ID NO: 1228552 - RNA, 13 nt, Mycobacterium leprae
gcgacacggcugu

SEQ ID NO: 1228553 - RNA, 22 nt, Mycobacterium leprae
gcgacauauucgcuacgcccga

SEQ ID NO: 1228554 - RNA, 14 nt, Mycobacterium leprae
gcgaccagcgagca

SEQ ID NO: 1228555 - RNA, 15 nt, Mycobacterium leprae
gcgaccggaugaaca

SEQ ID NO: 1228556 - RNA, 15 nt, Mycobacterium leprae
gcgaccuggucgagc

SEQ ID NO: 1228557 - RNA, 18 nt, Mycobacterium leprae
gcgacggacaggccguag

SEQ ID NO: 1228558 - RNA, 15 nt, Mycobacterium leprae
gcgagaucggguuga

SEQ ID NO: 1228559 - RNA, 15 nt, Mycobacterium leprae
gcgauugccaccacc

SEQ ID NO: 1228560 - RNA, 18 nt, Mycobacterium leprae
gcgauucuaggcggugac

SEQ ID NO: 1228561 - RNA, 16 nt, Mycobacterium leprae
gcgauucgggagagga

SEQ ID NO: 1228562 - RNA, 17 nt, Mycobacterium leprae
gcgcaauuuggugauca

SEQ ID NO: 1228563 - RNA, 18 nt, Mycobacterium leprae
gcgaucgcagucaucacc

SEQ ID NO: 1228564 - RNA, 20 nt, Mycobacterium leprae
gcgaucaugagcaacacgua

SEQ ID NO: 1228565 - RNA, 19 nt, Mycobacterium leprae
gcgaucaggagguggucaa

SEQ ID NO: 1228566 - RNA, 12 nt, Mycobacterium leprae
gcgaucagcagg

SEQ ID NO: 1228567 - RNA, 19 nt, Mycobacterium leprae
gcgaggucaacguuugucg

SEQ ID NO: 1228568 - RNA, 20 nt, Mycobacterium leprae
gcgaugagauucgagcgggc

SEQ ID NO: 1228569 - RNA, 21 nt, Mycobacterium leprae
gcgaucuggauggccgccagc

SEQ ID NO: 1228570 - RNA, 14 nt, Mycobacterium leprae
gccuuaucccacca

SEQ ID NO: 1228571 - RNA, 14 nt, Mycobacterium leprae
gccugaugccauca

SEQ ID NO: 1228572 - RNA, 16 nt, Mycobacterium leprae
gccucuccagccauca

SEQ ID NO: 1228573 - RNA, 16 nt, Mycobacterium leprae
gccucgucggccagca

SEQ ID NO: 1228574 - RNA, 18 nt, Mycobacterium leprae
gccucgucggccagcacu

SEQ ID NO: 1228575 - RNA, 15 nt, Mycobacterium leprae
gccucggcuucccga

SEQ ID NO: 1228576 - RNA, 16 nt, Mycobacterium leprae
gccuccagaaucacag

SEQ ID NO: 1228577 - RNA, 16 nt, Mycobacterium leprae
gccguagcgcaccaau

SEQ ID NO: 1228578 - RNA, 14 nt, Mycobacterium leprae
gccgugcagcgacc

SEQ ID NO: 1228579 - RNA, 11 nt, Mycobacterium leprae
gccgugcccaa

SEQ ID NO: 1228580 - RNA, 14 nt, Mycobacterium leprae
ucggcauauccgcc

SEQ ID NO: 1228581 - RNA, 13 nt, Mycobacterium leprae
ucgcugugugcgc

SEQ ID NO: 1228582 - RNA, 22 nt, Mycobacterium leprae
ucggaaccgcagcugcucggcc

SEQ ID NO: 1228583 - RNA, 13 nt, Mycobacterium leprae
ucggaagcguugu

SEQ ID NO: 1228584 - RNA, 15 nt, Mycobacterium leprae
ucggaaucgccgcga

SEQ ID NO: 1228585 - RNA, 15 nt, Mycobacterium leprae
ucggacacgagcggc

SEQ ID NO: 1228586 - RNA, 14 nt, Mycobacterium leprae
ucggauccaucaga

SEQ ID NO: 1228587 - RNA, 21 nt, Mycobacterium leprae
ucggaguuugcgcucgucgau

SEQ ID NO: 1228588 - RNA, 15 nt, Mycobacterium leprae
ucggagcgagcucua

SEQ ID NO: 1228589 - RNA, 18 nt, Mycobacterium leprae
ucgcugauguccaaagac

SEQ ID NO: 1228590 - RNA, 15 nt, Mycobacterium leprae
ucgcuguauucugca

SEQ ID NO: 1228591 - RNA, 19 nt, Mycobacterium leprae
ucgcgggacaacaccacuu

SEQ ID NO: 1228592 - RNA, 16 nt, Mycobacterium leprae
ucggcgguaccgucua

SEQ ID NO: 1228593 - RNA, 14 nt, Mycobacterium leprae
ucggcgucgguggc

SEQ ID NO: 1228594 - RNA, 14 nt, Mycobacterium leprae
ucggccuaccgcgc

SEQ ID NO: 1228595 - RNA, 14 nt, Mycobacterium leprae
ucgcagacacagcc

SEQ ID NO: 1228596 - RNA, 13 nt, Mycobacterium leprae
ucgcacguggcac

SEQ ID NO: 1228597 - RNA, 13 nt, Mycobacterium leprae
ucgcagagcucac

SEQ ID NO: 1228598 - RNA, 12 nt, Mycobacterium leprae
ucgccaugaacu

SEQ ID NO: 1228599 - RNA, 16 nt, Mycobacterium leprae
ucgccgaaaucggugg

SEQ ID NO: 1228600 - RNA, 18 nt, Mycobacterium leprae
ucgccgagcucaaacgac

SEQ ID NO: 1228601 - RNA, 12 nt, Mycobacterium leprae
ucgccgccggcg

SEQ ID NO: 1228602 - RNA, 19 nt, Mycobacterium leprae
ucgccgcgcaucaucgccc

SEQ ID NO: 1228603 - RNA, 18 nt, Mycobacterium leprae
ucgcgagcugaacaggcg

SEQ ID NO: 1228604 - RNA, 13 nt, Mycobacterium leprae
ucgcgcaccgcga

SEQ ID NO: 1228605 - RNA, 19 nt, Mycobacterium leprae
ucgcggccgcagcgcggcc

SEQ ID NO: 1228606 - RNA, 19 nt, Mycobacterium leprae
ucgcggccacgucgccguu

SEQ ID NO: 1228607 - RNA, 16 nt, Mycobacterium leprae
ucgcgcugaagccgcu

SEQ ID NO: 1228608 - RNA, 15 nt, Mycobacterium leprae
uccuugaccaccacc

SEQ ID NO: 1228609 - RNA, 18 nt, Mycobacterium leprae
ucgaaaugggaucgagcg

SEQ ID NO: 1228610 - RNA, 15 nt, Mycobacterium leprae
ucgaagccaaaaacu

SEQ ID NO: 1228611 - RNA, 18 nt, Mycobacterium leprae
ucgaauuaggcggauggg

SEQ ID NO: 1228612 - RNA, 20 nt, Mycobacterium leprae
ucgacaaugucggccaccgg

SEQ ID NO: 1228613 - RNA, 13 nt, Mycobacterium leprae
ucgacaccgagca

SEQ ID NO: 1228614 - RNA, 13 nt, Mycobacterium leprae
ucgacaccggcca

SEQ ID NO: 1228615 - RNA, 14 nt, Mycobacterium leprae
ucgacaucaccggc

SEQ ID NO: 1228616 - RNA, 19 nt, Mycobacterium leprae
ucgacaucccagcaacgcu

SEQ ID NO: 1228617 - RNA, 23 nt, Mycobacterium leprae
ucgacgaaccaacaccccacccg

SEQ ID NO: 1228618 - RNA, 20 nt, Mycobacterium leprae
ucgaccgcuggggucgcgga

SEQ ID NO: 1228619 - RNA, 19 nt, Mycobacterium leprae
ucgaccuccuugaccacca

SEQ ID NO: 1228620 - RNA, 23 nt, Mycobacterium leprae
ucgaccuccuugaccaccaccgc

SEQ ID NO: 1228621 - RNA, 14 nt, Mycobacterium leprae
ucgauucugcccgg

SEQ ID NO: 1228622 - RNA, 14 nt, Mycobacterium leprae
ucgauucaccgauc

SEQ ID NO: 1228623 - RNA, 18 nt, Mycobacterium leprae
ucgaugucggggaugguu

SEQ ID NO: 1228624 - RNA, 14 nt, Mycobacterium leprae
ucgcaccgauaucc

SEQ ID NO: 1228625 - RNA, 18 nt, Mycobacterium leprae
ucgcaccgauauccggcc

SEQ ID NO: 1228626 - RNA, 22 nt, Mycobacterium leprae
ucgaucagcuaccagggucggc

SEQ ID NO: 1228627 - RNA, 23 nt, Mycobacterium leprae
ucgaucagcuaccagggucggcc

SEQ ID NO: 1228628 - RNA, 17 nt, Mycobacterium leprae
ucgaucauggauuaccu

SEQ ID NO: 1228629 - RNA, 21 nt, Mycobacterium leprae
ucgaugcacuguucacuaaca

SEQ ID NO: 1228630 - RNA, 20 nt, Mycobacterium leprae
ucgaugcgaaucaugucgaa

SEQ ID NO: 1228631 - RNA, 23 nt, Mycobacterium leprae
ucgauaagaaguuguagcugugg

SEQ ID NO: 1228632 - RNA, 19 nt, Mycobacterium leprae
ucgagcgaggagcacggcu

SEQ ID NO: 1228633 - RNA, 18 nt, Mycobacterium leprae
ucgagcgauugugcggaa

SEQ ID NO: 1228634 - RNA, 18 nt, Mycobacterium leprae
ucgagcagccgaccgccc

SEQ ID NO: 1228635 - RNA, 15 nt, Mycobacterium leprae
ucgacggcuggcagc

SEQ ID NO: 1228636 - RNA, 18 nt, Mycobacterium leprae
ucgacgggaagugguggc

SEQ ID NO: 1228637 - RNA, 18 nt, Mycobacterium leprae
uccguuguccgcggcuau

SEQ ID NO: 1228638 - RNA, 19 nt, Mycobacterium leprae
uccguuuuucaccuccacg

SEQ ID NO: 1228639 - RNA, 23 nt, Mycobacterium leprae
uccucacguugucgaaaaaucag

SEQ ID NO: 1228640 - RNA, 14 nt, Mycobacterium leprae
uccggcgccagccu

SEQ ID NO: 1228641 - RNA, 23 nt, Mycobacterium leprae
uccgagcgcccgcacagcaccau

SEQ ID NO: 1228642 - RNA, 16 nt, Mycobacterium leprae
uccgcaaaaugcuccc

SEQ ID NO: 1228643 - RNA, 16 nt, Mycobacterium leprae
ucccgcccggccagua

SEQ ID NO: 1228644 - RNA, 15 nt, Mycobacterium leprae
ucccggcggccaauu

SEQ ID NO: 1228645 - RNA, 16 nt, Mycobacterium leprae
ucccacgacggugcgg

SEQ ID NO: 1228646 - RNA, 22 nt, Mycobacterium leprae
ucccaauccuggaugugugcac

SEQ ID NO: 1228647 - RNA, 14 nt, Mycobacterium leprae
ugcaaaacgucgau

SEQ ID NO: 1228648 - RNA, 20 nt, Mycobacterium leprae
ugcaaaacgucgaucucgac

SEQ ID NO: 1228649 - RNA, 20 nt, Mycobacterium leprae
ugcaauccgccgaucccgaa

SEQ ID NO: 1228650 - RNA, 18 nt, Mycobacterium leprae
ugcaaucaaucauuaccg

SEQ ID NO: 1228651 - RNA, 16 nt, Mycobacterium leprae
ugcaagugcaccaucu

SEQ ID NO: 1228652 - RNA, 15 nt, Mycobacterium leprae
ugcacccgucgcuga

SEQ ID NO: 1228653 - RNA, 21 nt, Mycobacterium leprae
ugcaccguggcaacgaccacc

SEQ ID NO: 1228654 - RNA, 15 nt, Mycobacterium leprae
ugaugccgaagcaga

SEQ ID NO: 1228655 - RNA, 20 nt, Mycobacterium leprae
ugauccucucccgaaucgcu

SEQ ID NO: 1228656 - RNA, 16 nt, Mycobacterium leprae
ugauccuucuuuucga

SEQ ID NO: 1228657 - RNA, 15 nt, Mycobacterium leprae
ugauucagcgcugau

SEQ ID NO: 1228658 - RNA, 14 nt, Mycobacterium leprae
ugagccuggcaccg

SEQ ID NO: 1228659 - RNA, 17 nt, Mycobacterium leprae
ugagcgggccagcacca

SEQ ID NO: 1228660 - RNA, 16 nt, Mycobacterium leprae
ugagugugaugccgaa

SEQ ID NO: 1228661 - RNA, 20 nt, Mycobacterium leprae
ugagugugaugccgaagcag

SEQ ID NO: 1228662 - RNA, 19 nt, Mycobacterium leprae
ugacugccugcuuucgaug

SEQ ID NO: 1228663 - RNA, 20 nt, Mycobacterium leprae
ugagacaucgccaccgaccg

SEQ ID NO: 1228664 - RNA, 18 nt, Mycobacterium leprae
ugagcacgccaaucgccu

SEQ ID NO: 1228665 - RNA, 22 nt, Mycobacterium leprae
ugaccagucuuccguacgccgc

SEQ ID NO: 1228666 - RNA, 19 nt, Mycobacterium leprae
ugacgguguuggugucacu

SEQ ID NO: 1228667 - RNA, 16 nt, Mycobacterium leprae
ugacgucccggcaccg

SEQ ID NO: 1228668 - RNA, 22 nt, Mycobacterium leprae
ugacgucguaaacuaccagaug

SEQ ID NO: 1228669 - RNA, 22 nt, Mycobacterium leprae
ugcaugaggacugcugaccggg

SEQ ID NO: 1228670 - RNA, 15 nt, Mycobacterium leprae
ugcaucagcaccgcg

SEQ ID NO: 1228671 - RNA, 16 nt, Mycobacterium leprae
ugcaucagcaccgcgc

SEQ ID NO: 1228672 - RNA, 14 nt, Mycobacterium leprae
ugcauccugcagca

SEQ ID NO: 1228673 - RNA, 20 nt, Mycobacterium leprae
ugcagggcgagcugcgccga

SEQ ID NO: 1228674 - RNA, 17 nt, Mycobacterium leprae
ugccauuggugggauga

SEQ ID NO: 1228675 - RNA, 13 nt, Mycobacterium leprae
ugccaaccugcgc

SEQ ID NO: 1228676 - RNA, 18 nt, Mycobacterium leprae
ugccaggcagcugugcac

SEQ ID NO: 1228677 - RNA, 21 nt, Mycobacterium leprae
ugccaggcagcugugcacgug

SEQ ID NO: 1228678 - RNA, 17 nt, Mycobacterium leprae
ugccaggggcugggcac

SEQ ID NO: 1228679 - RNA, 22 nt, Mycobacterium leprae
ugccaggggcugggcaccuggg

SEQ ID NO: 1228680 - RNA, 12 nt, Mycobacterium leprae
ugcccgacagcc

SEQ ID NO: 1228681 - RNA, 14 nt, Mycobacterium leprae
ugcccucgcugccg

SEQ ID NO: 1228682 - RNA, 19 nt, Mycobacterium leprae
ugccgaagcgaagacaucg

SEQ ID NO: 1228683 - RNA, 15 nt, Mycobacterium leprae
ugccgaacugcugca

SEQ ID NO: 1228684 - RNA, 21 nt, Mycobacterium leprae
ugccgagcugguaggugacgc

SEQ ID NO: 1228685 - RNA, 20 nt, Mycobacterium leprae
ugccgacaguuuaccgugcc

SEQ ID NO: 1228686 - RNA, 15 nt, Mycobacterium leprae
ugccgccgaucggua

SEQ ID NO: 1228687 - RNA, 14 nt, Mycobacterium leprae
ucuaggguguugug

SEQ ID NO: 1228688 - RNA, 18 nt, Mycobacterium leprae
ucuagcaaguagacggcu

SEQ ID NO: 1228689 - RNA, 18 nt, Mycobacterium leprae
ucuagagcugugccgaca

SEQ ID NO: 1228690 - RNA, 15 nt, Mycobacterium leprae
ucuaucgcgucggca

SEQ ID NO: 1228691 - RNA, 19 nt, Mycobacterium leprae
ucuccaccagccggccggg

SEQ ID NO: 1228692 - RNA, 21 nt, Mycobacterium leprae
ucguucccacuugggcaacac

SEQ ID NO: 1228693 - RNA, 11 nt, Mycobacterium leprae
ucguugacgcc

SEQ ID NO: 1228694 - RNA, 21 nt, Mycobacterium leprae
ucguugacguggacuucugcg

SEQ ID NO: 1228695 - RNA, 18 nt, Mycobacterium leprae
ucgugugcuuugccgcag

SEQ ID NO: 1228696 - RNA, 13 nt, Mycobacterium leprae
ucguuaaccguuc

SEQ ID NO: 1228697 - RNA, 19 nt, Mycobacterium leprae
ucgugcuguugucagcaga

SEQ ID NO: 1228698 - RNA, 22 nt, Mycobacterium leprae
ucgugcguuguugauggugucg

SEQ ID NO: 1228699 - RNA, 17 nt, Mycobacterium leprae
ucgugcugaucaccggc

SEQ ID NO: 1228700 - RNA, 20 nt, Mycobacterium leprae
ucgugcacuguaucucgugc

SEQ ID NO: 1228701 - RNA, 15 nt, Mycobacterium leprae
ucgucggccagcacu

SEQ ID NO: 1228702 - RNA, 18 nt, Mycobacterium leprae
ucgucaauucggcgauau

SEQ ID NO: 1228703 - RNA, 13 nt, Mycobacterium leprae
ucgucagcugcug

SEQ ID NO: 1228704 - RNA, 15 nt, Mycobacterium leprae
ucgucagauccggcc

SEQ ID NO: 1228705 - RNA, 14 nt, Mycobacterium leprae
ucgucaucgacgau

SEQ ID NO: 1228706 - RNA, 15 nt, Mycobacterium leprae
ucgucgacuauaucc

SEQ ID NO: 1228707 - RNA, 19 nt, Mycobacterium leprae
ucgguaagcuggcucgguc

SEQ ID NO: 1228708 - RNA, 14 nt, Mycobacterium leprae
ucggucugcucggc

SEQ ID NO: 1228709 - RNA, 19 nt, Mycobacterium leprae
ucggcuggucguugcccgg

SEQ ID NO: 1228710 - RNA, 19 nt, Mycobacterium leprae
ucggcucccaucggcggcc

SEQ ID NO: 1228711 - RNA, 23 nt, Mycobacterium leprae
ucggugccguaaugugcagugcg

SEQ ID NO: 1228712 - RNA, 21 nt, Mycobacterium leprae
ucggugguggaugcugcuugg

SEQ ID NO: 1228713 - RNA, 16 nt, Mycobacterium leprae
ucuguaguagcccaca

SEQ ID NO: 1228714 - RNA, 15 nt, Mycobacterium leprae
ucuguagcuucgucg

SEQ ID NO: 1228715 - RNA, 20 nt, Mycobacterium leprae
ucugggugguguggcccgac

SEQ ID NO: 1228716 - RNA, 15 nt, Mycobacterium leprae
ucugucgcgucgaca

SEQ ID NO: 1228717 - RNA, 12 nt, Mycobacterium leprae
ucugucgucgaa

SEQ ID NO: 1228718 - RNA, 19 nt, Mycobacterium leprae
ucugugggcagugccuggc

SEQ ID NO: 1228719 - RNA, 22 nt, Mycobacterium leprae
ucugcgguggucauguggccgc

SEQ ID NO: 1228720 - RNA, 21 nt, Mycobacterium leprae
ucugcgucgcccucgccggcg

SEQ ID NO: 1228721 - RNA, 21 nt, Mycobacterium leprae
ucugcggcguagguuggcgac

SEQ ID NO: 1228722 - RNA, 14 nt, Mycobacterium leprae
ucugcgcuggccac

SEQ ID NO: 1228723 - RNA, 19 nt, Mycobacterium leprae
ucugcgcuggccacaaaac

SEQ ID NO: 1228724 - RNA, 20 nt, Mycobacterium leprae
ucucgacaaccucuagccaa

SEQ ID NO: 1228725 - RNA, 21 nt, Mycobacterium leprae
ucuggcuacaacaaggugugc

SEQ ID NO: 1228726 - RNA, 16 nt, Mycobacterium leprae
ucuuguucuugcgcgu

SEQ ID NO: 1228727 - RNA, 22 nt, Mycobacterium leprae
ucuugugcccgaggacacccgg

SEQ ID NO: 1228728 - RNA, 21 nt, Mycobacterium leprae
ucuguugcaggcuucgucaca

SEQ ID NO: 1228729 - RNA, 19 nt, Mycobacterium leprae
ugaagggccggguaaguuc

SEQ ID NO: 1228730 - RNA, 17 nt, Mycobacterium leprae
ugaagcauuuggcucgc

SEQ ID NO: 1228731 - RNA, 22 nt, Mycobacterium leprae
ugaacgcguugcucgacgcgga

SEQ ID NO: 1228732 - RNA, 16 nt, Mycobacterium leprae
ugaacuggaucgguca

SEQ ID NO: 1228733 - RNA, 17 nt, Mycobacterium leprae
ugacaacacgaucgcag

SEQ ID NO: 1228734 - RNA, 18 nt, Mycobacterium leprae
ugaaucagaugaccggcu

SEQ ID NO: 1228735 - RNA, 16 nt, Mycobacterium leprae
ugacauauuugggagc

SEQ ID NO: 1228736 - RNA, 21 nt, Mycobacterium leprae
ugaccaagaaguuaccgagcc

SEQ ID NO: 1228737 - RNA, 14 nt, Mycobacterium leprae
ugaccacgccgaca

SEQ ID NO: 1228738 - RNA, 19 nt, Mycobacterium leprae
ugaccacccacaacgccaa

SEQ ID NO: 1228739 - RNA, 18 nt, Mycobacterium leprae
ucagauuacgcgcgacau

SEQ ID NO: 1228740 - RNA, 13 nt, Mycobacterium leprae
ucagcaucgacag

SEQ ID NO: 1228741 - RNA, 17 nt, Mycobacterium leprae
ucagcauggacgaaucc

SEQ ID NO: 1228742 - RNA, 15 nt, Mycobacterium leprae
ucagcaugucggcca

SEQ ID NO: 1228743 - RNA, 17 nt, Mycobacterium leprae
ucagcaugucggccacu

SEQ ID NO: 1228744 - RNA, 17 nt, Mycobacterium leprae
ucagccuagcagcaucg

SEQ ID NO: 1228745 - RNA, 19 nt, Mycobacterium leprae
ucagcuggugcuggcgucg

SEQ ID NO: 1228746 - RNA, 14 nt, Mycobacterium leprae
ucaggaugcugucg

SEQ ID NO: 1228747 - RNA, 21 nt, Mycobacterium leprae
ucagcggacugcuagccggcu

SEQ ID NO: 1228748 - RNA, 15 nt, Mycobacterium leprae
ucagcuccgaagcag

SEQ ID NO: 1228749 - RNA, 14 nt, Mycobacterium leprae
ucaccucguauggc

SEQ ID NO: 1228750 - RNA, 13 nt, Mycobacterium leprae
ucacccuuucggg

SEQ ID NO: 1228751 - RNA, 22 nt, Mycobacterium leprae
ucaccgacggaugcccagccag

SEQ ID NO: 1228752 - RNA, 16 nt, Mycobacterium leprae
ucaccgaccuucgcga

SEQ ID NO: 1228753 - RNA, 14 nt, Mycobacterium leprae
ucaccgcggccgac

SEQ ID NO: 1228754 - RNA, 18 nt, Mycobacterium leprae
ucacggucgacuucgcag

SEQ ID NO: 1228755 - RNA, 22 nt, Mycobacterium leprae
aauaagaaagaauuuaccggcg

SEQ ID NO: 1228756 - RNA, 17 nt, Mycobacterium leprae
aauaaccagggccguca

SEQ ID NO: 1228757 - RNA, 23 nt, Mycobacterium leprae
ucacgggugguuagaaucgccug

SEQ ID NO: 1228758 - RNA, 17 nt, Mycobacterium leprae
aauaacagagugcacca

SEQ ID NO: 1228759 - RNA, 22 nt, Mycobacterium leprae
ucagaguguguguggcaccggg

SEQ ID NO: 1228760 - RNA, 22 nt, Mycobacterium leprae
ucacuuccgcuuugccgcugug

SEQ ID NO: 1228761 - RNA, 15 nt, Mycobacterium leprae
ucacuugcugaccga

SEQ ID NO: 1228762 - RNA, 14 nt, Mycobacterium leprae
ucacuacguccacu

SEQ ID NO: 1228763 - RNA, 15 nt, Mycobacterium leprae
ucacuacguuggcca

SEQ ID NO: 1228764 - RNA, 13 nt, Mycobacterium leprae
uccacucgccgcg

SEQ ID NO: 1228765 - RNA, 14 nt, Mycobacterium leprae
uccacguuguccgc

SEQ ID NO: 1228766 - RNA, 22 nt, Mycobacterium leprae
uccacguuguccgcguggaugc

SEQ ID NO: 1228767 - RNA, 19 nt, Mycobacterium leprae
uccacugcggcaaagcaca

SEQ ID NO: 1228768 - RNA, 19 nt, Mycobacterium leprae
uccacgugucugucggcua

SEQ ID NO: 1228769 - RNA, 20 nt, Mycobacterium leprae
uccacaucgauguggccgca

SEQ ID NO: 1228770 - RNA, 21 nt, Mycobacterium leprae
uccagaaaguacugaccggcu

SEQ ID NO: 1228771 - RNA, 17 nt, Mycobacterium leprae
uccacuggcuaaaucgu

SEQ ID NO: 1228772 - RNA, 20 nt, Mycobacterium leprae
uccagcgaagguagcccguu

SEQ ID NO: 1228773 - RNA, 16 nt, Mycobacterium leprae
uccauuuucguggcga

SEQ ID NO: 1228774 - RNA, 14 nt, Mycobacterium leprae
uccauauagcgucc

SEQ ID NO: 1228775 - RNA, 12 nt, Mycobacterium leprae
ucauagcggcga

SEQ ID NO: 1228776 - RNA, 19 nt, Mycobacterium leprae
ucauagaaccugccuagca

SEQ ID NO: 1228777 - RNA, 22 nt, Mycobacterium leprae
ucaucagauucacagucggcgc

SEQ ID NO: 1228778 - RNA, 23 nt, Mycobacterium leprae
ucaucuaucuccaccagccggcc

SEQ ID NO: 1228779 - RNA, 16 nt, Mycobacterium leprae
uccaagccggucggga

SEQ ID NO: 1228780 - RNA, 14 nt, Mycobacterium leprae
ucauguuccgcuga

SEQ ID NO: 1228781 - RNA, 15 nt, Mycobacterium leprae
uaucggugucggcgg

SEQ ID NO: 1228782 - RNA, 18 nt, Mycobacterium leprae
uagguccuggaugccgac

SEQ ID NO: 1228783 - RNA, 14 nt, Mycobacterium leprae
uagggaggucacca

SEQ ID NO: 1228784 - RNA, 19 nt, Mycobacterium leprae
uagggaccgcugcgguguc

SEQ ID NO: 1228785 - RNA, 17 nt, Mycobacterium leprae
uaucccgaccggcccga

SEQ ID NO: 1228786 - RNA, 17 nt, Mycobacterium leprae
ucaaacgcugcgcgcag

SEQ ID NO: 1228787 - RNA, 19 nt, Mycobacterium leprae
uacggcgacucaucgccaa

SEQ ID NO: 1228788 - RNA, 14 nt, Mycobacterium leprae
uacgggugaagcau

SEQ ID NO: 1228789 - RNA, 17 nt, Mycobacterium leprae
uacgcgaucuaccccgg

SEQ ID NO: 1228790 - RNA, 18 nt, Mycobacterium leprae
uacugcgacagcagccac

SEQ ID NO: 1228791 - RNA, 15 nt, Mycobacterium leprae
uacugcugcccgcgg

SEQ ID NO: 1228792 - RNA, 15 nt, Mycobacterium leprae
uagaaagacccccgg

SEQ ID NO: 1228793 - RNA, 19 nt, Mycobacterium leprae
uacguuagucuggcuggcc

SEQ ID NO: 1228794 - RNA, 15 nt, Mycobacterium leprae
uacucuggcuggucg

SEQ ID NO: 1228795 - RNA, 19 nt, Mycobacterium leprae
uacugauuugaacuuggca

SEQ ID NO: 1228796 - RNA, 16 nt, Mycobacterium leprae
uacguagcgucggcgg

SEQ ID NO: 1228797 - RNA, 17 nt, Mycobacterium leprae
uacgugccaacucggcc

SEQ ID NO: 1228798 - RNA, 23 nt, Mycobacterium leprae
uagcgugagccuggcaccguguc

SEQ ID NO: 1228799 - RNA, 18 nt, Mycobacterium leprae
uagcaacgucacgucgac

SEQ ID NO: 1228800 - RNA, 22 nt, Mycobacterium leprae
uagcccuccggaaauacggcag

SEQ ID NO: 1228801 - RNA, 17 nt, Mycobacterium leprae
uagcgcgcugaucgggc

SEQ ID NO: 1228802 - RNA, 20 nt, Mycobacterium leprae
uagccgauuagacacacuuc

SEQ ID NO: 1228803 - RNA, 21 nt, Mycobacterium leprae
uaggcaccacgcacacgacag

SEQ ID NO: 1228804 - RNA, 13 nt, Mycobacterium leprae
uaggcguccgcgg

SEQ ID NO: 1228805 - RNA, 14 nt, Mycobacterium leprae
uaggcuucaucauu

SEQ ID NO: 1228806 - RNA, 17 nt, Mycobacterium leprae
uacaaucgcggcacaug

SEQ ID NO: 1228807 - RNA, 18 nt, Mycobacterium leprae
uacaccuuggccgccggc

SEQ ID NO: 1228808 - RNA, 16 nt, Mycobacterium leprae
uaaugucgaagggcug

SEQ ID NO: 1228809 - RNA, 17 nt, Mycobacterium leprae
uaaucaguaaucgacgc

SEQ ID NO: 1228810 - RNA, 15 nt, Mycobacterium leprae
uaaucaagaucggcc

SEQ ID NO: 1228811 - RNA, 17 nt, Mycobacterium leprae
uaacuuaaucgccggcg

SEQ ID NO: 1228812 - RNA, 23 nt, Mycobacterium leprae
uaacccgcaaaccaaacaacaac

SEQ ID NO: 1228813 - RNA, 21 nt, Mycobacterium leprae
guuuggaugcguugucgucgg

SEQ ID NO: 1228814 - RNA, 19 nt, Mycobacterium leprae
guuugcuauccguuggcgg

SEQ ID NO: 1228815 - RNA, 15 nt, Mycobacterium leprae
guucgaccaggaugu

SEQ ID NO: 1228816 - RNA, 14 nt, Mycobacterium leprae
guucuguugugggg

SEQ ID NO: 1228817 - RNA, 17 nt, Mycobacterium leprae
guugacgaccggcugca

SEQ ID NO: 1228818 - RNA, 16 nt, Mycobacterium leprae
guugcguaauggccgg

SEQ ID NO: 1228819 - RNA, 14 nt, Mycobacterium leprae
guugcugaguguug

SEQ ID NO: 1228820 - RNA, 23 nt, Mycobacterium leprae
guugggagugcuagcggcgccag

SEQ ID NO: 1228821 - RNA, 21 nt, Mycobacterium leprae
guugcgcuggaaggagcgcgc

SEQ ID NO: 1228822 - RNA, 14 nt, Mycobacterium leprae
gugcuguugucagc

SEQ ID NO: 1228823 - RNA, 20 nt, Mycobacterium leprae
guggauccgaaugacaacgg

SEQ ID NO: 1228824 - RNA, 16 nt, Mycobacterium leprae
guggauguuccgcagc

SEQ ID NO: 1228825 - RNA, 20 nt, Mycobacterium leprae
guggaguaaagggugguggg

SEQ ID NO: 1228826 - RNA, 16 nt, Mycobacterium leprae
gugcguagucgaccgg

SEQ ID NO: 1228827 - RNA, 16 nt, Mycobacterium leprae
gugcguaaucgccggu

SEQ ID NO: 1228828 - RNA, 14 nt, Mycobacterium leprae
gugccgccgacggc

SEQ ID NO: 1228829 - RNA, 18 nt, Mycobacterium leprae
gugccuguucaggugcgg

SEQ ID NO: 1228830 - RNA, 19 nt, Mycobacterium leprae
gugcccgggaaacuagcgg

SEQ ID NO: 1228831 - RNA, 23 nt, Mycobacterium leprae
gugccgaucacaaguccgcggga

SEQ ID NO: 1228832 - RNA, 19 nt, Mycobacterium leprae
gugccgagcuggccggggc

SEQ ID NO: 1228833 - RNA, 23 nt, Mycobacterium leprae
gugagucgcccagcagguugagg

SEQ ID NO: 1228834 - RNA, 19 nt, Mycobacterium leprae
gugagugaaagaggccgac

SEQ ID NO: 1228835 - RNA, 21 nt, Mycobacterium leprae
gugagugauacuaggucgccu

SEQ ID NO: 1228836 - RNA, 20 nt, Mycobacterium leprae
gugcacaaccuggaggccaa

SEQ ID NO: 1228837 - RNA, 14 nt, Mycobacterium leprae
gugcaggauugcgu

SEQ ID NO: 1228838 - RNA, 17 nt, Mycobacterium leprae
gugcauuaacggcuucc

SEQ ID NO: 1228839 - RNA, 23 nt, Mycobacterium leprae
guucagccgucgcugugccaagu

SEQ ID NO: 1228840 - RNA, 19 nt, Mycobacterium leprae
guucaccggcaucggacag

SEQ ID NO: 1228841 - RNA, 17 nt, Mycobacterium leprae
guuauccacagcaucaa

SEQ ID NO: 1228842 - RNA, 14 nt, Mycobacterium leprae
guuagcgagggucg

SEQ ID NO: 1228843 - RNA, 22 nt, Mycobacterium leprae
guuagguugguggugaaaucgu

SEQ ID NO: 1228844 - RNA, 17 nt, Mycobacterium leprae
guuacugucggugccgc

SEQ ID NO: 1228845 - RNA, 16 nt, Mycobacterium leprae
guguuuuaccagccag

SEQ ID NO: 1228846 - RNA, 14 nt, Mycobacterium leprae
guguugucgccgaa

SEQ ID NO: 1228847 - RNA, 16 nt, Mycobacterium leprae
guuccggcgaccagcg

SEQ ID NO: 1228848 - RNA, 18 nt, Mycobacterium leprae
guucccugacuguuuccg

SEQ ID NO: 1228849 - RNA, 20 nt, Mycobacterium leprae
guuccgcccagugacgucgg

SEQ ID NO: 1228850 - RNA, 18 nt, Mycobacterium leprae
guuccgcaauuucggcgu

SEQ ID NO: 1228851 - RNA, 17 nt, Mycobacterium leprae
guuccagucgaagguga

SEQ ID NO: 1228852 - RNA, 21 nt, Mycobacterium leprae
guuccaagauggcgucaccgu

SEQ ID NO: 1228853 - RNA, 19 nt, Mycobacterium leprae
guucagugccguaaaucgu

SEQ ID NO: 1228854 - RNA, 12 nt, Mycobacterium leprae
guggguggcuga

SEQ ID NO: 1228855 - RNA, 19 nt, Mycobacterium leprae
guggucgauuacucacgcg

SEQ ID NO: 1228856 - RNA, 21 nt, Mycobacterium leprae
guggucgauuacucacgcgca

SEQ ID NO: 1228857 - RNA, 22 nt, Mycobacterium leprae
guggccaaugcgcguugugcca

SEQ ID NO: 1228858 - RNA, 16 nt, Mycobacterium leprae
guggcagauuauuaag

SEQ ID NO: 1228859 - RNA, 20 nt, Mycobacterium leprae
gugguguucauaucgcgcaa

SEQ ID NO: 1228860 - RNA, 16 nt, Mycobacterium leprae
gugguguugugguggg

SEQ ID NO: 1228861 - RNA, 19 nt, Mycobacterium leprae
gugguguggcccgacggcg

SEQ ID NO: 1228862 - RNA, 20 nt, Mycobacterium leprae
gugguuagacagugaugauc

SEQ ID NO: 1228863 - RNA, 13 nt, Mycobacterium leprae
gugguugagucgu

SEQ ID NO: 1228864 - RNA, 14 nt, Mycobacterium leprae
guguccgucgacgu

SEQ ID NO: 1228865 - RNA, 13 nt, Mycobacterium leprae
gugugcuuucggc

SEQ ID NO: 1228866 - RNA, 22 nt, Mycobacterium leprae
guguggcaccggguauugaacg

SEQ ID NO: 1228867 - RNA, 12 nt, Mycobacterium leprae
guguguugcagu

SEQ ID NO: 1228868 - RNA, 22 nt, Mycobacterium leprae
guguguccuuaacugacuggug

SEQ ID NO: 1228869 - RNA, 22 nt, Mycobacterium leprae
gugugguuucgaucaugccugg

SEQ ID NO: 1228870 - RNA, 19 nt, Mycobacterium leprae
gugugggacgugaugcagc

SEQ ID NO: 1228871 - RNA, 20 nt, Mycobacterium leprae
ugcuacgaaggggucgauga

SEQ ID NO: 1228872 - RNA, 17 nt, Mycobacterium leprae
ugcguaauggccggcgc

SEQ ID NO: 1228873 - RNA, 20 nt, Mycobacterium leprae
ugcucgguauuugcggugga

SEQ ID NO: 1228874 - RNA, 14 nt, Mycobacterium leprae
ugcuauccgcggug

SEQ ID NO: 1228875 - RNA, 14 nt, Mycobacterium leprae
ugcucaaucagcga

SEQ ID NO: 1228876 - RNA, 17 nt, Mycobacterium leprae
ugcugcaucgguaacca

SEQ ID NO: 1228877 - RNA, 20 nt, Mycobacterium leprae
ugcugccaauugucgugggu

SEQ ID NO: 1228878 - RNA, 22 nt, Mycobacterium leprae
ugcugggacauccgcugauugg

SEQ ID NO: 1228879 - RNA, 18 nt, Mycobacterium leprae
uggacuuuaaugucgcga

SEQ ID NO: 1228880 - RNA, 20 nt, Mycobacterium leprae
uggagugaccgaugcucgcc

SEQ ID NO: 1228881 - RNA, 16 nt, Mycobacterium leprae
uggauacguagcgucg

SEQ ID NO: 1228882 - RNA, 18 nt, Mycobacterium leprae
uggagcaccucagcaacu

SEQ ID NO: 1228883 - RNA, 13 nt, Mycobacterium leprae
uggagccaccaca

SEQ ID NO: 1228884 - RNA, 17 nt, Mycobacterium leprae
uggaagccgccguggug

SEQ ID NO: 1228885 - RNA, 14 nt, Mycobacterium leprae
uggaauagcugugg

SEQ ID NO: 1228886 - RNA, 14 nt, Mycobacterium leprae
uggaccgcgccgcg

SEQ ID NO: 1228887 - RNA, 20 nt, Mycobacterium leprae
uggacgcucggugagauagc

SEQ ID NO: 1228888 - RNA, 17 nt, Mycobacterium leprae
uggauccgaaugacaac

SEQ ID NO: 1228889 - RNA, 14 nt, Mycobacterium leprae
uggaugucgcagag

SEQ ID NO: 1228890 - RNA, 12 nt, Mycobacterium leprae
uggaugcccagg

SEQ ID NO: 1228891 - RNA, 12 nt, Mycobacterium leprae
uggauggucggc

SEQ ID NO: 1228892 - RNA, 21 nt, Mycobacterium leprae
uggcaacgcugcccaccagua

SEQ ID NO: 1228893 - RNA, 21 nt, Mycobacterium leprae
uggcaccagucgcgcaguguc

SEQ ID NO: 1228894 - RNA, 19 nt, Mycobacterium leprae
uggcaccagugugccagcg

SEQ ID NO: 1228895 - RNA, 18 nt, Mycobacterium leprae
ugcgauaucggauucguu

SEQ ID NO: 1228896 - RNA, 11 nt, Mycobacterium leprae
ugcgauagcgg

SEQ ID NO: 1228897 - RNA, 14 nt, Mycobacterium leprae
ugcgauagcggugc

SEQ ID NO: 1228898 - RNA, 12 nt, Mycobacterium leprae
ugccgugugcuu

SEQ ID NO: 1228899 - RNA, 17 nt, Mycobacterium leprae
ugccucgagcaaaccag

SEQ ID NO: 1228900 - RNA, 22 nt, Mycobacterium leprae
ugccucuagcaaggcgcgguau

SEQ ID NO: 1228901 - RNA, 16 nt, Mycobacterium leprae
ugccucggcuucccga

SEQ ID NO: 1228902 - RNA, 12 nt, Mycobacterium leprae
ugccucgucgau

SEQ ID NO: 1228903 - RNA, 14 nt, Mycobacterium leprae
ugccgcgcguuggc

SEQ ID NO: 1228904 - RNA, 20 nt, Mycobacterium leprae
ugcggccaagcuagaucaac

SEQ ID NO: 1228905 - RNA, 19 nt, Mycobacterium leprae
ugcgcugcagcaacagcca

SEQ ID NO: 1228906 - RNA, 17 nt, Mycobacterium leprae
ugcgcggcgccgguacu

SEQ ID NO: 1228907 - RNA, 14 nt, Mycobacterium leprae
ugcgcggcgccggu

SEQ ID NO: 1228908 - RNA, 14 nt, Mycobacterium leprae
ugcgcgggagcggc

SEQ ID NO: 1228909 - RNA, 15 nt, Mycobacterium leprae
ugcgcgggagcggcu

SEQ ID NO: 1228910 - RNA, 16 nt, Mycobacterium leprae
ugcgcgccgaccucgg

SEQ ID NO: 1228911 - RNA, 16 nt, Mycobacterium leprae
ugcgcauccucggacu

SEQ ID NO: 1228912 - RNA, 12 nt, Mycobacterium leprae
ugguucgucgag

SEQ ID NO: 1228913 - RNA, 14 nt, Mycobacterium leprae
aaucaccagcgacg

SEQ ID NO: 1228914 - RNA, 13 nt, Mycobacterium leprae
uguauuugcgcgg

SEQ ID NO: 1228915 - RNA, 21 nt, Mycobacterium leprae
uguauccaggauugaugccuu

SEQ ID NO: 1228916 - RNA, 17 nt, Mycobacterium leprae
uguccacuuaccgcggc

SEQ ID NO: 1228917 - RNA, 18 nt, Mycobacterium leprae
uguccaccgaacccaucc

SEQ ID NO: 1228918 - RNA, 15 nt, Mycobacterium leprae
ugucgaugaugcgcu

SEQ ID NO: 1228919 - RNA, 17 nt, Mycobacterium leprae
ugucgacguuccggccu

SEQ ID NO: 1228920 - RNA, 23 nt, Mycobacterium leprae
ugucgacguuccggccuucguca

SEQ ID NO: 1228921 - RNA, 22 nt, Mycobacterium leprae
uggugugugaggaucugcugau

SEQ ID NO: 1228922 - RNA, 18 nt, Mycobacterium leprae
ugguguguucacgggaua

SEQ ID NO: 1228923 - RNA, 20 nt, Mycobacterium leprae
uggugauaaauucuuuugca

SEQ ID NO: 1228924 - RNA, 14 nt, Mycobacterium leprae
uggucggcgcuggc

SEQ ID NO: 1228925 - RNA, 23 nt, Mycobacterium leprae
uggucucaaugaccgcaccgauc

SEQ ID NO: 1228926 - RNA, 15 nt, Mycobacterium leprae
ugguaaagccguugg

SEQ ID NO: 1228927 - RNA, 14 nt, Mycobacterium leprae
uggucagcaguucu

SEQ ID NO: 1228928 - RNA, 13 nt, Mycobacterium leprae
uggucaccgcugu

SEQ ID NO: 1228929 - RNA, 19 nt, Mycobacterium leprae
uggucagguccaacgcggc

SEQ ID NO: 1228930 - RNA, 13 nt, Mycobacterium leprae
uggcugcgccggc

SEQ ID NO: 1228931 - RNA, 15 nt, Mycobacterium leprae
ugggcacggagcggc

SEQ ID NO: 1228932 - RNA, 15 nt, Mycobacterium leprae
ugggcauccugcugu

SEQ ID NO: 1228933 - RNA, 19 nt, Mycobacterium leprae
ugggcagcuugaacgccgc

SEQ ID NO: 1228934 - RNA, 12 nt, Mycobacterium leprae
ugggaucgacac

SEQ ID NO: 1228935 - RNA, 13 nt, Mycobacterium leprae
uggcgucgguggc

SEQ ID NO: 1228936 - RNA, 17 nt, Mycobacterium leprae
uggcugacucgacauag

SEQ ID NO: 1228937 - RNA, 16 nt, Mycobacterium leprae
uggcucgauuccagcu

SEQ ID NO: 1228938 - RNA, 16 nt, Mycobacterium leprae
uggcaucggcauugcc

SEQ ID NO: 1228939 - RNA, 18 nt, Mycobacterium leprae
uggcgaccgcaccggcga

SEQ ID NO: 1228940 - RNA, 14 nt, Mycobacterium leprae
uggcgaacaacaaa

SEQ ID NO: 1228941 - RNA, 17 nt, Mycobacterium leprae
uggccuugaggugucgg

SEQ ID NO: 1228942 - RNA, 18 nt, Mycobacterium leprae
uggccuuaauagaccagc

SEQ ID NO: 1228943 - RNA, 12 nt, Mycobacterium leprae
uggcgcggcacg

SEQ ID NO: 1228944 - RNA, 15 nt, Mycobacterium leprae
uggcgcggcacguuc

SEQ ID NO: 1228945 - RNA, 22 nt, Mycobacterium leprae
uggcgcagaccucuuccgccgc

SEQ ID NO: 1228946 - RNA, 22 nt, Mycobacterium leprae
aauugaauccgcugcccugggu

SEQ ID NO: 1228947 - RNA, 13 nt, Mycobacterium leprae
aaugcugagcgaa

SEQ ID NO: 1228948 - RNA, 14 nt, Mycobacterium leprae
aaugccgguggcca

SEQ ID NO: 1228949 - RNA, 23 nt, Mycobacterium leprae
aaugcuaugauaauuuggcugau

SEQ ID NO: 1228950 - RNA, 19 nt, Mycobacterium leprae
aaucuccgagcguacuggu

SEQ ID NO: 1228951 - RNA, 14 nt, Mycobacterium leprae
aaucugaugacgcg

SEQ ID NO: 1228952 - RNA, 20 nt, Mycobacterium leprae
aaucugcgucaucgacucga

SEQ ID NO: 1228953 - RNA, 15 nt, Mycobacterium leprae
aaugcauuggaugag

SEQ ID NO: 1228954 - RNA, 17 nt, Mycobacterium leprae
uuucgucgucagcugcu

SEQ ID NO: 1228955 - RNA, 14 nt, Mycobacterium leprae
uuucagccgggcua

SEQ ID NO: 1228956 - RNA, 18 nt, Mycobacterium leprae
uuucgauccgcucaaagc

SEQ ID NO: 1228957 - RNA, 18 nt, Mycobacterium leprae
uuuagaggcugcaccggc

SEQ ID NO: 1228958 - RNA, 20 nt, Mycobacterium leprae
uuguucgguugguuucauag

SEQ ID NO: 1228959 - RNA, 16 nt, Mycobacterium leprae
uuguuagcgccgcggg

SEQ ID NO: 1228960 - RNA, 17 nt, Mycobacterium leprae
aaucgaaaaaugccgga

SEQ ID NO: 1228961 - RNA, 17 nt, Mycobacterium leprae
aauccugagaugccagc

SEQ ID NO: 1228962 - RNA, 17 nt, Mycobacterium leprae
aauccucacccgcgauc

SEQ ID NO: 1228963 - RNA, 18 nt, Mycobacterium leprae
uugggcgccucgucggcc

SEQ ID NO: 1228964 - RNA, 21 nt, Mycobacterium leprae
uugggccguacaaccgcgaug

SEQ ID NO: 1228965 - RNA, 17 nt, Mycobacterium leprae
uugggccaucggcagau

SEQ ID NO: 1228966 - RNA, 16 nt, Mycobacterium leprae
uuguagcguucguaga

SEQ ID NO: 1228967 - RNA, 18 nt, Mycobacterium leprae
uuggcuuguguggugucc

SEQ ID NO: 1228968 - RNA, 20 nt, Mycobacterium leprae
uugggagugcuagcggcgcc

SEQ ID NO: 1228969 - RNA, 20 nt, Mycobacterium leprae
uuggacaacacguuucugca

SEQ ID NO: 1228970 - RNA, 23 nt, Mycobacterium leprae
uuggcccaccgccggacggcacc

SEQ ID NO: 1228971 - RNA, 12 nt, Mycobacterium leprae
uuggccgcggca

SEQ ID NO: 1228972 - RNA, 22 nt, Mycobacterium leprae
uugcgacgaccuccucgggggu

SEQ ID NO: 1228973 - RNA, 21 nt, Mycobacterium leprae
uugcucugggcgcggacauac

SEQ ID NO: 1228974 - RNA, 12 nt, Mycobacterium leprae
uugagcggcacc

SEQ ID NO: 1228975 - RNA, 18 nt, Mycobacterium leprae
uucuaguugauaugcguu

SEQ ID NO: 1228976 - RNA, 20 nt, Mycobacterium leprae
uucggucacgggucggcggg

SEQ ID NO: 1228977 - RNA, 19 nt, Mycobacterium leprae
uucgguccgcucaccgcgg

SEQ ID NO: 1228978 - RNA, 15 nt, Mycobacterium leprae
uucgguagucguggg

SEQ ID NO: 1228979 - RNA, 19 nt, Mycobacterium leprae
uucugcacaacgauacguu

SEQ ID NO: 1228980 - RNA, 20 nt, Mycobacterium leprae
uuccucgcgggcggcgugau

SEQ ID NO: 1228981 - RNA, 17 nt, Mycobacterium leprae
uuccggagacggcagcg

SEQ ID NO: 1228982 - RNA, 16 nt, Mycobacterium leprae
uucaguucacgcuggc

SEQ ID NO: 1228983 - RNA, 21 nt, Mycobacterium leprae
uucgcuaacuucccgacggug

SEQ ID NO: 1228984 - RNA, 16 nt, Mycobacterium leprae
uucgccuuagcacguc

SEQ ID NO: 1228985 - RNA, 16 nt, Mycobacterium leprae
uucggcgcacacccgg

SEQ ID NO: 1228986 - RNA, 12 nt, Mycobacterium leprae
uucgccgcggcc

SEQ ID NO: 1228987 - RNA, 18 nt, Mycobacterium leprae
uucgacggcaacggcacc

SEQ ID NO: 1228988 - RNA, 15 nt, Mycobacterium leprae
uucgacgaucaccgc

SEQ ID NO: 1228989 - RNA, 14 nt, Mycobacterium leprae
uuauucuaggcgau

SEQ ID NO: 1228990 - RNA, 18 nt, Mycobacterium leprae
uuacuggcaugagccgac

SEQ ID NO: 1228991 - RNA, 17 nt, Mycobacterium leprae
uucaacaaaaccaucgu

SEQ ID NO: 1228992 - RNA, 16 nt, Mycobacterium leprae
uuauuugcgucguggg

SEQ ID NO: 1228993 - RNA, 16 nt, Mycobacterium leprae
uucacaugucccggug

SEQ ID NO: 1228994 - RNA, 22 nt, Mycobacterium leprae
uucagcgaagaguuucugcugc

SEQ ID NO: 1228995 - RNA, 22 nt, Mycobacterium leprae
uucagccgggcuaaggugcguu

SEQ ID NO: 1228996 - RNA, 13 nt, Mycobacterium leprae
uucagccgucgcu

SEQ ID NO: 1228997 - RNA, 14 nt, Mycobacterium leprae
uguuggucgccagu

SEQ ID NO: 1228998 - RNA, 13 nt, Mycobacterium leprae
uguugcugagugu

SEQ ID NO: 1228999 - RNA, 14 nt, Mycobacterium leprae
uguuggccagcagc

SEQ ID NO: 1229000 - RNA, 22 nt, Mycobacterium leprae
ugugugaccagccauccgaaac

SEQ ID NO: 1229001 - RNA, 16 nt, Mycobacterium leprae
uguggugggcuggugg

SEQ ID NO: 1229002 - RNA, 12 nt, Mycobacterium leprae
uuacccgcggug

SEQ ID NO: 1229003 - RNA, 15 nt, Mycobacterium leprae
uguuucucgccgacc

SEQ ID NO: 1229004 - RNA, 17 nt, Mycobacterium leprae
acuuuguacgacgaccu

SEQ ID NO: 1229005 - RNA, 16 nt, Mycobacterium leprae
acuuuccugaccgcgg

SEQ ID NO: 1229006 - RNA, 15 nt, Mycobacterium leprae
acuugacggucgagc

SEQ ID NO: 1229007 - RNA, 21 nt, Mycobacterium leprae
acuugaaaccggccgcggugg

SEQ ID NO: 1229008 - RNA, 19 nt, Mycobacterium leprae
acuucuggaucuagccggg

SEQ ID NO: 1229009 - RNA, 21 nt, Mycobacterium leprae
acuugcacuaugucgaucggc

SEQ ID NO: 1229010 - RNA, 21 nt, Mycobacterium leprae
acugugcuaaccgggccaacu

SEQ ID NO: 1229011 - RNA, 19 nt, Mycobacterium leprae
acuguugucaguggcgacg

SEQ ID NO: 1229012 - RNA, 19 nt, Mycobacterium leprae
acugucaaugcaggugguc

SEQ ID NO: 1229013 - RNA, 21 nt, Mycobacterium leprae
acuguccacucggacaccggg

SEQ ID NO: 1229014 - RNA, 23 nt, Mycobacterium leprae
acuucgcccucuuugaucagcaa

SEQ ID NO: 1229015 - RNA, 20 nt, Mycobacterium leprae
acuucgcugagcgaagucga

SEQ ID NO: 1229016 - RNA, 17 nt, Mycobacterium leprae
acucgugcgucgucuca

SEQ ID NO: 1229017 - RNA, 18 nt, Mycobacterium leprae
acugacggagcaagcgcu

SEQ ID NO: 1229018 - RNA, 19 nt, Mycobacterium leprae
acugacccaagcgccagcu

SEQ ID NO: 1229019 - RNA, 19 nt, Mycobacterium leprae
acucggccgccagguccac

SEQ ID NO: 1229020 - RNA, 15 nt, Mycobacterium leprae
acucaauggccugcu

SEQ ID NO: 1229021 - RNA, 20 nt, Mycobacterium leprae
acucagugguggggccgcca

SEQ ID NO: 1229022 - RNA, 18 nt, Mycobacterium leprae
acucagaaaucguucgac

SEQ ID NO: 1229023 - RNA, 13 nt, Mycobacterium leprae
acuggauaugccg

SEQ ID NO: 1229024 - RNA, 14 nt, Mycobacterium leprae
acugcuagccggcu

SEQ ID NO: 1229025 - RNA, 22 nt, Mycobacterium leprae
acugcacggcgugcaggcaguc

SEQ ID NO: 1229026 - RNA, 17 nt, Mycobacterium leprae
acugcacgaccacacug

SEQ ID NO: 1229027 - RNA, 22 nt, Mycobacterium leprae
acugguggcagccacagcgacg

SEQ ID NO: 1229028 - RNA, 15 nt, Mycobacterium leprae
acuggcgaccgcacg

SEQ ID NO: 1229029 - RNA, 21 nt, Mycobacterium leprae
acgugacugcggcucaccgac

SEQ ID NO: 1229030 - RNA, 12 nt, Mycobacterium leprae
acguggcggugu

SEQ ID NO: 1229031 - RNA, 18 nt, Mycobacterium leprae
acguguugauagcgcugg

SEQ ID NO: 1229032 - RNA, 19 nt, Mycobacterium leprae
acgugucuucgaccgacau

SEQ ID NO: 1229033 - RNA, 18 nt, Mycobacterium leprae
acgugugugacggcuggu

SEQ ID NO: 1229034 - RNA, 16 nt, Mycobacterium leprae
acguguaaggccagcg

SEQ ID NO: 1229035 - RNA, 16 nt, Mycobacterium leprae
acgugccaacucggcc

SEQ ID NO: 1229036 - RNA, 17 nt, Mycobacterium leprae
acuaucgugugcugauc

SEQ ID NO: 1229037 - RNA, 14 nt, Mycobacterium leprae
acuaccaaugagca

SEQ ID NO: 1229038 - RNA, 12 nt, Mycobacterium leprae
acguugcugcug

SEQ ID NO: 1229039 - RNA, 17 nt, Mycobacterium leprae
acguugcgcacugcccg

SEQ ID NO: 1229040 - RNA, 18 nt, Mycobacterium leprae
acguugcgcacugcccgg

SEQ ID NO: 1229041 - RNA, 17 nt, Mycobacterium leprae
acuaauccagacaucgg

SEQ ID NO: 1229042 - RNA, 16 nt, Mycobacterium leprae
acguagaacaagugca

SEQ ID NO: 1229043 - RNA, 15 nt, Mycobacterium leprae
acgucuagcgaacac

SEQ ID NO: 1229044 - RNA, 20 nt, Mycobacterium leprae
acgucgccgguagcagcggu

SEQ ID NO: 1229045 - RNA, 20 nt, Mycobacterium leprae
acggcgguguuucucgccga

SEQ ID NO: 1229046 - RNA, 15 nt, Mycobacterium leprae
acggcguggucggcg

SEQ ID NO: 1229047 - RNA, 21 nt, Mycobacterium leprae
acggcaccaaacccgccgguc

SEQ ID NO: 1229048 - RNA, 19 nt, Mycobacterium leprae
acggcaacggcaccaaacc

SEQ ID NO: 1229049 - RNA, 20 nt, Mycobacterium leprae
acggcuuaaguaggcgguca

SEQ ID NO: 1229050 - RNA, 17 nt, Mycobacterium leprae
acggggucgucggccag

SEQ ID NO: 1229051 - RNA, 16 nt, Mycobacterium leprae
acgguccugguggcaa

SEQ ID NO: 1229052 - RNA, 21 nt, Mycobacterium leprae
acggugccgaauucgcccgag

SEQ ID NO: 1229053 - RNA, 13 nt, Mycobacterium leprae
acgaggcggugac

SEQ ID NO: 1229054 - RNA, 15 nt, Mycobacterium leprae
acgauacugcugcac

SEQ ID NO: 1229055 - RNA, 15 nt, Mycobacterium leprae
acgagaaugucgcac

SEQ ID NO: 1229056 - RNA, 16 nt, Mycobacterium leprae
acgagaccaguugcac

SEQ ID NO: 1229057 - RNA, 14 nt, Mycobacterium leprae
acgagacacugacg

SEQ ID NO: 1229058 - RNA, 21 nt, Mycobacterium leprae
acgacagccgcaaucgccgac

SEQ ID NO: 1229059 - RNA, 14 nt, Mycobacterium leprae
acgacguagcccac

SEQ ID NO: 1229060 - RNA, 22 nt, Mycobacterium leprae
acgacgucaaggggacugcgaa

SEQ ID NO: 1229061 - RNA, 22 nt, Mycobacterium leprae
acgaccaaaccucugcaaccga

SEQ ID NO: 1229062 - RNA, 18 nt, Mycobacterium leprae
acgacggcuuugcugucg

SEQ ID NO: 1229063 - RNA, 18 nt, Mycobacterium leprae
acgacauugugggccgcu

SEQ ID NO: 1229064 - RNA, 19 nt, Mycobacterium leprae
accuggugugcgcgccgcc

SEQ ID NO: 1229065 - RNA, 23 nt, Mycobacterium leprae
acgaaaccaugccgccgaagccg

SEQ ID NO: 1229066 - RNA, 22 nt, Mycobacterium leprae
acgaacugggugaccacccaca

SEQ ID NO: 1229067 - RNA, 19 nt, Mycobacterium leprae
acgcaagagaaaaccaagc

SEQ ID NO: 1229068 - RNA, 17 nt, Mycobacterium leprae
acgaucgggaugccgaa

SEQ ID NO: 1229069 - RNA, 19 nt, Mycobacterium leprae
acgcaugacacccccggga

SEQ ID NO: 1229070 - RNA, 19 nt, Mycobacterium leprae
acgcauuugaagcgguuga

SEQ ID NO: 1229071 - RNA, 23 nt, Mycobacterium leprae
acgcucggugagauagcggcggu

SEQ ID NO: 1229072 - RNA, 16 nt, Mycobacterium leprae
acgcugaaaccggggu

SEQ ID NO: 1229073 - RNA, 18 nt, Mycobacterium leprae
acgcugauaaggucuggc

SEQ ID NO: 1229074 - RNA, 18 nt, Mycobacterium leprae
acgcugauugccaacuca

SEQ ID NO: 1229075 - RNA, 21 nt, Mycobacterium leprae
acgcugauggcacuacccgac

SEQ ID NO: 1229076 - RNA, 17 nt, Mycobacterium leprae
acgcucaacuguucggc

SEQ ID NO: 1229077 - RNA, 13 nt, Mycobacterium leprae
acgcgugcggcgc

SEQ ID NO: 1229078 - RNA, 18 nt, Mycobacterium leprae
acgcgguugccggcggaa

SEQ ID NO: 1229079 - RNA, 17 nt, Mycobacterium leprae
acgcgaacgugcugcug

SEQ ID NO: 1229080 - RNA, 20 nt, Mycobacterium leprae
acgcgcgacaguaucgacca

SEQ ID NO: 1229081 - RNA, 14 nt, Mycobacterium leprae
acgcgacgccgcca

SEQ ID NO: 1229082 - RNA, 13 nt, Mycobacterium leprae
acgcggcggcggc

SEQ ID NO: 1229083 - RNA, 21 nt, Mycobacterium leprae
acgccggggaaccuggaccga

SEQ ID NO: 1229084 - RNA, 18 nt, Mycobacterium leprae
acgccggcggccaccgcg

SEQ ID NO: 1229085 - RNA, 17 nt, Mycobacterium leprae
acgccggcgucgcaccg

SEQ ID NO: 1229086 - RNA, 22 nt, Mycobacterium leprae
acgccgggcacuugggucaccg

SEQ ID NO: 1229087 - RNA, 14 nt, Mycobacterium leprae
acacaguuguuggc

SEQ ID NO: 1229088 - RNA, 18 nt, Mycobacterium leprae
acaccagacguucuagaa

SEQ ID NO: 1229089 - RNA, 14 nt, Mycobacterium leprae
acacgacagccgca

SEQ ID NO: 1229090 - RNA, 20 nt, Mycobacterium leprae
acagcaagauuacccgcggu

SEQ ID NO: 1229091 - RNA, 16 nt, Mycobacterium leprae
acagaugcgaucgcag

SEQ ID NO: 1229092 - RNA, 19 nt, Mycobacterium leprae
acagagcugauggccgcca

SEQ ID NO: 1229093 - RNA, 18 nt, Mycobacterium leprae
acagagcgcucggcgugc

SEQ ID NO: 1229094 - RNA, 15 nt, Mycobacterium leprae
acagagcaagccgca

SEQ ID NO: 1229095 - RNA, 19 nt, Mycobacterium leprae
acagcaucggcaacgcugu

SEQ ID NO: 1229096 - RNA, 15 nt, Mycobacterium leprae
acagcaggucgccga

SEQ ID NO: 1229097 - RNA, 15 nt, Mycobacterium leprae
acagcguucgaccca

SEQ ID NO: 1229098 - RNA, 17 nt, Mycobacterium leprae
acagcuggcuugucggc

SEQ ID NO: 1229099 - RNA, 16 nt, Mycobacterium leprae
acagcuucggucuggc

SEQ ID NO: 1229100 - RNA, 18 nt, Mycobacterium leprae
acaggcgcguuugucggc

SEQ ID NO: 1229101 - RNA, 17 nt, Mycobacterium leprae
acauccaaccaauugcc

SEQ ID NO: 1229102 - RNA, 14 nt, Mycobacterium leprae
acaucgccaccgac

SEQ ID NO: 1229103 - RNA, 21 nt, Mycobacterium leprae
acauguagaccaagcagcauc

SEQ ID NO: 1229104 - RNA, 15 nt, Mycobacterium leprae
acauggcgaucugca

SEQ ID NO: 1229105 - RNA, 21 nt, Mycobacterium leprae
accauaacacuacuugcgcuc

SEQ ID NO: 1229106 - RNA, 17 nt, Mycobacterium leprae
accaucgaaacugccaa

SEQ ID NO: 1229107 - RNA, 22 nt, Mycobacterium leprae
accauccggcgggcgugcuguc

SEQ ID NO: 1229108 - RNA, 19 nt, Mycobacterium leprae
accaucagaaaaccgucgc

SEQ ID NO: 1229109 - RNA, 20 nt, Mycobacterium leprae
accacaaagucaucggcgca

SEQ ID NO: 1229110 - RNA, 14 nt, Mycobacterium leprae
accacaagcaacug

SEQ ID NO: 1229111 - RNA, 18 nt, Mycobacterium leprae
accacgcgacaucgugga

SEQ ID NO: 1229112 - RNA, 17 nt, Mycobacterium leprae
accacgcaaugucgccg

SEQ ID NO: 1229113 - RNA, 21 nt, Mycobacterium leprae
accagauuggaaaucgcucga

SEQ ID NO: 1229114 - RNA, 14 nt, Mycobacterium leprae
accagccagaccaa

SEQ ID NO: 1229115 - RNA, 15 nt, Mycobacterium leprae
acccgguugucgacg

SEQ ID NO: 1229116 - RNA, 23 nt, Mycobacterium leprae
acccuggcugggcugcugccgaa

SEQ ID NO: 1229117 - RNA, 17 nt, Mycobacterium leprae
acccuccucgcggcggu

SEQ ID NO: 1229118 - RNA, 21 nt, Mycobacterium leprae
acccuccugcagguugcuguc

SEQ ID NO: 1229119 - RNA, 12 nt, Mycobacterium leprae
acccggucgucu

SEQ ID NO: 1229120 - RNA, 17 nt, Mycobacterium leprae
acccggucgucuccguc

SEQ ID NO: 1229121 - RNA, 21 nt, Mycobacterium leprae
acccgcuggugcguggcgacc

SEQ ID NO: 1229122 - RNA, 22 nt, Mycobacterium leprae
acccgcacaguuaccacgacgu

SEQ ID NO: 1229123 - RNA, 21 nt, Mycobacterium leprae
acccgcagcaccuugggcgcc

SEQ ID NO: 1229124 - RNA, 21 nt, Mycobacterium leprae
accgacguauccaaggugaug

SEQ ID NO: 1229125 - RNA, 22 nt, Mycobacterium leprae
accgaagaucaccgccaccacg

SEQ ID NO: 1229126 - RNA, 15 nt, Mycobacterium leprae
accgauacgccaguc

SEQ ID NO: 1229127 - RNA, 15 nt, Mycobacterium leprae
accgauauccggccu

SEQ ID NO: 1229128 - RNA, 20 nt, Mycobacterium leprae
accgaugcucgcccucggac

SEQ ID NO: 1229129 - RNA, 22 nt, Mycobacterium leprae
accgaucgugaagauaggucgc

SEQ ID NO: 1229130 - RNA, 21 nt, Mycobacterium leprae
accgauccggcggccggcaag

SEQ ID NO: 1229131 - RNA, 18 nt, Mycobacterium leprae
accgcacagagcccagca

SEQ ID NO: 1229132 - RNA, 23 nt, Mycobacterium leprae
accgcaaucgaaaaaugccggaa

SEQ ID NO: 1229133 - RNA, 21 nt, Mycobacterium leprae
accgcaccgaucugcccagca

SEQ ID NO: 1229134 - RNA, 19 nt, Mycobacterium leprae
accgccaccuaggccugcu

SEQ ID NO: 1229135 - RNA, 20 nt, Mycobacterium leprae
accgccgccauccuugccga

SEQ ID NO: 1229136 - RNA, 23 nt, Mycobacterium leprae
accguacugaacgagaagcagcu

SEQ ID NO: 1229137 - RNA, 22 nt, Mycobacterium leprae
accgguugccgaaccucgccac

SEQ ID NO: 1229138 - RNA, 15 nt, Mycobacterium leprae
accggugauguggcc

SEQ ID NO: 1229139 - RNA, 16 nt, Mycobacterium leprae
accgggaugugugcgc

SEQ ID NO: 1229140 - RNA, 21 nt, Mycobacterium leprae
accgggcagcgccacgccgga

SEQ ID NO: 1229141 - RNA, 16 nt, Mycobacterium leprae
accguucguuuggguu

SEQ ID NO: 1229142 - RNA, 20 nt, Mycobacterium leprae
accgugguguugucgccgaa

SEQ ID NO: 1229143 - RNA, 21 nt, Mycobacterium leprae
accgugcagcugccaaccggu

SEQ ID NO: 1229144 - RNA, 22 nt, Mycobacterium leprae
accgugcagcugccaaccggug

SEQ ID NO: 1229145 - RNA, 24 nt, Mycobacterium leprae
accguggccggcccccguaugauc

SEQ ID NO: 1229146 - RNA, 20 nt, Mycobacterium leprae
accgucgggccugaguggug

SEQ ID NO: 1229147 - RNA, 21 nt, Mycobacterium leprae
accgucgggaucgcucgucac

SEQ ID NO: 1229148 - RNA, 19 nt, Mycobacterium leprae
accgucgaagugcgccagc

SEQ ID NO: 1229149 - RNA, 16 nt, Mycobacterium leprae
accguccucggcggca

SEQ ID NO: 1229150 - RNA, 18 nt, Mycobacterium leprae
accggcguuuccaaaacc

SEQ ID NO: 1229151 - RNA, 10 nt, Mycobacterium leprae
accggcgucu

SEQ ID NO: 1229152 - RNA, 13 nt, Mycobacterium leprae
accggccaccacg

SEQ ID NO: 1229153 - RNA, 15 nt, Mycobacterium leprae
accggcauggccgcu

SEQ ID NO: 1229154 - RNA, 22 nt, Mycobacterium leprae
accggaauguccaccagccgca

SEQ ID NO: 1229155 - RNA, 17 nt, Mycobacterium leprae
accggaauuccgacgaa

SEQ ID NO: 1229156 - RNA, 20 nt, Mycobacterium leprae
accggaauuccgacgaaggu

SEQ ID NO: 1229157 - RNA, 14 nt, Mycobacterium leprae
accgcguaacagau

SEQ ID NO: 1229158 - RNA, 20 nt, Mycobacterium leprae
accgcggggcuaugccgcgc

SEQ ID NO: 1229159 - RNA, 18 nt, Mycobacterium leprae
accgccgguuucgcccca

SEQ ID NO: 1229160 - RNA, 15 nt, Mycobacterium leprae
accgcggaucgcagu

SEQ ID NO: 1229161 - RNA, 13 nt, Mycobacterium leprae
accgcggauucca

SEQ ID NO: 1229162 - RNA, 19 nt, Mycobacterium leprae
aucucgaccgcgcgcuccg

SEQ ID NO: 1229163 - RNA, 23 nt, Mycobacterium leprae
aucuaguggucgauuacucacgc

SEQ ID NO: 1229164 - RNA, 20 nt, Mycobacterium leprae
aucgucuaccggcgcggauc

SEQ ID NO: 1229165 - RNA, 20 nt, Mycobacterium leprae
aucgucucgcuccacaucgu

SEQ ID NO: 1229166 - RNA, 18 nt, Mycobacterium leprae
aucgucucgggcgguuga

SEQ ID NO: 1229167 - RNA, 21 nt, Mycobacterium leprae
aucggcucccaucggcggcca

SEQ ID NO: 1229168 - RNA, 23 nt, Mycobacterium leprae
aucggcucccaucggcggccagc

SEQ ID NO: 1229169 - RNA, 22 nt, Mycobacterium leprae
aucggcguacguaugccgccaa

SEQ ID NO: 1229170 - RNA, 19 nt, Mycobacterium leprae
aucggcuacggcaaccgca

SEQ ID NO: 1229171 - RNA, 16 nt, Mycobacterium leprae
aucuuggugaugucga

SEQ ID NO: 1229172 - RNA, 21 nt, Mycobacterium leprae
aucuuggcccggcuccggugu

SEQ ID NO: 1229173 - RNA, 21 nt, Mycobacterium leprae
aucuggcgacucggcgccauc

SEQ ID NO: 1229174 - RNA, 19 nt, Mycobacterium leprae
aucuggggaaugucgaugg

SEQ ID NO: 1229175 - RNA, 21 nt, Mycobacterium leprae
aucugcgucgcccucgccggc

SEQ ID NO: 1229176 - RNA, 14 nt, Mycobacterium leprae
aucugcucggcgaa

SEQ ID NO: 1229177 - RNA, 15 nt, Mycobacterium leprae
augaguuucggcgcc

SEQ ID NO: 1229178 - RNA, 17 nt, Mycobacterium leprae
augacacugcggcugcg

SEQ ID NO: 1229179 - RNA, 16 nt, Mycobacterium leprae
aucuuuucggcugcac

SEQ ID NO: 1229180 - RNA, 18 nt, Mycobacterium leprae
auccucggcacagugacg

SEQ ID NO: 1229181 - RNA, 21 nt, Mycobacterium leprae
auccugcagcaucaggguacu

SEQ ID NO: 1229182 - RNA, 23 nt, Mycobacterium leprae
aucgaauugaccgacggcgccgc

SEQ ID NO: 1229183 - RNA, 16 nt, Mycobacterium leprae
aucgacacggcgaccg

SEQ ID NO: 1229184 - RNA, 20 nt, Mycobacterium leprae
aucgacacggcgaccgacug

SEQ ID NO: 1229185 - RNA, 17 nt, Mycobacterium leprae
aucgacaccucaccauc

SEQ ID NO: 1229186 - RNA, 13 nt, Mycobacterium leprae
aucgacauccuga

SEQ ID NO: 1229187 - RNA, 16 nt, Mycobacterium leprae
auccgacaaagcagca

SEQ ID NO: 1229188 - RNA, 14 nt, Mycobacterium leprae
auccgaaacccgaa

SEQ ID NO: 1229189 - RNA, 20 nt, Mycobacterium leprae
auccgaucaauggcagccac

SEQ ID NO: 1229190 - RNA, 21 nt, Mycobacterium leprae
auccgagaaaacucgaucgag

SEQ ID NO: 1229191 - RNA, 13 nt, Mycobacterium leprae
auccgccgauccc

SEQ ID NO: 1229192 - RNA, 19 nt, Mycobacterium leprae
auccggcacaucgaaccga

SEQ ID NO: 1229193 - RNA, 14 nt, Mycobacterium leprae
aucgagcggagcug

SEQ ID NO: 1229194 - RNA, 15 nt, Mycobacterium leprae
aucgacggccgcaca

SEQ ID NO: 1229195 - RNA, 21 nt, Mycobacterium leprae
aucgagaagggagugcagugc

SEQ ID NO: 1229196 - RNA, 12 nt, Mycobacterium leprae
aucgccgaugac

SEQ ID NO: 1229197 - RNA, 15 nt, Mycobacterium leprae
aucgccggcguugau

SEQ ID NO: 1229198 - RNA, 21 nt, Mycobacterium leprae
aucggcgcagacuagucgaga

SEQ ID NO: 1229199 - RNA, 13 nt, Mycobacterium leprae
aucggcggccagc

SEQ ID NO: 1229200 - RNA, 17 nt, Mycobacterium leprae
aucggcacuucgcugag

SEQ ID NO: 1229201 - RNA, 22 nt, Mycobacterium leprae
aucggcagaucgaucucgacgg

SEQ ID NO: 1229202 - RNA, 20 nt, Mycobacterium leprae
auugaucguccgcaaccgau

SEQ ID NO: 1229203 - RNA, 15 nt, Mycobacterium leprae
auugcauuggcugau

SEQ ID NO: 1229204 - RNA, 16 nt, Mycobacterium leprae
auugcaugcaccgacg

SEQ ID NO: 1229205 - RNA, 21 nt, Mycobacterium leprae
auugccauccucgaugguguc

SEQ ID NO: 1229206 - RNA, 18 nt, Mycobacterium leprae
auugacgaaacggcgucg

SEQ ID NO: 1229207 - RNA, 19 nt, Mycobacterium leprae
auugacaaaagugcaguga

SEQ ID NO: 1229208 - RNA, 15 nt, Mycobacterium leprae
auugggucaucggcg

SEQ ID NO: 1229209 - RNA, 21 nt, Mycobacterium leprae
auugucgguguugaucgaccg

SEQ ID NO: 1229210 - RNA, 21 nt, Mycobacterium leprae
auugcguugaccgccgccauc

SEQ ID NO: 1229211 - RNA, 15 nt, Mycobacterium leprae
auuggcucgacauug

SEQ ID NO: 1229212 - RNA, 22 nt, Mycobacterium leprae
auugcucgguauuugcggugga

SEQ ID NO: 1229213 - RNA, 22 nt, Mycobacterium leprae
auugcuggugccccagucgcca

SEQ ID NO: 1229214 - RNA, 17 nt, Mycobacterium leprae
auuccugcagccgaucg

SEQ ID NO: 1229215 - RNA, 21 nt, Mycobacterium leprae
auucgcucgccgggguauagu

SEQ ID NO: 1229216 - RNA, 16 nt, Mycobacterium leprae
auucuaggcgaucgag

SEQ ID NO: 1229217 - RNA, 22 nt, Mycobacterium leprae
auucgucgaguaaugcagguga

SEQ ID NO: 1229218 - RNA, 13 nt, Mycobacterium leprae
auucgugguggug

SEQ ID NO: 1229219 - RNA, 15 nt, Mycobacterium leprae
auucguggugguggc

SEQ ID NO: 1229220 - RNA, 18 nt, Mycobacterium leprae
auucggucacgggucggc

SEQ ID NO: 1229221 - RNA, 22 nt, Mycobacterium leprae
auggaucaguuugccgucggga

SEQ ID NO: 1229222 - RNA, 15 nt, Mycobacterium leprae
auggacagaacaccc

SEQ ID NO: 1229223 - RNA, 15 nt, Mycobacterium leprae
auggcacugccgauc

SEQ ID NO: 1229224 - RNA, 22 nt, Mycobacterium leprae
auggcaguccacaggacuucaa

SEQ ID NO: 1229225 - RNA, 21 nt, Mycobacterium leprae
auggccagccgucccacgcca

SEQ ID NO: 1229226 - RNA, 19 nt, Mycobacterium leprae
augcgcagccgcgguaacg

SEQ ID NO: 1229227 - RNA, 18 nt, Mycobacterium leprae
augcugcgcagagcgcug

SEQ ID NO: 1229228 - RNA, 18 nt, Mycobacterium leprae
augcggcgggaucgccga

SEQ ID NO: 1229229 - RNA, 21 nt, Mycobacterium leprae
augcggggggagagacgucga

SEQ ID NO: 1229230 - RNA, 20 nt, Mycobacterium leprae
augcgguagucuaucccggc

SEQ ID NO: 1229231 - RNA, 17 nt, Mycobacterium leprae
auguaaucguaccaaca

SEQ ID NO: 1229232 - RNA, 14 nt, Mycobacterium leprae
auguauccaggauu

SEQ ID NO: 1229233 - RNA, 12 nt, Mycobacterium leprae
augguuggcaga

SEQ ID NO: 1229234 - RNA, 21 nt, Mycobacterium leprae
augggggugggaaaagcaggc

SEQ ID NO: 1229235 - RNA, 22 nt, Mycobacterium leprae
augugccacgucgaucagcggc

SEQ ID NO: 1229236 - RNA, 22 nt, Mycobacterium leprae
augucgguggugggugcugcuu

SEQ ID NO: 1229237 - RNA, 17 nt, Mycobacterium leprae
augucacuucccaccgu

SEQ ID NO: 1229238 - RNA, 21 nt, Mycobacterium leprae
augucggccacugcacgacca

SEQ ID NO: 1229239 - RNA, 17 nt, Mycobacterium leprae
augucggcgcgacugca

SEQ ID NO: 1229240 - RNA, 19 nt, Mycobacterium leprae
caaacuggucaacgcagcg

SEQ ID NO: 1229241 - RNA, 14 nt, Mycobacterium leprae
caaacugcugcgca

SEQ ID NO: 1229242 - RNA, 22 nt, Mycobacterium leprae
caaacgucguccgguggucgcg

SEQ ID NO: 1229243 - RNA, 21 nt, Mycobacterium leprae
caaaccaggcgacacgcgcga

SEQ ID NO: 1229244 - RNA, 14 nt, Mycobacterium leprae
caaaucaccagcga

SEQ ID NO: 1229245 - RNA, 15 nt, Mycobacterium leprae
caaaucaccagcgac

SEQ ID NO: 1229246 - RNA, 17 nt, Mycobacterium leprae
caacacccaggucggug

SEQ ID NO: 1229247 - RNA, 18 nt, Mycobacterium leprae
caacccggcagaggcacc

SEQ ID NO: 1229248 - RNA, 14 nt, Mycobacterium leprae
caaccgccggcaag

SEQ ID NO: 1229249 - RNA, 23 nt, Mycobacterium leprae
caaccguucgagccccggaacgg

SEQ ID NO: 1229250 - RNA, 13 nt, Mycobacterium leprae
caacacgaucgca

SEQ ID NO: 1229251 - RNA, 22 nt, Mycobacterium leprae
caacacgaucgcagcccagauu

SEQ ID NO: 1229252 - RNA, 17 nt, Mycobacterium leprae
caaccaaucuccggugg

SEQ ID NO: 1229253 - RNA, 20 nt, Mycobacterium leprae
caacgugugugacggcuggu

SEQ ID NO: 1229254 - RNA, 20 nt, Mycobacterium leprae
caacgugggcgauucgggcc

SEQ ID NO: 1229255 - RNA, 21 nt, Mycobacterium leprae
caacguagggaugaucgaucc

SEQ ID NO: 1229256 - RNA, 23 nt, Mycobacterium leprae
caacgucacgucgacggcggccg

SEQ ID NO: 1229257 - RNA, 17 nt, Mycobacterium leprae
caacggcguggucggcg

SEQ ID NO: 1229258 - RNA, 20 nt, Mycobacterium leprae
caacggcuacggggugggca

SEQ ID NO: 1229259 - RNA, 14 nt, Mycobacterium leprae
caacgggaucgaca

SEQ ID NO: 1229260 - RNA, 15 nt, Mycobacterium leprae
caacgggaucgacaa

SEQ ID NO: 1229261 - RNA, 19 nt, Mycobacterium leprae
caacgcugcaaggugggcg

SEQ ID NO: 1229262 - RNA, 21 nt, Mycobacterium leprae
caacgcugcaaggugggcgau

SEQ ID NO: 1229263 - RNA, 15 nt, Mycobacterium leprae
caacggcggcaaggu

SEQ ID NO: 1229264 - RNA, 16 nt, Mycobacterium leprae
caagcucaucggcgac

SEQ ID NO: 1229265 - RNA, 14 nt, Mycobacterium leprae
caacucggccgcca

SEQ ID NO: 1229266 - RNA, 20 nt, Mycobacterium leprae
caagucagccuagcagcauc

SEQ ID NO: 1229267 - RNA, 20 nt, Mycobacterium leprae
caaguaagacagguaauuga

SEQ ID NO: 1229268 - RNA, 15 nt, Mycobacterium leprae
caaguaggguggguu

SEQ ID NO: 1229269 - RNA, 15 nt, Mycobacterium leprae
caaguagguuguucg

SEQ ID NO: 1229270 - RNA, 14 nt, Mycobacterium leprae
caagucggucgccg

SEQ ID NO: 1229271 - RNA, 16 nt, Mycobacterium leprae
caagucuuucagauac

SEQ ID NO: 1229272 - RNA, 23 nt, Mycobacterium leprae
caagugacugcguuucaugacga

SEQ ID NO: 1229273 - RNA, 20 nt, Mycobacterium leprae
caaguguguucuacccaggc

SEQ ID NO: 1229274 - RNA, 21 nt, Mycobacterium leprae
caaguggcugcuaugguuggu

SEQ ID NO: 1229275 - RNA, 19 nt, Mycobacterium leprae
caauaccgaccgaaagccg

SEQ ID NO: 1229276 - RNA, 17 nt, Mycobacterium leprae
caauaccuaucgacauc

SEQ ID NO: 1229277 - RNA, 14 nt, Mycobacterium leprae
caaugcagacacgc

SEQ ID NO: 1229278 - RNA, 19 nt, Mycobacterium leprae
caaucucggggguugaucc

SEQ ID NO: 1229279 - RNA, 14 nt, Mycobacterium leprae
caaucgacucacca

SEQ ID NO: 1229280 - RNA, 12 nt, Mycobacterium leprae
caauccguuguc

SEQ ID NO: 1229281 - RNA, 22 nt, Mycobacterium leprae
cacaaucacaaggagccaacga

SEQ ID NO: 1229282 - RNA, 12 nt, Mycobacterium leprae
cacaacgccgag

SEQ ID NO: 1229283 - RNA, 19 nt, Mycobacterium leprae
caauugcggccgaauucga

SEQ ID NO: 1229284 - RNA, 13 nt, Mycobacterium leprae
caauugacgccga

SEQ ID NO: 1229285 - RNA, 16 nt, Mycobacterium leprae
caauugacgccgaccg

SEQ ID NO: 1229286 - RNA, 17 nt, Mycobacterium leprae
caauugacgccgaccgc

SEQ ID NO: 1229287 - RNA, 23 nt, Mycobacterium leprae
caccuaguugguugccaagauac

SEQ ID NO: 1229288 - RNA, 18 nt, Mycobacterium leprae
caccucaaggccaugaca

SEQ ID NO: 1229289 - RNA, 16 nt, Mycobacterium leprae
caccguuguggaucga

SEQ ID NO: 1229290 - RNA, 22 nt, Mycobacterium leprae
caccguuguggaucgaccuccu

SEQ ID NO: 1229291 - RNA, 19 nt, Mycobacterium leprae
caccguggcaacgaccacc

SEQ ID NO: 1229292 - RNA, 18 nt, Mycobacterium leprae
caccguggucacgguugc

SEQ ID NO: 1229293 - RNA, 16 nt, Mycobacterium leprae
caccguccucggcggc

SEQ ID NO: 1229294 - RNA, 17 nt, Mycobacterium leprae
caccguccucggcggca

SEQ ID NO: 1229295 - RNA, 17 nt, Mycobacterium leprae
caccguaaacgucaugc

SEQ ID NO: 1229296 - RNA, 20 nt, Mycobacterium leprae
caccgguugccgaaccucgc

SEQ ID NO: 1229297 - RNA, 21 nt, Mycobacterium leprae
caccgguugccgaaccucgcc

SEQ ID NO: 1229298 - RNA, 23 nt, Mycobacterium leprae
caccggcgcuuguaaggccagca

SEQ ID NO: 1229299 - RNA, 23 nt, Mycobacterium leprae
caccggcggugucggcuaccaau

SEQ ID NO: 1229300 - RNA, 15 nt, Mycobacterium leprae
caccgcuacggcggu

SEQ ID NO: 1229301 - RNA, 15 nt, Mycobacterium leprae
caccggcauggccgc

SEQ ID NO: 1229302 - RNA, 18 nt, Mycobacterium leprae
caccggccaaaagccuug

SEQ ID NO: 1229303 - RNA, 21 nt, Mycobacterium leprae
caccgcggugcugagucggcg

SEQ ID NO: 1229304 - RNA, 20 nt, Mycobacterium leprae
caccgcggugagcggucgca

SEQ ID NO: 1229305 - RNA, 21 nt, Mycobacterium leprae
caccgcggcggguagucggcg

SEQ ID NO: 1229306 - RNA, 22 nt, Mycobacterium leprae
caccgaucgcccgcccaacuag

SEQ ID NO: 1229307 - RNA, 16 nt, Mycobacterium leprae
caccgagacgggugcu

SEQ ID NO: 1229308 - RNA, 17 nt, Mycobacterium leprae
caccgccggucaucgcu

SEQ ID NO: 1229309 - RNA, 17 nt, Mycobacterium leprae
caccgccggcgucaggc

SEQ ID NO: 1229310 - RNA, 23 nt, Mycobacterium leprae
cacacugguggugacaacgccgc

SEQ ID NO: 1229311 - RNA, 14 nt, Mycobacterium leprae
cacacugugccugc

SEQ ID NO: 1229312 - RNA, 16 nt, Mycobacterium leprae
caccacaucaucgauc

SEQ ID NO: 1229313 - RNA, 13 nt, Mycobacterium leprae
cacacggcgcgau

SEQ ID NO: 1229314 - RNA, 13 nt, Mycobacterium leprae
caccagaucagca

SEQ ID NO: 1229315 - RNA, 16 nt, Mycobacterium leprae
caccagaaguggucga

SEQ ID NO: 1229316 - RNA, 16 nt, Mycobacterium leprae
caccagcgacuggcug

SEQ ID NO: 1229317 - RNA, 14 nt, Mycobacterium leprae
cacccgcgaggccu

SEQ ID NO: 1229318 - RNA, 15 nt, Mycobacterium leprae
cacccaggacuacgc

SEQ ID NO: 1229319 - RNA, 21 nt, Mycobacterium leprae
caccgacaugcuuacgugcgc

SEQ ID NO: 1229320 - RNA, 14 nt, Mycobacterium leprae
caccgaccuucgcg

SEQ ID NO: 1229321 - RNA, 15 nt, Mycobacterium leprae
caccgacgagcaacc

SEQ ID NO: 1229322 - RNA, 15 nt, Mycobacterium leprae
caccgaacagcucga

SEQ ID NO: 1229323 - RNA, 16 nt, Mycobacterium leprae
auagcgcagacgucgu

SEQ ID NO: 1229324 - RNA, 21 nt, Mycobacterium leprae
auagccgugaccgacagcucg

SEQ ID NO: 1229325 - RNA, 20 nt, Mycobacterium leprae
aucaaucacgcccagcgcag

SEQ ID NO: 1229326 - RNA, 18 nt, Mycobacterium leprae
aucaaucgggcugcccgu

SEQ ID NO: 1229327 - RNA, 22 nt, Mycobacterium leprae
aucaagggauuccacugccaga

SEQ ID NO: 1229328 - RNA, 17 nt, Mycobacterium leprae
aucaagaucggccagcc

SEQ ID NO: 1229329 - RNA, 13 nt, Mycobacterium leprae
auauuucggcgaa

SEQ ID NO: 1229330 - RNA, 18 nt, Mycobacterium leprae
aucaaccggugauugccg

SEQ ID NO: 1229331 - RNA, 19 nt, Mycobacterium leprae
aucagcaacacuggcgacc

SEQ ID NO: 1229332 - RNA, 19 nt, Mycobacterium leprae
aucagauccgguggcgaca

SEQ ID NO: 1229333 - RNA, 13 nt, Mycobacterium leprae
aucaccggccagc

SEQ ID NO: 1229334 - RNA, 22 nt, Mycobacterium leprae
aucaccggcggugucggcuacc

SEQ ID NO: 1229335 - RNA, 14 nt, Mycobacterium leprae
aucacacggcgcga

SEQ ID NO: 1229336 - RNA, 16 nt, Mycobacterium leprae
aucacacggcgcgauc

SEQ ID NO: 1229337 - RNA, 19 nt, Mycobacterium leprae
aucaccacgaucaccgcgg

SEQ ID NO: 1229338 - RNA, 21 nt, Mycobacterium leprae
auacccccugucuaucacauc

SEQ ID NO: 1229339 - RNA, 23 nt, Mycobacterium leprae
auacagguggcaucagauauccu

SEQ ID NO: 1229340 - RNA, 13 nt, Mycobacterium leprae
auaagcgaagucc

SEQ ID NO: 1229341 - RNA, 11 nt, Mycobacterium leprae
aguuguucggu

SEQ ID NO: 1229342 - RNA, 23 nt, Mycobacterium leprae
aguugaacgcguugcucgacgcg

SEQ ID NO: 1229343 - RNA, 16 nt, Mycobacterium leprae
agucgcauccucgacu

SEQ ID NO: 1229344 - RNA, 23 nt, Mycobacterium leprae
agucgcaaaacgauucugcggaa

SEQ ID NO: 1229345 - RNA, 19 nt, Mycobacterium leprae
aguggucacacugguggug

SEQ ID NO: 1229346 - RNA, 20 nt, Mycobacterium leprae
agugugcaggcagcgacgug

SEQ ID NO: 1229347 - RNA, 14 nt, Mycobacterium leprae
agguuguggcacca

SEQ ID NO: 1229348 - RNA, 21 nt, Mycobacterium leprae
agguuguuuguucagugccgu

SEQ ID NO: 1229349 - RNA, 22 nt, Mycobacterium leprae
agguuuaccgccaucggcuggu

SEQ ID NO: 1229350 - RNA, 18 nt, Mycobacterium leprae
agguucguccgucccggu

SEQ ID NO: 1229351 - RNA, 18 nt, Mycobacterium leprae
aggugcguugugcgguga

SEQ ID NO: 1229352 - RNA, 15 nt, Mycobacterium leprae
aggugucugcgaaca

SEQ ID NO: 1229353 - RNA, 14 nt, Mycobacterium leprae
agguguugcgguga

SEQ ID NO: 1229354 - RNA, 14 nt, Mycobacterium leprae
aguaucgaaucggu

SEQ ID NO: 1229355 - RNA, 15 nt, Mycobacterium leprae
aguaucgaccagcca

SEQ ID NO: 1229356 - RNA, 17 nt, Mycobacterium leprae
aguaucgaccagccacg

SEQ ID NO: 1229357 - RNA, 21 nt, Mycobacterium leprae
aguaccgugccgcgaccgcca

SEQ ID NO: 1229358 - RNA, 18 nt, Mycobacterium leprae
aggucacccuccucgcgg

SEQ ID NO: 1229359 - RNA, 15 nt, Mycobacterium leprae
agggcacgugcggcg

SEQ ID NO: 1229360 - RNA, 18 nt, Mycobacterium leprae
aggucauccuugcgcugg

SEQ ID NO: 1229361 - RNA, 22 nt, Mycobacterium leprae
aggucaguucucgccgaggaug

SEQ ID NO: 1229362 - RNA, 14 nt, Mycobacterium leprae
aggucauucucgac

SEQ ID NO: 1229363 - RNA, 15 nt, Mycobacterium leprae
agguccaaccgacga

SEQ ID NO: 1229364 - RNA, 21 nt, Mycobacterium leprae
aggucgcacagcaggucgccg

SEQ ID NO: 1229365 - RNA, 19 nt, Mycobacterium leprae
aggucgagcgauggcugcc

SEQ ID NO: 1229366 - RNA, 21 nt, Mycobacterium leprae
aggugaucguaggucgcccgg

SEQ ID NO: 1229367 - RNA, 16 nt, Mycobacterium leprae
aggugaugcccaucau

SEQ ID NO: 1229368 - RNA, 14 nt, Mycobacterium leprae
aggugaccggagca

SEQ ID NO: 1229369 - RNA, 16 nt, Mycobacterium leprae
aggugaagccggcgca

SEQ ID NO: 1229370 - RNA, 18 nt, Mycobacterium leprae
aggucuccuggucuccuc

SEQ ID NO: 1229371 - RNA, 15 nt, Mycobacterium leprae
aggucguguugccac

SEQ ID NO: 1229372 - RNA, 18 nt, Mycobacterium leprae
aggugaaacuccccacgu

SEQ ID NO: 1229373 - RNA, 15 nt, Mycobacterium leprae
aggauggcgacgucg

SEQ ID NO: 1229374 - RNA, 20 nt, Mycobacterium leprae
aggauuagcccgaccgacca

SEQ ID NO: 1229375 - RNA, 21 nt, Mycobacterium leprae
agcugcccggcgaacaugacg

SEQ ID NO: 1229376 - RNA, 18 nt, Mycobacterium leprae
agcugccagcuucgcaga

SEQ ID NO: 1229377 - RNA, 12 nt, Mycobacterium leprae
agcugccaagcu

SEQ ID NO: 1229378 - RNA, 20 nt, Mycobacterium leprae
aggauuugcuggcugccgcc

SEQ ID NO: 1229379 - RNA, 21 nt, Mycobacterium leprae
aggcgguaggaaucaccggac

SEQ ID NO: 1229380 - RNA, 16 nt, Mycobacterium leprae
aggcggugaccgaacu

SEQ ID NO: 1229381 - RNA, 23 nt, Mycobacterium leprae
aggcgcguuauugcugugucgcg

SEQ ID NO: 1229382 - RNA, 23 nt, Mycobacterium leprae
agcaccauggaacagcguucgac

SEQ ID NO: 1229383 - RNA, 21 nt, Mycobacterium leprae
agcaauccucagagugugugu

SEQ ID NO: 1229384 - RNA, 21 nt, Mycobacterium leprae
agauucgucgauaaugccggu

SEQ ID NO: 1229385 - RNA, 14 nt, Mycobacterium leprae
agauuaucgcauca

SEQ ID NO: 1229386 - RNA, 13 nt, Mycobacterium leprae
agcaacgacgcca

SEQ ID NO: 1229387 - RNA, 19 nt, Mycobacterium leprae
agcacggcgcucaccgacg

SEQ ID NO: 1229388 - RNA, 14 nt, Mycobacterium leprae
agcagcacggggug

SEQ ID NO: 1229389 - RNA, 23 nt, Mycobacterium leprae
agaucgcgucgcaucgguggcac

SEQ ID NO: 1229390 - RNA, 16 nt, Mycobacterium leprae
agaucgcccaccgcaa

SEQ ID NO: 1229391 - RNA, 13 nt, Mycobacterium leprae
agaugacagcgcg

SEQ ID NO: 1229392 - RNA, 16 nt, Mycobacterium leprae
agaggaugucgagauc

SEQ ID NO: 1229393 - RNA, 23 nt, Mycobacterium leprae
agaggcaaagugcgguuuucggc

SEQ ID NO: 1229394 - RNA, 17 nt, Mycobacterium leprae
agaggcugcaccggcuu

SEQ ID NO: 1229395 - RNA, 20 nt, Mycobacterium leprae
agagcgucgugaccgcgggg

SEQ ID NO: 1229396 - RNA, 15 nt, Mycobacterium leprae
agagagugcggugcu

SEQ ID NO: 1229397 - RNA, 20 nt, Mycobacterium leprae
agccaaucguguaucgucgc

SEQ ID NO: 1229398 - RNA, 22 nt, Mycobacterium leprae
agccaaugcugcagcugggaua

SEQ ID NO: 1229399 - RNA, 14 nt, Mycobacterium leprae
agccacgcaaacga

SEQ ID NO: 1229400 - RNA, 20 nt, Mycobacterium leprae
agccagaauggaguuggugu

SEQ ID NO: 1229401 - RNA, 23 nt, Mycobacterium leprae
agccaggagaagcgcugcagcga

SEQ ID NO: 1229402 - RNA, 21 nt, Mycobacterium leprae
agcaggucuuuuagguguggu

SEQ ID NO: 1229403 - RNA, 16 nt, Mycobacterium leprae
agcagccgaccgcccg

SEQ ID NO: 1229404 - RNA, 16 nt, Mycobacterium leprae
agcaugcccagaccga

SEQ ID NO: 1229405 - RNA, 19 nt, Mycobacterium leprae
agcagucccaaggggagca

SEQ ID NO: 1229406 - RNA, 22 nt, Mycobacterium leprae
agcaucaacgcguuaacgacga

SEQ ID NO: 1229407 - RNA, 14 nt, Mycobacterium leprae
agcccauccgucca

SEQ ID NO: 1229408 - RNA, 23 nt, Mycobacterium leprae
agcccgauuuggauggucggcag

SEQ ID NO: 1229409 - RNA, 13 nt, Mycobacterium leprae
agcccgccgcggc

SEQ ID NO: 1229410 - RNA, 18 nt, Mycobacterium leprae
agccccauggcacggcga

SEQ ID NO: 1229411 - RNA, 14 nt, Mycobacterium leprae
agccgaccgcccgg

SEQ ID NO: 1229412 - RNA, 19 nt, Mycobacterium leprae
agccgaccgcccgguagca

SEQ ID NO: 1229413 - RNA, 17 nt, Mycobacterium leprae
agccgacaaucucacgu

SEQ ID NO: 1229414 - RNA, 23 nt, Mycobacterium leprae
agccgccagucgcagggcgcgca

SEQ ID NO: 1229415 - RNA, 15 nt, Mycobacterium leprae
agccgccagugcgca

SEQ ID NO: 1229416 - RNA, 20 nt, Mycobacterium leprae
agcccucccagccaucgaau

SEQ ID NO: 1229417 - RNA, 17 nt, Mycobacterium leprae
agcccggauacagcacg

SEQ ID NO: 1229418 - RNA, 18 nt, Mycobacterium leprae
agcccggaauccuguuga

SEQ ID NO: 1229419 - RNA, 20 nt, Mycobacterium leprae
agcgcagcaagcggccgccc

SEQ ID NO: 1229420 - RNA, 12 nt, Mycobacterium leprae
agcgcaccgcgg

SEQ ID NO: 1229421 - RNA, 16 nt, Mycobacterium leprae
agcgaucggaacauca

SEQ ID NO: 1229422 - RNA, 13 nt, Mycobacterium leprae
agcgagcguguca

SEQ ID NO: 1229423 - RNA, 21 nt, Mycobacterium leprae
agccguuggcuuguguggugu

SEQ ID NO: 1229424 - RNA, 19 nt, Mycobacterium leprae
agccguugggcugcccucc

SEQ ID NO: 1229425 - RNA, 13 nt, Mycobacterium leprae
agccguucggcua

SEQ ID NO: 1229426 - RNA, 22 nt, Mycobacterium leprae
agccgugcccaaggucacgaug

SEQ ID NO: 1229427 - RNA, 15 nt, Mycobacterium leprae
agcgcgguucgccac

SEQ ID NO: 1229428 - RNA, 18 nt, Mycobacterium leprae
agcgcuaugccauccacc

SEQ ID NO: 1229429 - RNA, 23 nt, Mycobacterium leprae
agcgcuaugccauccaccgccga

SEQ ID NO: 1229430 - RNA, 18 nt, Mycobacterium leprae
agcgcuauuaagucggcu

SEQ ID NO: 1229431 - RNA, 23 nt, Mycobacterium leprae
agcguggucaccgcuguggcaga

SEQ ID NO: 1229432 - RNA, 14 nt, Mycobacterium leprae
agcggucggcgcac

SEQ ID NO: 1229433 - RNA, 21 nt, Mycobacterium leprae
agcucagcaacuuuccugacc

SEQ ID NO: 1229434 - RNA, 14 nt, Mycobacterium leprae
agcuccaguucgau

SEQ ID NO: 1229435 - RNA, 16 nt, Mycobacterium leprae
agcuaaagugcugcug

SEQ ID NO: 1229436 - RNA, 21 nt, Mycobacterium leprae
agcuaaagugcugcugugguu

SEQ ID NO: 1229437 - RNA, 19 nt, Mycobacterium leprae
agcucaauuggcagagcau

SEQ ID NO: 1229438 - RNA, 13 nt, Mycobacterium leprae
agcugaccggcga

SEQ ID NO: 1229439 - RNA, 21 nt, Mycobacterium leprae
agcugaccacucgcgacgaua

SEQ ID NO: 1229440 - RNA, 13 nt, Mycobacterium leprae
ccaauugccaucc

SEQ ID NO: 1229441 - RNA, 21 nt, Mycobacterium leprae
ccaauugccauccucgauggu

SEQ ID NO: 1229442 - RNA, 14 nt, Mycobacterium leprae
ccaaugcagcaacg

SEQ ID NO: 1229443 - RNA, 23 nt, Mycobacterium leprae
ccaagcugacggaaagugccgcg

SEQ ID NO: 1229444 - RNA, 17 nt, Mycobacterium leprae
ccacagauucguaccgc

SEQ ID NO: 1229445 - RNA, 16 nt, Mycobacterium leprae
ccacccacggcuguca

SEQ ID NO: 1229446 - RNA, 14 nt, Mycobacterium leprae
ccacccgucccgca

SEQ ID NO: 1229447 - RNA, 23 nt, Mycobacterium leprae
ccaccgaaccgggcagcgccacg

SEQ ID NO: 1229448 - RNA, 20 nt, Mycobacterium leprae
cauugaccgcaucaccgauc

SEQ ID NO: 1229449 - RNA, 17 nt, Mycobacterium leprae
ccaacaccccgauucca

SEQ ID NO: 1229450 - RNA, 12 nt, Mycobacterium leprae
ccaacacgccga

SEQ ID NO: 1229451 - RNA, 16 nt, Mycobacterium leprae
cauuacaccuaauccg

SEQ ID NO: 1229452 - RNA, 19 nt, Mycobacterium leprae
cauuacgcgaucuaccccg

SEQ ID NO: 1229453 - RNA, 15 nt, Mycobacterium leprae
cauuaacgcuggucg

SEQ ID NO: 1229454 - RNA, 23 nt, Mycobacterium leprae
cauuauuucgucgucagcugcug

SEQ ID NO: 1229455 - RNA, 14 nt, Mycobacterium leprae
cauucggaaucgcg

SEQ ID NO: 1229456 - RNA, 23 nt, Mycobacterium leprae
cauguuaaaauaaaccggcagac

SEQ ID NO: 1229457 - RNA, 17 nt, Mycobacterium leprae
cauguucaucacgggug

SEQ ID NO: 1229458 - RNA, 20 nt, Mycobacterium leprae
caucggcucccaucggcggc

SEQ ID NO: 1229459 - RNA, 20 nt, Mycobacterium leprae
caucggcggccagcucagca

SEQ ID NO: 1229460 - RNA, 17 nt, Mycobacterium leprae
caugcaagucgaacgga

SEQ ID NO: 1229461 - RNA, 14 nt, Mycobacterium leprae
caugcacgccggcg

SEQ ID NO: 1229462 - RNA, 16 nt, Mycobacterium leprae
caugcccgcgccgcag

SEQ ID NO: 1229463 - RNA, 18 nt, Mycobacterium leprae
caugccgccgaagccgcg

SEQ ID NO: 1229464 - RNA, 22 nt, Mycobacterium leprae
ccagcguuggaccgaacagguc

SEQ ID NO: 1229465 - RNA, 20 nt, Mycobacterium leprae
ccagcucacccgcagcaccu

SEQ ID NO: 1229466 - RNA, 13 nt, Mycobacterium leprae
ccagcgacacagc

SEQ ID NO: 1229467 - RNA, 16 nt, Mycobacterium leprae
ccagcgacacagccgg

SEQ ID NO: 1229468 - RNA, 19 nt, Mycobacterium leprae
ccagcgaucgacccaagca

SEQ ID NO: 1229469 - RNA, 19 nt, Mycobacterium leprae
ccacuugacggucgagcug

SEQ ID NO: 1229470 - RNA, 17 nt, Mycobacterium leprae
ccacuucggcacagugc

SEQ ID NO: 1229471 - RNA, 18 nt, Mycobacterium leprae
ccacugaaccugccaucc

SEQ ID NO: 1229472 - RNA, 19 nt, Mycobacterium leprae
ccacugaacguggcaccaa

SEQ ID NO: 1229473 - RNA, 21 nt, Mycobacterium leprae
ccagacucagaaaucguucga

SEQ ID NO: 1229474 - RNA, 21 nt, Mycobacterium leprae
ccacgcuggcacuccgaccga

SEQ ID NO: 1229475 - RNA, 21 nt, Mycobacterium leprae
ccaccguauccuggucaucug

SEQ ID NO: 1229476 - RNA, 20 nt, Mycobacterium leprae
ccagauugcaguccaccaga

SEQ ID NO: 1229477 - RNA, 15 nt, Mycobacterium leprae
ccaugcaugcaccgu

SEQ ID NO: 1229478 - RNA, 17 nt, Mycobacterium leprae
ccaugccgccgaagccg

SEQ ID NO: 1229479 - RNA, 12 nt, Mycobacterium leprae
ccauccaccgcc

SEQ ID NO: 1229480 - RNA, 15 nt, Mycobacterium leprae
ccaucgacgccgccg

SEQ ID NO: 1229481 - RNA, 13 nt, Mycobacterium leprae
ccaucgacgccgu

SEQ ID NO: 1229482 - RNA, 15 nt, Mycobacterium leprae
ccagugugccagcgc

SEQ ID NO: 1229483 - RNA, 19 nt, Mycobacterium leprae
ccaguggcugcaccggcuc

SEQ ID NO: 1229484 - RNA, 22 nt, Mycobacterium leprae
ccaggucaucuaaacugacgcu

SEQ ID NO: 1229485 - RNA, 14 nt, Mycobacterium leprae
ccagggcgccgauu

SEQ ID NO: 1229486 - RNA, 12 nt, Mycobacterium leprae
ccccaacugguu

SEQ ID NO: 1229487 - RNA, 21 nt, Mycobacterium leprae
ccccauucagcggcgauuucg

SEQ ID NO: 1229488 - RNA, 14 nt, Mycobacterium leprae
ccccggaacgggca

SEQ ID NO: 1229489 - RNA, 20 nt, Mycobacterium leprae
ccccggacaguccaccgcca

SEQ ID NO: 1229490 - RNA, 21 nt, Mycobacterium leprae
ccccgaaugcaaugcgccauu

SEQ ID NO: 1229491 - RNA, 12 nt, Mycobacterium leprae
cccacgaggacc

SEQ ID NO: 1229492 - RNA, 18 nt, Mycobacterium leprae
ccauucgcgauccaucag

SEQ ID NO: 1229493 - RNA, 22 nt, Mycobacterium leprae
ccauugccagcguaaacgugau

SEQ ID NO: 1229494 - RNA, 22 nt, Mycobacterium leprae
cccaguaaugugcuaucaccgc

SEQ ID NO: 1229495 - RNA, 15 nt, Mycobacterium leprae
cccagugugcugcau

SEQ ID NO: 1229496 - RNA, 13 nt, Mycobacterium leprae
cccggccgccguc

SEQ ID NO: 1229497 - RNA, 18 nt, Mycobacterium leprae
cccgcacagcaccaugga

SEQ ID NO: 1229498 - RNA, 12 nt, Mycobacterium leprae
cccgcggaucgg

SEQ ID NO: 1229499 - RNA, 17 nt, Mycobacterium leprae
cccgcguuagucgucgu

SEQ ID NO: 1229500 - RNA, 12 nt, Mycobacterium leprae
cccgcgccgccg

SEQ ID NO: 1229501 - RNA, 13 nt, Mycobacterium leprae
ccgacgaaggugg

SEQ ID NO: 1229502 - RNA, 14 nt, Mycobacterium leprae
ccgaccgguugggu

SEQ ID NO: 1229503 - RNA, 17 nt, Mycobacterium leprae
ccgacaccgauaccagc

SEQ ID NO: 1229504 - RNA, 17 nt, Mycobacterium leprae
ccgaagaucaccgccac

SEQ ID NO: 1229505 - RNA, 14 nt, Mycobacterium leprae
cccuucacaagugg

SEQ ID NO: 1229506 - RNA, 14 nt, Mycobacterium leprae
cauagcggccgcca

SEQ ID NO: 1229507 - RNA, 16 nt, Mycobacterium leprae
caucgaacggcggggc

SEQ ID NO: 1229508 - RNA, 15 nt, Mycobacterium leprae
caucgaagcaaccag

SEQ ID NO: 1229509 - RNA, 17 nt, Mycobacterium leprae
cauccaucgcaucugcc

SEQ ID NO: 1229510 - RNA, 18 nt, Mycobacterium leprae
caucccagaaucgucggc

SEQ ID NO: 1229511 - RNA, 14 nt, Mycobacterium leprae
caucgcgucuucca

SEQ ID NO: 1229512 - RNA, 20 nt, Mycobacterium leprae
caucggacaggaucggugau

SEQ ID NO: 1229513 - RNA, 14 nt, Mycobacterium leprae
caucgcggcugcca

SEQ ID NO: 1229514 - RNA, 15 nt, Mycobacterium leprae
caucgcggcugccac

SEQ ID NO: 1229515 - RNA, 19 nt, Mycobacterium leprae
caucgccaaccgucgggau

SEQ ID NO: 1229516 - RNA, 12 nt, Mycobacterium leprae
caucgacgccgc

SEQ ID NO: 1229517 - RNA, 22 nt, Mycobacterium leprae
caucgacaucccagcaacgcua

SEQ ID NO: 1229518 - RNA, 21 nt, Mycobacterium leprae
caucgaugcacuguucacuaa

SEQ ID NO: 1229519 - RNA, 13 nt, Mycobacterium leprae
caucgcagcgauu

SEQ ID NO: 1229520 - RNA, 15 nt, Mycobacterium leprae
caucgaucagacccu

SEQ ID NO: 1229521 - RNA, 15 nt, Mycobacterium leprae
cagucagcaucgggu

SEQ ID NO: 1229522 - RNA, 18 nt, Mycobacterium leprae
cagucaacauggcgaucu

SEQ ID NO: 1229523 - RNA, 16 nt, Mycobacterium leprae
caguaucgaccagcca

SEQ ID NO: 1229524 - RNA, 21 nt, Mycobacterium leprae
caguaauccaguccggugcug

SEQ ID NO: 1229525 - RNA, 21 nt, Mycobacterium leprae
cagguuccccggugucacccg

SEQ ID NO: 1229526 - RNA, 19 nt, Mycobacterium leprae
cagucggaaccgcagcugc

SEQ ID NO: 1229527 - RNA, 20 nt, Mycobacterium leprae
cagucgaaggugagucgaca

SEQ ID NO: 1229528 - RNA, 16 nt, Mycobacterium leprae
cagucuuugggccauc

SEQ ID NO: 1229529 - RNA, 23 nt, Mycobacterium leprae
cagucuuugggccaucggcagau

SEQ ID NO: 1229530 - RNA, 15 nt, Mycobacterium leprae
cagugaacacgcuga

SEQ ID NO: 1229531 - RNA, 15 nt, Mycobacterium leprae
cagucguugacgaua

SEQ ID NO: 1229532 - RNA, 19 nt, Mycobacterium leprae
caguuagcaugagcugcug

SEQ ID NO: 1229533 - RNA, 19 nt, Mycobacterium leprae
caguggccaagcuaucggu

SEQ ID NO: 1229534 - RNA, 15 nt, Mycobacterium leprae
caguguccgucgacg

SEQ ID NO: 1229535 - RNA, 21 nt, Mycobacterium leprae
cagugucuuagggcgauucga

SEQ ID NO: 1229536 - RNA, 17 nt, Mycobacterium leprae
cagugaugaucggcaaa

SEQ ID NO: 1229537 - RNA, 16 nt, Mycobacterium leprae
cagugacggcgucgaa

SEQ ID NO: 1229538 - RNA, 17 nt, Mycobacterium leprae
cagugacggcgucgaau

SEQ ID NO: 1229539 - RNA, 14 nt, Mycobacterium leprae
cagugcaucgauga

SEQ ID NO: 1229540 - RNA, 13 nt, Mycobacterium leprae
caggauagccgau

SEQ ID NO: 1229541 - RNA, 16 nt, Mycobacterium leprae
caggaguugaccaggc

SEQ ID NO: 1229542 - RNA, 21 nt, Mycobacterium leprae
caggauucggucacgggucgg

SEQ ID NO: 1229543 - RNA, 23 nt, Mycobacterium leprae
caggauucggucacgggucggcg

SEQ ID NO: 1229544 - RNA, 15 nt, Mycobacterium leprae
caggacccagcgaua

SEQ ID NO: 1229545 - RNA, 16 nt, Mycobacterium leprae
cagcucguccaucgcg

SEQ ID NO: 1229546 - RNA, 23 nt, Mycobacterium leprae
cagcgguaccugugggucaccac

SEQ ID NO: 1229547 - RNA, 17 nt, Mycobacterium leprae
cagcuaaucccauggga

SEQ ID NO: 1229548 - RNA, 20 nt, Mycobacterium leprae
cagcuaaucccaugggaguu

SEQ ID NO: 1229549 - RNA, 13 nt, Mycobacterium leprae
cagcucggacaag

SEQ ID NO: 1229550 - RNA, 20 nt, Mycobacterium leprae
cagcucgcggugggcuucca

SEQ ID NO: 1229551 - RNA, 16 nt, Mycobacterium leprae
cagcucgauggugcca

SEQ ID NO: 1229552 - RNA, 22 nt, Mycobacterium leprae
cagcucgccaaggucgaucuag

SEQ ID NO: 1229553 - RNA, 14 nt, Mycobacterium leprae
cagcucgacagcag

SEQ ID NO: 1229554 - RNA, 16 nt, Mycobacterium leprae
cagggaagugacgcca

SEQ ID NO: 1229555 - RNA, 18 nt, Mycobacterium leprae
caggcugcauccugcagc

SEQ ID NO: 1229556 - RNA, 21 nt, Mycobacterium leprae
caggcacccguugaagccguu

SEQ ID NO: 1229557 - RNA, 13 nt, Mycobacterium leprae
cagaugacagcgc

SEQ ID NO: 1229558 - RNA, 19 nt, Mycobacterium leprae
cagauccugggcggcuagu

SEQ ID NO: 1229559 - RNA, 14 nt, Mycobacterium leprae
cagauccgguggcg

SEQ ID NO: 1229560 - RNA, 20 nt, Mycobacterium leprae
cagagucaaauucaaccgga

SEQ ID NO: 1229561 - RNA, 14 nt, Mycobacterium leprae
cagaguaaccacuu

SEQ ID NO: 1229562 - RNA, 15 nt, Mycobacterium leprae
cagagacucgugagc

SEQ ID NO: 1229563 - RNA, 14 nt, Mycobacterium leprae
cagagccggcgggu

SEQ ID NO: 1229564 - RNA, 15 nt, Mycobacterium leprae
cagagcugcagguca

SEQ ID NO: 1229565 - RNA, 19 nt, Mycobacterium leprae
cagagcccagcacgcgcga

SEQ ID NO: 1229566 - RNA, 13 nt, Mycobacterium leprae
cagagcuuccucg

SEQ ID NO: 1229567 - RNA, 14 nt, Mycobacterium leprae
cagagcucacuggg

SEQ ID NO: 1229568 - RNA, 13 nt, Mycobacterium leprae
cagacugcccaga

SEQ ID NO: 1229569 - RNA, 15 nt, Mycobacterium leprae
cagacgucgucguca

SEQ ID NO: 1229570 - RNA, 18 nt, Mycobacterium leprae
cagacgucgucgucaucg

SEQ ID NO: 1229571 - RNA, 21 nt, Mycobacterium leprae
cagacgucgucgucaucguug

SEQ ID NO: 1229572 - RNA, 22 nt, Mycobacterium leprae
cagacggauucaaaggucgaca

SEQ ID NO: 1229573 - RNA, 15 nt, Mycobacterium leprae
cacucauauccgaga

SEQ ID NO: 1229574 - RNA, 15 nt, Mycobacterium leprae
cacucauuggaccca

SEQ ID NO: 1229575 - RNA, 15 nt, Mycobacterium leprae
cacuugacggucgag

SEQ ID NO: 1229576 - RNA, 17 nt, Mycobacterium leprae
cacuucccaccguggug

SEQ ID NO: 1229577 - RNA, 14 nt, Mycobacterium leprae
cagaaaucguucga

SEQ ID NO: 1229578 - RNA, 19 nt, Mycobacterium leprae
cacuucuuguacagugaug

SEQ ID NO: 1229579 - RNA, 14 nt, Mycobacterium leprae
cagaaaaccgucgc

SEQ ID NO: 1229580 - RNA, 15 nt, Mycobacterium leprae
cagaauuuucggcgg

SEQ ID NO: 1229581 - RNA, 15 nt, Mycobacterium leprae
cagacccuuggucga

SEQ ID NO: 1229582 - RNA, 16 nt, Mycobacterium leprae
cagacgcgaccgccac

SEQ ID NO: 1229583 - RNA, 14 nt, Mycobacterium leprae
cagaccggcgaucu

SEQ ID NO: 1229584 - RNA, 20 nt, Mycobacterium leprae
cagaccucuuccgccgcuac

SEQ ID NO: 1229585 - RNA, 20 nt, Mycobacterium leprae
cacuacuguugucaguggcg

SEQ ID NO: 1229586 - RNA, 20 nt, Mycobacterium leprae
cacgucgacggcggccgcca

SEQ ID NO: 1229587 - RNA, 14 nt, Mycobacterium leprae
cacgucgaucagcg

SEQ ID NO: 1229588 - RNA, 15 nt, Mycobacterium leprae
cacggucguguaguu

SEQ ID NO: 1229589 - RNA, 21 nt, Mycobacterium leprae
cacggucgacuucgcagccac

SEQ ID NO: 1229590 - RNA, 13 nt, Mycobacterium leprae
cacgggauggcca

SEQ ID NO: 1229591 - RNA, 20 nt, Mycobacterium leprae
cacggcagcgucaccaagcg

SEQ ID NO: 1229592 - RNA, 21 nt, Mycobacterium leprae
cacgcuguuccauaacguugc

SEQ ID NO: 1229593 - RNA, 21 nt, Mycobacterium leprae
cacgccgauaucgaccagcca

SEQ ID NO: 1229594 - RNA, 22 nt, Mycobacterium leprae
cacgccgauaucgaccagccaa

SEQ ID NO: 1229595 - RNA, 13 nt, Mycobacterium leprae
cacgccggcgucg

SEQ ID NO: 1229596 - RNA, 20 nt, Mycobacterium leprae
cagcaagcgagccaucgcaa

SEQ ID NO: 1229597 - RNA, 13 nt, Mycobacterium leprae
cagcaagcggccg

SEQ ID NO: 1229598 - RNA, 22 nt, Mycobacterium leprae
cagcaaggcuuggccagcaagu

SEQ ID NO: 1229599 - RNA, 17 nt, Mycobacterium leprae
cagcacgggguguuggc

SEQ ID NO: 1229600 - RNA, 17 nt, Mycobacterium leprae
cagcacuugcaguuugg

SEQ ID NO: 1229601 - RNA, 14 nt, Mycobacterium leprae
cagcacucgacuca

SEQ ID NO: 1229602 - RNA, 18 nt, Mycobacterium leprae
cagcaggcgaguggcgag

SEQ ID NO: 1229603 - RNA, 15 nt, Mycobacterium leprae
cagccauccgaaacc

SEQ ID NO: 1229604 - RNA, 20 nt, Mycobacterium leprae
cagccaccacucucaucgcg

SEQ ID NO: 1229605 - RNA, 20 nt, Mycobacterium leprae
cagccaaugucacaucgauu

SEQ ID NO: 1229606 - RNA, 17 nt, Mycobacterium leprae
cagcaugguggccacga

SEQ ID NO: 1229607 - RNA, 20 nt, Mycobacterium leprae
cagcaugucggccacugcac

SEQ ID NO: 1229608 - RNA, 15 nt, Mycobacterium leprae
cagccaagccgccag

SEQ ID NO: 1229609 - RNA, 22 nt, Mycobacterium leprae
cagcaucguauagcacacgacc

SEQ ID NO: 1229610 - RNA, 15 nt, Mycobacterium leprae
cagcaucgacagcac

SEQ ID NO: 1229611 - RNA, 15 nt, Mycobacterium leprae
cagcauccucggcac

SEQ ID NO: 1229612 - RNA, 18 nt, Mycobacterium leprae
cagcgaucuaccucgcca

SEQ ID NO: 1229613 - RNA, 22 nt, Mycobacterium leprae
cagcgauugggaucguacgaaa

SEQ ID NO: 1229614 - RNA, 21 nt, Mycobacterium leprae
cagcgauaccagcgucgcuca

SEQ ID NO: 1229615 - RNA, 18 nt, Mycobacterium leprae
cagccgaggggccgucgg

SEQ ID NO: 1229616 - RNA, 20 nt, Mycobacterium leprae
cagccgaggggccgucggca

SEQ ID NO: 1229617 - RNA, 19 nt, Mycobacterium leprae
cagccuagcagcaucgcgu

SEQ ID NO: 1229618 - RNA, 22 nt, Mycobacterium leprae
cagccuugcaaaacgucgaucu

SEQ ID NO: 1229619 - RNA, 18 nt, Mycobacterium leprae
cagccuuucaggugugcu

SEQ ID NO: 1229620 - RNA, 16 nt, Mycobacterium leprae
cagcgccacgccggac

SEQ ID NO: 1229621 - RNA, 21 nt, Mycobacterium leprae
cucacguuguuauugccgggg

SEQ ID NO: 1229622 - RNA, 15 nt, Mycobacterium leprae
cucacgugucuucga

SEQ ID NO: 1229623 - RNA, 16 nt, Mycobacterium leprae
cucacggccaccauag

SEQ ID NO: 1229624 - RNA, 14 nt, Mycobacterium leprae
cucaucggcuccca

SEQ ID NO: 1229625 - RNA, 13 nt, Mycobacterium leprae
cucaucgccaacc

SEQ ID NO: 1229626 - RNA, 20 nt, Mycobacterium leprae
cuacuguugucaguggcgac

SEQ ID NO: 1229627 - RNA, 19 nt, Mycobacterium leprae
cuacucuaauauagacuau

SEQ ID NO: 1229628 - RNA, 22 nt, Mycobacterium leprae
cuagacgggaggaagauauccg

SEQ ID NO: 1229629 - RNA, 18 nt, Mycobacterium leprae
cuagaucaacagcgcagu

SEQ ID NO: 1229630 - RNA, 18 nt, Mycobacterium leprae
cuacuuuucgugcugccg

SEQ ID NO: 1229631 - RNA, 14 nt, Mycobacterium leprae
cuaccgaguugucc

SEQ ID NO: 1229632 - RNA, 22 nt, Mycobacterium leprae
cuaccgaguuguccagauucga

SEQ ID NO: 1229633 - RNA, 23 nt, Mycobacterium leprae
cguugacuauggcucucgggugc

SEQ ID NO: 1229634 - RNA, 22 nt, Mycobacterium leprae
cguugagcgcagccaccacucu

SEQ ID NO: 1229635 - RNA, 15 nt, Mycobacterium leprae
cuacccuugagcacc

SEQ ID NO: 1229636 - RNA, 18 nt, Mycobacterium leprae
cuacccuagagucgaccg

SEQ ID NO: 1229637 - RNA, 20 nt, Mycobacterium leprae
cuacacccgauccggggccg

SEQ ID NO: 1229638 - RNA, 19 nt, Mycobacterium leprae
cuacagaugacagcgcgaa

SEQ ID NO: 1229639 - RNA, 17 nt, Mycobacterium leprae
cuacacugcagcgguca

SEQ ID NO: 1229640 - RNA, 15 nt, Mycobacterium leprae
cucaagucgacgaug

SEQ ID NO: 1229641 - RNA, 21 nt, Mycobacterium leprae
cucaauccguuguccgcggcu

SEQ ID NO: 1229642 - RNA, 15 nt, Mycobacterium leprae
cucaaucgcccgcaa

SEQ ID NO: 1229643 - RNA, 12 nt, Mycobacterium leprae
cuaugccgcgcg

SEQ ID NO: 1229644 - RNA, 18 nt, Mycobacterium leprae
cuaugaguuucggcgccu

SEQ ID NO: 1229645 - RNA, 13 nt, Mycobacterium leprae
cuauaucgcggcg

SEQ ID NO: 1229646 - RNA, 19 nt, Mycobacterium leprae
cuauacuggauaacuuugc

SEQ ID NO: 1229647 - RNA, 22 nt, Mycobacterium leprae
cuagcgaucucgaugucggaca

SEQ ID NO: 1229648 - RNA, 22 nt, Mycobacterium leprae
cuagcaucgaccacgucgggca

SEQ ID NO: 1229649 - RNA, 22 nt, Mycobacterium leprae
cuagcaaggguugguagcuggc

SEQ ID NO: 1229650 - RNA, 14 nt, Mycobacterium leprae
cuccuccagcaucg

SEQ ID NO: 1229651 - RNA, 22 nt, Mycobacterium leprae
cucgacgcgagaaaaucagaug

SEQ ID NO: 1229652 - RNA, 20 nt, Mycobacterium leprae
cuccgcagcaccugccgcag

SEQ ID NO: 1229653 - RNA, 13 nt, Mycobacterium leprae
cucccuucgccgg

SEQ ID NO: 1229654 - RNA, 13 nt, Mycobacterium leprae
cucgcuggucagc

SEQ ID NO: 1229655 - RNA, 16 nt, Mycobacterium leprae
cucgcuggucagcacu

SEQ ID NO: 1229656 - RNA, 12 nt, Mycobacterium leprae
cucggcaucggc

SEQ ID NO: 1229657 - RNA, 20 nt, Mycobacterium leprae
cucgccgcgcaucaucgccc

SEQ ID NO: 1229658 - RNA, 15 nt, Mycobacterium leprae
cucgcaucaacgccg

SEQ ID NO: 1229659 - RNA, 19 nt, Mycobacterium leprae
cugcauccgacaaagcagc

SEQ ID NO: 1229660 - RNA, 21 nt, Mycobacterium leprae
cugcauggacgauaucgcuaa

SEQ ID NO: 1229661 - RNA, 18 nt, Mycobacterium leprae
cugcauugcaagggacau

SEQ ID NO: 1229662 - RNA, 15 nt, Mycobacterium leprae
cugccaaucagcacu

SEQ ID NO: 1229663 - RNA, 18 nt, Mycobacterium leprae
cugccaaucagcacucga

SEQ ID NO: 1229664 - RNA, 15 nt, Mycobacterium leprae
cugccagagaugcgu

SEQ ID NO: 1229665 - RNA, 22 nt, Mycobacterium leprae
cugccaucgacgccgucuccgc

SEQ ID NO: 1229666 - RNA, 22 nt, Mycobacterium leprae
cugccauccaacgugaccagcu

SEQ ID NO: 1229667 - RNA, 15 nt, Mycobacterium leprae
cugccauuggccgcu

SEQ ID NO: 1229668 - RNA, 23 nt, Mycobacterium leprae
cugcccugcaacgcuucgugcau

SEQ ID NO: 1229669 - RNA, 14 nt, Mycobacterium leprae
cugccggcaaccag

SEQ ID NO: 1229670 - RNA, 22 nt, Mycobacterium leprae
cugccggugaccgggccggccg

SEQ ID NO: 1229671 - RNA, 13 nt, Mycobacterium leprae
cugcgacaacacc

SEQ ID NO: 1229672 - RNA, 17 nt, Mycobacterium leprae
cugcgacacuugccgcg

SEQ ID NO: 1229673 - RNA, 13 nt, Mycobacterium leprae
cugcgaacagccg

SEQ ID NO: 1229674 - RNA, 13 nt, Mycobacterium leprae
cugagccgccgug

SEQ ID NO: 1229675 - RNA, 21 nt, Mycobacterium leprae
cugauaguguaagccaucacc

SEQ ID NO: 1229676 - RNA, 21 nt, Mycobacterium leprae
cugcagcaacagccacacccg

SEQ ID NO: 1229677 - RNA, 22 nt, Mycobacterium leprae
cugcagcaacagccacacccga

SEQ ID NO: 1229678 - RNA, 19 nt, Mycobacterium leprae
cugcacauucaaccagcca

SEQ ID NO: 1229679 - RNA, 20 nt, Mycobacterium leprae
cucuaccucggucggcaugu

SEQ ID NO: 1229680 - RNA, 20 nt, Mycobacterium leprae
cucguucaguuugguccagg

SEQ ID NO: 1229681 - RNA, 23 nt, Mycobacterium leprae
cucguucaguuugguccaggcga

SEQ ID NO: 1229682 - RNA, 12 nt, Mycobacterium leprae
cucgucggugag

SEQ ID NO: 1229683 - RNA, 16 nt, Mycobacterium leprae
cucgguugugaaccac

SEQ ID NO: 1229684 - RNA, 13 nt, Mycobacterium leprae
cucuuucggcgag

SEQ ID NO: 1229685 - RNA, 16 nt, Mycobacterium leprae
cucugcgguaucgccg

SEQ ID NO: 1229686 - RNA, 20 nt, Mycobacterium leprae
cucugcgguaucgccgauca

SEQ ID NO: 1229687 - RNA, 18 nt, Mycobacterium leprae
cugacagauacucagcga

SEQ ID NO: 1229688 - RNA, 21 nt, Mycobacterium leprae
cugacacuucuuacacgugcc

SEQ ID NO: 1229689 - RNA, 15 nt, Mycobacterium leprae
cugacaucaucgcua

SEQ ID NO: 1229690 - RNA, 15 nt, Mycobacterium leprae
cgugaccgcggggcu

SEQ ID NO: 1229691 - RNA, 16 nt, Mycobacterium leprae
cgugcaaacugcugcg

SEQ ID NO: 1229692 - RNA, 19 nt, Mycobacterium leprae
cgugauuuucauuggcauu

SEQ ID NO: 1229693 - RNA, 17 nt, Mycobacterium leprae
cgugccaacucggccgc

SEQ ID NO: 1229694 - RNA, 17 nt, Mycobacterium leprae
cgugccgagcuggccgg

SEQ ID NO: 1229695 - RNA, 20 nt, Mycobacterium leprae
cguggauaccacugacgggu

SEQ ID NO: 1229696 - RNA, 22 nt, Mycobacterium leprae
cgucguuguuugauguggccaa

SEQ ID NO: 1229697 - RNA, 17 nt, Mycobacterium leprae
cgucguuguguaggcgg

SEQ ID NO: 1229698 - RNA, 19 nt, Mycobacterium leprae
cgucgugcugaucaccggc

SEQ ID NO: 1229699 - RNA, 21 nt, Mycobacterium leprae
cgucgugaaucaugccgcagc

SEQ ID NO: 1229700 - RNA, 13 nt, Mycobacterium leprae
cgucgugaucggc

SEQ ID NO: 1229701 - RNA, 16 nt, Mycobacterium leprae
cgugaauccgcugcaa

SEQ ID NO: 1229702 - RNA, 13 nt, Mycobacterium leprae
cgucugucacccg

SEQ ID NO: 1229703 - RNA, 21 nt, Mycobacterium leprae
cgucgcgggccuggauuagcu

SEQ ID NO: 1229704 - RNA, 15 nt, Mycobacterium leprae
cgucgcggguggguc

SEQ ID NO: 1229705 - RNA, 19 nt, Mycobacterium leprae
cgucgguagccucggcgcu

SEQ ID NO: 1229706 - RNA, 13 nt, Mycobacterium leprae
cgucgggugccga

SEQ ID NO: 1229707 - RNA, 17 nt, Mycobacterium leprae
cgucgucgcaucgguga

SEQ ID NO: 1229708 - RNA, 16 nt, Mycobacterium leprae
cguuauccacagcauc

SEQ ID NO: 1229709 - RNA, 15 nt, Mycobacterium leprae
cguuauccacgccga

SEQ ID NO: 1229710 - RNA, 15 nt, Mycobacterium leprae
cguguucguuguucu

SEQ ID NO: 1229711 - RNA, 20 nt, Mycobacterium leprae
cguuaacuguagucgguuac

SEQ ID NO: 1229712 - RNA, 22 nt, Mycobacterium leprae
cguguucacgcagucauccacu

SEQ ID NO: 1229713 - RNA, 13 nt, Mycobacterium leprae
cgugugccgcuga

SEQ ID NO: 1229714 - RNA, 15 nt, Mycobacterium leprae
cgugucggccccccg

SEQ ID NO: 1229715 - RNA, 23 nt, Mycobacterium leprae
cguucggcuacugcgacagcagc

SEQ ID NO: 1229716 - RNA, 18 nt, Mycobacterium leprae
cguucaucgucgggugcu

SEQ ID NO: 1229717 - RNA, 17 nt, Mycobacterium leprae
cguggucggugccgagg

SEQ ID NO: 1229718 - RNA, 21 nt, Mycobacterium leprae
cguggucaccgcuguggcaga

SEQ ID NO: 1229719 - RNA, 15 nt, Mycobacterium leprae
cguggguacguggug

SEQ ID NO: 1229720 - RNA, 12 nt, Mycobacterium leprae
cgugguggcugc

SEQ ID NO: 1229721 - RNA, 15 nt, Mycobacterium leprae
cguguaaacuggcga

SEQ ID NO: 1229722 - RNA, 14 nt, Mycobacterium leprae
cguguccacugcgg

SEQ ID NO: 1229723 - RNA, 17 nt, Mycobacterium leprae
cguggcagucucgcugg

SEQ ID NO: 1229724 - RNA, 16 nt, Mycobacterium leprae
cguaagcgucucgacg

SEQ ID NO: 1229725 - RNA, 19 nt, Mycobacterium leprae
cguaagcgucucgacggau

SEQ ID NO: 1229726 - RNA, 15 nt, Mycobacterium leprae
cguaacggucgguaa

SEQ ID NO: 1229727 - RNA, 16 nt, Mycobacterium leprae
cguaacaccgucgaaa

SEQ ID NO: 1229728 - RNA, 21 nt, Mycobacterium leprae
cguaacagauuauugccgccc

SEQ ID NO: 1229729 - RNA, 15 nt, Mycobacterium leprae
cgguugcguggcugc

SEQ ID NO: 1229730 - RNA, 23 nt, Mycobacterium leprae
cgguugcguaauggccggcgccu

SEQ ID NO: 1229731 - RNA, 14 nt, Mycobacterium leprae
cgguguagcugcga

SEQ ID NO: 1229732 - RNA, 14 nt, Mycobacterium leprae
cggugucggcggcu

SEQ ID NO: 1229733 - RNA, 23 nt, Mycobacterium leprae
cgguguuccgcccagugacgucg

SEQ ID NO: 1229734 - RNA, 16 nt, Mycobacterium leprae
cgguguguugcagugu

SEQ ID NO: 1229735 - RNA, 21 nt, Mycobacterium leprae
cguaccggaauguccaccagc

SEQ ID NO: 1229736 - RNA, 17 nt, Mycobacterium leprae
cguaccggaucgacggc

SEQ ID NO: 1229737 - RNA, 19 nt, Mycobacterium leprae
cguaaggaccaaccgcgca

SEQ ID NO: 1229738 - RNA, 23 nt, Mycobacterium leprae
cguaccgggaugugugcgcgccg

SEQ ID NO: 1229739 - RNA, 23 nt, Mycobacterium leprae
cguacucacgugucuucgaccga

SEQ ID NO: 1229740 - RNA, 13 nt, Mycobacterium leprae
cguagcggcggcg

SEQ ID NO: 1229741 - RNA, 18 nt, Mycobacterium leprae
cguagcgucggcggucag

SEQ ID NO: 1229742 - RNA, 15 nt, Mycobacterium leprae
cguagcgcaccaauc

SEQ ID NO: 1229743 - RNA, 18 nt, Mycobacterium leprae
cgucaacggcgccgacaa

SEQ ID NO: 1229744 - RNA, 12 nt, Mycobacterium leprae
cguauggccgcg

SEQ ID NO: 1229745 - RNA, 16 nt, Mycobacterium leprae
cgucgaugucggggau

SEQ ID NO: 1229746 - RNA, 19 nt, Mycobacterium leprae
cgucgcccaacguaucggc

SEQ ID NO: 1229747 - RNA, 16 nt, Mycobacterium leprae
cgucgacgaguuccag

SEQ ID NO: 1229748 - RNA, 14 nt, Mycobacterium leprae
cguccgcggcggcc

SEQ ID NO: 1229749 - RNA, 16 nt, Mycobacterium leprae
cgucaggccaggcagc

SEQ ID NO: 1229750 - RNA, 17 nt, Mycobacterium leprae
cgucaucgacagaugcg

SEQ ID NO: 1229751 - RNA, 14 nt, Mycobacterium leprae
cgucaucgacgaug

SEQ ID NO: 1229752 - RNA, 22 nt, Mycobacterium leprae
cgucaucguugccgcugucgau

SEQ ID NO: 1229753 - RNA, 22 nt, Mycobacterium leprae
cguccagcuggccgggaucggc

SEQ ID NO: 1229754 - RNA, 15 nt, Mycobacterium leprae
gacuuguugucgcgu

SEQ ID NO: 1229755 - RNA, 22 nt, Mycobacterium leprae
gacuucacucacuaacguucgg

SEQ ID NO: 1229756 - RNA, 17 nt, Mycobacterium leprae
gacugugcuaaccgggc

SEQ ID NO: 1229757 - RNA, 13 nt, Mycobacterium leprae
gacuggcugccca

SEQ ID NO: 1229758 - RNA, 15 nt, Mycobacterium leprae
gacugcuagccggcu

SEQ ID NO: 1229759 - RNA, 16 nt, Mycobacterium leprae
gacucuccccacugca

SEQ ID NO: 1229760 - RNA, 13 nt, Mycobacterium leprae
gacucgucagccu

SEQ ID NO: 1229761 - RNA, 22 nt, Mycobacterium leprae
gacuaccggagguucucggcgu

SEQ ID NO: 1229762 - RNA, 15 nt, Mycobacterium leprae
gacucaguggcgggc

SEQ ID NO: 1229763 - RNA, 20 nt, Mycobacterium leprae
gacuaugauuucaucugcca

SEQ ID NO: 1229764 - RNA, 15 nt, Mycobacterium leprae
gacucccuucgccgg

SEQ ID NO: 1229765 - RNA, 17 nt, Mycobacterium leprae
gagagucgggcuuggcc

SEQ ID NO: 1229766 - RNA, 16 nt, Mycobacterium leprae
gagagugccaccgcug

SEQ ID NO: 1229767 - RNA, 13 nt, Mycobacterium leprae
gagagugcggugc

SEQ ID NO: 1229768 - RNA, 21 nt, Mycobacterium leprae
gagagacgucgaugucagcgu

SEQ ID NO: 1229769 - RNA, 16 nt, Mycobacterium leprae
gagacuccacgugcgu

SEQ ID NO: 1229770 - RNA, 13 nt, Mycobacterium leprae
gagacgucgaugu

SEQ ID NO: 1229771 - RNA, 20 nt, Mycobacterium leprae
gagaagcgcugcagcgauac

SEQ ID NO: 1229772 - RNA, 21 nt, Mycobacterium leprae
gagaagggagugcagugcccg

SEQ ID NO: 1229773 - RNA, 13 nt, Mycobacterium leprae
gagaaucgguguu

SEQ ID NO: 1229774 - RNA, 12 nt, Mycobacterium leprae
gagacaucgcca

SEQ ID NO: 1229775 - RNA, 11 nt, Mycobacterium leprae
gagcaagccgc

SEQ ID NO: 1229776 - RNA, 13 nt, Mycobacterium leprae
gagaucgggcaug

SEQ ID NO: 1229777 - RNA, 14 nt, Mycobacterium leprae
gagcaccucagcaa

SEQ ID NO: 1229778 - RNA, 16 nt, Mycobacterium leprae
gagcacggcacaaucg

SEQ ID NO: 1229779 - RNA, 13 nt, Mycobacterium leprae
gacgugaucgacg

SEQ ID NO: 1229780 - RNA, 20 nt, Mycobacterium leprae
gacguggugguagccaacgc

SEQ ID NO: 1229781 - RNA, 15 nt, Mycobacterium leprae
gacggcagaaauaac

SEQ ID NO: 1229782 - RNA, 18 nt, Mycobacterium leprae
gacggaugcccagccagg

SEQ ID NO: 1229783 - RNA, 20 nt, Mycobacterium leprae
gacgcucgaggaagcgcagc

SEQ ID NO: 1229784 - RNA, 20 nt, Mycobacterium leprae
gacgcucggugagauagcgg

SEQ ID NO: 1229785 - RNA, 14 nt, Mycobacterium leprae
gacgcugcgcugag

SEQ ID NO: 1229786 - RNA, 22 nt, Mycobacterium leprae
gaccgugcagcugccaaccggu

SEQ ID NO: 1229787 - RNA, 24 nt, Mycobacterium leprae
gaccggcccucagccagcaagcag

SEQ ID NO: 1229788 - RNA, 19 nt, Mycobacterium leprae
gaccgcaucaccgaucacg

SEQ ID NO: 1229789 - RNA, 17 nt, Mycobacterium leprae
gaccgaugcucgcccuc

SEQ ID NO: 1229790 - RNA, 20 nt, Mycobacterium leprae
gaccauaaugcagcggcagu

SEQ ID NO: 1229791 - RNA, 20 nt, Mycobacterium leprae
gaccaucgucagucggccuu

SEQ ID NO: 1229792 - RNA, 20 nt, Mycobacterium leprae
gacacagaacgguucaacgg

SEQ ID NO: 1229793 - RNA, 19 nt, Mycobacterium leprae
gacaaggguuagcagaaac

SEQ ID NO: 1229794 - RNA, 17 nt, Mycobacterium leprae
gaauggcggcagcgcca

SEQ ID NO: 1229795 - RNA, 18 nt, Mycobacterium leprae
gacaaaccaggcgacacg

SEQ ID NO: 1229796 - RNA, 14 nt, Mycobacterium leprae
gacaaccguucgag

SEQ ID NO: 1229797 - RNA, 15 nt, Mycobacterium leprae
gaauuuaccggcguu

SEQ ID NO: 1229798 - RNA, 15 nt, Mycobacterium leprae
gaauccucgauggcg

SEQ ID NO: 1229799 - RNA, 14 nt, Mycobacterium leprae
gaauccuguugacg

SEQ ID NO: 1229800 - RNA, 16 nt, Mycobacterium leprae
gaaucagaugaccggc

SEQ ID NO: 1229801 - RNA, 12 nt, Mycobacterium leprae
gacaccgaacag

SEQ ID NO: 1229802 - RNA, 22 nt, Mycobacterium leprae
gacaggcgcggucgucaagugc

SEQ ID NO: 1229803 - RNA, 19 nt, Mycobacterium leprae
gaccacggcagcgucacca

SEQ ID NO: 1229804 - RNA, 14 nt, Mycobacterium leprae
gaccaccaccgcca

SEQ ID NO: 1229805 - RNA, 22 nt, Mycobacterium leprae
gacaucggaaucgccgcgacga

SEQ ID NO: 1229806 - RNA, 17 nt, Mycobacterium leprae
gaaaucguucgaccaga

SEQ ID NO: 1229807 - RNA, 22 nt, Mycobacterium leprae
gaacuagagucccucagcggca

SEQ ID NO: 1229808 - RNA, 18 nt, Mycobacterium leprae
gaacgaauccucagcguc

SEQ ID NO: 1229809 - RNA, 16 nt, Mycobacterium leprae
gaaccuggaccgacca

SEQ ID NO: 1229810 - RNA, 15 nt, Mycobacterium leprae
gaacgccucggcaag

SEQ ID NO: 1229811 - RNA, 15 nt, Mycobacterium leprae
gaaccuacaguggca

SEQ ID NO: 1229812 - RNA, 13 nt, Mycobacterium leprae
gaaccaucaacgg

SEQ ID NO: 1229813 - RNA, 14 nt, Mycobacterium leprae
gaaaaccgucgcgg

SEQ ID NO: 1229814 - RNA, 18 nt, Mycobacterium leprae
gaaagaauuuaccggcgu

SEQ ID NO: 1229815 - RNA, 19 nt, Mycobacterium leprae
gaaagacccccggauaccg

SEQ ID NO: 1229816 - RNA, 14 nt, Mycobacterium leprae
gaaauaguggcuga

SEQ ID NO: 1229817 - RNA, 16 nt, Mycobacterium leprae
gaaagugccgcggucu

SEQ ID NO: 1229818 - RNA, 15 nt, Mycobacterium leprae
gaaagucagcaucag

SEQ ID NO: 1229819 - RNA, 16 nt, Mycobacterium leprae
gaaagucagcaucaga

SEQ ID NO: 1229820 - RNA, 11 nt, Mycobacterium leprae
cuugucgggca

SEQ ID NO: 1229821 - RNA, 19 nt, Mycobacterium leprae
cuugguuauucuaggcgau

SEQ ID NO: 1229822 - RNA, 17 nt, Mycobacterium leprae
cuugccgauauucgcga

SEQ ID NO: 1229823 - RNA, 16 nt, Mycobacterium leprae
cuucuaaaccgaccuc

SEQ ID NO: 1229824 - RNA, 18 nt, Mycobacterium leprae
cuucgucaauucggcgau

SEQ ID NO: 1229825 - RNA, 19 nt, Mycobacterium leprae
cuugcuaaccgucggaaac

SEQ ID NO: 1229826 - RNA, 16 nt, Mycobacterium leprae
cuugcgcucacccaag

SEQ ID NO: 1229827 - RNA, 19 nt, Mycobacterium leprae
cuuccuaaaacaucgacuu

SEQ ID NO: 1229828 - RNA, 13 nt, Mycobacterium leprae
cuucggccagcgc

SEQ ID NO: 1229829 - RNA, 18 nt, Mycobacterium leprae
cuucggcacagugccuga

SEQ ID NO: 1229830 - RNA, 15 nt, Mycobacterium leprae
cuucgcugagcgaag

SEQ ID NO: 1229831 - RNA, 13 nt, Mycobacterium leprae
cuucgcucagcau

SEQ ID NO: 1229832 - RNA, 22 nt, Mycobacterium leprae
cuggugugcgcgccgcccagca

SEQ ID NO: 1229833 - RNA, 18 nt, Mycobacterium leprae
cugguguccuacagcagu

SEQ ID NO: 1229834 - RNA, 17 nt, Mycobacterium leprae
cugguugggcaucgccg

SEQ ID NO: 1229835 - RNA, 18 nt, Mycobacterium leprae
cugucgauuaccacugcc

SEQ ID NO: 1229836 - RNA, 23 nt, Mycobacterium leprae
cuuagcugagaaguagcgacauc

SEQ ID NO: 1229837 - RNA, 14 nt, Mycobacterium leprae
cuuagcauagcggc

SEQ ID NO: 1229838 - RNA, 18 nt, Mycobacterium leprae
cuguuuuccgcggcaagu

SEQ ID NO: 1229839 - RNA, 18 nt, Mycobacterium leprae
cuguugcaggcuucguca

SEQ ID NO: 1229840 - RNA, 16 nt, Mycobacterium leprae
cuguugcggccaagcu

SEQ ID NO: 1229841 - RNA, 16 nt, Mycobacterium leprae
cuguugaucgacgcaa

SEQ ID NO: 1229842 - RNA, 18 nt, Mycobacterium leprae
cuguucgugaucgacggc

SEQ ID NO: 1229843 - RNA, 17 nt, Mycobacterium leprae
cugugcaugcacgugca

SEQ ID NO: 1229844 - RNA, 13 nt, Mycobacterium leprae
cugucggugccgc

SEQ ID NO: 1229845 - RNA, 19 nt, Mycobacterium leprae
cuguuccgguuggcugccg

SEQ ID NO: 1229846 - RNA, 22 nt, Mycobacterium leprae
cuggaucgguaccagcggcagc

SEQ ID NO: 1229847 - RNA, 17 nt, Mycobacterium leprae
cuggcacgccagcuggu

SEQ ID NO: 1229848 - RNA, 17 nt, Mycobacterium leprae
cuggauggcgaucgccu

SEQ ID NO: 1229849 - RNA, 20 nt, Mycobacterium leprae
cuggagucauccccaucgcu

SEQ ID NO: 1229850 - RNA, 19 nt, Mycobacterium leprae
cuggccuguucauggugug

SEQ ID NO: 1229851 - RNA, 19 nt, Mycobacterium leprae
cuggcccuguuccucgcgg

SEQ ID NO: 1229852 - RNA, 20 nt, Mycobacterium leprae
cugggaacugccggcaacca

SEQ ID NO: 1229853 - RNA, 14 nt, Mycobacterium leprae
cuggcuugucacca

SEQ ID NO: 1229854 - RNA, 15 nt, Mycobacterium leprae
cuggucuggcgggug

SEQ ID NO: 1229855 - RNA, 17 nt, Mycobacterium leprae
cugguggggugugggug

SEQ ID NO: 1229856 - RNA, 17 nt, Mycobacterium leprae
cuggugggcgcagacgu

SEQ ID NO: 1229857 - RNA, 16 nt, Mycobacterium leprae
cuggugcuguguugug

SEQ ID NO: 1229858 - RNA, 18 nt, Mycobacterium leprae
gcccaguaggcaccacgc

SEQ ID NO: 1229859 - RNA, 16 nt, Mycobacterium leprae
gcccagugacgucgga

SEQ ID NO: 1229860 - RNA, 20 nt, Mycobacterium leprae
gcccaauggugcggcgauca

SEQ ID NO: 1229861 - RNA, 15 nt, Mycobacterium leprae
gccccggaacgggca

SEQ ID NO: 1229862 - RNA, 18 nt, Mycobacterium leprae
gccccuaccccgcggcgc

SEQ ID NO: 1229863 - RNA, 19 nt, Mycobacterium leprae
gccccuuccugacaaccgu

SEQ ID NO: 1229864 - RNA, 22 nt, Mycobacterium leprae
gcccgcugcugcgaccgaccaa

SEQ ID NO: 1229865 - RNA, 20 nt, Mycobacterium leprae
gcccgcgucgccuuagccga

SEQ ID NO: 1229866 - RNA, 18 nt, Mycobacterium leprae
gccagacuggccggugga

SEQ ID NO: 1229867 - RNA, 21 nt, Mycobacterium leprae
gccagacuucagcgagcgugu

SEQ ID NO: 1229868 - RNA, 21 nt, Mycobacterium leprae
gccagaccaacaugaacguca

SEQ ID NO: 1229869 - RNA, 19 nt, Mycobacterium leprae
gccacuccgguugcggcga

SEQ ID NO: 1229870 - RNA, 13 nt, Mycobacterium leprae
gccacgugcacau

SEQ ID NO: 1229871 - RNA, 19 nt, Mycobacterium leprae
gccacgucgccguuuccgc

SEQ ID NO: 1229872 - RNA, 16 nt, Mycobacterium leprae
gccacgagacccagcc

SEQ ID NO: 1229873 - RNA, 14 nt, Mycobacterium leprae
gccaacgcgcaccu

SEQ ID NO: 1229874 - RNA, 20 nt, Mycobacterium leprae
gccauccauuuguggcgaua

SEQ ID NO: 1229875 - RNA, 19 nt, Mycobacterium leprae
gccaucggcagaucgaucu

SEQ ID NO: 1229876 - RNA, 21 nt, Mycobacterium leprae
gccaugggacuaccgguaagc

SEQ ID NO: 1229877 - RNA, 13 nt, Mycobacterium leprae
gccauuggcaccg

SEQ ID NO: 1229878 - RNA, 22 nt, Mycobacterium leprae
gcccaacgucuggaccacgcaa

SEQ ID NO: 1229879 - RNA, 23 nt, Mycobacterium leprae
gcccaacguaucggcgauagcgc

SEQ ID NO: 1229880 - RNA, 22 nt, Mycobacterium leprae
gccagggcggcauucccaaccg

SEQ ID NO: 1229881 - RNA, 17 nt, Mycobacterium leprae
gccaggcgccgcagcau

SEQ ID NO: 1229882 - RNA, 21 nt, Mycobacterium leprae
gccgagcaugaccgagcuggc

SEQ ID NO: 1229883 - RNA, 13 nt, Mycobacterium leprae
gccgagcgcacca

SEQ ID NO: 1229884 - RNA, 16 nt, Mycobacterium leprae
gccgagacugaaugcg

SEQ ID NO: 1229885 - RNA, 12 nt, Mycobacterium leprae
gccgaccgcgac

SEQ ID NO: 1229886 - RNA, 18 nt, Mycobacterium leprae
gcccuagaacaaacgccg

SEQ ID NO: 1229887 - RNA, 21 nt, Mycobacterium leprae
gccgaauuaccauuggcgaca

SEQ ID NO: 1229888 - RNA, 22 nt, Mycobacterium leprae
gccgaauuucuuuaucucccua

SEQ ID NO: 1229889 - RNA, 16 nt, Mycobacterium leprae
gccgcacccggcagca

SEQ ID NO: 1229890 - RNA, 21 nt, Mycobacterium leprae
gccgauuccggagacggcagc

SEQ ID NO: 1229891 - RNA, 22 nt, Mycobacterium leprae
gccgagcuugcugcuuugcggu

SEQ ID NO: 1229892 - RNA, 14 nt, Mycobacterium leprae
gccgaggaagcucg

SEQ ID NO: 1229893 - RNA, 17 nt, Mycobacterium leprae
gccgcgagcacugacau

SEQ ID NO: 1229894 - RNA, 17 nt, Mycobacterium leprae
gccgccgggacgcguca

SEQ ID NO: 1229895 - RNA, 20 nt, Mycobacterium leprae
gccgccgggugcagcaguau

SEQ ID NO: 1229896 - RNA, 14 nt, Mycobacterium leprae
gccgccagugcgca

SEQ ID NO: 1229897 - RNA, 14 nt, Mycobacterium leprae
gccgccaaguaccg

SEQ ID NO: 1229898 - RNA, 21 nt, Mycobacterium leprae
gccggccaauugaauccgcug

SEQ ID NO: 1229899 - RNA, 22 nt, Mycobacterium leprae
gccgcguccagacaccacugcc

SEQ ID NO: 1229900 - RNA, 20 nt, Mycobacterium leprae
gccgcgaguuggccgagcgu

SEQ ID NO: 1229901 - RNA, 21 nt, Mycobacterium leprae
gccggccgguccauucgccgu

SEQ ID NO: 1229902 - RNA, 22 nt, Mycobacterium leprae
gccggccggcaagcugcccggc

SEQ ID NO: 1229903 - RNA, 22 nt, Mycobacterium leprae
gccggcgucaaagucgcgggcu

SEQ ID NO: 1229904 - RNA, 18 nt, Mycobacterium leprae
gccggcggccaccgcgaa

SEQ ID NO: 1229905 - RNA, 21 nt, Mycobacterium leprae
gccggcggcagauguuggccc

SEQ ID NO: 1229906 - RNA, 15 nt, Mycobacterium leprae
gcaucggcagaugcc

SEQ ID NO: 1229907 - RNA, 15 nt, Mycobacterium leprae
gcaucugcuacgcug

SEQ ID NO: 1229908 - RNA, 16 nt, Mycobacterium leprae
gcaugagugaucugcu

SEQ ID NO: 1229909 - RNA, 19 nt, Mycobacterium leprae
gcaugcgcugaggcagcag

SEQ ID NO: 1229910 - RNA, 12 nt, Mycobacterium leprae
gcauucccaacc

SEQ ID NO: 1229911 - RNA, 15 nt, Mycobacterium leprae
gcauuauccgggcug

SEQ ID NO: 1229912 - RNA, 19 nt, Mycobacterium leprae
gcaugucgguggugggugc

SEQ ID NO: 1229913 - RNA, 14 nt, Mycobacterium leprae
gcauggccgcuggg

SEQ ID NO: 1229914 - RNA, 13 nt, Mycobacterium leprae
gcauuggaugaga

SEQ ID NO: 1229915 - RNA, 22 nt, Mycobacterium leprae
gcauuuaccgagaucgacgcug

SEQ ID NO: 1229916 - RNA, 15 nt, Mycobacterium leprae
gcauaaucagcgucg

SEQ ID NO: 1229917 - RNA, 20 nt, Mycobacterium leprae
gcauagaucuucucgacgac

SEQ ID NO: 1229918 - RNA, 23 nt, Mycobacterium leprae
gcaguggacacgauuagcgcggc

SEQ ID NO: 1229919 - RNA, 14 nt, Mycobacterium leprae
gcagguggaucguc

SEQ ID NO: 1229920 - RNA, 21 nt, Mycobacterium leprae
gcaggugacgguguugguguc

SEQ ID NO: 1229921 - RNA, 16 nt, Mycobacterium leprae
gcaggugaccggccaa

SEQ ID NO: 1229922 - RNA, 17 nt, Mycobacterium leprae
gcagugccgccgaucgg

SEQ ID NO: 1229923 - RNA, 21 nt, Mycobacterium leprae
gcagugccuggcgucaucgac

SEQ ID NO: 1229924 - RNA, 23 nt, Mycobacterium leprae
gcaucgcggauugauccggucac

SEQ ID NO: 1229925 - RNA, 18 nt, Mycobacterium leprae
gcaucgcgcaggccuggu

SEQ ID NO: 1229926 - RNA, 16 nt, Mycobacterium leprae
gcaucaagcugugagu

SEQ ID NO: 1229927 - RNA, 19 nt, Mycobacterium leprae
gcaucaagucggucgccga

SEQ ID NO: 1229928 - RNA, 17 nt, Mycobacterium leprae
gcaggcugacuccgggu

SEQ ID NO: 1229929 - RNA, 16 nt, Mycobacterium leprae
gcagguacggaucgaa

SEQ ID NO: 1229930 - RNA, 18 nt, Mycobacterium leprae
gcaggcaugccgccgggu

SEQ ID NO: 1229931 - RNA, 14 nt, Mycobacterium leprae
gcagcccugagcac

SEQ ID NO: 1229932 - RNA, 12 nt, Mycobacterium leprae
gcagccgcggua

SEQ ID NO: 1229933 - RNA, 21 nt, Mycobacterium leprae
gcagccgcgguaacggcggug

SEQ ID NO: 1229934 - RNA, 21 nt, Mycobacterium leprae
gcagcgccugccccgcuggug

SEQ ID NO: 1229935 - RNA, 18 nt, Mycobacterium leprae
gcagcggcggugucccga

SEQ ID NO: 1229936 - RNA, 14 nt, Mycobacterium leprae
gcagauucgagcuc

SEQ ID NO: 1229937 - RNA, 16 nt, Mycobacterium leprae
gcagacacgccgcggc

SEQ ID NO: 1229938 - RNA, 15 nt, Mycobacterium leprae
gcagaagaccgugcu

SEQ ID NO: 1229939 - RNA, 24 nt, Mycobacterium leprae
gcagaccuuuuagcugcgcgcgcc

SEQ ID NO: 1229940 - RNA, 14 nt, Mycobacterium leprae
gcaccugccacggc

SEQ ID NO: 1229941 - RNA, 23 nt, Mycobacterium leprae
gcacgaaauggcgccaccguggu

SEQ ID NO: 1229942 - RNA, 19 nt, Mycobacterium leprae
gcacuuacgcgauucauga

SEQ ID NO: 1229943 - RNA, 16 nt, Mycobacterium leprae
gcacuuaaguggcugg

SEQ ID NO: 1229944 - RNA, 17 nt, Mycobacterium leprae
gcacuucgguaacgcug

SEQ ID NO: 1229945 - RNA, 15 nt, Mycobacterium leprae
gcacugcacggcgug

SEQ ID NO: 1229946 - RNA, 21 nt, Mycobacterium leprae
gcacugagaguacugaccgac

SEQ ID NO: 1229947 - RNA, 14 nt, Mycobacterium leprae
gcacuggaacguuu

SEQ ID NO: 1229948 - RNA, 19 nt, Mycobacterium leprae
gcacucacccgcgaggccu

SEQ ID NO: 1229949 - RNA, 21 nt, Mycobacterium leprae
gcaagguuguuuguucagugc

SEQ ID NO: 1229950 - RNA, 19 nt, Mycobacterium leprae
gcaaggguugguagcuggc

SEQ ID NO: 1229951 - RNA, 18 nt, Mycobacterium leprae
gcaauccgccgaucccga

SEQ ID NO: 1229952 - RNA, 13 nt, Mycobacterium leprae
gcacaaugggugu

SEQ ID NO: 1229953 - RNA, 15 nt, Mycobacterium leprae
gcaacucucaagugg

SEQ ID NO: 1229954 - RNA, 17 nt, Mycobacterium leprae
gcaacacguaguaccgc

SEQ ID NO: 1229955 - RNA, 21 nt, Mycobacterium leprae
gcaacgaaaccaugccgccga

SEQ ID NO: 1229956 - RNA, 17 nt, Mycobacterium leprae
gcaacgccuccacugcu

SEQ ID NO: 1229957 - RNA, 14 nt, Mycobacterium leprae
gcaacgcuucgugc

SEQ ID NO: 1229958 - RNA, 12 nt, Mycobacterium leprae
gcaacguacugc

SEQ ID NO: 1229959 - RNA, 16 nt, Mycobacterium leprae
gcaacgggacaaguca

SEQ ID NO: 1229960 - RNA, 19 nt, Mycobacterium leprae
gcaaacugcugcgcaaggu

SEQ ID NO: 1229961 - RNA, 22 nt, Mycobacterium leprae
gauguggccgcacgggauggcc

SEQ ID NO: 1229962 - RNA, 17 nt, Mycobacterium leprae
gaugugucagcaccggc

SEQ ID NO: 1229963 - RNA, 20 nt, Mycobacterium leprae
gaugugcucggucaguccga

SEQ ID NO: 1229964 - RNA, 23 nt, Mycobacterium leprae
gauucguugacuauggcucucgg

SEQ ID NO: 1229965 - RNA, 20 nt, Mycobacterium leprae
gauucugcggaaaugugcgg

SEQ ID NO: 1229966 - RNA, 14 nt, Mycobacterium leprae
gauucucgagcggc

SEQ ID NO: 1229967 - RNA, 21 nt, Mycobacterium leprae
gauucgggccguuauccacag

SEQ ID NO: 1229968 - RNA, 18 nt, Mycobacterium leprae
gauucgguggcgaucggc

SEQ ID NO: 1229969 - RNA, 21 nt, Mycobacterium leprae
gauggccuauaucgcggcgcg

SEQ ID NO: 1229970 - RNA, 16 nt, Mycobacterium leprae
gauggccugcuggccg

SEQ ID NO: 1229971 - RNA, 20 nt, Mycobacterium leprae
gauggcauccaacacgccga

SEQ ID NO: 1229972 - RNA, 22 nt, Mycobacterium leprae
gauggccaagccgcccggccug

SEQ ID NO: 1229973 - RNA, 15 nt, Mycobacterium leprae
gaugcuaucgccggu

SEQ ID NO: 1229974 - RNA, 18 nt, Mycobacterium leprae
gaugaccauaaugcagcg

SEQ ID NO: 1229975 - RNA, 21 nt, Mycobacterium leprae
gaugaccauaaugcagcggca

SEQ ID NO: 1229976 - RNA, 14 nt, Mycobacterium leprae
gaucgucgcagguu

SEQ ID NO: 1229977 - RNA, 20 nt, Mycobacterium leprae
gaucgcaaauauaauccggc

SEQ ID NO: 1229978 - RNA, 14 nt, Mycobacterium leprae
gaucgggaugccga

SEQ ID NO: 1229979 - RNA, 24 nt, Mycobacterium leprae
gaucggggauucaaucagacacgg

SEQ ID NO: 1229980 - RNA, 18 nt, Mycobacterium leprae
gauccugcucauucaggc

SEQ ID NO: 1229981 - RNA, 18 nt, Mycobacterium leprae
gauccggcacaucgaacc

SEQ ID NO: 1229982 - RNA, 23 nt, Mycobacterium leprae
gauccggcggcucuuucggcgag

SEQ ID NO: 1229983 - RNA, 15 nt, Mycobacterium leprae
gaucauugacuuggc

SEQ ID NO: 1229984 - RNA, 17 nt, Mycobacterium leprae
gaucaguuugccgucgg

SEQ ID NO: 1229985 - RNA, 23 nt, Mycobacterium leprae
gaucauccgcaagcgcgccgagu

SEQ ID NO: 1229986 - RNA, 23 nt, Mycobacterium leprae
gagugaaaguaggcacagcccag

SEQ ID NO: 1229987 - RNA, 21 nt, Mycobacterium leprae
gagucggcaauccuugaugcu

SEQ ID NO: 1229988 - RNA, 21 nt, Mycobacterium leprae
gagguguugggagcgaagaca

SEQ ID NO: 1229989 - RNA, 16 nt, Mycobacterium leprae
gaggugucggcguggu

SEQ ID NO: 1229990 - RNA, 18 nt, Mycobacterium leprae
gaggugcaggagcguggg

SEQ ID NO: 1229991 - RNA, 19 nt, Mycobacterium leprae
gagugguacaacaguuguu

SEQ ID NO: 1229992 - RNA, 23 nt, Mycobacterium leprae
gaguuccucguggguacgugcca

SEQ ID NO: 1229993 - RNA, 16 nt, Mycobacterium leprae
gaguuggccgcggcaa

SEQ ID NO: 1229994 - RNA, 13 nt, Mycobacterium leprae
gaggcggugaccg

SEQ ID NO: 1229995 - RNA, 14 nt, Mycobacterium leprae
gaggcggugaccga

SEQ ID NO: 1229996 - RNA, 14 nt, Mycobacterium leprae
gauacugcaauccg

SEQ ID NO: 1229997 - RNA, 13 nt, Mycobacterium leprae
gauagcgaccauc

SEQ ID NO: 1229998 - RNA, 14 nt, Mycobacterium leprae
gaucacguuggccg

SEQ ID NO: 1229999 - RNA, 19 nt, Mycobacterium leprae
gaucacucugcggcguagg

SEQ ID NO: 1230000 - RNA, 13 nt, Mycobacterium leprae
gaucagccgcgca

SEQ ID NO: 1230001 - RNA, 14 nt, Mycobacterium leprae
gauauucggugacu

SEQ ID NO: 1230002 - RNA, 21 nt, Mycobacterium leprae
cggaguuugcgcucgucgaug

SEQ ID NO: 1230003 - RNA, 23 nt, Mycobacterium leprae
cggagucaugauccagcugucag

SEQ ID NO: 1230004 - RNA, 23 nt, Mycobacterium leprae
cggauuuaauuacaucggcccac

SEQ ID NO: 1230005 - RNA, 21 nt, Mycobacterium leprae
cggauuucucgugguggcugg

SEQ ID NO: 1230006 - RNA, 23 nt, Mycobacterium leprae
cggauucguugggagccgcgcgc

SEQ ID NO: 1230007 - RNA, 21 nt, Mycobacterium leprae
cggcaaaauuuucuugugagu

SEQ ID NO: 1230008 - RNA, 14 nt, Mycobacterium leprae
cggauguguugguu

SEQ ID NO: 1230009 - RNA, 18 nt, Mycobacterium leprae
cggcagaggcaccuggaa

SEQ ID NO: 1230010 - RNA, 16 nt, Mycobacterium leprae
cggcaaugucaaagcc

SEQ ID NO: 1230011 - RNA, 21 nt, Mycobacterium leprae
cggcacagugccugaccaucg

SEQ ID NO: 1230012 - RNA, 18 nt, Mycobacterium leprae
cggcacaucgucggccca

SEQ ID NO: 1230013 - RNA, 19 nt, Mycobacterium leprae
cggcacgccgaacagccgc

SEQ ID NO: 1230014 - RNA, 16 nt, Mycobacterium leprae
cggccagggccguugg

SEQ ID NO: 1230015 - RNA, 10 nt, Mycobacterium leprae
cggccagcgc

SEQ ID NO: 1230016 - RNA, 18 nt, Mycobacterium leprae
cggccagacacuggcgga

SEQ ID NO: 1230017 - RNA, 16 nt, Mycobacterium leprae
cggccagccaggaugc

SEQ ID NO: 1230018 - RNA, 19 nt, Mycobacterium leprae
cggccacuacgacguuguu

SEQ ID NO: 1230019 - RNA, 17 nt, Mycobacterium leprae
cggccacugcacgacca

SEQ ID NO: 1230020 - RNA, 14 nt, Mycobacterium leprae
cggccaccggcgcu

SEQ ID NO: 1230021 - RNA, 21 nt, Mycobacterium leprae
cggccacauugaccacgccga

SEQ ID NO: 1230022 - RNA, 18 nt, Mycobacterium leprae
cggcaugaucgcgaucag

SEQ ID NO: 1230023 - RNA, 16 nt, Mycobacterium leprae
cggcaugguagugcac

SEQ ID NO: 1230024 - RNA, 23 nt, Mycobacterium leprae
cggcgccugaacuggaucgguca

SEQ ID NO: 1230025 - RNA, 17 nt, Mycobacterium leprae
cggcgaugaccggacga

SEQ ID NO: 1230026 - RNA, 15 nt, Mycobacterium leprae
cggcgcccagcaccu

SEQ ID NO: 1230027 - RNA, 22 nt, Mycobacterium leprae
cggccguaaucaagaucggcca

SEQ ID NO: 1230028 - RNA, 22 nt, Mycobacterium leprae
cggccggugaugacgaaauucg

SEQ ID NO: 1230029 - RNA, 21 nt, Mycobacterium leprae
cggccggagauguaguccuca

SEQ ID NO: 1230030 - RNA, 14 nt, Mycobacterium leprae
cggccgcgguggcg

SEQ ID NO: 1230031 - RNA, 20 nt, Mycobacterium leprae
cggccgaugauggugccgau

SEQ ID NO: 1230032 - RNA, 13 nt, Mycobacterium leprae
cggccccggaugc

SEQ ID NO: 1230033 - RNA, 21 nt, Mycobacterium leprae
cggcgaccaguuuacaucgga

SEQ ID NO: 1230034 - RNA, 15 nt, Mycobacterium leprae
cggcgaaagucgcua

SEQ ID NO: 1230035 - RNA, 15 nt, Mycobacterium leprae
cggccuguugauggg

SEQ ID NO: 1230036 - RNA, 22 nt, Mycobacterium leprae
cggccucgugcugcgugccugg

SEQ ID NO: 1230037 - RNA, 14 nt, Mycobacterium leprae
cggucugcggugcu

SEQ ID NO: 1230038 - RNA, 14 nt, Mycobacterium leprae
cggucguccggugc

SEQ ID NO: 1230039 - RNA, 20 nt, Mycobacterium leprae
cggucucuuucggcagcgag

SEQ ID NO: 1230040 - RNA, 21 nt, Mycobacterium leprae
cggucgucuccguccagcugg

SEQ ID NO: 1230041 - RNA, 17 nt, Mycobacterium leprae
cggucgguaaauccacc

SEQ ID NO: 1230042 - RNA, 15 nt, Mycobacterium leprae
cggucguagaccucu

SEQ ID NO: 1230043 - RNA, 21 nt, Mycobacterium leprae
cggucgcacgaccuugccgcg

SEQ ID NO: 1230044 - RNA, 12 nt, Mycobacterium leprae
cggucgccgaug

SEQ ID NO: 1230045 - RNA, 16 nt, Mycobacterium leprae
cgguagccucggcgcu

SEQ ID NO: 1230046 - RNA, 20 nt, Mycobacterium leprae
cgguagcgcgcugaucgggc

SEQ ID NO: 1230047 - RNA, 15 nt, Mycobacterium leprae
cgguaggccgaacau

SEQ ID NO: 1230048 - RNA, 15 nt, Mycobacterium leprae
cgguccuugaccuca

SEQ ID NO: 1230049 - RNA, 15 nt, Mycobacterium leprae
cgguccagccaacgg

SEQ ID NO: 1230050 - RNA, 13 nt, Mycobacterium leprae
cggucccaucgcu

SEQ ID NO: 1230051 - RNA, 18 nt, Mycobacterium leprae
cgguaaacagagcugaug

SEQ ID NO: 1230052 - RNA, 20 nt, Mycobacterium leprae
cgguacaaggcuucgccgag

SEQ ID NO: 1230053 - RNA, 18 nt, Mycobacterium leprae
cggguggacgaaccggac

SEQ ID NO: 1230054 - RNA, 19 nt, Mycobacterium leprae
cggguggacgaaccggaca

SEQ ID NO: 1230055 - RNA, 19 nt, Mycobacterium leprae
cggggugggcagccuggac

SEQ ID NO: 1230056 - RNA, 21 nt, Mycobacterium leprae
cggggaugguuuccagggcga

SEQ ID NO: 1230057 - RNA, 19 nt, Mycobacterium leprae
cggggcuggguccccggac

SEQ ID NO: 1230058 - RNA, 21 nt, Mycobacterium leprae
cgggcuaaguccggccugccc

SEQ ID NO: 1230059 - RNA, 22 nt, Mycobacterium leprae
cgggcuaaguccggccugcccg

SEQ ID NO: 1230060 - RNA, 13 nt, Mycobacterium leprae
cgggcuuggccgg

SEQ ID NO: 1230061 - RNA, 21 nt, Mycobacterium leprae
cgggcuuggccggaacagcau

SEQ ID NO: 1230062 - RNA, 16 nt, Mycobacterium leprae
cggcgucgugaucggc

SEQ ID NO: 1230063 - RNA, 20 nt, Mycobacterium leprae
cggcgucaaagucgcgggcu

SEQ ID NO: 1230064 - RNA, 15 nt, Mycobacterium leprae
cggcguggucggcga

SEQ ID NO: 1230065 - RNA, 16 nt, Mycobacterium leprae
cggcggcggccauggu

SEQ ID NO: 1230066 - RNA, 20 nt, Mycobacterium leprae
cggcguacguaugccgccaa

SEQ ID NO: 1230067 - RNA, 15 nt, Mycobacterium leprae
cgggauuuggugcug

SEQ ID NO: 1230068 - RNA, 23 nt, Mycobacterium leprae
cgggcaaaccacuuagcgugagc

SEQ ID NO: 1230069 - RNA, 20 nt, Mycobacterium leprae
cgggaugaugauugccgccg

SEQ ID NO: 1230070 - RNA, 13 nt, Mycobacterium leprae
cgggaucgcggca

SEQ ID NO: 1230071 - RNA, 22 nt, Mycobacterium leprae
cggcuucuccagucccgcgcug

SEQ ID NO: 1230072 - RNA, 20 nt, Mycobacterium leprae
cggaaagugccgcggucuag

SEQ ID NO: 1230073 - RNA, 19 nt, Mycobacterium leprae
cggaacaucgcgaaugacg

SEQ ID NO: 1230074 - RNA, 12 nt, Mycobacterium leprae
cggaacagcauc

SEQ ID NO: 1230075 - RNA, 18 nt, Mycobacterium leprae
cggaaagaucgcccaccg

SEQ ID NO: 1230076 - RNA, 17 nt, Mycobacterium leprae
cggaacgacacugaacc

SEQ ID NO: 1230077 - RNA, 12 nt, Mycobacterium leprae
cggaacgcgcaa

SEQ ID NO: 1230078 - RNA, 19 nt, Mycobacterium leprae
cgcuugguugcggguacga

SEQ ID NO: 1230079 - RNA, 21 nt, Mycobacterium leprae
cgcuguuguuggucggcgcug

SEQ ID NO: 1230080 - RNA, 17 nt, Mycobacterium leprae
cgcuucaacguugaagc

SEQ ID NO: 1230081 - RNA, 16 nt, Mycobacterium leprae
cgcuucaucagcucug

SEQ ID NO: 1230082 - RNA, 22 nt, Mycobacterium leprae
cgcugggugugucaucaucacc

SEQ ID NO: 1230083 - RNA, 15 nt, Mycobacterium leprae
cgcuaaucgcgggca

SEQ ID NO: 1230084 - RNA, 20 nt, Mycobacterium leprae
cgcuaagguggagcgaccga

SEQ ID NO: 1230085 - RNA, 22 nt, Mycobacterium leprae
cgcuaagguggagcgaccgagc

SEQ ID NO: 1230086 - RNA, 14 nt, Mycobacterium leprae
cgcuaaggcugcug

SEQ ID NO: 1230087 - RNA, 18 nt, Mycobacterium leprae
cgcuaacuucccgacggu

SEQ ID NO: 1230088 - RNA, 17 nt, Mycobacterium leprae
cgcguucugucgcgucg

SEQ ID NO: 1230089 - RNA, 13 nt, Mycobacterium leprae
cgcgugccaccag

SEQ ID NO: 1230090 - RNA, 20 nt, Mycobacterium leprae
cgcgugaucgcuccugcagc

SEQ ID NO: 1230091 - RNA, 23 nt, Mycobacterium leprae
cgcuaugugcaaucgauccggcg

SEQ ID NO: 1230092 - RNA, 15 nt, Mycobacterium leprae
cgcucaccgacggau

SEQ ID NO: 1230093 - RNA, 18 nt, Mycobacterium leprae
cgcucacagcaguccgcu

SEQ ID NO: 1230094 - RNA, 21 nt, Mycobacterium leprae
cgcucacgauugcucugaggu

SEQ ID NO: 1230095 - RNA, 12 nt, Mycobacterium leprae
cgcuacgcccga

SEQ ID NO: 1230096 - RNA, 15 nt, Mycobacterium leprae
cgcugaggauagcca

SEQ ID NO: 1230097 - RNA, 12 nt, Mycobacterium leprae
cgcugcacgaaa

SEQ ID NO: 1230098 - RNA, 21 nt, Mycobacterium leprae
cgcugcacauucaaccagcca

SEQ ID NO: 1230099 - RNA, 22 nt, Mycobacterium leprae
cgcugcacauucaaccagccaa

SEQ ID NO: 1230100 - RNA, 17 nt, Mycobacterium leprae
cgcucaggcuaccgagc

SEQ ID NO: 1230101 - RNA, 11 nt, Mycobacterium leprae
cgcucgccggg

SEQ ID NO: 1230102 - RNA, 17 nt, Mycobacterium leprae
cgcugaaccgcgucggc

SEQ ID NO: 1230103 - RNA, 23 nt, Mycobacterium leprae
cgcggcgaggggaugcagguacu

SEQ ID NO: 1230104 - RNA, 21 nt, Mycobacterium leprae
cgcgguacaaucagucgggcc

SEQ ID NO: 1230105 - RNA, 14 nt, Mycobacterium leprae
cgcggucgccgaug

SEQ ID NO: 1230106 - RNA, 19 nt, Mycobacterium leprae
cgcggggcgaugucgaccu

SEQ ID NO: 1230107 - RNA, 20 nt, Mycobacterium leprae
cgcggugggcuuccagcaga

SEQ ID NO: 1230108 - RNA, 16 nt, Mycobacterium leprae
cgcggugauuggcuga

SEQ ID NO: 1230109 - RNA, 12 nt, Mycobacterium leprae
cgcgggcaagcc

SEQ ID NO: 1230110 - RNA, 22 nt, Mycobacterium leprae
cgcgcgacaguaucgaccagcc

SEQ ID NO: 1230111 - RNA, 15 nt, Mycobacterium leprae
cgcggaagcccgccc

SEQ ID NO: 1230112 - RNA, 17 nt, Mycobacterium leprae
cgcgcugaagccgcugg

SEQ ID NO: 1230113 - RNA, 14 nt, Mycobacterium leprae
cgccguccacugca

SEQ ID NO: 1230114 - RNA, 20 nt, Mycobacterium leprae
cgccguccacugcagggcga

SEQ ID NO: 1230115 - RNA, 21 nt, Mycobacterium leprae
cgccuaaucuagccucgguca

SEQ ID NO: 1230116 - RNA, 13 nt, Mycobacterium leprae
cgccguucgucga

SEQ ID NO: 1230117 - RNA, 16 nt, Mycobacterium leprae
cgccguucucccgcca

SEQ ID NO: 1230118 - RNA, 17 nt, Mycobacterium leprae
cgccuagagagugcggu

SEQ ID NO: 1230119 - RNA, 20 nt, Mycobacterium leprae
cgccuagagagugcggugcu

SEQ ID NO: 1230120 - RNA, 20 nt, Mycobacterium leprae
cgccguggaggugcggcugg

SEQ ID NO: 1230121 - RNA, 21 nt, Mycobacterium leprae
cgccucaaugcagacacgccg

SEQ ID NO: 1230122 - RNA, 18 nt, Mycobacterium leprae
cgcgaaauaacggaacgg

SEQ ID NO: 1230123 - RNA, 18 nt, Mycobacterium leprae
cgcgacaguaucgaccag

SEQ ID NO: 1230124 - RNA, 13 nt, Mycobacterium leprae
cgcgacggcaagu

SEQ ID NO: 1230125 - RNA, 13 nt, Mycobacterium leprae
cgcgacggccggc

SEQ ID NO: 1230126 - RNA, 16 nt, Mycobacterium leprae
cgcgacauauucgcua

SEQ ID NO: 1230127 - RNA, 16 nt, Mycobacterium leprae
cgcgaccaacccggcg

SEQ ID NO: 1230128 - RNA, 12 nt, Mycobacterium leprae
cgcgaccaacgc

SEQ ID NO: 1230129 - RNA, 14 nt, Mycobacterium leprae
cgcgauaccggcga

SEQ ID NO: 1230130 - RNA, 19 nt, Mycobacterium leprae
cgcgauucguauaaugucg

SEQ ID NO: 1230131 - RNA, 17 nt, Mycobacterium leprae
cgcgaucuacgccaucg

SEQ ID NO: 1230132 - RNA, 17 nt, Mycobacterium leprae
cgccgcgcaucaucgcc

SEQ ID NO: 1230133 - RNA, 18 nt, Mycobacterium leprae
cgccgcgcaucaucgccc

SEQ ID NO: 1230134 - RNA, 17 nt, Mycobacterium leprae
cgccgcugcuuccucga

SEQ ID NO: 1230135 - RNA, 14 nt, Mycobacterium leprae
cgccgauaucgacc

SEQ ID NO: 1230136 - RNA, 18 nt, Mycobacterium leprae
cgccgauaucgaccagcc

SEQ ID NO: 1230137 - RNA, 12 nt, Mycobacterium leprae
cgccgaucggua

SEQ ID NO: 1230138 - RNA, 19 nt, Mycobacterium leprae
cgccgagaggaugucgaga

SEQ ID NO: 1230139 - RNA, 18 nt, Mycobacterium leprae
cgccgaccucggcgcugg

SEQ ID NO: 1230140 - RNA, 16 nt, Mycobacterium leprae
cgcccgggaaggacgc

SEQ ID NO: 1230141 - RNA, 20 nt, Mycobacterium leprae
cgcccgggaaggacgcaucc

SEQ ID NO: 1230142 - RNA, 21 nt, Mycobacterium leprae
cgcccgggaaggacgcaucca

SEQ ID NO: 1230143 - RNA, 17 nt, Mycobacterium leprae
ccuaauuugucgguagu

SEQ ID NO: 1230144 - RNA, 19 nt, Mycobacterium leprae
ccucaaugcagacacgccg

SEQ ID NO: 1230145 - RNA, 16 nt, Mycobacterium leprae
ccucacacucacgccu

SEQ ID NO: 1230146 - RNA, 23 nt, Mycobacterium leprae
ccuauccgaguggguaaaaccgg

SEQ ID NO: 1230147 - RNA, 21 nt, Mycobacterium leprae
ccguugcuaacgcuuaaccau

SEQ ID NO: 1230148 - RNA, 16 nt, Mycobacterium leprae
ccguuggggucgugca

SEQ ID NO: 1230149 - RNA, 16 nt, Mycobacterium leprae
ccguugacguggugau

SEQ ID NO: 1230150 - RNA, 13 nt, Mycobacterium leprae
ccgugccaacacu

SEQ ID NO: 1230151 - RNA, 20 nt, Mycobacterium leprae
ccgugcagcgaccucaugcc

SEQ ID NO: 1230152 - RNA, 17 nt, Mycobacterium leprae
ccgucggaugauagccg

SEQ ID NO: 1230153 - RNA, 14 nt, Mycobacterium leprae
ccuggaauccgcgc

SEQ ID NO: 1230154 - RNA, 17 nt, Mycobacterium leprae
ccuggaccgaccagagc

SEQ ID NO: 1230155 - RNA, 16 nt, Mycobacterium leprae
ccugacgcacaccguu

SEQ ID NO: 1230156 - RNA, 16 nt, Mycobacterium leprae
ccugagcaccaucucg

SEQ ID NO: 1230157 - RNA, 19 nt, Mycobacterium leprae
ccucgcugcagcauaaccc

SEQ ID NO: 1230158 - RNA, 14 nt, Mycobacterium leprae
ccucgaauccgccu

SEQ ID NO: 1230159 - RNA, 20 nt, Mycobacterium leprae
ccggcuauguggcgcgucgg

SEQ ID NO: 1230160 - RNA, 19 nt, Mycobacterium leprae
ccggcgucuggcuggccuc

SEQ ID NO: 1230161 - RNA, 14 nt, Mycobacterium leprae
ccgggccagucggu

SEQ ID NO: 1230162 - RNA, 18 nt, Mycobacterium leprae
ccgggaugacguugcugg

SEQ ID NO: 1230163 - RNA, 13 nt, Mycobacterium leprae
ccggcggccaauu

SEQ ID NO: 1230164 - RNA, 20 nt, Mycobacterium leprae
ccggucaacaagccgccgac

SEQ ID NO: 1230165 - RNA, 18 nt, Mycobacterium leprae
ccggguucuugaucgacg

SEQ ID NO: 1230166 - RNA, 14 nt, Mycobacterium leprae
ccgguagcguggac

SEQ ID NO: 1230167 - RNA, 15 nt, Mycobacterium leprae
ccgguagcgccgagc

SEQ ID NO: 1230168 - RNA, 19 nt, Mycobacterium leprae
ccggucggcggcgccgauc

SEQ ID NO: 1230169 - RNA, 21 nt, Mycobacterium leprae
ccggucggggaaggccaagcg

SEQ ID NO: 1230170 - RNA, 16 nt, Mycobacterium leprae
ccggucgucaagcuca

SEQ ID NO: 1230171 - RNA, 14 nt, Mycobacterium leprae
ccggugccggccaa

SEQ ID NO: 1230172 - RNA, 18 nt, Mycobacterium leprae
ccggugcugcagccacga

SEQ ID NO: 1230173 - RNA, 19 nt, Mycobacterium leprae
ccgguggucgcgauccaau

SEQ ID NO: 1230174 - RNA, 19 nt, Mycobacterium leprae
ccguaguguuuuaccagcc

SEQ ID NO: 1230175 - RNA, 21 nt, Mycobacterium leprae
ccgcagcacuaaagucuucaa

SEQ ID NO: 1230176 - RNA, 23 nt, Mycobacterium leprae
ccgcacguugccucuguucaggc

SEQ ID NO: 1230177 - RNA, 14 nt, Mycobacterium leprae
ccgcaccgaucugc

SEQ ID NO: 1230178 - RNA, 15 nt, Mycobacterium leprae
ccgcaaggucacgag

SEQ ID NO: 1230179 - RNA, 17 nt, Mycobacterium leprae
ccgcaagcgcgccgagu

SEQ ID NO: 1230180 - RNA, 14 nt, Mycobacterium leprae
ccgaugcucgcccu

SEQ ID NO: 1230181 - RNA, 17 nt, Mycobacterium leprae
ccgaugcagcugguggu

SEQ ID NO: 1230182 - RNA, 19 nt, Mycobacterium leprae
ccgaugcagggccagcccg

SEQ ID NO: 1230183 - RNA, 14 nt, Mycobacterium leprae
ccgccacagcaagu

SEQ ID NO: 1230184 - RNA, 16 nt, Mycobacterium leprae
ccgccaggucagcgau

SEQ ID NO: 1230185 - RNA, 22 nt, Mycobacterium leprae
ccgcccaggugucuuccagugg

SEQ ID NO: 1230186 - RNA, 14 nt, Mycobacterium leprae
ccgccgacaccgau

SEQ ID NO: 1230187 - RNA, 19 nt, Mycobacterium leprae
ccgccgcggcgggcaagcc

SEQ ID NO: 1230188 - RNA, 21 nt, Mycobacterium leprae
ccgccguccacugcagggcga

SEQ ID NO: 1230189 - RNA, 13 nt, Mycobacterium leprae
ccgcgcacagugu

SEQ ID NO: 1230190 - RNA, 17 nt, Mycobacterium leprae
ccgccuucacgaaugcc

SEQ ID NO: 1230191 - RNA, 16 nt, Mycobacterium leprae
ccgcugguaucggugu

SEQ ID NO: 1230192 - RNA, 14 nt, Mycobacterium leprae
ccgcuggucaagcu

SEQ ID NO: 1230193 - RNA, 19 nt, Mycobacterium leprae
ccgcugcauccgcagcacu

SEQ ID NO: 1230194 - RNA, 17 nt, Mycobacterium leprae
ccgcgguagauaucuac

SEQ ID NO: 1230195 - RNA, 15 nt, Mycobacterium leprae
ccgcggucaaugguc

SEQ ID NO: 1230196 - RNA, 16 nt, Mycobacterium leprae
ccgcgguuuccgcggc

SEQ ID NO: 1230197 - RNA, 22 nt, Mycobacterium leprae
ccgcguaaccaacuaggcgcca

SEQ ID NO: 1230198 - RNA, 20 nt, Mycobacterium leprae
ccgcguaaccgcucgauggc

SEQ ID NO: 1230199 - RNA, 22 nt, Mycobacterium leprae
ccgcgcuagacgucugucaccc

SEQ ID NO: 1230200 - RNA, 17 nt, Mycobacterium leprae
ccggcaugggccggugu

SEQ ID NO: 1230201 - RNA, 12 nt, Mycobacterium leprae
ccggacccgagc

SEQ ID NO: 1230202 - RNA, 16 nt, Mycobacterium leprae
ccggacgugcacaucg

SEQ ID NO: 1230203 - RNA, 21 nt, Mycobacterium leprae
ccggacggccauuggcaccgu

SEQ ID NO: 1230204 - RNA, 20 nt, Mycobacterium leprae
ccggacggcccagcaccacu

SEQ ID NO: 1230205 - RNA, 23 nt, Mycobacterium leprae
ccggacggcaccuacaacuucaa

SEQ ID NO: 1230206 - RNA, 22 nt, Mycobacterium leprae
cgaugacauggaagccgccgug

SEQ ID NO: 1230207 - RNA, 23 nt, Mycobacterium leprae
cgaugauggccgaccuaccgcau

SEQ ID NO: 1230208 - RNA, 17 nt, Mycobacterium leprae
cgaggcguccguuuuuc

SEQ ID NO: 1230209 - RNA, 13 nt, Mycobacterium leprae
cgaggcggugacc

SEQ ID NO: 1230210 - RNA, 21 nt, Mycobacterium leprae
cgauagggguucgccgccggc

SEQ ID NO: 1230211 - RNA, 23 nt, Mycobacterium leprae
cgauagguauacuacacccgauc

SEQ ID NO: 1230212 - RNA, 14 nt, Mycobacterium leprae
cgauauccgccggc

SEQ ID NO: 1230213 - RNA, 16 nt, Mycobacterium leprae
cgauauccccgacguc

SEQ ID NO: 1230214 - RNA, 13 nt, Mycobacterium leprae
cgauaucgcgucg

SEQ ID NO: 1230215 - RNA, 15 nt, Mycobacterium leprae
cgauccaugccgagu

SEQ ID NO: 1230216 - RNA, 22 nt, Mycobacterium leprae
cgauccuuguugccgaaaucgu

SEQ ID NO: 1230217 - RNA, 13 nt, Mycobacterium leprae
cgaucccaggauc

SEQ ID NO: 1230218 - RNA, 20 nt, Mycobacterium leprae
cgaucaccuagaacagcauc

SEQ ID NO: 1230219 - RNA, 18 nt, Mycobacterium leprae
cgcaacagucagccgcgg

SEQ ID NO: 1230220 - RNA, 14 nt, Mycobacterium leprae
cgcaaccgccggca

SEQ ID NO: 1230221 - RNA, 21 nt, Mycobacterium leprae
cgaugucgaccugaccgugcu

SEQ ID NO: 1230222 - RNA, 14 nt, Mycobacterium leprae
cgaugcgugccccg

SEQ ID NO: 1230223 - RNA, 22 nt, Mycobacterium leprae
cgcaauacggugcaccagcuca

SEQ ID NO: 1230224 - RNA, 23 nt, Mycobacterium leprae
cgcaacugguugaccccgcccca

SEQ ID NO: 1230225 - RNA, 18 nt, Mycobacterium leprae
cgcaacugcuggagggca

SEQ ID NO: 1230226 - RNA, 20 nt, Mycobacterium leprae
cgcaacuuuguacgacgacc

SEQ ID NO: 1230227 - RNA, 20 nt, Mycobacterium leprae
cgcaagugcggcgcccagca

SEQ ID NO: 1230228 - RNA, 18 nt, Mycobacterium leprae
cgcaaguucgacgugguc

SEQ ID NO: 1230229 - RNA, 23 nt, Mycobacterium leprae
cgcaagguuguuuguucagugcc

SEQ ID NO: 1230230 - RNA, 17 nt, Mycobacterium leprae
cgcacacgacagccgca

SEQ ID NO: 1230231 - RNA, 14 nt, Mycobacterium leprae
cgcaauuuggugau

SEQ ID NO: 1230232 - RNA, 16 nt, Mycobacterium leprae
cgcacccugccgccac

SEQ ID NO: 1230233 - RNA, 20 nt, Mycobacterium leprae
cgcacccugccgccacagca

SEQ ID NO: 1230234 - RNA, 16 nt, Mycobacterium leprae
cgcaccgauauccggc

SEQ ID NO: 1230235 - RNA, 14 nt, Mycobacterium leprae
cgcacagcaggucg

SEQ ID NO: 1230236 - RNA, 16 nt, Mycobacterium leprae
cgcauauggccgaacc

SEQ ID NO: 1230237 - RNA, 21 nt, Mycobacterium leprae
cgcaucagccaacaccaccag

SEQ ID NO: 1230238 - RNA, 15 nt, Mycobacterium leprae
cgcaugagccggucg

SEQ ID NO: 1230239 - RNA, 21 nt, Mycobacterium leprae
cgcaguggguggacgacggcu

SEQ ID NO: 1230240 - RNA, 23 nt, Mycobacterium leprae
cgcaguggacacgauuagcgcgg

SEQ ID NO: 1230241 - RNA, 19 nt, Mycobacterium leprae
cgcaggacaaagucagcuu

SEQ ID NO: 1230242 - RNA, 17 nt, Mycobacterium leprae
cgcagcaagcggccgcc

SEQ ID NO: 1230243 - RNA, 15 nt, Mycobacterium leprae
cgcagcaucggcauc

SEQ ID NO: 1230244 - RNA, 13 nt, Mycobacterium leprae
cgccauagccgau

SEQ ID NO: 1230245 - RNA, 21 nt, Mycobacterium leprae
cgccauauccucgaccaccag

SEQ ID NO: 1230246 - RNA, 14 nt, Mycobacterium leprae
cgagaucauccgca

SEQ ID NO: 1230247 - RNA, 16 nt, Mycobacterium leprae
cgagacuccacgugcg

SEQ ID NO: 1230248 - RNA, 17 nt, Mycobacterium leprae
cgacugaccagcgaucg

SEQ ID NO: 1230249 - RNA, 20 nt, Mycobacterium leprae
cgagcaaauugccgagcugg

SEQ ID NO: 1230250 - RNA, 20 nt, Mycobacterium leprae
cgagcccagugugucggcgu

SEQ ID NO: 1230251 - RNA, 17 nt, Mycobacterium leprae
cgagcgauacacagccg

SEQ ID NO: 1230252 - RNA, 16 nt, Mycobacterium leprae
cgagcgauugugcgga

SEQ ID NO: 1230253 - RNA, 22 nt, Mycobacterium leprae
cgagccgacaaucgagcacggc

SEQ ID NO: 1230254 - RNA, 12 nt, Mycobacterium leprae
cgagcgugucau

SEQ ID NO: 1230255 - RNA, 15 nt, Mycobacterium leprae
cgagcuaaacagcaa

SEQ ID NO: 1230256 - RNA, 18 nt, Mycobacterium leprae
cgagcguacuggugauaa

SEQ ID NO: 1230257 - RNA, 22 nt, Mycobacterium leprae
cgaggaagcucgguucggugac

SEQ ID NO: 1230258 - RNA, 23 nt, Mycobacterium leprae
cgaggaguuagaggguccggacc

SEQ ID NO: 1230259 - RNA, 16 nt, Mycobacterium leprae
cgaggauuaucgccgg

SEQ ID NO: 1230260 - RNA, 18 nt, Mycobacterium leprae
cgacuccgcaagaugccc

SEQ ID NO: 1230261 - RNA, 15 nt, Mycobacterium leprae
cgacucgcgauccca

SEQ ID NO: 1230262 - RNA, 17 nt, Mycobacterium leprae
cgacucggcgccaucga

SEQ ID NO: 1230263 - RNA, 19 nt, Mycobacterium leprae
cgacggugcugauggccgg

SEQ ID NO: 1230264 - RNA, 17 nt, Mycobacterium leprae
cgacgccuagagagugc

SEQ ID NO: 1230265 - RNA, 23 nt, Mycobacterium leprae
cgacgccuagagagugcggugcu

SEQ ID NO: 1230266 - RNA, 16 nt, Mycobacterium leprae
cgacggcaacggcacc

SEQ ID NO: 1230267 - RNA, 18 nt, Mycobacterium leprae
cgacggauuucucguggu

SEQ ID NO: 1230268 - RNA, 18 nt, Mycobacterium leprae
cgacgaggugacucgccg

SEQ ID NO: 1230269 - RNA, 15 nt, Mycobacterium leprae
cgacgaggcggugac

SEQ ID NO: 1230270 - RNA, 19 nt, Mycobacterium leprae
cgacgaccuccgcagcauc

SEQ ID NO: 1230271 - RNA, 19 nt, Mycobacterium leprae
cgaccuccuugaccaccac

SEQ ID NO: 1230272 - RNA, 17 nt, Mycobacterium leprae
cgaccuccgcagcaucg

SEQ ID NO: 1230273 - RNA, 15 nt, Mycobacterium leprae
cgaccucaugcccgg

SEQ ID NO: 1230274 - RNA, 19 nt, Mycobacterium leprae
cgaaagccgcaccaggucg

SEQ ID NO: 1230275 - RNA, 17 nt, Mycobacterium leprae
cgaacagccgcgccaac

SEQ ID NO: 1230276 - RNA, 22 nt, Mycobacterium leprae
cgaacccagacgcgaccgccac

SEQ ID NO: 1230277 - RNA, 23 nt, Mycobacterium leprae
cgaacccagacgcgaccgccacc

SEQ ID NO: 1230278 - RNA, 21 nt, Mycobacterium leprae
cgaacagugggggugcggcag

SEQ ID NO: 1230279 - RNA, 17 nt, Mycobacterium leprae
cgaagagaggaaccgau

SEQ ID NO: 1230280 - RNA, 20 nt, Mycobacterium leprae
cgaagacuucuucgauuacg

SEQ ID NO: 1230281 - RNA, 16 nt, Mycobacterium leprae
cgaagagcggcacgau

SEQ ID NO: 1230282 - RNA, 15 nt, Mycobacterium leprae
cgaaccgauccagca

SEQ ID NO: 1230283 - RNA, 15 nt, Mycobacterium leprae
ccuucuccaccaccg

SEQ ID NO: 1230284 - RNA, 13 nt, Mycobacterium leprae
ccuugcggcgccc

SEQ ID NO: 1230285 - RNA, 15 nt, Mycobacterium leprae
cgaaacgucaucgac

SEQ ID NO: 1230286 - RNA, 14 nt, Mycobacterium leprae
cgaaacuaaauccg

SEQ ID NO: 1230287 - RNA, 17 nt, Mycobacterium leprae
ccuucuaugacaacggu

SEQ ID NO: 1230288 - RNA, 17 nt, Mycobacterium leprae
ccuguuauauagugcgc

SEQ ID NO: 1230289 - RNA, 22 nt, Mycobacterium leprae
ccuguguugccaucgacgccgc

SEQ ID NO: 1230290 - RNA, 20 nt, Mycobacterium leprae
cgacauacaaucgcggcaca

SEQ ID NO: 1230291 - RNA, 18 nt, Mycobacterium leprae
cgacaguaucgaccagcc

SEQ ID NO: 1230292 - RNA, 19 nt, Mycobacterium leprae
cgacaguaucgaccagcca

SEQ ID NO: 1230293 - RNA, 21 nt, Mycobacterium leprae
cgaccaugugaccgcggugca

SEQ ID NO: 1230294 - RNA, 22 nt, Mycobacterium leprae
cgaccaugugaccgcggugcag

SEQ ID NO: 1230295 - RNA, 14 nt, Mycobacterium leprae
cgaccagcgcuaaa

SEQ ID NO: 1230296 - RNA, 16 nt, Mycobacterium leprae
cgaagugcgucauccc

SEQ ID NO: 1230297 - RNA, 17 nt, Mycobacterium leprae
cgaagggaaugcgucag

SEQ ID NO: 1230298 - RNA, 18 nt, Mycobacterium leprae
cgaaggugagucgacagc

SEQ ID NO: 1230299 - RNA, 11 nt, Mycobacterium leprae
cgacacggcga

SEQ ID NO: 1230300 - RNA, 21 nt, Mycobacterium leprae
cgacagccugccgauauaccu

SEQ ID NO: 1230301 - RNA, 12 nt, Mycobacterium leprae
cgacaccucacc

SEQ ID NO: 1230302 - RNA, 15 nt, Mycobacterium leprae
cgacaccucaaggcc

SEQ ID NO: 1230303 - RNA, 19 nt, Mycobacterium leprae
cgacaccucaaggccauga

SEQ ID NO: 1230304 - RNA, 18 nt, Mycobacterium leprae
cgacaccgauaccagcgg

SEQ ID NO: 1230305 - RNA, 11 nt, Mycobacterium leprae
aaaacugccgg

SEQ ID NO: 1230306 - RNA, 11 nt, Mycobacterium leprae
aaaucgccugu

SEQ ID NO: 1230307 - RNA, 20 nt, Mycobacterium leprae
aaaccuguguaucagugcuc

SEQ ID NO: 1230308 - RNA, 15 nt, Mycobacterium leprae
aaaccaugccgccga

SEQ ID NO: 1230309 - RNA, 11 nt, Mycobacterium leprae
aaaccaagcca

SEQ ID NO: 1230310 - RNA, 20 nt, Mycobacterium leprae
aaaggcuguccuugccggcg

SEQ ID NO: 1230311 - RNA, 15 nt, Mycobacterium leprae
aaaggguagccgugg

SEQ ID NO: 1230312 - RNA, 22 nt, Mycobacterium leprae
aaagacgacaacagagcaagca

SEQ ID NO: 1230313 - RNA, 23 nt, Mycobacterium leprae
aaacggccuugccgcuccgcgca

SEQ ID NO: 1230314 - RNA, 12 nt, Mycobacterium leprae
aauguugagugc

SEQ ID NO: 1230315 - RNA, 16 nt, Mycobacterium leprae
aauuggguaaagugaa

SEQ ID NO: 1230316 - RNA, 19 nt, Mycobacterium leprae
aauucgggcucgacguuga

SEQ ID NO: 1230317 - RNA, 21 nt, Mycobacterium leprae
aauucggcgauauccgccggc

SEQ ID NO: 1230318 - RNA, 12 nt, Mycobacterium leprae
aauucgccgacc

SEQ ID NO: 1230319 - RNA, 14 nt, Mycobacterium leprae
aauugacgccgacc

SEQ ID NO: 1230320 - RNA, 20 nt, Mycobacterium leprae
aaugaccgcaccgaucugcc

SEQ ID NO: 1230321 - RNA, 19 nt, Mycobacterium leprae
aaugcagcaacgugcaguc

SEQ ID NO: 1230322 - RNA, 15 nt, Mycobacterium leprae
acaaugucggccacc

SEQ ID NO: 1230323 - RNA, 13 nt, Mycobacterium leprae
acaaguccgcggg

SEQ ID NO: 1230324 - RNA, 15 nt, Mycobacterium leprae
acaagcagaauugga

SEQ ID NO: 1230325 - RNA, 13 nt, Mycobacterium leprae
acaagcaacugca

SEQ ID NO: 1230326 - RNA, 17 nt, Mycobacterium leprae
acaacuggaguacuggc

SEQ ID NO: 1230327 - RNA, 18 nt, Mycobacterium leprae
acaacuggaaguacuguc

SEQ ID NO: 1230328 - RNA, 18 nt, Mycobacterium leprae
acaacgucagaagcuggu

SEQ ID NO: 1230329 - RNA, 17 nt, Mycobacterium leprae
acaacaaaaauagccgc

SEQ ID NO: 1230330 - RNA, 13 nt, Mycobacterium leprae
aauuucggcgucg

SEQ ID NO: 1230331 - RNA, 22 nt, Mycobacterium leprae
acacgaggguacgagugguuga

SEQ ID NO: 1230332 - RNA, 16 nt, Mycobacterium leprae
acaccuuggugcccac

SEQ ID NO: 1230333 - RNA, 14 nt, Mycobacterium leprae
acaccuaauccggg

SEQ ID NO: 1230334 - RNA, 19 nt, Mycobacterium leprae
acaccguuagguugucggg

SEQ ID NO: 1230335 - RNA, 21 nt, Mycobacterium leprae
acaccauccacaacgucagaa

SEQ ID NO: 1230336 - RNA, 16 nt, Mycobacterium leprae
acacaugcaagucgaa

SEQ ID NO: 1230337 - RNA, 20 nt, Mycobacterium leprae
acaccacuucuugugcaccg

SEQ ID NO: 1230338 - RNA, 23 nt, Mycobacterium leprae
acaccacugccagcuauccccga

SEQ ID NO: 1230339 - RNA, 21 nt, Mycobacterium leprae
acacguugaugcaucaagcug

SEQ ID NO: 1230340 - RNA, 16 nt, Mycobacterium leprae
acacgguugugcacag

SEQ ID NO: 1230341 - RNA, 19 nt, Mycobacterium leprae
acacgguugugcacaggau

SEQ ID NO: 1230342 - RNA, 13 nt, Mycobacterium leprae
acacggugccgaa

SEQ ID NO: 1230343 - RNA, 16 nt, Mycobacterium leprae
acacuucuacgaaaaa

SEQ ID NO: 1230344 - RNA, 15 nt, Mycobacterium leprae
acacuuacaccaaca

SEQ ID NO: 1230345 - RNA, 14 nt, Mycobacterium leprae
acacuucgggcaag

SEQ ID NO: 1230346 - RNA, 17 nt, Mycobacterium leprae
acagcacccagcucaca

SEQ ID NO: 1230347 - RNA, 18 nt, Mycobacterium leprae
acagauucguaccgcgca

SEQ ID NO: 1230348 - RNA, 22 nt, Mycobacterium leprae
acagagucaaauucaaccggaa

SEQ ID NO: 1230349 - RNA, 16 nt, Mycobacterium leprae
acagagccggcauaga

SEQ ID NO: 1230350 - RNA, 15 nt, Mycobacterium leprae
acaggaauugguggu

SEQ ID NO: 1230351 - RNA, 16 nt, Mycobacterium leprae
acaggaauuggugguc

SEQ ID NO: 1230352 - RNA, 21 nt, Mycobacterium leprae
acagcgcagugugcuuucggc

SEQ ID NO: 1230353 - RNA, 14 nt, Mycobacterium leprae
acagcgggcggggc

SEQ ID NO: 1230354 - RNA, 22 nt, Mycobacterium leprae
acagcgggcggggcgguggcag

SEQ ID NO: 1230355 - RNA, 23 nt, Mycobacterium leprae
acagccuugcaaaacgucgaucu

SEQ ID NO: 1230356 - RNA, 23 nt, Mycobacterium leprae
acagcagagggcaauacgcugcc

SEQ ID NO: 1230357 - RNA, 19 nt, Mycobacterium leprae
aaggugcguugugcgguga

SEQ ID NO: 1230358 - RNA, 15 nt, Mycobacterium leprae
aaguguaaccaacgc

SEQ ID NO: 1230359 - RNA, 14 nt, Mycobacterium leprae
aagccguuggcuug

SEQ ID NO: 1230360 - RNA, 21 nt, Mycobacterium leprae
aagcgcagaugauccggugcc

SEQ ID NO: 1230361 - RNA, 20 nt, Mycobacterium leprae
aagccgcuacucgucaagau

SEQ ID NO: 1230362 - RNA, 17 nt, Mycobacterium leprae
aagccgccgacaccgau

SEQ ID NO: 1230363 - RNA, 17 nt, Mycobacterium leprae
aaggcaacgugggcgau

SEQ ID NO: 1230364 - RNA, 12 nt, Mycobacterium leprae
aaggagccgagg

SEQ ID NO: 1230365 - RNA, 23 nt, Mycobacterium leprae
aagcgggugccgcguccguugua

SEQ ID NO: 1230366 - RNA, 21 nt, Mycobacterium leprae
aaggcuguccuugccggcgcc

SEQ ID NO: 1230367 - RNA, 19 nt, Mycobacterium leprae
aacgagauugccgacgccg

SEQ ID NO: 1230368 - RNA, 14 nt, Mycobacterium leprae
aacgccaggcgccg

SEQ ID NO: 1230369 - RNA, 20 nt, Mycobacterium leprae
aacgcugcacauucaaccag

SEQ ID NO: 1230370 - RNA, 19 nt, Mycobacterium leprae
aaccuccacggucaugguc

SEQ ID NO: 1230371 - RNA, 11 nt, Mycobacterium leprae
aaccguucgac

SEQ ID NO: 1230372 - RNA, 18 nt, Mycobacterium leprae
aaccgguuugauccagcc

SEQ ID NO: 1230373 - RNA, 17 nt, Mycobacterium leprae
aaccggugauugccgcg

SEQ ID NO: 1230374 - RNA, 19 nt, Mycobacterium leprae
aaccgggaaauacggcacg

SEQ ID NO: 1230375 - RNA, 17 nt, Mycobacterium leprae
aacacgaucgcagccca

SEQ ID NO: 1230376 - RNA, 23 nt, Mycobacterium leprae
aacacgugcugaggguggcgccg

SEQ ID NO: 1230377 - RNA, 22 nt, Mycobacterium leprae
aacuugguccgacggcuggcug

SEQ ID NO: 1230378 - RNA, 22 nt, Mycobacterium leprae
aacuucuucagcuacagcggca

SEQ ID NO: 1230379 - RNA, 19 nt, Mycobacterium leprae
aacuucagcacuggcauua

SEQ ID NO: 1230380 - RNA, 17 nt, Mycobacterium leprae
aacuggaucggucagcc

SEQ ID NO: 1230381 - RNA, 14 nt, Mycobacterium leprae
aacuggguuucgcg

SEQ ID NO: 1230382 - RNA, 20 nt, Mycobacterium leprae
aagacaucgguaucggcaua

SEQ ID NO: 1230383 - RNA, 21 nt, Mycobacterium leprae
aagacauuguccgucgcagca

SEQ ID NO: 1230384 - RNA, 24 nt, Mycobacterium leprae
aacugaggcgggucagcggcucga

SEQ ID NO: 1230385 - RNA, 20 nt, Mycobacterium leprae
aacugcagcuaaucccaugg

SEQ ID NO: 1230386 - RNA, 14 nt, Mycobacterium leprae
aacucaucggcucc

SEQ ID NO: 1230387 - RNA, 22 nt, Mycobacterium leprae
aacucauaguguucgcauuccg

SEQ ID NO: 1230388 - RNA, 14 nt, Mycobacterium leprae
agauccgauucgcg

SEQ ID NO: 1230389 - RNA, 14 nt, Mycobacterium leprae
agauaggucgccga

SEQ ID NO: 1230390 - RNA, 15 nt, Mycobacterium leprae
agauaucucgccuuc

SEQ ID NO: 1230391 - RNA, 13 nt, Mycobacterium leprae
agauaccgggcuc

SEQ ID NO: 1230392 - RNA, 16 nt, Mycobacterium leprae
agauacugcaauccgu

SEQ ID NO: 1230393 - RNA, 13 nt, Mycobacterium leprae
agaugaccggcuu

SEQ ID NO: 1230394 - RNA, 19 nt, Mycobacterium leprae
agaugccagccaacggcua

SEQ ID NO: 1230395 - RNA, 22 nt, Mycobacterium leprae
agauggcgucuugaucgaccuc

SEQ ID NO: 1230396 - RNA, 14 nt, Mycobacterium leprae
agauguuggcccgu

SEQ ID NO: 1230397 - RNA, 23 nt, Mycobacterium leprae
agaucgacuugaccuauacugga

SEQ ID NO: 1230398 - RNA, 21 nt, Mycobacterium leprae
agaucggcauaaucagcgucg

SEQ ID NO: 1230399 - RNA, 22 nt, Mycobacterium leprae
agaucguccucaugcccaugcc

SEQ ID NO: 1230400 - RNA, 16 nt, Mycobacterium leprae
agaucuugcagcuggc

SEQ ID NO: 1230401 - RNA, 14 nt, Mycobacterium leprae
agacugcacccggc

SEQ ID NO: 1230402 - RNA, 14 nt, Mycobacterium leprae
agacugaaugcgau

SEQ ID NO: 1230403 - RNA, 20 nt, Mycobacterium leprae
agacugaaugcgaugcuggc

SEQ ID NO: 1230404 - RNA, 15 nt, Mycobacterium leprae
agagcagugcugaca

SEQ ID NO: 1230405 - RNA, 15 nt, Mycobacterium leprae
agacgcgaccgccac

SEQ ID NO: 1230406 - RNA, 11 nt, Mycobacterium leprae
agacgucgaug

SEQ ID NO: 1230407 - RNA, 16 nt, Mycobacterium leprae
agacgucugucacccg

SEQ ID NO: 1230408 - RNA, 13 nt, Mycobacterium leprae
agaccaugagcac

SEQ ID NO: 1230409 - RNA, 14 nt, Mycobacterium leprae
agaccucccugacg

SEQ ID NO: 1230410 - RNA, 24 nt, Mycobacterium leprae
agaccgcuaugcggacggacacug

SEQ ID NO: 1230411 - RNA, 12 nt, Mycobacterium leprae
agacgaucgcaa

SEQ ID NO: 1230412 - RNA, 17 nt, Mycobacterium leprae
agaauuuaccggcguuc

SEQ ID NO: 1230413 - RNA, 17 nt, Mycobacterium leprae
acuucgcagccaccgac

SEQ ID NO: 1230414 - RNA, 20 nt, Mycobacterium leprae
acuaucugcgugccgagccu

SEQ ID NO: 1230415 - RNA, 17 nt, Mycobacterium leprae
acuauccaagacaucgg

SEQ ID NO: 1230416 - RNA, 15 nt, Mycobacterium leprae
acuaguaaucgcauu

SEQ ID NO: 1230417 - RNA, 12 nt, Mycobacterium leprae
acugaccggcua

SEQ ID NO: 1230418 - RNA, 17 nt, Mycobacterium leprae
acugagauuaucccgau

SEQ ID NO: 1230419 - RNA, 22 nt, Mycobacterium leprae
acugaccaagaaguuaccgagc

SEQ ID NO: 1230420 - RNA, 14 nt, Mycobacterium leprae
acugccgaccgccu

SEQ ID NO: 1230421 - RNA, 19 nt, Mycobacterium leprae
acugcccgggugaacgcca

SEQ ID NO: 1230422 - RNA, 16 nt, Mycobacterium leprae
acugcacccggccguc

SEQ ID NO: 1230423 - RNA, 15 nt, Mycobacterium leprae
acuuaaguggcuggc

SEQ ID NO: 1230424 - RNA, 20 nt, Mycobacterium leprae
acuuaccgcggcggccaacu

SEQ ID NO: 1230425 - RNA, 15 nt, Mycobacterium leprae
acugugaucgcaugc

SEQ ID NO: 1230426 - RNA, 20 nt, Mycobacterium leprae
acggaucggcuacaucgaca

SEQ ID NO: 1230427 - RNA, 20 nt, Mycobacterium leprae
acggcaaccuucuagcgcag

SEQ ID NO: 1230428 - RNA, 19 nt, Mycobacterium leprae
acggauuucucgugguggc

SEQ ID NO: 1230429 - RNA, 23 nt, Mycobacterium leprae
acggauuucucgugguggcuggc

SEQ ID NO: 1230430 - RNA, 20 nt, Mycobacterium leprae
acggcagguggaucgucggc

SEQ ID NO: 1230431 - RNA, 24 nt, Mycobacterium leprae
acggcagguggaucgucggccgga

SEQ ID NO: 1230432 - RNA, 22 nt, Mycobacterium leprae
acggaauaaucacagccuccga

SEQ ID NO: 1230433 - RNA, 14 nt, Mycobacterium leprae
acggagcaagcgcu

SEQ ID NO: 1230434 - RNA, 18 nt, Mycobacterium leprae
acggacgauggugugcag

SEQ ID NO: 1230435 - RNA, 21 nt, Mycobacterium leprae
acgcugcuugcucuggguggu

SEQ ID NO: 1230436 - RNA, 16 nt, Mycobacterium leprae
acgcugcgcggcugcg

SEQ ID NO: 1230437 - RNA, 13 nt, Mycobacterium leprae
acgcuggccgccg

SEQ ID NO: 1230438 - RNA, 11 nt, Mycobacterium leprae
aaacagagcug

SEQ ID NO: 1230439 - RNA, 13 nt, Mycobacterium leprae
acgcgaccgccac

SEQ ID NO: 1230440 - RNA, 15 nt, Mycobacterium leprae
acgcucaaucggguu

SEQ ID NO: 1230441 - RNA, 16 nt, Mycobacterium leprae
acgcgguccuguccag

SEQ ID NO: 1230442 - RNA, 21 nt, Mycobacterium leprae
acgcucccaggggggcgcggu

SEQ ID NO: 1230443 - RNA, 15 nt, Mycobacterium leprae
acgcugaucgcugau

SEQ ID NO: 1230444 - RNA, 22 nt, Mycobacterium leprae
acgcggaaagcuucugguccgu

SEQ ID NO: 1230445 - RNA, 15 nt, Mycobacterium leprae
acgcggcggcggcca

SEQ ID NO: 1230446 - RNA, 18 nt, Mycobacterium leprae
acuaaccgcagccggccu

SEQ ID NO: 1230447 - RNA, 22 nt, Mycobacterium leprae
acuaagccgaguugaagugcug

SEQ ID NO: 1230448 - RNA, 21 nt, Mycobacterium leprae
acuacgugugcucgcugcugc

SEQ ID NO: 1230449 - RNA, 21 nt, Mycobacterium leprae
acuacguuggccagcacggcg

SEQ ID NO: 1230450 - RNA, 15 nt, Mycobacterium leprae
acuagcuuuaauagg

SEQ ID NO: 1230451 - RNA, 22 nt, Mycobacterium leprae
acuagccaguaagcuugggguc

SEQ ID NO: 1230452 - RNA, 15 nt, Mycobacterium leprae
acuaccccgagauca

SEQ ID NO: 1230453 - RNA, 21 nt, Mycobacterium leprae
acguuggccggcaugcgaccg

SEQ ID NO: 1230454 - RNA, 15 nt, Mycobacterium leprae
acguuggacgaccac

SEQ ID NO: 1230455 - RNA, 16 nt, Mycobacterium leprae
acguuggacgaccacg

SEQ ID NO: 1230456 - RNA, 18 nt, Mycobacterium leprae
acguuggacgaccacguc

SEQ ID NO: 1230457 - RNA, 14 nt, Mycobacterium leprae
acguugcugcuggu

SEQ ID NO: 1230458 - RNA, 15 nt, Mycobacterium leprae
acguuguggcgcgag

SEQ ID NO: 1230459 - RNA, 15 nt, Mycobacterium leprae
acguuugcaggugcu

SEQ ID NO: 1230460 - RNA, 16 nt, Mycobacterium leprae
acgugcacugguggug

SEQ ID NO: 1230461 - RNA, 22 nt, Mycobacterium leprae
acgucuagcgaacacacagguc

SEQ ID NO: 1230462 - RNA, 21 nt, Mycobacterium leprae
acguggcaccaaaaaagucga

SEQ ID NO: 1230463 - RNA, 15 nt, Mycobacterium leprae
acgugcguaaggugg

SEQ ID NO: 1230464 - RNA, 17 nt, Mycobacterium leprae
acgugcagcuggccgca

SEQ ID NO: 1230465 - RNA, 22 nt, Mycobacterium leprae
acgguuugccaugcacgccggc

SEQ ID NO: 1230466 - RNA, 16 nt, Mycobacterium leprae
acgucgccgguagcag

SEQ ID NO: 1230467 - RNA, 17 nt, Mycobacterium leprae
acgucgguguggugcuc

SEQ ID NO: 1230468 - RNA, 22 nt, Mycobacterium leprae
acgguguauucauagcgguuuc

SEQ ID NO: 1230469 - RNA, 22 nt, Mycobacterium leprae
acgguaauaaggcgucaagcag

SEQ ID NO: 1230470 - RNA, 13 nt, Mycobacterium leprae
acgggcucacggg

SEQ ID NO: 1230471 - RNA, 16 nt, Mycobacterium leprae
acgggaagugguggca

SEQ ID NO: 1230472 - RNA, 20 nt, Mycobacterium leprae
acggcccagcaccacugcgg

SEQ ID NO: 1230473 - RNA, 24 nt, Mycobacterium leprae
acggccagcgcggcaucgucggca

SEQ ID NO: 1230474 - RNA, 14 nt, Mycobacterium leprae
acggcggccgccac

SEQ ID NO: 1230475 - RNA, 18 nt, Mycobacterium leprae
acccgcaucguugucggc

SEQ ID NO: 1230476 - RNA, 15 nt, Mycobacterium leprae
acccgcccaagcgaa

SEQ ID NO: 1230477 - RNA, 13 nt, Mycobacterium leprae
acccgccucgauc

SEQ ID NO: 1230478 - RNA, 18 nt, Mycobacterium leprae
accauuucugccgcuggu

SEQ ID NO: 1230479 - RNA, 14 nt, Mycobacterium leprae
accauggaaucguu

SEQ ID NO: 1230480 - RNA, 14 nt, Mycobacterium leprae
acccagccguggug

SEQ ID NO: 1230481 - RNA, 21 nt, Mycobacterium leprae
accaugcggcggacgaucgag

SEQ ID NO: 1230482 - RNA, 16 nt, Mycobacterium leprae
accauaguuacgacgu

SEQ ID NO: 1230483 - RNA, 21 nt, Mycobacterium leprae
accauaguuacgacgucgccg

SEQ ID NO: 1230484 - RNA, 21 nt, Mycobacterium leprae
accauacagcuaaccuccacg

SEQ ID NO: 1230485 - RNA, 19 nt, Mycobacterium leprae
accaguugcacaucagcaa

SEQ ID NO: 1230486 - RNA, 16 nt, Mycobacterium leprae
accgauaccagcggca

SEQ ID NO: 1230487 - RNA, 14 nt, Mycobacterium leprae
accgaccuucgcga

SEQ ID NO: 1230488 - RNA, 23 nt, Mycobacterium leprae
accgagcucuggucugguccggc

SEQ ID NO: 1230489 - RNA, 17 nt, Mycobacterium leprae
accgaccaaccguagug

SEQ ID NO: 1230490 - RNA, 19 nt, Mycobacterium leprae
accgaugcucgcccucgga

SEQ ID NO: 1230491 - RNA, 15 nt, Mycobacterium leprae
accgauccggcggcc

SEQ ID NO: 1230492 - RNA, 21 nt, Mycobacterium leprae
accgaugcagggccagcccgc

SEQ ID NO: 1230493 - RNA, 16 nt, Mycobacterium leprae
accgcagccggagggu

SEQ ID NO: 1230494 - RNA, 13 nt, Mycobacterium leprae
accgcaggcgagc

SEQ ID NO: 1230495 - RNA, 21 nt, Mycobacterium leprae
accgcauacuggcacgccagc

SEQ ID NO: 1230496 - RNA, 13 nt, Mycobacterium leprae
accgcaucaccga

SEQ ID NO: 1230497 - RNA, 16 nt, Mycobacterium leprae
accgcauccggcgcca

SEQ ID NO: 1230498 - RNA, 14 nt, Mycobacterium leprae
accgcgucggcguc

SEQ ID NO: 1230499 - RNA, 15 nt, Mycobacterium leprae
accggauggcugcaa

SEQ ID NO: 1230500 - RNA, 20 nt, Mycobacterium leprae
accggaucgacggcagcgcu

SEQ ID NO: 1230501 - RNA, 18 nt, Mycobacterium leprae
accucuucagacuggaug

SEQ ID NO: 1230502 - RNA, 14 nt, Mycobacterium leprae
accugaccguugcg

SEQ ID NO: 1230503 - RNA, 19 nt, Mycobacterium leprae
accucggcgcuggggcgcu

SEQ ID NO: 1230504 - RNA, 16 nt, Mycobacterium leprae
accuccuugaccacca

SEQ ID NO: 1230505 - RNA, 14 nt, Mycobacterium leprae
accuauacuggaua

SEQ ID NO: 1230506 - RNA, 16 nt, Mycobacterium leprae
accuagauuaggugug

SEQ ID NO: 1230507 - RNA, 20 nt, Mycobacterium leprae
accuaagccaagcucagcgc

SEQ ID NO: 1230508 - RNA, 14 nt, Mycobacterium leprae
accguugcgucgcu

SEQ ID NO: 1230509 - RNA, 11 nt, Mycobacterium leprae
accgugcagcu

SEQ ID NO: 1230510 - RNA, 18 nt, Mycobacterium leprae
accgugguguugucgccg

SEQ ID NO: 1230511 - RNA, 19 nt, Mycobacterium leprae
accgugguguugucgccga

SEQ ID NO: 1230512 - RNA, 18 nt, Mycobacterium leprae
accggugcugcagccacg

SEQ ID NO: 1230513 - RNA, 16 nt, Mycobacterium leprae
accgguuugauccagc

SEQ ID NO: 1230514 - RNA, 17 nt, Mycobacterium leprae
accgguuuaccgcaugu

SEQ ID NO: 1230515 - RNA, 23 nt, Mycobacterium leprae
accguccguccugccggugcggu

SEQ ID NO: 1230516 - RNA, 13 nt, Mycobacterium leprae
accgguagcgugg

SEQ ID NO: 1230517 - RNA, 17 nt, Mycobacterium leprae
accggugauguggccgu

SEQ ID NO: 1230518 - RNA, 18 nt, Mycobacterium leprae
acgaacccgucgaugauc

SEQ ID NO: 1230519 - RNA, 23 nt, Mycobacterium leprae
accuugacugcuaagucgccgaa

SEQ ID NO: 1230520 - RNA, 22 nt, Mycobacterium leprae
acgaagccgccacgaccaaacc

SEQ ID NO: 1230521 - RNA, 18 nt, Mycobacterium leprae
acgaauaacugccaauca

SEQ ID NO: 1230522 - RNA, 15 nt, Mycobacterium leprae
acgaaugcugaccau

SEQ ID NO: 1230523 - RNA, 15 nt, Mycobacterium leprae
acgacagccugccga

SEQ ID NO: 1230524 - RNA, 21 nt, Mycobacterium leprae
acgacgacucaguggcgggcu

SEQ ID NO: 1230525 - RNA, 16 nt, Mycobacterium leprae
acgaccuccgcagcau

SEQ ID NO: 1230526 - RNA, 21 nt, Mycobacterium leprae
acgacuugaccagccgcagca

SEQ ID NO: 1230527 - RNA, 14 nt, Mycobacterium leprae
acgagaaugucgca

SEQ ID NO: 1230528 - RNA, 21 nt, Mycobacterium leprae
acgauccggaaaagucgugga

SEQ ID NO: 1230529 - RNA, 22 nt, Mycobacterium leprae
acgcaacgagguaagacaaggu

SEQ ID NO: 1230530 - RNA, 14 nt, Mycobacterium leprae
cucauuguggcugg

SEQ ID NO: 1230531 - RNA, 23 nt, Mycobacterium leprae
cuccacuauucggguagacgaug

SEQ ID NO: 1230532 - RNA, 14 nt, Mycobacterium leprae
cucacacucacgcc

SEQ ID NO: 1230533 - RNA, 22 nt, Mycobacterium leprae
cucacaauugacaacacgaucg

SEQ ID NO: 1230534 - RNA, 20 nt, Mycobacterium leprae
cucacuaacguucggugacg

SEQ ID NO: 1230535 - RNA, 20 nt, Mycobacterium leprae
cucagcaacuucuugugggg

SEQ ID NO: 1230536 - RNA, 16 nt, Mycobacterium leprae
cuauaguacggcggcg

SEQ ID NO: 1230537 - RNA, 15 nt, Mycobacterium leprae
cuauaaggcagcucg

SEQ ID NO: 1230538 - RNA, 12 nt, Mycobacterium leprae
cuagccgccggg

SEQ ID NO: 1230539 - RNA, 18 nt, Mycobacterium leprae
cuagccgaagcggccgga

SEQ ID NO: 1230540 - RNA, 14 nt, Mycobacterium leprae
cuagagucgaccgc

SEQ ID NO: 1230541 - RNA, 16 nt, Mycobacterium leprae
cuacggcguugcgggc

SEQ ID NO: 1230542 - RNA, 14 nt, Mycobacterium leprae
cucaaccaugccgc

SEQ ID NO: 1230543 - RNA, 23 nt, Mycobacterium leprae
cuaugucacuucccaccguggug

SEQ ID NO: 1230544 - RNA, 16 nt, Mycobacterium leprae
cuaugugcaaucgauc

SEQ ID NO: 1230545 - RNA, 16 nt, Mycobacterium leprae
cuaucguaccggucaa

SEQ ID NO: 1230546 - RNA, 20 nt, Mycobacterium leprae
cuauccucgggugcgcacgg

SEQ ID NO: 1230547 - RNA, 19 nt, Mycobacterium leprae
cuccuugaccaccaccgcc

SEQ ID NO: 1230548 - RNA, 19 nt, Mycobacterium leprae
cucccaucggcggccagcu

SEQ ID NO: 1230549 - RNA, 15 nt, Mycobacterium leprae
cuccggaaauacggc

SEQ ID NO: 1230550 - RNA, 16 nt, Mycobacterium leprae
cucgcacacaacgccg

SEQ ID NO: 1230551 - RNA, 15 nt, Mycobacterium leprae
cucgccggcgguacu

SEQ ID NO: 1230552 - RNA, 16 nt, Mycobacterium leprae
cucgcgggcggcguga

SEQ ID NO: 1230553 - RNA, 14 nt, Mycobacterium leprae
cucggacaccggga

SEQ ID NO: 1230554 - RNA, 13 nt, Mycobacterium leprae
cugaauucguggu

SEQ ID NO: 1230555 - RNA, 14 nt, Mycobacterium leprae
cugacagacauggc

SEQ ID NO: 1230556 - RNA, 22 nt, Mycobacterium leprae
cugacaucggcuacggcaaccg

SEQ ID NO: 1230557 - RNA, 20 nt, Mycobacterium leprae
cugaccaagaaguuaccgag

SEQ ID NO: 1230558 - RNA, 16 nt, Mycobacterium leprae
cugaccacucgcgacg

SEQ ID NO: 1230559 - RNA, 16 nt, Mycobacterium leprae
cugaaccaggggucgg

SEQ ID NO: 1230560 - RNA, 19 nt, Mycobacterium leprae
cugaacauuaguuccuggg

SEQ ID NO: 1230561 - RNA, 16 nt, Mycobacterium leprae
cugaaccugccaucca

SEQ ID NO: 1230562 - RNA, 19 nt, Mycobacterium leprae
cucuguugcuguccaccga

SEQ ID NO: 1230563 - RNA, 20 nt, Mycobacterium leprae
cucugguaacggaccuggca

SEQ ID NO: 1230564 - RNA, 16 nt, Mycobacterium leprae
cucugguggccaccga

SEQ ID NO: 1230565 - RNA, 19 nt, Mycobacterium leprae
cucuagcuggucccacagc

SEQ ID NO: 1230566 - RNA, 14 nt, Mycobacterium leprae
cucugccgccucga

SEQ ID NO: 1230567 - RNA, 15 nt, Mycobacterium leprae
cucugcgguaucgcc

SEQ ID NO: 1230568 - RNA, 19 nt, Mycobacterium leprae
cucugcguaggccaggucu

SEQ ID NO: 1230569 - RNA, 16 nt, Mycobacterium leprae
cugacggagcaagcgc

SEQ ID NO: 1230570 - RNA, 14 nt, Mycobacterium leprae
cugacgcugcgcug

SEQ ID NO: 1230571 - RNA, 14 nt, Mycobacterium leprae
cugagacaucgcca

SEQ ID NO: 1230572 - RNA, 18 nt, Mycobacterium leprae
cugaccguugcgucgcug

SEQ ID NO: 1230573 - RNA, 18 nt, Mycobacterium leprae
cugaguccgaugaugguu

SEQ ID NO: 1230574 - RNA, 17 nt, Mycobacterium leprae
cugaucaccggccagcc

SEQ ID NO: 1230575 - RNA, 13 nt, Mycobacterium leprae
cugaggcagcagc

SEQ ID NO: 1230576 - RNA, 21 nt, Mycobacterium leprae
cugaggcggccggcacugaga

SEQ ID NO: 1230577 - RNA, 18 nt, Mycobacterium leprae
cugagcgggccagcacca

SEQ ID NO: 1230578 - RNA, 21 nt, Mycobacterium leprae
cugccacggccccggaugcgu

SEQ ID NO: 1230579 - RNA, 16 nt, Mycobacterium leprae
cugcauggacgauauc

SEQ ID NO: 1230580 - RNA, 14 nt, Mycobacterium leprae
cugcauccgcagca

SEQ ID NO: 1230581 - RNA, 13 nt, Mycobacterium leprae
cugcagcggucag

SEQ ID NO: 1230582 - RNA, 11 nt, Mycobacterium leprae
cugcagcuacu

SEQ ID NO: 1230583 - RNA, 20 nt, Mycobacterium leprae
cugccagagaugcguagcca

SEQ ID NO: 1230584 - RNA, 16 nt, Mycobacterium leprae
cugcccgacgaggcgg

SEQ ID NO: 1230585 - RNA, 21 nt, Mycobacterium leprae
cugauugccaacucaccgcag

SEQ ID NO: 1230586 - RNA, 23 nt, Mycobacterium leprae
cugcaacgcuucgugcaucgggu

SEQ ID NO: 1230587 - RNA, 16 nt, Mycobacterium leprae
cugcaacucaucggcu

SEQ ID NO: 1230588 - RNA, 17 nt, Mycobacterium leprae
cugaucggucagcucga

SEQ ID NO: 1230589 - RNA, 18 nt, Mycobacterium leprae
cugaugacgcgacgccgg

SEQ ID NO: 1230590 - RNA, 18 nt, Mycobacterium leprae
cugauggccgucgaugau

SEQ ID NO: 1230591 - RNA, 21 nt, Mycobacterium leprae
cugauggccuaaacuccgggc

SEQ ID NO: 1230592 - RNA, 19 nt, Mycobacterium leprae
cugcacgucuacgucuuca

SEQ ID NO: 1230593 - RNA, 20 nt, Mycobacterium leprae
aaccgauuuucucggcagca

SEQ ID NO: 1230594 - RNA, 11 nt, Mycobacterium leprae
aacccguuguc

SEQ ID NO: 1230595 - RNA, 20 nt, Mycobacterium leprae
cgugaagauaggucgccgaa

SEQ ID NO: 1230596 - RNA, 16 nt, Mycobacterium leprae
cgugacaucgacccgu

SEQ ID NO: 1230597 - RNA, 21 nt, Mycobacterium leprae
cgucuuucucauuguggcugg

SEQ ID NO: 1230598 - RNA, 15 nt, Mycobacterium leprae
cgucuuccggaaaac

SEQ ID NO: 1230599 - RNA, 19 nt, Mycobacterium leprae
cgucuggaacacgaucggc

SEQ ID NO: 1230600 - RNA, 18 nt, Mycobacterium leprae
cgucgucgcaucggugau

SEQ ID NO: 1230601 - RNA, 14 nt, Mycobacterium leprae
cgugauggacgacc

SEQ ID NO: 1230602 - RNA, 15 nt, Mycobacterium leprae
cgugcacacgucgag

SEQ ID NO: 1230603 - RNA, 23 nt, Mycobacterium leprae
cgugcaauuugucacgaaucgcu

SEQ ID NO: 1230604 - RNA, 15 nt, Mycobacterium leprae
cgugagccggucggc

SEQ ID NO: 1230605 - RNA, 15 nt, Mycobacterium leprae
cgugcacggcgagga

SEQ ID NO: 1230606 - RNA, 17 nt, Mycobacterium leprae
cgugcaggauucacccg

SEQ ID NO: 1230607 - RNA, 22 nt, Mycobacterium leprae
cgugcagcgaccucaugcccgg

SEQ ID NO: 1230608 - RNA, 16 nt, Mycobacterium leprae
cgugccgaugcggaau

SEQ ID NO: 1230609 - RNA, 23 nt, Mycobacterium leprae
cgugccgaaguguaaucggccga

SEQ ID NO: 1230610 - RNA, 17 nt, Mycobacterium leprae
cguguuuucaguucacg

SEQ ID NO: 1230611 - RNA, 14 nt, Mycobacterium leprae
cguguucguuguuc

SEQ ID NO: 1230612 - RNA, 12 nt, Mycobacterium leprae
cgugguggcugg

SEQ ID NO: 1230613 - RNA, 21 nt, Mycobacterium leprae
cguuccggccuucgucagcug

SEQ ID NO: 1230614 - RNA, 16 nt, Mycobacterium leprae
cguugcaaaucaccag

SEQ ID NO: 1230615 - RNA, 13 nt, Mycobacterium leprae
cguugacguggug

SEQ ID NO: 1230616 - RNA, 15 nt, Mycobacterium leprae
cgugcugaggguggc

SEQ ID NO: 1230617 - RNA, 18 nt, Mycobacterium leprae
cgugcugaucaccggcca

SEQ ID NO: 1230618 - RNA, 16 nt, Mycobacterium leprae
cguggacuucugcgcg

SEQ ID NO: 1230619 - RNA, 18 nt, Mycobacterium leprae
cguggcgagugcugacgc

SEQ ID NO: 1230620 - RNA, 21 nt, Mycobacterium leprae
cguggcgagugcugacgccgg

SEQ ID NO: 1230621 - RNA, 12 nt, Mycobacterium leprae
cguggucggcga

SEQ ID NO: 1230622 - RNA, 16 nt, Mycobacterium leprae
cgucaccaagcgcaga

SEQ ID NO: 1230623 - RNA, 16 nt, Mycobacterium leprae
cguaugaccgcggucg

SEQ ID NO: 1230624 - RNA, 17 nt, Mycobacterium leprae
cguaugaccgcggucgg

SEQ ID NO: 1230625 - RNA, 17 nt, Mycobacterium leprae
cguaguacccggccaga

SEQ ID NO: 1230626 - RNA, 19 nt, Mycobacterium leprae
cguagcgcaccaauccacc

SEQ ID NO: 1230627 - RNA, 17 nt, Mycobacterium leprae
cguacguaugccgccaa

SEQ ID NO: 1230628 - RNA, 12 nt, Mycobacterium leprae
cguacaacgugu

SEQ ID NO: 1230629 - RNA, 20 nt, Mycobacterium leprae
cgguugccugucgauuacca

SEQ ID NO: 1230630 - RNA, 13 nt, Mycobacterium leprae
cgguuuuggcggu

SEQ ID NO: 1230631 - RNA, 16 nt, Mycobacterium leprae
cgguuucgggaaagcu

SEQ ID NO: 1230632 - RNA, 16 nt, Mycobacterium leprae
cggucgccgaugcgcu

SEQ ID NO: 1230633 - RNA, 15 nt, Mycobacterium leprae
cguccgcgccggcgu

SEQ ID NO: 1230634 - RNA, 13 nt, Mycobacterium leprae
cguccgcggcagc

SEQ ID NO: 1230635 - RNA, 15 nt, Mycobacterium leprae
cguccgcggcagcug

SEQ ID NO: 1230636 - RNA, 13 nt, Mycobacterium leprae
cgucccacgccaa

SEQ ID NO: 1230637 - RNA, 15 nt, Mycobacterium leprae
cguccucgucgguga

SEQ ID NO: 1230638 - RNA, 19 nt, Mycobacterium leprae
cguccaucuuguuggccgg

SEQ ID NO: 1230639 - RNA, 19 nt, Mycobacterium leprae
cgucgcugauacaacugga

SEQ ID NO: 1230640 - RNA, 17 nt, Mycobacterium leprae
cgucgcugcuuccugaa

SEQ ID NO: 1230641 - RNA, 14 nt, Mycobacterium leprae
cgucgaugucgggg

SEQ ID NO: 1230642 - RNA, 22 nt, Mycobacterium leprae
cgucgcccaacguaucggcgau

SEQ ID NO: 1230643 - RNA, 16 nt, Mycobacterium leprae
cgucgaggaccgccau

SEQ ID NO: 1230644 - RNA, 23 nt, Mycobacterium leprae
cgucgacgaguuccaggacaacg

SEQ ID NO: 1230645 - RNA, 14 nt, Mycobacterium leprae
gacaucgccaccga

SEQ ID NO: 1230646 - RNA, 18 nt, Mycobacterium leprae
gacaucgccaccgaccgc

SEQ ID NO: 1230647 - RNA, 18 nt, Mycobacterium leprae
gacaucacuugcugaccg

SEQ ID NO: 1230648 - RNA, 16 nt, Mycobacterium leprae
gacauacaggacgauc

SEQ ID NO: 1230649 - RNA, 16 nt, Mycobacterium leprae
gacagcggcccaaccc

SEQ ID NO: 1230650 - RNA, 18 nt, Mycobacterium leprae
gacagaugcgaucgcagu

SEQ ID NO: 1230651 - RNA, 19 nt, Mycobacterium leprae
gacagaauaguuuccggac

SEQ ID NO: 1230652 - RNA, 16 nt, Mycobacterium leprae
gacaccgcccgguauc

SEQ ID NO: 1230653 - RNA, 22 nt, Mycobacterium leprae
gacacagccgucagggcagcag

SEQ ID NO: 1230654 - RNA, 15 nt, Mycobacterium leprae
gaacucgauacaguc

SEQ ID NO: 1230655 - RNA, 22 nt, Mycobacterium leprae
gaaucgaucccacugacgccga

SEQ ID NO: 1230656 - RNA, 16 nt, Mycobacterium leprae
gacaagucaaaaccag

SEQ ID NO: 1230657 - RNA, 17 nt, Mycobacterium leprae
gacaacggcggcaaggu

SEQ ID NO: 1230658 - RNA, 16 nt, Mycobacterium leprae
gacaacggugccgggu

SEQ ID NO: 1230659 - RNA, 20 nt, Mycobacterium leprae
gacaaccucguuacgaucca

SEQ ID NO: 1230660 - RNA, 15 nt, Mycobacterium leprae
gacaacgauccggaa

SEQ ID NO: 1230661 - RNA, 18 nt, Mycobacterium leprae
gacaaagucagcuugucg

SEQ ID NO: 1230662 - RNA, 19 nt, Mycobacterium leprae
gaauugaccgacggcgccg

SEQ ID NO: 1230663 - RNA, 16 nt, Mycobacterium leprae
gaaugcgaugcuggcc

SEQ ID NO: 1230664 - RNA, 20 nt, Mycobacterium leprae
gaaugcgaugcuggccgugu

SEQ ID NO: 1230665 - RNA, 14 nt, Mycobacterium leprae
gaccaugugaccgc

SEQ ID NO: 1230666 - RNA, 15 nt, Mycobacterium leprae
gaccagccaagccgc

SEQ ID NO: 1230667 - RNA, 14 nt, Mycobacterium leprae
gaccagccacgcaa

SEQ ID NO: 1230668 - RNA, 14 nt, Mycobacterium leprae
gaccagcgagcaac

SEQ ID NO: 1230669 - RNA, 18 nt, Mycobacterium leprae
aacgccccuaccccgcgg

SEQ ID NO: 1230670 - RNA, 18 nt, Mycobacterium leprae
aacgccgccuuuacgaag

SEQ ID NO: 1230671 - RNA, 17 nt, Mycobacterium leprae
gaccaccgaaccgggca

SEQ ID NO: 1230672 - RNA, 15 nt, Mycobacterium leprae
aacgcgguguucguc

SEQ ID NO: 1230673 - RNA, 23 nt, Mycobacterium leprae
aacggaaauggguuuggugggca

SEQ ID NO: 1230674 - RNA, 16 nt, Mycobacterium leprae
gaccgagcgcgacaau

SEQ ID NO: 1230675 - RNA, 22 nt, Mycobacterium leprae
gaccgaguugggccaugcaguc

SEQ ID NO: 1230676 - RNA, 17 nt, Mycobacterium leprae
gaccgcccgguagcacc

SEQ ID NO: 1230677 - RNA, 20 nt, Mycobacterium leprae
gaccgcccuggaccgcagca

SEQ ID NO: 1230678 - RNA, 15 nt, Mycobacterium leprae
gaccgcgugaucgcu

SEQ ID NO: 1230679 - RNA, 15 nt, Mycobacterium leprae
gaccgcggugcagug

SEQ ID NO: 1230680 - RNA, 16 nt, Mycobacterium leprae
gaccgcggucggcauc

SEQ ID NO: 1230681 - RNA, 15 nt, Mycobacterium leprae
aacguccaguauguc

SEQ ID NO: 1230682 - RNA, 20 nt, Mycobacterium leprae
aacguccaguaugucgucaa

SEQ ID NO: 1230683 - RNA, 15 nt, Mycobacterium leprae
aacgucaucguccuc

SEQ ID NO: 1230684 - RNA, 19 nt, Mycobacterium leprae
gacgguccugguggcaacg

SEQ ID NO: 1230685 - RNA, 16 nt, Mycobacterium leprae
gacgguaacugaccaa

SEQ ID NO: 1230686 - RNA, 17 nt, Mycobacterium leprae
gacgggcaguaucuacc

SEQ ID NO: 1230687 - RNA, 20 nt, Mycobacterium leprae
gacggauucaaaggucgaca

SEQ ID NO: 1230688 - RNA, 20 nt, Mycobacterium leprae
gacggauuucucgugguggc

SEQ ID NO: 1230689 - RNA, 19 nt, Mycobacterium leprae
gacggccggcgucgcguca

SEQ ID NO: 1230690 - RNA, 17 nt, Mycobacterium leprae
gacggccggaucaucga

SEQ ID NO: 1230691 - RNA, 13 nt, Mycobacterium leprae
gacggcccagcac

SEQ ID NO: 1230692 - RNA, 15 nt, Mycobacterium leprae
gacggcccagcacca

SEQ ID NO: 1230693 - RNA, 18 nt, Mycobacterium leprae
gacgcuuucgagcaguag

SEQ ID NO: 1230694 - RNA, 20 nt, Mycobacterium leprae
gacggacacuguccacucgg

SEQ ID NO: 1230695 - RNA, 12 nt, Mycobacterium leprae
gacggagcgcag

SEQ ID NO: 1230696 - RNA, 13 nt, Mycobacterium leprae
gacgcugcgcuga

SEQ ID NO: 1230697 - RNA, 14 nt, Mycobacterium leprae
gacgcuaccgagga

SEQ ID NO: 1230698 - RNA, 22 nt, Mycobacterium leprae
gacgcuauguuggccagcagcg

SEQ ID NO: 1230699 - RNA, 21 nt, Mycobacterium leprae
gaccuucggagucuugaugcc

SEQ ID NO: 1230700 - RNA, 16 nt, Mycobacterium leprae
gaccuggugacgucgu

SEQ ID NO: 1230701 - RNA, 17 nt, Mycobacterium leprae
gacgaggugucggcgau

SEQ ID NO: 1230702 - RNA, 13 nt, Mycobacterium leprae
gacgaggcgguga

SEQ ID NO: 1230703 - RNA, 19 nt, Mycobacterium leprae
gacgaucgcaaucgacggc

SEQ ID NO: 1230704 - RNA, 21 nt, Mycobacterium leprae
aacgucacgucgacggcggcc

SEQ ID NO: 1230705 - RNA, 16 nt, Mycobacterium leprae
gacgaugaucggcuug

SEQ ID NO: 1230706 - RNA, 19 nt, Mycobacterium leprae
gacgaugaucggcuugccg

SEQ ID NO: 1230707 - RNA, 17 nt, Mycobacterium leprae
gacgaugcaguggguga

SEQ ID NO: 1230708 - RNA, 15 nt, Mycobacterium leprae
gacgccgcggcugcc

SEQ ID NO: 1230709 - RNA, 17 nt, Mycobacterium leprae
gacgccggccgucgcgg

SEQ ID NO: 1230710 - RNA, 22 nt, Mycobacterium leprae
gaacacgaucggcuccgcauac

SEQ ID NO: 1230711 - RNA, 17 nt, Mycobacterium leprae
aaccuugguugccgcgg

SEQ ID NO: 1230712 - RNA, 16 nt, Mycobacterium leprae
aaccugggcggcauga

SEQ ID NO: 1230713 - RNA, 21 nt, Mycobacterium leprae
aaccugcgcggcugccgcacc

SEQ ID NO: 1230714 - RNA, 17 nt, Mycobacterium leprae
aaccugcugaucgaauu

SEQ ID NO: 1230715 - RNA, 23 nt, Mycobacterium leprae
gaaccaguucuugguaaucaggu

SEQ ID NO: 1230716 - RNA, 20 nt, Mycobacterium leprae
gaaccaucacuaucgucgug

SEQ ID NO: 1230717 - RNA, 22 nt, Mycobacterium leprae
gaacagcggcguaaccgggaaa

SEQ ID NO: 1230718 - RNA, 17 nt, Mycobacterium leprae
gaacagcucgacagcag

SEQ ID NO: 1230719 - RNA, 22 nt, Mycobacterium leprae
gaacagccuugcaaaacgucga

SEQ ID NO: 1230720 - RNA, 12 nt, Mycobacterium leprae
gaacuagccgaa

SEQ ID NO: 1230721 - RNA, 23 nt, Mycobacterium leprae
gaacucagcgguaagcggauccu

SEQ ID NO: 1230722 - RNA, 16 nt, Mycobacterium leprae
gaacgccucggcaagc

SEQ ID NO: 1230723 - RNA, 14 nt, Mycobacterium leprae
gaaaacucgaucga

SEQ ID NO: 1230724 - RNA, 14 nt, Mycobacterium leprae
gaaaaccaagcugu

SEQ ID NO: 1230725 - RNA, 17 nt, Mycobacterium leprae
gaaaaauccgcgcaaca

SEQ ID NO: 1230726 - RNA, 15 nt, Mycobacterium leprae
cuuuugaccagcacu

SEQ ID NO: 1230727 - RNA, 19 nt, Mycobacterium leprae
cuuugggccaucggcagau

SEQ ID NO: 1230728 - RNA, 23 nt, Mycobacterium leprae
cuuugcgguugagcucgaggaga

SEQ ID NO: 1230729 - RNA, 20 nt, Mycobacterium leprae
cuuugcuggucagcgucagu

SEQ ID NO: 1230730 - RNA, 20 nt, Mycobacterium leprae
cuuucuaguugauaugcguu

SEQ ID NO: 1230731 - RNA, 23 nt, Mycobacterium leprae
cuuucuccgggucgcgggacaac

SEQ ID NO: 1230732 - RNA, 20 nt, Mycobacterium leprae
cuugggcgccucgucggcca

SEQ ID NO: 1230733 - RNA, 14 nt, Mycobacterium leprae
aaccgugucggccc

SEQ ID NO: 1230734 - RNA, 19 nt, Mycobacterium leprae
aaccggugauugccgcggu

SEQ ID NO: 1230735 - RNA, 15 nt, Mycobacterium leprae
cuuuagcccgccgcg

SEQ ID NO: 1230736 - RNA, 15 nt, Mycobacterium leprae
cuugucaccagauug

SEQ ID NO: 1230737 - RNA, 14 nt, Mycobacterium leprae
cuuggggacgccgg

SEQ ID NO: 1230738 - RNA, 21 nt, Mycobacterium leprae
cuuaagcugcauaugcagcug

SEQ ID NO: 1230739 - RNA, 14 nt, Mycobacterium leprae
cuguguugccaucg

SEQ ID NO: 1230740 - RNA, 15 nt, Mycobacterium leprae
cuguuacgaggacuc

SEQ ID NO: 1230741 - RNA, 19 nt, Mycobacterium leprae
cuguuguggggguggagua

SEQ ID NO: 1230742 - RNA, 17 nt, Mycobacterium leprae
cuguuguuaccggcgaa

SEQ ID NO: 1230743 - RNA, 12 nt, Mycobacterium leprae
cuguuguugguc

SEQ ID NO: 1230744 - RNA, 17 nt, Mycobacterium leprae
cuguggcacccacucgg

SEQ ID NO: 1230745 - RNA, 22 nt, Mycobacterium leprae
cugugucacgcgaccaacgccg

SEQ ID NO: 1230746 - RNA, 17 nt, Mycobacterium leprae
cugucgcgaccaacccg

SEQ ID NO: 1230747 - RNA, 18 nt, Mycobacterium leprae
cuucagcgacaggcagcu

SEQ ID NO: 1230748 - RNA, 21 nt, Mycobacterium leprae
cuucaauaccgaccgaaagcc

SEQ ID NO: 1230749 - RNA, 21 nt, Mycobacterium leprae
cuucauguccuacacaaacaa

SEQ ID NO: 1230750 - RNA, 20 nt, Mycobacterium leprae
cuuccgauuguccaugccac

SEQ ID NO: 1230751 - RNA, 16 nt, Mycobacterium leprae
cuucgcagacacagcc

SEQ ID NO: 1230752 - RNA, 16 nt, Mycobacterium leprae
cuggcugagggccggu

SEQ ID NO: 1230753 - RNA, 15 nt, Mycobacterium leprae
cuggcguagcggagc

SEQ ID NO: 1230754 - RNA, 16 nt, Mycobacterium leprae
cugggaccaccugaga

SEQ ID NO: 1230755 - RNA, 15 nt, Mycobacterium leprae
cuggcaagcucgggu

SEQ ID NO: 1230756 - RNA, 20 nt, Mycobacterium leprae
cuggaucagcgcgccaaaca

SEQ ID NO: 1230757 - RNA, 20 nt, Mycobacterium leprae
cugcccugccccgguggcug

SEQ ID NO: 1230758 - RNA, 14 nt, Mycobacterium leprae
cugcccguaugcac

SEQ ID NO: 1230759 - RNA, 15 nt, Mycobacterium leprae
cuggcaagugccgcg

SEQ ID NO: 1230760 - RNA, 21 nt, Mycobacterium leprae
cuggcccuguuccucgcgggc

SEQ ID NO: 1230761 - RNA, 19 nt, Mycobacterium leprae
cuggccuaccgggcgcuca

SEQ ID NO: 1230762 - RNA, 22 nt, Mycobacterium leprae
cuggccuccuaggccacccgcc

SEQ ID NO: 1230763 - RNA, 19 nt, Mycobacterium leprae
cuggcgcaauuuggugauc

SEQ ID NO: 1230764 - RNA, 22 nt, Mycobacterium leprae
gaugccaaccugcgcggcugcc

SEQ ID NO: 1230765 - RNA, 17 nt, Mycobacterium leprae
gaugauggugccgaugu

SEQ ID NO: 1230766 - RNA, 14 nt, Mycobacterium leprae
gaugaggcucgugc

SEQ ID NO: 1230767 - RNA, 21 nt, Mycobacterium leprae
gaugcgcaccucgcugcagca

SEQ ID NO: 1230768 - RNA, 20 nt, Mycobacterium leprae
gaugccguuuucaccaaacu

SEQ ID NO: 1230769 - RNA, 14 nt, Mycobacterium leprae
gaugacaccgaaca

SEQ ID NO: 1230770 - RNA, 16 nt, Mycobacterium leprae
gaugaauuugccgcga

SEQ ID NO: 1230771 - RNA, 20 nt, Mycobacterium leprae
gaugacgaaauucggcggcc

SEQ ID NO: 1230772 - RNA, 22 nt, Mycobacterium leprae
gaugaccauguacgcgacagcu

SEQ ID NO: 1230773 - RNA, 14 nt, Mycobacterium leprae
gaugacucggcgug

SEQ ID NO: 1230774 - RNA, 16 nt, Mycobacterium leprae
gaugacucggcgugcc

SEQ ID NO: 1230775 - RNA, 22 nt, Mycobacterium leprae
gaucugcacaacaccuugcgcc

SEQ ID NO: 1230776 - RNA, 20 nt, Mycobacterium leprae
gaucuucccuaaaguucccu

SEQ ID NO: 1230777 - RNA, 16 nt, Mycobacterium leprae
gaucuugcagcuggcg

SEQ ID NO: 1230778 - RNA, 21 nt, Mycobacterium leprae
gaucuugaguguagcaggucg

SEQ ID NO: 1230779 - RNA, 13 nt, Mycobacterium leprae
gaucucgacgcga

SEQ ID NO: 1230780 - RNA, 23 nt, Mycobacterium leprae
gauuaccggcugcgccguucguc

SEQ ID NO: 1230781 - RNA, 19 nt, Mycobacterium leprae
gauucaaaggucgacacuc

SEQ ID NO: 1230782 - RNA, 18 nt, Mycobacterium leprae
gauugcagauguugcagc

SEQ ID NO: 1230783 - RNA, 12 nt, Mycobacterium leprae
gauuccacugcc

SEQ ID NO: 1230784 - RNA, 17 nt, Mycobacterium leprae
gauucauggcuugcugc

SEQ ID NO: 1230785 - RNA, 17 nt, Mycobacterium leprae
gauuuucuugccgucga

SEQ ID NO: 1230786 - RNA, 20 nt, Mycobacterium leprae
gcaaacuuugucagcggaca

SEQ ID NO: 1230787 - RNA, 17 nt, Mycobacterium leprae
gcaacacggggagaucg

SEQ ID NO: 1230788 - RNA, 20 nt, Mycobacterium leprae
gaugcgcuguuguuggucgg

SEQ ID NO: 1230789 - RNA, 15 nt, Mycobacterium leprae
gaugcucgcccucgg

SEQ ID NO: 1230790 - RNA, 16 nt, Mycobacterium leprae
gauggcugggagggcu

SEQ ID NO: 1230791 - RNA, 17 nt, Mycobacterium leprae
gauggccucuccagcca

SEQ ID NO: 1230792 - RNA, 20 nt, Mycobacterium leprae
gauggccuaaacuccgggcc

SEQ ID NO: 1230793 - RNA, 19 nt, Mycobacterium leprae
gauggccuauaucgcggcg

SEQ ID NO: 1230794 - RNA, 17 nt, Mycobacterium leprae
gauggucggcagcuggu

SEQ ID NO: 1230795 - RNA, 18 nt, Mycobacterium leprae
gauggucggcagcugguu

SEQ ID NO: 1230796 - RNA, 20 nt, Mycobacterium leprae
gaugucagcgucguggcugu

SEQ ID NO: 1230797 - RNA, 17 nt, Mycobacterium leprae
gaucgagcggagcuggg

SEQ ID NO: 1230798 - RNA, 14 nt, Mycobacterium leprae
gaucgaucucgacg

SEQ ID NO: 1230799 - RNA, 15 nt, Mycobacterium leprae
gauccugguuuacug

SEQ ID NO: 1230800 - RNA, 13 nt, Mycobacterium leprae
gaucgacaauguc

SEQ ID NO: 1230801 - RNA, 19 nt, Mycobacterium leprae
gaucgacaccucaccaucu

SEQ ID NO: 1230802 - RNA, 22 nt, Mycobacterium leprae
gaucagcagaaauuuuucggac

SEQ ID NO: 1230803 - RNA, 15 nt, Mycobacterium leprae
gaucaucgaugcacu

SEQ ID NO: 1230804 - RNA, 21 nt, Mycobacterium leprae
gaucauccgcaagcgcgccga

SEQ ID NO: 1230805 - RNA, 13 nt, Mycobacterium leprae
gauacgcgucugg

SEQ ID NO: 1230806 - RNA, 17 nt, Mycobacterium leprae
gauaccagcgucgcuca

SEQ ID NO: 1230807 - RNA, 19 nt, Mycobacterium leprae
gauaacgcugaaccgcguc

SEQ ID NO: 1230808 - RNA, 14 nt, Mycobacterium leprae
gaguacguccgcgc

SEQ ID NO: 1230809 - RNA, 23 nt, Mycobacterium leprae
gauauggcagaguagagaaguca

SEQ ID NO: 1230810 - RNA, 20 nt, Mycobacterium leprae
gaucaccuagaacagcaucg

SEQ ID NO: 1230811 - RNA, 16 nt, Mycobacterium leprae
aacugaucgucgcagg

SEQ ID NO: 1230812 - RNA, 15 nt, Mycobacterium leprae
gagcgguucaucgac

SEQ ID NO: 1230813 - RNA, 18 nt, Mycobacterium leprae
aacugaagauuuggcgag

SEQ ID NO: 1230814 - RNA, 13 nt, Mycobacterium leprae
gagcgcucggcgu

SEQ ID NO: 1230815 - RNA, 22 nt, Mycobacterium leprae
gagcgcguuaggcaugcgcuga

SEQ ID NO: 1230816 - RNA, 15 nt, Mycobacterium leprae
gagcgcuauuaaguc

SEQ ID NO: 1230817 - RNA, 17 nt, Mycobacterium leprae
gagcgcccgcacagcac

SEQ ID NO: 1230818 - RNA, 19 nt, Mycobacterium leprae
gagcgcccgcacagcacca

SEQ ID NO: 1230819 - RNA, 15 nt, Mycobacterium leprae
gacguaacggucggu

SEQ ID NO: 1230820 - RNA, 18 nt, Mycobacterium leprae
gaggcaugggugcguuga

SEQ ID NO: 1230821 - RNA, 22 nt, Mycobacterium leprae
gagcuggucuucuuggcgcuga

SEQ ID NO: 1230822 - RNA, 18 nt, Mycobacterium leprae
gagcugauggccgccagg

SEQ ID NO: 1230823 - RNA, 16 nt, Mycobacterium leprae
gagcgucgugaccgcg

SEQ ID NO: 1230824 - RNA, 17 nt, Mycobacterium leprae
gagcucgaagucaacga

SEQ ID NO: 1230825 - RNA, 17 nt, Mycobacterium leprae
gagcucaaacgaccgga

SEQ ID NO: 1230826 - RNA, 17 nt, Mycobacterium leprae
gagcucaccggcggcga

SEQ ID NO: 1230827 - RNA, 16 nt, Mycobacterium leprae
gaggguacgagugguu

SEQ ID NO: 1230828 - RNA, 12 nt, Mycobacterium leprae
gagggucgacga

SEQ ID NO: 1230829 - RNA, 15 nt, Mycobacterium leprae
gaggggaccgcgucg

SEQ ID NO: 1230830 - RNA, 17 nt, Mycobacterium leprae
gaggucgaagcugcccu

SEQ ID NO: 1230831 - RNA, 18 nt, Mycobacterium leprae
gcagguggaucgucggcc

SEQ ID NO: 1230832 - RNA, 22 nt, Mycobacterium leprae
gcagguugaggaggugcuggau

SEQ ID NO: 1230833 - RNA, 18 nt, Mycobacterium leprae
gcagguugcugucguguu

SEQ ID NO: 1230834 - RNA, 18 nt, Mycobacterium leprae
gcagggcguugccguccc

SEQ ID NO: 1230835 - RNA, 19 nt, Mycobacterium leprae
gcagggcgagcugcgccga

SEQ ID NO: 1230836 - RNA, 13 nt, Mycobacterium leprae
gcaggcugcaucc

SEQ ID NO: 1230837 - RNA, 13 nt, Mycobacterium leprae
gcaggccggccug

SEQ ID NO: 1230838 - RNA, 14 nt, Mycobacterium leprae
gcagcaagcggccg

SEQ ID NO: 1230839 - RNA, 17 nt, Mycobacterium leprae
gcagcggaccgcggacc

SEQ ID NO: 1230840 - RNA, 21 nt, Mycobacterium leprae
gcagcuaaucccaugggaguu

SEQ ID NO: 1230841 - RNA, 21 nt, Mycobacterium leprae
gcagcgugucguuguacagac

SEQ ID NO: 1230842 - RNA, 16 nt, Mycobacterium leprae
gcagcuccagcucgcg

SEQ ID NO: 1230843 - RNA, 17 nt, Mycobacterium leprae
gcaggacugauggccgu

SEQ ID NO: 1230844 - RNA, 18 nt, Mycobacterium leprae
gcagcuucaaaccggcca

SEQ ID NO: 1230845 - RNA, 17 nt, Mycobacterium leprae
gcagcuuccugcggugg

SEQ ID NO: 1230846 - RNA, 18 nt, Mycobacterium leprae
gcagcuuccugcgguggu

SEQ ID NO: 1230847 - RNA, 18 nt, Mycobacterium leprae
gcagcuugaacgccgcga

SEQ ID NO: 1230848 - RNA, 20 nt, Mycobacterium leprae
gcagcuugaacgccgcgagc

SEQ ID NO: 1230849 - RNA, 15 nt, Mycobacterium leprae
gcagcugggauagcu

SEQ ID NO: 1230850 - RNA, 17 nt, Mycobacterium leprae
gcagcuggccaagcgga

SEQ ID NO: 1230851 - RNA, 15 nt, Mycobacterium leprae
gcagagguaaaucug

SEQ ID NO: 1230852 - RNA, 16 nt, Mycobacterium leprae
gcacuguaucucgugc

SEQ ID NO: 1230853 - RNA, 18 nt, Mycobacterium leprae
gcacuauaaggcagcucg

SEQ ID NO: 1230854 - RNA, 22 nt, Mycobacterium leprae
gcacuccuacgguguauggcgu

SEQ ID NO: 1230855 - RNA, 22 nt, Mycobacterium leprae
gcacugccgaucucguguuaca

SEQ ID NO: 1230856 - RNA, 17 nt, Mycobacterium leprae
gcacugagaguacugac

SEQ ID NO: 1230857 - RNA, 16 nt, Mycobacterium leprae
gcacugagcaguugcg

SEQ ID NO: 1230858 - RNA, 16 nt, Mycobacterium leprae
gcacgggguguuggcg

SEQ ID NO: 1230859 - RNA, 23 nt, Mycobacterium leprae
gcacgaguuggauugaucguccg

SEQ ID NO: 1230860 - RNA, 14 nt, Mycobacterium leprae
gcacgauaggcagu

SEQ ID NO: 1230861 - RNA, 15 nt, Mycobacterium leprae
gcacagugccugacc

SEQ ID NO: 1230862 - RNA, 12 nt, Mycobacterium leprae
gcaccaaacccg

SEQ ID NO: 1230863 - RNA, 16 nt, Mycobacterium leprae
gcacacaacgccgagg

SEQ ID NO: 1230864 - RNA, 19 nt, Mycobacterium leprae
gcacaccguguccgaacgg

SEQ ID NO: 1230865 - RNA, 16 nt, Mycobacterium leprae
gcacacgagaccauga

SEQ ID NO: 1230866 - RNA, 17 nt, Mycobacterium leprae
gcacacgacagccgcaa

SEQ ID NO: 1230867 - RNA, 16 nt, Mycobacterium leprae
gcaccauucuggucga

SEQ ID NO: 1230868 - RNA, 18 nt, Mycobacterium leprae
gcacccacgcugcgcggc

SEQ ID NO: 1230869 - RNA, 14 nt, Mycobacterium leprae
gcaccaggucgucg

SEQ ID NO: 1230870 - RNA, 17 nt, Mycobacterium leprae
aagauguuccggcgacc

SEQ ID NO: 1230871 - RNA, 20 nt, Mycobacterium leprae
aagauguuccggcgaccagc

SEQ ID NO: 1230872 - RNA, 13 nt, Mycobacterium leprae
gccgcacguuaga

SEQ ID NO: 1230873 - RNA, 18 nt, Mycobacterium leprae
gccgacagugccacggug

SEQ ID NO: 1230874 - RNA, 13 nt, Mycobacterium leprae
gccgaacagccgc

SEQ ID NO: 1230875 - RNA, 17 nt, Mycobacterium leprae
gcccuugcccacgucca

SEQ ID NO: 1230876 - RNA, 16 nt, Mycobacterium leprae
gccgaagagcugcagc

SEQ ID NO: 1230877 - RNA, 20 nt, Mycobacterium leprae
gcccugcacuugcacuucga

SEQ ID NO: 1230878 - RNA, 23 nt, Mycobacterium leprae
gccgcgaguuggccgagcgucga

SEQ ID NO: 1230879 - RNA, 19 nt, Mycobacterium leprae
gccgccuuuacgaagccgc

SEQ ID NO: 1230880 - RNA, 14 nt, Mycobacterium leprae
gccgccucgaugcg

SEQ ID NO: 1230881 - RNA, 13 nt, Mycobacterium leprae
gccgccagaugcc

SEQ ID NO: 1230882 - RNA, 23 nt, Mycobacterium leprae
gccgccgugguggcugucgggca

SEQ ID NO: 1230883 - RNA, 13 nt, Mycobacterium leprae
gccgccguccacu

SEQ ID NO: 1230884 - RNA, 20 nt, Mycobacterium leprae
gccgccggcggcacagaccg

SEQ ID NO: 1230885 - RNA, 20 nt, Mycobacterium leprae
gccgcuaaacggaauacagc

SEQ ID NO: 1230886 - RNA, 22 nt, Mycobacterium leprae
gccgcucgaccaugugaccgcg

SEQ ID NO: 1230887 - RNA, 17 nt, Mycobacterium leprae
gccgcggcugcgcucac

SEQ ID NO: 1230888 - RNA, 14 nt, Mycobacterium leprae
gccgcgcuggccuc

SEQ ID NO: 1230889 - RNA, 16 nt, Mycobacterium leprae
gccgcgcuacggcggu

SEQ ID NO: 1230890 - RNA, 18 nt, Mycobacterium leprae
gcccaccauguuuccgau

SEQ ID NO: 1230891 - RNA, 17 nt, Mycobacterium leprae
gcccaacuagucgcccg

SEQ ID NO: 1230892 - RNA, 18 nt, Mycobacterium leprae
gcccaauggugcggcgau

SEQ ID NO: 1230893 - RNA, 14 nt, Mycobacterium leprae
gccauuuggcaccc

SEQ ID NO: 1230894 - RNA, 17 nt, Mycobacterium leprae
gcccagcaguuacuggu

SEQ ID NO: 1230895 - RNA, 15 nt, Mycobacterium leprae
gcccagcgcagcccg

SEQ ID NO: 1230896 - RNA, 22 nt, Mycobacterium leprae
gccccccggacaguccaccgcc

SEQ ID NO: 1230897 - RNA, 18 nt, Mycobacterium leprae
gccccuggcaucaucaac

SEQ ID NO: 1230898 - RNA, 18 nt, Mycobacterium leprae
gccaaguaccggaaucga

SEQ ID NO: 1230899 - RNA, 20 nt, Mycobacterium leprae
gccacaacguagggaugauc

SEQ ID NO: 1230900 - RNA, 21 nt, Mycobacterium leprae
gcagugaacacgcugaucgcu

SEQ ID NO: 1230901 - RNA, 21 nt, Mycobacterium leprae
gcagucguucgcugacagcaa

SEQ ID NO: 1230902 - RNA, 15 nt, Mycobacterium leprae
gccaagaccuaccug

SEQ ID NO: 1230903 - RNA, 14 nt, Mycobacterium leprae
gccaacucggccgc

SEQ ID NO: 1230904 - RNA, 13 nt, Mycobacterium leprae
gcaguccgcguca

SEQ ID NO: 1230905 - RNA, 18 nt, Mycobacterium leprae
gcagucaguuuggcgcug

SEQ ID NO: 1230906 - RNA, 16 nt, Mycobacterium leprae
gcagucgauuagccgg

SEQ ID NO: 1230907 - RNA, 20 nt, Mycobacterium leprae
gccacugugucacgcgacca

SEQ ID NO: 1230908 - RNA, 21 nt, Mycobacterium leprae
gccacuccgguugcggcgagc

SEQ ID NO: 1230909 - RNA, 22 nt, Mycobacterium leprae
gccacgcuggcacuccgaccga

SEQ ID NO: 1230910 - RNA, 19 nt, Mycobacterium leprae
gccaccggugauguggccg

SEQ ID NO: 1230911 - RNA, 20 nt, Mycobacterium leprae
gccaccgcgaacgccucggc

SEQ ID NO: 1230912 - RNA, 16 nt, Mycobacterium leprae
gccacccgcaucguug

SEQ ID NO: 1230913 - RNA, 14 nt, Mycobacterium leprae
gccacuucgcccga

SEQ ID NO: 1230914 - RNA, 20 nt, Mycobacterium leprae
gccagcaucaacgccagcaa

SEQ ID NO: 1230915 - RNA, 14 nt, Mycobacterium leprae
gcuucaucagugug

SEQ ID NO: 1230916 - RNA, 14 nt, Mycobacterium leprae
gcuugagcagcacg

SEQ ID NO: 1230917 - RNA, 18 nt, Mycobacterium leprae
gcuugccgauauucgcga

SEQ ID NO: 1230918 - RNA, 18 nt, Mycobacterium leprae
gcuugauuugcacaacau

SEQ ID NO: 1230919 - RNA, 21 nt, Mycobacterium leprae
gcuugagccuguugcaagcgg

SEQ ID NO: 1230920 - RNA, 14 nt, Mycobacterium leprae
gcuuucgaugaggc

SEQ ID NO: 1230921 - RNA, 15 nt, Mycobacterium leprae
gcuuuuugugaacau

SEQ ID NO: 1230922 - RNA, 18 nt, Mycobacterium leprae
ggaaaccuuccggcgguc

SEQ ID NO: 1230923 - RNA, 23 nt, Mycobacterium leprae
gcuguucgugaucgacggcuggc

SEQ ID NO: 1230924 - RNA, 17 nt, Mycobacterium leprae
gcugucgugcccagaug

SEQ ID NO: 1230925 - RNA, 17 nt, Mycobacterium leprae
gcugguaggugacgcca

SEQ ID NO: 1230926 - RNA, 21 nt, Mycobacterium leprae
gcuggucagguccaacgcggc

SEQ ID NO: 1230927 - RNA, 16 nt, Mycobacterium leprae
gcuggggucgcggacc

SEQ ID NO: 1230928 - RNA, 17 nt, Mycobacterium leprae
gcugggcuugaaacccg

SEQ ID NO: 1230929 - RNA, 18 nt, Mycobacterium leprae
gcugguggccgaggucga

SEQ ID NO: 1230930 - RNA, 19 nt, Mycobacterium leprae
gcugggccacagcaucucg

SEQ ID NO: 1230931 - RNA, 17 nt, Mycobacterium leprae
gcuggcucugucgucga

SEQ ID NO: 1230932 - RNA, 17 nt, Mycobacterium leprae
gcuggcuuccucuccua

SEQ ID NO: 1230933 - RNA, 17 nt, Mycobacterium leprae
gcugcucaaccaugccg

SEQ ID NO: 1230934 - RNA, 14 nt, Mycobacterium leprae
gcugcaauucgcua

SEQ ID NO: 1230935 - RNA, 12 nt, Mycobacterium leprae
gcugcccaccag

SEQ ID NO: 1230936 - RNA, 23 nt, Mycobacterium leprae
gcugccaaaguuagcggagaccc

SEQ ID NO: 1230937 - RNA, 23 nt, Mycobacterium leprae
gcugccgcaguaauccaguccgg

SEQ ID NO: 1230938 - RNA, 16 nt, Mycobacterium leprae
gcugcgugccugguug

SEQ ID NO: 1230939 - RNA, 22 nt, Mycobacterium leprae
gcucuauguuuuucucgguugu

SEQ ID NO: 1230940 - RNA, 22 nt, Mycobacterium leprae
gcucuacgacgaguaugcugcc

SEQ ID NO: 1230941 - RNA, 17 nt, Mycobacterium leprae
gcugaagggccggguaa

SEQ ID NO: 1230942 - RNA, 21 nt, Mycobacterium leprae
gcugaggguggcgccggcgug

SEQ ID NO: 1230943 - RNA, 21 nt, Mycobacterium leprae
gcugagucuucgaucacgcgu

SEQ ID NO: 1230944 - RNA, 21 nt, Mycobacterium leprae
gcugaggugcgagauccgugc

SEQ ID NO: 1230945 - RNA, 16 nt, Mycobacterium leprae
gcugagcgaagucgac

SEQ ID NO: 1230946 - RNA, 16 nt, Mycobacterium leprae
gcugagagugccaccg

SEQ ID NO: 1230947 - RNA, 23 nt, Mycobacterium leprae
gcucgccaaggucgaucuagcgu

SEQ ID NO: 1230948 - RNA, 16 nt, Mycobacterium leprae
gcucggcgaagucaag

SEQ ID NO: 1230949 - RNA, 21 nt, Mycobacterium leprae
gcuccuucuuaucucaucguc

SEQ ID NO: 1230950 - RNA, 23 nt, Mycobacterium leprae
gcuccuucuuaucucaucgucuc

SEQ ID NO: 1230951 - RNA, 23 nt, Mycobacterium leprae
gcucgacauuguagaaacggccu

SEQ ID NO: 1230952 - RNA, 13 nt, Mycobacterium leprae
gcucgagcagccg

SEQ ID NO: 1230953 - RNA, 17 nt, Mycobacterium leprae
gcucgauggugccauug

SEQ ID NO: 1230954 - RNA, 16 nt, Mycobacterium leprae
gcucccaucggcggcc

SEQ ID NO: 1230955 - RNA, 21 nt, Mycobacterium leprae
gcuccauugcguuugaugucg

SEQ ID NO: 1230956 - RNA, 22 nt, Mycobacterium leprae
gcuccauuugucaucggcgugc

SEQ ID NO: 1230957 - RNA, 16 nt, Mycobacterium leprae
gcuccacaucgucuac

SEQ ID NO: 1230958 - RNA, 23 nt, Mycobacterium leprae
gcucaguguaucgcgagugcgag

SEQ ID NO: 1230959 - RNA, 23 nt, Mycobacterium leprae
gcucauagcuaguguacagaccg

SEQ ID NO: 1230960 - RNA, 11 nt, Mycobacterium leprae
gcucagcagau

SEQ ID NO: 1230961 - RNA, 21 nt, Mycobacterium leprae
gcguaaggaagaugacaccga

SEQ ID NO: 1230962 - RNA, 22 nt, Mycobacterium leprae
gcgguucuauuuguguuggccg

SEQ ID NO: 1230963 - RNA, 22 nt, Mycobacterium leprae
gcgguuugguaccgaguuuggc

SEQ ID NO: 1230964 - RNA, 13 nt, Mycobacterium leprae
gcgguggcagcgu

SEQ ID NO: 1230965 - RNA, 23 nt, Mycobacterium leprae
gcgugauccacaauucuucgcuc

SEQ ID NO: 1230966 - RNA, 16 nt, Mycobacterium leprae
gcgugagguguugccg

SEQ ID NO: 1230967 - RNA, 15 nt, Mycobacterium leprae
gcgugagugugagga

SEQ ID NO: 1230968 - RNA, 16 nt, Mycobacterium leprae
gcgucgguggcagcau

SEQ ID NO: 1230969 - RNA, 20 nt, Mycobacterium leprae
gcgucggugacucugaccga

SEQ ID NO: 1230970 - RNA, 22 nt, Mycobacterium leprae
gcgucggugacucugaccgaca

SEQ ID NO: 1230971 - RNA, 16 nt, Mycobacterium leprae
gcgucuggauggcuga

SEQ ID NO: 1230972 - RNA, 18 nt, Mycobacterium leprae
gcguuaauuuucaacggu

SEQ ID NO: 1230973 - RNA, 22 nt, Mycobacterium leprae
gcguuaauaacccccaacuggu

SEQ ID NO: 1230974 - RNA, 15 nt, Mycobacterium leprae
gcgugggugugagga

SEQ ID NO: 1230975 - RNA, 21 nt, Mycobacterium leprae
gcgugaucgacaucguguggu

SEQ ID NO: 1230976 - RNA, 19 nt, Mycobacterium leprae
gcgucaaguccagcacgau

SEQ ID NO: 1230977 - RNA, 19 nt, Mycobacterium leprae
gcguccgagguuaccagcg

SEQ ID NO: 1230978 - RNA, 17 nt, Mycobacterium leprae
gcgucgguagacguggc

SEQ ID NO: 1230979 - RNA, 16 nt, Mycobacterium leprae
aagcgguuguccggcg

SEQ ID NO: 1230980 - RNA, 16 nt, Mycobacterium leprae
aagcgggugccgcguc

SEQ ID NO: 1230981 - RNA, 17 nt, Mycobacterium leprae
gcggcggacgaucgaga

SEQ ID NO: 1230982 - RNA, 16 nt, Mycobacterium leprae
aagcguuacagccgag

SEQ ID NO: 1230983 - RNA, 21 nt, Mycobacterium leprae
gcgggaacccgcuuggugauc

SEQ ID NO: 1230984 - RNA, 14 nt, Mycobacterium leprae
gcggcucuuucggc

SEQ ID NO: 1230985 - RNA, 16 nt, Mycobacterium leprae
gcggcugggcagccga

SEQ ID NO: 1230986 - RNA, 14 nt, Mycobacterium leprae
gcggcucguggcag

SEQ ID NO: 1230987 - RNA, 22 nt, Mycobacterium leprae
gcggcucguggcagucucgcug

SEQ ID NO: 1230988 - RNA, 22 nt, Mycobacterium leprae
gcggccccuuucacgucggcgu

SEQ ID NO: 1230989 - RNA, 12 nt, Mycobacterium leprae
aagcgcuugccc

SEQ ID NO: 1230990 - RNA, 15 nt, Mycobacterium leprae
gcggccaagcuagau

SEQ ID NO: 1230991 - RNA, 12 nt, Mycobacterium leprae
gcggccagccag

SEQ ID NO: 1230992 - RNA, 18 nt, Mycobacterium leprae
gcgaaaacacuuacacca

SEQ ID NO: 1230993 - RNA, 21 nt, Mycobacterium leprae
gccuuggugcuuaacgccgcc

SEQ ID NO: 1230994 - RNA, 22 nt, Mycobacterium leprae
gccuugauugccgucggaugau

SEQ ID NO: 1230995 - RNA, 15 nt, Mycobacterium leprae
gccuguucaggugcg

SEQ ID NO: 1230996 - RNA, 17 nt, Mycobacterium leprae
gccugugcuguugggga

SEQ ID NO: 1230997 - RNA, 19 nt, Mycobacterium leprae
gccugugucgagcuggcug

SEQ ID NO: 1230998 - RNA, 13 nt, Mycobacterium leprae
gccuucgucagcu

SEQ ID NO: 1230999 - RNA, 17 nt, Mycobacterium leprae
gcgaaccuacaguggca

SEQ ID NO: 1231000 - RNA, 14 nt, Mycobacterium leprae
gcgaacagaggcgc

SEQ ID NO: 1231001 - RNA, 19 nt, Mycobacterium leprae
gcgagugcugacgccgggc

SEQ ID NO: 1231002 - RNA, 17 nt, Mycobacterium leprae
gcgaguacguccgcgcc

SEQ ID NO: 1231003 - RNA, 20 nt, Mycobacterium leprae
gcgaguacguccgcgccggc

SEQ ID NO: 1231004 - RNA, 20 nt, Mycobacterium leprae
gcgaguaucgaaucggugau

SEQ ID NO: 1231005 - RNA, 13 nt, Mycobacterium leprae
gcgaggccguggc

SEQ ID NO: 1231006 - RNA, 16 nt, Mycobacterium leprae
gcgagcuuacgcgcgu

SEQ ID NO: 1231007 - RNA, 19 nt, Mycobacterium leprae
gcgagcuggggcggccgcc

SEQ ID NO: 1231008 - RNA, 17 nt, Mycobacterium leprae
gcgagcaagcggugugc

SEQ ID NO: 1231009 - RNA, 15 nt, Mycobacterium leprae
gcgagauugccaccg

SEQ ID NO: 1231010 - RNA, 15 nt, Mycobacterium leprae
gcgacugauaccgga

SEQ ID NO: 1231011 - RNA, 13 nt, Mycobacterium leprae
gcgacugcagugu

SEQ ID NO: 1231012 - RNA, 22 nt, Mycobacterium leprae
gcgacaaagagaacuucuucag

SEQ ID NO: 1231013 - RNA, 20 nt, Mycobacterium leprae
gcgacacgcgcgacacguca

SEQ ID NO: 1231014 - RNA, 16 nt, Mycobacterium leprae
gcgacauucaccagua

SEQ ID NO: 1231015 - RNA, 17 nt, Mycobacterium leprae
gcgaccaacgccgagcc

SEQ ID NO: 1231016 - RNA, 19 nt, Mycobacterium leprae
gcgacgaccuccgcagcau

SEQ ID NO: 1231017 - RNA, 20 nt, Mycobacterium leprae
gcgacgaacccgucgaugau

SEQ ID NO: 1231018 - RNA, 21 nt, Mycobacterium leprae
gcgacgaacccgucgaugauc

SEQ ID NO: 1231019 - RNA, 22 nt, Mycobacterium leprae
aagccacauccgagcaggucau

SEQ ID NO: 1231020 - RNA, 13 nt, Mycobacterium leprae
gccuccuaggcca

SEQ ID NO: 1231021 - RNA, 22 nt, Mycobacterium leprae
gccuccaggugaagccggcgca

SEQ ID NO: 1231022 - RNA, 21 nt, Mycobacterium leprae
gccuccgaaaagcugagccga

SEQ ID NO: 1231023 - RNA, 14 nt, Mycobacterium leprae
gccucacguaccgg

SEQ ID NO: 1231024 - RNA, 20 nt, Mycobacterium leprae
gccucaccugcgacagccgu

SEQ ID NO: 1231025 - RNA, 14 nt, Mycobacterium leprae
gccuauaucgcggc

SEQ ID NO: 1231026 - RNA, 16 nt, Mycobacterium leprae
gccucgguguucgaca

SEQ ID NO: 1231027 - RNA, 19 nt, Mycobacterium leprae
gccucguugcguaccggaa

SEQ ID NO: 1231028 - RNA, 14 nt, Mycobacterium leprae
gccucgugcgguca

SEQ ID NO: 1231029 - RNA, 17 nt, Mycobacterium leprae
gccucgucggccagcac

SEQ ID NO: 1231030 - RNA, 18 nt, Mycobacterium leprae
gccugagcgggccagcac

SEQ ID NO: 1231031 - RNA, 16 nt, Mycobacterium leprae
gccuagcuggcagucg

SEQ ID NO: 1231032 - RNA, 20 nt, Mycobacterium leprae
gccguucuaggguguugugg

SEQ ID NO: 1231033 - RNA, 14 nt, Mycobacterium leprae
gccguucggcuacu

SEQ ID NO: 1231034 - RNA, 16 nt, Mycobacterium leprae
gccggcuacuggacgu

SEQ ID NO: 1231035 - RNA, 17 nt, Mycobacterium leprae
gccggcgucaggccagg

SEQ ID NO: 1231036 - RNA, 20 nt, Mycobacterium leprae
gccgggugcgcugcugacgu

SEQ ID NO: 1231037 - RNA, 22 nt, Mycobacterium leprae
gccgggguauaguacagaccga

SEQ ID NO: 1231038 - RNA, 19 nt, Mycobacterium leprae
gcgcaguggguggacgacg

SEQ ID NO: 1231039 - RNA, 14 nt, Mycobacterium leprae
gcgcagccaccacu

SEQ ID NO: 1231040 - RNA, 14 nt, Mycobacterium leprae
gcgcagagcgcugu

SEQ ID NO: 1231041 - RNA, 20 nt, Mycobacterium leprae
gcgcagaccucuuccgccgc

SEQ ID NO: 1231042 - RNA, 19 nt, Mycobacterium leprae
gcgcaccucgcugcagcau

SEQ ID NO: 1231043 - RNA, 15 nt, Mycobacterium leprae
gcgcacccgagcggc

SEQ ID NO: 1231044 - RNA, 16 nt, Mycobacterium leprae
gcgcacccgagcggca

SEQ ID NO: 1231045 - RNA, 17 nt, Mycobacterium leprae
gcgauauauaccuacga

SEQ ID NO: 1231046 - RNA, 24 nt, Mycobacterium leprae
gcgaguucuccuaucgaaauacga

SEQ ID NO: 1231047 - RNA, 14 nt, Mycobacterium leprae
gcgcacacccggua

SEQ ID NO: 1231048 - RNA, 16 nt, Mycobacterium leprae
gcgcaauuuggugauc

SEQ ID NO: 1231049 - RNA, 13 nt, Mycobacterium leprae
gcgccaguucggc

SEQ ID NO: 1231050 - RNA, 18 nt, Mycobacterium leprae
gcgcgcuauucgggccag

SEQ ID NO: 1231051 - RNA, 15 nt, Mycobacterium leprae
gcgcgccucgaugca

SEQ ID NO: 1231052 - RNA, 24 nt, Mycobacterium leprae
gcgcgcucacagcaggcgaguggc

SEQ ID NO: 1231053 - RNA, 10 nt, Mycobacterium leprae
gcgcgcaccc

SEQ ID NO: 1231054 - RNA, 17 nt, Mycobacterium leprae
gcgcgguacaaucaguc

SEQ ID NO: 1231055 - RNA, 17 nt, Mycobacterium leprae
gcgcguuaggugccccg

SEQ ID NO: 1231056 - RNA, 18 nt, Mycobacterium leprae
gcgcucaccgacggaugc

SEQ ID NO: 1231057 - RNA, 17 nt, Mycobacterium leprae
gcgcuaaaucuggccaa

SEQ ID NO: 1231058 - RNA, 15 nt, Mycobacterium leprae
guaauugacaccgcc

SEQ ID NO: 1231059 - RNA, 16 nt, Mycobacterium leprae
guaacgggcccgguac

SEQ ID NO: 1231060 - RNA, 19 nt, Mycobacterium leprae
gguuugaggcgcgcgaggc

SEQ ID NO: 1231061 - RNA, 14 nt, Mycobacterium leprae
gguuuccggcacca

SEQ ID NO: 1231062 - RNA, 22 nt, Mycobacterium leprae
guaccacugcucaggucgacga

SEQ ID NO: 1231063 - RNA, 19 nt, Mycobacterium leprae
guacggacaucauugcgac

SEQ ID NO: 1231064 - RNA, 15 nt, Mycobacterium leprae
guacucauagcggcg

SEQ ID NO: 1231065 - RNA, 17 nt, Mycobacterium leprae
guagagccuacucccgg

SEQ ID NO: 1231066 - RNA, 19 nt, Mycobacterium leprae
guagagagccgagcgcagc

SEQ ID NO: 1231067 - RNA, 17 nt, Mycobacterium leprae
guagauaaacaucgagu

SEQ ID NO: 1231068 - RNA, 16 nt, Mycobacterium leprae
guagcuagaccgaauc

SEQ ID NO: 1231069 - RNA, 14 nt, Mycobacterium leprae
guaggaaucaccgg

SEQ ID NO: 1231070 - RNA, 18 nt, Mycobacterium leprae
guaggaguuuuucagcgg

SEQ ID NO: 1231071 - RNA, 14 nt, Mycobacterium leprae
aaguccggccugcc

SEQ ID NO: 1231072 - RNA, 20 nt, Mycobacterium leprae
guagggaugaucgauccagu

SEQ ID NO: 1231073 - RNA, 23 nt, Mycobacterium leprae
guaguuccgcgcugaauggucau

SEQ ID NO: 1231074 - RNA, 21 nt, Mycobacterium leprae
ggugggguguugguucgucga

SEQ ID NO: 1231075 - RNA, 14 nt, Mycobacterium leprae
gguggucgaccgcg

SEQ ID NO: 1231076 - RNA, 16 nt, Mycobacterium leprae
gguguacacgugcugc

SEQ ID NO: 1231077 - RNA, 15 nt, Mycobacterium leprae
ggugaugaucacccg

SEQ ID NO: 1231078 - RNA, 22 nt, Mycobacterium leprae
ggugcuggcugcgccggcuauc

SEQ ID NO: 1231079 - RNA, 17 nt, Mycobacterium leprae
gguggcgccggcgugcg

SEQ ID NO: 1231080 - RNA, 16 nt, Mycobacterium leprae
gguuguucgacaagcu

SEQ ID NO: 1231081 - RNA, 17 nt, Mycobacterium leprae
gguuguggaccggauca

SEQ ID NO: 1231082 - RNA, 17 nt, Mycobacterium leprae
gguuggcuagcgugcuu

SEQ ID NO: 1231083 - RNA, 19 nt, Mycobacterium leprae
gguuggccacuggugcugu

SEQ ID NO: 1231084 - RNA, 18 nt, Mycobacterium leprae
gguuaccgcauacuggca

SEQ ID NO: 1231085 - RNA, 14 nt, Mycobacterium leprae
gguguugugguggg

SEQ ID NO: 1231086 - RNA, 17 nt, Mycobacterium leprae
gguguugguucgucgag

SEQ ID NO: 1231087 - RNA, 14 nt, Mycobacterium leprae
gguguggcccgacg

SEQ ID NO: 1231088 - RNA, 22 nt, Mycobacterium leprae
ggugugcguugccugaaaacua

SEQ ID NO: 1231089 - RNA, 19 nt, Mycobacterium leprae
gguuaucgacacggcgacc

SEQ ID NO: 1231090 - RNA, 15 nt, Mycobacterium leprae
gguuagcaucgaccg

SEQ ID NO: 1231091 - RNA, 22 nt, Mycobacterium leprae
gguagacgaugaucggcuugcc

SEQ ID NO: 1231092 - RNA, 13 nt, Mycobacterium leprae
gguagcggcuaca

SEQ ID NO: 1231093 - RNA, 21 nt, Mycobacterium leprae
gguagccguggggcucggcca

SEQ ID NO: 1231094 - RNA, 17 nt, Mycobacterium leprae
gguagccguucggcuac

SEQ ID NO: 1231095 - RNA, 13 nt, Mycobacterium leprae
gguacgcugcaug

SEQ ID NO: 1231096 - RNA, 14 nt, Mycobacterium leprae
gguacgcugcauga

SEQ ID NO: 1231097 - RNA, 17 nt, Mycobacterium leprae
gguacgagugguugagu

SEQ ID NO: 1231098 - RNA, 20 nt, Mycobacterium leprae
ggguucacgucgauucgcuc

SEQ ID NO: 1231099 - RNA, 20 nt, Mycobacterium leprae
gguaauucuugacaccgaug

SEQ ID NO: 1231100 - RNA, 21 nt, Mycobacterium leprae
ggguguuucauaggugguggg

SEQ ID NO: 1231101 - RNA, 20 nt, Mycobacterium leprae
ggguuuuagauugacaccgc

SEQ ID NO: 1231102 - RNA, 22 nt, Mycobacterium leprae
ggguggaguaaagggugguggg

SEQ ID NO: 1231103 - RNA, 18 nt, Mycobacterium leprae
gggugugggugguugauc

SEQ ID NO: 1231104 - RNA, 18 nt, Mycobacterium leprae
gggugaccacccacaacg

SEQ ID NO: 1231105 - RNA, 19 nt, Mycobacterium leprae
gggucacaaaccccucguc

SEQ ID NO: 1231106 - RNA, 13 nt, Mycobacterium leprae
ggguaucgaugcu

SEQ ID NO: 1231107 - RNA, 20 nt, Mycobacterium leprae
ggguaggccgacuucggcaa

SEQ ID NO: 1231108 - RNA, 20 nt, Mycobacterium leprae
gggucgcccaauggugcggc

SEQ ID NO: 1231109 - RNA, 22 nt, Mycobacterium leprae
gggaagacguaacggucgguaa

SEQ ID NO: 1231110 - RNA, 18 nt, Mycobacterium leprae
gggaaggacgcauccauc

SEQ ID NO: 1231111 - RNA, 13 nt, Mycobacterium leprae
aaguaggcgaaga

SEQ ID NO: 1231112 - RNA, 19 nt, Mycobacterium leprae
gggggugcggcagcugcca

SEQ ID NO: 1231113 - RNA, 16 nt, Mycobacterium leprae
ggggcuaaauccgcug

SEQ ID NO: 1231114 - RNA, 19 nt, Mycobacterium leprae
ggggcuacaaucuaguaga

SEQ ID NO: 1231115 - RNA, 16 nt, Mycobacterium leprae
gguccuugcaccgauc

SEQ ID NO: 1231116 - RNA, 12 nt, Mycobacterium leprae
gguccgccagcg

SEQ ID NO: 1231117 - RNA, 19 nt, Mycobacterium leprae
ggucgagcagccacccgca

SEQ ID NO: 1231118 - RNA, 16 nt, Mycobacterium leprae
ggucgacuucgcagcc

SEQ ID NO: 1231119 - RNA, 21 nt, Mycobacterium leprae
ggucgagacacagaucgagcg

SEQ ID NO: 1231120 - RNA, 22 nt, Mycobacterium leprae
gguaguucuugguuagguuggu

SEQ ID NO: 1231121 - RNA, 19 nt, Mycobacterium leprae
ggucauuaacgcuggucgg

SEQ ID NO: 1231122 - RNA, 16 nt, Mycobacterium leprae
ggucauuacucacgau

SEQ ID NO: 1231123 - RNA, 21 nt, Mycobacterium leprae
gguccgaucgcaccggcugca

SEQ ID NO: 1231124 - RNA, 15 nt, Mycobacterium leprae
ggucguacggcgacu

SEQ ID NO: 1231125 - RNA, 17 nt, Mycobacterium leprae
ggucguacggcgacuca

SEQ ID NO: 1231126 - RNA, 14 nt, Mycobacterium leprae
ggucggcguuauug

SEQ ID NO: 1231127 - RNA, 15 nt, Mycobacterium leprae
ggugacggcuggauc

SEQ ID NO: 1231128 - RNA, 17 nt, Mycobacterium leprae
ggugacggucgugcugu

SEQ ID NO: 1231129 - RNA, 13 nt, Mycobacterium leprae
ggugacgguggcg

SEQ ID NO: 1231130 - RNA, 19 nt, Mycobacterium leprae
ggucuuuucgcgcgcaccc

SEQ ID NO: 1231131 - RNA, 20 nt, Mycobacterium leprae
ggugaacgccaggcgccgca

SEQ ID NO: 1231132 - RNA, 19 nt, Mycobacterium leprae
guccgcgcucgcuuuccgc

SEQ ID NO: 1231133 - RNA, 23 nt, Mycobacterium leprae
guccaucuuguuggccggugcua

SEQ ID NO: 1231134 - RNA, 15 nt, Mycobacterium leprae
guccaaaugcggugg

SEQ ID NO: 1231135 - RNA, 19 nt, Mycobacterium leprae
guccaacaagguucuuaug

SEQ ID NO: 1231136 - RNA, 18 nt, Mycobacterium leprae
guccaccagccgcaggca

SEQ ID NO: 1231137 - RNA, 22 nt, Mycobacterium leprae
guccagaaggggcugcggcuac

SEQ ID NO: 1231138 - RNA, 22 nt, Mycobacterium leprae
guccacugcggcaaagcacacg

SEQ ID NO: 1231139 - RNA, 13 nt, Mycobacterium leprae
guccacggcagcu

SEQ ID NO: 1231140 - RNA, 16 nt, Mycobacterium leprae
gucaguggcgacgacc

SEQ ID NO: 1231141 - RNA, 22 nt, Mycobacterium leprae
gucagcuugucgauguuggugu

SEQ ID NO: 1231142 - RNA, 21 nt, Mycobacterium leprae
gucagcuggugaccugacauc

SEQ ID NO: 1231143 - RNA, 18 nt, Mycobacterium leprae
guccugguggcaacgcug

SEQ ID NO: 1231144 - RNA, 17 nt, Mycobacterium leprae
gucgagggcucagugua

SEQ ID NO: 1231145 - RNA, 15 nt, Mycobacterium leprae
gucgauucaccgauc

SEQ ID NO: 1231146 - RNA, 14 nt, Mycobacterium leprae
gucgcaccgauauc

SEQ ID NO: 1231147 - RNA, 16 nt, Mycobacterium leprae
gucgcggaaguaacgu

SEQ ID NO: 1231148 - RNA, 12 nt, Mycobacterium leprae
gucgccgguagc

SEQ ID NO: 1231149 - RNA, 15 nt, Mycobacterium leprae
gucgucaucguugcc

SEQ ID NO: 1231150 - RNA, 18 nt, Mycobacterium leprae
gucguccgguggucgcga

SEQ ID NO: 1231151 - RNA, 17 nt, Mycobacterium leprae
gucgguuguuguggugu

SEQ ID NO: 1231152 - RNA, 16 nt, Mycobacterium leprae
gucgguggcggucggu

SEQ ID NO: 1231153 - RNA, 17 nt, Mycobacterium leprae
gucgguguuguuuggca

SEQ ID NO: 1231154 - RNA, 23 nt, Mycobacterium leprae
gucgugcccagaugaauucgcug

SEQ ID NO: 1231155 - RNA, 21 nt, Mycobacterium leprae
gucgugcguuguugauggugu

SEQ ID NO: 1231156 - RNA, 14 nt, Mycobacterium leprae
gucgugaucggcau

SEQ ID NO: 1231157 - RNA, 13 nt, Mycobacterium leprae
gucguguuugugu

SEQ ID NO: 1231158 - RNA, 16 nt, Mycobacterium leprae
gucguucgcugacagc

SEQ ID NO: 1231159 - RNA, 14 nt, Mycobacterium leprae
gucgucgucaucgu

SEQ ID NO: 1231160 - RNA, 15 nt, Mycobacterium leprae
gucgucggccgcggc

SEQ ID NO: 1231161 - RNA, 16 nt, Mycobacterium leprae
gucggcgaaacguuca

SEQ ID NO: 1231162 - RNA, 22 nt, Mycobacterium leprae
gucggcguugagcgcagccacc

SEQ ID NO: 1231163 - RNA, 22 nt, Mycobacterium leprae
gucgggaggauggcgacgucgc

SEQ ID NO: 1231164 - RNA, 17 nt, Mycobacterium leprae
gucgggugccgaucaca

SEQ ID NO: 1231165 - RNA, 20 nt, Mycobacterium leprae
gucgguagacguggcagucg

SEQ ID NO: 1231166 - RNA, 20 nt, Mycobacterium leprae
gugaaauucuucucgguguu

SEQ ID NO: 1231167 - RNA, 18 nt, Mycobacterium leprae
gugaaucccgcgacggcc

SEQ ID NO: 1231168 - RNA, 21 nt, Mycobacterium leprae
gugaccgcggugcagugccgc

SEQ ID NO: 1231169 - RNA, 13 nt, Mycobacterium leprae
gugacggucgugc

SEQ ID NO: 1231170 - RNA, 20 nt, Mycobacterium leprae
gugaccgggccggccgcgga

SEQ ID NO: 1231171 - RNA, 13 nt, Mycobacterium leprae
gugaccgugcagc

SEQ ID NO: 1231172 - RNA, 18 nt, Mycobacterium leprae
gugaccgugcagcugcca

SEQ ID NO: 1231173 - RNA, 22 nt, Mycobacterium leprae
gucuucuuggcgcugagcaguc

SEQ ID NO: 1231174 - RNA, 20 nt, Mycobacterium leprae
gucuguggcgauagccagaa

SEQ ID NO: 1231175 - RNA, 18 nt, Mycobacterium leprae
gucugcggugcugagcaa

SEQ ID NO: 1231176 - RNA, 13 nt, Mycobacterium leprae
gucugggcuggcc

SEQ ID NO: 1231177 - RNA, 12 nt, Mycobacterium leprae
gucucacgcacc

SEQ ID NO: 1231178 - RNA, 18 nt, Mycobacterium leprae
gucucccacaaguugucc

SEQ ID NO: 1231179 - RNA, 21 nt, Mycobacterium leprae
gucugaaugggccgaucgcag

SEQ ID NO: 1231180 - RNA, 15 nt, Mycobacterium leprae
gucucguugccgggg

SEQ ID NO: 1231181 - RNA, 23 nt, Mycobacterium leprae
gucucucaggccgucguugccga

SEQ ID NO: 1231182 - RNA, 19 nt, Mycobacterium leprae
gucucuucgcuguuggugu

SEQ ID NO: 1231183 - RNA, 19 nt, Mycobacterium leprae
gucugaaucggcaaaugcc

SEQ ID NO: 1231184 - RNA, 18 nt, Mycobacterium leprae
ggcuggaggagcccgacg

SEQ ID NO: 1231185 - RNA, 20 nt, Mycobacterium leprae
ggcugcuguucaugccaggu

SEQ ID NO: 1231186 - RNA, 13 nt, Mycobacterium leprae
ggcugcguuggca

SEQ ID NO: 1231187 - RNA, 18 nt, Mycobacterium leprae
ggcuggccaucgcaccga

SEQ ID NO: 1231188 - RNA, 15 nt, Mycobacterium leprae
ggcuuuucgacauug

SEQ ID NO: 1231189 - RNA, 22 nt, Mycobacterium leprae
ggcuuugcaaagcagaauauug

SEQ ID NO: 1231190 - RNA, 19 nt, Mycobacterium leprae
ggcuugccgauauucgcga

SEQ ID NO: 1231191 - RNA, 18 nt, Mycobacterium leprae
ggcuuccucuccuagggu

SEQ ID NO: 1231192 - RNA, 18 nt, Mycobacterium leprae
ggcugcgccguucgucga

SEQ ID NO: 1231193 - RNA, 20 nt, Mycobacterium leprae
ggcugcucaaucagcgacuc

SEQ ID NO: 1231194 - RNA, 21 nt, Mycobacterium leprae
ggcugcugcagaccggauaca

SEQ ID NO: 1231195 - RNA, 15 nt, Mycobacterium leprae
ggcugcaccgagcga

SEQ ID NO: 1231196 - RNA, 12 nt, Mycobacterium leprae
ggcucgacauug

SEQ ID NO: 1231197 - RNA, 13 nt, Mycobacterium leprae
ggcucggccaggu

SEQ ID NO: 1231198 - RNA, 15 nt, Mycobacterium leprae
ggcguugucuugugg

SEQ ID NO: 1231199 - RNA, 13 nt, Mycobacterium leprae
ggcuaccgagcuc

SEQ ID NO: 1231200 - RNA, 21 nt, Mycobacterium leprae
ggcuauggguaggccgacuuc

SEQ ID NO: 1231201 - RNA, 13 nt, Mycobacterium leprae
ggcucagcaccau

SEQ ID NO: 1231202 - RNA, 17 nt, Mycobacterium leprae
ggcucagcgcugaucaa

SEQ ID NO: 1231203 - RNA, 21 nt, Mycobacterium leprae
ggcucccgggucgagcagcca

SEQ ID NO: 1231204 - RNA, 13 nt, Mycobacterium leprae
ggcgucguuuugg

SEQ ID NO: 1231205 - RNA, 17 nt, Mycobacterium leprae
ggcgucgcugugucgau

SEQ ID NO: 1231206 - RNA, 23 nt, Mycobacterium leprae
ggcgucgcaccgauauccggccu

SEQ ID NO: 1231207 - RNA, 15 nt, Mycobacterium leprae
ggcgaugaccggacg

SEQ ID NO: 1231208 - RNA, 16 nt, Mycobacterium leprae
ggcgauauccgccggc

SEQ ID NO: 1231209 - RNA, 15 nt, Mycobacterium leprae
ggccuggauuagcuc

SEQ ID NO: 1231210 - RNA, 21 nt, Mycobacterium leprae
ggcgaguacguccgcgccggc

SEQ ID NO: 1231211 - RNA, 14 nt, Mycobacterium leprae
ggcgccaggcgucc

SEQ ID NO: 1231212 - RNA, 12 nt, Mycobacterium leprae
ggcgccugcauc

SEQ ID NO: 1231213 - RNA, 15 nt, Mycobacterium leprae
ggcggcgccgauccc

SEQ ID NO: 1231214 - RNA, 15 nt, Mycobacterium leprae
ggcgcugagcagucc

SEQ ID NO: 1231215 - RNA, 19 nt, Mycobacterium leprae
ggcgcgcuauucgggccag

SEQ ID NO: 1231216 - RNA, 14 nt, Mycobacterium leprae
ggcgcgaagugcga

SEQ ID NO: 1231217 - RNA, 17 nt, Mycobacterium leprae
ggaucuuuugaccagca

SEQ ID NO: 1231218 - RNA, 17 nt, Mycobacterium leprae
ggaucuaugguuuuggc

SEQ ID NO: 1231219 - RNA, 19 nt, Mycobacterium leprae
ggaucuguagggaaucggc

SEQ ID NO: 1231220 - RNA, 17 nt, Mycobacterium leprae
ggaucgucucacgcacc

SEQ ID NO: 1231221 - RNA, 19 nt, Mycobacterium leprae
ggaucgcuguauucugcac

SEQ ID NO: 1231222 - RNA, 16 nt, Mycobacterium leprae
ggauggccugcuggcc

SEQ ID NO: 1231223 - RNA, 23 nt, Mycobacterium leprae
ggaugccguucaucgucgggugc

SEQ ID NO: 1231224 - RNA, 23 nt, Mycobacterium leprae
ggaugguuagcaugagcacgcca

SEQ ID NO: 1231225 - RNA, 17 nt, Mycobacterium leprae
ggauguuauucgggagc

SEQ ID NO: 1231226 - RNA, 15 nt, Mycobacterium leprae
ggaugucgcagaggu

SEQ ID NO: 1231227 - RNA, 18 nt, Mycobacterium leprae
ggauugaucguccgcaac

SEQ ID NO: 1231228 - RNA, 16 nt, Mycobacterium leprae
ggauugcaugcaccga

SEQ ID NO: 1231229 - RNA, 11 nt, Mycobacterium leprae
ggauugggcau

SEQ ID NO: 1231230 - RNA, 19 nt, Mycobacterium leprae
ggcacagugacgcccggga

SEQ ID NO: 1231231 - RNA, 19 nt, Mycobacterium leprae
ggcacuacccgacacaaag

SEQ ID NO: 1231232 - RNA, 15 nt, Mycobacterium leprae
ggcacuccgaccgag

SEQ ID NO: 1231233 - RNA, 15 nt, Mycobacterium leprae
ggcacgaauaucgcu

SEQ ID NO: 1231234 - RNA, 19 nt, Mycobacterium leprae
ggcacccauaacgugcugu

SEQ ID NO: 1231235 - RNA, 14 nt, Mycobacterium leprae
ggcauugaucgcuc

SEQ ID NO: 1231236 - RNA, 19 nt, Mycobacterium leprae
ggcaugagccgacugacaa

SEQ ID NO: 1231237 - RNA, 18 nt, Mycobacterium leprae
ggcaguagcaucgaacaa

SEQ ID NO: 1231238 - RNA, 12 nt, Mycobacterium leprae
ggcagcaaccgc

SEQ ID NO: 1231239 - RNA, 13 nt, Mycobacterium leprae
ggccagcguugga

SEQ ID NO: 1231240 - RNA, 17 nt, Mycobacterium leprae
ggccagcccggcgugca

SEQ ID NO: 1231241 - RNA, 15 nt, Mycobacterium leprae
ggccaauccagccga

SEQ ID NO: 1231242 - RNA, 12 nt, Mycobacterium leprae
ggccgaggcgca

SEQ ID NO: 1231243 - RNA, 23 nt, Mycobacterium leprae
ggccgaucucggcgcgcucucug

SEQ ID NO: 1231244 - RNA, 14 nt, Mycobacterium leprae
ggccgauuuggcgg

SEQ ID NO: 1231245 - RNA, 22 nt, Mycobacterium leprae
ggccgugcauuaacggcuuccg

SEQ ID NO: 1231246 - RNA, 14 nt, Mycobacterium leprae
ggccguggccgacg

SEQ ID NO: 1231247 - RNA, 23 nt, Mycobacterium leprae
ggccgucgcucgguaagcuggcu

SEQ ID NO: 1231248 - RNA, 21 nt, Mycobacterium leprae
ggccggguaaguucuaccgac

SEQ ID NO: 1231249 - RNA, 22 nt, Mycobacterium leprae
ggccgcggaaauaacgggcaug

SEQ ID NO: 1231250 - RNA, 19 nt, Mycobacterium leprae
ggccgcaacuuuguacgac

SEQ ID NO: 1231251 - RNA, 16 nt, Mycobacterium leprae
ggccgcacccggcagc

SEQ ID NO: 1231252 - RNA, 22 nt, Mycobacterium leprae
aacagugggggugcggcagcug

SEQ ID NO: 1231253 - RNA, 18 nt, Mycobacterium leprae
cggcagcauccgccgacg

SEQ ID NO: 1231254 - RNA, 21 nt, Mycobacterium leprae
cggcacuucgcugagcgaagu

SEQ ID NO: 1231255 - RNA, 23 nt, Mycobacterium leprae
cggcacuucgcugagcgaagucg

SEQ ID NO: 1231256 - RNA, 14 nt, Mycobacterium leprae
cggcagagcguucg

SEQ ID NO: 1231257 - RNA, 14 nt, Mycobacterium leprae
cggcagaucgaucu

SEQ ID NO: 1231258 - RNA, 21 nt, Mycobacterium leprae
cggacaagaucgaggccagcc

SEQ ID NO: 1231259 - RNA, 18 nt, Mycobacterium leprae
cggacagcacccccggcc

SEQ ID NO: 1231260 - RNA, 21 nt, Mycobacterium leprae
cggcaccgacguauccaaggu

SEQ ID NO: 1231261 - RNA, 16 nt, Mycobacterium leprae
cggcaggccggccugg

SEQ ID NO: 1231262 - RNA, 20 nt, Mycobacterium leprae
cggcaggcuuagccaacacc

SEQ ID NO: 1231263 - RNA, 13 nt, Mycobacterium leprae
cggccaguaacca

SEQ ID NO: 1231264 - RNA, 15 nt, Mycobacterium leprae
cggccccccggggcu

SEQ ID NO: 1231265 - RNA, 22 nt, Mycobacterium leprae
cggccagccguggcuccgcgcu

SEQ ID NO: 1231266 - RNA, 21 nt, Mycobacterium leprae
cggccgcccaggugucuucca

SEQ ID NO: 1231267 - RNA, 13 nt, Mycobacterium leprae
cggccgccacgcc

SEQ ID NO: 1231268 - RNA, 13 nt, Mycobacterium leprae
cggcccgaauuca

SEQ ID NO: 1231269 - RNA, 14 nt, Mycobacterium leprae
cggcggacgaucga

SEQ ID NO: 1231270 - RNA, 15 nt, Mycobacterium leprae
cggcgauauccgccg

SEQ ID NO: 1231271 - RNA, 14 nt, Mycobacterium leprae
cggcgacguuuugu

SEQ ID NO: 1231272 - RNA, 18 nt, Mycobacterium leprae
cggcgagcaagcggugug

SEQ ID NO: 1231273 - RNA, 13 nt, Mycobacterium leprae
cggcgauaacggc

SEQ ID NO: 1231274 - RNA, 15 nt, Mycobacterium leprae
cggcgaaggagcggu

SEQ ID NO: 1231275 - RNA, 15 nt, Mycobacterium leprae
cggcgaagucaagau

SEQ ID NO: 1231276 - RNA, 15 nt, Mycobacterium leprae
cggcgaaucggucug

SEQ ID NO: 1231277 - RNA, 18 nt, Mycobacterium leprae
cggcgacacagagcgcuc

SEQ ID NO: 1231278 - RNA, 21 nt, Mycobacterium leprae
aacccagacgcgaccgccacc

SEQ ID NO: 1231279 - RNA, 21 nt, Mycobacterium leprae
cggguuuuagauugacaccgc

SEQ ID NO: 1231280 - RNA, 23 nt, Mycobacterium leprae
cggguuuuagauugacaccgccg

SEQ ID NO: 1231281 - RNA, 15 nt, Mycobacterium leprae
aaccaucaacggcua

SEQ ID NO: 1231282 - RNA, 17 nt, Mycobacterium leprae
aaccaucgucgacgagu

SEQ ID NO: 1231283 - RNA, 17 nt, Mycobacterium leprae
cggguugggaaccggcg

SEQ ID NO: 1231284 - RNA, 22 nt, Mycobacterium leprae
cgguaacggcgguggcagccgc

SEQ ID NO: 1231285 - RNA, 14 nt, Mycobacterium leprae
cgguacccgugguc

SEQ ID NO: 1231286 - RNA, 17 nt, Mycobacterium leprae
cgguacccgccaggauc

SEQ ID NO: 1231287 - RNA, 18 nt, Mycobacterium leprae
cgguauugggcgguguug

SEQ ID NO: 1231288 - RNA, 23 nt, Mycobacterium leprae
cggucaaaggcuguccuugccgg

SEQ ID NO: 1231289 - RNA, 12 nt, Mycobacterium leprae
cggucaacaagc

SEQ ID NO: 1231290 - RNA, 20 nt, Mycobacterium leprae
cggucaacaagccgccgaca

SEQ ID NO: 1231291 - RNA, 16 nt, Mycobacterium leprae
cgguaugcggccgcaa

SEQ ID NO: 1231292 - RNA, 17 nt, Mycobacterium leprae
cgguaccguugacaacg

SEQ ID NO: 1231293 - RNA, 18 nt, Mycobacterium leprae
cgguagacguggcagucg

SEQ ID NO: 1231294 - RNA, 21 nt, Mycobacterium leprae
cgguagauaucuacugggccg

SEQ ID NO: 1231295 - RNA, 20 nt, Mycobacterium leprae
cggucacgggucggcggggu

SEQ ID NO: 1231296 - RNA, 14 nt, Mycobacterium leprae
cggucagguauuca

SEQ ID NO: 1231297 - RNA, 15 nt, Mycobacterium leprae
cggucagguauucag

SEQ ID NO: 1231298 - RNA, 22 nt, Mycobacterium leprae
cggucccaucgcugaccggugc

SEQ ID NO: 1231299 - RNA, 22 nt, Mycobacterium leprae
aaccacauugugugaccagcca

SEQ ID NO: 1231300 - RNA, 22 nt, Mycobacterium leprae
cgggcuaaggugcguugugcgg

SEQ ID NO: 1231301 - RNA, 13 nt, Mycobacterium leprae
cgggcucggugaa

SEQ ID NO: 1231302 - RNA, 18 nt, Mycobacterium leprae
cgggucgagcagccaccc

SEQ ID NO: 1231303 - RNA, 21 nt, Mycobacterium leprae
cgggucgagcagccacccgca

SEQ ID NO: 1231304 - RNA, 16 nt, Mycobacterium leprae
cggcuaccaauugcga

SEQ ID NO: 1231305 - RNA, 23 nt, Mycobacterium leprae
cggcuacacaacaagcgacuucg

SEQ ID NO: 1231306 - RNA, 15 nt, Mycobacterium leprae
cggcguuauugacca

SEQ ID NO: 1231307 - RNA, 14 nt, Mycobacterium leprae
cggcguggucggcg

SEQ ID NO: 1231308 - RNA, 23 nt, Mycobacterium leprae
cggcgucuucccaaugcucgacc

SEQ ID NO: 1231309 - RNA, 14 nt, Mycobacterium leprae
cggcgucuggcugg

SEQ ID NO: 1231310 - RNA, 16 nt, Mycobacterium leprae
cggcgucuggcuggcc

SEQ ID NO: 1231311 - RNA, 16 nt, Mycobacterium leprae
cggcgucgacaucacc

SEQ ID NO: 1231312 - RNA, 20 nt, Mycobacterium leprae
cggcgucgacaucaccggcg

SEQ ID NO: 1231313 - RNA, 18 nt, Mycobacterium leprae
cggcuaugagacgaaugc

SEQ ID NO: 1231314 - RNA, 13 nt, Mycobacterium leprae
cggcuaucgccgc

SEQ ID NO: 1231315 - RNA, 20 nt, Mycobacterium leprae
cggcuacugcgacagcagcc

SEQ ID NO: 1231316 - RNA, 18 nt, Mycobacterium leprae
cggcucccaucggcggcc

SEQ ID NO: 1231317 - RNA, 19 nt, Mycobacterium leprae
cgggcaccagauggcuccc

SEQ ID NO: 1231318 - RNA, 20 nt, Mycobacterium leprae
cgggccagagcugcgacgga

SEQ ID NO: 1231319 - RNA, 15 nt, Mycobacterium leprae
cgggcccgucguggu

SEQ ID NO: 1231320 - RNA, 15 nt, Mycobacterium leprae
cgggccugaguggug

SEQ ID NO: 1231321 - RNA, 20 nt, Mycobacterium leprae
cgggccguuauccacagcau

SEQ ID NO: 1231322 - RNA, 14 nt, Mycobacterium leprae
cgggcgucacgaag

SEQ ID NO: 1231323 - RNA, 15 nt, Mycobacterium leprae
cgggcggcaccugca

SEQ ID NO: 1231324 - RNA, 17 nt, Mycobacterium leprae
cgcuuugcuggcaagcu

SEQ ID NO: 1231325 - RNA, 21 nt, Mycobacterium leprae
cggaaauggguuuggugggca

SEQ ID NO: 1231326 - RNA, 13 nt, Mycobacterium leprae
cgcuuuccgcgcc

SEQ ID NO: 1231327 - RNA, 21 nt, Mycobacterium leprae
cggaauacaucggcacgacag

SEQ ID NO: 1231328 - RNA, 21 nt, Mycobacterium leprae
cggaaucgccgcgacgaaccc

SEQ ID NO: 1231329 - RNA, 18 nt, Mycobacterium leprae
cggaacaucacacggcgc

SEQ ID NO: 1231330 - RNA, 21 nt, Mycobacterium leprae
cggaacccucugacguuguuu

SEQ ID NO: 1231331 - RNA, 14 nt, Mycobacterium leprae
cgcugucgauggac

SEQ ID NO: 1231332 - RNA, 21 nt, Mycobacterium leprae
cgcugugcaaauacgcgcgcu

SEQ ID NO: 1231333 - RNA, 14 nt, Mycobacterium leprae
cgcuugcccgcugg

SEQ ID NO: 1231334 - RNA, 20 nt, Mycobacterium leprae
cgcuucgguuagcaucgacc

SEQ ID NO: 1231335 - RNA, 18 nt, Mycobacterium leprae
cgcuucaucgugaaucag

SEQ ID NO: 1231336 - RNA, 13 nt, Mycobacterium leprae
cgcugcauccgca

SEQ ID NO: 1231337 - RNA, 21 nt, Mycobacterium leprae
cgcugcagcaacagccacacc

SEQ ID NO: 1231338 - RNA, 21 nt, Mycobacterium leprae
cgcugaucgggcugcggugac

SEQ ID NO: 1231339 - RNA, 20 nt, Mycobacterium leprae
cgcugaucgcgauaccggcg

SEQ ID NO: 1231340 - RNA, 23 nt, Mycobacterium leprae
cgcugcaauucgcuaacuucccg

SEQ ID NO: 1231341 - RNA, 16 nt, Mycobacterium leprae
cgcugauugccaacuc

SEQ ID NO: 1231342 - RNA, 20 nt, Mycobacterium leprae
cgcuccugcagcgcggacuc

SEQ ID NO: 1231343 - RNA, 12 nt, Mycobacterium leprae
cgcugaucaacg

SEQ ID NO: 1231344 - RNA, 22 nt, Mycobacterium leprae
cgcugcgcagcgucgucuuucu

SEQ ID NO: 1231345 - RNA, 12 nt, Mycobacterium leprae
cgcuggccgccg

SEQ ID NO: 1231346 - RNA, 15 nt, Mycobacterium leprae
cgcuggccgccgggc

SEQ ID NO: 1231347 - RNA, 13 nt, Mycobacterium leprae
cgcuggcucaacg

SEQ ID NO: 1231348 - RNA, 21 nt, Mycobacterium leprae
cgcugguaucggugucggcgg

SEQ ID NO: 1231349 - RNA, 15 nt, Mycobacterium leprae
cgcugggugagcugu

SEQ ID NO: 1231350 - RNA, 9 nt, Mycobacterium leprae
cgcggcgcc

SEQ ID NO: 1231351 - RNA, 19 nt, Mycobacterium leprae
cgcggcgaccuggucgagc

SEQ ID NO: 1231352 - RNA, 13 nt, Mycobacterium leprae
cgcggaucugggc

SEQ ID NO: 1231353 - RNA, 15 nt, Mycobacterium leprae
cgcggcaucgucggc

SEQ ID NO: 1231354 - RNA, 15 nt, Mycobacterium leprae
cgcgugccagcgcug

SEQ ID NO: 1231355 - RNA, 15 nt, Mycobacterium leprae
cgcguucguugcuga

SEQ ID NO: 1231356 - RNA, 14 nt, Mycobacterium leprae
cgcgugcggcgccc

SEQ ID NO: 1231357 - RNA, 20 nt, Mycobacterium leprae
cgcuacgauuuugcaacgga

SEQ ID NO: 1231358 - RNA, 22 nt, Mycobacterium leprae
cgcucaccgacggaugcccagc

SEQ ID NO: 1231359 - RNA, 15 nt, Mycobacterium leprae
cgcucaccgcggccg

SEQ ID NO: 1231360 - RNA, 18 nt, Mycobacterium leprae
cgcuaacaacuauccuca

SEQ ID NO: 1231361 - RNA, 20 nt, Mycobacterium leprae
cgcuaagaaagacacgacag

SEQ ID NO: 1231362 - RNA, 19 nt, Mycobacterium leprae
cgcuaaucgcgggcaagcc

SEQ ID NO: 1231363 - RNA, 17 nt, Mycobacterium leprae
cgcuaccgaggaaugcc

SEQ ID NO: 1231364 - RNA, 21 nt, Mycobacterium leprae
cgcgggcgaugccaucgggcc

SEQ ID NO: 1231365 - RNA, 12 nt, Mycobacterium leprae
cgcgguagauau

SEQ ID NO: 1231366 - RNA, 21 nt, Mycobacterium leprae
cgcgucgagaaguuaccgacg

SEQ ID NO: 1231367 - RNA, 21 nt, Mycobacterium leprae
cgcgauucguauaaugucgaa

SEQ ID NO: 1231368 - RNA, 20 nt, Mycobacterium leprae
cgcgauugaaauauacgacg

SEQ ID NO: 1231369 - RNA, 13 nt, Mycobacterium leprae
cgcgauguuuugg

SEQ ID NO: 1231370 - RNA, 20 nt, Mycobacterium leprae
cgcgaucuggauggccgcca

SEQ ID NO: 1231371 - RNA, 21 nt, Mycobacterium leprae
cgcgaucuggauggccgccag

SEQ ID NO: 1231372 - RNA, 22 nt, Mycobacterium leprae
cgcgacgccggccgucgcggga

SEQ ID NO: 1231373 - RNA, 14 nt, Mycobacterium leprae
cgcgacgccgccau

SEQ ID NO: 1231374 - RNA, 15 nt, Mycobacterium leprae
cgcgacgccgccaua

SEQ ID NO: 1231375 - RNA, 15 nt, Mycobacterium leprae
cgcgcauacacggca

SEQ ID NO: 1231376 - RNA, 14 nt, Mycobacterium leprae
cgcgcagaacacga

SEQ ID NO: 1231377 - RNA, 19 nt, Mycobacterium leprae
cgccucgucggccagcacu

SEQ ID NO: 1231378 - RNA, 16 nt, Mycobacterium leprae
cgccuugcugccggcg

SEQ ID NO: 1231379 - RNA, 13 nt, Mycobacterium leprae
cgccuugcaagcc

SEQ ID NO: 1231380 - RNA, 20 nt, Mycobacterium leprae
cgcgacaaucucggcaucca

SEQ ID NO: 1231381 - RNA, 16 nt, Mycobacterium leprae
cgcgacaguaucgacc

SEQ ID NO: 1231382 - RNA, 23 nt, Mycobacterium leprae
cgcgacaguaucgaccagccacg

SEQ ID NO: 1231383 - RNA, 17 nt, Mycobacterium leprae
cgcgaccaacccggcga

SEQ ID NO: 1231384 - RNA, 21 nt, Mycobacterium leprae
cgccgucauauaacggcuuca

SEQ ID NO: 1231385 - RNA, 21 nt, Mycobacterium leprae
cgccguccacugcagggcgag

SEQ ID NO: 1231386 - RNA, 15 nt, Mycobacterium leprae
cgccgcgaacacggc

SEQ ID NO: 1231387 - RNA, 21 nt, Mycobacterium leprae
cgcccacguucagaagacauu

SEQ ID NO: 1231388 - RNA, 16 nt, Mycobacterium leprae
cgccgauaucgaccag

SEQ ID NO: 1231389 - RNA, 19 nt, Mycobacterium leprae
cgccgauaucgaccagcca

SEQ ID NO: 1231390 - RNA, 19 nt, Mycobacterium leprae
cgccgaucccaucggcugc

SEQ ID NO: 1231391 - RNA, 15 nt, Mycobacterium leprae
ccgggccgcaacaca

SEQ ID NO: 1231392 - RNA, 17 nt, Mycobacterium leprae
ccgggaaacuagcgggc

SEQ ID NO: 1231393 - RNA, 16 nt, Mycobacterium leprae
ccggcuaccggcccga

SEQ ID NO: 1231394 - RNA, 18 nt, Mycobacterium leprae
ccgucuggaacacgaucg

SEQ ID NO: 1231395 - RNA, 11 nt, Mycobacterium leprae
ccgucagccgu

SEQ ID NO: 1231396 - RNA, 21 nt, Mycobacterium leprae
ccgucacuacguuggccagca

SEQ ID NO: 1231397 - RNA, 22 nt, Mycobacterium leprae
ccguaguguuuuaccagccaga

SEQ ID NO: 1231398 - RNA, 19 nt, Mycobacterium leprae
ccguauccuggucaucugu

SEQ ID NO: 1231399 - RNA, 17 nt, Mycobacterium leprae
ccggugcugcagccacg

SEQ ID NO: 1231400 - RNA, 12 nt, Mycobacterium leprae
ccggugucaccc

SEQ ID NO: 1231401 - RNA, 16 nt, Mycobacterium leprae
ccuccuuuucgccggc

SEQ ID NO: 1231402 - RNA, 14 nt, Mycobacterium leprae
ccguggucggcgau

SEQ ID NO: 1231403 - RNA, 16 nt, Mycobacterium leprae
ccgugguggucgaccg

SEQ ID NO: 1231404 - RNA, 17 nt, Mycobacterium leprae
ccucgagcaaaccaggu

SEQ ID NO: 1231405 - RNA, 17 nt, Mycobacterium leprae
ccugaacaacgcucaac

SEQ ID NO: 1231406 - RNA, 21 nt, Mycobacterium leprae
ccucuuggauuucggugguaa

SEQ ID NO: 1231407 - RNA, 15 nt, Mycobacterium leprae
ccucuucgacaccga

SEQ ID NO: 1231408 - RNA, 14 nt, Mycobacterium leprae
ccucguugacgccc

SEQ ID NO: 1231409 - RNA, 23 nt, Mycobacterium leprae
ccucguugacgcccuccuggcga

SEQ ID NO: 1231410 - RNA, 17 nt, Mycobacterium leprae
ccucuguugugauccuc

SEQ ID NO: 1231411 - RNA, 15 nt, Mycobacterium leprae
ccucugcgaucauug

SEQ ID NO: 1231412 - RNA, 18 nt, Mycobacterium leprae
ccucuucaggcaacacgu

SEQ ID NO: 1231413 - RNA, 21 nt, Mycobacterium leprae
ccugagugugaugccgaagca

SEQ ID NO: 1231414 - RNA, 21 nt, Mycobacterium leprae
ccugauaagggucauccaacg

SEQ ID NO: 1231415 - RNA, 15 nt, Mycobacterium leprae
ccugacgcacaccgu

SEQ ID NO: 1231416 - RNA, 16 nt, Mycobacterium leprae
ccugaccucggcgaaa

SEQ ID NO: 1231417 - RNA, 15 nt, Mycobacterium leprae
ccugccacugacgag

SEQ ID NO: 1231418 - RNA, 21 nt, Mycobacterium leprae
ccugcguccacgucgcccaac

SEQ ID NO: 1231419 - RNA, 15 nt, Mycobacterium leprae
ccugccccgguggcu

SEQ ID NO: 1231420 - RNA, 22 nt, Mycobacterium leprae
ccugcgagaucggguugacgcu

SEQ ID NO: 1231421 - RNA, 14 nt, Mycobacterium leprae
ccugcgacagccgu

SEQ ID NO: 1231422 - RNA, 23 nt, Mycobacterium leprae
ccugguagcaucccgaagugauc

SEQ ID NO: 1231423 - RNA, 14 nt, Mycobacterium leprae
ccuggucgagcagc

SEQ ID NO: 1231424 - RNA, 22 nt, Mycobacterium leprae
ccuggaugugugcacucgcauc

SEQ ID NO: 1231425 - RNA, 13 nt, Mycobacterium leprae
ccuggaccgcagc

SEQ ID NO: 1231426 - RNA, 16 nt, Mycobacterium leprae
ccgccuugucggcaau

SEQ ID NO: 1231427 - RNA, 19 nt, Mycobacterium leprae
ccgccuugucggcaauguc

SEQ ID NO: 1231428 - RNA, 18 nt, Mycobacterium leprae
ccgccguucucgcgcagg

SEQ ID NO: 1231429 - RNA, 20 nt, Mycobacterium leprae
aaaugcuggagcgaugucga

SEQ ID NO: 1231430 - RNA, 22 nt, Mycobacterium leprae
ccgcgcuagcgauguagccaac

SEQ ID NO: 1231431 - RNA, 12 nt, Mycobacterium leprae
ccgccgaucggu

SEQ ID NO: 1231432 - RNA, 14 nt, Mycobacterium leprae
ccgccgaagcagcc

SEQ ID NO: 1231433 - RNA, 17 nt, Mycobacterium leprae
ccgccagcgacaccacc

SEQ ID NO: 1231434 - RNA, 19 nt, Mycobacterium leprae
ccgccagaccggcgaucuu

SEQ ID NO: 1231435 - RNA, 16 nt, Mycobacterium leprae
ccgccagacuggccgg

SEQ ID NO: 1231436 - RNA, 15 nt, Mycobacterium leprae
ccgcauccggcgcca

SEQ ID NO: 1231437 - RNA, 22 nt, Mycobacterium leprae
ccgcucgauggccagccguccc

SEQ ID NO: 1231438 - RNA, 16 nt, Mycobacterium leprae
ccgcuggaucggugcu

SEQ ID NO: 1231439 - RNA, 17 nt, Mycobacterium leprae
ccggaaauaguggcuga

SEQ ID NO: 1231440 - RNA, 16 nt, Mycobacterium leprae
ccggacagcacccccg

SEQ ID NO: 1231441 - RNA, 16 nt, Mycobacterium leprae
ccggacaguccaccgc

SEQ ID NO: 1231442 - RNA, 18 nt, Mycobacterium leprae
ccggacaguccaccgcca

SEQ ID NO: 1231443 - RNA, 19 nt, Mycobacterium leprae
ccggacaguccaccgccag

SEQ ID NO: 1231444 - RNA, 13 nt, Mycobacterium leprae
ccggaauuccgac

SEQ ID NO: 1231445 - RNA, 22 nt, Mycobacterium leprae
ccggaauuccgacgaagguggc

SEQ ID NO: 1231446 - RNA, 19 nt, Mycobacterium leprae
ccggacgauuugcgaucaa

SEQ ID NO: 1231447 - RNA, 18 nt, Mycobacterium leprae
ccggcaucggacaggauc

SEQ ID NO: 1231448 - RNA, 15 nt, Mycobacterium leprae
ccggcgaaucggucu

SEQ ID NO: 1231449 - RNA, 15 nt, Mycobacterium leprae
ccggccgucgcggga

SEQ ID NO: 1231450 - RNA, 22 nt, Mycobacterium leprae
ccggcagacgugcuacugcgau

SEQ ID NO: 1231451 - RNA, 16 nt, Mycobacterium leprae
ccggcacaucgucggc

SEQ ID NO: 1231452 - RNA, 19 nt, Mycobacterium leprae
ccggauguguugguuuggu

SEQ ID NO: 1231453 - RNA, 13 nt, Mycobacterium leprae
cgauucugcccgg

SEQ ID NO: 1231454 - RNA, 15 nt, Mycobacterium leprae
cgcaacagucagccg

SEQ ID NO: 1231455 - RNA, 20 nt, Mycobacterium leprae
cgauugauugugcgcagugg

SEQ ID NO: 1231456 - RNA, 14 nt, Mycobacterium leprae
cgaugaaauccgca

SEQ ID NO: 1231457 - RNA, 21 nt, Mycobacterium leprae
cgaugauccggccgucggcgg

SEQ ID NO: 1231458 - RNA, 15 nt, Mycobacterium leprae
cgaugauucguugac

SEQ ID NO: 1231459 - RNA, 18 nt, Mycobacterium leprae
cgaugaggcuucgugugc

SEQ ID NO: 1231460 - RNA, 19 nt, Mycobacterium leprae
cgaugcggaauacaucggc

SEQ ID NO: 1231461 - RNA, 23 nt, Mycobacterium leprae
cgaugcggaauacaucggcacga

SEQ ID NO: 1231462 - RNA, 12 nt, Mycobacterium leprae
cgauggcaacac

SEQ ID NO: 1231463 - RNA, 13 nt, Mycobacterium leprae
cgcagccaccacu

SEQ ID NO: 1231464 - RNA, 22 nt, Mycobacterium leprae
cgcagccaccacucucaucgcg

SEQ ID NO: 1231465 - RNA, 15 nt, Mycobacterium leprae
cgcagcgcggccauc

SEQ ID NO: 1231466 - RNA, 17 nt, Mycobacterium leprae
cgcagcgacggcaagcu

SEQ ID NO: 1231467 - RNA, 19 nt, Mycobacterium leprae
cgcagcucgccaaggucga

SEQ ID NO: 1231468 - RNA, 15 nt, Mycobacterium leprae
cgcagcuggccaagc

SEQ ID NO: 1231469 - RNA, 15 nt, Mycobacterium leprae
cgcaccaacucgaug

SEQ ID NO: 1231470 - RNA, 14 nt, Mycobacterium leprae
cgcaccaauccacc

SEQ ID NO: 1231471 - RNA, 22 nt, Mycobacterium leprae
cgcaacgaaaccaugccgccga

SEQ ID NO: 1231472 - RNA, 17 nt, Mycobacterium leprae
cgcaaccgauacgccag

SEQ ID NO: 1231473 - RNA, 14 nt, Mycobacterium leprae
cgcaccgauccggc

SEQ ID NO: 1231474 - RNA, 18 nt, Mycobacterium leprae
cgcaccgauccggcggcc

SEQ ID NO: 1231475 - RNA, 17 nt, Mycobacterium leprae
cgcacccugcacacuga

SEQ ID NO: 1231476 - RNA, 17 nt, Mycobacterium leprae
cgcacccugccgccaca

SEQ ID NO: 1231477 - RNA, 20 nt, Mycobacterium leprae
cgcacccggcagcauccgcc

SEQ ID NO: 1231478 - RNA, 18 nt, Mycobacterium leprae
cgccaaacuggucaacgc

SEQ ID NO: 1231479 - RNA, 20 nt, Mycobacterium leprae
cgcauuuaccgagaucgacg

SEQ ID NO: 1231480 - RNA, 14 nt, Mycobacterium leprae
cgcauugccaacgu

SEQ ID NO: 1231481 - RNA, 16 nt, Mycobacterium leprae
cgccacgccggacugc

SEQ ID NO: 1231482 - RNA, 17 nt, Mycobacterium leprae
cgccagcgacacagccg

SEQ ID NO: 1231483 - RNA, 17 nt, Mycobacterium leprae
cgccacucauauccgag

SEQ ID NO: 1231484 - RNA, 18 nt, Mycobacterium leprae
cgccagacuggccggugg

SEQ ID NO: 1231485 - RNA, 20 nt, Mycobacterium leprae
cgccagacuggccgguggau

SEQ ID NO: 1231486 - RNA, 15 nt, Mycobacterium leprae
cgccauauccucgac

SEQ ID NO: 1231487 - RNA, 16 nt, Mycobacterium leprae
cgcccaccgcaacgcc

SEQ ID NO: 1231488 - RNA, 19 nt, Mycobacterium leprae
cgcccaauggugcggcgau

SEQ ID NO: 1231489 - RNA, 15 nt, Mycobacterium leprae
cgcccaacguaucgg

SEQ ID NO: 1231490 - RNA, 13 nt, Mycobacterium leprae
cgccaggucagcg

SEQ ID NO: 1231491 - RNA, 16 nt, Mycobacterium leprae
cgccaggucagcgauu

SEQ ID NO: 1231492 - RNA, 14 nt, Mycobacterium leprae
cgccaggcgaauug

SEQ ID NO: 1231493 - RNA, 12 nt, Mycobacterium leprae
cgccagugcgca

SEQ ID NO: 1231494 - RNA, 14 nt, Mycobacterium leprae
cgaagagcugcagc

SEQ ID NO: 1231495 - RNA, 23 nt, Mycobacterium leprae
cgaacuaguguucggcacccauc

SEQ ID NO: 1231496 - RNA, 23 nt, Mycobacterium leprae
cgaauccugagaugccagccaac

SEQ ID NO: 1231497 - RNA, 17 nt, Mycobacterium leprae
cgaauccgccucggugu

SEQ ID NO: 1231498 - RNA, 16 nt, Mycobacterium leprae
cgacaccauccacaac

SEQ ID NO: 1231499 - RNA, 22 nt, Mycobacterium leprae
cgacaccgauaccagcggcaga

SEQ ID NO: 1231500 - RNA, 17 nt, Mycobacterium leprae
cgacaguaucgaccagc

SEQ ID NO: 1231501 - RNA, 14 nt, Mycobacterium leprae
cgacagcacccagc

SEQ ID NO: 1231502 - RNA, 13 nt, Mycobacterium leprae
cgacacgcgcgac

SEQ ID NO: 1231503 - RNA, 18 nt, Mycobacterium leprae
cgacagaacccauccgaa

SEQ ID NO: 1231504 - RNA, 18 nt, Mycobacterium leprae
cgacgccgucuccgccgu

SEQ ID NO: 1231505 - RNA, 22 nt, Mycobacterium leprae
cgacgccuagagagugcggugc

SEQ ID NO: 1231506 - RNA, 13 nt, Mycobacterium leprae
cgacgcagaccgg

SEQ ID NO: 1231507 - RNA, 21 nt, Mycobacterium leprae
cgacgaacccgucgaugaucu

SEQ ID NO: 1231508 - RNA, 18 nt, Mycobacterium leprae
cgacccuugcuugagccu

SEQ ID NO: 1231509 - RNA, 15 nt, Mycobacterium leprae
cgaccgcaccggcga

SEQ ID NO: 1231510 - RNA, 16 nt, Mycobacterium leprae
cgaccgcaucgauaag

SEQ ID NO: 1231511 - RNA, 17 nt, Mycobacterium leprae
cgaccgcacggcaagcc

SEQ ID NO: 1231512 - RNA, 21 nt, Mycobacterium leprae
cgaccuagcuucgauccaggc

SEQ ID NO: 1231513 - RNA, 17 nt, Mycobacterium leprae
cgaccagcgagcaaccu

SEQ ID NO: 1231514 - RNA, 23 nt, Mycobacterium leprae
cgagcuggcugugcccguuaacg

SEQ ID NO: 1231515 - RNA, 12 nt, Mycobacterium leprae
cgaggaccgcca

SEQ ID NO: 1231516 - RNA, 15 nt, Mycobacterium leprae
cgaggaccgccaugc

SEQ ID NO: 1231517 - RNA, 22 nt, Mycobacterium leprae
cgaggaagcgcagcucgccaag

SEQ ID NO: 1231518 - RNA, 14 nt, Mycobacterium leprae
cgagccgcaggucu

SEQ ID NO: 1231519 - RNA, 19 nt, Mycobacterium leprae
cgagcgcaucggcggcgga

SEQ ID NO: 1231520 - RNA, 19 nt, Mycobacterium leprae
cgauaucgaccagccaagc

SEQ ID NO: 1231521 - RNA, 23 nt, Mycobacterium leprae
cgauauccccgacgucucgcggu

SEQ ID NO: 1231522 - RNA, 17 nt, Mycobacterium leprae
cgauaucgaugcaggcg

SEQ ID NO: 1231523 - RNA, 17 nt, Mycobacterium leprae
cgaggcucugcucggcu

SEQ ID NO: 1231524 - RNA, 15 nt, Mycobacterium leprae
cgaguaaugcaggug

SEQ ID NO: 1231525 - RNA, 15 nt, Mycobacterium leprae
cgagguggcggcgac

SEQ ID NO: 1231526 - RNA, 23 nt, Mycobacterium leprae
cgacgcuauguuggccagcagcg

SEQ ID NO: 1231527 - RNA, 17 nt, Mycobacterium leprae
cgacgcgguugccggcg

SEQ ID NO: 1231528 - RNA, 13 nt, Mycobacterium leprae
cgacgucgccgau

SEQ ID NO: 1231529 - RNA, 22 nt, Mycobacterium leprae
cgagaucucaacggggucgucg

SEQ ID NO: 1231530 - RNA, 17 nt, Mycobacterium leprae
cgagaguguagcaaggu

SEQ ID NO: 1231531 - RNA, 16 nt, Mycobacterium leprae
cgagaccaugaccagg

SEQ ID NO: 1231532 - RNA, 18 nt, Mycobacterium leprae
cgacuuguugucgcgucg

SEQ ID NO: 1231533 - RNA, 22 nt, Mycobacterium leprae
cgagcaaguuugagaacagccu

SEQ ID NO: 1231534 - RNA, 16 nt, Mycobacterium leprae
cgagcaaccaacuuca

SEQ ID NO: 1231535 - RNA, 14 nt, Mycobacterium leprae
cgagcaucuggccg

SEQ ID NO: 1231536 - RNA, 16 nt, Mycobacterium leprae
cccuccuuuucgccgg

SEQ ID NO: 1231537 - RNA, 17 nt, Mycobacterium leprae
ccgaaccugugcguaag

SEQ ID NO: 1231538 - RNA, 22 nt, Mycobacterium leprae
ccgaagaucaccgccaccacga

SEQ ID NO: 1231539 - RNA, 15 nt, Mycobacterium leprae
ccgaaguccaccgga

SEQ ID NO: 1231540 - RNA, 21 nt, Mycobacterium leprae
aaaucucacgcccgacgaacg

SEQ ID NO: 1231541 - RNA, 18 nt, Mycobacterium leprae
cccgguuaguccgaccgc

SEQ ID NO: 1231542 - RNA, 23 nt, Mycobacterium leprae
ccgaaugauuguguguaggugau

SEQ ID NO: 1231543 - RNA, 23 nt, Mycobacterium leprae
ccgaaugcaaugcgccauuucga

SEQ ID NO: 1231544 - RNA, 16 nt, Mycobacterium leprae
ccgaaucguuccaccc

SEQ ID NO: 1231545 - RNA, 18 nt, Mycobacterium leprae
ccgacaaucucacguccg

SEQ ID NO: 1231546 - RNA, 12 nt, Mycobacterium leprae
ccgacgaaugca

SEQ ID NO: 1231547 - RNA, 14 nt, Mycobacterium leprae
ccgaccgaaagccg

SEQ ID NO: 1231548 - RNA, 22 nt, Mycobacterium leprae
ccgaccgaaagccgcaccaggu

SEQ ID NO: 1231549 - RNA, 16 nt, Mycobacterium leprae
ccgacgcaacugcugg

SEQ ID NO: 1231550 - RNA, 21 nt, Mycobacterium leprae
ccgacgcuauguuggccagca

SEQ ID NO: 1231551 - RNA, 21 nt, Mycobacterium leprae
ccgacggaugcccagccagga

SEQ ID NO: 1231552 - RNA, 12 nt, Mycobacterium leprae
ccgacggcgccg

SEQ ID NO: 1231553 - RNA, 21 nt, Mycobacterium leprae
ccgagaauaaaugccggugca

SEQ ID NO: 1231554 - RNA, 18 nt, Mycobacterium leprae
ccgagaaaacucgaucga

SEQ ID NO: 1231555 - RNA, 14 nt, Mycobacterium leprae
ccgacucaccggua

SEQ ID NO: 1231556 - RNA, 13 nt, Mycobacterium leprae
ccgacgucuucaa

SEQ ID NO: 1231557 - RNA, 14 nt, Mycobacterium leprae
cccauaacgugcug

SEQ ID NO: 1231558 - RNA, 14 nt, Mycobacterium leprae
cccagucgccagag

SEQ ID NO: 1231559 - RNA, 15 nt, Mycobacterium leprae
cccauccguccaccc

SEQ ID NO: 1231560 - RNA, 13 nt, Mycobacterium leprae
cccauccgggcca

SEQ ID NO: 1231561 - RNA, 17 nt, Mycobacterium leprae
cccauccgaaucaccgc

SEQ ID NO: 1231562 - RNA, 20 nt, Mycobacterium leprae
cccauccgaaucaccgcugg

SEQ ID NO: 1231563 - RNA, 22 nt, Mycobacterium leprae
cccaugggaguuuaucggugga

SEQ ID NO: 1231564 - RNA, 22 nt, Mycobacterium leprae
cccaggguagcugacgguugcu

SEQ ID NO: 1231565 - RNA, 21 nt, Mycobacterium leprae
cccaggugucuuccaguggcu

SEQ ID NO: 1231566 - RNA, 21 nt, Mycobacterium leprae
ccauuauuucgucgucagcug

SEQ ID NO: 1231567 - RNA, 23 nt, Mycobacterium leprae
aaaucgagaauuuaccggcguuc

SEQ ID NO: 1231568 - RNA, 14 nt, Mycobacterium leprae
ccauuggccgcugg

SEQ ID NO: 1231569 - RNA, 16 nt, Mycobacterium leprae
ccaugcggcggacgau

SEQ ID NO: 1231570 - RNA, 16 nt, Mycobacterium leprae
ccagucgaaggugagu

SEQ ID NO: 1231571 - RNA, 16 nt, Mycobacterium leprae
cccaaccgcgacgcca

SEQ ID NO: 1231572 - RNA, 22 nt, Mycobacterium leprae
cccccagaaccaucccaaaacc

SEQ ID NO: 1231573 - RNA, 20 nt, Mycobacterium leprae
cccgaaagugccguuggccc

SEQ ID NO: 1231574 - RNA, 16 nt, Mycobacterium leprae
cccggacaagucagcc

SEQ ID NO: 1231575 - RNA, 23 nt, Mycobacterium leprae
cccggacaagucagccuagcagc

SEQ ID NO: 1231576 - RNA, 15 nt, Mycobacterium leprae
cccgccccaccauaa

SEQ ID NO: 1231577 - RNA, 22 nt, Mycobacterium leprae
cccgaugauccacucgccgcgg

SEQ ID NO: 1231578 - RNA, 15 nt, Mycobacterium leprae
cccgcagcaccuugg

SEQ ID NO: 1231579 - RNA, 15 nt, Mycobacterium leprae
ccagcguaaucgcuu

SEQ ID NO: 1231580 - RNA, 16 nt, Mycobacterium leprae
ccagccacgcaaacga

SEQ ID NO: 1231581 - RNA, 17 nt, Mycobacterium leprae
ccagcaguggucggcga

SEQ ID NO: 1231582 - RNA, 20 nt, Mycobacterium leprae
ccagcagguugaggaggugc

SEQ ID NO: 1231583 - RNA, 14 nt, Mycobacterium leprae
ccagcaucaacgcc

SEQ ID NO: 1231584 - RNA, 16 nt, Mycobacterium leprae
ccagcgcacccauccg

SEQ ID NO: 1231585 - RNA, 17 nt, Mycobacterium leprae
ccagcgcacccauccga

SEQ ID NO: 1231586 - RNA, 15 nt, Mycobacterium leprae
ccagcgcaucagcca

SEQ ID NO: 1231587 - RNA, 19 nt, Mycobacterium leprae
ccagcgaagguagcccguu

SEQ ID NO: 1231588 - RNA, 19 nt, Mycobacterium leprae
ccagggcggcauucccaac

SEQ ID NO: 1231589 - RNA, 17 nt, Mycobacterium leprae
ccacgcaaugucgccgg

SEQ ID NO: 1231590 - RNA, 23 nt, Mycobacterium leprae
ccacgcuggcacuccgaccgagc

SEQ ID NO: 1231591 - RNA, 22 nt, Mycobacterium leprae
aaaggcuguccuugccggcgcc

SEQ ID NO: 1231592 - RNA, 12 nt, Mycobacterium leprae
ccaccggcggcu

SEQ ID NO: 1231593 - RNA, 16 nt, Mycobacterium leprae
ccagacgcgaccgcca

SEQ ID NO: 1231594 - RNA, 13 nt, Mycobacterium leprae
ccacggcggcauc

SEQ ID NO: 1231595 - RNA, 16 nt, Mycobacterium leprae
ccacggcggcaucuca

SEQ ID NO: 1231596 - RNA, 19 nt, Mycobacterium leprae
ccacgucgggcagcaaccg

SEQ ID NO: 1231597 - RNA, 14 nt, Mycobacterium leprae
ccacugucgcccga

SEQ ID NO: 1231598 - RNA, 20 nt, Mycobacterium leprae
aaaggccaauccagccgagg

SEQ ID NO: 1231599 - RNA, 16 nt, Mycobacterium leprae
ccaccgcuacggcggu

SEQ ID NO: 1231600 - RNA, 18 nt, Mycobacterium leprae
ccaagauggcgucaccgu

SEQ ID NO: 1231601 - RNA, 14 nt, Mycobacterium leprae
ccaacgcggccgca

SEQ ID NO: 1231602 - RNA, 15 nt, Mycobacterium leprae
ccaaaucagcaccau

SEQ ID NO: 1231603 - RNA, 14 nt, Mycobacterium leprae
ccaacagcuugaca

SEQ ID NO: 1231604 - RNA, 12 nt, Mycobacterium leprae
ccaaugcagcgu

SEQ ID NO: 1231605 - RNA, 15 nt, Mycobacterium leprae
ccaagucuucgaugc

SEQ ID NO: 1231606 - RNA, 15 nt, Mycobacterium leprae
ccaauccaccgugcu

SEQ ID NO: 1231607 - RNA, 23 nt, Mycobacterium leprae
ccaaucuaucaagccacacgguu

SEQ ID NO: 1231608 - RNA, 13 nt, Mycobacterium leprae
caugagcaacacg

SEQ ID NO: 1231609 - RNA, 16 nt, Mycobacterium leprae
caugagcacacgcugc

SEQ ID NO: 1231610 - RNA, 13 nt, Mycobacterium leprae
caugacggcguug

SEQ ID NO: 1231611 - RNA, 15 nt, Mycobacterium leprae
caucuuuaaaggugg

SEQ ID NO: 1231612 - RNA, 16 nt, Mycobacterium leprae
caucugcuuguggcgg

SEQ ID NO: 1231613 - RNA, 20 nt, Mycobacterium leprae
caugccgaguucggaugcgg

SEQ ID NO: 1231614 - RNA, 14 nt, Mycobacterium leprae
caugccgaucagcc

SEQ ID NO: 1231615 - RNA, 19 nt, Mycobacterium leprae
caugcaccgacggugcuga

SEQ ID NO: 1231616 - RNA, 22 nt, Mycobacterium leprae
caugcaacuaugcggcgggauc

SEQ ID NO: 1231617 - RNA, 14 nt, Mycobacterium leprae
caugauucgagaaa

SEQ ID NO: 1231618 - RNA, 22 nt, Mycobacterium leprae
caucggaaucgccgcgacgaac

SEQ ID NO: 1231619 - RNA, 16 nt, Mycobacterium leprae
caucgcugccaucgac

SEQ ID NO: 1231620 - RNA, 17 nt, Mycobacterium leprae
caucgcugccaucgacg

SEQ ID NO: 1231621 - RNA, 20 nt, Mycobacterium leprae
caucgcugccaucgacgccg

SEQ ID NO: 1231622 - RNA, 21 nt, Mycobacterium leprae
caucgcugccaucgacgccgu

SEQ ID NO: 1231623 - RNA, 17 nt, Mycobacterium leprae
caucggcagaucgaucu

SEQ ID NO: 1231624 - RNA, 13 nt, Mycobacterium leprae
caucggucggcgu

SEQ ID NO: 1231625 - RNA, 18 nt, Mycobacterium leprae
caucggcgugccuggccc

SEQ ID NO: 1231626 - RNA, 17 nt, Mycobacterium leprae
caucggcucccaucggc

SEQ ID NO: 1231627 - RNA, 18 nt, Mycobacterium leprae
caucggcucccaucggcg

SEQ ID NO: 1231628 - RNA, 20 nt, Mycobacterium leprae
caucucaacauggaccaccg

SEQ ID NO: 1231629 - RNA, 15 nt, Mycobacterium leprae
caucugcucucagca

SEQ ID NO: 1231630 - RNA, 15 nt, Mycobacterium leprae
caucguugccgcugu

SEQ ID NO: 1231631 - RNA, 22 nt, Mycobacterium leprae
caucgucagucggccuuaauaa

SEQ ID NO: 1231632 - RNA, 20 nt, Mycobacterium leprae
caucguauagcacacgaccg

SEQ ID NO: 1231633 - RNA, 19 nt, Mycobacterium leprae
caucgucggcccagggaug

SEQ ID NO: 1231634 - RNA, 17 nt, Mycobacterium leprae
caguguauuggcggguc

SEQ ID NO: 1231635 - RNA, 15 nt, Mycobacterium leprae
cagugucggugccgu

SEQ ID NO: 1231636 - RNA, 12 nt, Mycobacterium leprae
cauagccgaucu

SEQ ID NO: 1231637 - RNA, 13 nt, Mycobacterium leprae
caucagauauccu

SEQ ID NO: 1231638 - RNA, 14 nt, Mycobacterium leprae
caucagcaccgcgc

SEQ ID NO: 1231639 - RNA, 19 nt, Mycobacterium leprae
caucagccaacaccaccag

SEQ ID NO: 1231640 - RNA, 13 nt, Mycobacterium leprae
caucccagcaacg

SEQ ID NO: 1231641 - RNA, 22 nt, Mycobacterium leprae
cauccauguacaacaccagauc

SEQ ID NO: 1231642 - RNA, 18 nt, Mycobacterium leprae
cauccaggauagccgauu

SEQ ID NO: 1231643 - RNA, 22 nt, Mycobacterium leprae
caucccagugugcugcauccga

SEQ ID NO: 1231644 - RNA, 18 nt, Mycobacterium leprae
cauccgacaaagcagcau

SEQ ID NO: 1231645 - RNA, 20 nt, Mycobacterium leprae
cauccgaucaauggcagcca

SEQ ID NO: 1231646 - RNA, 13 nt, Mycobacterium leprae
caucgcgucgucu

SEQ ID NO: 1231647 - RNA, 18 nt, Mycobacterium leprae
caucgcggcugccacugu

SEQ ID NO: 1231648 - RNA, 15 nt, Mycobacterium leprae
caucgcccaccgcaa

SEQ ID NO: 1231649 - RNA, 14 nt, Mycobacterium leprae
caucgccaccgacc

SEQ ID NO: 1231650 - RNA, 14 nt, Mycobacterium leprae
caucgacgccgccg

SEQ ID NO: 1231651 - RNA, 15 nt, Mycobacterium leprae
caucgacgccgccgu

SEQ ID NO: 1231652 - RNA, 15 nt, Mycobacterium leprae
caggcaaccaagaug

SEQ ID NO: 1231653 - RNA, 21 nt, Mycobacterium leprae
caggcaaccgcccgcaguagc

SEQ ID NO: 1231654 - RNA, 17 nt, Mycobacterium leprae
caggccgucguugccga

SEQ ID NO: 1231655 - RNA, 13 nt, Mycobacterium leprae
caggcgccgcagc

SEQ ID NO: 1231656 - RNA, 13 nt, Mycobacterium leprae
cagugcacugagc

SEQ ID NO: 1231657 - RNA, 21 nt, Mycobacterium leprae
cagucagccgucgagccgauu

SEQ ID NO: 1231658 - RNA, 13 nt, Mycobacterium leprae
caguccaccgcca

SEQ ID NO: 1231659 - RNA, 18 nt, Mycobacterium leprae
cagucgcagggcgcgcag

SEQ ID NO: 1231660 - RNA, 20 nt, Mycobacterium leprae
cagucggucugcucggcgaa

SEQ ID NO: 1231661 - RNA, 22 nt, Mycobacterium leprae
caguagaauuuauuucggagaa

SEQ ID NO: 1231662 - RNA, 13 nt, Mycobacterium leprae
cagguuccccggu

SEQ ID NO: 1231663 - RNA, 16 nt, Mycobacterium leprae
cagguucugcacccca

SEQ ID NO: 1231664 - RNA, 20 nt, Mycobacterium leprae
cagguucgugcaggcgcuca

SEQ ID NO: 1231665 - RNA, 21 nt, Mycobacterium leprae
cagguugcugucguguuugug

SEQ ID NO: 1231666 - RNA, 19 nt, Mycobacterium leprae
cagguggcaucagauaucc

SEQ ID NO: 1231667 - RNA, 14 nt, Mycobacterium leprae
cagguccacccgca

SEQ ID NO: 1231668 - RNA, 17 nt, Mycobacterium leprae
cagguccacccgcaugc

SEQ ID NO: 1231669 - RNA, 21 nt, Mycobacterium leprae
caggucgagcgauggcugccg

SEQ ID NO: 1231670 - RNA, 15 nt, Mycobacterium leprae
cagggguuccaagau

SEQ ID NO: 1231671 - RNA, 23 nt, Mycobacterium leprae
cagggcggcauucccaaccgcga

SEQ ID NO: 1231672 - RNA, 21 nt, Mycobacterium leprae
cagggcgaguacguccgcgcc

SEQ ID NO: 1231673 - RNA, 18 nt, Mycobacterium leprae
cagcauccgccgacgaug

SEQ ID NO: 1231674 - RNA, 19 nt, Mycobacterium leprae
cagcaguggucggcgaagg

SEQ ID NO: 1231675 - RNA, 21 nt, Mycobacterium leprae
cagcaguggucggcgaaggag

SEQ ID NO: 1231676 - RNA, 19 nt, Mycobacterium leprae
cagcaggaaucccagcagc

SEQ ID NO: 1231677 - RNA, 22 nt, Mycobacterium leprae
cagcaacuguuuggugccgauc

SEQ ID NO: 1231678 - RNA, 21 nt, Mycobacterium leprae
cagauucacagucggcgcagu

SEQ ID NO: 1231679 - RNA, 21 nt, Mycobacterium leprae
cagauugcgugaccgcgccga

SEQ ID NO: 1231680 - RNA, 17 nt, Mycobacterium leprae
cagaugaauucgcugau

SEQ ID NO: 1231681 - RNA, 21 nt, Mycobacterium leprae
cagaugcgaucgcagucauca

SEQ ID NO: 1231682 - RNA, 12 nt, Mycobacterium leprae
cagcaccggcau

SEQ ID NO: 1231683 - RNA, 18 nt, Mycobacterium leprae
cagcaccauucuggucga

SEQ ID NO: 1231684 - RNA, 13 nt, Mycobacterium leprae
cagcacccagcuc

SEQ ID NO: 1231685 - RNA, 14 nt, Mycobacterium leprae
aaagacacgacagc

SEQ ID NO: 1231686 - RNA, 19 nt, Mycobacterium leprae
aaagaauuuaccggcguuc

SEQ ID NO: 1231687 - RNA, 19 nt, Mycobacterium leprae
cagaucacauuggucgacg

SEQ ID NO: 1231688 - RNA, 20 nt, Mycobacterium leprae
cagagcuucgacuaagccgc

SEQ ID NO: 1231689 - RNA, 16 nt, Mycobacterium leprae
cagagcucacugggcu

SEQ ID NO: 1231690 - RNA, 19 nt, Mycobacterium leprae
cagagcugauggccgccag

SEQ ID NO: 1231691 - RNA, 19 nt, Mycobacterium leprae
cagaucgacuccgcaagau

SEQ ID NO: 1231692 - RNA, 16 nt, Mycobacterium leprae
cagaucgacagcggcc

SEQ ID NO: 1231693 - RNA, 13 nt, Mycobacterium leprae
cagauccagcauc

SEQ ID NO: 1231694 - RNA, 15 nt, Mycobacterium leprae
cagaucgcgucgcau

SEQ ID NO: 1231695 - RNA, 21 nt, Mycobacterium leprae
cagaaauuuuucggacgggca

SEQ ID NO: 1231696 - RNA, 16 nt, Mycobacterium leprae
cacuucagcgacaggc

SEQ ID NO: 1231697 - RNA, 21 nt, Mycobacterium leprae
cacugcuucggccagcgcauc

SEQ ID NO: 1231698 - RNA, 22 nt, Mycobacterium leprae
cacuaugucgaucggcaguggu

SEQ ID NO: 1231699 - RNA, 17 nt, Mycobacterium leprae
cacuagcuugugcuccu

SEQ ID NO: 1231700 - RNA, 16 nt, Mycobacterium leprae
cacgcgacgccgccau

SEQ ID NO: 1231701 - RNA, 16 nt, Mycobacterium leprae
cacugcacgaccacac

SEQ ID NO: 1231702 - RNA, 16 nt, Mycobacterium leprae
cacugcacggcgugca

SEQ ID NO: 1231703 - RNA, 14 nt, Mycobacterium leprae
cacugcagcgguca

SEQ ID NO: 1231704 - RNA, 18 nt, Mycobacterium leprae
cagcggacguacaguggu

SEQ ID NO: 1231705 - RNA, 20 nt, Mycobacterium leprae
cagcgggcggggcgguggca

SEQ ID NO: 1231706 - RNA, 15 nt, Mycobacterium leprae
cagcgaggccguggc

SEQ ID NO: 1231707 - RNA, 16 nt, Mycobacterium leprae
cagccgucgagccgau

SEQ ID NO: 1231708 - RNA, 14 nt, Mycobacterium leprae
cagccgucgcguga

SEQ ID NO: 1231709 - RNA, 21 nt, Mycobacterium leprae
cagcgacggcaagcugaucac

SEQ ID NO: 1231710 - RNA, 21 nt, Mycobacterium leprae
cagccaccagggaagaucuca

SEQ ID NO: 1231711 - RNA, 15 nt, Mycobacterium leprae
cagccacccgcaucg

SEQ ID NO: 1231712 - RNA, 22 nt, Mycobacterium leprae
cagccggaggguugccgacggc

SEQ ID NO: 1231713 - RNA, 23 nt, Mycobacterium leprae
auuuguuuuccugugcaggucga

SEQ ID NO: 1231714 - RNA, 19 nt, Mycobacterium leprae
auuuggauggucggcagcu

SEQ ID NO: 1231715 - RNA, 14 nt, Mycobacterium leprae
auuuucggcggcac

SEQ ID NO: 1231716 - RNA, 16 nt, Mycobacterium leprae
auuuucuugccgucga

SEQ ID NO: 1231717 - RNA, 20 nt, Mycobacterium leprae
caaaggccaauccagccgag

SEQ ID NO: 1231718 - RNA, 22 nt, Mycobacterium leprae
caaagaacgcgaccuguuggug

SEQ ID NO: 1231719 - RNA, 18 nt, Mycobacterium leprae
caaagagcgggcggcagc

SEQ ID NO: 1231720 - RNA, 13 nt, Mycobacterium leprae
caaaggucgacac

SEQ ID NO: 1231721 - RNA, 17 nt, Mycobacterium leprae
caaagucugcuuccaag

SEQ ID NO: 1231722 - RNA, 20 nt, Mycobacterium leprae
caaagucagcuugucgaugu

SEQ ID NO: 1231723 - RNA, 13 nt, Mycobacterium leprae
caaacguuucgcc

SEQ ID NO: 1231724 - RNA, 16 nt, Mycobacterium leprae
caaaccggccaccacg

SEQ ID NO: 1231725 - RNA, 22 nt, Mycobacterium leprae
caaaaugcucccccaaugcagc

SEQ ID NO: 1231726 - RNA, 21 nt, Mycobacterium leprae
auugugguuaacucuuucccu

SEQ ID NO: 1231727 - RNA, 20 nt, Mycobacterium leprae
auucucgagcgagcccagug

SEQ ID NO: 1231728 - RNA, 22 nt, Mycobacterium leprae
auucucgagcggcgcaugccaa

SEQ ID NO: 1231729 - RNA, 15 nt, Mycobacterium leprae
auucgguuuccucau

SEQ ID NO: 1231730 - RNA, 14 nt, Mycobacterium leprae
auugcagcgcgaac

SEQ ID NO: 1231731 - RNA, 15 nt, Mycobacterium leprae
auugucauggccgcu

SEQ ID NO: 1231732 - RNA, 20 nt, Mycobacterium leprae
auuggcugagaccgguccac

SEQ ID NO: 1231733 - RNA, 16 nt, Mycobacterium leprae
auugcggcauugcggc

SEQ ID NO: 1231734 - RNA, 15 nt, Mycobacterium leprae
augucggccacugca

SEQ ID NO: 1231735 - RNA, 14 nt, Mycobacterium leprae
auucaccgaucgac

SEQ ID NO: 1231736 - RNA, 16 nt, Mycobacterium leprae
auucaccgaucgacaa

SEQ ID NO: 1231737 - RNA, 17 nt, Mycobacterium leprae
augagauucgagcgggc

SEQ ID NO: 1231738 - RNA, 16 nt, Mycobacterium leprae
augagcacacgcugcg

SEQ ID NO: 1231739 - RNA, 16 nt, Mycobacterium leprae
augagauaucgucggc

SEQ ID NO: 1231740 - RNA, 21 nt, Mycobacterium leprae
augacgccugggaacccauug

SEQ ID NO: 1231741 - RNA, 20 nt, Mycobacterium leprae
augacggcgcaguugaccgg

SEQ ID NO: 1231742 - RNA, 15 nt, Mycobacterium leprae
augcacgugauggcg

SEQ ID NO: 1231743 - RNA, 14 nt, Mycobacterium leprae
augcagggccagcc

SEQ ID NO: 1231744 - RNA, 22 nt, Mycobacterium leprae
augcagucgcucaggcuaccga

SEQ ID NO: 1231745 - RNA, 15 nt, Mycobacterium leprae
aucgggcugcgguga

SEQ ID NO: 1231746 - RNA, 13 nt, Mycobacterium leprae
aucgggcccagca

SEQ ID NO: 1231747 - RNA, 22 nt, Mycobacterium leprae
aucgguuccgcaauuucggcgu

SEQ ID NO: 1231748 - RNA, 20 nt, Mycobacterium leprae
aucuccaccagccggccggg

SEQ ID NO: 1231749 - RNA, 20 nt, Mycobacterium leprae
aucgugcgugagaucaccag

SEQ ID NO: 1231750 - RNA, 23 nt, Mycobacterium leprae
aucgucggccggagagucgggcu

SEQ ID NO: 1231751 - RNA, 19 nt, Mycobacterium leprae
aucguguccacugcggcaa

SEQ ID NO: 1231752 - RNA, 18 nt, Mycobacterium leprae
aucuccgcaugagccggu

SEQ ID NO: 1231753 - RNA, 17 nt, Mycobacterium leprae
aucuggauggccgccag

SEQ ID NO: 1231754 - RNA, 15 nt, Mycobacterium leprae
aucugcuuguggcgg

SEQ ID NO: 1231755 - RNA, 13 nt, Mycobacterium leprae
augguuggucggc

SEQ ID NO: 1231756 - RNA, 17 nt, Mycobacterium leprae
augguuuuggccgcggu

SEQ ID NO: 1231757 - RNA, 16 nt, Mycobacterium leprae
augguccacccgcgcg

SEQ ID NO: 1231758 - RNA, 24 nt, Mycobacterium leprae
auggcgguguuagcaugcuuguca

SEQ ID NO: 1231759 - RNA, 20 nt, Mycobacterium leprae
auggauauucgauggcuggg

SEQ ID NO: 1231760 - RNA, 23 nt, Mycobacterium leprae
auggauacucaauugcagcgcga

SEQ ID NO: 1231761 - RNA, 15 nt, Mycobacterium leprae
auggaguuggugucu

SEQ ID NO: 1231762 - RNA, 15 nt, Mycobacterium leprae
auggcauugaucgcu

SEQ ID NO: 1231763 - RNA, 21 nt, Mycobacterium leprae
auggcauccaacacgccgauc

SEQ ID NO: 1231764 - RNA, 20 nt, Mycobacterium leprae
auggccgaccuaccgcaucc

SEQ ID NO: 1231765 - RNA, 20 nt, Mycobacterium leprae
auggccgaggagucggcaau

SEQ ID NO: 1231766 - RNA, 14 nt, Mycobacterium leprae
auggcagccaccau

SEQ ID NO: 1231767 - RNA, 17 nt, Mycobacterium leprae
augccgccgggugcagc

SEQ ID NO: 1231768 - RNA, 23 nt, Mycobacterium leprae
augccggauuccgaacgaccuug

SEQ ID NO: 1231769 - RNA, 15 nt, Mycobacterium leprae
augcgaacgaaucgc

SEQ ID NO: 1231770 - RNA, 18 nt, Mycobacterium leprae
augcggcggacgaucgag

SEQ ID NO: 1231771 - RNA, 20 nt, Mycobacterium leprae
augcggcgggaucgccgaug

SEQ ID NO: 1231772 - RNA, 22 nt, Mycobacterium leprae
augcggcgggaucgccgaugac

SEQ ID NO: 1231773 - RNA, 14 nt, Mycobacterium leprae
augcuaucgccggu

SEQ ID NO: 1231774 - RNA, 14 nt, Mycobacterium leprae
caaguuugagaaca

SEQ ID NO: 1231775 - RNA, 17 nt, Mycobacterium leprae
caagugugaaucccgcg

SEQ ID NO: 1231776 - RNA, 14 nt, Mycobacterium leprae
caaggggagcaggu

SEQ ID NO: 1231777 - RNA, 22 nt, Mycobacterium leprae
caagucggucgccgagcugauc

SEQ ID NO: 1231778 - RNA, 16 nt, Mycobacterium leprae
caaggucgagugcgag

SEQ ID NO: 1231779 - RNA, 22 nt, Mycobacterium leprae
caaggucgagugcgagccacuc

SEQ ID NO: 1231780 - RNA, 15 nt, Mycobacterium leprae
caagcgcgugaucuc

SEQ ID NO: 1231781 - RNA, 14 nt, Mycobacterium leprae
caagcgcgccgagu

SEQ ID NO: 1231782 - RNA, 14 nt, Mycobacterium leprae
caagcaacugcagc

SEQ ID NO: 1231783 - RNA, 16 nt, Mycobacterium leprae
caagauggcgucaccg

SEQ ID NO: 1231784 - RNA, 19 nt, Mycobacterium leprae
caagauccgguggucugcg

SEQ ID NO: 1231785 - RNA, 14 nt, Mycobacterium leprae
caagccaguguucc

SEQ ID NO: 1231786 - RNA, 19 nt, Mycobacterium leprae
caagcagucccaaggggag

SEQ ID NO: 1231787 - RNA, 19 nt, Mycobacterium leprae
caagccaugcaaccacacc

SEQ ID NO: 1231788 - RNA, 18 nt, Mycobacterium leprae
caagcccccucggcgauc

SEQ ID NO: 1231789 - RNA, 13 nt, Mycobacterium leprae
caagcacugcagu

SEQ ID NO: 1231790 - RNA, 14 nt, Mycobacterium leprae
caagcacuucgcga

SEQ ID NO: 1231791 - RNA, 19 nt, Mycobacterium leprae
caacuggaguacuggcggc

SEQ ID NO: 1231792 - RNA, 23 nt, Mycobacterium leprae
caauugucgugggucagucggaa

SEQ ID NO: 1231793 - RNA, 15 nt, Mycobacterium leprae
caaugucacugcgac

SEQ ID NO: 1231794 - RNA, 17 nt, Mycobacterium leprae
caaugucacaucgauuu

SEQ ID NO: 1231795 - RNA, 21 nt, Mycobacterium leprae
caauaccgaccgaaagccgca

SEQ ID NO: 1231796 - RNA, 15 nt, Mycobacterium leprae
caaugccggacuggc

SEQ ID NO: 1231797 - RNA, 21 nt, Mycobacterium leprae
cacagcaagcagaucgacagc

SEQ ID NO: 1231798 - RNA, 15 nt, Mycobacterium leprae
cacagcaagucgccu

SEQ ID NO: 1231799 - RNA, 22 nt, Mycobacterium leprae
cacagcaagucgccuacaccag

SEQ ID NO: 1231800 - RNA, 14 nt, Mycobacterium leprae
cacagcgccaacaa

SEQ ID NO: 1231801 - RNA, 18 nt, Mycobacterium leprae
cacacguucggaucauug

SEQ ID NO: 1231802 - RNA, 15 nt, Mycobacterium leprae
cacacucacgccugc

SEQ ID NO: 1231803 - RNA, 18 nt, Mycobacterium leprae
cacacucacgccugcauc

SEQ ID NO: 1231804 - RNA, 21 nt, Mycobacterium leprae
cacaccuggugugcgcgccgc

SEQ ID NO: 1231805 - RNA, 14 nt, Mycobacterium leprae
cacacggcgcgauc

SEQ ID NO: 1231806 - RNA, 14 nt, Mycobacterium leprae
cacacgagaccaug

SEQ ID NO: 1231807 - RNA, 21 nt, Mycobacterium leprae
caccacccaagauagcgcaga

SEQ ID NO: 1231808 - RNA, 18 nt, Mycobacterium leprae
caccaccgacaugcuuac

SEQ ID NO: 1231809 - RNA, 19 nt, Mycobacterium leprae
caccaccccuacccaaauc

SEQ ID NO: 1231810 - RNA, 13 nt, Mycobacterium leprae
caccaaucaggcc

SEQ ID NO: 1231811 - RNA, 20 nt, Mycobacterium leprae
caccaaucagaucacguugg

SEQ ID NO: 1231812 - RNA, 14 nt, Mycobacterium leprae
caccaauagccgac

SEQ ID NO: 1231813 - RNA, 15 nt, Mycobacterium leprae
caccaagcgcagaug

SEQ ID NO: 1231814 - RNA, 22 nt, Mycobacterium leprae
caccagauuggaaaucgcucga

SEQ ID NO: 1231815 - RNA, 12 nt, Mycobacterium leprae
caccaccgccac

SEQ ID NO: 1231816 - RNA, 13 nt, Mycobacterium leprae
caccagucgcgca

SEQ ID NO: 1231817 - RNA, 21 nt, Mycobacterium leprae
caccauccggcgggcgugcug

SEQ ID NO: 1231818 - RNA, 16 nt, Mycobacterium leprae
cacccaagauagcgca

SEQ ID NO: 1231819 - RNA, 15 nt, Mycobacterium leprae
cacccacaacgccaa

SEQ ID NO: 1231820 - RNA, 22 nt, Mycobacterium leprae
caccaucuuugacauccggugu

SEQ ID NO: 1231821 - RNA, 17 nt, Mycobacterium leprae
cacccaggucgguggau

SEQ ID NO: 1231822 - RNA, 17 nt, Mycobacterium leprae
caccuuggugcgggcac

SEQ ID NO: 1231823 - RNA, 17 nt, Mycobacterium leprae
cacgaucaccgcggcgu

SEQ ID NO: 1231824 - RNA, 22 nt, Mycobacterium leprae
cacgacggugcggcuggcucca

SEQ ID NO: 1231825 - RNA, 22 nt, Mycobacterium leprae
cacgcaaacgaauaacugccaa

SEQ ID NO: 1231826 - RNA, 14 nt, Mycobacterium leprae
cacgcacacgacag

SEQ ID NO: 1231827 - RNA, 19 nt, Mycobacterium leprae
cacgccgcggcugggcagc

SEQ ID NO: 1231828 - RNA, 22 nt, Mycobacterium leprae
cacgccgugcuuccauucgcga

SEQ ID NO: 1231829 - RNA, 16 nt, Mycobacterium leprae
cacgccgauaucgacc

SEQ ID NO: 1231830 - RNA, 16 nt, Mycobacterium leprae
cacgccgaacagccgc

SEQ ID NO: 1231831 - RNA, 12 nt, Mycobacterium leprae
caccgagcgacc

SEQ ID NO: 1231832 - RNA, 18 nt, Mycobacterium leprae
caccgcaggcgagcaccg

SEQ ID NO: 1231833 - RNA, 13 nt, Mycobacterium leprae
caccgcaaucgaa

SEQ ID NO: 1231834 - RNA, 23 nt, Mycobacterium leprae
caccgcggcguuauccacgccga

SEQ ID NO: 1231835 - RNA, 12 nt, Mycobacterium leprae
caccgcggaucg

SEQ ID NO: 1231836 - RNA, 23 nt, Mycobacterium leprae
caccucguucaagauacuggauu

SEQ ID NO: 1231837 - RNA, 20 nt, Mycobacterium leprae
caccugcauggacgauaucg

SEQ ID NO: 1231838 - RNA, 16 nt, Mycobacterium leprae
caccuccccgcccaag

SEQ ID NO: 1231839 - RNA, 22 nt, Mycobacterium leprae
caccuccccgcccaaggcucca

SEQ ID NO: 1231840 - RNA, 21 nt, Mycobacterium leprae
caccggcggugucggcuacca

SEQ ID NO: 1231841 - RNA, 22 nt, Mycobacterium leprae
caccguaagucagauggaacaa

SEQ ID NO: 1231842 - RNA, 22 nt, Mycobacterium leprae
aucccaccggcggcuggugcgg

SEQ ID NO: 1231843 - RNA, 14 nt, Mycobacterium leprae
auccaguagugcgg

SEQ ID NO: 1231844 - RNA, 15 nt, Mycobacterium leprae
aucccaucggcugca

SEQ ID NO: 1231845 - RNA, 17 nt, Mycobacterium leprae
aucccaucggcugcacc

SEQ ID NO: 1231846 - RNA, 18 nt, Mycobacterium leprae
aucccaucggcugcaccg

SEQ ID NO: 1231847 - RNA, 16 nt, Mycobacterium leprae
aucccgcgaucuacgc

SEQ ID NO: 1231848 - RNA, 22 nt, Mycobacterium leprae
aucauucacccuuucgggaggu

SEQ ID NO: 1231849 - RNA, 22 nt, Mycobacterium leprae
auccacgccgauaucgaccagc

SEQ ID NO: 1231850 - RNA, 16 nt, Mycobacterium leprae
auccagcccguugauc

SEQ ID NO: 1231851 - RNA, 24 nt, Mycobacterium leprae
auccugcguucgguagcgcgcuga

SEQ ID NO: 1231852 - RNA, 15 nt, Mycobacterium leprae
auccucgacccacca

SEQ ID NO: 1231853 - RNA, 14 nt, Mycobacterium leprae
auccgugaauacau

SEQ ID NO: 1231854 - RNA, 19 nt, Mycobacterium leprae
auccggcguuaaacgcgau

SEQ ID NO: 1231855 - RNA, 13 nt, Mycobacterium leprae
auccgggccaguc

SEQ ID NO: 1231856 - RNA, 21 nt, Mycobacterium leprae
auccgggcgcucagcggccag

SEQ ID NO: 1231857 - RNA, 21 nt, Mycobacterium leprae
auccgaguggguaaaaccggu

SEQ ID NO: 1231858 - RNA, 13 nt, Mycobacterium leprae
auccgcgcaucgu

SEQ ID NO: 1231859 - RNA, 21 nt, Mycobacterium leprae
auccgcuuacucugccgccuc

SEQ ID NO: 1231860 - RNA, 19 nt, Mycobacterium leprae
auccggaggcggccacgug

SEQ ID NO: 1231861 - RNA, 19 nt, Mycobacterium leprae
auccgcuacuuguguucgg

SEQ ID NO: 1231862 - RNA, 13 nt, Mycobacterium leprae
aucaucgcccacc

SEQ ID NO: 1231863 - RNA, 19 nt, Mycobacterium leprae
aucagcgucggacgccgga

SEQ ID NO: 1231864 - RNA, 18 nt, Mycobacterium leprae
aucagcggccccgcaucu

SEQ ID NO: 1231865 - RNA, 16 nt, Mycobacterium leprae
aucaccuagaacagca

SEQ ID NO: 1231866 - RNA, 19 nt, Mycobacterium leprae
aucaccuagaacagcaucg

SEQ ID NO: 1231867 - RNA, 14 nt, Mycobacterium leprae
aucaccggugcacc

SEQ ID NO: 1231868 - RNA, 18 nt, Mycobacterium leprae
aucagaagaccaggugau

SEQ ID NO: 1231869 - RNA, 17 nt, Mycobacterium leprae
aucagacagagccggca

SEQ ID NO: 1231870 - RNA, 18 nt, Mycobacterium leprae
aucacuugcugaccgacu

SEQ ID NO: 1231871 - RNA, 23 nt, Mycobacterium leprae
aucacggguggugcccaggugaa

SEQ ID NO: 1231872 - RNA, 18 nt, Mycobacterium leprae
aucaaccgugucggcccc

SEQ ID NO: 1231873 - RNA, 14 nt, Mycobacterium leprae
auauuuagcgacua

SEQ ID NO: 1231874 - RNA, 21 nt, Mycobacterium leprae
auacagccucucgacaaagaa

SEQ ID NO: 1231875 - RNA, 19 nt, Mycobacterium leprae
aguuguuaucgaggugagc

SEQ ID NO: 1231876 - RNA, 17 nt, Mycobacterium leprae
aguucacgcuggccgcc

SEQ ID NO: 1231877 - RNA, 17 nt, Mycobacterium leprae
aguucaauggugccgag

SEQ ID NO: 1231878 - RNA, 15 nt, Mycobacterium leprae
agugaucugcucggc

SEQ ID NO: 1231879 - RNA, 18 nt, Mycobacterium leprae
agugaucugcucggcgaa

SEQ ID NO: 1231880 - RNA, 16 nt, Mycobacterium leprae
agugccaaacgacaug

SEQ ID NO: 1231881 - RNA, 15 nt, Mycobacterium leprae
agugcaucgaugauc

SEQ ID NO: 1231882 - RNA, 17 nt, Mycobacterium leprae
agucgggccaggccgag

SEQ ID NO: 1231883 - RNA, 18 nt, Mycobacterium leprae
agucgguuacaucgucaa

SEQ ID NO: 1231884 - RNA, 15 nt, Mycobacterium leprae
agucggcgugcggau

SEQ ID NO: 1231885 - RNA, 12 nt, Mycobacterium leprae
agucggucgccg

SEQ ID NO: 1231886 - RNA, 18 nt, Mycobacterium leprae
aguguuuccacaccgacu

SEQ ID NO: 1231887 - RNA, 19 nt, Mycobacterium leprae
agugccguuggcccaccgc

SEQ ID NO: 1231888 - RNA, 21 nt, Mycobacterium leprae
agucgcgucuuugcuggucag

SEQ ID NO: 1231889 - RNA, 14 nt, Mycobacterium leprae
agucgauuagccgg

SEQ ID NO: 1231890 - RNA, 12 nt, Mycobacterium leprae
aguccggcgcca

SEQ ID NO: 1231891 - RNA, 18 nt, Mycobacterium leprae
agucgacgcagaccgggc

SEQ ID NO: 1231892 - RNA, 19 nt, Mycobacterium leprae
agucgaccggaccaucguc

SEQ ID NO: 1231893 - RNA, 11 nt, Mycobacterium leprae
agucgaccgga

SEQ ID NO: 1231894 - RNA, 14 nt, Mycobacterium leprae
agucgaccgccgaa

SEQ ID NO: 1231895 - RNA, 14 nt, Mycobacterium leprae
aguccaagcacgau

SEQ ID NO: 1231896 - RNA, 20 nt, Mycobacterium leprae
agucaugccccgcgcucugg

SEQ ID NO: 1231897 - RNA, 21 nt, Mycobacterium leprae
aguccagucgcgcaccgcgaa

SEQ ID NO: 1231898 - RNA, 15 nt, Mycobacterium leprae
aguaggcgaagagcg

SEQ ID NO: 1231899 - RNA, 21 nt, Mycobacterium leprae
agguucucggcguuccccggu

SEQ ID NO: 1231900 - RNA, 21 nt, Mycobacterium leprae
aguaccgaaaacacgggcacc

SEQ ID NO: 1231901 - RNA, 17 nt, Mycobacterium leprae
aguagcaagccgccagu

SEQ ID NO: 1231902 - RNA, 23 nt, Mycobacterium leprae
aguagcaagccgccagugcgcaa

SEQ ID NO: 1231903 - RNA, 18 nt, Mycobacterium leprae
aguacgaaaugaacguca

SEQ ID NO: 1231904 - RNA, 14 nt, Mycobacterium leprae
aggucgccgccgaa

SEQ ID NO: 1231905 - RNA, 15 nt, Mycobacterium leprae
aggucgccgccgaac

SEQ ID NO: 1231906 - RNA, 20 nt, Mycobacterium leprae
aggucguguugccaccgaca

SEQ ID NO: 1231907 - RNA, 17 nt, Mycobacterium leprae
aggucuacucgccugau

SEQ ID NO: 1231908 - RNA, 16 nt, Mycobacterium leprae
agguggcggcgacacg

SEQ ID NO: 1231909 - RNA, 16 nt, Mycobacterium leprae
agggcaauacgcugcc

SEQ ID NO: 1231910 - RNA, 19 nt, Mycobacterium leprae
agggcaucgccgugguggc

SEQ ID NO: 1231911 - RNA, 23 nt, Mycobacterium leprae
agggcggcauucccaaccgcgac

SEQ ID NO: 1231912 - RNA, 14 nt, Mycobacterium leprae
agcucgauggugcc

SEQ ID NO: 1231913 - RNA, 14 nt, Mycobacterium leprae
agcucgccaagguc

SEQ ID NO: 1231914 - RNA, 17 nt, Mycobacterium leprae
agcucgacgggcggcac

SEQ ID NO: 1231915 - RNA, 23 nt, Mycobacterium leprae
agcugccggugaccgggccggcc

SEQ ID NO: 1231916 - RNA, 18 nt, Mycobacterium leprae
agcugauuuggccgccau

SEQ ID NO: 1231917 - RNA, 13 nt, Mycobacterium leprae
agcgucgugaccg

SEQ ID NO: 1231918 - RNA, 16 nt, Mycobacterium leprae
agcgucaccaagcgca

SEQ ID NO: 1231919 - RNA, 14 nt, Mycobacterium leprae
agcgcugcgcagcg

SEQ ID NO: 1231920 - RNA, 14 nt, Mycobacterium leprae
agcuugaaguguug

SEQ ID NO: 1231921 - RNA, 19 nt, Mycobacterium leprae
agcuggugcuggcgucguu

SEQ ID NO: 1231922 - RNA, 15 nt, Mycobacterium leprae
agcugugagugugca

SEQ ID NO: 1231923 - RNA, 23 nt, Mycobacterium leprae
agcuguucggguuggucguggca

SEQ ID NO: 1231924 - RNA, 19 nt, Mycobacterium leprae
agcuggggcggccgccggc

SEQ ID NO: 1231925 - RNA, 18 nt, Mycobacterium leprae
agcuggcggaugcgggcu

SEQ ID NO: 1231926 - RNA, 17 nt, Mycobacterium leprae
aggaaugucucgguguc

SEQ ID NO: 1231927 - RNA, 20 nt, Mycobacterium leprae
aggaagcucgguucggugac

SEQ ID NO: 1231928 - RNA, 17 nt, Mycobacterium leprae
aggaguuuuucagcgga

SEQ ID NO: 1231929 - RNA, 12 nt, Mycobacterium leprae
aggauggcgacg

SEQ ID NO: 1231930 - RNA, 17 nt, Mycobacterium leprae
aggaugcgugcccauau

SEQ ID NO: 1231931 - RNA, 13 nt, Mycobacterium leprae
aggcaaccaagau

SEQ ID NO: 1231932 - RNA, 15 nt, Mycobacterium leprae
aggcacagcccagua

SEQ ID NO: 1231933 - RNA, 19 nt, Mycobacterium leprae
aggcacguccccgugcacg

SEQ ID NO: 1231934 - RNA, 19 nt, Mycobacterium leprae
aggccaccguuggacacca

SEQ ID NO: 1231935 - RNA, 17 nt, Mycobacterium leprae
agcauagcccaugccga

SEQ ID NO: 1231936 - RNA, 15 nt, Mycobacterium leprae
agcaguucggcugaa

SEQ ID NO: 1231937 - RNA, 20 nt, Mycobacterium leprae
agcaugcgccuccagcucgu

SEQ ID NO: 1231938 - RNA, 19 nt, Mycobacterium leprae
agccaucaccguggccggc

SEQ ID NO: 1231939 - RNA, 23 nt, Mycobacterium leprae
agccaucgaauauccaucuagcg

SEQ ID NO: 1231940 - RNA, 19 nt, Mycobacterium leprae
agcccgacgcaacugcugg

SEQ ID NO: 1231941 - RNA, 19 nt, Mycobacterium leprae
agcccgcugcugcgaccga

SEQ ID NO: 1231942 - RNA, 22 nt, Mycobacterium leprae
agcccgauuuggauggucggca

SEQ ID NO: 1231943 - RNA, 18 nt, Mycobacterium leprae
agccgccagacuggccgg

SEQ ID NO: 1231944 - RNA, 18 nt, Mycobacterium leprae
agccgaacuauccaagac

SEQ ID NO: 1231945 - RNA, 22 nt, Mycobacterium leprae
agcgaacacacaggucauccuu

SEQ ID NO: 1231946 - RNA, 17 nt, Mycobacterium leprae
agcgaaaaugaaaacaa

SEQ ID NO: 1231947 - RNA, 12 nt, Mycobacterium leprae
agccgugcagcc

SEQ ID NO: 1231948 - RNA, 14 nt, Mycobacterium leprae
agccuaugauggcg

SEQ ID NO: 1231949 - RNA, 22 nt, Mycobacterium leprae
agccgucuuggccaugggggcg

SEQ ID NO: 1231950 - RNA, 21 nt, Mycobacterium leprae
agccgcugcggguucguugau

SEQ ID NO: 1231951 - RNA, 23 nt, Mycobacterium leprae
agccgcgguaacggcgguggcag

SEQ ID NO: 1231952 - RNA, 18 nt, Mycobacterium leprae
agcgaugggugaaucgcu

SEQ ID NO: 1231953 - RNA, 22 nt, Mycobacterium leprae
agcgauugugcggaacaucgcg

SEQ ID NO: 1231954 - RNA, 21 nt, Mycobacterium leprae
agcgagaagccccauggcacg

SEQ ID NO: 1231955 - RNA, 21 nt, Mycobacterium leprae
agcgacuucgaugcgaugcgc

SEQ ID NO: 1231956 - RNA, 15 nt, Mycobacterium leprae
agcgagaaucccagu

SEQ ID NO: 1231957 - RNA, 19 nt, Mycobacterium leprae
agcgagaaucccaguguau

SEQ ID NO: 1231958 - RNA, 20 nt, Mycobacterium leprae
agcgaagaguuucugcugcc

SEQ ID NO: 1231959 - RNA, 15 nt, Mycobacterium leprae
agcgaccggccagug

SEQ ID NO: 1231960 - RNA, 11 nt, Mycobacterium leprae
agcgccgcggg

SEQ ID NO: 1231961 - RNA, 12 nt, Mycobacterium leprae
agcgccgcgggg

SEQ ID NO: 1231962 - RNA, 13 nt, Mycobacterium leprae
agcgcccgcacag

SEQ ID NO: 1231963 - RNA, 15 nt, Mycobacterium leprae
agcgcccgcacagca

SEQ ID NO: 1231964 - RNA, 21 nt, Mycobacterium leprae
agcgcagugugcuuucggcuc

SEQ ID NO: 1231965 - RNA, 17 nt, Mycobacterium leprae
agcgcagcaugguggcc

SEQ ID NO: 1231966 - RNA, 15 nt, Mycobacterium leprae
uuuugugaacauauc

SEQ ID NO: 1231967 - RNA, 22 nt, Mycobacterium leprae
uuuuguucuguccgcacaaacu

SEQ ID NO: 1231968 - RNA, 21 nt, Mycobacterium leprae
uuuuguuguuguugauuuuuu

SEQ ID NO: 1231969 - RNA, 23 nt, Mycobacterium leprae
uuuuggccgcggucgugcugcug

SEQ ID NO: 1231970 - RNA, 23 nt, Mycobacterium leprae
uuuuggcaguaccaaaguggauu

SEQ ID NO: 1231971 - RNA, 19 nt, Mycobacterium leprae
uuuugcuagauaucucgcc

SEQ ID NO: 1231972 - RNA, 15 nt, Mycobacterium leprae
uuuaccuucaggucu

SEQ ID NO: 1231973 - RNA, 16 nt, Mycobacterium leprae
uuuugcccaaugcagc

SEQ ID NO: 1231974 - RNA, 18 nt, Mycobacterium leprae
uuuugcccaaugcagcaa

SEQ ID NO: 1231975 - RNA, 13 nt, Mycobacterium leprae
uuuugcaggccag

SEQ ID NO: 1231976 - RNA, 22 nt, Mycobacterium leprae
ugaaccgcugugacagcgugcc

SEQ ID NO: 1231977 - RNA, 22 nt, Mycobacterium leprae
ugaaaaccguguagugcacaga

SEQ ID NO: 1231978 - RNA, 22 nt, Mycobacterium leprae
ugaaaguaggcacagcccagua

SEQ ID NO: 1231979 - RNA, 19 nt, Mycobacterium leprae
ugaaaccgggguacaauaa

SEQ ID NO: 1231980 - RNA, 23 nt, Mycobacterium leprae
ucuuuuuagagaagaauuaauau

SEQ ID NO: 1231981 - RNA, 20 nt, Mycobacterium leprae
ucuuggugagagcuccauuu

SEQ ID NO: 1231982 - RNA, 17 nt, Mycobacterium leprae
ucuuacccgagcugacu

SEQ ID NO: 1231983 - RNA, 11 nt, Mycobacterium leprae
ucugcacggca

SEQ ID NO: 1231984 - RNA, 16 nt, Mycobacterium leprae
ucugcacccgccaggg

SEQ ID NO: 1231985 - RNA, 17 nt, Mycobacterium leprae
ucuggugggcacccgca

SEQ ID NO: 1231986 - RNA, 15 nt, Mycobacterium leprae
ucugguugcacggca

SEQ ID NO: 1231987 - RNA, 15 nt, Mycobacterium leprae
ucuggcuagccgcug

SEQ ID NO: 1231988 - RNA, 13 nt, Mycobacterium leprae
ucuguccgcacaa

SEQ ID NO: 1231989 - RNA, 19 nt, Mycobacterium leprae
ucuccacuauucggguaga

SEQ ID NO: 1231990 - RNA, 23 nt, Mycobacterium leprae
ucucauuguggcuggcuuccucu

SEQ ID NO: 1231991 - RNA, 15 nt, Mycobacterium leprae
ucucauucucugccu

SEQ ID NO: 1231992 - RNA, 16 nt, Mycobacterium leprae
ucuccagucgcauccu

SEQ ID NO: 1231993 - RNA, 13 nt, Mycobacterium leprae
ucucccgccacuc

SEQ ID NO: 1231994 - RNA, 23 nt, Mycobacterium leprae
ucuccgcaacgggacaagucaaa

SEQ ID NO: 1231995 - RNA, 22 nt, Mycobacterium leprae
ucucgacgacguuaucuugaug

SEQ ID NO: 1231996 - RNA, 18 nt, Mycobacterium leprae
ucucgugguggcuggcua

SEQ ID NO: 1231997 - RNA, 13 nt, Mycobacterium leprae
ucucuaaaaagau

SEQ ID NO: 1231998 - RNA, 13 nt, Mycobacterium leprae
ucucuaaaagaau

SEQ ID NO: 1231999 - RNA, 17 nt, Mycobacterium leprae
ucucucaggccgucguu

SEQ ID NO: 1232000 - RNA, 16 nt, Mycobacterium leprae
ucugaucuucuuucac

SEQ ID NO: 1232001 - RNA, 22 nt, Mycobacterium leprae
ucugacguuguuuuuguuggcc

SEQ ID NO: 1232002 - RNA, 20 nt, Mycobacterium leprae
ucugagagugcagagaguug

SEQ ID NO: 1232003 - RNA, 17 nt, Mycobacterium leprae
ucugaaggcaaaauccu

SEQ ID NO: 1232004 - RNA, 14 nt, Mycobacterium leprae
ucuacauccaccca

SEQ ID NO: 1232005 - RNA, 17 nt, Mycobacterium leprae
ucgugagaaucgguguu

SEQ ID NO: 1232006 - RNA, 21 nt, Mycobacterium leprae
ucgugaaucaugccgcagcau

SEQ ID NO: 1232007 - RNA, 14 nt, Mycobacterium leprae
ucguucaguuuggu

SEQ ID NO: 1232008 - RNA, 18 nt, Mycobacterium leprae
ucguucaagauacuggau

SEQ ID NO: 1232009 - RNA, 22 nt, Mycobacterium leprae
ucguugucggcuccuccagcau

SEQ ID NO: 1232010 - RNA, 20 nt, Mycobacterium leprae
ucguuguuugucagauaacg

SEQ ID NO: 1232011 - RNA, 15 nt, Mycobacterium leprae
ucgucgucagcugcu

SEQ ID NO: 1232012 - RNA, 15 nt, Mycobacterium leprae
ucgucggaagcugcc

SEQ ID NO: 1232013 - RNA, 21 nt, Mycobacterium leprae
ucguaccgcgcaaaaaguauu

SEQ ID NO: 1232014 - RNA, 20 nt, Mycobacterium leprae
ucguacaacguguuuaggaa

SEQ ID NO: 1232015 - RNA, 23 nt, Mycobacterium leprae
ucggguuuuagauugacaccgcc

SEQ ID NO: 1232016 - RNA, 15 nt, Mycobacterium leprae
ucgguaccagcggca

SEQ ID NO: 1232017 - RNA, 23 nt, Mycobacterium leprae
ucgguaaugcaagcgcuuuuccu

SEQ ID NO: 1232018 - RNA, 17 nt, Mycobacterium leprae
ucgguaggcuguuguca

SEQ ID NO: 1232019 - RNA, 22 nt, Mycobacterium leprae
ucggucaccccgagcucggccu

SEQ ID NO: 1232020 - RNA, 19 nt, Mycobacterium leprae
ucgguccuugaccucaucc

SEQ ID NO: 1232021 - RNA, 22 nt, Mycobacterium leprae
ucggucggcaugugcauccagu

SEQ ID NO: 1232022 - RNA, 17 nt, Mycobacterium leprae
ucgguggcagccggcug

SEQ ID NO: 1232023 - RNA, 20 nt, Mycobacterium leprae
ucgggugcucacaggcagca

SEQ ID NO: 1232024 - RNA, 22 nt, Mycobacterium leprae
ucgggagaggaucagcgcugcu

SEQ ID NO: 1232025 - RNA, 17 nt, Mycobacterium leprae
ucggcugaaccgcugug

SEQ ID NO: 1232026 - RNA, 17 nt, Mycobacterium leprae
ucggcguugagcgcagc

SEQ ID NO: 1232027 - RNA, 16 nt, Mycobacterium leprae
ucggcugucgcggaau

SEQ ID NO: 1232028 - RNA, 14 nt, Mycobacterium leprae
ucggcgguucacau

SEQ ID NO: 1232029 - RNA, 14 nt, Mycobacterium leprae
ucggcggcuuguuu

SEQ ID NO: 1232030 - RNA, 21 nt, Mycobacterium leprae
ucggcggcuuguuuguugcca

SEQ ID NO: 1232031 - RNA, 23 nt, Mycobacterium leprae
ucggcgucgugaucggcauggcg

SEQ ID NO: 1232032 - RNA, 21 nt, Mycobacterium leprae
ucggcguacguaugccgccaa

SEQ ID NO: 1232033 - RNA, 20 nt, Mycobacterium leprae
ucggcgauauccgccggccg

SEQ ID NO: 1232034 - RNA, 19 nt, Mycobacterium leprae
ucggcggcgccgaucccau

SEQ ID NO: 1232035 - RNA, 20 nt, Mycobacterium leprae
ucggaucguuugaggaagaa

SEQ ID NO: 1232036 - RNA, 15 nt, Mycobacterium leprae
ucgcuuuccgcgccc

SEQ ID NO: 1232037 - RNA, 18 nt, Mycobacterium leprae
ucgcuuggugcugcugcu

SEQ ID NO: 1232038 - RNA, 18 nt, Mycobacterium leprae
ucgcuggcucugucgucg

SEQ ID NO: 1232039 - RNA, 20 nt, Mycobacterium leprae
ucggccaccggccguuuggu

SEQ ID NO: 1232040 - RNA, 14 nt, Mycobacterium leprae
ucggcccacgagaa

SEQ ID NO: 1232041 - RNA, 15 nt, Mycobacterium leprae
ucggccaggugugcc

SEQ ID NO: 1232042 - RNA, 12 nt, Mycobacterium leprae
ucggcccaggga

SEQ ID NO: 1232043 - RNA, 18 nt, Mycobacterium leprae
ucggccgaugauggugcc

SEQ ID NO: 1232044 - RNA, 16 nt, Mycobacterium leprae
ucgcccuguguucggu

SEQ ID NO: 1232045 - RNA, 21 nt, Mycobacterium leprae
ucgccgcgccacuguagagcu

SEQ ID NO: 1232046 - RNA, 20 nt, Mycobacterium leprae
ucgccaugaacugacuucag

SEQ ID NO: 1232047 - RNA, 21 nt, Mycobacterium leprae
ucgcccucuuugaucagcaag

SEQ ID NO: 1232048 - RNA, 22 nt, Mycobacterium leprae
ucgcccucuuugaucagcaagg

SEQ ID NO: 1232049 - RNA, 19 nt, Mycobacterium leprae
ucgcccgagucucuggugc

SEQ ID NO: 1232050 - RNA, 22 nt, Mycobacterium leprae
ucgcccgcuuaaccaucagaaa

SEQ ID NO: 1232051 - RNA, 14 nt, Mycobacterium leprae
ucgcagacacagcc

SEQ ID NO: 1232052 - RNA, 17 nt, Mycobacterium leprae
ucgcacaaauguucaac

SEQ ID NO: 1232053 - RNA, 19 nt, Mycobacterium leprae
ucgcaccgauauccggccu

SEQ ID NO: 1232054 - RNA, 18 nt, Mycobacterium leprae
ucgaucuggacaaagucu

SEQ ID NO: 1232055 - RNA, 17 nt, Mycobacterium leprae
ucgauuugaaaaaugcc

SEQ ID NO: 1232056 - RNA, 21 nt, Mycobacterium leprae
ucgagugcagcuaauuuucca

SEQ ID NO: 1232057 - RNA, 17 nt, Mycobacterium leprae
ucgaguccaagcucaac

SEQ ID NO: 1232058 - RNA, 18 nt, Mycobacterium leprae
ucgacgcagcaacuguuu

SEQ ID NO: 1232059 - RNA, 21 nt, Mycobacterium leprae
ucgacgcagcaacuguuuggu

SEQ ID NO: 1232060 - RNA, 23 nt, Mycobacterium leprae
ucgacgcgagaaaaucagaugua

SEQ ID NO: 1232061 - RNA, 14 nt, Mycobacterium leprae
ucgagcuggcugug

SEQ ID NO: 1232062 - RNA, 17 nt, Mycobacterium leprae
ucgacggagcgcaggaa

SEQ ID NO: 1232063 - RNA, 15 nt, Mycobacterium leprae
ucgaggccagccugc

SEQ ID NO: 1232064 - RNA, 13 nt, Mycobacterium leprae
ucgaaaaaucaga

SEQ ID NO: 1232065 - RNA, 12 nt, Mycobacterium leprae
ucgaaaaaugcc

SEQ ID NO: 1232066 - RNA, 15 nt, Mycobacterium leprae
ucgaauauccaucua

SEQ ID NO: 1232067 - RNA, 18 nt, Mycobacterium leprae
ucgaccuauuucggcaaa

SEQ ID NO: 1232068 - RNA, 19 nt, Mycobacterium leprae
ucgacgaugugcagcagcu

SEQ ID NO: 1232069 - RNA, 14 nt, Mycobacterium leprae
ucgacccuugcuug

SEQ ID NO: 1232070 - RNA, 17 nt, Mycobacterium leprae
ucgacccggugguguuc

SEQ ID NO: 1232071 - RNA, 17 nt, Mycobacterium leprae
ucgaccgccgaagcagc

SEQ ID NO: 1232072 - RNA, 15 nt, Mycobacterium leprae
ucgaaauguaacugu

SEQ ID NO: 1232073 - RNA, 19 nt, Mycobacterium leprae
ucgaauaccuuuucaacag

SEQ ID NO: 1232074 - RNA, 13 nt, Mycobacterium leprae
ucgaagggcuggu

SEQ ID NO: 1232075 - RNA, 14 nt, Mycobacterium leprae
uccugcuguaauau

SEQ ID NO: 1232076 - RNA, 22 nt, Mycobacterium leprae
uccugcguucgguagcgcgcug

SEQ ID NO: 1232077 - RNA, 20 nt, Mycobacterium leprae
uccugcagguugcugucgug

SEQ ID NO: 1232078 - RNA, 13 nt, Mycobacterium leprae
uccugcagcgcgg

SEQ ID NO: 1232079 - RNA, 22 nt, Mycobacterium leprae
uccuuggaaccaucaacggcua

SEQ ID NO: 1232080 - RNA, 19 nt, Mycobacterium leprae
uccuucaaaaagguguuca

SEQ ID NO: 1232081 - RNA, 15 nt, Mycobacterium leprae
uccuucauguccuac

SEQ ID NO: 1232082 - RNA, 16 nt, Mycobacterium leprae
uccuucauguccuaca

SEQ ID NO: 1232083 - RNA, 23 nt, Mycobacterium leprae
ugaauguccauauagcgucccag

SEQ ID NO: 1232084 - RNA, 23 nt, Mycobacterium leprae
ugaaugggccgaucgcaggagua

SEQ ID NO: 1232085 - RNA, 18 nt, Mycobacterium leprae
ugaauccccgauccagac

SEQ ID NO: 1232086 - RNA, 13 nt, Mycobacterium leprae
ugaaucagucugc

SEQ ID NO: 1232087 - RNA, 21 nt, Mycobacterium leprae
ugaauagcuaaagugcugcug

SEQ ID NO: 1232088 - RNA, 20 nt, Mycobacterium leprae
ugaagcggauaguaugccuc

SEQ ID NO: 1232089 - RNA, 21 nt, Mycobacterium leprae
ugaacuugauuucaaggaauu

SEQ ID NO: 1232090 - RNA, 17 nt, Mycobacterium leprae
ugaacuggaucggucag

SEQ ID NO: 1232091 - RNA, 16 nt, Mycobacterium leprae
ugaacguuuuuucccg

SEQ ID NO: 1232092 - RNA, 13 nt, Mycobacterium leprae
ugacggcuggauc

SEQ ID NO: 1232093 - RNA, 20 nt, Mycobacterium leprae
ugacggcggcagcuggaaag

SEQ ID NO: 1232094 - RNA, 17 nt, Mycobacterium leprae
ugacgcgacgccggccg

SEQ ID NO: 1232095 - RNA, 14 nt, Mycobacterium leprae
ugacgcccuccugg

SEQ ID NO: 1232096 - RNA, 14 nt, Mycobacterium leprae
ugacgcaugacacc

SEQ ID NO: 1232097 - RNA, 23 nt, Mycobacterium leprae
ugacgccaauuuagcaaugccac

SEQ ID NO: 1232098 - RNA, 20 nt, Mycobacterium leprae
ugaccgcggugcagugccgc

SEQ ID NO: 1232099 - RNA, 16 nt, Mycobacterium leprae
ugaccgcggauuccag

SEQ ID NO: 1232100 - RNA, 19 nt, Mycobacterium leprae
ugaccgcggucggcaucug

SEQ ID NO: 1232101 - RNA, 14 nt, Mycobacterium leprae
ugaccgccugugcu

SEQ ID NO: 1232102 - RNA, 14 nt, Mycobacterium leprae
ugacgaaaauguuu

SEQ ID NO: 1232103 - RNA, 22 nt, Mycobacterium leprae
ugacgaaauucggcggccacua

SEQ ID NO: 1232104 - RNA, 15 nt, Mycobacterium leprae
ugacaucagucagca

SEQ ID NO: 1232105 - RNA, 14 nt, Mycobacterium leprae
ugacacaaagaagu

SEQ ID NO: 1232106 - RNA, 16 nt, Mycobacterium leprae
ugacauauuugggagc

SEQ ID NO: 1232107 - RNA, 17 nt, Mycobacterium leprae
ugacauuuucaccgaac

SEQ ID NO: 1232108 - RNA, 17 nt, Mycobacterium leprae
ugaccagggaagugacg

SEQ ID NO: 1232109 - RNA, 23 nt, Mycobacterium leprae
ugaccagacaaauugacaacguu

SEQ ID NO: 1232110 - RNA, 19 nt, Mycobacterium leprae
ugaccgcaccgaucugccc

SEQ ID NO: 1232111 - RNA, 22 nt, Mycobacterium leprae
ugaccgcaccgaucugcccagc

SEQ ID NO: 1232112 - RNA, 22 nt, Mycobacterium leprae
ugaccgacggcgccgcacagcg

SEQ ID NO: 1232113 - RNA, 19 nt, Mycobacterium leprae
ugaccgacucaccgguaca

SEQ ID NO: 1232114 - RNA, 19 nt, Mycobacterium leprae
ugaccgaaccgaugauggc

SEQ ID NO: 1232115 - RNA, 21 nt, Mycobacterium leprae
ugagaggcggucggcggcuug

SEQ ID NO: 1232116 - RNA, 15 nt, Mycobacterium leprae
ugagcaauuucuucu

SEQ ID NO: 1232117 - RNA, 20 nt, Mycobacterium leprae
ugagacaucgucgcaagcuu

SEQ ID NO: 1232118 - RNA, 15 nt, Mycobacterium leprae
ugagacauuucauua

SEQ ID NO: 1232119 - RNA, 19 nt, Mycobacterium leprae
ugagacauuucgacaggcu

SEQ ID NO: 1232120 - RNA, 15 nt, Mycobacterium leprae
ugacuaguccggaaa

SEQ ID NO: 1232121 - RNA, 17 nt, Mycobacterium leprae
ugacguguuuugcugug

SEQ ID NO: 1232122 - RNA, 20 nt, Mycobacterium leprae
ugacguguuuugcuguguug

SEQ ID NO: 1232123 - RNA, 16 nt, Mycobacterium leprae
ugcaaauggcacugau

SEQ ID NO: 1232124 - RNA, 21 nt, Mycobacterium leprae
ugcaaccacacccuggcuggg

SEQ ID NO: 1232125 - RNA, 18 nt, Mycobacterium leprae
ugcaaccuccguuguccc

SEQ ID NO: 1232126 - RNA, 20 nt, Mycobacterium leprae
ugcaacgcugcaaggugggc

SEQ ID NO: 1232127 - RNA, 21 nt, Mycobacterium leprae
ugcaauaccuaucgacauccu

SEQ ID NO: 1232128 - RNA, 17 nt, Mycobacterium leprae
ugcaccgucuuugcuaa

SEQ ID NO: 1232129 - RNA, 19 nt, Mycobacterium leprae
ugcaccgucuuugcuaaca

SEQ ID NO: 1232130 - RNA, 19 nt, Mycobacterium leprae
ugcacuaacgugcagcugg

SEQ ID NO: 1232131 - RNA, 15 nt, Mycobacterium leprae
ugcacggcaaaguca

SEQ ID NO: 1232132 - RNA, 19 nt, Mycobacterium leprae
ugcaccgacggugcugaug

SEQ ID NO: 1232133 - RNA, 22 nt, Mycobacterium leprae
ugauucugguucagccauucua

SEQ ID NO: 1232134 - RNA, 18 nt, Mycobacterium leprae
ugauuggcugagaccggu

SEQ ID NO: 1232135 - RNA, 20 nt, Mycobacterium leprae
ugaugaugccaggggcuggg

SEQ ID NO: 1232136 - RNA, 21 nt, Mycobacterium leprae
ugauagugguucgauucugcc

SEQ ID NO: 1232137 - RNA, 15 nt, Mycobacterium leprae
ugauagauggagcca

SEQ ID NO: 1232138 - RNA, 14 nt, Mycobacterium leprae
ugauaauuuggcug

SEQ ID NO: 1232139 - RNA, 13 nt, Mycobacterium leprae
ugauaacuaggcu

SEQ ID NO: 1232140 - RNA, 23 nt, Mycobacterium leprae
ugaguucgcaagcaaauuuuuug

SEQ ID NO: 1232141 - RNA, 14 nt, Mycobacterium leprae
ugaguuguucgguu

SEQ ID NO: 1232142 - RNA, 13 nt, Mycobacterium leprae
ugagucuucgauc

SEQ ID NO: 1232143 - RNA, 21 nt, Mycobacterium leprae
ugcuuagcauagcggccgcca

SEQ ID NO: 1232144 - RNA, 15 nt, Mycobacterium leprae
ugcugugucgguugc

SEQ ID NO: 1232145 - RNA, 13 nt, Mycobacterium leprae
ugcuguguggcug

SEQ ID NO: 1232146 - RNA, 15 nt, Mycobacterium leprae
ugcuguguugcgggg

SEQ ID NO: 1232147 - RNA, 20 nt, Mycobacterium leprae
ugcuguuguaagcacugcac

SEQ ID NO: 1232148 - RNA, 21 nt, Mycobacterium leprae
ugcuuacgcagcgaguguccg

SEQ ID NO: 1232149 - RNA, 22 nt, Mycobacterium leprae
ugcugcugguggugacucugug

SEQ ID NO: 1232150 - RNA, 23 nt, Mycobacterium leprae
ugcugggacauccgcugauuggc

SEQ ID NO: 1232151 - RNA, 15 nt, Mycobacterium leprae
ugcuccgcagcaccu

SEQ ID NO: 1232152 - RNA, 20 nt, Mycobacterium leprae
ugcguuguagaccaugagca

SEQ ID NO: 1232153 - RNA, 20 nt, Mycobacterium leprae
ugcguugucgucggccgcgg

SEQ ID NO: 1232154 - RNA, 16 nt, Mycobacterium leprae
ugcguuguugauggug

SEQ ID NO: 1232155 - RNA, 22 nt, Mycobacterium leprae
ugcugaggguggcgccggcgug

SEQ ID NO: 1232156 - RNA, 20 nt, Mycobacterium leprae
ugcugcaucgguaaccauaa

SEQ ID NO: 1232157 - RNA, 23 nt, Mycobacterium leprae
ugcugcauccgacaaagcagcau

SEQ ID NO: 1232158 - RNA, 20 nt, Mycobacterium leprae
ugcugcaguuaauccgccgu

SEQ ID NO: 1232159 - RNA, 13 nt, Mycobacterium leprae
ugcugcacugugc

SEQ ID NO: 1232160 - RNA, 13 nt, Mycobacterium leprae
ugcugccacaugu

SEQ ID NO: 1232161 - RNA, 15 nt, Mycobacterium leprae
ugcugcagccacgaa

SEQ ID NO: 1232162 - RNA, 15 nt, Mycobacterium leprae
ugcgugccccggccg

SEQ ID NO: 1232163 - RNA, 18 nt, Mycobacterium leprae
ugcgugccccggccgccg

SEQ ID NO: 1232164 - RNA, 18 nt, Mycobacterium leprae
ugcgugagaucaccagca

SEQ ID NO: 1232165 - RNA, 13 nt, Mycobacterium leprae
ugcggucaucagg

SEQ ID NO: 1232166 - RNA, 21 nt, Mycobacterium leprae
ugcggggggccuuaucccacc

SEQ ID NO: 1232167 - RNA, 14 nt, Mycobacterium leprae
ugcggcgcccagca

SEQ ID NO: 1232168 - RNA, 15 nt, Mycobacterium leprae
ugcggcgccccucug

SEQ ID NO: 1232169 - RNA, 20 nt, Mycobacterium leprae
ugcggcgagcuuacgcgcgu

SEQ ID NO: 1232170 - RNA, 22 nt, Mycobacterium leprae
ugcggcagggcguugccguccc

SEQ ID NO: 1232171 - RNA, 15 nt, Mycobacterium leprae
ugcggagcaugacag

SEQ ID NO: 1232172 - RNA, 17 nt, Mycobacterium leprae
ugcgcucacccaagggc

SEQ ID NO: 1232173 - RNA, 14 nt, Mycobacterium leprae
ugcgcgcacccaag

SEQ ID NO: 1232174 - RNA, 16 nt, Mycobacterium leprae
ugcgcgccgcccagca

SEQ ID NO: 1232175 - RNA, 19 nt, Mycobacterium leprae
ugcgcgccgcccagcaguu

SEQ ID NO: 1232176 - RNA, 13 nt, Mycobacterium leprae
ugcgcguccaggg

SEQ ID NO: 1232177 - RNA, 19 nt, Mycobacterium leprae
ugcgccuugcaagccacau

SEQ ID NO: 1232178 - RNA, 15 nt, Mycobacterium leprae
ugcgccuccagcucg

SEQ ID NO: 1232179 - RNA, 16 nt, Mycobacterium leprae
ugccuugacuucuugu

SEQ ID NO: 1232180 - RNA, 13 nt, Mycobacterium leprae
ugccuguccggag

SEQ ID NO: 1232181 - RNA, 11 nt, Mycobacterium leprae
ugccuggccuc

SEQ ID NO: 1232182 - RNA, 17 nt, Mycobacterium leprae
ugccucuguucaggccg

SEQ ID NO: 1232183 - RNA, 22 nt, Mycobacterium leprae
ugccucgucguuguuugaugug

SEQ ID NO: 1232184 - RNA, 15 nt, Mycobacterium leprae
ugccgguagccugga

SEQ ID NO: 1232185 - RNA, 13 nt, Mycobacterium leprae
ugccgggucagag

SEQ ID NO: 1232186 - RNA, 21 nt, Mycobacterium leprae
ugccggugauuucggcggcuu

SEQ ID NO: 1232187 - RNA, 20 nt, Mycobacterium leprae
ugccgcuccgcgcacagugu

SEQ ID NO: 1232188 - RNA, 13 nt, Mycobacterium leprae
ugccggaaccauc

SEQ ID NO: 1232189 - RNA, 23 nt, Mycobacterium leprae
ugcccgacgaggcggugaccgaa

SEQ ID NO: 1232190 - RNA, 14 nt, Mycobacterium leprae
ugcccgacagccac

SEQ ID NO: 1232191 - RNA, 13 nt, Mycobacterium leprae
ugcccgcgggggu

SEQ ID NO: 1232192 - RNA, 13 nt, Mycobacterium leprae
ugccgauauaccu

SEQ ID NO: 1232193 - RNA, 16 nt, Mycobacterium leprae
ugccgagcuggccggg

SEQ ID NO: 1232194 - RNA, 21 nt, Mycobacterium leprae
ugccgagcugguaggugacgc

SEQ ID NO: 1232195 - RNA, 13 nt, Mycobacterium leprae
ugccgagccugga

SEQ ID NO: 1232196 - RNA, 13 nt, Mycobacterium leprae
ugccgcaggcacc

SEQ ID NO: 1232197 - RNA, 19 nt, Mycobacterium leprae
ugccgccgggugcagcagu

SEQ ID NO: 1232198 - RNA, 11 nt, Mycobacterium leprae
ugccgccgaag

SEQ ID NO: 1232199 - RNA, 15 nt, Mycobacterium leprae
ugccauccaccgccg

SEQ ID NO: 1232200 - RNA, 19 nt, Mycobacterium leprae
ugccauccucgaugguguc

SEQ ID NO: 1232201 - RNA, 15 nt, Mycobacterium leprae
ugccaucgggccaga

SEQ ID NO: 1232202 - RNA, 19 nt, Mycobacterium leprae
ugccagaauuuucagcggu

SEQ ID NO: 1232203 - RNA, 13 nt, Mycobacterium leprae
ugccaccgcugac

SEQ ID NO: 1232204 - RNA, 18 nt, Mycobacterium leprae
ugccaccgacaaagcuca

SEQ ID NO: 1232205 - RNA, 13 nt, Mycobacterium leprae
ugccacgguggcc

SEQ ID NO: 1232206 - RNA, 14 nt, Mycobacterium leprae
ugccacgguggccu

SEQ ID NO: 1232207 - RNA, 16 nt, Mycobacterium leprae
ugcauucugacuuugc

SEQ ID NO: 1232208 - RNA, 19 nt, Mycobacterium leprae
ugcauucgaaaaucgccua

SEQ ID NO: 1232209 - RNA, 17 nt, Mycobacterium leprae
ugcauauauuuguaugc

SEQ ID NO: 1232210 - RNA, 15 nt, Mycobacterium leprae
ugcagugagcagugg

SEQ ID NO: 1232211 - RNA, 20 nt, Mycobacterium leprae
ugcagugucgcuguucggcg

SEQ ID NO: 1232212 - RNA, 23 nt, Mycobacterium leprae
ugcacuaugucgaucggcagugg

SEQ ID NO: 1232213 - RNA, 20 nt, Mycobacterium leprae
ugcaugcaccgacggugcug

SEQ ID NO: 1232214 - RNA, 17 nt, Mycobacterium leprae
uuauggaccugaugaca

SEQ ID NO: 1232215 - RNA, 23 nt, Mycobacterium leprae
uuauguuauuuauagaugccagu

SEQ ID NO: 1232216 - RNA, 20 nt, Mycobacterium leprae
uuaucgaucucgcauauuca

SEQ ID NO: 1232217 - RNA, 14 nt, Mycobacterium leprae
uuauccccacaugu

SEQ ID NO: 1232218 - RNA, 20 nt, Mycobacterium leprae
uuagagaagaauuaauauau

SEQ ID NO: 1232219 - RNA, 14 nt, Mycobacterium leprae
uuauucuuuuagag

SEQ ID NO: 1232220 - RNA, 20 nt, Mycobacterium leprae
uuauuuggcgcacaaaaauc

SEQ ID NO: 1232221 - RNA, 15 nt, Mycobacterium leprae
uuauuuauauucaau

SEQ ID NO: 1232222 - RNA, 15 nt, Mycobacterium leprae
uucaagacugcaccc

SEQ ID NO: 1232223 - RNA, 12 nt, Mycobacterium leprae
uuaaaccuuaca

SEQ ID NO: 1232224 - RNA, 17 nt, Mycobacterium leprae
uuaaacaguuaaaggua

SEQ ID NO: 1232225 - RNA, 15 nt, Mycobacterium leprae
uuaaaggccggcaag

SEQ ID NO: 1232226 - RNA, 20 nt, Mycobacterium leprae
uuaacgaguugacccacaag

SEQ ID NO: 1232227 - RNA, 22 nt, Mycobacterium leprae
uuacggcuuugcaaagcagaau

SEQ ID NO: 1232228 - RNA, 13 nt, Mycobacterium leprae
uguucaacaacaa

SEQ ID NO: 1232229 - RNA, 14 nt, Mycobacterium leprae
uguuagugcugcug

SEQ ID NO: 1232230 - RNA, 13 nt, Mycobacterium leprae
uguguugaacagu

SEQ ID NO: 1232231 - RNA, 18 nt, Mycobacterium leprae
uguucugggaacugccgg

SEQ ID NO: 1232232 - RNA, 16 nt, Mycobacterium leprae
uguucauugaugaaug

SEQ ID NO: 1232233 - RNA, 19 nt, Mycobacterium leprae
uguucuuaggcacuggcca

SEQ ID NO: 1232234 - RNA, 18 nt, Mycobacterium leprae
uguggcacccacucggcg

SEQ ID NO: 1232235 - RNA, 20 nt, Mycobacterium leprae
uguggcacccacucggcggu

SEQ ID NO: 1232236 - RNA, 12 nt, Mycobacterium leprae
uguggagccugc

SEQ ID NO: 1232237 - RNA, 20 nt, Mycobacterium leprae
ugugccacgucgaucagcgg

SEQ ID NO: 1232238 - RNA, 20 nt, Mycobacterium leprae
ugugcugggcggauguguca

SEQ ID NO: 1232239 - RNA, 18 nt, Mycobacterium leprae
ugugccgcugcauccgca

SEQ ID NO: 1232240 - RNA, 18 nt, Mycobacterium leprae
ugugccgcugaccagucu

SEQ ID NO: 1232241 - RNA, 21 nt, Mycobacterium leprae
ugugcucggucaguccgauug

SEQ ID NO: 1232242 - RNA, 15 nt, Mycobacterium leprae
ugucugucagcacau

SEQ ID NO: 1232243 - RNA, 16 nt, Mycobacterium leprae
ugucugucggcuaaaa

SEQ ID NO: 1232244 - RNA, 11 nt, Mycobacterium leprae
ugucugggauc

SEQ ID NO: 1232245 - RNA, 22 nt, Mycobacterium leprae
ugugaaaaagcacacgagacca

SEQ ID NO: 1232246 - RNA, 12 nt, Mycobacterium leprae
ugugauccucau

SEQ ID NO: 1232247 - RNA, 23 nt, Mycobacterium leprae
ugugaucgagaagggagugcagu

SEQ ID NO: 1232248 - RNA, 16 nt, Mycobacterium leprae
ugugaacgacaccacc

SEQ ID NO: 1232249 - RNA, 20 nt, Mycobacterium leprae
ugugagugugcaggcagcga

SEQ ID NO: 1232250 - RNA, 15 nt, Mycobacterium leprae
ugucguuguccagca

SEQ ID NO: 1232251 - RNA, 12 nt, Mycobacterium leprae
ugucguggcugc

SEQ ID NO: 1232252 - RNA, 18 nt, Mycobacterium leprae
ugucggguggucagcagu

SEQ ID NO: 1232253 - RNA, 13 nt, Mycobacterium leprae
ugucgguggugga

SEQ ID NO: 1232254 - RNA, 13 nt, Mycobacterium leprae
ugucggugguggg

SEQ ID NO: 1232255 - RNA, 13 nt, Mycobacterium leprae
ugucgguaggcug

SEQ ID NO: 1232256 - RNA, 15 nt, Mycobacterium leprae
ugucggccaccggcc

SEQ ID NO: 1232257 - RNA, 16 nt, Mycobacterium leprae
ugucggccaccggccg

SEQ ID NO: 1232258 - RNA, 19 nt, Mycobacterium leprae
ugucggcggcuuguugacc

SEQ ID NO: 1232259 - RNA, 22 nt, Mycobacterium leprae
ugucgacguuccggccuucguc

SEQ ID NO: 1232260 - RNA, 16 nt, Mycobacterium leprae
ugucgcgaccaacccg

SEQ ID NO: 1232261 - RNA, 16 nt, Mycobacterium leprae
uguccgggccgcaaca

SEQ ID NO: 1232262 - RNA, 21 nt, Mycobacterium leprae
uguccgcaaaaugcuccccca

SEQ ID NO: 1232263 - RNA, 22 nt, Mycobacterium leprae
uguccgcccugaugguuugcug

SEQ ID NO: 1232264 - RNA, 19 nt, Mycobacterium leprae
ugucccaccgaguuuuugu

SEQ ID NO: 1232265 - RNA, 22 nt, Mycobacterium leprae
ugucccaccgaguuuuuguucc

SEQ ID NO: 1232266 - RNA, 18 nt, Mycobacterium leprae
uguccaugccacugucgc

SEQ ID NO: 1232267 - RNA, 21 nt, Mycobacterium leprae
uguccacugcggcaaagcaca

SEQ ID NO: 1232268 - RNA, 22 nt, Mycobacterium leprae
uguccaggugcgguaaucccag

SEQ ID NO: 1232269 - RNA, 20 nt, Mycobacterium leprae
uguccaagccgagacugaau

SEQ ID NO: 1232270 - RNA, 13 nt, Mycobacterium leprae
ugucaacagcgga

SEQ ID NO: 1232271 - RNA, 23 nt, Mycobacterium leprae
ugucagcuaaaagacggcauguc

SEQ ID NO: 1232272 - RNA, 12 nt, Mycobacterium leprae
uguacagcucuu

SEQ ID NO: 1232273 - RNA, 20 nt, Mycobacterium leprae
uguacagcucuuuucgucug

SEQ ID NO: 1232274 - RNA, 16 nt, Mycobacterium leprae
ugguuaaucaccucau

SEQ ID NO: 1232275 - RNA, 15 nt, Mycobacterium leprae
ugguucauggcaguc

SEQ ID NO: 1232276 - RNA, 16 nt, Mycobacterium leprae
ugguuucgaucaugcc

SEQ ID NO: 1232277 - RNA, 13 nt, Mycobacterium leprae
ugguuuggguggu

SEQ ID NO: 1232278 - RNA, 16 nt, Mycobacterium leprae
ugguuguucaugcucc

SEQ ID NO: 1232279 - RNA, 16 nt, Mycobacterium leprae
uguaagugcaguuccu

SEQ ID NO: 1232280 - RNA, 15 nt, Mycobacterium leprae
uguaauuacuucggu

SEQ ID NO: 1232281 - RNA, 13 nt, Mycobacterium leprae
uguaaugcugcug

SEQ ID NO: 1232282 - RNA, 19 nt, Mycobacterium leprae
ugguaaguauguuuggauu

SEQ ID NO: 1232283 - RNA, 14 nt, Mycobacterium leprae
uggucaccgcugug

SEQ ID NO: 1232284 - RNA, 17 nt, Mycobacterium leprae
uggucauguggccgcuc

SEQ ID NO: 1232285 - RNA, 17 nt, Mycobacterium leprae
uggucacaccuggugug

SEQ ID NO: 1232286 - RNA, 13 nt, Mycobacterium leprae
uggucgcuuguuc

SEQ ID NO: 1232287 - RNA, 14 nt, Mycobacterium leprae
uggucgcuuguucg

SEQ ID NO: 1232288 - RNA, 18 nt, Mycobacterium leprae
uggucccgcagccgcguc

SEQ ID NO: 1232289 - RNA, 15 nt, Mycobacterium leprae
uggugccguccucgu

SEQ ID NO: 1232290 - RNA, 16 nt, Mycobacterium leprae
uggugccgaucccggc

SEQ ID NO: 1232291 - RNA, 19 nt, Mycobacterium leprae
uggugcaagggauaacauc

SEQ ID NO: 1232292 - RNA, 17 nt, Mycobacterium leprae
uggugcuccgaugcagc

SEQ ID NO: 1232293 - RNA, 14 nt, Mycobacterium leprae
uggugcuuggcagc

SEQ ID NO: 1232294 - RNA, 11 nt, Mycobacterium leprae
uggugcugccc

SEQ ID NO: 1232295 - RNA, 17 nt, Mycobacterium leprae
uggugggcacaucagcc

SEQ ID NO: 1232296 - RNA, 14 nt, Mycobacterium leprae
uggugggugaaaug

SEQ ID NO: 1232297 - RNA, 13 nt, Mycobacterium leprae
ugggaguggugcu

SEQ ID NO: 1232298 - RNA, 15 nt, Mycobacterium leprae
ugggaguggugcucc

SEQ ID NO: 1232299 - RNA, 13 nt, Mycobacterium leprae
ugggcuuccagca

SEQ ID NO: 1232300 - RNA, 17 nt, Mycobacterium leprae
ugggcuuccagcagacc

SEQ ID NO: 1232301 - RNA, 21 nt, Mycobacterium leprae
uggggacgccggcggccaccg

SEQ ID NO: 1232302 - RNA, 16 nt, Mycobacterium leprae
ugggcggcggccgaac

SEQ ID NO: 1232303 - RNA, 13 nt, Mycobacterium leprae
uggcuguagugau

SEQ ID NO: 1232304 - RNA, 21 nt, Mycobacterium leprae
uggcugccgggcgucacgaag

SEQ ID NO: 1232305 - RNA, 18 nt, Mycobacterium leprae
uggcugcgauggcauuga

SEQ ID NO: 1232306 - RNA, 13 nt, Mycobacterium leprae
uggcuugagugcu

SEQ ID NO: 1232307 - RNA, 19 nt, Mycobacterium leprae
uggcggcgacacggcuguc

SEQ ID NO: 1232308 - RNA, 22 nt, Mycobacterium leprae
uggcgcuacgacgaguagugau

SEQ ID NO: 1232309 - RNA, 23 nt, Mycobacterium leprae
uggcgcuuaauguagcauguacu

SEQ ID NO: 1232310 - RNA, 15 nt, Mycobacterium leprae
uggcuacgcagcucu

SEQ ID NO: 1232311 - RNA, 15 nt, Mycobacterium leprae
uggcuaccaugccac

SEQ ID NO: 1232312 - RNA, 14 nt, Mycobacterium leprae
uggcucgacauugu

SEQ ID NO: 1232313 - RNA, 15 nt, Mycobacterium leprae
uggcuccugggaagu

SEQ ID NO: 1232314 - RNA, 16 nt, Mycobacterium leprae
uggcuccauccugccu

SEQ ID NO: 1232315 - RNA, 19 nt, Mycobacterium leprae
uggcuaagaucuucggauu

SEQ ID NO: 1232316 - RNA, 17 nt, Mycobacterium leprae
uggcgucguuuuggcgc

SEQ ID NO: 1232317 - RNA, 23 nt, Mycobacterium leprae
uggcgugacggauacggaaagca

SEQ ID NO: 1232318 - RNA, 19 nt, Mycobacterium leprae
uucacgaacaacagagcaa

SEQ ID NO: 1232319 - RNA, 14 nt, Mycobacterium leprae
uucagagcugcagg

SEQ ID NO: 1232320 - RNA, 13 nt, Mycobacterium leprae
uucagcacuggca

SEQ ID NO: 1232321 - RNA, 17 nt, Mycobacterium leprae
uucacagugccgaaagc

SEQ ID NO: 1232322 - RNA, 23 nt, Mycobacterium leprae
uucauuauugucggucugccuug

SEQ ID NO: 1232323 - RNA, 21 nt, Mycobacterium leprae
uucauguccuacacaaacaag

SEQ ID NO: 1232324 - RNA, 16 nt, Mycobacterium leprae
uucauggcuugcugca

SEQ ID NO: 1232325 - RNA, 15 nt, Mycobacterium leprae
uucaggugugcugca

SEQ ID NO: 1232326 - RNA, 22 nt, Mycobacterium leprae
uucccgcugagcaauuucuucu

SEQ ID NO: 1232327 - RNA, 12 nt, Mycobacterium leprae
uuccgauuggug

SEQ ID NO: 1232328 - RNA, 21 nt, Mycobacterium leprae
uuccgcagcgacggcaagcug

SEQ ID NO: 1232329 - RNA, 16 nt, Mycobacterium leprae
uuccgccgucgaucuc

SEQ ID NO: 1232330 - RNA, 22 nt, Mycobacterium leprae
uuccgccguucucccgccacuc

SEQ ID NO: 1232331 - RNA, 17 nt, Mycobacterium leprae
uucgacaccgagcagcc

SEQ ID NO: 1232332 - RNA, 19 nt, Mycobacterium leprae
uucgcagacacagccguca

SEQ ID NO: 1232333 - RNA, 12 nt, Mycobacterium leprae
uucgcaccugau

SEQ ID NO: 1232334 - RNA, 18 nt, Mycobacterium leprae
uucgauguguugaacagu

SEQ ID NO: 1232335 - RNA, 13 nt, Mycobacterium leprae
uucgauaagaagu

SEQ ID NO: 1232336 - RNA, 15 nt, Mycobacterium leprae
uucgcgaucuggaug

SEQ ID NO: 1232337 - RNA, 13 nt, Mycobacterium leprae
uucgcugacagca

SEQ ID NO: 1232338 - RNA, 17 nt, Mycobacterium leprae
uucgccacucaaauuca

SEQ ID NO: 1232339 - RNA, 22 nt, Mycobacterium leprae
uuccuggcgaucgauccaguag

SEQ ID NO: 1232340 - RNA, 21 nt, Mycobacterium leprae
uuccucuaggggggcggugaa

SEQ ID NO: 1232341 - RNA, 15 nt, Mycobacterium leprae
uuguugaccaaugug

SEQ ID NO: 1232342 - RNA, 20 nt, Mycobacterium leprae
uuguuuccgauguagcacag

SEQ ID NO: 1232343 - RNA, 16 nt, Mycobacterium leprae
uuguuuauguucggca

SEQ ID NO: 1232344 - RNA, 12 nt, Mycobacterium leprae
uuguuagugcug

SEQ ID NO: 1232345 - RNA, 15 nt, Mycobacterium leprae
uugugaagcugaggc

SEQ ID NO: 1232346 - RNA, 14 nt, Mycobacterium leprae
uugugacugugcca

SEQ ID NO: 1232347 - RNA, 10 nt, Mycobacterium leprae
uugugaguug

SEQ ID NO: 1232348 - RNA, 20 nt, Mycobacterium leprae
uuguagcguucguagagcug

SEQ ID NO: 1232349 - RNA, 21 nt, Mycobacterium leprae
uuuaagcgaaaaugaaaacaa

SEQ ID NO: 1232350 - RNA, 20 nt, Mycobacterium leprae
uuuacccccagaaccauccc

SEQ ID NO: 1232351 - RNA, 24 nt, Mycobacterium leprae
uuuaccccggacggccauuggcac

SEQ ID NO: 1232352 - RNA, 22 nt, Mycobacterium leprae
uuggucggggugcugcacggcu

SEQ ID NO: 1232353 - RNA, 17 nt, Mycobacterium leprae
uuggucuacauguugau

SEQ ID NO: 1232354 - RNA, 15 nt, Mycobacterium leprae
uugggugcacaaccu

SEQ ID NO: 1232355 - RNA, 18 nt, Mycobacterium leprae
uuggguaaagugaacaau

SEQ ID NO: 1232356 - RNA, 18 nt, Mycobacterium leprae
uugguuggggaaaugaca

SEQ ID NO: 1232357 - RNA, 19 nt, Mycobacterium leprae
uuggugaugucgacugcuu

SEQ ID NO: 1232358 - RNA, 15 nt, Mycobacterium leprae
uuggccggaacagca

SEQ ID NO: 1232359 - RNA, 12 nt, Mycobacterium leprae
uuggcuuguccc

SEQ ID NO: 1232360 - RNA, 20 nt, Mycobacterium leprae
uuggcuugugugguguccua

SEQ ID NO: 1232361 - RNA, 15 nt, Mycobacterium leprae
uugggagccagggca

SEQ ID NO: 1232362 - RNA, 16 nt, Mycobacterium leprae
uugggagugcuagcgg

SEQ ID NO: 1232363 - RNA, 15 nt, Mycobacterium leprae
uugcuugcugugacc

SEQ ID NO: 1232364 - RNA, 13 nt, Mycobacterium leprae
uugcuugagccug

SEQ ID NO: 1232365 - RNA, 18 nt, Mycobacterium leprae
uugcuggcggugggugca

SEQ ID NO: 1232366 - RNA, 19 nt, Mycobacterium leprae
uuggauguaaucguaccaa

SEQ ID NO: 1232367 - RNA, 16 nt, Mycobacterium leprae
uuggaugguuagcaug

SEQ ID NO: 1232368 - RNA, 23 nt, Mycobacterium leprae
uugccauaaaucaucgcugccau

SEQ ID NO: 1232369 - RNA, 16 nt, Mycobacterium leprae
uugccggggcugcgcu

SEQ ID NO: 1232370 - RNA, 17 nt, Mycobacterium leprae
uugcggccgaauucgag

SEQ ID NO: 1232371 - RNA, 17 nt, Mycobacterium leprae
uugcggcgccccucugc

SEQ ID NO: 1232372 - RNA, 20 nt, Mycobacterium leprae
uugcucgacgcggaguguaa

SEQ ID NO: 1232373 - RNA, 22 nt, Mycobacterium leprae
uugcggugugggacgugaugca

SEQ ID NO: 1232374 - RNA, 16 nt, Mycobacterium leprae
uugcuagcggcuucuc

SEQ ID NO: 1232375 - RNA, 19 nt, Mycobacterium leprae
uugcagcgaggccguggcc

SEQ ID NO: 1232376 - RNA, 18 nt, Mycobacterium leprae
uugcagcccugagcacca

SEQ ID NO: 1232377 - RNA, 15 nt, Mycobacterium leprae
uugauugcugcaucu

SEQ ID NO: 1232378 - RNA, 16 nt, Mycobacterium leprae
uugauugggcuuugcc

SEQ ID NO: 1232379 - RNA, 15 nt, Mycobacterium leprae
uugaucuuggugaug

SEQ ID NO: 1232380 - RNA, 21 nt, Mycobacterium leprae
uugaugaugccaggggcuggg

SEQ ID NO: 1232381 - RNA, 17 nt, Mycobacterium leprae
uugaugagaucacugag

SEQ ID NO: 1232382 - RNA, 13 nt, Mycobacterium leprae
uugaucaacccca

SEQ ID NO: 1232383 - RNA, 18 nt, Mycobacterium leprae
uugaaacccggaaugacg

SEQ ID NO: 1232384 - RNA, 14 nt, Mycobacterium leprae
uugaccgucaugcu

SEQ ID NO: 1232385 - RNA, 22 nt, Mycobacterium leprae
uugacaaagaaaaagagcccgg

SEQ ID NO: 1232386 - RNA, 13 nt, Mycobacterium leprae
uugacgcccuccu

SEQ ID NO: 1232387 - RNA, 13 nt, Mycobacterium leprae
uugacgcugcuug

SEQ ID NO: 1232388 - RNA, 16 nt, Mycobacterium leprae
uucuuacccgagcuga

SEQ ID NO: 1232389 - RNA, 19 nt, Mycobacterium leprae
uucuugauccgagaaaacu

SEQ ID NO: 1232390 - RNA, 15 nt, Mycobacterium leprae
uucuggcugggacac

SEQ ID NO: 1232391 - RNA, 18 nt, Mycobacterium leprae
uucuggcacccacgcugc

SEQ ID NO: 1232392 - RNA, 22 nt, Mycobacterium leprae
uucugauggggggugugaugcu

SEQ ID NO: 1232393 - RNA, 20 nt, Mycobacterium leprae
uucucgagcggcgcaugcca

SEQ ID NO: 1232394 - RNA, 20 nt, Mycobacterium leprae
uucguacaacguguuuagga

SEQ ID NO: 1232395 - RNA, 22 nt, Mycobacterium leprae
uucgguugggacagaagugguu

SEQ ID NO: 1232396 - RNA, 14 nt, Mycobacterium leprae
uucgucgaguaaug

SEQ ID NO: 1232397 - RNA, 14 nt, Mycobacterium leprae
uucuaaccggucaa

SEQ ID NO: 1232398 - RNA, 20 nt, Mycobacterium leprae
uucuaaccggucaaucaggu

SEQ ID NO: 1232399 - RNA, 19 nt, Mycobacterium leprae
gcacuaaagucuucaaucc

SEQ ID NO: 1232400 - RNA, 21 nt, Mycobacterium leprae
gcacgugcaaacugcugcgca

SEQ ID NO: 1232401 - RNA, 14 nt, Mycobacterium leprae
gcacgugcggcggc

SEQ ID NO: 1232402 - RNA, 21 nt, Mycobacterium leprae
gcacgugcggcggccuuggca

SEQ ID NO: 1232403 - RNA, 17 nt, Mycobacterium leprae
gcacucacccgcgaggc

SEQ ID NO: 1232404 - RNA, 20 nt, Mycobacterium leprae
gcacuauggcccgucgcugc

SEQ ID NO: 1232405 - RNA, 16 nt, Mycobacterium leprae
gcacuagcaucuguuc

SEQ ID NO: 1232406 - RNA, 17 nt, Mycobacterium leprae
gcacuccuucaugcugg

SEQ ID NO: 1232407 - RNA, 15 nt, Mycobacterium leprae
gcacugauucgacac

SEQ ID NO: 1232408 - RNA, 14 nt, Mycobacterium leprae
gcacugcguuguag

SEQ ID NO: 1232409 - RNA, 17 nt, Mycobacterium leprae
gcacugcuucggccagc

SEQ ID NO: 1232410 - RNA, 20 nt, Mycobacterium leprae
gcacugcuucggccagcgca

SEQ ID NO: 1232411 - RNA, 23 nt, Mycobacterium leprae
gcacggcgcucaccgacggaugc

SEQ ID NO: 1232412 - RNA, 14 nt, Mycobacterium leprae
gcacggggucagcg

SEQ ID NO: 1232413 - RNA, 19 nt, Mycobacterium leprae
gcacguaagcaugucggug

SEQ ID NO: 1232414 - RNA, 23 nt, Mycobacterium leprae
gcacguaagcaugucgguggugg

SEQ ID NO: 1232415 - RNA, 16 nt, Mycobacterium leprae
gcacguccccgugcac

SEQ ID NO: 1232416 - RNA, 18 nt, Mycobacterium leprae
gcacguccucggcccaug

SEQ ID NO: 1232417 - RNA, 13 nt, Mycobacterium leprae
gcacggauucggu

SEQ ID NO: 1232418 - RNA, 18 nt, Mycobacterium leprae
gcacggauucgguuuccu

SEQ ID NO: 1232419 - RNA, 21 nt, Mycobacterium leprae
gcaccugaucggucagcucga

SEQ ID NO: 1232420 - RNA, 24 nt, Mycobacterium leprae
gcaccuuacgauuacgcacgccuu

SEQ ID NO: 1232421 - RNA, 19 nt, Mycobacterium leprae
gcacgccgaacagccgcgc

SEQ ID NO: 1232422 - RNA, 19 nt, Mycobacterium leprae
gcaccagcucacccgcagc

SEQ ID NO: 1232423 - RNA, 12 nt, Mycobacterium leprae
gcacccucaccc

SEQ ID NO: 1232424 - RNA, 21 nt, Mycobacterium leprae
gcaccggcguuccggccucgg

SEQ ID NO: 1232425 - RNA, 15 nt, Mycobacterium leprae
gcaccgaucgcccgc

SEQ ID NO: 1232426 - RNA, 20 nt, Mycobacterium leprae
gcaccgaucgcccgcccaac

SEQ ID NO: 1232427 - RNA, 16 nt, Mycobacterium leprae
gcaccgaucugcccag

SEQ ID NO: 1232428 - RNA, 17 nt, Mycobacterium leprae
gcacccugccgccacag

SEQ ID NO: 1232429 - RNA, 14 nt, Mycobacterium leprae
gcaagucgaacgga

SEQ ID NO: 1232430 - RNA, 22 nt, Mycobacterium leprae
gcaagucauaucgucaaggcca

SEQ ID NO: 1232431 - RNA, 16 nt, Mycobacterium leprae
gcaagauuacccgcgg

SEQ ID NO: 1232432 - RNA, 14 nt, Mycobacterium leprae
gcaagcgcuuuucc

SEQ ID NO: 1232433 - RNA, 23 nt, Mycobacterium leprae
gcaaggguugguagcuggcucug

SEQ ID NO: 1232434 - RNA, 12 nt, Mycobacterium leprae
gcaagggugggg

SEQ ID NO: 1232435 - RNA, 13 nt, Mycobacterium leprae
gcaaggguggggc

SEQ ID NO: 1232436 - RNA, 14 nt, Mycobacterium leprae
gcaaggucccccgc

SEQ ID NO: 1232437 - RNA, 20 nt, Mycobacterium leprae
gcaagguuguuuguucagug

SEQ ID NO: 1232438 - RNA, 17 nt, Mycobacterium leprae
gcaagguguugcgguga

SEQ ID NO: 1232439 - RNA, 20 nt, Mycobacterium leprae
gcaaggugagcguugugggc

SEQ ID NO: 1232440 - RNA, 14 nt, Mycobacterium leprae
gcaagccaaaacau

SEQ ID NO: 1232441 - RNA, 12 nt, Mycobacterium leprae
gcaagcagugcc

SEQ ID NO: 1232442 - RNA, 11 nt, Mycobacterium leprae
gcaagccgcca

SEQ ID NO: 1232443 - RNA, 16 nt, Mycobacterium leprae
gcaagccuuuguuuua

SEQ ID NO: 1232444 - RNA, 20 nt, Mycobacterium leprae
gcacauugggaucccaccgg

SEQ ID NO: 1232445 - RNA, 15 nt, Mycobacterium leprae
gcacacugcggcugc

SEQ ID NO: 1232446 - RNA, 13 nt, Mycobacterium leprae
gcaauuuuucggu

SEQ ID NO: 1232447 - RNA, 19 nt, Mycobacterium leprae
gcacaaucaaccaggcaac

SEQ ID NO: 1232448 - RNA, 19 nt, Mycobacterium leprae
gcaauucgccaauucaaac

SEQ ID NO: 1232449 - RNA, 15 nt, Mycobacterium leprae
gcauccgccacaugu

SEQ ID NO: 1232450 - RNA, 14 nt, Mycobacterium leprae
gcauccgacaaagc

SEQ ID NO: 1232451 - RNA, 13 nt, Mycobacterium leprae
gcauccugcagca

SEQ ID NO: 1232452 - RNA, 17 nt, Mycobacterium leprae
gcaucgauaagcagcag

SEQ ID NO: 1232453 - RNA, 16 nt, Mycobacterium leprae
gcaucaacgccagcaa

SEQ ID NO: 1232454 - RNA, 21 nt, Mycobacterium leprae
gcaucagauauccuaggccac

SEQ ID NO: 1232455 - RNA, 14 nt, Mycobacterium leprae
gcaucagacagagc

SEQ ID NO: 1232456 - RNA, 15 nt, Mycobacterium leprae
gcagugcaagugggc

SEQ ID NO: 1232457 - RNA, 13 nt, Mycobacterium leprae
gcaguccgcucag

SEQ ID NO: 1232458 - RNA, 17 nt, Mycobacterium leprae
gcagugcaguucaccac

SEQ ID NO: 1232459 - RNA, 19 nt, Mycobacterium leprae
gcaggcaugccgccgggug

SEQ ID NO: 1232460 - RNA, 22 nt, Mycobacterium leprae
gcaggcgaguggcgaguccagg

SEQ ID NO: 1232461 - RNA, 22 nt, Mycobacterium leprae
gcagcugcaacaccuccucugg

SEQ ID NO: 1232462 - RNA, 15 nt, Mycobacterium leprae
gcagcugccaggcau

SEQ ID NO: 1232463 - RNA, 21 nt, Mycobacterium leprae
gcagcugccauuggccgcugg

SEQ ID NO: 1232464 - RNA, 19 nt, Mycobacterium leprae
gcagcgguacccgccagga

SEQ ID NO: 1232465 - RNA, 19 nt, Mycobacterium leprae
gcagcggcaguccgcguca

SEQ ID NO: 1232466 - RNA, 21 nt, Mycobacterium leprae
gcagcggcggccgugauuuuc

SEQ ID NO: 1232467 - RNA, 15 nt, Mycobacterium leprae
gcagcgcggacucuc

SEQ ID NO: 1232468 - RNA, 22 nt, Mycobacterium leprae
gcagcgccugccccgcuggugu

SEQ ID NO: 1232469 - RNA, 15 nt, Mycobacterium leprae
gcacuguucauugau

SEQ ID NO: 1232470 - RNA, 19 nt, Mycobacterium leprae
gcacuguucauugaugaau

SEQ ID NO: 1232471 - RNA, 21 nt, Mycobacterium leprae
gcacugugucaccugaaagag

SEQ ID NO: 1232472 - RNA, 18 nt, Mycobacterium leprae
gcacuuacgcgauucaug

SEQ ID NO: 1232473 - RNA, 19 nt, Mycobacterium leprae
gcagcaacagccacacccg

SEQ ID NO: 1232474 - RNA, 14 nt, Mycobacterium leprae
gcagauguccuuca

SEQ ID NO: 1232475 - RNA, 13 nt, Mycobacterium leprae
gcagcauauggaa

SEQ ID NO: 1232476 - RNA, 15 nt, Mycobacterium leprae
gcagcauagucggug

SEQ ID NO: 1232477 - RNA, 14 nt, Mycobacterium leprae
gcagcaugguggcc

SEQ ID NO: 1232478 - RNA, 17 nt, Mycobacterium leprae
gcagcauuggcuccugg

SEQ ID NO: 1232479 - RNA, 12 nt, Mycobacterium leprae
gcagcaucuguc

SEQ ID NO: 1232480 - RNA, 13 nt, Mycobacterium leprae
gcaaaggucagcg

SEQ ID NO: 1232481 - RNA, 19 nt, Mycobacterium leprae
gcaaaguccucgaaucgga

SEQ ID NO: 1232482 - RNA, 16 nt, Mycobacterium leprae
gcaaaguuaugcaacg

SEQ ID NO: 1232483 - RNA, 18 nt, Mycobacterium leprae
gcaaaauccuucaugucc

SEQ ID NO: 1232484 - RNA, 16 nt, Mycobacterium leprae
gcaaaccaaacaacaa

SEQ ID NO: 1232485 - RNA, 17 nt, Mycobacterium leprae
gauuugaacugggacca

SEQ ID NO: 1232486 - RNA, 13 nt, Mycobacterium leprae
gauuuugggugau

SEQ ID NO: 1232487 - RNA, 20 nt, Mycobacterium leprae
gcaaaaaauagcugccaagc

SEQ ID NO: 1232488 - RNA, 14 nt, Mycobacterium leprae
gauuuaagcaggcu

SEQ ID NO: 1232489 - RNA, 21 nt, Mycobacterium leprae
gauuggaaggcauaugagcau

SEQ ID NO: 1232490 - RNA, 19 nt, Mycobacterium leprae
gauugacaaaagugcagug

SEQ ID NO: 1232491 - RNA, 16 nt, Mycobacterium leprae
gauguccaaggggcua

SEQ ID NO: 1232492 - RNA, 14 nt, Mycobacterium leprae
gaugucgagaucau

SEQ ID NO: 1232493 - RNA, 14 nt, Mycobacterium leprae
gauguuuuggaccg

SEQ ID NO: 1232494 - RNA, 22 nt, Mycobacterium leprae
gaugguguagcugagccacgcu

SEQ ID NO: 1232495 - RNA, 15 nt, Mycobacterium leprae
gauggugcacuugca

SEQ ID NO: 1232496 - RNA, 23 nt, Mycobacterium leprae
gauguaaucgcgugccagcgcug

SEQ ID NO: 1232497 - RNA, 18 nt, Mycobacterium leprae
gauguaaucguaccaaca

SEQ ID NO: 1232498 - RNA, 14 nt, Mycobacterium leprae
gaugguuuggcugc

SEQ ID NO: 1232499 - RNA, 17 nt, Mycobacterium leprae
gauguagccaacagcca

SEQ ID NO: 1232500 - RNA, 23 nt, Mycobacterium leprae
gauggcauccaacacgccgaucg

SEQ ID NO: 1232501 - RNA, 15 nt, Mycobacterium leprae
gauggcgcgugaauu

SEQ ID NO: 1232502 - RNA, 17 nt, Mycobacterium leprae
gauggucauuugguggu

SEQ ID NO: 1232503 - RNA, 14 nt, Mycobacterium leprae
gaugggaucucugu

SEQ ID NO: 1232504 - RNA, 20 nt, Mycobacterium leprae
gaugcuggccguguugcugc

SEQ ID NO: 1232505 - RNA, 20 nt, Mycobacterium leprae
gaugcuguguggcuguuucu

SEQ ID NO: 1232506 - RNA, 21 nt, Mycobacterium leprae
gaugcgcaccucgcugcagca

SEQ ID NO: 1232507 - RNA, 16 nt, Mycobacterium leprae
gaugcaggcgugggug

SEQ ID NO: 1232508 - RNA, 17 nt, Mycobacterium leprae
gaugaugccaggggcug

SEQ ID NO: 1232509 - RNA, 14 nt, Mycobacterium leprae
gaugaugaaaaaug

SEQ ID NO: 1232510 - RNA, 19 nt, Mycobacterium leprae
gaugagauucgagcgggca

SEQ ID NO: 1232511 - RNA, 18 nt, Mycobacterium leprae
gaugaucggcaaaauuuu

SEQ ID NO: 1232512 - RNA, 22 nt, Mycobacterium leprae
gaucgugaagauaggucgccga

SEQ ID NO: 1232513 - RNA, 14 nt, Mycobacterium leprae
gaugacaagaguga

SEQ ID NO: 1232514 - RNA, 15 nt, Mycobacterium leprae
gaugacaguaaguag

SEQ ID NO: 1232515 - RNA, 21 nt, Mycobacterium leprae
gaucgcaaucgacggccgcac

SEQ ID NO: 1232516 - RNA, 14 nt, Mycobacterium leprae
gaucgcaaauauaa

SEQ ID NO: 1232517 - RNA, 21 nt, Mycobacterium leprae
gaucgcaggcaccacaaacaa

SEQ ID NO: 1232518 - RNA, 21 nt, Mycobacterium leprae
gaucgcaugccgaucagccgc

SEQ ID NO: 1232519 - RNA, 15 nt, Mycobacterium leprae
gaucgcguucugucg

SEQ ID NO: 1232520 - RNA, 20 nt, Mycobacterium leprae
gaucgcuaguuuacuaggcc

SEQ ID NO: 1232521 - RNA, 23 nt, Mycobacterium leprae
gaucgcuaguuuacuaggcccca

SEQ ID NO: 1232522 - RNA, 19 nt, Mycobacterium leprae
gaucggggcgauguuaugu

SEQ ID NO: 1232523 - RNA, 21 nt, Mycobacterium leprae
gaucggcgugcacggcgagga

SEQ ID NO: 1232524 - RNA, 20 nt, Mycobacterium leprae
gauccacaauucuucgcuca

SEQ ID NO: 1232525 - RNA, 19 nt, Mycobacterium leprae
gauccugcucauucaggcc

SEQ ID NO: 1232526 - RNA, 20 nt, Mycobacterium leprae
gaucgaccgcugaaguuauc

SEQ ID NO: 1232527 - RNA, 23 nt, Mycobacterium leprae
gauccggcggccggcaagaagug

SEQ ID NO: 1232528 - RNA, 16 nt, Mycobacterium leprae
gauccgguguggagug

SEQ ID NO: 1232529 - RNA, 14 nt, Mycobacterium leprae
gauauccgccggcc

SEQ ID NO: 1232530 - RNA, 18 nt, Mycobacterium leprae
gauauccgccggccgcac

SEQ ID NO: 1232531 - RNA, 21 nt, Mycobacterium leprae
gauauggccgaccaaauggga

SEQ ID NO: 1232532 - RNA, 21 nt, Mycobacterium leprae
gaucaacagcgcagugugcuu

SEQ ID NO: 1232533 - RNA, 13 nt, Mycobacterium leprae
gaucagccgcgca

SEQ ID NO: 1232534 - RNA, 12 nt, Mycobacterium leprae
gaucagugcggu

SEQ ID NO: 1232535 - RNA, 16 nt, Mycobacterium leprae
gaucagugcaauaccu

SEQ ID NO: 1232536 - RNA, 23 nt, Mycobacterium leprae
gaucagggcgccccccaguggug

SEQ ID NO: 1232537 - RNA, 19 nt, Mycobacterium leprae
gauaacgggugucuaauca

SEQ ID NO: 1232538 - RNA, 15 nt, Mycobacterium leprae
gauaauuuggcugau

SEQ ID NO: 1232539 - RNA, 23 nt, Mycobacterium leprae
gauacagccucucgacaaagaaa

SEQ ID NO: 1232540 - RNA, 13 nt, Mycobacterium leprae
gauacacuuuaau

SEQ ID NO: 1232541 - RNA, 17 nt, Mycobacterium leprae
gauagauggagccacca

SEQ ID NO: 1232542 - RNA, 13 nt, Mycobacterium leprae
gaguucacugagg

SEQ ID NO: 1232543 - RNA, 11 nt, Mycobacterium leprae
gaguucaacaa

SEQ ID NO: 1232544 - RNA, 18 nt, Mycobacterium leprae
gagugcgcugcagcaaca

SEQ ID NO: 1232545 - RNA, 20 nt, Mycobacterium leprae
gaguucuaucaacauuuguu

SEQ ID NO: 1232546 - RNA, 22 nt, Mycobacterium leprae
gaguucuucacacgagccgcau

SEQ ID NO: 1232547 - RNA, 15 nt, Mycobacterium leprae
gaguaucugugggca

SEQ ID NO: 1232548 - RNA, 16 nt, Mycobacterium leprae
gagucucacccaccuu

SEQ ID NO: 1232549 - RNA, 21 nt, Mycobacterium leprae
gagucucuggugcgccaacac

SEQ ID NO: 1232550 - RNA, 15 nt, Mycobacterium leprae
gagugcauucugacu

SEQ ID NO: 1232551 - RNA, 15 nt, Mycobacterium leprae
gagugcuagcggcgc

SEQ ID NO: 1232552 - RNA, 20 nt, Mycobacterium leprae
gagugcuggucaacaguggc

SEQ ID NO: 1232553 - RNA, 14 nt, Mycobacterium leprae
gccgucagggcagc

SEQ ID NO: 1232554 - RNA, 15 nt, Mycobacterium leprae
gccguaguacccggc

SEQ ID NO: 1232555 - RNA, 18 nt, Mycobacterium leprae
gccgguuucgccccaacu

SEQ ID NO: 1232556 - RNA, 22 nt, Mycobacterium leprae
gccgguggcuauacccccuguc

SEQ ID NO: 1232557 - RNA, 20 nt, Mycobacterium leprae
gccgguggcaaccgacacac

SEQ ID NO: 1232558 - RNA, 23 nt, Mycobacterium leprae
gccguggauaccacugacgggug

SEQ ID NO: 1232559 - RNA, 17 nt, Mycobacterium leprae
gccgugaauccgcugca

SEQ ID NO: 1232560 - RNA, 19 nt, Mycobacterium leprae
gccgucccuauagguggca

SEQ ID NO: 1232561 - RNA, 22 nt, Mycobacterium leprae
gccgucgauuuugcaggccagu

SEQ ID NO: 1232562 - RNA, 13 nt, Mycobacterium leprae
gccgucgcgggug

SEQ ID NO: 1232563 - RNA, 18 nt, Mycobacterium leprae
gccggcgucaggccaggc

SEQ ID NO: 1232564 - RNA, 18 nt, Mycobacterium leprae
gccggcgcgcaggcugcg

SEQ ID NO: 1232565 - RNA, 12 nt, Mycobacterium leprae
gccggcgccugg

SEQ ID NO: 1232566 - RNA, 15 nt, Mycobacterium leprae
gccggcgccgcugcu

SEQ ID NO: 1232567 - RNA, 13 nt, Mycobacterium leprae
gccgguggccagc

SEQ ID NO: 1232568 - RNA, 14 nt, Mycobacterium leprae
gccggugaugacga

SEQ ID NO: 1232569 - RNA, 18 nt, Mycobacterium leprae
gccggucgaagugaccuc

SEQ ID NO: 1232570 - RNA, 20 nt, Mycobacterium leprae
gccggucaacaagccgccga

SEQ ID NO: 1232571 - RNA, 20 nt, Mycobacterium leprae
gccggagauguaguccucag

SEQ ID NO: 1232572 - RNA, 14 nt, Mycobacterium leprae
gccgcugcauccgc

SEQ ID NO: 1232573 - RNA, 13 nt, Mycobacterium leprae
gccgcugcauccg

SEQ ID NO: 1232574 - RNA, 18 nt, Mycobacterium leprae
gccgcugcauccgcagca

SEQ ID NO: 1232575 - RNA, 13 nt, Mycobacterium leprae
gccgcguccagac

SEQ ID NO: 1232576 - RNA, 19 nt, Mycobacterium leprae
gccgcaaguuuagcaacaa

SEQ ID NO: 1232577 - RNA, 16 nt, Mycobacterium leprae
gccgccgaagccgcgc

SEQ ID NO: 1232578 - RNA, 15 nt, Mycobacterium leprae
gccgccgacaccgau

SEQ ID NO: 1232579 - RNA, 22 nt, Mycobacterium leprae
gccgccuuuacgaagccgccac

SEQ ID NO: 1232580 - RNA, 17 nt, Mycobacterium leprae
gccgacuaauuguggcu

SEQ ID NO: 1232581 - RNA, 14 nt, Mycobacterium leprae
gccgacgucuucaa

SEQ ID NO: 1232582 - RNA, 20 nt, Mycobacterium leprae
gccgaccuaccgcauccggc

SEQ ID NO: 1232583 - RNA, 18 nt, Mycobacterium leprae
gccgaccucggcgcuggg

SEQ ID NO: 1232584 - RNA, 19 nt, Mycobacterium leprae
gccgagacuaccggagguu

SEQ ID NO: 1232585 - RNA, 12 nt, Mycobacterium leprae
gccgagcaugac

SEQ ID NO: 1232586 - RNA, 22 nt, Mycobacterium leprae
gccgagcaugaccgagcuggcg

SEQ ID NO: 1232587 - RNA, 17 nt, Mycobacterium leprae
gccgauuagacacacuu

SEQ ID NO: 1232588 - RNA, 15 nt, Mycobacterium leprae
gccgaucccaucggc

SEQ ID NO: 1232589 - RNA, 16 nt, Mycobacterium leprae
gccgaucccaucggcu

SEQ ID NO: 1232590 - RNA, 20 nt, Mycobacterium leprae
gccgaucccaucggcugcac

SEQ ID NO: 1232591 - RNA, 23 nt, Mycobacterium leprae
gccgaucauggcuggacagaagc

SEQ ID NO: 1232592 - RNA, 17 nt, Mycobacterium leprae
gccgaggaugccguaga

SEQ ID NO: 1232593 - RNA, 20 nt, Mycobacterium leprae
gccgagcgucgaauaaacuu

SEQ ID NO: 1232594 - RNA, 18 nt, Mycobacterium leprae
gccgagguucccggcggc

SEQ ID NO: 1232595 - RNA, 18 nt, Mycobacterium leprae
gccgagguggcagcuggg

SEQ ID NO: 1232596 - RNA, 14 nt, Mycobacterium leprae
gcccuucuccacca

SEQ ID NO: 1232597 - RNA, 17 nt, Mycobacterium leprae
gccgaacuauccaagac

SEQ ID NO: 1232598 - RNA, 17 nt, Mycobacterium leprae
gccgaagccgccagguu

SEQ ID NO: 1232599 - RNA, 14 nt, Mycobacterium leprae
gccgacagugccac

SEQ ID NO: 1232600 - RNA, 15 nt, Mycobacterium leprae
gcccuggaccgcagc

SEQ ID NO: 1232601 - RNA, 16 nt, Mycobacterium leprae
gcccuggaccgcagca

SEQ ID NO: 1232602 - RNA, 12 nt, Mycobacterium leprae
gcccucgccggc

SEQ ID NO: 1232603 - RNA, 21 nt, Mycobacterium leprae
gcccgguuuuagcgugcugug

SEQ ID NO: 1232604 - RNA, 16 nt, Mycobacterium leprae
gcccgucguggugugc

SEQ ID NO: 1232605 - RNA, 22 nt, Mycobacterium leprae
gccccucgaagucggagugucu

SEQ ID NO: 1232606 - RNA, 22 nt, Mycobacterium leprae
gcccgaagugcuugggcacgcu

SEQ ID NO: 1232607 - RNA, 17 nt, Mycobacterium leprae
gccccuaccccgcggcg

SEQ ID NO: 1232608 - RNA, 19 nt, Mycobacterium leprae
gcccggacggcccagcacc

SEQ ID NO: 1232609 - RNA, 20 nt, Mycobacterium leprae
gcccggacggcccagcacca

SEQ ID NO: 1232610 - RNA, 21 nt, Mycobacterium leprae
gcccggauacagcacggcgcu

SEQ ID NO: 1232611 - RNA, 12 nt, Mycobacterium leprae
gcccgcacagca

SEQ ID NO: 1232612 - RNA, 15 nt, Mycobacterium leprae
gcccgcacagcacca

SEQ ID NO: 1232613 - RNA, 17 nt, Mycobacterium leprae
gcccgcacagcaccaug

SEQ ID NO: 1232614 - RNA, 18 nt, Mycobacterium leprae
gccauccaccgccgagcg

SEQ ID NO: 1232615 - RNA, 18 nt, Mycobacterium leprae
gccauccgggccagaauc

SEQ ID NO: 1232616 - RNA, 16 nt, Mycobacterium leprae
gccaucacugauccca

SEQ ID NO: 1232617 - RNA, 18 nt, Mycobacterium leprae
gccaugaccgaccugggg

SEQ ID NO: 1232618 - RNA, 18 nt, Mycobacterium leprae
gccaugucuaagacacuu

SEQ ID NO: 1232619 - RNA, 17 nt, Mycobacterium leprae
gcccaagcgaagccugg

SEQ ID NO: 1232620 - RNA, 14 nt, Mycobacterium leprae
gcccaagacucagu

SEQ ID NO: 1232621 - RNA, 22 nt, Mycobacterium leprae
gcccaaugcagcaacgugcagu

SEQ ID NO: 1232622 - RNA, 23 nt, Mycobacterium leprae
gcccaaugcagcaacgugcaguc

SEQ ID NO: 1232623 - RNA, 13 nt, Mycobacterium leprae
gccauuugcggcu

SEQ ID NO: 1232624 - RNA, 19 nt, Mycobacterium leprae
gcccaccgcaacgccucca

SEQ ID NO: 1232625 - RNA, 21 nt, Mycobacterium leprae
gcccaccgcaaucgaaaaaug

SEQ ID NO: 1232626 - RNA, 13 nt, Mycobacterium leprae
gcccaccgccgga

SEQ ID NO: 1232627 - RNA, 24 nt, Mycobacterium leprae
gcccacgaauaugcccagcagaug

SEQ ID NO: 1232628 - RNA, 21 nt, Mycobacterium leprae
gcccagaccgaaaaccacaag

SEQ ID NO: 1232629 - RNA, 18 nt, Mycobacterium leprae
gcccagagaucgccgcuc

SEQ ID NO: 1232630 - RNA, 14 nt, Mycobacterium leprae
gccagcgcucgcug

SEQ ID NO: 1232631 - RNA, 19 nt, Mycobacterium leprae
gccagcgacacagccggcc

SEQ ID NO: 1232632 - RNA, 20 nt, Mycobacterium leprae
gccagcgacacagccggccg

SEQ ID NO: 1232633 - RNA, 21 nt, Mycobacterium leprae
gccagcgacacagccggccgg

SEQ ID NO: 1232634 - RNA, 19 nt, Mycobacterium leprae
gccaggggaaccaucgcac

SEQ ID NO: 1232635 - RNA, 14 nt, Mycobacterium leprae
gccagggggcguca

SEQ ID NO: 1232636 - RNA, 16 nt, Mycobacterium leprae
gccagggguuccaaga

SEQ ID NO: 1232637 - RNA, 20 nt, Mycobacterium leprae
gccaggugguaucugcaccu

SEQ ID NO: 1232638 - RNA, 18 nt, Mycobacterium leprae
gccaggcguccucauccc

SEQ ID NO: 1232639 - RNA, 21 nt, Mycobacterium leprae
gccagggcggcauucccaacc

SEQ ID NO: 1232640 - RNA, 19 nt, Mycobacterium leprae
gccaggaugcggcccagug

SEQ ID NO: 1232641 - RNA, 17 nt, Mycobacterium leprae
gccagacuucagcgagc

SEQ ID NO: 1232642 - RNA, 14 nt, Mycobacterium leprae
gccagcaaggcaac

SEQ ID NO: 1232643 - RNA, 14 nt, Mycobacterium leprae
gccagcaagcaggc

SEQ ID NO: 1232644 - RNA, 14 nt, Mycobacterium leprae
gccacuucgcccga

SEQ ID NO: 1232645 - RNA, 22 nt, Mycobacterium leprae
gccacugucgcgaccaacccgg

SEQ ID NO: 1232646 - RNA, 16 nt, Mycobacterium leprae
gccaaucuaucaagcc

SEQ ID NO: 1232647 - RNA, 18 nt, Mycobacterium leprae
gccaauugaauccgcugc

SEQ ID NO: 1232648 - RNA, 15 nt, Mycobacterium leprae
gccacaacgcggccu

SEQ ID NO: 1232649 - RNA, 19 nt, Mycobacterium leprae
gccaaguuguaagugcagu

SEQ ID NO: 1232650 - RNA, 23 nt, Mycobacterium leprae
gccacaggcgauucauggcuugc

SEQ ID NO: 1232651 - RNA, 14 nt, Mycobacterium leprae
gccacauugccggu

SEQ ID NO: 1232652 - RNA, 15 nt, Mycobacterium leprae
gccaccaccaccccu

SEQ ID NO: 1232653 - RNA, 21 nt, Mycobacterium leprae
gccaccacaaauacuucacca

SEQ ID NO: 1232654 - RNA, 23 nt, Mycobacterium leprae
gccaccauauaagcgaaguccuu

SEQ ID NO: 1232655 - RNA, 15 nt, Mycobacterium leprae
gccaccgacaaagcu

SEQ ID NO: 1232656 - RNA, 21 nt, Mycobacterium leprae
gccaccgacaaagcucaggcc

SEQ ID NO: 1232657 - RNA, 21 nt, Mycobacterium leprae
gcauuucgaaagucaccuguc

SEQ ID NO: 1232658 - RNA, 21 nt, Mycobacterium leprae
gccaaacacggccagcgcggc

SEQ ID NO: 1232659 - RNA, 17 nt, Mycobacterium leprae
gccaaacuugcacugau

SEQ ID NO: 1232660 - RNA, 24 nt, Mycobacterium leprae
gccaacagccaaugucacaucgau

SEQ ID NO: 1232661 - RNA, 18 nt, Mycobacterium leprae
gccaaccacagcaauaga

SEQ ID NO: 1232662 - RNA, 15 nt, Mycobacterium leprae
gccaaccugugcaug

SEQ ID NO: 1232663 - RNA, 22 nt, Mycobacterium leprae
gccaacuguugcuugcccugcg

SEQ ID NO: 1232664 - RNA, 23 nt, Mycobacterium leprae
gcauuuaccgagaucgacgcugc

SEQ ID NO: 1232665 - RNA, 19 nt, Mycobacterium leprae
gcauugccggggcugcgcu

SEQ ID NO: 1232666 - RNA, 24 nt, Mycobacterium leprae
gcauugcuggugccccagucgcca

SEQ ID NO: 1232667 - RNA, 22 nt, Mycobacterium leprae
gcauucccaaccgcgacgccag

SEQ ID NO: 1232668 - RNA, 21 nt, Mycobacterium leprae
gcauguucuguugugggggug

SEQ ID NO: 1232669 - RNA, 15 nt, Mycobacterium leprae
gcaugugcauccagu

SEQ ID NO: 1232670 - RNA, 15 nt, Mycobacterium leprae
gcaugguggccacga

SEQ ID NO: 1232671 - RNA, 12 nt, Mycobacterium leprae
gcauggcacugc

SEQ ID NO: 1232672 - RNA, 17 nt, Mycobacterium leprae
gcauggccgcuggggca

SEQ ID NO: 1232673 - RNA, 19 nt, Mycobacterium leprae
gcaugcuaacaucauucac

SEQ ID NO: 1232674 - RNA, 18 nt, Mycobacterium leprae
gcauggacccacugggca

SEQ ID NO: 1232675 - RNA, 15 nt, Mycobacterium leprae
gcaucgucggcaaau

SEQ ID NO: 1232676 - RNA, 19 nt, Mycobacterium leprae
gcaucgucuggacucgguc

SEQ ID NO: 1232677 - RNA, 16 nt, Mycobacterium leprae
gcaucugccauaucaa

SEQ ID NO: 1232678 - RNA, 20 nt, Mycobacterium leprae
gcaucucaacuuucgcggcc

SEQ ID NO: 1232679 - RNA, 15 nt, Mycobacterium leprae
gcaucggcaucccag

SEQ ID NO: 1232680 - RNA, 18 nt, Mycobacterium leprae
gcaucggcauugccgggg

SEQ ID NO: 1232681 - RNA, 15 nt, Mycobacterium leprae
gcaucggcaggcugu

SEQ ID NO: 1232682 - RNA, 21 nt, Mycobacterium leprae
gcaugcccugggccagcgauc

SEQ ID NO: 1232683 - RNA, 17 nt, Mycobacterium leprae
gcaugccgccgggugca

SEQ ID NO: 1232684 - RNA, 14 nt, Mycobacterium leprae
gcaugagcugcugg

SEQ ID NO: 1232685 - RNA, 17 nt, Mycobacterium leprae
gcaugccaaccugugca

SEQ ID NO: 1232686 - RNA, 13 nt, Mycobacterium leprae
gcaugaccgagcu

SEQ ID NO: 1232687 - RNA, 23 nt, Mycobacterium leprae
gcgguagcggaccugcgagaucg

SEQ ID NO: 1232688 - RNA, 18 nt, Mycobacterium leprae
gcgguaguuuccugagca

SEQ ID NO: 1232689 - RNA, 21 nt, Mycobacterium leprae
gcggucuuggugagagcucca

SEQ ID NO: 1232690 - RNA, 22 nt, Mycobacterium leprae
gcgggguuuuuguuggugggug

SEQ ID NO: 1232691 - RNA, 19 nt, Mycobacterium leprae
gcgggaggccuuaagcugc

SEQ ID NO: 1232692 - RNA, 17 nt, Mycobacterium leprae
gcgggcccgucguggug

SEQ ID NO: 1232693 - RNA, 15 nt, Mycobacterium leprae
gcgggacagaagcau

SEQ ID NO: 1232694 - RNA, 15 nt, Mycobacterium leprae
gcgggacgugcacug

SEQ ID NO: 1232695 - RNA, 16 nt, Mycobacterium leprae
gcgggacgugcacugg

SEQ ID NO: 1232696 - RNA, 18 nt, Mycobacterium leprae
gcgggacgugcacuggug

SEQ ID NO: 1232697 - RNA, 11 nt, Mycobacterium leprae
gcgggagaucu

SEQ ID NO: 1232698 - RNA, 13 nt, Mycobacterium leprae
gcgggcggcagcc

SEQ ID NO: 1232699 - RNA, 15 nt, Mycobacterium leprae
gcggcuacucugcgu

SEQ ID NO: 1232700 - RNA, 18 nt, Mycobacterium leprae
gcggcuagucggccggcu

SEQ ID NO: 1232701 - RNA, 16 nt, Mycobacterium leprae
gcggcuggugcggcgg

SEQ ID NO: 1232702 - RNA, 19 nt, Mycobacterium leprae
gcggcguuauccacgccga

SEQ ID NO: 1232703 - RNA, 22 nt, Mycobacterium leprae
gcggcgugauauccgccguucu

SEQ ID NO: 1232704 - RNA, 17 nt, Mycobacterium leprae
gcggcgccugaacugga

SEQ ID NO: 1232705 - RNA, 14 nt, Mycobacterium leprae
gcggcgcccagcac

SEQ ID NO: 1232706 - RNA, 17 nt, Mycobacterium leprae
gcggcacgauaggcagu

SEQ ID NO: 1232707 - RNA, 20 nt, Mycobacterium leprae
gcggcacgauaggcagugcu

SEQ ID NO: 1232708 - RNA, 16 nt, Mycobacterium leprae
gcggcaccuguacuug

SEQ ID NO: 1232709 - RNA, 16 nt, Mycobacterium leprae
gcguagggucaagucu

SEQ ID NO: 1232710 - RNA, 15 nt, Mycobacterium leprae
gcggugagagcuucc

SEQ ID NO: 1232711 - RNA, 22 nt, Mycobacterium leprae
gcggugaucgcugccggcggca

SEQ ID NO: 1232712 - RNA, 16 nt, Mycobacterium leprae
gcggugccaacgcgca

SEQ ID NO: 1232713 - RNA, 12 nt, Mycobacterium leprae
gcggugcagugc

SEQ ID NO: 1232714 - RNA, 18 nt, Mycobacterium leprae
gcguagcaagguguugcg

SEQ ID NO: 1232715 - RNA, 17 nt, Mycobacterium leprae
gcgucaguuuacuggca

SEQ ID NO: 1232716 - RNA, 14 nt, Mycobacterium leprae
gcgucaggccaggc

SEQ ID NO: 1232717 - RNA, 18 nt, Mycobacterium leprae
gcgucaagcagcaccaca

SEQ ID NO: 1232718 - RNA, 15 nt, Mycobacterium leprae
gcguccucaucccau

SEQ ID NO: 1232719 - RNA, 16 nt, Mycobacterium leprae
gcguccucaucccaug

SEQ ID NO: 1232720 - RNA, 20 nt, Mycobacterium leprae
gcguccagacaccacugcca

SEQ ID NO: 1232721 - RNA, 14 nt, Mycobacterium leprae
gcguccgcggcggc

SEQ ID NO: 1232722 - RNA, 17 nt, Mycobacterium leprae
gcguucagcgaagaguu

SEQ ID NO: 1232723 - RNA, 15 nt, Mycobacterium leprae
gcguguucaucaucu

SEQ ID NO: 1232724 - RNA, 15 nt, Mycobacterium leprae
gcguugccguccccu

SEQ ID NO: 1232725 - RNA, 13 nt, Mycobacterium leprae
gcguuggaccgaa

SEQ ID NO: 1232726 - RNA, 14 nt, Mycobacterium leprae
gcguugggaaagcu

SEQ ID NO: 1232727 - RNA, 13 nt, Mycobacterium leprae
gcgugugcacucc

SEQ ID NO: 1232728 - RNA, 16 nt, Mycobacterium leprae
gcguggcuaggccagu

SEQ ID NO: 1232729 - RNA, 20 nt, Mycobacterium leprae
gcgugccugguugggcaucg

SEQ ID NO: 1232730 - RNA, 16 nt, Mycobacterium leprae
gcgucguugcgcugga

SEQ ID NO: 1232731 - RNA, 16 nt, Mycobacterium leprae
gcgugaucuccgcaug

SEQ ID NO: 1232732 - RNA, 16 nt, Mycobacterium leprae
gcgugauagaagacag

SEQ ID NO: 1232733 - RNA, 22 nt, Mycobacterium leprae
gcgugaucgacaucguguggug

SEQ ID NO: 1232734 - RNA, 16 nt, Mycobacterium leprae
gcgugagugugaggau

SEQ ID NO: 1232735 - RNA, 18 nt, Mycobacterium leprae
gcgucgcccucgccggcg

SEQ ID NO: 1232736 - RNA, 12 nt, Mycobacterium leprae
gcgucgcgccug

SEQ ID NO: 1232737 - RNA, 17 nt, Mycobacterium leprae
gcucugguggccaccga

SEQ ID NO: 1232738 - RNA, 18 nt, Mycobacterium leprae
gcucuguucuggugggga

SEQ ID NO: 1232739 - RNA, 23 nt, Mycobacterium leprae
gcucucugguaacggaccuggca

SEQ ID NO: 1232740 - RNA, 20 nt, Mycobacterium leprae
gcucugaggucaccggccac

SEQ ID NO: 1232741 - RNA, 18 nt, Mycobacterium leprae
gcucucucgggguugaau

SEQ ID NO: 1232742 - RNA, 16 nt, Mycobacterium leprae
gcucgugggcggcggc

SEQ ID NO: 1232743 - RNA, 19 nt, Mycobacterium leprae
gcugaaauccucgggcgca

SEQ ID NO: 1232744 - RNA, 18 nt, Mycobacterium leprae
gcugaaguuaucugcuga

SEQ ID NO: 1232745 - RNA, 17 nt, Mycobacterium leprae
gcugaauggucauugga

SEQ ID NO: 1232746 - RNA, 13 nt, Mycobacterium leprae
gcugaccagcaga

SEQ ID NO: 1232747 - RNA, 14 nt, Mycobacterium leprae
gcugaccagcagau

SEQ ID NO: 1232748 - RNA, 19 nt, Mycobacterium leprae
gcugacaugacaucacugg

SEQ ID NO: 1232749 - RNA, 23 nt, Mycobacterium leprae
gcugacggcuaggguuggauggu

SEQ ID NO: 1232750 - RNA, 23 nt, Mycobacterium leprae
gcugaccggcgaccaguuuacau

SEQ ID NO: 1232751 - RNA, 17 nt, Mycobacterium leprae
gcugaccgggguucaau

SEQ ID NO: 1232752 - RNA, 18 nt, Mycobacterium leprae
gcugagucggcgcucugu

SEQ ID NO: 1232753 - RNA, 20 nt, Mycobacterium leprae
gcugagccauuuggcaccca

SEQ ID NO: 1232754 - RNA, 17 nt, Mycobacterium leprae
gcugagccacgcuggca

SEQ ID NO: 1232755 - RNA, 20 nt, Mycobacterium leprae
gcugagaccgguccaccugc

SEQ ID NO: 1232756 - RNA, 22 nt, Mycobacterium leprae
gcucaucggcgacugggauaga

SEQ ID NO: 1232757 - RNA, 18 nt, Mycobacterium leprae
gcuccauugcguuugaug

SEQ ID NO: 1232758 - RNA, 23 nt, Mycobacterium leprae
gcuccauuuuucuugaaaaauaa

SEQ ID NO: 1232759 - RNA, 15 nt, Mycobacterium leprae
gcuccccgagccgcu

SEQ ID NO: 1232760 - RNA, 16 nt, Mycobacterium leprae
gcuccccgucggggaa

SEQ ID NO: 1232761 - RNA, 18 nt, Mycobacterium leprae
gcucccgggucgagcagc

SEQ ID NO: 1232762 - RNA, 22 nt, Mycobacterium leprae
gcucccgggucgagcagccacc

SEQ ID NO: 1232763 - RNA, 20 nt, Mycobacterium leprae
gcucacgauugcucugaggu

SEQ ID NO: 1232764 - RNA, 21 nt, Mycobacterium leprae
gcucaaccaugccgcgcgccu

SEQ ID NO: 1232765 - RNA, 19 nt, Mycobacterium leprae
gcucaacagaguuuggcca

SEQ ID NO: 1232766 - RNA, 14 nt, Mycobacterium leprae
gcucaaccgugcug

SEQ ID NO: 1232767 - RNA, 16 nt, Mycobacterium leprae
gcuaugacaagaccac

SEQ ID NO: 1232768 - RNA, 17 nt, Mycobacterium leprae
gcuauguccaacaaggu

SEQ ID NO: 1232769 - RNA, 19 nt, Mycobacterium leprae
gcuauucgggccaguuuca

SEQ ID NO: 1232770 - RNA, 11 nt, Mycobacterium leprae
gcuagcaucga

SEQ ID NO: 1232771 - RNA, 13 nt, Mycobacterium leprae
gcuagccagagac

SEQ ID NO: 1232772 - RNA, 12 nt, Mycobacterium leprae
gcuagcggcgcc

SEQ ID NO: 1232773 - RNA, 14 nt, Mycobacterium leprae
gcuagcgauucggg

SEQ ID NO: 1232774 - RNA, 13 nt, Mycobacterium leprae
gcuaguugccugg

SEQ ID NO: 1232775 - RNA, 16 nt, Mycobacterium leprae
gcuaguugccuggccu

SEQ ID NO: 1232776 - RNA, 13 nt, Mycobacterium leprae
gcuauccgcggug

SEQ ID NO: 1232777 - RNA, 14 nt, Mycobacterium leprae
gcgcaucgcgcagg

SEQ ID NO: 1232778 - RNA, 15 nt, Mycobacterium leprae
gcgcacagcucuccg

SEQ ID NO: 1232779 - RNA, 23 nt, Mycobacterium leprae
gcgcagugugcuuucggcucaag

SEQ ID NO: 1232780 - RNA, 15 nt, Mycobacterium leprae
gcgcaguugaccgga

SEQ ID NO: 1232781 - RNA, 16 nt, Mycobacterium leprae
gcgcaucagccaacac

SEQ ID NO: 1232782 - RNA, 15 nt, Mycobacterium leprae
gcgcauacacggcag

SEQ ID NO: 1232783 - RNA, 14 nt, Mycobacterium leprae
gcgagcaucuggcc

SEQ ID NO: 1232784 - RNA, 22 nt, Mycobacterium leprae
gcgaucuggauggccgccagca

SEQ ID NO: 1232785 - RNA, 14 nt, Mycobacterium leprae
gcgauauccgccgg

SEQ ID NO: 1232786 - RNA, 15 nt, Mycobacterium leprae
gcgaucaaacucgcu

SEQ ID NO: 1232787 - RNA, 15 nt, Mycobacterium leprae
gcgagugcuggucaa

SEQ ID NO: 1232788 - RNA, 19 nt, Mycobacterium leprae
gcgaguacguccgcgccgg

SEQ ID NO: 1232789 - RNA, 21 nt, Mycobacterium leprae
gcgaguacguccgcgccggcg

SEQ ID NO: 1232790 - RNA, 18 nt, Mycobacterium leprae
gcgaccgcacggcaagcc

SEQ ID NO: 1232791 - RNA, 12 nt, Mycobacterium leprae
gcgacgccaggc

SEQ ID NO: 1232792 - RNA, 13 nt, Mycobacterium leprae
gcgaccggccagu

SEQ ID NO: 1232793 - RNA, 19 nt, Mycobacterium leprae
gcgacagguaguagccgcu

SEQ ID NO: 1232794 - RNA, 17 nt, Mycobacterium leprae
gcgacaggcagcugcag

SEQ ID NO: 1232795 - RNA, 14 nt, Mycobacterium leprae
gcgaccaacgccga

SEQ ID NO: 1232796 - RNA, 18 nt, Mycobacterium leprae
gcgacaucucggucaggu

SEQ ID NO: 1232797 - RNA, 13 nt, Mycobacterium leprae
gcgaauggugcuc

SEQ ID NO: 1232798 - RNA, 20 nt, Mycobacterium leprae
gccuaaagcggcaagcagau

SEQ ID NO: 1232799 - RNA, 22 nt, Mycobacterium leprae
gcgaaacagggguccugaccgc

SEQ ID NO: 1232800 - RNA, 20 nt, Mycobacterium leprae
gcgaagaguuucugcugccg

SEQ ID NO: 1232801 - RNA, 13 nt, Mycobacterium leprae
gcggaggcugggc

SEQ ID NO: 1232802 - RNA, 16 nt, Mycobacterium leprae
gcggagcuugagcagc

SEQ ID NO: 1232803 - RNA, 19 nt, Mycobacterium leprae
gcggagcgcggagcuggug

SEQ ID NO: 1232804 - RNA, 13 nt, Mycobacterium leprae
gcggacuggcugu

SEQ ID NO: 1232805 - RNA, 19 nt, Mycobacterium leprae
gcggacucuccccacugca

SEQ ID NO: 1232806 - RNA, 15 nt, Mycobacterium leprae
gcggaccauggcgcu

SEQ ID NO: 1232807 - RNA, 20 nt, Mycobacterium leprae
gcggacgacgcugagaggcg

SEQ ID NO: 1232808 - RNA, 13 nt, Mycobacterium leprae
gcggaccguggug

SEQ ID NO: 1232809 - RNA, 18 nt, Mycobacterium leprae
gcggaugugucagcaccg

SEQ ID NO: 1232810 - RNA, 16 nt, Mycobacterium leprae
gcggcaaguagggugg

SEQ ID NO: 1232811 - RNA, 19 nt, Mycobacterium leprae
gcggcaaguaggguggguu

SEQ ID NO: 1232812 - RNA, 20 nt, Mycobacterium leprae
gcggcacagaccgaaaucaa

SEQ ID NO: 1232813 - RNA, 19 nt, Mycobacterium leprae
gcggaugguguaaggccag

SEQ ID NO: 1232814 - RNA, 23 nt, Mycobacterium leprae
gcggaaauaacgggcaugcagua

SEQ ID NO: 1232815 - RNA, 17 nt, Mycobacterium leprae
gcgcugggacaugaagc

SEQ ID NO: 1232816 - RNA, 20 nt, Mycobacterium leprae
gcgcugggacaugaagccgu

SEQ ID NO: 1232817 - RNA, 21 nt, Mycobacterium leprae
gcgcgguucuugccaaggucg

SEQ ID NO: 1232818 - RNA, 13 nt, Mycobacterium leprae
gcgcuggccacaa

SEQ ID NO: 1232819 - RNA, 15 nt, Mycobacterium leprae
gcgcuggccgcaagu

SEQ ID NO: 1232820 - RNA, 23 nt, Mycobacterium leprae
gcgcugaggaacgaauccucagc

SEQ ID NO: 1232821 - RNA, 19 nt, Mycobacterium leprae
gcgccuugcaagccacauc

SEQ ID NO: 1232822 - RNA, 19 nt, Mycobacterium leprae
gcgccugagcgggccagca

SEQ ID NO: 1232823 - RNA, 19 nt, Mycobacterium leprae
gcgccucgucggccagcac

SEQ ID NO: 1232824 - RNA, 20 nt, Mycobacterium leprae
gcgccucgucggccagcacu

SEQ ID NO: 1232825 - RNA, 24 nt, Mycobacterium leprae
gcgccugaagguuaucgacacggc

SEQ ID NO: 1232826 - RNA, 23 nt, Mycobacterium leprae
gcgccggcuaucuugcggauuug

SEQ ID NO: 1232827 - RNA, 18 nt, Mycobacterium leprae
ggcaucgucggcaaauuu

SEQ ID NO: 1232828 - RNA, 17 nt, Mycobacterium leprae
ggcaucgccgugguggc

SEQ ID NO: 1232829 - RNA, 13 nt, Mycobacterium leprae
ggcaugggccggu

SEQ ID NO: 1232830 - RNA, 20 nt, Mycobacterium leprae
ggcagcuaagaagcugcccu

SEQ ID NO: 1232831 - RNA, 16 nt, Mycobacterium leprae
ggcagcuacagcgggc

SEQ ID NO: 1232832 - RNA, 20 nt, Mycobacterium leprae
ggcagccgucgaagcccugc

SEQ ID NO: 1232833 - RNA, 12 nt, Mycobacterium leprae
ggcagcugggua

SEQ ID NO: 1232834 - RNA, 20 nt, Mycobacterium leprae
ggcagcugccauuggccgcu

SEQ ID NO: 1232835 - RNA, 16 nt, Mycobacterium leprae
ggcaggaucugcuugg

SEQ ID NO: 1232836 - RNA, 19 nt, Mycobacterium leprae
ggcagcaggaucacgugug

SEQ ID NO: 1232837 - RNA, 15 nt, Mycobacterium leprae
ggcagacgugcuacu

SEQ ID NO: 1232838 - RNA, 17 nt, Mycobacterium leprae
ggcaccagauggcuccc

SEQ ID NO: 1232839 - RNA, 18 nt, Mycobacterium leprae
ggcacacgaggcaggacu

SEQ ID NO: 1232840 - RNA, 15 nt, Mycobacterium leprae
ggcacaccguguccg

SEQ ID NO: 1232841 - RNA, 13 nt, Mycobacterium leprae
ggcacgaagugcg

SEQ ID NO: 1232842 - RNA, 19 nt, Mycobacterium leprae
ggcaccgcgguaggccagg

SEQ ID NO: 1232843 - RNA, 20 nt, Mycobacterium leprae
ggcaccgcgguaggccaggu

SEQ ID NO: 1232844 - RNA, 22 nt, Mycobacterium leprae
ggcacgagggcggugccccggg

SEQ ID NO: 1232845 - RNA, 20 nt, Mycobacterium leprae
ggcacguucgaucggcagcc

SEQ ID NO: 1232846 - RNA, 15 nt, Mycobacterium leprae
ggccagagcugcgac

SEQ ID NO: 1232847 - RNA, 21 nt, Mycobacterium leprae
ggccaugcagucgcucaggcu

SEQ ID NO: 1232848 - RNA, 20 nt, Mycobacterium leprae
ggccaguuagugccaguucc

SEQ ID NO: 1232849 - RNA, 12 nt, Mycobacterium leprae
ggccagcgcggc

SEQ ID NO: 1232850 - RNA, 22 nt, Mycobacterium leprae
ggccagggggcgucaaguccag

SEQ ID NO: 1232851 - RNA, 19 nt, Mycobacterium leprae
ggcccauacgcgccggcua

SEQ ID NO: 1232852 - RNA, 18 nt, Mycobacterium leprae
ggcccagcaccacugcgg

SEQ ID NO: 1232853 - RNA, 22 nt, Mycobacterium leprae
ggccccgcaucuucgcccagca

SEQ ID NO: 1232854 - RNA, 22 nt, Mycobacterium leprae
ggccgcaacacacccuccugca

SEQ ID NO: 1232855 - RNA, 19 nt, Mycobacterium leprae
ggcccgcgucgccuuagcc

SEQ ID NO: 1232856 - RNA, 16 nt, Mycobacterium leprae
ggcccucgcgcggggc

SEQ ID NO: 1232857 - RNA, 19 nt, Mycobacterium leprae
ggcccucagccagcaagca

SEQ ID NO: 1232858 - RNA, 21 nt, Mycobacterium leprae
ggaugcugcuuggucuacaug

SEQ ID NO: 1232859 - RNA, 16 nt, Mycobacterium leprae
ggaugcugggucagca

SEQ ID NO: 1232860 - RNA, 20 nt, Mycobacterium leprae
ggauguaaucguaccaacac

SEQ ID NO: 1232861 - RNA, 11 nt, Mycobacterium leprae
ggaugugugca

SEQ ID NO: 1232862 - RNA, 20 nt, Mycobacterium leprae
ggaucguuugaggaagaacg

SEQ ID NO: 1232863 - RNA, 21 nt, Mycobacterium leprae
ggaucgguaccagcggcagcg

SEQ ID NO: 1232864 - RNA, 14 nt, Mycobacterium leprae
ggauaccggggguc

SEQ ID NO: 1232865 - RNA, 16 nt, Mycobacterium leprae
ggaucaucgaugcacu

SEQ ID NO: 1232866 - RNA, 18 nt, Mycobacterium leprae
ggaucaguuugccgucgg

SEQ ID NO: 1232867 - RNA, 22 nt, Mycobacterium leprae
ggaucccaccggcggcuggugc

SEQ ID NO: 1232868 - RNA, 15 nt, Mycobacterium leprae
ggaggugcuggaugc

SEQ ID NO: 1232869 - RNA, 15 nt, Mycobacterium leprae
ggaguugaccaggca

SEQ ID NO: 1232870 - RNA, 15 nt, Mycobacterium leprae
ggaggcguugcacug

SEQ ID NO: 1232871 - RNA, 22 nt, Mycobacterium leprae
ggagcuguuggguuuggucaau

SEQ ID NO: 1232872 - RNA, 17 nt, Mycobacterium leprae
ggagcugggcgaaaaca

SEQ ID NO: 1232873 - RNA, 13 nt, Mycobacterium leprae
ggagcgugggucg

SEQ ID NO: 1232874 - RNA, 16 nt, Mycobacterium leprae
ggagccagggcagccu

SEQ ID NO: 1232875 - RNA, 20 nt, Mycobacterium leprae
ggacggcaccuacaacuuca

SEQ ID NO: 1232876 - RNA, 20 nt, Mycobacterium leprae
ggacggcccagcaccacugc

SEQ ID NO: 1232877 - RNA, 20 nt, Mycobacterium leprae
ggagaauguuguuagugcug

SEQ ID NO: 1232878 - RNA, 14 nt, Mycobacterium leprae
ggacucccuucgcc

SEQ ID NO: 1232879 - RNA, 14 nt, Mycobacterium leprae
ggagagcagaugga

SEQ ID NO: 1232880 - RNA, 15 nt, Mycobacterium leprae
ggagagcagauggaa

SEQ ID NO: 1232881 - RNA, 19 nt, Mycobacterium leprae
ggagagcagauggaaggcg

SEQ ID NO: 1232882 - RNA, 17 nt, Mycobacterium leprae
ggagaggaucagcgcug

SEQ ID NO: 1232883 - RNA, 19 nt, Mycobacterium leprae
ggagagcgccgcuaaacgg

SEQ ID NO: 1232884 - RNA, 19 nt, Mycobacterium leprae
ggacacaaccagcuuggga

SEQ ID NO: 1232885 - RNA, 15 nt, Mycobacterium leprae
ggacacuacagcgug

SEQ ID NO: 1232886 - RNA, 18 nt, Mycobacterium leprae
ggacacgagcggccucag

SEQ ID NO: 1232887 - RNA, 17 nt, Mycobacterium leprae
ggacacgauuagcgcgg

SEQ ID NO: 1232888 - RNA, 22 nt, Mycobacterium leprae
ggaauucagagcugcaggucag

SEQ ID NO: 1232889 - RNA, 12 nt, Mycobacterium leprae
ggaauuuacccg

SEQ ID NO: 1232890 - RNA, 18 nt, Mycobacterium leprae
ggaaggaucgagcggagc

SEQ ID NO: 1232891 - RNA, 23 nt, Mycobacterium leprae
ggaauauuuuuaaggucaucuac

SEQ ID NO: 1232892 - RNA, 12 nt, Mycobacterium leprae
ggaauggcggca

SEQ ID NO: 1232893 - RNA, 20 nt, Mycobacterium leprae
ggaacgucuuuauuagcaug

SEQ ID NO: 1232894 - RNA, 18 nt, Mycobacterium leprae
ggaagaaauacccaccca

SEQ ID NO: 1232895 - RNA, 21 nt, Mycobacterium leprae
ggaacgauaugagcuccacug

SEQ ID NO: 1232896 - RNA, 15 nt, Mycobacterium leprae
ggaacgacuugacca

SEQ ID NO: 1232897 - RNA, 18 nt, Mycobacterium leprae
ggaaccuggaccgaccag

SEQ ID NO: 1232898 - RNA, 17 nt, Mycobacterium leprae
ggaacauagccagcauc

SEQ ID NO: 1232899 - RNA, 19 nt, Mycobacterium leprae
ggaaagcaauacuggcagu

SEQ ID NO: 1232900 - RNA, 22 nt, Mycobacterium leprae
ggaaaccuucgauuccagcuga

SEQ ID NO: 1232901 - RNA, 15 nt, Mycobacterium leprae
ggaaacacagcaagc

SEQ ID NO: 1232902 - RNA, 21 nt, Mycobacterium leprae
ggaaaacugccgguagccugg

SEQ ID NO: 1232903 - RNA, 17 nt, Mycobacterium leprae
gcuuugcaaagcagaau

SEQ ID NO: 1232904 - RNA, 22 nt, Mycobacterium leprae
gcuuucaguuggaucuagcaag

SEQ ID NO: 1232905 - RNA, 21 nt, Mycobacterium leprae
gcuuuccgcgccccuuccuga

SEQ ID NO: 1232906 - RNA, 14 nt, Mycobacterium leprae
gcuuugcuggcaag

SEQ ID NO: 1232907 - RNA, 21 nt, Mycobacterium leprae
gcuuugggaucuuuugaccag

SEQ ID NO: 1232908 - RNA, 19 nt, Mycobacterium leprae
gcuuuggggguugcacuga

SEQ ID NO: 1232909 - RNA, 15 nt, Mycobacterium leprae
gcuuguugccgccgg

SEQ ID NO: 1232910 - RNA, 18 nt, Mycobacterium leprae
gcuuguugccgccgggac

SEQ ID NO: 1232911 - RNA, 19 nt, Mycobacterium leprae
gcuuguugccgccgggacg

SEQ ID NO: 1232912 - RNA, 17 nt, Mycobacterium leprae
gcuuggucuacauguug

SEQ ID NO: 1232913 - RNA, 15 nt, Mycobacterium leprae
gcuuguaaggccagc

SEQ ID NO: 1232914 - RNA, 19 nt, Mycobacterium leprae
gcuugugaucguggcaccg

SEQ ID NO: 1232915 - RNA, 20 nt, Mycobacterium leprae
gcuugauacagacccagcua

SEQ ID NO: 1232916 - RNA, 20 nt, Mycobacterium leprae
gcuuccgauuguccaugcca

SEQ ID NO: 1232917 - RNA, 18 nt, Mycobacterium leprae
gcuucgccacugaccuau

SEQ ID NO: 1232918 - RNA, 21 nt, Mycobacterium leprae
gcuucgguuuuggcggugcca

SEQ ID NO: 1232919 - RNA, 20 nt, Mycobacterium leprae
gcuucguugcaaaucaccag

SEQ ID NO: 1232920 - RNA, 23 nt, Mycobacterium leprae
gcuucuccagucccgcgcuguug

SEQ ID NO: 1232921 - RNA, 14 nt, Mycobacterium leprae
gcuugaaacccgga

SEQ ID NO: 1232922 - RNA, 15 nt, Mycobacterium leprae
gcuucacuuagccau

SEQ ID NO: 1232923 - RNA, 23 nt, Mycobacterium leprae
gcuucaucguagcgcacaucgau

SEQ ID NO: 1232924 - RNA, 21 nt, Mycobacterium leprae
gcuuccaaaacuuacuucugu

SEQ ID NO: 1232925 - RNA, 19 nt, Mycobacterium leprae
gcuuagccaucucuauuug

SEQ ID NO: 1232926 - RNA, 17 nt, Mycobacterium leprae
gcuuaauguagcaugua

SEQ ID NO: 1232927 - RNA, 19 nt, Mycobacterium leprae
gcuggcucggucacuccac

SEQ ID NO: 1232928 - RNA, 22 nt, Mycobacterium leprae
gcuggcuaauggcgggcuggag

SEQ ID NO: 1232929 - RNA, 16 nt, Mycobacterium leprae
gcugggcaccugggcu

SEQ ID NO: 1232930 - RNA, 20 nt, Mycobacterium leprae
gcugggcaccugggcugugc

SEQ ID NO: 1232931 - RNA, 17 nt, Mycobacterium leprae
gcugggcaagcccggau

SEQ ID NO: 1232932 - RNA, 17 nt, Mycobacterium leprae
gcugggugagcugugcc

SEQ ID NO: 1232933 - RNA, 18 nt, Mycobacterium leprae
gcugggugagcugugccg

SEQ ID NO: 1232934 - RNA, 12 nt, Mycobacterium leprae
gcuggggcaagu

SEQ ID NO: 1232935 - RNA, 17 nt, Mycobacterium leprae
gcuggucaagcugggcu

SEQ ID NO: 1232936 - RNA, 22 nt, Mycobacterium leprae
gcuggcgcagaccucuuccgcc

SEQ ID NO: 1232937 - RNA, 22 nt, Mycobacterium leprae
gcuggcgucguuuuggcgcguc

SEQ ID NO: 1232938 - RNA, 15 nt, Mycobacterium leprae
gcuggcggugggugc

SEQ ID NO: 1232939 - RNA, 15 nt, Mycobacterium leprae
gcuggccuguucaug

SEQ ID NO: 1232940 - RNA, 17 nt, Mycobacterium leprae
gcuggcaguggcaacug

SEQ ID NO: 1232941 - RNA, 18 nt, Mycobacterium leprae
gcugugccgacaccaucc

SEQ ID NO: 1232942 - RNA, 15 nt, Mycobacterium leprae
gcugugaugcugugg

SEQ ID NO: 1232943 - RNA, 19 nt, Mycobacterium leprae
gcugugcaaauacgcgcgc

SEQ ID NO: 1232944 - RNA, 19 nt, Mycobacterium leprae
gcugucguguuugugucug

SEQ ID NO: 1232945 - RNA, 14 nt, Mycobacterium leprae
gcugucgggcaccu

SEQ ID NO: 1232946 - RNA, 19 nt, Mycobacterium leprae
gcuguguugcgggguuuuu

SEQ ID NO: 1232947 - RNA, 15 nt, Mycobacterium leprae
gcuguguugugggug

SEQ ID NO: 1232948 - RNA, 18 nt, Mycobacterium leprae
gcuguguuugcuggucag

SEQ ID NO: 1232949 - RNA, 19 nt, Mycobacterium leprae
gcuguguuugcuggucagg

SEQ ID NO: 1232950 - RNA, 14 nt, Mycobacterium leprae
gcuguuguaagcac

SEQ ID NO: 1232951 - RNA, 18 nt, Mycobacterium leprae
gcuguuguaagcacugca

SEQ ID NO: 1232952 - RNA, 19 nt, Mycobacterium leprae
gcuguuuuggucauggcga

SEQ ID NO: 1232953 - RNA, 17 nt, Mycobacterium leprae
gcugguggaguacuggg

SEQ ID NO: 1232954 - RNA, 22 nt, Mycobacterium leprae
gcuggugccccagucgccagag

SEQ ID NO: 1232955 - RNA, 12 nt, Mycobacterium leprae
gcuggugcuggc

SEQ ID NO: 1232956 - RNA, 20 nt, Mycobacterium leprae
gcugguuugguuuggguggu

SEQ ID NO: 1232957 - RNA, 15 nt, Mycobacterium leprae
gcuguauaacaaauc

SEQ ID NO: 1232958 - RNA, 13 nt, Mycobacterium leprae
gcugucagagugc

SEQ ID NO: 1232959 - RNA, 16 nt, Mycobacterium leprae
gcugucagagugcaga

SEQ ID NO: 1232960 - RNA, 18 nt, Mycobacterium leprae
gcugucccgggggccagc

SEQ ID NO: 1232961 - RNA, 22 nt, Mycobacterium leprae
gcugcuaacaacgaccagcgcu

SEQ ID NO: 1232962 - RNA, 17 nt, Mycobacterium leprae
gcugcuacccacuggug

SEQ ID NO: 1232963 - RNA, 15 nt, Mycobacterium leprae
gcugcucgagcagcc

SEQ ID NO: 1232964 - RNA, 16 nt, Mycobacterium leprae
gcugcucgagcagccg

SEQ ID NO: 1232965 - RNA, 17 nt, Mycobacterium leprae
gcugcucgagcagccga

SEQ ID NO: 1232966 - RNA, 18 nt, Mycobacterium leprae
gcugcgcagagcgcugug

SEQ ID NO: 1232967 - RNA, 12 nt, Mycobacterium leprae
gcugcgcggcug

SEQ ID NO: 1232968 - RNA, 16 nt, Mycobacterium leprae
gcugcugagcguggcu

SEQ ID NO: 1232969 - RNA, 18 nt, Mycobacterium leprae
gcugcugcggaucggugc

SEQ ID NO: 1232970 - RNA, 18 nt, Mycobacterium leprae
gcugcuuacucgcgccgu

SEQ ID NO: 1232971 - RNA, 23 nt, Mycobacterium leprae
gcuggagagaucgccugguucac

SEQ ID NO: 1232972 - RNA, 14 nt, Mycobacterium leprae
gcuggaauccccca

SEQ ID NO: 1232973 - RNA, 22 nt, Mycobacterium leprae
gcuggaucggugcuaugguucu

SEQ ID NO: 1232974 - RNA, 15 nt, Mycobacterium leprae
gcugcauccgcagca

SEQ ID NO: 1232975 - RNA, 20 nt, Mycobacterium leprae
gcugcauccgcagcacuaaa

SEQ ID NO: 1232976 - RNA, 13 nt, Mycobacterium leprae
gcugcaucggcag

SEQ ID NO: 1232977 - RNA, 13 nt, Mycobacterium leprae
gcugccaaccggu

SEQ ID NO: 1232978 - RNA, 13 nt, Mycobacterium leprae
gcugccagggcuc

SEQ ID NO: 1232979 - RNA, 19 nt, Mycobacterium leprae
gcugcauccgacaaagcag

SEQ ID NO: 1232980 - RNA, 23 nt, Mycobacterium leprae
gcugcagugcuacgaaggggucg

SEQ ID NO: 1232981 - RNA, 20 nt, Mycobacterium leprae
gcugcacauucaaccagcca

SEQ ID NO: 1232982 - RNA, 14 nt, Mycobacterium leprae
gcugcaaugccgga

SEQ ID NO: 1232983 - RNA, 14 nt, Mycobacterium leprae
gcugcacgaaaaga

SEQ ID NO: 1232984 - RNA, 18 nt, Mycobacterium leprae
gcugcacgaaaagaaacg

SEQ ID NO: 1232985 - RNA, 21 nt, Mycobacterium leprae
gcugcgaguucguuccuggcu

SEQ ID NO: 1232986 - RNA, 16 nt, Mycobacterium leprae
gcugcgacaacaccuu

SEQ ID NO: 1232987 - RNA, 24 nt, Mycobacterium leprae
gcugccggugaccgggccggccgc

SEQ ID NO: 1232988 - RNA, 14 nt, Mycobacterium leprae
gcugccgugugcuu

SEQ ID NO: 1232989 - RNA, 22 nt, Mycobacterium leprae
gcugcccgucacuacguuggcc

SEQ ID NO: 1232990 - RNA, 17 nt, Mycobacterium leprae
gcugccauuggccgcug

SEQ ID NO: 1232991 - RNA, 18 nt, Mycobacterium leprae
uacaguguuuggcuuguc

SEQ ID NO: 1232992 - RNA, 14 nt, Mycobacterium leprae
uacagcgugaacca

SEQ ID NO: 1232993 - RNA, 13 nt, Mycobacterium leprae
uacacuauuuccc

SEQ ID NO: 1232994 - RNA, 20 nt, Mycobacterium leprae
uacagcaguguucaggccau

SEQ ID NO: 1232995 - RNA, 23 nt, Mycobacterium leprae
uacacccgauccggggccggcua

SEQ ID NO: 1232996 - RNA, 17 nt, Mycobacterium leprae
uacaacuucaaccaagc

SEQ ID NO: 1232997 - RNA, 17 nt, Mycobacterium leprae
uaaugccgguggccagc

SEQ ID NO: 1232998 - RNA, 22 nt, Mycobacterium leprae
uaaugccaagcaguuccugugu

SEQ ID NO: 1232999 - RNA, 16 nt, Mycobacterium leprae
uaauggcgggcuggag

SEQ ID NO: 1233000 - RNA, 16 nt, Mycobacterium leprae
uaauggccggcgccug

SEQ ID NO: 1233001 - RNA, 17 nt, Mycobacterium leprae
uaauuacaucggcccac

SEQ ID NO: 1233002 - RNA, 15 nt, Mycobacterium leprae
uaauccguauugguu

SEQ ID NO: 1233003 - RNA, 14 nt, Mycobacterium leprae
uaacgugcagcugg

SEQ ID NO: 1233004 - RNA, 20 nt, Mycobacterium leprae
uaacguucggugacgaacau

SEQ ID NO: 1233005 - RNA, 14 nt, Mycobacterium leprae
uaauauauauauag

SEQ ID NO: 1233006 - RNA, 16 nt, Mycobacterium leprae
uacuuggcagugugca

SEQ ID NO: 1233007 - RNA, 22 nt, Mycobacterium leprae
uacuuugugugcauguucuguu

SEQ ID NO: 1233008 - RNA, 14 nt, Mycobacterium leprae
uacuguugucagug

SEQ ID NO: 1233009 - RNA, 18 nt, Mycobacterium leprae
uacuggcacgccagcugg

SEQ ID NO: 1233010 - RNA, 21 nt, Mycobacterium leprae
uacugcgacagcagccacuga

SEQ ID NO: 1233011 - RNA, 22 nt, Mycobacterium leprae
uacucuagcuggucccacagcc

SEQ ID NO: 1233012 - RNA, 22 nt, Mycobacterium leprae
uacucgcgcagcaaucaaugug

SEQ ID NO: 1233013 - RNA, 18 nt, Mycobacterium leprae
uacucagcgguaaauacu

SEQ ID NO: 1233014 - RNA, 14 nt, Mycobacterium leprae
uacucaaugcuguu

SEQ ID NO: 1233015 - RNA, 14 nt, Mycobacterium leprae
uacccgacacaaag

SEQ ID NO: 1233016 - RNA, 20 nt, Mycobacterium leprae
uaccggcguucgauaagaag

SEQ ID NO: 1233017 - RNA, 13 nt, Mycobacterium leprae
uaccagccagacc

SEQ ID NO: 1233018 - RNA, 20 nt, Mycobacterium leprae
uaccagccagaccaacauga

SEQ ID NO: 1233019 - RNA, 22 nt, Mycobacterium leprae
uacgacaaaauuuucaggcugu

SEQ ID NO: 1233020 - RNA, 14 nt, Mycobacterium leprae
uacggagccagugg

SEQ ID NO: 1233021 - RNA, 22 nt, Mycobacterium leprae
uacggagauagacaugugugcu

SEQ ID NO: 1233022 - RNA, 19 nt, Mycobacterium leprae
uacggcguaucgcugugca

SEQ ID NO: 1233023 - RNA, 17 nt, Mycobacterium leprae
uacggcgguguuucucg

SEQ ID NO: 1233024 - RNA, 19 nt, Mycobacterium leprae
uacgcguacuccagcagcg

SEQ ID NO: 1233025 - RNA, 23 nt, Mycobacterium leprae
uacgcuaaucgcgggcaagcccu

SEQ ID NO: 1233026 - RNA, 16 nt, Mycobacterium leprae
uagguguagcagcugc

SEQ ID NO: 1233027 - RNA, 17 nt, Mycobacterium leprae
uagguguagcagcugca

SEQ ID NO: 1233028 - RNA, 22 nt, Mycobacterium leprae
uaggcugucugcggauuuugcc

SEQ ID NO: 1233029 - RNA, 13 nt, Mycobacterium leprae
uaggcuguuguca

SEQ ID NO: 1233030 - RNA, 20 nt, Mycobacterium leprae
uaggucugaccuaucaaucc

SEQ ID NO: 1233031 - RNA, 18 nt, Mycobacterium leprae
uaguccgcagaaugugcu

SEQ ID NO: 1233032 - RNA, 20 nt, Mycobacterium leprae
uagucgcccggaauuuaccc

SEQ ID NO: 1233033 - RNA, 14 nt, Mycobacterium leprae
uagucauguuguug

SEQ ID NO: 1233034 - RNA, 15 nt, Mycobacterium leprae
uagucacuauauaua

SEQ ID NO: 1233035 - RNA, 16 nt, Mycobacterium leprae
uagucagcggacugcu

SEQ ID NO: 1233036 - RNA, 21 nt, Mycobacterium leprae
uagucaccgccgaagagcugc

SEQ ID NO: 1233037 - RNA, 13 nt, Mycobacterium leprae
uauaacaaaucau

SEQ ID NO: 1233038 - RNA, 15 nt, Mycobacterium leprae
uauaacaaaucauag

SEQ ID NO: 1233039 - RNA, 13 nt, Mycobacterium leprae
uagcuagccgacg

SEQ ID NO: 1233040 - RNA, 15 nt, Mycobacterium leprae
uaggacaacagagca

SEQ ID NO: 1233041 - RNA, 16 nt, Mycobacterium leprae
uaggacaacagagcac

SEQ ID NO: 1233042 - RNA, 21 nt, Mycobacterium leprae
uaggauuucgcuaaguccucc

SEQ ID NO: 1233043 - RNA, 18 nt, Mycobacterium leprae
uaggcaccacgcacacga

SEQ ID NO: 1233044 - RNA, 20 nt, Mycobacterium leprae
uagcgccgggguguggcacg

SEQ ID NO: 1233045 - RNA, 14 nt, Mycobacterium leprae
uagcgccgagcacu

SEQ ID NO: 1233046 - RNA, 18 nt, Mycobacterium leprae
uagcgucggcggucagga

SEQ ID NO: 1233047 - RNA, 16 nt, Mycobacterium leprae
uagcgucccagcucca

SEQ ID NO: 1233048 - RNA, 21 nt, Mycobacterium leprae
uagcgucccagcuccagaacg

SEQ ID NO: 1233049 - RNA, 23 nt, Mycobacterium leprae
uagcaggucgccgaggcgacuga

SEQ ID NO: 1233050 - RNA, 18 nt, Mycobacterium leprae
uagcccgccgcggcgggc

SEQ ID NO: 1233051 - RNA, 22 nt, Mycobacterium leprae
uagcaacagcaagcgagccauc

SEQ ID NO: 1233052 - RNA, 14 nt, Mycobacterium leprae
uagcaagccgccag

SEQ ID NO: 1233053 - RNA, 17 nt, Mycobacterium leprae
uagcagaguaaccacuu

SEQ ID NO: 1233054 - RNA, 19 nt, Mycobacterium leprae
uagcaacguguaaggccag

SEQ ID NO: 1233055 - RNA, 20 nt, Mycobacterium leprae
uagcaacguguaaggccagc

SEQ ID NO: 1233056 - RNA, 16 nt, Mycobacterium leprae
uagauguuaauuuauu

SEQ ID NO: 1233057 - RNA, 16 nt, Mycobacterium leprae
uaucgucaaauuuucc

SEQ ID NO: 1233058 - RNA, 20 nt, Mycobacterium leprae
uaucguggcagcuguauaac

SEQ ID NO: 1233059 - RNA, 13 nt, Mycobacterium leprae
uaucucaaucacc

SEQ ID NO: 1233060 - RNA, 22 nt, Mycobacterium leprae
uaucggacacgagcggccucag

SEQ ID NO: 1233061 - RNA, 15 nt, Mycobacterium leprae
uaucgccgguggcua

SEQ ID NO: 1233062 - RNA, 18 nt, Mycobacterium leprae
uaucgccgguggcuauac

SEQ ID NO: 1233063 - RNA, 21 nt, Mycobacterium leprae
uauccucacacucacgccugc

SEQ ID NO: 1233064 - RNA, 14 nt, Mycobacterium leprae
uauccaaggugaug

SEQ ID NO: 1233065 - RNA, 17 nt, Mycobacterium leprae
uauccaaagaaguuugu

SEQ ID NO: 1233066 - RNA, 21 nt, Mycobacterium leprae
uaucagacguugggagcaucu

SEQ ID NO: 1233067 - RNA, 21 nt, Mycobacterium leprae
uauaaucccacucuugacuaa

SEQ ID NO: 1233068 - RNA, 16 nt, Mycobacterium leprae
uauagugacuacgguu

SEQ ID NO: 1233069 - RNA, 15 nt, Mycobacterium leprae
uauauauuaauucuu

SEQ ID NO: 1233070 - RNA, 21 nt, Mycobacterium leprae
uauauauuaauucuucucuaa

SEQ ID NO: 1233071 - RNA, 14 nt, Mycobacterium leprae
uauggcgcugaggu

SEQ ID NO: 1233072 - RNA, 15 nt, Mycobacterium leprae
uauggcuccauagaa

SEQ ID NO: 1233073 - RNA, 22 nt, Mycobacterium leprae
uaugggaccgggcguuucccua

SEQ ID NO: 1233074 - RNA, 23 nt, Mycobacterium leprae
uauggccgaacgugagcgacagc

SEQ ID NO: 1233075 - RNA, 16 nt, Mycobacterium leprae
uaugcccagcagaugg

SEQ ID NO: 1233076 - RNA, 14 nt, Mycobacterium leprae
uaugccguuccuga

SEQ ID NO: 1233077 - RNA, 13 nt, Mycobacterium leprae
uaugguagucagu

SEQ ID NO: 1233078 - RNA, 15 nt, Mycobacterium leprae
uauguccaacaaggu

SEQ ID NO: 1233079 - RNA, 21 nt, Mycobacterium leprae
uaugugccgccgacggccgga

SEQ ID NO: 1233080 - RNA, 15 nt, Mycobacterium leprae
uaugauggcguucgu

SEQ ID NO: 1233081 - RNA, 22 nt, Mycobacterium leprae
uaugagcaaaaauccgcugcgu

SEQ ID NO: 1233082 - RNA, 15 nt, Mycobacterium leprae
ucagccacauccucg

SEQ ID NO: 1233083 - RNA, 18 nt, Mycobacterium leprae
ucagccacauccucggua

SEQ ID NO: 1233084 - RNA, 13 nt, Mycobacterium leprae
ucagccacacucg

SEQ ID NO: 1233085 - RNA, 14 nt, Mycobacterium leprae
ucagccaaaaugaa

SEQ ID NO: 1233086 - RNA, 15 nt, Mycobacterium leprae
ucagcaucagacaga

SEQ ID NO: 1233087 - RNA, 21 nt, Mycobacterium leprae
ucagcauggcgaugcgcagcc

SEQ ID NO: 1233088 - RNA, 23 nt, Mycobacterium leprae
ucagccagggucacaaaccccuc

SEQ ID NO: 1233089 - RNA, 13 nt, Mycobacterium leprae
ucagccgugccca

SEQ ID NO: 1233090 - RNA, 19 nt, Mycobacterium leprae
ucagccgggcuaaggugcg

SEQ ID NO: 1233091 - RNA, 19 nt, Mycobacterium leprae
ucagcgaagaguuucugcu

SEQ ID NO: 1233092 - RNA, 23 nt, Mycobacterium leprae
ucagcgaagaguuucugcugccg

SEQ ID NO: 1233093 - RNA, 17 nt, Mycobacterium leprae
ucagcaaugcucugcug

SEQ ID NO: 1233094 - RNA, 11 nt, Mycobacterium leprae
ucagcacagcc

SEQ ID NO: 1233095 - RNA, 21 nt, Mycobacterium leprae
ucagcaggaaucccagcagcu

SEQ ID NO: 1233096 - RNA, 16 nt, Mycobacterium leprae
ucagagugcagaucac

SEQ ID NO: 1233097 - RNA, 18 nt, Mycobacterium leprae
ucagauauccuaggccac

SEQ ID NO: 1233098 - RNA, 23 nt, Mycobacterium leprae
ucagauccgguggcgacaguguu

SEQ ID NO: 1233099 - RNA, 16 nt, Mycobacterium leprae
ucagaucaaccaaaug

SEQ ID NO: 1233100 - RNA, 16 nt, Mycobacterium leprae
ucagacgccggggaac

SEQ ID NO: 1233101 - RNA, 19 nt, Mycobacterium leprae
ucagacugcccagacucag

SEQ ID NO: 1233102 - RNA, 11 nt, Mycobacterium leprae
ucagacuggau

SEQ ID NO: 1233103 - RNA, 23 nt, Mycobacterium leprae
ucagacuggauggcgaucgccuu

SEQ ID NO: 1233104 - RNA, 19 nt, Mycobacterium leprae
ucagaagcacgacacuagc

SEQ ID NO: 1233105 - RNA, 17 nt, Mycobacterium leprae
ucacguugucgaaaaau

SEQ ID NO: 1233106 - RNA, 19 nt, Mycobacterium leprae
ucacuucagcgacaggcag

SEQ ID NO: 1233107 - RNA, 12 nt, Mycobacterium leprae
ucacuuagccau

SEQ ID NO: 1233108 - RNA, 22 nt, Mycobacterium leprae
ucacugugucuuuacauuuuga

SEQ ID NO: 1233109 - RNA, 15 nt, Mycobacterium leprae
ucacgaacaacagag

SEQ ID NO: 1233110 - RNA, 17 nt, Mycobacterium leprae
ucacgcagucauccacu

SEQ ID NO: 1233111 - RNA, 19 nt, Mycobacterium leprae
ucacgguugcuuccaaccc

SEQ ID NO: 1233112 - RNA, 14 nt, Mycobacterium leprae
ucacggccaccaua

SEQ ID NO: 1233113 - RNA, 14 nt, Mycobacterium leprae
ucacgcgcagugca

SEQ ID NO: 1233114 - RNA, 17 nt, Mycobacterium leprae
ucaccacuuuggcaacg

SEQ ID NO: 1233115 - RNA, 11 nt, Mycobacterium leprae
ucaccagcaag

SEQ ID NO: 1233116 - RNA, 10 nt, Mycobacterium leprae
ucaccccaga

SEQ ID NO: 1233117 - RNA, 22 nt, Mycobacterium leprae
ucaccgccuacauccuggcguu

SEQ ID NO: 1233118 - RNA, 21 nt, Mycobacterium leprae
ucacccgcgauagcuugcagu

SEQ ID NO: 1233119 - RNA, 15 nt, Mycobacterium leprae
ucacccgcagcaccu

SEQ ID NO: 1233120 - RNA, 20 nt, Mycobacterium leprae
ucacccgcagcaccuugggc

SEQ ID NO: 1233121 - RNA, 19 nt, Mycobacterium leprae
ucaccaaguuggugucaac

SEQ ID NO: 1233122 - RNA, 17 nt, Mycobacterium leprae
ucaccaauagccgacca

SEQ ID NO: 1233123 - RNA, 22 nt, Mycobacterium leprae
ucacaugucccggugcugccug

SEQ ID NO: 1233124 - RNA, 17 nt, Mycobacterium leprae
ucacaucucaacaugga

SEQ ID NO: 1233125 - RNA, 23 nt, Mycobacterium leprae
ucacaucgauuuguaaaauuccu

SEQ ID NO: 1233126 - RNA, 17 nt, Mycobacterium leprae
ucacaucagugcugugg

SEQ ID NO: 1233127 - RNA, 19 nt, Mycobacterium leprae
ucacaaccaucgcuggcua

SEQ ID NO: 1233128 - RNA, 14 nt, Mycobacterium leprae
ucacacccgcacag

SEQ ID NO: 1233129 - RNA, 23 nt, Mycobacterium leprae
ucacagagcugugucaaugacaa

SEQ ID NO: 1233130 - RNA, 22 nt, Mycobacterium leprae
ucaauccugcguagcaaggugu

SEQ ID NO: 1233131 - RNA, 23 nt, Mycobacterium leprae
ucaaugggugcucgcacugcguu

SEQ ID NO: 1233132 - RNA, 15 nt, Mycobacterium leprae
ucacaaaccccucgu

SEQ ID NO: 1233133 - RNA, 22 nt, Mycobacterium leprae
ucacaaaccccucgucagguga

SEQ ID NO: 1233134 - RNA, 14 nt, Mycobacterium leprae
ucaaggugucgucg

SEQ ID NO: 1233135 - RNA, 21 nt, Mycobacterium leprae
ucaaggccaauccgcagucgg

SEQ ID NO: 1233136 - RNA, 19 nt, Mycobacterium leprae
ucaagucugaaggcaaaau

SEQ ID NO: 1233137 - RNA, 22 nt, Mycobacterium leprae
ucaagucacaccacuaccccga

SEQ ID NO: 1233138 - RNA, 15 nt, Mycobacterium leprae
ucaaagcccuucacu

SEQ ID NO: 1233139 - RNA, 19 nt, Mycobacterium leprae
ucaaagcccuucacuuccg

SEQ ID NO: 1233140 - RNA, 14 nt, Mycobacterium leprae
ucaaagucagccaa

SEQ ID NO: 1233141 - RNA, 13 nt, Mycobacterium leprae
ucaacaaaaccau

SEQ ID NO: 1233142 - RNA, 17 nt, Mycobacterium leprae
ucaaccaaaugcuauga

SEQ ID NO: 1233143 - RNA, 21 nt, Mycobacterium leprae
ucaaccaaaugcuaugauaau

SEQ ID NO: 1233144 - RNA, 12 nt, Mycobacterium leprae
ucaaccaacaug

SEQ ID NO: 1233145 - RNA, 16 nt, Mycobacterium leprae
ucaaccauggucucga

SEQ ID NO: 1233146 - RNA, 23 nt, Mycobacterium leprae
ucaacccgggacuugacuccucu

SEQ ID NO: 1233147 - RNA, 21 nt, Mycobacterium leprae
ucaacaggaugcgugcccaua

SEQ ID NO: 1233148 - RNA, 15 nt, Mycobacterium leprae
ucaacuauccagccc

SEQ ID NO: 1233149 - RNA, 17 nt, Mycobacterium leprae
ucaacucuucugcugga

SEQ ID NO: 1233150 - RNA, 12 nt, Mycobacterium leprae
ucaacgugcgca

SEQ ID NO: 1233151 - RNA, 19 nt, Mycobacterium leprae
ucaacgcgaaaggguagcc

SEQ ID NO: 1233152 - RNA, 23 nt, Mycobacterium leprae
ucaacgaauacgagcuccucaua

SEQ ID NO: 1233153 - RNA, 23 nt, Mycobacterium leprae
ucaagcaauagagauagcgccuc

SEQ ID NO: 1233154 - RNA, 17 nt, Mycobacterium leprae
ucaagaugaucgucaua

SEQ ID NO: 1233155 - RNA, 21 nt, Mycobacterium leprae
ucaagacguugugacaguuca

SEQ ID NO: 1233156 - RNA, 14 nt, Mycobacterium leprae
uauugcauuggcug

SEQ ID NO: 1233157 - RNA, 19 nt, Mycobacterium leprae
uauugauggaguuuuuguu

SEQ ID NO: 1233158 - RNA, 19 nt, Mycobacterium leprae
uauugucggucugccuuga

SEQ ID NO: 1233159 - RNA, 13 nt, Mycobacterium leprae
uauuuccuaaaau

SEQ ID NO: 1233160 - RNA, 14 nt, Mycobacterium leprae
uauuugaugacaga

SEQ ID NO: 1233161 - RNA, 17 nt, Mycobacterium leprae
uauuugaugacagaauc

SEQ ID NO: 1233162 - RNA, 20 nt, Mycobacterium leprae
uauucugcacgcccaacaca

SEQ ID NO: 1233163 - RNA, 22 nt, Mycobacterium leprae
uauuccggucgucaagcucaau

SEQ ID NO: 1233164 - RNA, 14 nt, Mycobacterium leprae
uauucaauuuucgc

SEQ ID NO: 1233165 - RNA, 20 nt, Mycobacterium leprae
uauucaaccgguuuccucaa

SEQ ID NO: 1233166 - RNA, 17 nt, Mycobacterium leprae
uauuaaguuuucucuaa

SEQ ID NO: 1233167 - RNA, 17 nt, Mycobacterium leprae
uauuaauucuucucuaa

SEQ ID NO: 1233168 - RNA, 18 nt, Mycobacterium leprae
uauuaauccaguaguuac

SEQ ID NO: 1233169 - RNA, 22 nt, Mycobacterium leprae
uaaaucucgggcagcugcaaca

SEQ ID NO: 1233170 - RNA, 13 nt, Mycobacterium leprae
uaaaugccucgcu

SEQ ID NO: 1233171 - RNA, 16 nt, Mycobacterium leprae
uaaaguucccucccuu

SEQ ID NO: 1233172 - RNA, 20 nt, Mycobacterium leprae
uaaaguaaagcaugcgccuc

SEQ ID NO: 1233173 - RNA, 22 nt, Mycobacterium leprae
uaaaccuuacagucacuauaau

SEQ ID NO: 1233174 - RNA, 14 nt, Mycobacterium leprae
uaaacgugaugcua

SEQ ID NO: 1233175 - RNA, 20 nt, Mycobacterium leprae
uaaccggucaaucagguuga

SEQ ID NO: 1233176 - RNA, 11 nt, Mycobacterium leprae
uaacaaaucau

SEQ ID NO: 1233177 - RNA, 16 nt, Mycobacterium leprae
uaaaacgaaaaucucu

SEQ ID NO: 1233178 - RNA, 18 nt, Mycobacterium leprae
guuuugugggcaggucag

SEQ ID NO: 1233179 - RNA, 20 nt, Mycobacterium leprae
guuuuuggaccccaaccaga

SEQ ID NO: 1233180 - RNA, 19 nt, Mycobacterium leprae
guuuucagccacauugccg

SEQ ID NO: 1233181 - RNA, 22 nt, Mycobacterium leprae
guuuucaccaaacuggacuucu

SEQ ID NO: 1233182 - RNA, 16 nt, Mycobacterium leprae
guuuucaaguucucaa

SEQ ID NO: 1233183 - RNA, 13 nt, Mycobacterium leprae
guuuuagugugca

SEQ ID NO: 1233184 - RNA, 21 nt, Mycobacterium leprae
guuucuuggguaacaauccug

SEQ ID NO: 1233185 - RNA, 13 nt, Mycobacterium leprae
guuugcugucaag

SEQ ID NO: 1233186 - RNA, 15 nt, Mycobacterium leprae
guuugggugguggug

SEQ ID NO: 1233187 - RNA, 17 nt, Mycobacterium leprae
guuugguuuggguggug

SEQ ID NO: 1233188 - RNA, 14 nt, Mycobacterium leprae
guuugguuuuguug

SEQ ID NO: 1233189 - RNA, 20 nt, Mycobacterium leprae
guucugcugauauagcgcuc

SEQ ID NO: 1233190 - RNA, 15 nt, Mycobacterium leprae
guuguuagugcugcu

SEQ ID NO: 1233191 - RNA, 17 nt, Mycobacterium leprae
guuguggguguuuuguc

SEQ ID NO: 1233192 - RNA, 16 nt, Mycobacterium leprae
guuucauagguggugg

SEQ ID NO: 1233193 - RNA, 17 nt, Mycobacterium leprae
guuucauaggugguggg

SEQ ID NO: 1233194 - RNA, 15 nt, Mycobacterium leprae
guucgacuucugguu

SEQ ID NO: 1233195 - RNA, 16 nt, Mycobacterium leprae
guucggccauggcagc

SEQ ID NO: 1233196 - RNA, 18 nt, Mycobacterium leprae
guucuccagucgcauccu

SEQ ID NO: 1233197 - RNA, 21 nt, Mycobacterium leprae
guucugcggggggccuuaucc

SEQ ID NO: 1233198 - RNA, 19 nt, Mycobacterium leprae
guucugcgcuggccacaaa

SEQ ID NO: 1233199 - RNA, 22 nt, Mycobacterium leprae
guuccgcgcuagacgucuguca

SEQ ID NO: 1233200 - RNA, 21 nt, Mycobacterium leprae
guuccgcugauacgugccggc

SEQ ID NO: 1233201 - RNA, 18 nt, Mycobacterium leprae
guuccauuccagaugccg

SEQ ID NO: 1233202 - RNA, 12 nt, Mycobacterium leprae
guuccagugccu

SEQ ID NO: 1233203 - RNA, 17 nt, Mycobacterium leprae
guuccacugucgcccga

SEQ ID NO: 1233204 - RNA, 17 nt, Mycobacterium leprae
guucaucacggguggug

SEQ ID NO: 1233205 - RNA, 17 nt, Mycobacterium leprae
guucaccacaucaucga

SEQ ID NO: 1233206 - RNA, 16 nt, Mycobacterium leprae
guuagcgccgcggggu

SEQ ID NO: 1233207 - RNA, 13 nt, Mycobacterium leprae
guuagguuggugg

SEQ ID NO: 1233208 - RNA, 15 nt, Mycobacterium leprae
guuagguugguggug

SEQ ID NO: 1233209 - RNA, 14 nt, Mycobacterium leprae
guuagugccaguuc

SEQ ID NO: 1233210 - RNA, 23 nt, Mycobacterium leprae
guuaccccggaucaggcugggga

SEQ ID NO: 1233211 - RNA, 21 nt, Mycobacterium leprae
guuaccagcgccagaccugcc

SEQ ID NO: 1233212 - RNA, 21 nt, Mycobacterium leprae
guuauauuguccgagcuuuuc

SEQ ID NO: 1233213 - RNA, 22 nt, Mycobacterium leprae
guuauauuguccgagcuuuucc

SEQ ID NO: 1233214 - RNA, 21 nt, Mycobacterium leprae
guuaugcgucguacucuggcu

SEQ ID NO: 1233215 - RNA, 21 nt, Mycobacterium leprae
guuaucgaucucgcauauuca

SEQ ID NO: 1233216 - RNA, 22 nt, Mycobacterium leprae
guuauugcggucacagagcugu

SEQ ID NO: 1233217 - RNA, 15 nt, Mycobacterium leprae
guucaauggugccga

SEQ ID NO: 1233218 - RNA, 18 nt, Mycobacterium leprae
guucaauggugccgagcg

SEQ ID NO: 1233219 - RNA, 15 nt, Mycobacterium leprae
guguuagugaacagu

SEQ ID NO: 1233220 - RNA, 17 nt, Mycobacterium leprae
guguaggugaugcuugc

SEQ ID NO: 1233221 - RNA, 20 nt, Mycobacterium leprae
guguagcugcagcgacugga

SEQ ID NO: 1233222 - RNA, 21 nt, Mycobacterium leprae
guguagcugcagcgacuggau

SEQ ID NO: 1233223 - RNA, 20 nt, Mycobacterium leprae
gugugcuuugccgcagugga

SEQ ID NO: 1233224 - RNA, 22 nt, Mycobacterium leprae
gugugcuuugccgcaguggaca

SEQ ID NO: 1233225 - RNA, 22 nt, Mycobacterium leprae
gugucgaugaugcgcuguuguu

SEQ ID NO: 1233226 - RNA, 14 nt, Mycobacterium leprae
gugucgggugguca

SEQ ID NO: 1233227 - RNA, 21 nt, Mycobacterium leprae
guguccgcaaaaugcuccccc

SEQ ID NO: 1233228 - RNA, 15 nt, Mycobacterium leprae
gugcuuugccgcagu

SEQ ID NO: 1233229 - RNA, 21 nt, Mycobacterium leprae
gugcuuugccgcaguggacac

SEQ ID NO: 1233230 - RNA, 17 nt, Mycobacterium leprae
gugcgcacuggguggau

SEQ ID NO: 1233231 - RNA, 14 nt, Mycobacterium leprae
gugcgcaccggcug

SEQ ID NO: 1233232 - RNA, 16 nt, Mycobacterium leprae
guggaguaaagggugg

SEQ ID NO: 1233233 - RNA, 17 nt, Mycobacterium leprae
guggaguaaaggguggc

SEQ ID NO: 1233234 - RNA, 21 nt, Mycobacterium leprae
guggaguaaaggguggcggug

SEQ ID NO: 1233235 - RNA, 22 nt, Mycobacterium leprae
guggacagcguaucucagcucc

SEQ ID NO: 1233236 - RNA, 20 nt, Mycobacterium leprae
guggagucggaguuugcgcu

SEQ ID NO: 1233237 - RNA, 15 nt, Mycobacterium leprae
guggauccaggugcu

SEQ ID NO: 1233238 - RNA, 21 nt, Mycobacterium leprae
guggcuaccgguacgcugcau

SEQ ID NO: 1233239 - RNA, 17 nt, Mycobacterium leprae
guggcggugaguuguuc

SEQ ID NO: 1233240 - RNA, 13 nt, Mycobacterium leprae
guggcagcugggu

SEQ ID NO: 1233241 - RNA, 12 nt, Mycobacterium leprae
guggccgaggaa

SEQ ID NO: 1233242 - RNA, 14 nt, Mycobacterium leprae
guggccgcaccuga

SEQ ID NO: 1233243 - RNA, 19 nt, Mycobacterium leprae
guggccgcaccugaacagg

SEQ ID NO: 1233244 - RNA, 14 nt, Mycobacterium leprae
gugggcagccugga

SEQ ID NO: 1233245 - RNA, 13 nt, Mycobacterium leprae
gugggcggcggcc

SEQ ID NO: 1233246 - RNA, 21 nt, Mycobacterium leprae
gugggcggcguuggcacggau

SEQ ID NO: 1233247 - RNA, 16 nt, Mycobacterium leprae
gugggcugguggggug

SEQ ID NO: 1233248 - RNA, 12 nt, Mycobacterium leprae
guggucgaggaa

SEQ ID NO: 1233249 - RNA, 18 nt, Mycobacterium leprae
guggucgauuacucacgc

SEQ ID NO: 1233250 - RNA, 19 nt, Mycobacterium leprae
gugcacugcuucggccagc

SEQ ID NO: 1233251 - RNA, 21 nt, Mycobacterium leprae
gugcacugcuucggccagcgc

SEQ ID NO: 1233252 - RNA, 14 nt, Mycobacterium leprae
gugcacugguggug

SEQ ID NO: 1233253 - RNA, 14 nt, Mycobacterium leprae
gugcacuugcacua

SEQ ID NO: 1233254 - RNA, 16 nt, Mycobacterium leprae
gugaucgcugccggcg

SEQ ID NO: 1233255 - RNA, 15 nt, Mycobacterium leprae
gugcagucaaacuuu

SEQ ID NO: 1233256 - RNA, 12 nt, Mycobacterium leprae
gugcaggcaguc

SEQ ID NO: 1233257 - RNA, 18 nt, Mycobacterium leprae
gugccauuggugggauga

SEQ ID NO: 1233258 - RNA, 17 nt, Mycobacterium leprae
gugcauguucuguugug

SEQ ID NO: 1233259 - RNA, 21 nt, Mycobacterium leprae
gugccaguucccuacacucau

SEQ ID NO: 1233260 - RNA, 19 nt, Mycobacterium leprae
gugccgcacguugacggau

SEQ ID NO: 1233261 - RNA, 14 nt, Mycobacterium leprae
gugccgcaggcacc

SEQ ID NO: 1233262 - RNA, 21 nt, Mycobacterium leprae
gugccgcugcauccgcagcac

SEQ ID NO: 1233263 - RNA, 19 nt, Mycobacterium leprae
gugccguaagacacuuccu

SEQ ID NO: 1233264 - RNA, 16 nt, Mycobacterium leprae
gugccguaaugugcag

SEQ ID NO: 1233265 - RNA, 16 nt, Mycobacterium leprae
gugccguugcauucga

SEQ ID NO: 1233266 - RNA, 13 nt, Mycobacterium leprae
gugccuauuucac

SEQ ID NO: 1233267 - RNA, 17 nt, Mycobacterium leprae
gugccuauuucacuggc

SEQ ID NO: 1233268 - RNA, 20 nt, Mycobacterium leprae
gugccuauuucacuggcccg

SEQ ID NO: 1233269 - RNA, 13 nt, Mycobacterium leprae
gugaggguaguug

SEQ ID NO: 1233270 - RNA, 16 nt, Mycobacterium leprae
gugaggguaguuguua

SEQ ID NO: 1233271 - RNA, 16 nt, Mycobacterium leprae
gugaggucgaagcugc

SEQ ID NO: 1233272 - RNA, 17 nt, Mycobacterium leprae
gugaucacccgcuggug

SEQ ID NO: 1233273 - RNA, 21 nt, Mycobacterium leprae
gugaucgacggcuggcagcaa

SEQ ID NO: 1233274 - RNA, 23 nt, Mycobacterium leprae
gugacucgauuggacauguucac

SEQ ID NO: 1233275 - RNA, 14 nt, Mycobacterium leprae
gugagacauuucau

SEQ ID NO: 1233276 - RNA, 13 nt, Mycobacterium leprae
gugacuuggcugg

SEQ ID NO: 1233277 - RNA, 15 nt, Mycobacterium leprae
gugacgcgggcgccg

SEQ ID NO: 1233278 - RNA, 17 nt, Mycobacterium leprae
gugacgcuaccgaggaa

SEQ ID NO: 1233279 - RNA, 13 nt, Mycobacterium leprae
gugacggcuggua

SEQ ID NO: 1233280 - RNA, 18 nt, Mycobacterium leprae
gugaccaggaucuucucu

SEQ ID NO: 1233281 - RNA, 17 nt, Mycobacterium leprae
gugaccgugcagcugcc

SEQ ID NO: 1233282 - RNA, 19 nt, Mycobacterium leprae
gugaccgugcagcugccaa

SEQ ID NO: 1233283 - RNA, 22 nt, Mycobacterium leprae
gugaccgcggugcagugccgcc

SEQ ID NO: 1233284 - RNA, 19 nt, Mycobacterium leprae
gugaacagugcaucgauga

SEQ ID NO: 1233285 - RNA, 13 nt, Mycobacterium leprae
gugaaauggcugu

SEQ ID NO: 1233286 - RNA, 14 nt, Mycobacterium leprae
gugaacgccaggcg

SEQ ID NO: 1233287 - RNA, 20 nt, Mycobacterium leprae
gugaacacgcugaucgcuga

SEQ ID NO: 1233288 - RNA, 18 nt, Mycobacterium leprae
gugaaucaugccgcagca

SEQ ID NO: 1233289 - RNA, 19 nt, Mycobacterium leprae
gugaaucaugccgcagcau

SEQ ID NO: 1233290 - RNA, 16 nt, Mycobacterium leprae
gugaauccgcugcaau

SEQ ID NO: 1233291 - RNA, 20 nt, Mycobacterium leprae
gugaaguuuauguuguucaa

SEQ ID NO: 1233292 - RNA, 14 nt, Mycobacterium leprae
gugaagcugaggcg

SEQ ID NO: 1233293 - RNA, 13 nt, Mycobacterium leprae
gugaagcagguac

SEQ ID NO: 1233294 - RNA, 20 nt, Mycobacterium leprae
gucuuucucauuguggcugg

SEQ ID NO: 1233295 - RNA, 16 nt, Mycobacterium leprae
gucuuuguuguccacg

SEQ ID NO: 1233296 - RNA, 16 nt, Mycobacterium leprae
gugaaacccuucacaa

SEQ ID NO: 1233297 - RNA, 21 nt, Mycobacterium leprae
gucuuccggaaaacugccggu

SEQ ID NO: 1233298 - RNA, 19 nt, Mycobacterium leprae
gucuuccaguggcugcacc

SEQ ID NO: 1233299 - RNA, 20 nt, Mycobacterium leprae
gucuuccaguggcugcaccg

SEQ ID NO: 1233300 - RNA, 14 nt, Mycobacterium leprae
gucuucuagagcug

SEQ ID NO: 1233301 - RNA, 15 nt, Mycobacterium leprae
gucuuggcugacggc

SEQ ID NO: 1233302 - RNA, 22 nt, Mycobacterium leprae
gucuggcgcaauuuggugauca

SEQ ID NO: 1233303 - RNA, 17 nt, Mycobacterium leprae
gucuggcggguggugua

SEQ ID NO: 1233304 - RNA, 20 nt, Mycobacterium leprae
gucuggucuggcggguggug

SEQ ID NO: 1233305 - RNA, 16 nt, Mycobacterium leprae
gucugucagcacaugg

SEQ ID NO: 1233306 - RNA, 17 nt, Mycobacterium leprae
gucugcggauuuugccc

SEQ ID NO: 1233307 - RNA, 21 nt, Mycobacterium leprae
gucguuggcaacguggccaca

SEQ ID NO: 1233308 - RNA, 16 nt, Mycobacterium leprae
gucguuguccagcacc

SEQ ID NO: 1233309 - RNA, 16 nt, Mycobacterium leprae
gucguucagcauuccu

SEQ ID NO: 1233310 - RNA, 13 nt, Mycobacterium leprae
gucguuccagcuu

SEQ ID NO: 1233311 - RNA, 17 nt, Mycobacterium leprae
gucuagauaagauaaau

SEQ ID NO: 1233312 - RNA, 19 nt, Mycobacterium leprae
gucucccaauccuggaugu

SEQ ID NO: 1233313 - RNA, 15 nt, Mycobacterium leprae
gucucaccaauagcc

SEQ ID NO: 1233314 - RNA, 15 nt, Mycobacterium leprae
gucucacccaccuug

SEQ ID NO: 1233315 - RNA, 20 nt, Mycobacterium leprae
gucguagucacgcggaguca

SEQ ID NO: 1233316 - RNA, 17 nt, Mycobacterium leprae
gucguagcucuccauua

SEQ ID NO: 1233317 - RNA, 15 nt, Mycobacterium leprae
gucguacucuggcug

SEQ ID NO: 1233318 - RNA, 11 nt, Mycobacterium leprae
gucgguggugg

SEQ ID NO: 1233319 - RNA, 17 nt, Mycobacterium leprae
gucggugguggaugcug

SEQ ID NO: 1233320 - RNA, 22 nt, Mycobacterium leprae
gucgguaaugcaagcgcuuuuc

SEQ ID NO: 1233321 - RNA, 17 nt, Mycobacterium leprae
gucguggugugcauccg

SEQ ID NO: 1233322 - RNA, 21 nt, Mycobacterium leprae
gucguguuugugucuguggcg

SEQ ID NO: 1233323 - RNA, 16 nt, Mycobacterium leprae
gucguuaguggccaau

SEQ ID NO: 1233324 - RNA, 18 nt, Mycobacterium leprae
gucgugauggucauuugg

SEQ ID NO: 1233325 - RNA, 23 nt, Mycobacterium leprae
gucgugauggucauuuggugguu

SEQ ID NO: 1233326 - RNA, 22 nt, Mycobacterium leprae
gucgugcaauuugucacgaauc

SEQ ID NO: 1233327 - RNA, 20 nt, Mycobacterium leprae
gucgcgucggguuaugcagu

SEQ ID NO: 1233328 - RNA, 16 nt, Mycobacterium leprae
gucggcagcugguugu

SEQ ID NO: 1233329 - RNA, 15 nt, Mycobacterium leprae
gucgauuaccacugc

SEQ ID NO: 1233330 - RNA, 11 nt, Mycobacterium leprae
gucgagcagcu

SEQ ID NO: 1233331 - RNA, 12 nt, Mycobacterium leprae
gucgagcagcuc

SEQ ID NO: 1233332 - RNA, 16 nt, Mycobacterium leprae
gucgaugaugcgcugu

SEQ ID NO: 1233333 - RNA, 18 nt, Mycobacterium leprae
gucggccaguaccuccag

SEQ ID NO: 1233334 - RNA, 19 nt, Mycobacterium leprae
gucggccgaucauggcugg

SEQ ID NO: 1233335 - RNA, 12 nt, Mycobacterium leprae
gucggccagcac

SEQ ID NO: 1233336 - RNA, 14 nt, Mycobacterium leprae
gucggggugcugca

SEQ ID NO: 1233337 - RNA, 16 nt, Mycobacterium leprae
gucgggcuuggccucg

SEQ ID NO: 1233338 - RNA, 15 nt, Mycobacterium leprae
gucgggcaucgacga

SEQ ID NO: 1233339 - RNA, 13 nt, Mycobacterium leprae
gucgggcaccugg

SEQ ID NO: 1233340 - RNA, 22 nt, Mycobacterium leprae
guccuccaguuguaugcgcuaa

SEQ ID NO: 1233341 - RNA, 14 nt, Mycobacterium leprae
gucccacggcggca

SEQ ID NO: 1233342 - RNA, 12 nt, Mycobacterium leprae
gucccggugcug

SEQ ID NO: 1233343 - RNA, 15 nt, Mycobacterium leprae
gucccgggggccagc

SEQ ID NO: 1233344 - RNA, 20 nt, Mycobacterium leprae
gucccgggggccagcguugg

SEQ ID NO: 1233345 - RNA, 20 nt, Mycobacterium leprae
gucgaacccucacucaugau

SEQ ID NO: 1233346 - RNA, 14 nt, Mycobacterium leprae
gucgaacgcacugg

SEQ ID NO: 1233347 - RNA, 13 nt, Mycobacterium leprae
gucgacgcgugcg

SEQ ID NO: 1233348 - RNA, 15 nt, Mycobacterium leprae
gucgaaggugagucg

SEQ ID NO: 1233349 - RNA, 14 nt, Mycobacterium leprae
gucgacaagcaucu

SEQ ID NO: 1233350 - RNA, 14 nt, Mycobacterium leprae
gucgacaguguccc

SEQ ID NO: 1233351 - RNA, 21 nt, Mycobacterium leprae
gucgacagugucccuguccuu

SEQ ID NO: 1233352 - RNA, 20 nt, Mycobacterium leprae
gucaucgacgaugccauaga

SEQ ID NO: 1233353 - RNA, 23 nt, Mycobacterium leprae
guccaaccgacgauuccuggaaa

SEQ ID NO: 1233354 - RNA, 15 nt, Mycobacterium leprae
guccaacgcggcggc

SEQ ID NO: 1233355 - RNA, 14 nt, Mycobacterium leprae
guccaacgugguug

SEQ ID NO: 1233356 - RNA, 18 nt, Mycobacterium leprae
gucaucuaaacugacgcu

SEQ ID NO: 1233357 - RNA, 20 nt, Mycobacterium leprae
gucauggcacugggcugcuc

SEQ ID NO: 1233358 - RNA, 19 nt, Mycobacterium leprae
guccaccagccgcaggcac

SEQ ID NO: 1233359 - RNA, 13 nt, Mycobacterium leprae
guccacggcagcu

SEQ ID NO: 1233360 - RNA, 13 nt, Mycobacterium leprae
guccacgugucug

SEQ ID NO: 1233361 - RNA, 18 nt, Mycobacterium leprae
guccacuugacuggcuug

SEQ ID NO: 1233362 - RNA, 20 nt, Mycobacterium leprae
guccacugcagggcgagcug

SEQ ID NO: 1233363 - RNA, 18 nt, Mycobacterium leprae
guccacugguaaguauaa

SEQ ID NO: 1233364 - RNA, 24 nt, Mycobacterium leprae
guccagccaacgggaacagcggcg

SEQ ID NO: 1233365 - RNA, 11 nt, Mycobacterium leprae
guauuuccuaa

SEQ ID NO: 1233366 - RNA, 18 nt, Mycobacterium leprae
guauuacguuggcuaaca

SEQ ID NO: 1233367 - RNA, 13 nt, Mycobacterium leprae
guauucuugauug

SEQ ID NO: 1233368 - RNA, 13 nt, Mycobacterium leprae
gucaaaggcuguc

SEQ ID NO: 1233369 - RNA, 19 nt, Mycobacterium leprae
gucaaagcccuucacuucc

SEQ ID NO: 1233370 - RNA, 16 nt, Mycobacterium leprae
gucacacuggugguga

SEQ ID NO: 1233371 - RNA, 22 nt, Mycobacterium leprae
gucaagugucggguggucagca

SEQ ID NO: 1233372 - RNA, 15 nt, Mycobacterium leprae
gucacagguaaacaa

SEQ ID NO: 1233373 - RNA, 11 nt, Mycobacterium leprae
gucaccacuga

SEQ ID NO: 1233374 - RNA, 23 nt, Mycobacterium leprae
gucaccacugaaccugccaucca

SEQ ID NO: 1233375 - RNA, 13 nt, Mycobacterium leprae
gucacauuccagu

SEQ ID NO: 1233376 - RNA, 15 nt, Mycobacterium leprae
gucacgagaccacgg

SEQ ID NO: 1233377 - RNA, 18 nt, Mycobacterium leprae
guaucggugucggcggcu

SEQ ID NO: 1233378 - RNA, 13 nt, Mycobacterium leprae
guaucgugccucc

SEQ ID NO: 1233379 - RNA, 20 nt, Mycobacterium leprae
guaucgaugccguggugaug

SEQ ID NO: 1233380 - RNA, 15 nt, Mycobacterium leprae
guauguguuuuguug

SEQ ID NO: 1233381 - RNA, 17 nt, Mycobacterium leprae
guauagcgaaaauaacu

SEQ ID NO: 1233382 - RNA, 19 nt, Mycobacterium leprae
guagcaaucuuugccuucg

SEQ ID NO: 1233383 - RNA, 21 nt, Mycobacterium leprae
guagccaugccuugaccuucu

SEQ ID NO: 1233384 - RNA, 17 nt, Mycobacterium leprae
guagcggucggcgcaca

SEQ ID NO: 1233385 - RNA, 17 nt, Mycobacterium leprae
guacugacuggggagug

SEQ ID NO: 1233386 - RNA, 14 nt, Mycobacterium leprae
guacucuggcuggu

SEQ ID NO: 1233387 - RNA, 13 nt, Mycobacterium leprae
guacuuguugauu

SEQ ID NO: 1233388 - RNA, 13 nt, Mycobacterium leprae
guacgagugcuaa

SEQ ID NO: 1233389 - RNA, 15 nt, Mycobacterium leprae
guacaugcuggcagu

SEQ ID NO: 1233390 - RNA, 17 nt, Mycobacterium leprae
guacaggcgugugcuau

SEQ ID NO: 1233391 - RNA, 19 nt, Mycobacterium leprae
guacagcgauucuguggua

SEQ ID NO: 1233392 - RNA, 22 nt, Mycobacterium leprae
guacaccaaucaggccaucgcc

SEQ ID NO: 1233393 - RNA, 16 nt, Mycobacterium leprae
guacacuaagccccgu

SEQ ID NO: 1233394 - RNA, 20 nt, Mycobacterium leprae
guaaucagcccaacgcugcc

SEQ ID NO: 1233395 - RNA, 14 nt, Mycobacterium leprae
gguugggugggggu

SEQ ID NO: 1233396 - RNA, 21 nt, Mycobacterium leprae
gguugguuucauagguggugg

SEQ ID NO: 1233397 - RNA, 22 nt, Mycobacterium leprae
gguugguuucauaggugguggg

SEQ ID NO: 1233398 - RNA, 15 nt, Mycobacterium leprae
gguugcggguacgac

SEQ ID NO: 1233399 - RNA, 14 nt, Mycobacterium leprae
gguugccgagcugu

SEQ ID NO: 1233400 - RNA, 22 nt, Mycobacterium leprae
gguugccgcgguuuccgcggca

SEQ ID NO: 1233401 - RNA, 20 nt, Mycobacterium leprae
gguugaggaggugcuggaug

SEQ ID NO: 1233402 - RNA, 21 nt, Mycobacterium leprae
gguuucguguuuucaguucac

SEQ ID NO: 1233403 - RNA, 14 nt, Mycobacterium leprae
gguuaccugggcca

SEQ ID NO: 1233404 - RNA, 21 nt, Mycobacterium leprae
gguuaccagcgccagaccugc

SEQ ID NO: 1233405 - RNA, 21 nt, Mycobacterium leprae
gguuaugucggcugucgcgga

SEQ ID NO: 1233406 - RNA, 14 nt, Mycobacterium leprae
gguuauugacguga

SEQ ID NO: 1233407 - RNA, 14 nt, Mycobacterium leprae
gguucgaguccugg

SEQ ID NO: 1233408 - RNA, 17 nt, Mycobacterium leprae
gguggcacuugaaauuu

SEQ ID NO: 1233409 - RNA, 23 nt, Mycobacterium leprae
ggugcugcagccacgaaaaucug

SEQ ID NO: 1233410 - RNA, 15 nt, Mycobacterium leprae
ggugcccuagaacaa

SEQ ID NO: 1233411 - RNA, 11 nt, Mycobacterium leprae
ggugcuggaug

SEQ ID NO: 1233412 - RNA, 19 nt, Mycobacterium leprae
gguggguuauccccacaug

SEQ ID NO: 1233413 - RNA, 21 nt, Mycobacterium leprae
ggugggcgaucaggagguggu

SEQ ID NO: 1233414 - RNA, 17 nt, Mycobacterium leprae
gguggggccgccagaug

SEQ ID NO: 1233415 - RNA, 22 nt, Mycobacterium leprae
gguguggacagcguaucucagc

SEQ ID NO: 1233416 - RNA, 13 nt, Mycobacterium leprae
ggugugugaggau

SEQ ID NO: 1233417 - RNA, 17 nt, Mycobacterium leprae
gguguggcccgacggcg

SEQ ID NO: 1233418 - RNA, 15 nt, Mycobacterium leprae
gguccguucgugucg

SEQ ID NO: 1233419 - RNA, 12 nt, Mycobacterium leprae
gguccggcugca

SEQ ID NO: 1233420 - RNA, 18 nt, Mycobacterium leprae
ggucucacgcugggguug

SEQ ID NO: 1233421 - RNA, 17 nt, Mycobacterium leprae
ggucgcuaucauagcca

SEQ ID NO: 1233422 - RNA, 16 nt, Mycobacterium leprae
ggugaugcccaucaug

SEQ ID NO: 1233423 - RNA, 22 nt, Mycobacterium leprae
ggugagucgcccagcagguuga

SEQ ID NO: 1233424 - RNA, 19 nt, Mycobacterium leprae
ggugcagugccgccgaucg

SEQ ID NO: 1233425 - RNA, 16 nt, Mycobacterium leprae
ggugcaggagcguggg

SEQ ID NO: 1233426 - RNA, 13 nt, Mycobacterium leprae
ggugccaggcagc

SEQ ID NO: 1233427 - RNA, 17 nt, Mycobacterium leprae
ggucugcggugcugagc

SEQ ID NO: 1233428 - RNA, 16 nt, Mycobacterium leprae
ggucugaaguggggua

SEQ ID NO: 1233429 - RNA, 17 nt, Mycobacterium leprae
ggugagcguugugggca

SEQ ID NO: 1233430 - RNA, 19 nt, Mycobacterium leprae
ggugagcguugugggcagc

SEQ ID NO: 1233431 - RNA, 17 nt, Mycobacterium leprae
ggugagagcuuccaagu

SEQ ID NO: 1233432 - RNA, 17 nt, Mycobacterium leprae
ggugaccacccacaacg

SEQ ID NO: 1233433 - RNA, 21 nt, Mycobacterium leprae
ggucauuuggugguuauuuuu

SEQ ID NO: 1233434 - RNA, 19 nt, Mycobacterium leprae
gguccacuugacuggcuug

SEQ ID NO: 1233435 - RNA, 19 nt, Mycobacterium leprae
gguccacccgcaugcccug

SEQ ID NO: 1233436 - RNA, 12 nt, Mycobacterium leprae
ggucccgcagcc

SEQ ID NO: 1233437 - RNA, 21 nt, Mycobacterium leprae
ggucaucuaaacugacgcugc

SEQ ID NO: 1233438 - RNA, 16 nt, Mycobacterium leprae
ggucaugaugcaggua

SEQ ID NO: 1233439 - RNA, 22 nt, Mycobacterium leprae
ggucaacaggaugcgugcccau

SEQ ID NO: 1233440 - RNA, 18 nt, Mycobacterium leprae
ggucaacguuugucgugu

SEQ ID NO: 1233441 - RNA, 17 nt, Mycobacterium leprae
ggucacacuggugguga

SEQ ID NO: 1233442 - RNA, 22 nt, Mycobacterium leprae
gguagcgcauuuagucuggcua

SEQ ID NO: 1233443 - RNA, 17 nt, Mycobacterium leprae
ggguguucauggcgcgc

SEQ ID NO: 1233444 - RNA, 19 nt, Mycobacterium leprae
ggguggggaucgugcguga

SEQ ID NO: 1233445 - RNA, 17 nt, Mycobacterium leprae
gggcugguggccgaggu

SEQ ID NO: 1233446 - RNA, 15 nt, Mycobacterium leprae
ggggccuuaucccac

SEQ ID NO: 1233447 - RNA, 19 nt, Mycobacterium leprae
gggcguuuuagugugcaug

SEQ ID NO: 1233448 - RNA, 17 nt, Mycobacterium leprae
gggcggcaccugcaaug

SEQ ID NO: 1233449 - RNA, 13 nt, Mycobacterium leprae
gggguugcacuga

SEQ ID NO: 1233450 - RNA, 17 nt, Mycobacterium leprae
ggggugugaugcuccac

SEQ ID NO: 1233451 - RNA, 22 nt, Mycobacterium leprae
gggguugaauuguacuuugugu

SEQ ID NO: 1233452 - RNA, 14 nt, Mycobacterium leprae
gggguguugcacca

SEQ ID NO: 1233453 - RNA, 15 nt, Mycobacterium leprae
gggguguuggcccaa

SEQ ID NO: 1233454 - RNA, 20 nt, Mycobacterium leprae
gggguggggaucgugcguga

SEQ ID NO: 1233455 - RNA, 17 nt, Mycobacterium leprae
gggucaauccguacugg

SEQ ID NO: 1233456 - RNA, 13 nt, Mycobacterium leprae
gggugcacaaccu

SEQ ID NO: 1233457 - RNA, 21 nt, Mycobacterium leprae
gggugauagauggagccacca

SEQ ID NO: 1233458 - RNA, 20 nt, Mycobacterium leprae
gggucggcugcaccacgguc

SEQ ID NO: 1233459 - RNA, 20 nt, Mycobacterium leprae
gggguauuggaauagcugug

SEQ ID NO: 1233460 - RNA, 13 nt, Mycobacterium leprae
ggggguugcacug

SEQ ID NO: 1233461 - RNA, 18 nt, Mycobacterium leprae
gggggugugaugcuccac

SEQ ID NO: 1233462 - RNA, 19 nt, Mycobacterium leprae
ggggguuaccugggccagg

SEQ ID NO: 1233463 - RNA, 12 nt, Mycobacterium leprae
ggggggcagccc

SEQ ID NO: 1233464 - RNA, 10 nt, Mycobacterium leprae
ggggguggga

SEQ ID NO: 1233465 - RNA, 14 nt, Mycobacterium leprae
ggggcugggcaccu

SEQ ID NO: 1233466 - RNA, 23 nt, Mycobacterium leprae
ggggcucgcgucguugcgcugga

SEQ ID NO: 1233467 - RNA, 23 nt, Mycobacterium leprae
ggggcucggccaggugugccugg

SEQ ID NO: 1233468 - RNA, 14 nt, Mycobacterium leprae
ggggcguccaguga

SEQ ID NO: 1233469 - RNA, 19 nt, Mycobacterium leprae
ggggcgccaccaugaaacg

SEQ ID NO: 1233470 - RNA, 21 nt, Mycobacterium leprae
gggauguuggcgccugccacu

SEQ ID NO: 1233471 - RNA, 18 nt, Mycobacterium leprae
gggagacggccugcucug

SEQ ID NO: 1233472 - RNA, 14 nt, Mycobacterium leprae
gggaucgacaaaau

SEQ ID NO: 1233473 - RNA, 12 nt, Mycobacterium leprae
gggcaagcccgg

SEQ ID NO: 1233474 - RNA, 17 nt, Mycobacterium leprae
gggcaagcccugcccgg

SEQ ID NO: 1233475 - RNA, 12 nt, Mycobacterium leprae
gggccaugcagu

SEQ ID NO: 1233476 - RNA, 22 nt, Mycobacterium leprae
gggccagggggcgucaagucca

SEQ ID NO: 1233477 - RNA, 21 nt, Mycobacterium leprae
gggccagcgaucuaccucgcc

SEQ ID NO: 1233478 - RNA, 21 nt, Mycobacterium leprae
ggcuucauucuuguguccaua

SEQ ID NO: 1233479 - RNA, 19 nt, Mycobacterium leprae
ggccgccagguccacccgc

SEQ ID NO: 1233480 - RNA, 14 nt, Mycobacterium leprae
ggccgcccaggugu

SEQ ID NO: 1233481 - RNA, 16 nt, Mycobacterium leprae
ggccgcacccggcagc

SEQ ID NO: 1233482 - RNA, 23 nt, Mycobacterium leprae
gggaaggccaagcggaauaucgg

SEQ ID NO: 1233483 - RNA, 15 nt, Mycobacterium leprae
ggcuuucgcuggcuc

SEQ ID NO: 1233484 - RNA, 17 nt, Mycobacterium leprae
gggacaagucaaaacca

SEQ ID NO: 1233485 - RNA, 18 nt, Mycobacterium leprae
gggacacggcguggaugg

SEQ ID NO: 1233486 - RNA, 14 nt, Mycobacterium leprae
cuacacugcagcgg

SEQ ID NO: 1233487 - RNA, 17 nt, Mycobacterium leprae
cuacacgguauaaaggc

SEQ ID NO: 1233488 - RNA, 18 nt, Mycobacterium leprae
cuacagcaguguucaggc

SEQ ID NO: 1233489 - RNA, 14 nt, Mycobacterium leprae
cuacaucgacaaaa

SEQ ID NO: 1233490 - RNA, 17 nt, Mycobacterium leprae
cuacaucgacaaaaaca

SEQ ID NO: 1233491 - RNA, 14 nt, Mycobacterium leprae
cuacccgacacaaa

SEQ ID NO: 1233492 - RNA, 20 nt, Mycobacterium leprae
cuacccaggccuguugcggc

SEQ ID NO: 1233493 - RNA, 16 nt, Mycobacterium leprae
cuaccacauaaacauu

SEQ ID NO: 1233494 - RNA, 22 nt, Mycobacterium leprae
cuaccacuuccuacuucugggu

SEQ ID NO: 1233495 - RNA, 23 nt, Mycobacterium leprae
cuacauuguuuucgguagacugg

SEQ ID NO: 1233496 - RNA, 18 nt, Mycobacterium leprae
cuaccucggucggcaugu

SEQ ID NO: 1233497 - RNA, 20 nt, Mycobacterium leprae
cuaccuauccgaguggguaa

SEQ ID NO: 1233498 - RNA, 18 nt, Mycobacterium leprae
cuaccguugacgugguga

SEQ ID NO: 1233499 - RNA, 21 nt, Mycobacterium leprae
cuaccgggcgcucagugauca

SEQ ID NO: 1233500 - RNA, 20 nt, Mycobacterium leprae
cuaccgagauggcgucuuga

SEQ ID NO: 1233501 - RNA, 18 nt, Mycobacterium leprae
cuaccggccaaccacagc

SEQ ID NO: 1233502 - RNA, 16 nt, Mycobacterium leprae
cuagacugacccaagc

SEQ ID NO: 1233503 - RNA, 17 nt, Mycobacterium leprae
cuagacgucugucaccc

SEQ ID NO: 1233504 - RNA, 14 nt, Mycobacterium leprae
cuacgguuaauaua

SEQ ID NO: 1233505 - RNA, 20 nt, Mycobacterium leprae
cuacggggugggcagccugg

SEQ ID NO: 1233506 - RNA, 14 nt, Mycobacterium leprae
cuagaaagaccccc

SEQ ID NO: 1233507 - RNA, 15 nt, Mycobacterium leprae
cuagaaaauccaagu

SEQ ID NO: 1233508 - RNA, 21 nt, Mycobacterium leprae
cuauaaaacacuucaacaucg

SEQ ID NO: 1233509 - RNA, 17 nt, Mycobacterium leprae
cuaggacaacagagcac

SEQ ID NO: 1233510 - RNA, 19 nt, Mycobacterium leprae
cuaguucgacaccggccaa

SEQ ID NO: 1233511 - RNA, 14 nt, Mycobacterium leprae
cucagcgucccaac

SEQ ID NO: 1233512 - RNA, 16 nt, Mycobacterium leprae
cucagcggccagacac

SEQ ID NO: 1233513 - RNA, 17 nt, Mycobacterium leprae
cucagcggccagacacc

SEQ ID NO: 1233514 - RNA, 19 nt, Mycobacterium leprae
cucagccagcaagcaggca

SEQ ID NO: 1233515 - RNA, 21 nt, Mycobacterium leprae
cucagccagcaagcaggcaug

SEQ ID NO: 1233516 - RNA, 14 nt, Mycobacterium leprae
cucacgccugcauc

SEQ ID NO: 1233517 - RNA, 19 nt, Mycobacterium leprae
cucagaaaucguucgacca

SEQ ID NO: 1233518 - RNA, 16 nt, Mycobacterium leprae
cucacccaccuuggcg

SEQ ID NO: 1233519 - RNA, 18 nt, Mycobacterium leprae
cucaccaauagccgacca

SEQ ID NO: 1233520 - RNA, 17 nt, Mycobacterium leprae
cucacaauugacaacac

SEQ ID NO: 1233521 - RNA, 22 nt, Mycobacterium leprae
cucaauggccugcucauggcac

SEQ ID NO: 1233522 - RNA, 16 nt, Mycobacterium leprae
cucaauuggcagagca

SEQ ID NO: 1233523 - RNA, 21 nt, Mycobacterium leprae
cucaaagccugcguccacguc

SEQ ID NO: 1233524 - RNA, 11 nt, Mycobacterium leprae
cucaaugcugu

SEQ ID NO: 1233525 - RNA, 12 nt, Mycobacterium leprae
cuaugcuggcua

SEQ ID NO: 1233526 - RNA, 18 nt, Mycobacterium leprae
cuaugauaauuuggcuga

SEQ ID NO: 1233527 - RNA, 23 nt, Mycobacterium leprae
cuaugagacgaaugcugaccauu

SEQ ID NO: 1233528 - RNA, 22 nt, Mycobacterium leprae
cuauggaauccacuugagcggc

SEQ ID NO: 1233529 - RNA, 14 nt, Mycobacterium leprae
cuauacuggcauua

SEQ ID NO: 1233530 - RNA, 20 nt, Mycobacterium leprae
cuaucugacgacuucuucug

SEQ ID NO: 1233531 - RNA, 14 nt, Mycobacterium leprae
cuauugcauuggcu

SEQ ID NO: 1233532 - RNA, 15 nt, Mycobacterium leprae
cuauucgcaccugau

SEQ ID NO: 1233533 - RNA, 18 nt, Mycobacterium leprae
cuauugcggucuugguga

SEQ ID NO: 1233534 - RNA, 19 nt, Mycobacterium leprae
cuauuuguuuuccugugca

SEQ ID NO: 1233535 - RNA, 14 nt, Mycobacterium leprae
cucguggcagucuc

SEQ ID NO: 1233536 - RNA, 22 nt, Mycobacterium leprae
cucguucaguuugguccaggcg

SEQ ID NO: 1233537 - RNA, 22 nt, Mycobacterium leprae
cucgugcguuauauuugagugg

SEQ ID NO: 1233538 - RNA, 17 nt, Mycobacterium leprae
cucuaaagucguuggcc

SEQ ID NO: 1233539 - RNA, 18 nt, Mycobacterium leprae
cucgggguuugacaccgc

SEQ ID NO: 1233540 - RNA, 19 nt, Mycobacterium leprae
cucgcggggaugcugaggu

SEQ ID NO: 1233541 - RNA, 14 nt, Mycobacterium leprae
cucgcugccgugug

SEQ ID NO: 1233542 - RNA, 21 nt, Mycobacterium leprae
cucggcgccaucgaauccucg

SEQ ID NO: 1233543 - RNA, 16 nt, Mycobacterium leprae
cucggcgcgcucucug

SEQ ID NO: 1233544 - RNA, 17 nt, Mycobacterium leprae
cucgauuugcucaguga

SEQ ID NO: 1233545 - RNA, 19 nt, Mycobacterium leprae
cucgaugucggacaaugag

SEQ ID NO: 1233546 - RNA, 15 nt, Mycobacterium leprae
cucgauggccagccg

SEQ ID NO: 1233547 - RNA, 17 nt, Mycobacterium leprae
cucgaacuuguucuuug

SEQ ID NO: 1233548 - RNA, 22 nt, Mycobacterium leprae
cucgaaccgauccagcauucag

SEQ ID NO: 1233549 - RNA, 23 nt, Mycobacterium leprae
cucgccaacgguaucuccccagg

SEQ ID NO: 1233550 - RNA, 14 nt, Mycobacterium leprae
cucgccgccuucuc

SEQ ID NO: 1233551 - RNA, 22 nt, Mycobacterium leprae
cucgccggggugucgagcuucg

SEQ ID NO: 1233552 - RNA, 23 nt, Mycobacterium leprae
cucgcgcaggucacccuccucgc

SEQ ID NO: 1233553 - RNA, 18 nt, Mycobacterium leprae
cucgcgcugaagccgcug

SEQ ID NO: 1233554 - RNA, 14 nt, Mycobacterium leprae
cuccguccagcugg

SEQ ID NO: 1233555 - RNA, 17 nt, Mycobacterium leprae
cuccgguugcggcgagc

SEQ ID NO: 1233556 - RNA, 20 nt, Mycobacterium leprae
cuccauuuuucuugaaaaau

SEQ ID NO: 1233557 - RNA, 15 nt, Mycobacterium leprae
cuccaccagccggcc

SEQ ID NO: 1233558 - RNA, 15 nt, Mycobacterium leprae
cguuuugucuucuag

SEQ ID NO: 1233559 - RNA, 20 nt, Mycobacterium leprae
cuaaaacgccccuaccccgc

SEQ ID NO: 1233560 - RNA, 19 nt, Mycobacterium leprae
cguuucgaggucuuggucu

SEQ ID NO: 1233561 - RNA, 23 nt, Mycobacterium leprae
cguuguucggcaggccggccugg

SEQ ID NO: 1233562 - RNA, 13 nt, Mycobacterium leprae
cguugucuugugg

SEQ ID NO: 1233563 - RNA, 23 nt, Mycobacterium leprae
cguugucggcuccuccagcaucg

SEQ ID NO: 1233564 - RNA, 17 nt, Mycobacterium leprae
cguugauugaggagugu

SEQ ID NO: 1233565 - RNA, 17 nt, Mycobacterium leprae
cguuaccgacaccgccg

SEQ ID NO: 1233566 - RNA, 17 nt, Mycobacterium leprae
cguuaucgaucuaccug

SEQ ID NO: 1233567 - RNA, 13 nt, Mycobacterium leprae
cgugcuguuaugu

SEQ ID NO: 1233568 - RNA, 12 nt, Mycobacterium leprae
cguuauugcugu

SEQ ID NO: 1233569 - RNA, 18 nt, Mycobacterium leprae
cguucaagauacuggauu

SEQ ID NO: 1233570 - RNA, 21 nt, Mycobacterium leprae
cguugaucuggaucagcgcgc

SEQ ID NO: 1233571 - RNA, 22 nt, Mycobacterium leprae
cguucggguugcggucaucagg

SEQ ID NO: 1233572 - RNA, 20 nt, Mycobacterium leprae
cguucgacuucugguugaca

SEQ ID NO: 1233573 - RNA, 19 nt, Mycobacterium leprae
cuaaccgauccggugugga

SEQ ID NO: 1233574 - RNA, 23 nt, Mycobacterium leprae
cuaacccgcaaaccaaacaacaa

SEQ ID NO: 1233575 - RNA, 21 nt, Mycobacterium leprae
cuaacacaggaauuuagaggc

SEQ ID NO: 1233576 - RNA, 22 nt, Mycobacterium leprae
cuaacaacgaccagcgcuaaau

SEQ ID NO: 1233577 - RNA, 20 nt, Mycobacterium leprae
cuaacaaggugaugcccauc

SEQ ID NO: 1233578 - RNA, 19 nt, Mycobacterium leprae
cuaacuuaguuuagagugc

SEQ ID NO: 1233579 - RNA, 13 nt, Mycobacterium leprae
cuaagaagcugcc

SEQ ID NO: 1233580 - RNA, 17 nt, Mycobacterium leprae
cuaaguccggccugccc

SEQ ID NO: 1233581 - RNA, 15 nt, Mycobacterium leprae
cuaagguggcuagcu

SEQ ID NO: 1233582 - RNA, 19 nt, Mycobacterium leprae
cuaauggcguccugcgaca

SEQ ID NO: 1233583 - RNA, 13 nt, Mycobacterium leprae
cgucgcagcagcg

SEQ ID NO: 1233584 - RNA, 20 nt, Mycobacterium leprae
cgucgccgauccucgugaca

SEQ ID NO: 1233585 - RNA, 22 nt, Mycobacterium leprae
cgucgccgauccucgugacauc

SEQ ID NO: 1233586 - RNA, 16 nt, Mycobacterium leprae
cgucgcccucgccggc

SEQ ID NO: 1233587 - RNA, 22 nt, Mycobacterium leprae
cgucgcggauuuacccccagaa

SEQ ID NO: 1233588 - RNA, 20 nt, Mycobacterium leprae
cgucgguagacguggcaguc

SEQ ID NO: 1233589 - RNA, 18 nt, Mycobacterium leprae
cgucgggaccgggcgcgc

SEQ ID NO: 1233590 - RNA, 23 nt, Mycobacterium leprae
cgucggcguugagcgcagccacc

SEQ ID NO: 1233591 - RNA, 17 nt, Mycobacterium leprae
cgucgugaccgcggggc

SEQ ID NO: 1233592 - RNA, 18 nt, Mycobacterium leprae
cgucguggcugugaugua

SEQ ID NO: 1233593 - RNA, 20 nt, Mycobacterium leprae
cgucuacgucuucaccaugg

SEQ ID NO: 1233594 - RNA, 15 nt, Mycobacterium leprae
cgucuggauggcuga

SEQ ID NO: 1233595 - RNA, 16 nt, Mycobacterium leprae
cgucugguugcacggc

SEQ ID NO: 1233596 - RNA, 12 nt, Mycobacterium leprae
cgugacucaaca

SEQ ID NO: 1233597 - RNA, 17 nt, Mycobacterium leprae
cgugaaucaugccgcag

SEQ ID NO: 1233598 - RNA, 16 nt, Mycobacterium leprae
cgucuuuauucuuuua

SEQ ID NO: 1233599 - RNA, 23 nt, Mycobacterium leprae
cgugauggucauuuggugguuau

SEQ ID NO: 1233600 - RNA, 22 nt, Mycobacterium leprae
cgugauucgggacagugucuua

SEQ ID NO: 1233601 - RNA, 13 nt, Mycobacterium leprae
cgugaugcagcau

SEQ ID NO: 1233602 - RNA, 22 nt, Mycobacterium leprae
cgugcagcgaccucaugcccgg

SEQ ID NO: 1233603 - RNA, 15 nt, Mycobacterium leprae
cgugcaggcagucuu

SEQ ID NO: 1233604 - RNA, 22 nt, Mycobacterium leprae
cgugcaggcugcauccugcagc

SEQ ID NO: 1233605 - RNA, 14 nt, Mycobacterium leprae
cgugccgagccugg

SEQ ID NO: 1233606 - RNA, 14 nt, Mycobacterium leprae
cgugccccggccgc

SEQ ID NO: 1233607 - RNA, 14 nt, Mycobacterium leprae
cgucaaaaaacuca

SEQ ID NO: 1233608 - RNA, 21 nt, Mycobacterium leprae
cguauugguugccgagcuguu

SEQ ID NO: 1233609 - RNA, 22 nt, Mycobacterium leprae
cguaucucagcuccgaagcagc

SEQ ID NO: 1233610 - RNA, 16 nt, Mycobacterium leprae
cgucaucgacauccca

SEQ ID NO: 1233611 - RNA, 14 nt, Mycobacterium leprae
cgucagggcagcag

SEQ ID NO: 1233612 - RNA, 17 nt, Mycobacterium leprae
cgucaggccaggcagcg

SEQ ID NO: 1233613 - RNA, 23 nt, Mycobacterium leprae
cgucagcuggaaucccccauucg

SEQ ID NO: 1233614 - RNA, 17 nt, Mycobacterium leprae
cguccacgucgcccaac

SEQ ID NO: 1233615 - RNA, 19 nt, Mycobacterium leprae
cguccagacaccacugcca

SEQ ID NO: 1233616 - RNA, 15 nt, Mycobacterium leprae
cguccgcaaccgaua

SEQ ID NO: 1233617 - RNA, 19 nt, Mycobacterium leprae
cguccgauaacagaccucc

SEQ ID NO: 1233618 - RNA, 23 nt, Mycobacterium leprae
cguauagcgaaaauaacuauaau

SEQ ID NO: 1233619 - RNA, 17 nt, Mycobacterium leprae
cguacugugcgagagua

SEQ ID NO: 1233620 - RNA, 18 nt, Mycobacterium leprae
cguaccggaucgacggca

SEQ ID NO: 1233621 - RNA, 22 nt, Mycobacterium leprae
cuucgauguguugaacaguacu

SEQ ID NO: 1233622 - RNA, 13 nt, Mycobacterium leprae
cuuccugaacaac

SEQ ID NO: 1233623 - RNA, 16 nt, Mycobacterium leprae
cuuccugacaaccguu

SEQ ID NO: 1233624 - RNA, 17 nt, Mycobacterium leprae
cuucagcgagcguguca

SEQ ID NO: 1233625 - RNA, 21 nt, Mycobacterium leprae
cuuaaguuauuuggaguuauu

SEQ ID NO: 1233626 - RNA, 21 nt, Mycobacterium leprae
cuuaaguggcuggcuuaggag

SEQ ID NO: 1233627 - RNA, 14 nt, Mycobacterium leprae
cuuauacugcugcg

SEQ ID NO: 1233628 - RNA, 22 nt, Mycobacterium leprae
cuuaucucaucgucucgcucca

SEQ ID NO: 1233629 - RNA, 18 nt, Mycobacterium leprae
cuguuguaagcacugcac

SEQ ID NO: 1233630 - RNA, 19 nt, Mycobacterium leprae
cuguugcucaacgggccgc

SEQ ID NO: 1233631 - RNA, 20 nt, Mycobacterium leprae
cuguguuguggguguuuugu

SEQ ID NO: 1233632 - RNA, 17 nt, Mycobacterium leprae
cuguguugccgugagga

SEQ ID NO: 1233633 - RNA, 12 nt, Mycobacterium leprae
cuguguugcggg

SEQ ID NO: 1233634 - RNA, 18 nt, Mycobacterium leprae
cugugucggucuuguccu

SEQ ID NO: 1233635 - RNA, 17 nt, Mycobacterium leprae
cuguguacgaagccuga

SEQ ID NO: 1233636 - RNA, 20 nt, Mycobacterium leprae
cuguguacgaagccugagac

SEQ ID NO: 1233637 - RNA, 12 nt, Mycobacterium leprae
cuguuacaggaa

SEQ ID NO: 1233638 - RNA, 18 nt, Mycobacterium leprae
cuguugacguguuuugcu

SEQ ID NO: 1233639 - RNA, 21 nt, Mycobacterium leprae
cuguugaauauacgaaucccg

SEQ ID NO: 1233640 - RNA, 14 nt, Mycobacterium leprae
cugucguggcugca

SEQ ID NO: 1233641 - RNA, 21 nt, Mycobacterium leprae
cugucuaccguugacguggug

SEQ ID NO: 1233642 - RNA, 16 nt, Mycobacterium leprae
cugucggugccgccau

SEQ ID NO: 1233643 - RNA, 23 nt, Mycobacterium leprae
cugucguaacaccagagacaccu

SEQ ID NO: 1233644 - RNA, 23 nt, Mycobacterium leprae
cugucuugcggcgugcugauaug

SEQ ID NO: 1233645 - RNA, 19 nt, Mycobacterium leprae
cugucugcggauuuugccc

SEQ ID NO: 1233646 - RNA, 19 nt, Mycobacterium leprae
cugucgauuaccacugccg

SEQ ID NO: 1233647 - RNA, 16 nt, Mycobacterium leprae
cugucgauacggccaa

SEQ ID NO: 1233648 - RNA, 21 nt, Mycobacterium leprae
cuguccuugccggcgccgcug

SEQ ID NO: 1233649 - RNA, 17 nt, Mycobacterium leprae
cugugacacuucuccaa

SEQ ID NO: 1233650 - RNA, 14 nt, Mycobacterium leprae
cugugauuggcugc

SEQ ID NO: 1233651 - RNA, 17 nt, Mycobacterium leprae
cuguggcggugaguugu

SEQ ID NO: 1233652 - RNA, 21 nt, Mycobacterium leprae
cugugccugcauucuccuguc

SEQ ID NO: 1233653 - RNA, 14 nt, Mycobacterium leprae
cugugccugguagg

SEQ ID NO: 1233654 - RNA, 21 nt, Mycobacterium leprae
cuguauugccguagaguucua

SEQ ID NO: 1233655 - RNA, 22 nt, Mycobacterium leprae
cuguagugggacacucgauccu

SEQ ID NO: 1233656 - RNA, 21 nt, Mycobacterium leprae
cuguagcucaauuggcagagc

SEQ ID NO: 1233657 - RNA, 17 nt, Mycobacterium leprae
cuguagaugacggcaaa

SEQ ID NO: 1233658 - RNA, 18 nt, Mycobacterium leprae
cugucauccucacgaccg

SEQ ID NO: 1233659 - RNA, 18 nt, Mycobacterium leprae
cuguacacuacuccugcu

SEQ ID NO: 1233660 - RNA, 19 nt, Mycobacterium leprae
cugguucacuaagccacuc

SEQ ID NO: 1233661 - RNA, 20 nt, Mycobacterium leprae
cugguucuuggcuugcuguc

SEQ ID NO: 1233662 - RNA, 16 nt, Mycobacterium leprae
cugguggcaagugugu

SEQ ID NO: 1233663 - RNA, 15 nt, Mycobacterium leprae
cuggugugcgcgccg

SEQ ID NO: 1233664 - RNA, 17 nt, Mycobacterium leprae
cuggugcuuggcagccc

SEQ ID NO: 1233665 - RNA, 13 nt, Mycobacterium leprae
cuggugcuguguu

SEQ ID NO: 1233666 - RNA, 15 nt, Mycobacterium leprae
cuggugccccagucg

SEQ ID NO: 1233667 - RNA, 16 nt, Mycobacterium leprae
cugguaacggaccugg

SEQ ID NO: 1233668 - RNA, 16 nt, Mycobacterium leprae
cuggguuauggaccug

SEQ ID NO: 1233669 - RNA, 15 nt, Mycobacterium leprae
cugggugguguggcc

SEQ ID NO: 1233670 - RNA, 19 nt, Mycobacterium leprae
cugggcggaugugucagca

SEQ ID NO: 1233671 - RNA, 23 nt, Mycobacterium leprae
cugggcggcuagucggccggcuc

SEQ ID NO: 1233672 - RNA, 13 nt, Mycobacterium leprae
cuggucaacgcag

SEQ ID NO: 1233673 - RNA, 17 nt, Mycobacterium leprae
cugguagccguucggcu

SEQ ID NO: 1233674 - RNA, 16 nt, Mycobacterium leprae
cuggucgagcagcucc

SEQ ID NO: 1233675 - RNA, 18 nt, Mycobacterium leprae
cuggucuuguggaacgga

SEQ ID NO: 1233676 - RNA, 23 nt, Mycobacterium leprae
cuggugaauagcuaaagugcugc

SEQ ID NO: 1233677 - RNA, 15 nt, Mycobacterium leprae
cuggcgaacaacaaa

SEQ ID NO: 1233678 - RNA, 16 nt, Mycobacterium leprae
cuggccggcagggaug

SEQ ID NO: 1233679 - RNA, 17 nt, Mycobacterium leprae
cuggccuaccgggcgcu

SEQ ID NO: 1233680 - RNA, 15 nt, Mycobacterium leprae
cuggcaguggcaacu

SEQ ID NO: 1233681 - RNA, 23 nt, Mycobacterium leprae
cuggcacgccagcugguggucac

SEQ ID NO: 1233682 - RNA, 15 nt, Mycobacterium leprae
cuggcacuccgaccg

SEQ ID NO: 1233683 - RNA, 20 nt, Mycobacterium leprae
cuggcaguuagcaugagcug

SEQ ID NO: 1233684 - RNA, 22 nt, Mycobacterium leprae
cuggcggcccacaaguccaggg

SEQ ID NO: 1233685 - RNA, 22 nt, Mycobacterium leprae
cuggcgauuuucuugccgucga

SEQ ID NO: 1233686 - RNA, 16 nt, Mycobacterium leprae
cuggcgcaacagucag

SEQ ID NO: 1233687 - RNA, 18 nt, Mycobacterium leprae
cuggcgccuuuuuaugaa

SEQ ID NO: 1233688 - RNA, 21 nt, Mycobacterium leprae
cuggcuugucaccagauugga

SEQ ID NO: 1233689 - RNA, 20 nt, Mycobacterium leprae
cugggacauccgcugauugg

SEQ ID NO: 1233690 - RNA, 22 nt, Mycobacterium leprae
cugggacauccgcugauuggca

SEQ ID NO: 1233691 - RNA, 21 nt, Mycobacterium leprae
cuggcuguauucuauagcguc

SEQ ID NO: 1233692 - RNA, 12 nt, Mycobacterium leprae
cugggcaccacc

SEQ ID NO: 1233693 - RNA, 22 nt, Mycobacterium leprae
cugggauugggcauccugcugu

SEQ ID NO: 1233694 - RNA, 21 nt, Mycobacterium leprae
cugggcaccugggcugugcug

SEQ ID NO: 1233695 - RNA, 16 nt, Mycobacterium leprae
cugggccgaucucggc

SEQ ID NO: 1233696 - RNA, 12 nt, Mycobacterium leprae
cugggccagcga

SEQ ID NO: 1233697 - RNA, 13 nt, Mycobacterium leprae
cugggcgaaaaca

SEQ ID NO: 1233698 - RNA, 12 nt, Mycobacterium leprae
cuggcugcugca

SEQ ID NO: 1233699 - RNA, 15 nt, Mycobacterium leprae
cuggcugcgccggcu

SEQ ID NO: 1233700 - RNA, 17 nt, Mycobacterium leprae
cuggcuccauccugccu

SEQ ID NO: 1233701 - RNA, 21 nt, Mycobacterium leprae
cuggcguuuggugcugcgcuc

SEQ ID NO: 1233702 - RNA, 21 nt, Mycobacterium leprae
cuggcuacgacaggagcuuca

SEQ ID NO: 1233703 - RNA, 22 nt, Mycobacterium leprae
cuggcuaauggcgggcuggagg

SEQ ID NO: 1233704 - RNA, 18 nt, Mycobacterium leprae
cuggaugccgggaagcga

SEQ ID NO: 1233705 - RNA, 14 nt, Mycobacterium leprae
cuggauggauuggu

SEQ ID NO: 1233706 - RNA, 15 nt, Mycobacterium leprae
cuggcacccacgcug

SEQ ID NO: 1233707 - RNA, 20 nt, Mycobacterium leprae
cuggcaccgugucgucuucc

SEQ ID NO: 1233708 - RNA, 21 nt, Mycobacterium leprae
cuggauugucgacaagcuggu

SEQ ID NO: 1233709 - RNA, 10 nt, Mycobacterium leprae
cuggauuuac

SEQ ID NO: 1233710 - RNA, 17 nt, Mycobacterium leprae
cuggauuagcgggaggc

SEQ ID NO: 1233711 - RNA, 13 nt, Mycobacterium leprae
cuggauuaauauu

SEQ ID NO: 1233712 - RNA, 22 nt, Mycobacterium leprae
cuggaagaugacucggcgugcc

SEQ ID NO: 1233713 - RNA, 17 nt, Mycobacterium leprae
cuggaauccgcgcaggg

SEQ ID NO: 1233714 - RNA, 21 nt, Mycobacterium leprae
cuggaauccgcgcagggccug

SEQ ID NO: 1233715 - RNA, 22 nt, Mycobacterium leprae
cuggaagucggucugcggggag

SEQ ID NO: 1233716 - RNA, 13 nt, Mycobacterium leprae
cuggaagcgcuga

SEQ ID NO: 1233717 - RNA, 14 nt, Mycobacterium leprae
cuggagaauguugu

SEQ ID NO: 1233718 - RNA, 23 nt, Mycobacterium leprae
cuggagaauguuguuagugcugc

SEQ ID NO: 1233719 - RNA, 20 nt, Mycobacterium leprae
cuggaacguuuauuccuaau

SEQ ID NO: 1233720 - RNA, 14 nt, Mycobacterium leprae
cugcuuguggcgga

SEQ ID NO: 1233721 - RNA, 18 nt, Mycobacterium leprae
cugcuucgggagucgcuc

SEQ ID NO: 1233722 - RNA, 16 nt, Mycobacterium leprae
cugcuugcucugggug

SEQ ID NO: 1233723 - RNA, 13 nt, Mycobacterium leprae
cugcuugcuggcu

SEQ ID NO: 1233724 - RNA, 18 nt, Mycobacterium leprae
cugcuugcuggcugaggg

SEQ ID NO: 1233725 - RNA, 22 nt, Mycobacterium leprae
cugcuucgauguguugaacagu

SEQ ID NO: 1233726 - RNA, 17 nt, Mycobacterium leprae
cugcugguucuuggcuu

SEQ ID NO: 1233727 - RNA, 17 nt, Mycobacterium leprae
cugcugcaagcccccuc

SEQ ID NO: 1233728 - RNA, 19 nt, Mycobacterium leprae
cugcugcaagcccccucgg

SEQ ID NO: 1233729 - RNA, 21 nt, Mycobacterium leprae
cugcugguggaguacugggca

SEQ ID NO: 1233730 - RNA, 15 nt, Mycobacterium leprae
cugcuacgugacugc

SEQ ID NO: 1233731 - RNA, 17 nt, Mycobacterium leprae
cugcgugccgagccugg

SEQ ID NO: 1233732 - RNA, 13 nt, Mycobacterium leprae
cugcucauggcac

SEQ ID NO: 1233733 - RNA, 17 nt, Mycobacterium leprae
cugcucauucaggccga

SEQ ID NO: 1233734 - RNA, 21 nt, Mycobacterium leprae
cugcgacaucucggucaggug

SEQ ID NO: 1233735 - RNA, 22 nt, Mycobacterium leprae
cugcgaacacugaguagaugca

SEQ ID NO: 1233736 - RNA, 19 nt, Mycobacterium leprae
cugcggggagcuguauuua

SEQ ID NO: 1233737 - RNA, 19 nt, Mycobacterium leprae
cugcgugauccgucgcacg

SEQ ID NO: 1233738 - RNA, 22 nt, Mycobacterium leprae
cugcgugauccgucgcacgugg

SEQ ID NO: 1233739 - RNA, 17 nt, Mycobacterium leprae
cugccacggccccggau

SEQ ID NO: 1233740 - RNA, 13 nt, Mycobacterium leprae
cugccaggcgcga

SEQ ID NO: 1233741 - RNA, 21 nt, Mycobacterium leprae
cugccagcuucgcagacacag

SEQ ID NO: 1233742 - RNA, 14 nt, Mycobacterium leprae
cugccccgcuggug

SEQ ID NO: 1233743 - RNA, 14 nt, Mycobacterium leprae
cugccccgaucugg

SEQ ID NO: 1233744 - RNA, 13 nt, Mycobacterium leprae
cugcccugccccg

SEQ ID NO: 1233745 - RNA, 16 nt, Mycobacterium leprae
cugccgauauaccugc

SEQ ID NO: 1233746 - RNA, 22 nt, Mycobacterium leprae
cugccgauauaccugcgucgcu

SEQ ID NO: 1233747 - RNA, 18 nt, Mycobacterium leprae
cugccggcggcagauguu

SEQ ID NO: 1233748 - RNA, 17 nt, Mycobacterium leprae
cugcacauucaaccagc

SEQ ID NO: 1233749 - RNA, 22 nt, Mycobacterium leprae
cugcacauucaaccagccaauc

SEQ ID NO: 1233750 - RNA, 15 nt, Mycobacterium leprae
cugcaccccaggcua

SEQ ID NO: 1233751 - RNA, 17 nt, Mycobacterium leprae
cugcacccggccgucgc

SEQ ID NO: 1233752 - RNA, 23 nt, Mycobacterium leprae
cugcacccggcggcaugccugcu

SEQ ID NO: 1233753 - RNA, 18 nt, Mycobacterium leprae
cugcacccgccagggcgg

SEQ ID NO: 1233754 - RNA, 15 nt, Mycobacterium leprae
cugcacgaccacacu

SEQ ID NO: 1233755 - RNA, 22 nt, Mycobacterium leprae
cugcacgaccacacugugccug

SEQ ID NO: 1233756 - RNA, 22 nt, Mycobacterium leprae
cugcacuauaaggcagcucgcc

SEQ ID NO: 1233757 - RNA, 22 nt, Mycobacterium leprae
cugcagccacgaaaaucuggcg

SEQ ID NO: 1233758 - RNA, 23 nt, Mycobacterium leprae
cugcagcauuggcuccugggaag

SEQ ID NO: 1233759 - RNA, 19 nt, Mycobacterium leprae
cugcagcuacucgggguuu

SEQ ID NO: 1233760 - RNA, 17 nt, Mycobacterium leprae
cugcauaugcagcugcc

SEQ ID NO: 1233761 - RNA, 16 nt, Mycobacterium leprae
cugcaggagguagcaa

SEQ ID NO: 1233762 - RNA, 17 nt, Mycobacterium leprae
cugaugugcugagagca

SEQ ID NO: 1233763 - RNA, 18 nt, Mycobacterium leprae
cugaugugcugagagcag

SEQ ID NO: 1233764 - RNA, 23 nt, Mycobacterium leprae
cugaugugcugagagcagauggu

SEQ ID NO: 1233765 - RNA, 16 nt, Mycobacterium leprae
cugauguuaucccuug

SEQ ID NO: 1233766 - RNA, 21 nt, Mycobacterium leprae
cugauguuaucccuugcacca

SEQ ID NO: 1233767 - RNA, 22 nt, Mycobacterium leprae
cugauggcacuacccgacacaa

SEQ ID NO: 1233768 - RNA, 19 nt, Mycobacterium leprae
cugaggucaccggccaccg

SEQ ID NO: 1233769 - RNA, 22 nt, Mycobacterium leprae
cugaggguggcgccggcgugcg

SEQ ID NO: 1233770 - RNA, 18 nt, Mycobacterium leprae
cugaggcgauuguguaac

SEQ ID NO: 1233771 - RNA, 22 nt, Mycobacterium leprae
cugagcuagucccgauggcaac

SEQ ID NO: 1233772 - RNA, 18 nt, Mycobacterium leprae
cugagcguggcugcucaa

SEQ ID NO: 1233773 - RNA, 21 nt, Mycobacterium leprae
cugagcggcagauguccuuca

SEQ ID NO: 1233774 - RNA, 11 nt, Mycobacterium leprae
cugagcgaagu

SEQ ID NO: 1233775 - RNA, 21 nt, Mycobacterium leprae
cugacuucgucagacgaaauu

SEQ ID NO: 1233776 - RNA, 12 nt, Mycobacterium leprae
cugacagauacu

SEQ ID NO: 1233777 - RNA, 17 nt, Mycobacterium leprae
cugacauauuugggagc

SEQ ID NO: 1233778 - RNA, 13 nt, Mycobacterium leprae
cugacaucaagcc

SEQ ID NO: 1233779 - RNA, 11 nt, Mycobacterium leprae
gaauuaauaua

SEQ ID NO: 1233780 - RNA, 18 nt, Mycobacterium leprae
gaauuuagaggcugcacc

SEQ ID NO: 1233781 - RNA, 14 nt, Mycobacterium leprae
gaauugcuaccugg

SEQ ID NO: 1233782 - RNA, 14 nt, Mycobacterium leprae
gacaaaaacaggcc

SEQ ID NO: 1233783 - RNA, 16 nt, Mycobacterium leprae
gacaauucaacgaaua

SEQ ID NO: 1233784 - RNA, 23 nt, Mycobacterium leprae
gacacaaagcuggcgaacaacaa

SEQ ID NO: 1233785 - RNA, 22 nt, Mycobacterium leprae
gacacaaccagcuugggagcau

SEQ ID NO: 1233786 - RNA, 12 nt, Mycobacterium leprae
gacaccacugcc

SEQ ID NO: 1233787 - RNA, 16 nt, Mycobacterium leprae
gacaacccgacggcac

SEQ ID NO: 1233788 - RNA, 21 nt, Mycobacterium leprae
gacaaccucguuacgauccau

SEQ ID NO: 1233789 - RNA, 23 nt, Mycobacterium leprae
gaaugucucggugucggacuugu

SEQ ID NO: 1233790 - RNA, 22 nt, Mycobacterium leprae
gaaucuuugaucugcugcaggu

SEQ ID NO: 1233791 - RNA, 14 nt, Mycobacterium leprae
gaauccuguugacg

SEQ ID NO: 1233792 - RNA, 12 nt, Mycobacterium leprae
gaaucugugccu

SEQ ID NO: 1233793 - RNA, 15 nt, Mycobacterium leprae
gaaucugugccuggu

SEQ ID NO: 1233794 - RNA, 15 nt, Mycobacterium leprae
gaaucaugaagaucg

SEQ ID NO: 1233795 - RNA, 21 nt, Mycobacterium leprae
gaaucaugccgcagcaucagg

SEQ ID NO: 1233796 - RNA, 24 nt, Mycobacterium leprae
gaauaacugccaaucagcacucga

SEQ ID NO: 1233797 - RNA, 19 nt, Mycobacterium leprae
aaagaucgggccauuugga

SEQ ID NO: 1233798 - RNA, 13 nt, Mycobacterium leprae
aaagauauuaagu

SEQ ID NO: 1233799 - RNA, 22 nt, Mycobacterium leprae
aaagauauuaaguuuucucuaa

SEQ ID NO: 1233800 - RNA, 14 nt, Mycobacterium leprae
gaaguagagaaaaa

SEQ ID NO: 1233801 - RNA, 17 nt, Mycobacterium leprae
gaaguagcgacaucggg

SEQ ID NO: 1233802 - RNA, 13 nt, Mycobacterium leprae
gaaggaagcaaag

SEQ ID NO: 1233803 - RNA, 17 nt, Mycobacterium leprae
gaaggagccgaggcaca

SEQ ID NO: 1233804 - RNA, 22 nt, Mycobacterium leprae
gaaggagcggugguacaauccc

SEQ ID NO: 1233805 - RNA, 21 nt, Mycobacterium leprae
gaaggaucgagcggagcuggg

SEQ ID NO: 1233806 - RNA, 17 nt, Mycobacterium leprae
gaaggcgauaucgaugc

SEQ ID NO: 1233807 - RNA, 21 nt, Mycobacterium leprae
gaaggcgauaucgaugcaggc

SEQ ID NO: 1233808 - RNA, 15 nt, Mycobacterium leprae
gaaguaaagcccugu

SEQ ID NO: 1233809 - RNA, 15 nt, Mycobacterium leprae
gaagguagugugaca

SEQ ID NO: 1233810 - RNA, 20 nt, Mycobacterium leprae
gaaggggucgaugaggcucg

SEQ ID NO: 1233811 - RNA, 15 nt, Mycobacterium leprae
gaagaguccugaucu

SEQ ID NO: 1233812 - RNA, 20 nt, Mycobacterium leprae
gaagcagccaaugcugcagc

SEQ ID NO: 1233813 - RNA, 21 nt, Mycobacterium leprae
gaagcagccaaugcugcagcu

SEQ ID NO: 1233814 - RNA, 19 nt, Mycobacterium leprae
gaacugggugaccacccac

SEQ ID NO: 1233815 - RNA, 22 nt, Mycobacterium leprae
gaacuucuggauuucagggcac

SEQ ID NO: 1233816 - RNA, 12 nt, Mycobacterium leprae
gaacuucuucag

SEQ ID NO: 1233817 - RNA, 15 nt, Mycobacterium leprae
gaacuuguucuuugc

SEQ ID NO: 1233818 - RNA, 17 nt, Mycobacterium leprae
gaacuuuuccaugcugc

SEQ ID NO: 1233819 - RNA, 14 nt, Mycobacterium leprae
gacgccggccgucg

SEQ ID NO: 1233820 - RNA, 16 nt, Mycobacterium leprae
gacggagcgcaggaac

SEQ ID NO: 1233821 - RNA, 14 nt, Mycobacterium leprae
gacggugcggcugg

SEQ ID NO: 1233822 - RNA, 18 nt, Mycobacterium leprae
gacggucgagcuggacag

SEQ ID NO: 1233823 - RNA, 22 nt, Mycobacterium leprae
gacggccggcgucgcgucauca

SEQ ID NO: 1233824 - RNA, 22 nt, Mycobacterium leprae
gacuaagccgccgaacaagcca

SEQ ID NO: 1233825 - RNA, 13 nt, Mycobacterium leprae
gacuaauauguuc

SEQ ID NO: 1233826 - RNA, 15 nt, Mycobacterium leprae
gacguuaucuugaug

SEQ ID NO: 1233827 - RNA, 18 nt, Mycobacterium leprae
gacguguuuugcuguguu

SEQ ID NO: 1233828 - RNA, 21 nt, Mycobacterium leprae
gacguguuuugcuguguugcg

SEQ ID NO: 1233829 - RNA, 19 nt, Mycobacterium leprae
gacgaacccgucgaugauc

SEQ ID NO: 1233830 - RNA, 23 nt, Mycobacterium leprae
gacgaagacauaucaacaacugc

SEQ ID NO: 1233831 - RNA, 13 nt, Mycobacterium leprae
gaccuugaaagcg

SEQ ID NO: 1233832 - RNA, 15 nt, Mycobacterium leprae
gaccggccagugcaa

SEQ ID NO: 1233833 - RNA, 14 nt, Mycobacterium leprae
gaccugacccgacg

SEQ ID NO: 1233834 - RNA, 12 nt, Mycobacterium leprae
gacgacugccga

SEQ ID NO: 1233835 - RNA, 21 nt, Mycobacterium leprae
gacgcauccaucgcaucugcc

SEQ ID NO: 1233836 - RNA, 16 nt, Mycobacterium leprae
gacgccgcggcugccg

SEQ ID NO: 1233837 - RNA, 17 nt, Mycobacterium leprae
gacaccgaacagcucga

SEQ ID NO: 1233838 - RNA, 21 nt, Mycobacterium leprae
gacaccgaacagcucgacagc

SEQ ID NO: 1233839 - RNA, 16 nt, Mycobacterium leprae
gacagacgagcucuca

SEQ ID NO: 1233840 - RNA, 14 nt, Mycobacterium leprae
gacaccgcagggcu

SEQ ID NO: 1233841 - RNA, 21 nt, Mycobacterium leprae
gacaccgcccgguaucccaau

SEQ ID NO: 1233842 - RNA, 17 nt, Mycobacterium leprae
gacagaugcgaucgcag

SEQ ID NO: 1233843 - RNA, 18 nt, Mycobacterium leprae
gacagguugaaaaagaaa

SEQ ID NO: 1233844 - RNA, 15 nt, Mycobacterium leprae
gacaucgccaccgac

SEQ ID NO: 1233845 - RNA, 21 nt, Mycobacterium leprae
gacaguggggggcauggcacu

SEQ ID NO: 1233846 - RNA, 18 nt, Mycobacterium leprae
gacagugucccuguccuu

SEQ ID NO: 1233847 - RNA, 15 nt, Mycobacterium leprae
gaccacacugugccu

SEQ ID NO: 1233848 - RNA, 15 nt, Mycobacterium leprae
gacauguucacagga

SEQ ID NO: 1233849 - RNA, 12 nt, Mycobacterium leprae
gacauuucgaca

SEQ ID NO: 1233850 - RNA, 23 nt, Mycobacterium leprae
gaccaaaauuuaugguagucagu

SEQ ID NO: 1233851 - RNA, 21 nt, Mycobacterium leprae
gaccauaacacuacuugcgcu

SEQ ID NO: 1233852 - RNA, 18 nt, Mycobacterium leprae
gaccaugugaccgcggug

SEQ ID NO: 1233853 - RNA, 18 nt, Mycobacterium leprae
gaccacgccgacaccuca

SEQ ID NO: 1233854 - RNA, 19 nt, Mycobacterium leprae
gacccgacgcgcacuagca

SEQ ID NO: 1233855 - RNA, 18 nt, Mycobacterium leprae
gaccgagcgcgacaaucu

SEQ ID NO: 1233856 - RNA, 11 nt, Mycobacterium leprae
gacccccggau

SEQ ID NO: 1233857 - RNA, 23 nt, Mycobacterium leprae
gaccccaaccagacccacagcug

SEQ ID NO: 1233858 - RNA, 21 nt, Mycobacterium leprae
gaccgccgguuucgccccaac

SEQ ID NO: 1233859 - RNA, 14 nt, Mycobacterium leprae
gaccgcggauucca

SEQ ID NO: 1233860 - RNA, 15 nt, Mycobacterium leprae
gaacgagaagcagcu

SEQ ID NO: 1233861 - RNA, 21 nt, Mycobacterium leprae
gaaccuggaccgaccagagcu

SEQ ID NO: 1233862 - RNA, 22 nt, Mycobacterium leprae
gaaccugugcguaaggaagaug

SEQ ID NO: 1233863 - RNA, 16 nt, Mycobacterium leprae
gaaccucgccaccugg

SEQ ID NO: 1233864 - RNA, 22 nt, Mycobacterium leprae
gaaccgauuuucucggcagcag

SEQ ID NO: 1233865 - RNA, 17 nt, Mycobacterium leprae
gaaccgacgaugcuguu

SEQ ID NO: 1233866 - RNA, 15 nt, Mycobacterium leprae
gaaccggacagcacc

SEQ ID NO: 1233867 - RNA, 23 nt, Mycobacterium leprae
gaacccauauucgucaaaaaacu

SEQ ID NO: 1233868 - RNA, 23 nt, Mycobacterium leprae
gaacccagacgcgaccgccacca

SEQ ID NO: 1233869 - RNA, 20 nt, Mycobacterium leprae
gaacaucccugggccggcac

SEQ ID NO: 1233870 - RNA, 23 nt, Mycobacterium leprae
gaacugcgcaauacggugcacca

SEQ ID NO: 1233871 - RNA, 11 nt, Mycobacterium leprae
gaacugcaggu

SEQ ID NO: 1233872 - RNA, 13 nt, Mycobacterium leprae
gaacgugcugcug

SEQ ID NO: 1233873 - RNA, 21 nt, Mycobacterium leprae
gaacuaacugccuaucugccc

SEQ ID NO: 1233874 - RNA, 17 nt, Mycobacterium leprae
gaacgugagcgacagcu

SEQ ID NO: 1233875 - RNA, 17 nt, Mycobacterium leprae
gaacacgcugaucgcug

SEQ ID NO: 1233876 - RNA, 17 nt, Mycobacterium leprae
gaacacguucuugccau

SEQ ID NO: 1233877 - RNA, 20 nt, Mycobacterium leprae
gaacaaggguacgccaggua

SEQ ID NO: 1233878 - RNA, 17 nt, Mycobacterium leprae
gaacagcucgacagcag

SEQ ID NO: 1233879 - RNA, 14 nt, Mycobacterium leprae
gaacauagccagca

SEQ ID NO: 1233880 - RNA, 13 nt, Mycobacterium leprae
gaacauauccagu

SEQ ID NO: 1233881 - RNA, 16 nt, Mycobacterium leprae
gaaaugcauuggauga

SEQ ID NO: 1233882 - RNA, 22 nt, Mycobacterium leprae
gaaauucgcgcuacgauuuugc

SEQ ID NO: 1233883 - RNA, 20 nt, Mycobacterium leprae
gaaauucagcgccaggacuc

SEQ ID NO: 1233884 - RNA, 21 nt, Mycobacterium leprae
gaaacugcauacagcgcugga

SEQ ID NO: 1233885 - RNA, 15 nt, Mycobacterium leprae
gaaagcgcgagauua

SEQ ID NO: 1233886 - RNA, 22 nt, Mycobacterium leprae
gaaaauccaagucuuucagaua

SEQ ID NO: 1233887 - RNA, 17 nt, Mycobacterium leprae
gaaaaugaaaacaauau

SEQ ID NO: 1233888 - RNA, 17 nt, Mycobacterium leprae
gaaagcucaagcuugag

SEQ ID NO: 1233889 - RNA, 23 nt, Mycobacterium leprae
gaaagucaccugucauucugaca

SEQ ID NO: 1233890 - RNA, 14 nt, Mycobacterium leprae
gaaagucagcauca

SEQ ID NO: 1233891 - RNA, 15 nt, Mycobacterium leprae
gaaagucagcaucag

SEQ ID NO: 1233892 - RNA, 15 nt, Mycobacterium leprae
gaaauacaaugcagu

SEQ ID NO: 1233893 - RNA, 20 nt, Mycobacterium leprae
gaaaacuuaauaucuuuuua

SEQ ID NO: 1233894 - RNA, 14 nt, Mycobacterium leprae
gaaaaccacaagca

SEQ ID NO: 1233895 - RNA, 12 nt, Mycobacterium leprae
cuuuuagagaaa

SEQ ID NO: 1233896 - RNA, 17 nt, Mycobacterium leprae
aaagacggcaugucaau

SEQ ID NO: 1233897 - RNA, 18 nt, Mycobacterium leprae
cuuuucucaagcgggcaa

SEQ ID NO: 1233898 - RNA, 12 nt, Mycobacterium leprae
cuuuucgccggc

SEQ ID NO: 1233899 - RNA, 22 nt, Mycobacterium leprae
aaagacggugucggauccccuc

SEQ ID NO: 1233900 - RNA, 17 nt, Mycobacterium leprae
aaagacuucgaauauga

SEQ ID NO: 1233901 - RNA, 20 nt, Mycobacterium leprae
cuuucagcucgauggugcca

SEQ ID NO: 1233902 - RNA, 13 nt, Mycobacterium leprae
cuucgcucagcau

SEQ ID NO: 1233903 - RNA, 15 nt, Mycobacterium leprae
cuuugcguccuccac

SEQ ID NO: 1233904 - RNA, 18 nt, Mycobacterium leprae
cuuugcaaagcagaauau

SEQ ID NO: 1233905 - RNA, 19 nt, Mycobacterium leprae
cuuugaccagacaaauuga

SEQ ID NO: 1233906 - RNA, 17 nt, Mycobacterium leprae
cuuugacgaaaauguuu

SEQ ID NO: 1233907 - RNA, 23 nt, Mycobacterium leprae
cuuuguacgcguacuccagcagc

SEQ ID NO: 1233908 - RNA, 12 nt, Mycobacterium leprae
cuuugcuggugg

SEQ ID NO: 1233909 - RNA, 14 nt, Mycobacterium leprae
cuuucuuguucuug

SEQ ID NO: 1233910 - RNA, 16 nt, Mycobacterium leprae
cuuucucauuguggcu

SEQ ID NO: 1233911 - RNA, 23 nt, Mycobacterium leprae
cuuucucauuguggcuggcuucc

SEQ ID NO: 1233912 - RNA, 23 nt, Mycobacterium leprae
gagcaagcaacgaagggaaugcg

SEQ ID NO: 1233913 - RNA, 14 nt, Mycobacterium leprae
gagcaaggugguga

SEQ ID NO: 1233914 - RNA, 17 nt, Mycobacterium leprae
gagcaagcgcuaugcca

SEQ ID NO: 1233915 - RNA, 22 nt, Mycobacterium leprae
gagcaauccucagagugugugu

SEQ ID NO: 1233916 - RNA, 20 nt, Mycobacterium leprae
gagcagccacccgcaucguu

SEQ ID NO: 1233917 - RNA, 13 nt, Mycobacterium leprae
aaagcagaauauu

SEQ ID NO: 1233918 - RNA, 14 nt, Mycobacterium leprae
gagcagugcugaca

SEQ ID NO: 1233919 - RNA, 18 nt, Mycobacterium leprae
gagaucguccucaugccc

SEQ ID NO: 1233920 - RNA, 18 nt, Mycobacterium leprae
gagaucuuaaucgagcca

SEQ ID NO: 1233921 - RNA, 14 nt, Mycobacterium leprae
gagauccgagauca

SEQ ID NO: 1233922 - RNA, 20 nt, Mycobacterium leprae
gagauugacgucgguguggu

SEQ ID NO: 1233923 - RNA, 20 nt, Mycobacterium leprae
gagcgucgugaccgcggggc

SEQ ID NO: 1233924 - RNA, 20 nt, Mycobacterium leprae
gagcuccauugcguuugaug

SEQ ID NO: 1233925 - RNA, 23 nt, Mycobacterium leprae
gagcuccauuuuucuugaaaaau

SEQ ID NO: 1233926 - RNA, 24 nt, Mycobacterium leprae
gagcguucgauaacaguggucugg

SEQ ID NO: 1233927 - RNA, 16 nt, Mycobacterium leprae
gagcggagcugggcga

SEQ ID NO: 1233928 - RNA, 15 nt, Mycobacterium leprae
gagcgauugugcgga

SEQ ID NO: 1233929 - RNA, 18 nt, Mycobacterium leprae
gagcgcaucggcggcgga

SEQ ID NO: 1233930 - RNA, 15 nt, Mycobacterium leprae
gagcgcagccaccac

SEQ ID NO: 1233931 - RNA, 13 nt, Mycobacterium leprae
gagcgcccgcaca

SEQ ID NO: 1233932 - RNA, 22 nt, Mycobacterium leprae
gagcgcccaagugaugucuuug

SEQ ID NO: 1233933 - RNA, 19 nt, Mycobacterium leprae
gagccgauuaccaucugcc

SEQ ID NO: 1233934 - RNA, 21 nt, Mycobacterium leprae
gagccgacaaucgagcacggc

SEQ ID NO: 1233935 - RNA, 23 nt, Mycobacterium leprae
gaguuugguuauugcucugucua

SEQ ID NO: 1233936 - RNA, 19 nt, Mycobacterium leprae
gaguguccgcaaaaugcuc

SEQ ID NO: 1233937 - RNA, 15 nt, Mycobacterium leprae
gagugguaaggcuca

SEQ ID NO: 1233938 - RNA, 24 nt, Mycobacterium leprae
gaguggcgaacgggugaguaacac

SEQ ID NO: 1233939 - RNA, 21 nt, Mycobacterium leprae
gaguguggguauuggacccga

SEQ ID NO: 1233940 - RNA, 22 nt, Mycobacterium leprae
gaguguggguauuggacccgau

SEQ ID NO: 1233941 - RNA, 15 nt, Mycobacterium leprae
gagugcagugcccgc

SEQ ID NO: 1233942 - RNA, 14 nt, Mycobacterium leprae
gagugaucugcucg

SEQ ID NO: 1233943 - RNA, 22 nt, Mycobacterium leprae
gaguagaugcaacugagcgcgu

SEQ ID NO: 1233944 - RNA, 22 nt, Mycobacterium leprae
gagucgaccgccgaagcagcca

SEQ ID NO: 1233945 - RNA, 22 nt, Mycobacterium leprae
gagcugcccgugcucagugaag

SEQ ID NO: 1233946 - RNA, 14 nt, Mycobacterium leprae
gaggacgggcggcc

SEQ ID NO: 1233947 - RNA, 16 nt, Mycobacterium leprae
gaggcaugggugcguu

SEQ ID NO: 1233948 - RNA, 21 nt, Mycobacterium leprae
gaggagcccgacgcaacugcu

SEQ ID NO: 1233949 - RNA, 18 nt, Mycobacterium leprae
gaguaaccacuugcagua

SEQ ID NO: 1233950 - RNA, 13 nt, Mycobacterium leprae
gaguaaagggugg

SEQ ID NO: 1233951 - RNA, 19 nt, Mycobacterium leprae
gaguacacguugaugcauc

SEQ ID NO: 1233952 - RNA, 15 nt, Mycobacterium leprae
gagguaaaucuggca

SEQ ID NO: 1233953 - RNA, 19 nt, Mycobacterium leprae
gaggguccggaccuggacc

SEQ ID NO: 1233954 - RNA, 22 nt, Mycobacterium leprae
gaggguccggaccuggacccac

SEQ ID NO: 1233955 - RNA, 20 nt, Mycobacterium leprae
gaggccuugggugguggugu

SEQ ID NO: 1233956 - RNA, 15 nt, Mycobacterium leprae
gaucucgacggcagu

SEQ ID NO: 1233957 - RNA, 21 nt, Mycobacterium leprae
gaucugcucggcgaagucaag

SEQ ID NO: 1233958 - RNA, 17 nt, Mycobacterium leprae
gaucugguuuuugccau

SEQ ID NO: 1233959 - RNA, 12 nt, Mycobacterium leprae
gaucggccagcc

SEQ ID NO: 1233960 - RNA, 18 nt, Mycobacterium leprae
gaucggugacuuggcugg

SEQ ID NO: 1233961 - RNA, 23 nt, Mycobacterium leprae
gaucggugauaucgacuguuguu

SEQ ID NO: 1233962 - RNA, 17 nt, Mycobacterium leprae
gaucguaggucgcccgg

SEQ ID NO: 1233963 - RNA, 19 nt, Mycobacterium leprae
gaucgguuaugucggcugu

SEQ ID NO: 1233964 - RNA, 14 nt, Mycobacterium leprae
gaucggaacaucac

SEQ ID NO: 1233965 - RNA, 17 nt, Mycobacterium leprae
gaucgcccgcccaacua

SEQ ID NO: 1233966 - RNA, 13 nt, Mycobacterium leprae
aaagcccacgccu

SEQ ID NO: 1233967 - RNA, 22 nt, Mycobacterium leprae
aaagcccuguucaacgcaucac

SEQ ID NO: 1233968 - RNA, 14 nt, Mycobacterium leprae
gauccgguggcgac

SEQ ID NO: 1233969 - RNA, 16 nt, Mycobacterium leprae
gauccgucguaggcug

SEQ ID NO: 1233970 - RNA, 14 nt, Mycobacterium leprae
gauccgugcgccuu

SEQ ID NO: 1233971 - RNA, 20 nt, Mycobacterium leprae
gaucgcaccggcugcacccg

SEQ ID NO: 1233972 - RNA, 14 nt, Mycobacterium leprae
gaucgcagcccaga

SEQ ID NO: 1233973 - RNA, 19 nt, Mycobacterium leprae
gaucgcagucaucaccccg

SEQ ID NO: 1233974 - RNA, 22 nt, Mycobacterium leprae
gaucgcaaucgacggccgcaca

SEQ ID NO: 1233975 - RNA, 21 nt, Mycobacterium leprae
gaucgagaagggagugcagug

SEQ ID NO: 1233976 - RNA, 14 nt, Mycobacterium leprae
gaucgacggcuggc

SEQ ID NO: 1233977 - RNA, 13 nt, Mycobacterium leprae
gaucgacaauguc

SEQ ID NO: 1233978 - RNA, 16 nt, Mycobacterium leprae
gaucgacaccucacca

SEQ ID NO: 1233979 - RNA, 14 nt, Mycobacterium leprae
gauccugggcggcu

SEQ ID NO: 1233980 - RNA, 15 nt, Mycobacterium leprae
gauccugggcggcua

SEQ ID NO: 1233981 - RNA, 17 nt, Mycobacterium leprae
gauccuuguugccgaaa

SEQ ID NO: 1233982 - RNA, 15 nt, Mycobacterium leprae
gauccagucaugaag

SEQ ID NO: 1233983 - RNA, 13 nt, Mycobacterium leprae
gauccagcuguca

SEQ ID NO: 1233984 - RNA, 19 nt, Mycobacterium leprae
gaucccaucggcugcaccg

SEQ ID NO: 1233985 - RNA, 19 nt, Mycobacterium leprae
gaucccgacagcaugucca

SEQ ID NO: 1233986 - RNA, 19 nt, Mycobacterium leprae
gaucccgaaagccaccaua

SEQ ID NO: 1233987 - RNA, 16 nt, Mycobacterium leprae
gaucccggcgcugucc

SEQ ID NO: 1233988 - RNA, 21 nt, Mycobacterium leprae
gaucauguuccgcugauacgu

SEQ ID NO: 1233989 - RNA, 20 nt, Mycobacterium leprae
gaucauggcuggacagaagc

SEQ ID NO: 1233990 - RNA, 21 nt, Mycobacterium leprae
gaucaugcccgcgccgcagca

SEQ ID NO: 1233991 - RNA, 15 nt, Mycobacterium leprae
gaucaguucuucgau

SEQ ID NO: 1233992 - RNA, 20 nt, Mycobacterium leprae
gaucacguuggccggcaugc

SEQ ID NO: 1233993 - RNA, 14 nt, Mycobacterium leprae
gaucagcaacacug

SEQ ID NO: 1233994 - RNA, 12 nt, Mycobacterium leprae
gaucaagauccg

SEQ ID NO: 1233995 - RNA, 23 nt, Mycobacterium leprae
gauauggcgaucaugagcaacac

SEQ ID NO: 1233996 - RNA, 13 nt, Mycobacterium leprae
gauauguucggua

SEQ ID NO: 1233997 - RNA, 16 nt, Mycobacterium leprae
gaucaacgugacuuga

SEQ ID NO: 1233998 - RNA, 17 nt, Mycobacterium leprae
gaucaacguuuugccga

SEQ ID NO: 1233999 - RNA, 20 nt, Mycobacterium leprae
gaucaacguuuugccgagca

SEQ ID NO: 1234000 - RNA, 15 nt, Mycobacterium leprae
gaucaacagcgcagu

SEQ ID NO: 1234001 - RNA, 20 nt, Mycobacterium leprae
gauagaggaucugcacaaca

SEQ ID NO: 1234002 - RNA, 18 nt, Mycobacterium leprae
gauagauggagccaccac

SEQ ID NO: 1234003 - RNA, 14 nt, Mycobacterium leprae
gauagcugugcagg

SEQ ID NO: 1234004 - RNA, 14 nt, Mycobacterium leprae
gauaagcagcagcg

SEQ ID NO: 1234005 - RNA, 17 nt, Mycobacterium leprae
gauaagauaaauaguau

SEQ ID NO: 1234006 - RNA, 21 nt, Mycobacterium leprae
gauacucgaguggcgaacggg

SEQ ID NO: 1234007 - RNA, 21 nt, Mycobacterium leprae
gauacugcugcacccggcggc

SEQ ID NO: 1234008 - RNA, 18 nt, Mycobacterium leprae
gauagacacuccacgcac

SEQ ID NO: 1234009 - RNA, 17 nt, Mycobacterium leprae
gaugcacgcgcgccugg

SEQ ID NO: 1234010 - RNA, 20 nt, Mycobacterium leprae
gaugauuacaucauccgccc

SEQ ID NO: 1234011 - RNA, 15 nt, Mycobacterium leprae
gaugauguuugcccg

SEQ ID NO: 1234012 - RNA, 22 nt, Mycobacterium leprae
gaugauuggccauuguugugcu

SEQ ID NO: 1234013 - RNA, 17 nt, Mycobacterium leprae
gaugcaggcgugggugu

SEQ ID NO: 1234014 - RNA, 17 nt, Mycobacterium leprae
gaugccccaucucaucu

SEQ ID NO: 1234015 - RNA, 14 nt, Mycobacterium leprae
gaugccuuacaaug

SEQ ID NO: 1234016 - RNA, 19 nt, Mycobacterium leprae
gaugcuaucgccgguggcu

SEQ ID NO: 1234017 - RNA, 13 nt, Mycobacterium leprae
gaugcggugguga

SEQ ID NO: 1234018 - RNA, 21 nt, Mycobacterium leprae
gaucuuuucggcugcacugug

SEQ ID NO: 1234019 - RNA, 17 nt, Mycobacterium leprae
gaugagauucgagcggg

SEQ ID NO: 1234020 - RNA, 20 nt, Mycobacterium leprae
gaugaguaucugugggcagu

SEQ ID NO: 1234021 - RNA, 14 nt, Mycobacterium leprae
gaugagucagacac

SEQ ID NO: 1234022 - RNA, 17 nt, Mycobacterium leprae
gaugauccacucgccgc

SEQ ID NO: 1234023 - RNA, 16 nt, Mycobacterium leprae
gaugaucuuggcccgg

SEQ ID NO: 1234024 - RNA, 14 nt, Mycobacterium leprae
gauuaccacugccg

SEQ ID NO: 1234025 - RNA, 21 nt, Mycobacterium leprae
gauuaucugcaacucaucggc

SEQ ID NO: 1234026 - RNA, 14 nt, Mycobacterium leprae
gauguuggcgccug

SEQ ID NO: 1234027 - RNA, 15 nt, Mycobacterium leprae
gauguuauguagcug

SEQ ID NO: 1234028 - RNA, 14 nt, Mycobacterium leprae
gauguggccgugga

SEQ ID NO: 1234029 - RNA, 14 nt, Mycobacterium leprae
gaugugcagcagcu

SEQ ID NO: 1234030 - RNA, 21 nt, Mycobacterium leprae
gauggugcacuugcacuaugu

SEQ ID NO: 1234031 - RNA, 22 nt, Mycobacterium leprae
gaugggacuagucgucgugcug

SEQ ID NO: 1234032 - RNA, 15 nt, Mycobacterium leprae
gaugggacuggcggu

SEQ ID NO: 1234033 - RNA, 17 nt, Mycobacterium leprae
gaugggguuguggaccg

SEQ ID NO: 1234034 - RNA, 18 nt, Mycobacterium leprae
gauguagccaacagccaa

SEQ ID NO: 1234035 - RNA, 13 nt, Mycobacterium leprae
gauguccauggcu

SEQ ID NO: 1234036 - RNA, 14 nt, Mycobacterium leprae
gauggugugcagua

SEQ ID NO: 1234037 - RNA, 12 nt, Mycobacterium leprae
gauguaaagcag

SEQ ID NO: 1234038 - RNA, 21 nt, Mycobacterium leprae
gauguaaucgcgugccagcgc

SEQ ID NO: 1234039 - RNA, 19 nt, Mycobacterium leprae
gauguaaucguaccaacac

SEQ ID NO: 1234040 - RNA, 16 nt, Mycobacterium leprae
gauggaguuuuuguuu

SEQ ID NO: 1234041 - RNA, 15 nt, Mycobacterium leprae
gaugcugggucagca

SEQ ID NO: 1234042 - RNA, 21 nt, Mycobacterium leprae
gaugcuggccguguugcugcu

SEQ ID NO: 1234043 - RNA, 22 nt, Mycobacterium leprae
gaugcuguguggcuguuucugc

SEQ ID NO: 1234044 - RNA, 15 nt, Mycobacterium leprae
gauggccucuccagc

SEQ ID NO: 1234045 - RNA, 15 nt, Mycobacterium leprae
gauggccugcuggcc

SEQ ID NO: 1234046 - RNA, 15 nt, Mycobacterium leprae
gauggccgccagcac

SEQ ID NO: 1234047 - RNA, 12 nt, Mycobacterium leprae
gauuugcucagu

SEQ ID NO: 1234048 - RNA, 15 nt, Mycobacterium leprae
gauuugaacuuggca

SEQ ID NO: 1234049 - RNA, 17 nt, Mycobacterium leprae
gauugggcauccugcug

SEQ ID NO: 1234050 - RNA, 19 nt, Mycobacterium leprae
gauuuaauuacaucggccc

SEQ ID NO: 1234051 - RNA, 21 nt, Mycobacterium leprae
gauuuaccacucgucuuuccg

SEQ ID NO: 1234052 - RNA, 18 nt, Mycobacterium leprae
gauuucaucugccaggcg

SEQ ID NO: 1234053 - RNA, 15 nt, Mycobacterium leprae
gauucgagcgggcaa

SEQ ID NO: 1234054 - RNA, 22 nt, Mycobacterium leprae
gauuggaaaagauuuucucggu

SEQ ID NO: 1234055 - RNA, 23 nt, Mycobacterium leprae
gauugggucagucagcgugccug

SEQ ID NO: 1234056 - RNA, 21 nt, Mycobacterium leprae
gauuggccauuguugugcugg

SEQ ID NO: 1234057 - RNA, 22 nt, Mycobacterium leprae
gauugcagauguugcagcaguu

SEQ ID NO: 1234058 - RNA, 20 nt, Mycobacterium leprae
gauucuaggcggugacugaa

SEQ ID NO: 1234059 - RNA, 15 nt, Mycobacterium leprae
gcaaccaaggcuccc

SEQ ID NO: 1234060 - RNA, 18 nt, Mycobacterium leprae
gcaacaaauucgccgcgg

SEQ ID NO: 1234061 - RNA, 19 nt, Mycobacterium leprae
gcaacaaauucgccgcggc

SEQ ID NO: 1234062 - RNA, 13 nt, Mycobacterium leprae
gcaacaccuccuc

SEQ ID NO: 1234063 - RNA, 14 nt, Mycobacterium leprae
gcaaagcggcauua

SEQ ID NO: 1234064 - RNA, 19 nt, Mycobacterium leprae
gauuuugcuaccgaagguc

SEQ ID NO: 1234065 - RNA, 16 nt, Mycobacterium leprae
gcaaaaugcuccccca

SEQ ID NO: 1234066 - RNA, 14 nt, Mycobacterium leprae
gcaaacaacuggag

SEQ ID NO: 1234067 - RNA, 19 nt, Mycobacterium leprae
gcaaaacgucgaucucgac

SEQ ID NO: 1234068 - RNA, 23 nt, Mycobacterium leprae
gcaaaacaacguaccuaagccaa

SEQ ID NO: 1234069 - RNA, 22 nt, Mycobacterium leprae
gccaggauagauaaugccaccg

SEQ ID NO: 1234070 - RNA, 23 nt, Mycobacterium leprae
gccaggaugcggcccagugcacu

SEQ ID NO: 1234071 - RNA, 12 nt, Mycobacterium leprae
gccagcucagca

SEQ ID NO: 1234072 - RNA, 12 nt, Mycobacterium leprae
gccagcgcggca

SEQ ID NO: 1234073 - RNA, 22 nt, Mycobacterium leprae
gccagcaucaacgccagcaagc

SEQ ID NO: 1234074 - RNA, 13 nt, Mycobacterium leprae
gccagccaacggc

SEQ ID NO: 1234075 - RNA, 19 nt, Mycobacterium leprae
gccagcagcgggaccaaga

SEQ ID NO: 1234076 - RNA, 22 nt, Mycobacterium leprae
gccagcgacgguaagcucgccc

SEQ ID NO: 1234077 - RNA, 18 nt, Mycobacterium leprae
gccaaaguccaugugcug

SEQ ID NO: 1234078 - RNA, 14 nt, Mycobacterium leprae
gccacauccucggu

SEQ ID NO: 1234079 - RNA, 14 nt, Mycobacterium leprae
gccaccugcaugga

SEQ ID NO: 1234080 - RNA, 16 nt, Mycobacterium leprae
gccaccuaggccugcu

SEQ ID NO: 1234081 - RNA, 23 nt, Mycobacterium leprae
gccaccagggaagaucucagcca

SEQ ID NO: 1234082 - RNA, 20 nt, Mycobacterium leprae
gccagcacaucgucgggugc

SEQ ID NO: 1234083 - RNA, 19 nt, Mycobacterium leprae
gccagcaccaaccuguaga

SEQ ID NO: 1234084 - RNA, 23 nt, Mycobacterium leprae
gccagacacuggcggauuuugac

SEQ ID NO: 1234085 - RNA, 17 nt, Mycobacterium leprae
gccacgcuggcacuccg

SEQ ID NO: 1234086 - RNA, 15 nt, Mycobacterium leprae
gccacggaugugguc

SEQ ID NO: 1234087 - RNA, 15 nt, Mycobacterium leprae
gcaucgaagcaacca

SEQ ID NO: 1234088 - RNA, 11 nt, Mycobacterium leprae
gcaucaucgcc

SEQ ID NO: 1234089 - RNA, 14 nt, Mycobacterium leprae
gcaucaucgcccac

SEQ ID NO: 1234090 - RNA, 16 nt, Mycobacterium leprae
gcaucaucaacaugua

SEQ ID NO: 1234091 - RNA, 23 nt, Mycobacterium leprae
gcauccagaaaguacugaccggc

SEQ ID NO: 1234092 - RNA, 14 nt, Mycobacterium leprae
gcaucugccgugca

SEQ ID NO: 1234093 - RNA, 20 nt, Mycobacterium leprae
gcaucugccgugcagcgacc

SEQ ID NO: 1234094 - RNA, 17 nt, Mycobacterium leprae
gcaucgaugauccggcc

SEQ ID NO: 1234095 - RNA, 21 nt, Mycobacterium leprae
gcaucaagcugugagugugca

SEQ ID NO: 1234096 - RNA, 19 nt, Mycobacterium leprae
gcaucaagucggucgccga

SEQ ID NO: 1234097 - RNA, 17 nt, Mycobacterium leprae
gcauagcgcuaaaugga

SEQ ID NO: 1234098 - RNA, 17 nt, Mycobacterium leprae
gcaucugcuacgcuggc

SEQ ID NO: 1234099 - RNA, 19 nt, Mycobacterium leprae
gcaucugguagccguucgg

SEQ ID NO: 1234100 - RNA, 16 nt, Mycobacterium leprae
gcaucuucgcccagca

SEQ ID NO: 1234101 - RNA, 17 nt, Mycobacterium leprae
gcaugaugugcucgggc

SEQ ID NO: 1234102 - RNA, 22 nt, Mycobacterium leprae
gcauggacccacugggcaagca

SEQ ID NO: 1234103 - RNA, 18 nt, Mycobacterium leprae
gcauggcgaugcgcagcc

SEQ ID NO: 1234104 - RNA, 14 nt, Mycobacterium leprae
gcauggccgcuggg

SEQ ID NO: 1234105 - RNA, 16 nt, Mycobacterium leprae
gcauggccgcuggggc

SEQ ID NO: 1234106 - RNA, 20 nt, Mycobacterium leprae
gcauugccggggcugcgcug

SEQ ID NO: 1234107 - RNA, 22 nt, Mycobacterium leprae
gcauugccggggcugcgcuggg

SEQ ID NO: 1234108 - RNA, 17 nt, Mycobacterium leprae
gcauucgcaaagcggca

SEQ ID NO: 1234109 - RNA, 20 nt, Mycobacterium leprae
gcaggcugcauccugcagca

SEQ ID NO: 1234110 - RNA, 14 nt, Mycobacterium leprae
gcagggccagcccg

SEQ ID NO: 1234111 - RNA, 23 nt, Mycobacterium leprae
gcaggagaaacaaaggugcccac

SEQ ID NO: 1234112 - RNA, 17 nt, Mycobacterium leprae
gcaggaaucccagcagc

SEQ ID NO: 1234113 - RNA, 13 nt, Mycobacterium leprae
gcaggccggccug

SEQ ID NO: 1234114 - RNA, 15 nt, Mycobacterium leprae
gcagcuacagcgggc

SEQ ID NO: 1234115 - RNA, 15 nt, Mycobacterium leprae
gcaguuuccaacaaa

SEQ ID NO: 1234116 - RNA, 20 nt, Mycobacterium leprae
gcaguguucaggccaucaga

SEQ ID NO: 1234117 - RNA, 19 nt, Mycobacterium leprae
gcaguuagcaugagcugcu

SEQ ID NO: 1234118 - RNA, 14 nt, Mycobacterium leprae
gcagugugcuuucg

SEQ ID NO: 1234119 - RNA, 17 nt, Mycobacterium leprae
gcaguguggcauccgcc

SEQ ID NO: 1234120 - RNA, 21 nt, Mycobacterium leprae
gcagugucaucgcguagugau

SEQ ID NO: 1234121 - RNA, 20 nt, Mycobacterium leprae
gcaguucaggauauggcaga

SEQ ID NO: 1234122 - RNA, 17 nt, Mycobacterium leprae
gcagugcggugaucgcu

SEQ ID NO: 1234123 - RNA, 11 nt, Mycobacterium leprae
gcaguggacac

SEQ ID NO: 1234124 - RNA, 23 nt, Mycobacterium leprae
gcaguaucguguuagugaacagu

SEQ ID NO: 1234125 - RNA, 22 nt, Mycobacterium leprae
gcaguaaccgauauggcgauca

SEQ ID NO: 1234126 - RNA, 19 nt, Mycobacterium leprae
gcagggcuguuuggccucc

SEQ ID NO: 1234127 - RNA, 23 nt, Mycobacterium leprae
gcagggcguugccguccccuccc

SEQ ID NO: 1234128 - RNA, 13 nt, Mycobacterium leprae
gcaguccaccaga

SEQ ID NO: 1234129 - RNA, 13 nt, Mycobacterium leprae
gcagucaucaccc

SEQ ID NO: 1234130 - RNA, 17 nt, Mycobacterium leprae
gcagucaguuuggcgcu

SEQ ID NO: 1234131 - RNA, 20 nt, Mycobacterium leprae
gcagucaguuuggcgcugcu

SEQ ID NO: 1234132 - RNA, 21 nt, Mycobacterium leprae
gcagucguucgcugacagcaa

SEQ ID NO: 1234133 - RNA, 20 nt, Mycobacterium leprae
gcagucuuggcucacaucuc

SEQ ID NO: 1234134 - RNA, 15 nt, Mycobacterium leprae
gcagucucgcuggcg

SEQ ID NO: 1234135 - RNA, 17 nt, Mycobacterium leprae
gcagugagcagugggcc

SEQ ID NO: 1234136 - RNA, 20 nt, Mycobacterium leprae
gcagugcacgagcggguguu

SEQ ID NO: 1234137 - RNA, 21 nt, Mycobacterium leprae
gcagugaucacaucagugcug

SEQ ID NO: 1234138 - RNA, 19 nt, Mycobacterium leprae
gccgcgcacccgagcggca

SEQ ID NO: 1234139 - RNA, 21 nt, Mycobacterium leprae
gccgcgcaaacaacuggagua

SEQ ID NO: 1234140 - RNA, 20 nt, Mycobacterium leprae
aaagcucaggccguggacga

SEQ ID NO: 1234141 - RNA, 15 nt, Mycobacterium leprae
gccgcuccgcgcaca

SEQ ID NO: 1234142 - RNA, 21 nt, Mycobacterium leprae
gccgcuccgcgcacagugugg

SEQ ID NO: 1234143 - RNA, 17 nt, Mycobacterium leprae
gccgcucuagaaauuag

SEQ ID NO: 1234144 - RNA, 15 nt, Mycobacterium leprae
gccgcugcauccgca

SEQ ID NO: 1234145 - RNA, 15 nt, Mycobacterium leprae
gccgcuggucaagcu

SEQ ID NO: 1234146 - RNA, 19 nt, Mycobacterium leprae
gccgcuuaaauuccccacu

SEQ ID NO: 1234147 - RNA, 16 nt, Mycobacterium leprae
gccgcgguuuccgcgg

SEQ ID NO: 1234148 - RNA, 18 nt, Mycobacterium leprae
gccgcguauaccggcuga

SEQ ID NO: 1234149 - RNA, 13 nt, Mycobacterium leprae
gccgcggcugccg

SEQ ID NO: 1234150 - RNA, 15 nt, Mycobacterium leprae
gccgcggcugggcag

SEQ ID NO: 1234151 - RNA, 16 nt, Mycobacterium leprae
gccgaauuaccauugg

SEQ ID NO: 1234152 - RNA, 17 nt, Mycobacterium leprae
gccgaauuaccauuggc

SEQ ID NO: 1234153 - RNA, 16 nt, Mycobacterium leprae
gccgaauucgaggacg

SEQ ID NO: 1234154 - RNA, 13 nt, Mycobacterium leprae
gccgacaaucuca

SEQ ID NO: 1234155 - RNA, 18 nt, Mycobacterium leprae
gccgacaaucucacgucc

SEQ ID NO: 1234156 - RNA, 21 nt, Mycobacterium leprae
gccgacaccgauaccagcggc

SEQ ID NO: 1234157 - RNA, 13 nt, Mycobacterium leprae
gccgaaucgguac

SEQ ID NO: 1234158 - RNA, 23 nt, Mycobacterium leprae
gccgaacagcugguucauggcug

SEQ ID NO: 1234159 - RNA, 13 nt, Mycobacterium leprae
gccgaccgcccgg

SEQ ID NO: 1234160 - RNA, 14 nt, Mycobacterium leprae
gcccugcgggaagu

SEQ ID NO: 1234161 - RNA, 15 nt, Mycobacterium leprae
gccgaacagccgcgc

SEQ ID NO: 1234162 - RNA, 15 nt, Mycobacterium leprae
gccgcagcaucuguc

SEQ ID NO: 1234163 - RNA, 18 nt, Mycobacterium leprae
gccgccacgaccaaaccu

SEQ ID NO: 1234164 - RNA, 21 nt, Mycobacterium leprae
gccgcacgggauggccaagcc

SEQ ID NO: 1234165 - RNA, 19 nt, Mycobacterium leprae
gccgcaccgcuucagagug

SEQ ID NO: 1234166 - RNA, 15 nt, Mycobacterium leprae
gccgacuucggcaac

SEQ ID NO: 1234167 - RNA, 17 nt, Mycobacterium leprae
gccgaucgugugcacug

SEQ ID NO: 1234168 - RNA, 14 nt, Mycobacterium leprae
gccgauauaccugc

SEQ ID NO: 1234169 - RNA, 15 nt, Mycobacterium leprae
gccgaggcacaacau

SEQ ID NO: 1234170 - RNA, 19 nt, Mycobacterium leprae
gccgaggcacaacaucacc

SEQ ID NO: 1234171 - RNA, 20 nt, Mycobacterium leprae
gccgagcuguuccucuugac

SEQ ID NO: 1234172 - RNA, 17 nt, Mycobacterium leprae
gccaucgacgccgccgu

SEQ ID NO: 1234173 - RNA, 22 nt, Mycobacterium leprae
gccaucgacgccgccguugcca

SEQ ID NO: 1234174 - RNA, 15 nt, Mycobacterium leprae
gccaggcucuauguu

SEQ ID NO: 1234175 - RNA, 20 nt, Mycobacterium leprae
gccauauacaaaccccagac

SEQ ID NO: 1234176 - RNA, 19 nt, Mycobacterium leprae
gccaggcgaauugcuaccu

SEQ ID NO: 1234177 - RNA, 23 nt, Mycobacterium leprae
gccaggcgaauugcuaccugguu

SEQ ID NO: 1234178 - RNA, 19 nt, Mycobacterium leprae
gccauugcucugggcgcgg

SEQ ID NO: 1234179 - RNA, 17 nt, Mycobacterium leprae
gccauuguugugcuggg

SEQ ID NO: 1234180 - RNA, 14 nt, Mycobacterium leprae
gcccaacgcugccc

SEQ ID NO: 1234181 - RNA, 15 nt, Mycobacterium leprae
gcccaacgucuggac

SEQ ID NO: 1234182 - RNA, 14 nt, Mycobacterium leprae
gccauguuaaacag

SEQ ID NO: 1234183 - RNA, 14 nt, Mycobacterium leprae
gcccagcagguuga

SEQ ID NO: 1234184 - RNA, 20 nt, Mycobacterium leprae
gcccagcaguuacugguggc

SEQ ID NO: 1234185 - RNA, 17 nt, Mycobacterium leprae
gcccaggugucuuccag

SEQ ID NO: 1234186 - RNA, 20 nt, Mycobacterium leprae
gcccaggugcccagccccug

SEQ ID NO: 1234187 - RNA, 12 nt, Mycobacterium leprae
gcccaccgcaac

SEQ ID NO: 1234188 - RNA, 19 nt, Mycobacterium leprae
gcccaccgccggacggcac

SEQ ID NO: 1234189 - RNA, 23 nt, Mycobacterium leprae
gcccacucccacucuagauaacu

SEQ ID NO: 1234190 - RNA, 13 nt, Mycobacterium leprae
gcccacguccacc

SEQ ID NO: 1234191 - RNA, 14 nt, Mycobacterium leprae
gccccggccgccgu

SEQ ID NO: 1234192 - RNA, 17 nt, Mycobacterium leprae
gcccgaaagaugcaggu

SEQ ID NO: 1234193 - RNA, 23 nt, Mycobacterium leprae
gcccgaaaaguucggccauggca

SEQ ID NO: 1234194 - RNA, 14 nt, Mycobacterium leprae
gccccgguggcugu

SEQ ID NO: 1234195 - RNA, 15 nt, Mycobacterium leprae
gcccgaggagaggca

SEQ ID NO: 1234196 - RNA, 18 nt, Mycobacterium leprae
gcccgcgucgccuuagcc

SEQ ID NO: 1234197 - RNA, 14 nt, Mycobacterium leprae
gcccgcguucaugg

SEQ ID NO: 1234198 - RNA, 14 nt, Mycobacterium leprae
gcccgcgccgccgu

SEQ ID NO: 1234199 - RNA, 13 nt, Mycobacterium leprae
gcccgcgccgccg

SEQ ID NO: 1234200 - RNA, 20 nt, Mycobacterium leprae
gcccggaaauaguggcugau

SEQ ID NO: 1234201 - RNA, 22 nt, Mycobacterium leprae
gcccgcugggugagcugugccg

SEQ ID NO: 1234202 - RNA, 16 nt, Mycobacterium leprae
gcccggacggcccagc

SEQ ID NO: 1234203 - RNA, 18 nt, Mycobacterium leprae
gcccggacggcccagcac

SEQ ID NO: 1234204 - RNA, 20 nt, Mycobacterium leprae
gcccgcugccaggaucugcu

SEQ ID NO: 1234205 - RNA, 21 nt, Mycobacterium leprae
gcccgcugccaggaucugcuc

SEQ ID NO: 1234206 - RNA, 18 nt, Mycobacterium leprae
gcccggauacagcacggc

SEQ ID NO: 1234207 - RNA, 11 nt, Mycobacterium leprae
gcccggccagu

SEQ ID NO: 1234208 - RNA, 19 nt, Mycobacterium leprae
gcgccgaucccaucggcug

SEQ ID NO: 1234209 - RNA, 22 nt, Mycobacterium leprae
gcgccgaaaaccuacgcggucc

SEQ ID NO: 1234210 - RNA, 15 nt, Mycobacterium leprae
gcgccgccugcugca

SEQ ID NO: 1234211 - RNA, 18 nt, Mycobacterium leprae
gcgccggcgucggccagu

SEQ ID NO: 1234212 - RNA, 18 nt, Mycobacterium leprae
gcgccugagcgggccagc

SEQ ID NO: 1234213 - RNA, 14 nt, Mycobacterium leprae
gcgccugccacuga

SEQ ID NO: 1234214 - RNA, 13 nt, Mycobacterium leprae
gcgccucaccaaa

SEQ ID NO: 1234215 - RNA, 14 nt, Mycobacterium leprae
gcgcggcgcacgua

SEQ ID NO: 1234216 - RNA, 16 nt, Mycobacterium leprae
gcgccuugcaagccac

SEQ ID NO: 1234217 - RNA, 15 nt, Mycobacterium leprae
gcgcgacugcagugu

SEQ ID NO: 1234218 - RNA, 15 nt, Mycobacterium leprae
gcggcguguaaguag

SEQ ID NO: 1234219 - RNA, 15 nt, Mycobacterium leprae
gcggcggcggccagc

SEQ ID NO: 1234220 - RNA, 13 nt, Mycobacterium leprae
gcggcggccccuu

SEQ ID NO: 1234221 - RNA, 13 nt, Mycobacterium leprae
gcggcgcuaacaa

SEQ ID NO: 1234222 - RNA, 13 nt, Mycobacterium leprae
gcggcgcccagca

SEQ ID NO: 1234223 - RNA, 18 nt, Mycobacterium leprae
gcggccgaauucgaggac

SEQ ID NO: 1234224 - RNA, 19 nt, Mycobacterium leprae
gcgguaacggcgguggcag

SEQ ID NO: 1234225 - RNA, 15 nt, Mycobacterium leprae
gcggguuucccagag

SEQ ID NO: 1234226 - RNA, 17 nt, Mycobacterium leprae
gcggggauagacacucc

SEQ ID NO: 1234227 - RNA, 22 nt, Mycobacterium leprae
gcggguaccccauucagcggcg

SEQ ID NO: 1234228 - RNA, 16 nt, Mycobacterium leprae
gcgggcuugaccugga

SEQ ID NO: 1234229 - RNA, 19 nt, Mycobacterium leprae
gcgggacaacaccacuucu

SEQ ID NO: 1234230 - RNA, 14 nt, Mycobacterium leprae
gcggcauucccaac

SEQ ID NO: 1234231 - RNA, 19 nt, Mycobacterium leprae
gcggcauucccaaccgcga

SEQ ID NO: 1234232 - RNA, 13 nt, Mycobacterium leprae
gcggccaccgcga

SEQ ID NO: 1234233 - RNA, 22 nt, Mycobacterium leprae
gcggaccgucgcgcgugccacc

SEQ ID NO: 1234234 - RNA, 23 nt, Mycobacterium leprae
gcggaccgucgcgcgugccacca

SEQ ID NO: 1234235 - RNA, 20 nt, Mycobacterium leprae
gcggaccuagucgaggcuca

SEQ ID NO: 1234236 - RNA, 16 nt, Mycobacterium leprae
gcggcagcugcugagc

SEQ ID NO: 1234237 - RNA, 14 nt, Mycobacterium leprae
gcggcagcuggaaa

SEQ ID NO: 1234238 - RNA, 20 nt, Mycobacterium leprae
gcggcacguucgaucggcag

SEQ ID NO: 1234239 - RNA, 15 nt, Mycobacterium leprae
gcggauuuaccccca

SEQ ID NO: 1234240 - RNA, 19 nt, Mycobacterium leprae
gcggauuuacccccagaac

SEQ ID NO: 1234241 - RNA, 17 nt, Mycobacterium leprae
gcgcuucaucagcucug

SEQ ID NO: 1234242 - RNA, 17 nt, Mycobacterium leprae
gcgcugugauuggcugc

SEQ ID NO: 1234243 - RNA, 18 nt, Mycobacterium leprae
gcgcugugauuggcugcu

SEQ ID NO: 1234244 - RNA, 19 nt, Mycobacterium leprae
gcggaagcuccauguuagg

SEQ ID NO: 1234245 - RNA, 17 nt, Mycobacterium leprae
gcgcugcugcggaucgg

SEQ ID NO: 1234246 - RNA, 19 nt, Mycobacterium leprae
gcgcucgcuaucgccacac

SEQ ID NO: 1234247 - RNA, 16 nt, Mycobacterium leprae
gcgcugaugcgagcgg

SEQ ID NO: 1234248 - RNA, 23 nt, Mycobacterium leprae
gcgcaucacuucagcgacaggca

SEQ ID NO: 1234249 - RNA, 21 nt, Mycobacterium leprae
gcgcaucugccgugcagcgac

SEQ ID NO: 1234250 - RNA, 18 nt, Mycobacterium leprae
gcgccaaacacggccagc

SEQ ID NO: 1234251 - RNA, 19 nt, Mycobacterium leprae
gcgccacuguagagcuuca

SEQ ID NO: 1234252 - RNA, 19 nt, Mycobacterium leprae
gcgcagcaagcggccgccc

SEQ ID NO: 1234253 - RNA, 14 nt, Mycobacterium leprae
gcgcagcacaaaau

SEQ ID NO: 1234254 - RNA, 17 nt, Mycobacterium leprae
gcgcacggaacccucug

SEQ ID NO: 1234255 - RNA, 19 nt, Mycobacterium leprae
gcgcagcucgccaaggucg

SEQ ID NO: 1234256 - RNA, 23 nt, Mycobacterium leprae
gcgcaggucacccuccucgcggc

SEQ ID NO: 1234257 - RNA, 23 nt, Mycobacterium leprae
gcgcaguuaguuuaacgccugcu

SEQ ID NO: 1234258 - RNA, 22 nt, Mycobacterium leprae
gcgcagugucaucgcguaguga

SEQ ID NO: 1234259 - RNA, 14 nt, Mycobacterium leprae
gcgcacaaaaaucc

SEQ ID NO: 1234260 - RNA, 16 nt, Mycobacterium leprae
gcgcacagcuggcuug

SEQ ID NO: 1234261 - RNA, 20 nt, Mycobacterium leprae
gcgcaagcgugcaggcugca

SEQ ID NO: 1234262 - RNA, 14 nt, Mycobacterium leprae
gcgcaagucuggag

SEQ ID NO: 1234263 - RNA, 17 nt, Mycobacterium leprae
gcgauugaugcacgcgc

SEQ ID NO: 1234264 - RNA, 21 nt, Mycobacterium leprae
gcgauugaugcacgcgcgccu

SEQ ID NO: 1234265 - RNA, 18 nt, Mycobacterium leprae
gcgaugucgagcggacca

SEQ ID NO: 1234266 - RNA, 20 nt, Mycobacterium leprae
gcgaugagauucgagcgggc

SEQ ID NO: 1234267 - RNA, 16 nt, Mycobacterium leprae
gcgauggcauugcugg

SEQ ID NO: 1234268 - RNA, 16 nt, Mycobacterium leprae
gcgauggggggcagca

SEQ ID NO: 1234269 - RNA, 21 nt, Mycobacterium leprae
gcgauggggggcagcaguggg

SEQ ID NO: 1234270 - RNA, 18 nt, Mycobacterium leprae
gcgaugaccggcgguggc

SEQ ID NO: 1234271 - RNA, 18 nt, Mycobacterium leprae
gcgaucugcauucugagu

SEQ ID NO: 1234272 - RNA, 17 nt, Mycobacterium leprae
gcgaggaccaccuggua

SEQ ID NO: 1234273 - RNA, 16 nt, Mycobacterium leprae
gcgauagcuugcaguu

SEQ ID NO: 1234274 - RNA, 14 nt, Mycobacterium leprae
gcgacggcaaguaa

SEQ ID NO: 1234275 - RNA, 18 nt, Mycobacterium leprae
gcgaaggagcggugguac

SEQ ID NO: 1234276 - RNA, 19 nt, Mycobacterium leprae
gcgagaauuuugugcugcg

SEQ ID NO: 1234277 - RNA, 13 nt, Mycobacterium leprae
gcgagacaugauu

SEQ ID NO: 1234278 - RNA, 15 nt, Mycobacterium leprae
gcgacucaucgccaa

SEQ ID NO: 1234279 - RNA, 18 nt, Mycobacterium leprae
gccuguugcggccaagcu

SEQ ID NO: 1234280 - RNA, 17 nt, Mycobacterium leprae
gccuguuguugugccuu

SEQ ID NO: 1234281 - RNA, 14 nt, Mycobacterium leprae
gccuuaagcugcau

SEQ ID NO: 1234282 - RNA, 16 nt, Mycobacterium leprae
gccuggucauggcuuc

SEQ ID NO: 1234283 - RNA, 13 nt, Mycobacterium leprae
gccuggcgucauc

SEQ ID NO: 1234284 - RNA, 12 nt, Mycobacterium leprae
gccugcugcaug

SEQ ID NO: 1234285 - RNA, 19 nt, Mycobacterium leprae
gccugcuggccggcaggga

SEQ ID NO: 1234286 - RNA, 16 nt, Mycobacterium leprae
gccugcuugcuggcug

SEQ ID NO: 1234287 - RNA, 14 nt, Mycobacterium leprae
gccuugcagcuuca

SEQ ID NO: 1234288 - RNA, 15 nt, Mycobacterium leprae
gccuugggugguggu

SEQ ID NO: 1234289 - RNA, 15 nt, Mycobacterium leprae
gccuucgucagcugg

SEQ ID NO: 1234290 - RNA, 19 nt, Mycobacterium leprae
gccuucgugauggccaaag

SEQ ID NO: 1234291 - RNA, 13 nt, Mycobacterium leprae
gcgaacaacaaaa

SEQ ID NO: 1234292 - RNA, 12 nt, Mycobacterium leprae
gcgaacaagaaa

SEQ ID NO: 1234293 - RNA, 21 nt, Mycobacterium leprae
gcgaacacacaggucauccuu

SEQ ID NO: 1234294 - RNA, 15 nt, Mycobacterium leprae
gcgaacagccgagcu

SEQ ID NO: 1234295 - RNA, 14 nt, Mycobacterium leprae
gcgaaacggcgcuc

SEQ ID NO: 1234296 - RNA, 15 nt, Mycobacterium leprae
gccuaggugaucgua

SEQ ID NO: 1234297 - RNA, 15 nt, Mycobacterium leprae
gccucagcagcaggc

SEQ ID NO: 1234298 - RNA, 18 nt, Mycobacterium leprae
gccucagcagcaggcuga

SEQ ID NO: 1234299 - RNA, 13 nt, Mycobacterium leprae
gccuccacugcuc

SEQ ID NO: 1234300 - RNA, 15 nt, Mycobacterium leprae
gccuccacugcuccu

SEQ ID NO: 1234301 - RNA, 21 nt, Mycobacterium leprae
gccuccgagcgcccgcacagc

SEQ ID NO: 1234302 - RNA, 14 nt, Mycobacterium leprae
gccuccuaggccac

SEQ ID NO: 1234303 - RNA, 15 nt, Mycobacterium leprae
gccucgucggccagc

SEQ ID NO: 1234304 - RNA, 20 nt, Mycobacterium leprae
gccucgucgucggccagguc

SEQ ID NO: 1234305 - RNA, 18 nt, Mycobacterium leprae
gccucgucgaugucgggg

SEQ ID NO: 1234306 - RNA, 18 nt, Mycobacterium leprae
gccguucaucgucgggug

SEQ ID NO: 1234307 - RNA, 14 nt, Mycobacterium leprae
gccguuccauucca

SEQ ID NO: 1234308 - RNA, 19 nt, Mycobacterium leprae
gccguuauggcgcugaggu

SEQ ID NO: 1234309 - RNA, 16 nt, Mycobacterium leprae
gccguuauccacagca

SEQ ID NO: 1234310 - RNA, 17 nt, Mycobacterium leprae
gccuacaccagcucggc

SEQ ID NO: 1234311 - RNA, 15 nt, Mycobacterium leprae
gccguugggcugccc

SEQ ID NO: 1234312 - RNA, 18 nt, Mycobacterium leprae
gccguugggcugcccucc

SEQ ID NO: 1234313 - RNA, 16 nt, Mycobacterium leprae
gccguuuccgcuacca

SEQ ID NO: 1234314 - RNA, 13 nt, Mycobacterium leprae
gccguuugggcca

SEQ ID NO: 1234315 - RNA, 17 nt, Mycobacterium leprae
gccguaugugccgccga

SEQ ID NO: 1234316 - RNA, 21 nt, Mycobacterium leprae
ggugaaaauauccaccauaca

SEQ ID NO: 1234317 - RNA, 15 nt, Mycobacterium leprae
ggucugaaguggggu

SEQ ID NO: 1234318 - RNA, 17 nt, Mycobacterium leprae
ggucucuuucggcagcg

SEQ ID NO: 1234319 - RNA, 20 nt, Mycobacterium leprae
ggucucuuucggcagcgaga

SEQ ID NO: 1234320 - RNA, 15 nt, Mycobacterium leprae
ggucggcgggguguc

SEQ ID NO: 1234321 - RNA, 20 nt, Mycobacterium leprae
ggucguguugcuugcuguga

SEQ ID NO: 1234322 - RNA, 13 nt, Mycobacterium leprae
ggucuacucgccu

SEQ ID NO: 1234323 - RNA, 21 nt, Mycobacterium leprae
ggucgcucggacugggcucau

SEQ ID NO: 1234324 - RNA, 17 nt, Mycobacterium leprae
ggucgccgcgccacugu

SEQ ID NO: 1234325 - RNA, 19 nt, Mycobacterium leprae
gguccugaccgccugugcu

SEQ ID NO: 1234326 - RNA, 15 nt, Mycobacterium leprae
gguccuuccggccuc

SEQ ID NO: 1234327 - RNA, 15 nt, Mycobacterium leprae
ggucgacacgaggau

SEQ ID NO: 1234328 - RNA, 14 nt, Mycobacterium leprae
ggucccgcagccgc

SEQ ID NO: 1234329 - RNA, 14 nt, Mycobacterium leprae
gguccggaccugga

SEQ ID NO: 1234330 - RNA, 15 nt, Mycobacterium leprae
gguccgacggcuggc

SEQ ID NO: 1234331 - RNA, 21 nt, Mycobacterium leprae
gguccgacggcuggcugcugc

SEQ ID NO: 1234332 - RNA, 14 nt, Mycobacterium leprae
gguccgccagcgac

SEQ ID NO: 1234333 - RNA, 13 nt, Mycobacterium leprae
ggucauuggaaag

SEQ ID NO: 1234334 - RNA, 15 nt, Mycobacterium leprae
ggucauuggaagcug

SEQ ID NO: 1234335 - RNA, 22 nt, Mycobacterium leprae
gguccaauucacgaacaacaga

SEQ ID NO: 1234336 - RNA, 20 nt, Mycobacterium leprae
gguccacuugacuggcuuga

SEQ ID NO: 1234337 - RNA, 13 nt, Mycobacterium leprae
ggucaggugucug

SEQ ID NO: 1234338 - RNA, 18 nt, Mycobacterium leprae
ggucaguguauuggcggg

SEQ ID NO: 1234339 - RNA, 15 nt, Mycobacterium leprae
ggucaugagcgucgc

SEQ ID NO: 1234340 - RNA, 14 nt, Mycobacterium leprae
ggucaccccgagcu

SEQ ID NO: 1234341 - RNA, 18 nt, Mycobacterium leprae
ggucacagguaaacaaaa

SEQ ID NO: 1234342 - RNA, 11 nt, Mycobacterium leprae
gguaucucaau

SEQ ID NO: 1234343 - RNA, 18 nt, Mycobacterium leprae
gguauugacgugguggua

SEQ ID NO: 1234344 - RNA, 20 nt, Mycobacterium leprae
gguagucguggggggcagcc

SEQ ID NO: 1234345 - RNA, 22 nt, Mycobacterium leprae
gguaucgaugccguggugaugc

SEQ ID NO: 1234346 - RNA, 22 nt, Mycobacterium leprae
gguaucaaagcgauuuggaccc

SEQ ID NO: 1234347 - RNA, 21 nt, Mycobacterium leprae
gguacaaggcuucgccgagcu

SEQ ID NO: 1234348 - RNA, 14 nt, Mycobacterium leprae
gguacacucucaga

SEQ ID NO: 1234349 - RNA, 18 nt, Mycobacterium leprae
gguacacucucagagagc

SEQ ID NO: 1234350 - RNA, 23 nt, Mycobacterium leprae
gguaccacugcucaggucgacga

SEQ ID NO: 1234351 - RNA, 15 nt, Mycobacterium leprae
gguaccagcggcagc

SEQ ID NO: 1234352 - RNA, 20 nt, Mycobacterium leprae
gguaccgaguuuggcugaca

SEQ ID NO: 1234353 - RNA, 22 nt, Mycobacterium leprae
gguagacgaugaucggcuugcc

SEQ ID NO: 1234354 - RNA, 15 nt, Mycobacterium leprae
gguagacgugcacaa

SEQ ID NO: 1234355 - RNA, 14 nt, Mycobacterium leprae
gguagacugggugg

SEQ ID NO: 1234356 - RNA, 16 nt, Mycobacterium leprae
gguagcccguuggggu

SEQ ID NO: 1234357 - RNA, 21 nt, Mycobacterium leprae
gguagcuacguggucugaagu

SEQ ID NO: 1234358 - RNA, 13 nt, Mycobacterium leprae
ggguugcacugau

SEQ ID NO: 1234359 - RNA, 17 nt, Mycobacterium leprae
ggguuaccugggccagg

SEQ ID NO: 1234360 - RNA, 14 nt, Mycobacterium leprae
gggugggcagccug

SEQ ID NO: 1234361 - RNA, 24 nt, Mycobacterium leprae
gggugggaaaagcaggcggaacgg

SEQ ID NO: 1234362 - RNA, 21 nt, Mycobacterium leprae
ggguggugaugaugcgaacga

SEQ ID NO: 1234363 - RNA, 19 nt, Mycobacterium leprae
ggguguggcacguuggaug

SEQ ID NO: 1234364 - RNA, 19 nt, Mycobacterium leprae
gguaaguugcuuaacgauc

SEQ ID NO: 1234365 - RNA, 24 nt, Mycobacterium leprae
gguaacugaugguccuggcugcga

SEQ ID NO: 1234366 - RNA, 14 nt, Mycobacterium leprae
gguaacuggcucga

SEQ ID NO: 1234367 - RNA, 17 nt, Mycobacterium leprae
gguaagaaaccugaucu

SEQ ID NO: 1234368 - RNA, 17 nt, Mycobacterium leprae
gguaacgcugaccagca

SEQ ID NO: 1234369 - RNA, 16 nt, Mycobacterium leprae
gguaacggaccuggca

SEQ ID NO: 1234370 - RNA, 12 nt, Mycobacterium leprae
gguaaccgguuu

SEQ ID NO: 1234371 - RNA, 16 nt, Mycobacterium leprae
gguaaacagugccaca

SEQ ID NO: 1234372 - RNA, 13 nt, Mycobacterium leprae
gggcguugaccuc

SEQ ID NO: 1234373 - RNA, 23 nt, Mycobacterium leprae
gggcuauccucgggugcgcacgg

SEQ ID NO: 1234374 - RNA, 19 nt, Mycobacterium leprae
gggcggccgccggcuaguu

SEQ ID NO: 1234375 - RNA, 19 nt, Mycobacterium leprae
gggcggcauucccaaccgc

SEQ ID NO: 1234376 - RNA, 15 nt, Mycobacterium leprae
gggcggccaggcagg

SEQ ID NO: 1234377 - RNA, 17 nt, Mycobacterium leprae
gggcgaugaaauccgca

SEQ ID NO: 1234378 - RNA, 20 nt, Mycobacterium leprae
gggcgcaagcgugcaggcug

SEQ ID NO: 1234379 - RNA, 21 nt, Mycobacterium leprae
gggcgacgaucugugacacuu

SEQ ID NO: 1234380 - RNA, 15 nt, Mycobacterium leprae
gggccagagcugcga

SEQ ID NO: 1234381 - RNA, 18 nt, Mycobacterium leprae
gggccacgagacccagcc

SEQ ID NO: 1234382 - RNA, 14 nt, Mycobacterium leprae
gggccaggccgagu

SEQ ID NO: 1234383 - RNA, 16 nt, Mycobacterium leprae
gggccgaagcagccgg

SEQ ID NO: 1234384 - RNA, 17 nt, Mycobacterium leprae
gggccgaagcagccggg

SEQ ID NO: 1234385 - RNA, 14 nt, Mycobacterium leprae
gggccgggcugcug

SEQ ID NO: 1234386 - RNA, 21 nt, Mycobacterium leprae
gggccguuauccacagcauca

SEQ ID NO: 1234387 - RNA, 19 nt, Mycobacterium leprae
ggggucagcgggggugggc

SEQ ID NO: 1234388 - RNA, 20 nt, Mycobacterium leprae
gggguccugaccgccugugc

SEQ ID NO: 1234389 - RNA, 13 nt, Mycobacterium leprae
ggggugggcagcc

SEQ ID NO: 1234390 - RNA, 15 nt, Mycobacterium leprae
ggguagcugcaucgg

SEQ ID NO: 1234391 - RNA, 22 nt, Mycobacterium leprae
ggguagcugcaucggcaggcug

SEQ ID NO: 1234392 - RNA, 16 nt, Mycobacterium leprae
ggguacgagugguuga

SEQ ID NO: 1234393 - RNA, 14 nt, Mycobacterium leprae
ggguacgccaggua

SEQ ID NO: 1234394 - RNA, 21 nt, Mycobacterium leprae
gggguuuuuguuggugggugg

SEQ ID NO: 1234395 - RNA, 12 nt, Mycobacterium leprae
ggguauugugcg

SEQ ID NO: 1234396 - RNA, 14 nt, Mycobacterium leprae
ggguccggaccugg

SEQ ID NO: 1234397 - RNA, 16 nt, Mycobacterium leprae
gggucagcgggggugg

SEQ ID NO: 1234398 - RNA, 13 nt, Mycobacterium leprae
gggucgagcuacc

SEQ ID NO: 1234399 - RNA, 17 nt, Mycobacterium leprae
gggucgacccgguggug

SEQ ID NO: 1234400 - RNA, 14 nt, Mycobacterium leprae
gggucgcgguagga

SEQ ID NO: 1234401 - RNA, 15 nt, Mycobacterium leprae
gggugaccacccaca

SEQ ID NO: 1234402 - RNA, 13 nt, Mycobacterium leprae
gggcuugaccugg

SEQ ID NO: 1234403 - RNA, 14 nt, Mycobacterium leprae
gggcuugaccugga

SEQ ID NO: 1234404 - RNA, 15 nt, Mycobacterium leprae
gggcuuccagcagac

SEQ ID NO: 1234405 - RNA, 22 nt, Mycobacterium leprae
ggggagucgauaucgggccgag

SEQ ID NO: 1234406 - RNA, 13 nt, Mycobacterium leprae
ggggacgccggcg

SEQ ID NO: 1234407 - RNA, 12 nt, Mycobacterium leprae
ggggcagcccgg

SEQ ID NO: 1234408 - RNA, 16 nt, Mycobacterium leprae
ggggauuucaggugac

SEQ ID NO: 1234409 - RNA, 21 nt, Mycobacterium leprae
gggggaucggggcgauguuau

SEQ ID NO: 1234410 - RNA, 16 nt, Mycobacterium leprae
gggggccuuaucccac

SEQ ID NO: 1234411 - RNA, 12 nt, Mycobacterium leprae
ggggcugggucc

SEQ ID NO: 1234412 - RNA, 15 nt, Mycobacterium leprae
ggggcucggccaggu

SEQ ID NO: 1234413 - RNA, 19 nt, Mycobacterium leprae
ggggcuauccucgggugcg

SEQ ID NO: 1234414 - RNA, 22 nt, Mycobacterium leprae
ggggcguuuuagugugcauguc

SEQ ID NO: 1234415 - RNA, 16 nt, Mycobacterium leprae
ggggcguccagugaug

SEQ ID NO: 1234416 - RNA, 22 nt, Mycobacterium leprae
ggggcgcgguaugcggccgcaa

SEQ ID NO: 1234417 - RNA, 22 nt, Mycobacterium leprae
ggggcgcggucgccgaugcgcu

SEQ ID NO: 1234418 - RNA, 14 nt, Mycobacterium leprae
ggggcaucugucua

SEQ ID NO: 1234419 - RNA, 20 nt, Mycobacterium leprae
ggggcaggccugaucuccaa

SEQ ID NO: 1234420 - RNA, 21 nt, Mycobacterium leprae
gggagagacgucgaugucagc

SEQ ID NO: 1234421 - RNA, 13 nt, Mycobacterium leprae
gggagaccagaga

SEQ ID NO: 1234422 - RNA, 20 nt, Mycobacterium leprae
gggacuuuagcaacgacgcc

SEQ ID NO: 1234423 - RNA, 18 nt, Mycobacterium leprae
gggacugcgaagcgcagc

SEQ ID NO: 1234424 - RNA, 14 nt, Mycobacterium leprae
gggacuugacuccu

SEQ ID NO: 1234425 - RNA, 22 nt, Mycobacterium leprae
gggacgcgucaccaugugcaca

SEQ ID NO: 1234426 - RNA, 21 nt, Mycobacterium leprae
gggaccgggcguuucccuauc

SEQ ID NO: 1234427 - RNA, 15 nt, Mycobacterium leprae
gggaaggacgcaucc

SEQ ID NO: 1234428 - RNA, 20 nt, Mycobacterium leprae
gggaacauaaccacauugug

SEQ ID NO: 1234429 - RNA, 20 nt, Mycobacterium leprae
gggauagcugugcaggagag

SEQ ID NO: 1234430 - RNA, 23 nt, Mycobacterium leprae
gggagucgauaucgggccgagcu

SEQ ID NO: 1234431 - RNA, 16 nt, Mycobacterium leprae
gggaggcguugcacug

SEQ ID NO: 1234432 - RNA, 14 nt, Mycobacterium leprae
gggaucggcggcac

SEQ ID NO: 1234433 - RNA, 15 nt, Mycobacterium leprae
gggcaagccauugcu

SEQ ID NO: 1234434 - RNA, 18 nt, Mycobacterium leprae
gggcaagccauugcucgg

SEQ ID NO: 1234435 - RNA, 17 nt, Mycobacterium leprae
gggcaacaccucaagca

SEQ ID NO: 1234436 - RNA, 13 nt, Mycobacterium leprae
gggcaacaggcgg

SEQ ID NO: 1234437 - RNA, 14 nt, Mycobacterium leprae
gggaugcagguacu

SEQ ID NO: 1234438 - RNA, 22 nt, Mycobacterium leprae
gggaucguacgaaagaugcugc

SEQ ID NO: 1234439 - RNA, 14 nt, Mycobacterium leprae
gggcaagcccugcc

SEQ ID NO: 1234440 - RNA, 18 nt, Mycobacterium leprae
gggcaagcccugcccggc

SEQ ID NO: 1234441 - RNA, 19 nt, Mycobacterium leprae
ggcuguccuugccggcgcc

SEQ ID NO: 1234442 - RNA, 18 nt, Mycobacterium leprae
ggcuggugcggcgguggg

SEQ ID NO: 1234443 - RNA, 21 nt, Mycobacterium leprae
ggcuggugcggcggugggagu

SEQ ID NO: 1234444 - RNA, 21 nt, Mycobacterium leprae
ggcuggugggguguggguggu

SEQ ID NO: 1234445 - RNA, 20 nt, Mycobacterium leprae
ggcuggcuacgcagcucugg

SEQ ID NO: 1234446 - RNA, 14 nt, Mycobacterium leprae
ggcugggcaccacc

SEQ ID NO: 1234447 - RNA, 16 nt, Mycobacterium leprae
ggcugggcagccgagg

SEQ ID NO: 1234448 - RNA, 20 nt, Mycobacterium leprae
ggcuucccccagcuagggau

SEQ ID NO: 1234449 - RNA, 16 nt, Mycobacterium leprae
ggcuuccagcagaccg

SEQ ID NO: 1234450 - RNA, 20 nt, Mycobacterium leprae
ggcuguugucaccccagacg

SEQ ID NO: 1234451 - RNA, 19 nt, Mycobacterium leprae
ggcuuauccaaucgguccu

SEQ ID NO: 1234452 - RNA, 23 nt, Mycobacterium leprae
ggcuugcgaucaaacucgcugaa

SEQ ID NO: 1234453 - RNA, 21 nt, Mycobacterium leprae
ggcuugauacagacccagcua

SEQ ID NO: 1234454 - RNA, 17 nt, Mycobacterium leprae
ggcucgcucgacuguau

SEQ ID NO: 1234455 - RNA, 20 nt, Mycobacterium leprae
ggcucgauuccagcuuggca

SEQ ID NO: 1234456 - RNA, 24 nt, Mycobacterium leprae
ggcuccauuugucaucggcgugcc

SEQ ID NO: 1234457 - RNA, 17 nt, Mycobacterium leprae
ggcucccaucggcggcc

SEQ ID NO: 1234458 - RNA, 14 nt, Mycobacterium leprae
ggcgucaaguccag

SEQ ID NO: 1234459 - RNA, 15 nt, Mycobacterium leprae
ggcugcaacgacugg

SEQ ID NO: 1234460 - RNA, 13 nt, Mycobacterium leprae
ggcugagaccggu

SEQ ID NO: 1234461 - RNA, 23 nt, Mycobacterium leprae
ggcugcgcugggacaugaagccg

SEQ ID NO: 1234462 - RNA, 17 nt, Mycobacterium leprae
ggcugcggaagccgcuc

SEQ ID NO: 1234463 - RNA, 12 nt, Mycobacterium leprae
ggcugcgccggc

SEQ ID NO: 1234464 - RNA, 13 nt, Mycobacterium leprae
ggcugcacugugg

SEQ ID NO: 1234465 - RNA, 22 nt, Mycobacterium leprae
ggcugcacuguggcgaucgcca

SEQ ID NO: 1234466 - RNA, 17 nt, Mycobacterium leprae
ggcugcauccugcagca

SEQ ID NO: 1234467 - RNA, 12 nt, Mycobacterium leprae
ggcugccacugu

SEQ ID NO: 1234468 - RNA, 20 nt, Mycobacterium leprae
ggcgacgaccuccgcagcau

SEQ ID NO: 1234469 - RNA, 23 nt, Mycobacterium leprae
ggcgagcaucuggccgugcggcg

SEQ ID NO: 1234470 - RNA, 18 nt, Mycobacterium leprae
ggcgacgucgcuugugau

SEQ ID NO: 1234471 - RNA, 22 nt, Mycobacterium leprae
ggcgaaaacauucaggaugcug

SEQ ID NO: 1234472 - RNA, 19 nt, Mycobacterium leprae
ggcgaccgcacggcaagcc

SEQ ID NO: 1234473 - RNA, 14 nt, Mycobacterium leprae
ggcgauauccgccg

SEQ ID NO: 1234474 - RNA, 15 nt, Mycobacterium leprae
ggcgauacgcgcuug

SEQ ID NO: 1234475 - RNA, 15 nt, Mycobacterium leprae
ggcgauucgagccgc

SEQ ID NO: 1234476 - RNA, 16 nt, Mycobacterium leprae
ggcgauucgagccgca

SEQ ID NO: 1234477 - RNA, 16 nt, Mycobacterium leprae
ggcgaugcgcagccgc

SEQ ID NO: 1234478 - RNA, 19 nt, Mycobacterium leprae
ggcgguuacgcgcucgccg

SEQ ID NO: 1234479 - RNA, 15 nt, Mycobacterium leprae
ggcgguugacccgcg

SEQ ID NO: 1234480 - RNA, 18 nt, Mycobacterium leprae
ggcgguagcguggguucg

SEQ ID NO: 1234481 - RNA, 20 nt, Mycobacterium leprae
ggcgguauugacgugguggu

SEQ ID NO: 1234482 - RNA, 14 nt, Mycobacterium leprae
ggcggcaccucccc

SEQ ID NO: 1234483 - RNA, 21 nt, Mycobacterium leprae
ggcggcacauacggcaaccuu

SEQ ID NO: 1234484 - RNA, 22 nt, Mycobacterium leprae
ggcggcaaggucggugggcaau

SEQ ID NO: 1234485 - RNA, 17 nt, Mycobacterium leprae
ggcggagcgcggagcug

SEQ ID NO: 1234486 - RNA, 20 nt, Mycobacterium leprae
ggcggagcgcggagcuggug

SEQ ID NO: 1234487 - RNA, 18 nt, Mycobacterium leprae
ggcggagauguggauccg

SEQ ID NO: 1234488 - RNA, 12 nt, Mycobacterium leprae
ggcggcagcugg

SEQ ID NO: 1234489 - RNA, 14 nt, Mycobacterium leprae
ggcggccaggcagg

SEQ ID NO: 1234490 - RNA, 13 nt, Mycobacterium leprae
ggcgcggucgccg

SEQ ID NO: 1234491 - RNA, 18 nt, Mycobacterium leprae
aaauacgcgcgcucacag

SEQ ID NO: 1234492 - RNA, 15 nt, Mycobacterium leprae
ggcgcgacaaagaga

SEQ ID NO: 1234493 - RNA, 19 nt, Mycobacterium leprae
ggcgccuuuuuaugaagag

SEQ ID NO: 1234494 - RNA, 19 nt, Mycobacterium leprae
ggccacgauuccggcuagg

SEQ ID NO: 1234495 - RNA, 15 nt, Mycobacterium leprae
ggccaaucgcaagcc

SEQ ID NO: 1234496 - RNA, 24 nt, Mycobacterium leprae
ggcaugccgccgggugcagcagua

SEQ ID NO: 1234497 - RNA, 16 nt, Mycobacterium leprae
ggcaucggccucaccu

SEQ ID NO: 1234498 - RNA, 22 nt, Mycobacterium leprae
ggcauauccgccccggcuaccu

SEQ ID NO: 1234499 - RNA, 14 nt, Mycobacterium leprae
ggcagcgauuggga

SEQ ID NO: 1234500 - RNA, 17 nt, Mycobacterium leprae
ggcagcgauugggaucg

SEQ ID NO: 1234501 - RNA, 21 nt, Mycobacterium leprae
ggcagcgccaauuccuccgcu

SEQ ID NO: 1234502 - RNA, 22 nt, Mycobacterium leprae
ggcagcucgcccggacgugcac

SEQ ID NO: 1234503 - RNA, 21 nt, Mycobacterium leprae
ggcaaguaaaacugacacuau

SEQ ID NO: 1234504 - RNA, 23 nt, Mycobacterium leprae
ggcaagcccggauacagcacggc

SEQ ID NO: 1234505 - RNA, 20 nt, Mycobacterium leprae
ggcagaccuuuuagcugcgc

SEQ ID NO: 1234506 - RNA, 14 nt, Mycobacterium leprae
ggcagaggcaccug

SEQ ID NO: 1234507 - RNA, 15 nt, Mycobacterium leprae
ggcagaggcugcagu

SEQ ID NO: 1234508 - RNA, 13 nt, Mycobacterium leprae
ggcagcaaccgca

SEQ ID NO: 1234509 - RNA, 24 nt, Mycobacterium leprae
ggcagcaaccgcacagagcccagc

SEQ ID NO: 1234510 - RNA, 17 nt, Mycobacterium leprae
ggcagcccggaauccug

SEQ ID NO: 1234511 - RNA, 21 nt, Mycobacterium leprae
ggcagccgagguucccggcgg

SEQ ID NO: 1234512 - RNA, 20 nt, Mycobacterium leprae
ggccccggacccgagccgca

SEQ ID NO: 1234513 - RNA, 18 nt, Mycobacterium leprae
ggccaugacaugcacacu

SEQ ID NO: 1234514 - RNA, 20 nt, Mycobacterium leprae
ggccauauaugaacuucagc

SEQ ID NO: 1234515 - RNA, 21 nt, Mycobacterium leprae
ggccagauggcgccaagaccu

SEQ ID NO: 1234516 - RNA, 22 nt, Mycobacterium leprae
ggccagggcgccgauuuggggg

SEQ ID NO: 1234517 - RNA, 16 nt, Mycobacterium leprae
ggccccuuucacgucg

SEQ ID NO: 1234518 - RNA, 18 nt, Mycobacterium leprae
ggcccgacggcgcggcug

SEQ ID NO: 1234519 - RNA, 18 nt, Mycobacterium leprae
ggcccgguaccguccguc

SEQ ID NO: 1234520 - RNA, 22 nt, Mycobacterium leprae
ggcccuguuccucgcgggcggc

SEQ ID NO: 1234521 - RNA, 23 nt, Mycobacterium leprae
ggcccuguuccucgcgggcggcg

SEQ ID NO: 1234522 - RNA, 21 nt, Mycobacterium leprae
ggccgaaacuaaauccgggcg

SEQ ID NO: 1234523 - RNA, 14 nt, Mycobacterium leprae
ggccgaacuuggga

SEQ ID NO: 1234524 - RNA, 15 nt, Mycobacterium leprae
ggcaacacggggaga

SEQ ID NO: 1234525 - RNA, 14 nt, Mycobacterium leprae
ggcaacacgugcug

SEQ ID NO: 1234526 - RNA, 13 nt, Mycobacterium leprae
ggcaaccgugcug

SEQ ID NO: 1234527 - RNA, 17 nt, Mycobacterium leprae
ggcaagaagugcgacga

SEQ ID NO: 1234528 - RNA, 21 nt, Mycobacterium leprae
ggaugugucagcaccggcaug

SEQ ID NO: 1234529 - RNA, 14 nt, Mycobacterium leprae
ggauuccagucgcg

SEQ ID NO: 1234530 - RNA, 13 nt, Mycobacterium leprae
ggauuccacugcc

SEQ ID NO: 1234531 - RNA, 15 nt, Mycobacterium leprae
ggauggucggcagcu

SEQ ID NO: 1234532 - RNA, 17 nt, Mycobacterium leprae
ggauggucggcagcugg

SEQ ID NO: 1234533 - RNA, 15 nt, Mycobacterium leprae
ggaugaucgauccag

SEQ ID NO: 1234534 - RNA, 19 nt, Mycobacterium leprae
ggaugaauaucaucgccaa

SEQ ID NO: 1234535 - RNA, 14 nt, Mycobacterium leprae
ggaucuuuugacca

SEQ ID NO: 1234536 - RNA, 16 nt, Mycobacterium leprae
ggaucugcacaacacc

SEQ ID NO: 1234537 - RNA, 14 nt, Mycobacterium leprae
ggaucagcgcgcca

SEQ ID NO: 1234538 - RNA, 17 nt, Mycobacterium leprae
ggaucccaccggcggcu

SEQ ID NO: 1234539 - RNA, 12 nt, Mycobacterium leprae
ggaucggggcga

SEQ ID NO: 1234540 - RNA, 23 nt, Mycobacterium leprae
ggaucggguagcugcaucggcag

SEQ ID NO: 1234541 - RNA, 21 nt, Mycobacterium leprae
ggaucguacgaaagaugcugc

SEQ ID NO: 1234542 - RNA, 12 nt, Mycobacterium leprae
ggaucggugcau

SEQ ID NO: 1234543 - RNA, 16 nt, Mycobacterium leprae
ggaguugagcgguuca

SEQ ID NO: 1234544 - RNA, 21 nt, Mycobacterium leprae
ggagccgaguccgcuaaggca

SEQ ID NO: 1234545 - RNA, 14 nt, Mycobacterium leprae
ggagcaccucagca

SEQ ID NO: 1234546 - RNA, 13 nt, Mycobacterium leprae
ggagccagggcag

SEQ ID NO: 1234547 - RNA, 19 nt, Mycobacterium leprae
ggagugguuagacagugau

SEQ ID NO: 1234548 - RNA, 12 nt, Mycobacterium leprae
ggauaaguccac

SEQ ID NO: 1234549 - RNA, 17 nt, Mycobacterium leprae
ggauaccgaacaguggg

SEQ ID NO: 1234550 - RNA, 13 nt, Mycobacterium leprae
ggacuggcgguau

SEQ ID NO: 1234551 - RNA, 14 nt, Mycobacterium leprae
ggacugauccccag

SEQ ID NO: 1234552 - RNA, 18 nt, Mycobacterium leprae
aaagggucguaauaauau

SEQ ID NO: 1234553 - RNA, 14 nt, Mycobacterium leprae
aaaggguggcggug

SEQ ID NO: 1234554 - RNA, 14 nt, Mycobacterium leprae
ggagcaggagcugu

SEQ ID NO: 1234555 - RNA, 10 nt, Mycobacterium leprae
ggacuucugc

SEQ ID NO: 1234556 - RNA, 18 nt, Mycobacterium leprae
ggagacggccugcucugu

SEQ ID NO: 1234557 - RNA, 16 nt, Mycobacterium leprae
aaaggggccaacacgu

SEQ ID NO: 1234558 - RNA, 13 nt, Mycobacterium leprae
ggacggacacugu

SEQ ID NO: 1234559 - RNA, 19 nt, Mycobacterium leprae
aaaggcuguccuugccggc

SEQ ID NO: 1234560 - RNA, 17 nt, Mycobacterium leprae
ggacagcggcccaaccc

SEQ ID NO: 1234561 - RNA, 17 nt, Mycobacterium leprae
ggaccggugcugcagcc

SEQ ID NO: 1234562 - RNA, 19 nt, Mycobacterium leprae
ggacccguugagcugcaug

SEQ ID NO: 1234563 - RNA, 19 nt, Mycobacterium leprae
ggaauaacagagugcacca

SEQ ID NO: 1234564 - RNA, 18 nt, Mycobacterium leprae
ggacaaccugggcggcau

SEQ ID NO: 1234565 - RNA, 12 nt, Mycobacterium leprae
ggaauugcugcg

SEQ ID NO: 1234566 - RNA, 15 nt, Mycobacterium leprae
ggaauuuagaggcug

SEQ ID NO: 1234567 - RNA, 17 nt, Mycobacterium leprae
ggacacgagcggccuca

SEQ ID NO: 1234568 - RNA, 18 nt, Mycobacterium leprae
ggacacgauacgcgucug

SEQ ID NO: 1234569 - RNA, 14 nt, Mycobacterium leprae
ggaagcccgcccaa

SEQ ID NO: 1234570 - RNA, 14 nt, Mycobacterium leprae
ggaacaacagacac

SEQ ID NO: 1234571 - RNA, 13 nt, Mycobacterium leprae
gcuuguugccgcc

SEQ ID NO: 1234572 - RNA, 19 nt, Mycobacterium leprae
gcuuuaccuucaggucuac

SEQ ID NO: 1234573 - RNA, 14 nt, Mycobacterium leprae
gcuuguaaggccag

SEQ ID NO: 1234574 - RNA, 13 nt, Mycobacterium leprae
gcuuggugcugcu

SEQ ID NO: 1234575 - RNA, 16 nt, Mycobacterium leprae
gcuugguugacagcag

SEQ ID NO: 1234576 - RNA, 15 nt, Mycobacterium leprae
gcuugggcacgcugg

SEQ ID NO: 1234577 - RNA, 18 nt, Mycobacterium leprae
gcuuggccggaacagcau

SEQ ID NO: 1234578 - RNA, 17 nt, Mycobacterium leprae
gcuugaacgccgcgagc

SEQ ID NO: 1234579 - RNA, 17 nt, Mycobacterium leprae
gcuugcccugcgggaag

SEQ ID NO: 1234580 - RNA, 14 nt, Mycobacterium leprae
gcuucgauccaggc

SEQ ID NO: 1234581 - RNA, 16 nt, Mycobacterium leprae
gcuucgccuugcugcc

SEQ ID NO: 1234582 - RNA, 22 nt, Mycobacterium leprae
gcuucggccagcgcaucagcca

SEQ ID NO: 1234583 - RNA, 20 nt, Mycobacterium leprae
gcuucgugugcuuugccgca

SEQ ID NO: 1234584 - RNA, 21 nt, Mycobacterium leprae
gcuucucggggcgaugaaauc

SEQ ID NO: 1234585 - RNA, 17 nt, Mycobacterium leprae
gcuuccucgacagucaa

SEQ ID NO: 1234586 - RNA, 16 nt, Mycobacterium leprae
gcuuagcuaugcagug

SEQ ID NO: 1234587 - RNA, 17 nt, Mycobacterium leprae
gcuuagcuaugcaguga

SEQ ID NO: 1234588 - RNA, 17 nt, Mycobacterium leprae
gcuuagcuuccggguuc

SEQ ID NO: 1234589 - RNA, 17 nt, Mycobacterium leprae
gcuuaguuguacuggcg

SEQ ID NO: 1234590 - RNA, 14 nt, Mycobacterium leprae
gcuuauacugcugc

SEQ ID NO: 1234591 - RNA, 22 nt, Mycobacterium leprae
gcuuacucugccgccucgaugc

SEQ ID NO: 1234592 - RNA, 19 nt, Mycobacterium leprae
gcuguuuuccgcggcaagu

SEQ ID NO: 1234593 - RNA, 18 nt, Mycobacterium leprae
gcuguugucaccccagac

SEQ ID NO: 1234594 - RNA, 18 nt, Mycobacterium leprae
gcuguugucagcagacca

SEQ ID NO: 1234595 - RNA, 20 nt, Mycobacterium leprae
gcuguugucagcagaccaca

SEQ ID NO: 1234596 - RNA, 15 nt, Mycobacterium leprae
gcuguugugaagcug

SEQ ID NO: 1234597 - RNA, 16 nt, Mycobacterium leprae
gcuguugugaagcuga

SEQ ID NO: 1234598 - RNA, 14 nt, Mycobacterium leprae
gcuguguugcgggg

SEQ ID NO: 1234599 - RNA, 19 nt, Mycobacterium leprae
gcuguccaccgaacccauc

SEQ ID NO: 1234600 - RNA, 14 nt, Mycobacterium leprae
gcuguugaccuggg

SEQ ID NO: 1234601 - RNA, 21 nt, Mycobacterium leprae
aaaggaguucaacaaaaccau

SEQ ID NO: 1234602 - RNA, 23 nt, Mycobacterium leprae
gcuggucguguugcuugcuguga

SEQ ID NO: 1234603 - RNA, 17 nt, Mycobacterium leprae
gcuggucggauggccau

SEQ ID NO: 1234604 - RNA, 15 nt, Mycobacterium leprae
gcuggucccacagcc

SEQ ID NO: 1234605 - RNA, 20 nt, Mycobacterium leprae
gcuggcaagcucgggugugu

SEQ ID NO: 1234606 - RNA, 20 nt, Mycobacterium leprae
gcugcuacgugacugcggcu

SEQ ID NO: 1234607 - RNA, 17 nt, Mycobacterium leprae
gcugcgcuucuggcugg

SEQ ID NO: 1234608 - RNA, 22 nt, Mycobacterium leprae
gcuggaucuguauuaaucuggc

SEQ ID NO: 1234609 - RNA, 13 nt, Mycobacterium leprae
gcugcugcuggug

SEQ ID NO: 1234610 - RNA, 16 nt, Mycobacterium leprae
gcugcugcggcgccug

SEQ ID NO: 1234611 - RNA, 19 nt, Mycobacterium leprae
gcugcugguggaguacugg

SEQ ID NO: 1234612 - RNA, 20 nt, Mycobacterium leprae
gcugccgcaccgcuucagag

SEQ ID NO: 1234613 - RNA, 18 nt, Mycobacterium leprae
gcugccagggcucgacca

SEQ ID NO: 1234614 - RNA, 17 nt, Mycobacterium leprae
gcugcgagucucaccca

SEQ ID NO: 1234615 - RNA, 14 nt, Mycobacterium leprae
gcugccggcggcag

SEQ ID NO: 1234616 - RNA, 19 nt, Mycobacterium leprae
gcugacagacauggcugua

SEQ ID NO: 1234617 - RNA, 20 nt, Mycobacterium leprae
gcucucgaggauuaucgccg

SEQ ID NO: 1234618 - RNA, 23 nt, Mycobacterium leprae
gcugaaccgcugugacagcgugc

SEQ ID NO: 1234619 - RNA, 18 nt, Mycobacterium leprae
gcugcaggccaccguugg

SEQ ID NO: 1234620 - RNA, 13 nt, Mycobacterium leprae
gcugaucgcugau

SEQ ID NO: 1234621 - RNA, 23 nt, Mycobacterium leprae
gcugagaggcggucggcggcuug

SEQ ID NO: 1234622 - RNA, 22 nt, Mycobacterium leprae
gcugagcagucccuuagucugc

SEQ ID NO: 1234623 - RNA, 14 nt, Mycobacterium leprae
gcucgguaagcugg

SEQ ID NO: 1234624 - RNA, 16 nt, Mycobacterium leprae
gcucuaauacagagcg

SEQ ID NO: 1234625 - RNA, 16 nt, Mycobacterium leprae
gcucuagccgggcuaa

SEQ ID NO: 1234626 - RNA, 23 nt, Mycobacterium leprae
gcucgcuuuccgcgccccuuccu

SEQ ID NO: 1234627 - RNA, 24 nt, Mycobacterium leprae
gcucgccgcgcaucaucgcccacc

SEQ ID NO: 1234628 - RNA, 23 nt, Mycobacterium leprae
gcucgcggugggcuuccagcaga

SEQ ID NO: 1234629 - RNA, 15 nt, Mycobacterium leprae
gcucgcauccgcaac

SEQ ID NO: 1234630 - RNA, 19 nt, Mycobacterium leprae
gcucgcauccgcaacgaaa

SEQ ID NO: 1234631 - RNA, 15 nt, Mycobacterium leprae
gcucgacgggcggca

SEQ ID NO: 1234632 - RNA, 18 nt, Mycobacterium leprae
gcucgacguugauguccc

SEQ ID NO: 1234633 - RNA, 20 nt, Mycobacterium leprae
gcuccuucuuaucucaucgu

SEQ ID NO: 1234634 - RNA, 20 nt, Mycobacterium leprae
gcuccugagacaucgccacc

SEQ ID NO: 1234635 - RNA, 17 nt, Mycobacterium leprae
gcucccgggucgagcag

SEQ ID NO: 1234636 - RNA, 19 nt, Mycobacterium leprae
gcuccgcagcaccugccgc

SEQ ID NO: 1234637 - RNA, 22 nt, Mycobacterium leprae
gcuccauuuuucuugaaaaaua

SEQ ID NO: 1234638 - RNA, 16 nt, Mycobacterium leprae
gcucauuuucgagcaa

SEQ ID NO: 1234639 - RNA, 18 nt, Mycobacterium leprae
gcggucaaaaaacuaggu

SEQ ID NO: 1234640 - RNA, 13 nt, Mycobacterium leprae
gcggucacauugu

SEQ ID NO: 1234641 - RNA, 18 nt, Mycobacterium leprae
aaaucauagugaccaaaa

SEQ ID NO: 1234642 - RNA, 18 nt, Mycobacterium leprae
guuuucagccacauugcc

SEQ ID NO: 1234643 - RNA, 15 nt, Mycobacterium leprae
guuuugccaaucuau

SEQ ID NO: 1234644 - RNA, 19 nt, Mycobacterium leprae
guuugcguugaugauguuu

SEQ ID NO: 1234645 - RNA, 15 nt, Mycobacterium leprae
guuuguucagugccg

SEQ ID NO: 1234646 - RNA, 15 nt, Mycobacterium leprae
guuucugcugccgcg

SEQ ID NO: 1234647 - RNA, 20 nt, Mycobacterium leprae
guuugauccagccgaacaaa

SEQ ID NO: 1234648 - RNA, 23 nt, Mycobacterium leprae
guuucggcgccucgucgcacaaa

SEQ ID NO: 1234649 - RNA, 17 nt, Mycobacterium leprae
guuucgggaaagcugag

SEQ ID NO: 1234650 - RNA, 19 nt, Mycobacterium leprae
guuuccgaucaucgaggug

SEQ ID NO: 1234651 - RNA, 13 nt, Mycobacterium leprae
guuucccagagcu

SEQ ID NO: 1234652 - RNA, 15 nt, Mycobacterium leprae
guuucauagguggug

SEQ ID NO: 1234653 - RNA, 20 nt, Mycobacterium leprae
guuucauaggugguggguga

SEQ ID NO: 1234654 - RNA, 19 nt, Mycobacterium leprae
guuuacgcucgguaaguug

SEQ ID NO: 1234655 - RNA, 17 nt, Mycobacterium leprae
guuuacuaggccccaga

SEQ ID NO: 1234656 - RNA, 17 nt, Mycobacterium leprae
guuucacaaccaucgcu

SEQ ID NO: 1234657 - RNA, 20 nt, Mycobacterium leprae
guuucacaaccaucgcuggc

SEQ ID NO: 1234658 - RNA, 20 nt, Mycobacterium leprae
guuggcggauauuuacucaa

SEQ ID NO: 1234659 - RNA, 16 nt, Mycobacterium leprae
guugguggguggcuga

SEQ ID NO: 1234660 - RNA, 15 nt, Mycobacterium leprae
guugcggugaguaaa

SEQ ID NO: 1234661 - RNA, 16 nt, Mycobacterium leprae
guugcguaauggccgg

SEQ ID NO: 1234662 - RNA, 16 nt, Mycobacterium leprae
guugcgggguuuuugu

SEQ ID NO: 1234663 - RNA, 18 nt, Mycobacterium leprae
guugcgggguuuuuguug

SEQ ID NO: 1234664 - RNA, 23 nt, Mycobacterium leprae
guugcucgacaggggcuauggcu

SEQ ID NO: 1234665 - RNA, 17 nt, Mycobacterium leprae
guugcacggcaaaguca

SEQ ID NO: 1234666 - RNA, 19 nt, Mycobacterium leprae
guugcacggcaaagucaug

SEQ ID NO: 1234667 - RNA, 14 nt, Mycobacterium leprae
guugcaguguugug

SEQ ID NO: 1234668 - RNA, 14 nt, Mycobacterium leprae
guugccgugaggau

SEQ ID NO: 1234669 - RNA, 22 nt, Mycobacterium leprae
guugccugucgauuaccacugc

SEQ ID NO: 1234670 - RNA, 19 nt, Mycobacterium leprae
guugagcgcagccaccacu

SEQ ID NO: 1234671 - RNA, 18 nt, Mycobacterium leprae
guucaugccgcuugauuu

SEQ ID NO: 1234672 - RNA, 17 nt, Mycobacterium leprae
guuccagucgaagguga

SEQ ID NO: 1234673 - RNA, 19 nt, Mycobacterium leprae
guuccaccguuacggccau

SEQ ID NO: 1234674 - RNA, 23 nt, Mycobacterium leprae
guuauugcggucacagagcugug

SEQ ID NO: 1234675 - RNA, 23 nt, Mycobacterium leprae
guucagcgaagaguuucugcugc

SEQ ID NO: 1234676 - RNA, 17 nt, Mycobacterium leprae
guucggcuacggcugau

SEQ ID NO: 1234677 - RNA, 20 nt, Mycobacterium leprae
guuccgacaaaccaggcgac

SEQ ID NO: 1234678 - RNA, 20 nt, Mycobacterium leprae
guuccauuccagaugccguu

SEQ ID NO: 1234679 - RNA, 16 nt, Mycobacterium leprae
guuagucuggcuggcc

SEQ ID NO: 1234680 - RNA, 17 nt, Mycobacterium leprae
guuagugaacagugcau

SEQ ID NO: 1234681 - RNA, 14 nt, Mycobacterium leprae
guuauauuguccga

SEQ ID NO: 1234682 - RNA, 21 nt, Mycobacterium leprae
guuaccggcgucuggcuggcc

SEQ ID NO: 1234683 - RNA, 15 nt, Mycobacterium leprae
guuacugguggcaag

SEQ ID NO: 1234684 - RNA, 14 nt, Mycobacterium leprae
guuacugagguacc

SEQ ID NO: 1234685 - RNA, 16 nt, Mycobacterium leprae
guuacugucggugccg

SEQ ID NO: 1234686 - RNA, 22 nt, Mycobacterium leprae
guuaagagaaguagagaaaaau

SEQ ID NO: 1234687 - RNA, 15 nt, Mycobacterium leprae
guuaacgaagaguau

SEQ ID NO: 1234688 - RNA, 22 nt, Mycobacterium leprae
guguugauagcgcugguguuca

SEQ ID NO: 1234689 - RNA, 14 nt, Mycobacterium leprae
guguugccaccgac

SEQ ID NO: 1234690 - RNA, 23 nt, Mycobacterium leprae
guguugcgggguuuuuguuggug

SEQ ID NO: 1234691 - RNA, 15 nt, Mycobacterium leprae
guguugcuggcggug

SEQ ID NO: 1234692 - RNA, 18 nt, Mycobacterium leprae
guguuuuuauacacggug

SEQ ID NO: 1234693 - RNA, 13 nt, Mycobacterium leprae
gugugcacugcuu

SEQ ID NO: 1234694 - RNA, 15 nt, Mycobacterium leprae
guguggcauccgcca

SEQ ID NO: 1234695 - RNA, 16 nt, Mycobacterium leprae
guguuccgggcugaga

SEQ ID NO: 1234696 - RNA, 19 nt, Mycobacterium leprae
guguucgcuccgcccacua

SEQ ID NO: 1234697 - RNA, 18 nt, Mycobacterium leprae
guguguuuuucugcacgg

SEQ ID NO: 1234698 - RNA, 19 nt, Mycobacterium leprae
guguggcccgacggcgcgg

SEQ ID NO: 1234699 - RNA, 20 nt, Mycobacterium leprae
guguggggguccgcgcacgg

SEQ ID NO: 1234700 - RNA, 22 nt, Mycobacterium leprae
gugguuggauuaccggcugcgc

SEQ ID NO: 1234701 - RNA, 15 nt, Mycobacterium leprae
guggugggugcugcu

SEQ ID NO: 1234702 - RNA, 19 nt, Mycobacterium leprae
gugggucgacccgguggug

SEQ ID NO: 1234703 - RNA, 17 nt, Mycobacterium leprae
gugggccccugcggcua

SEQ ID NO: 1234704 - RNA, 17 nt, Mycobacterium leprae
guggggauacagccucu

SEQ ID NO: 1234705 - RNA, 17 nt, Mycobacterium leprae
guggggaucgugcguga

SEQ ID NO: 1234706 - RNA, 15 nt, Mycobacterium leprae
guggggugugggugg

SEQ ID NO: 1234707 - RNA, 16 nt, Mycobacterium leprae
gugucugaacugguga

SEQ ID NO: 1234708 - RNA, 14 nt, Mycobacterium leprae
gugucuguggcggu

SEQ ID NO: 1234709 - RNA, 15 nt, Mycobacterium leprae
gugucuguggcggug

SEQ ID NO: 1234710 - RNA, 17 nt, Mycobacterium leprae
gugugacaccagcgacg

SEQ ID NO: 1234711 - RNA, 19 nt, Mycobacterium leprae
gugucuugucuaccagcac

SEQ ID NO: 1234712 - RNA, 22 nt, Mycobacterium leprae
gugucuuccaguggcugcaccg

SEQ ID NO: 1234713 - RNA, 23 nt, Mycobacterium leprae
gugucggccccccggggcugccc

SEQ ID NO: 1234714 - RNA, 23 nt, Mycobacterium leprae
guguccacaaccucggccgaggc

SEQ ID NO: 1234715 - RNA, 12 nt, Mycobacterium leprae
guguagcugagc

SEQ ID NO: 1234716 - RNA, 12 nt, Mycobacterium leprae
gugucagcagca

SEQ ID NO: 1234717 - RNA, 16 nt, Mycobacterium leprae
gugucacccgggguga

SEQ ID NO: 1234718 - RNA, 21 nt, Mycobacterium leprae
aaauauacgacgucaacguua

SEQ ID NO: 1234719 - RNA, 17 nt, Mycobacterium leprae
gugcuguuaugugguug

SEQ ID NO: 1234720 - RNA, 12 nt, Mycobacterium leprae
gugcugucaucc

SEQ ID NO: 1234721 - RNA, 16 nt, Mycobacterium leprae
guggaggugcggcugg

SEQ ID NO: 1234722 - RNA, 15 nt, Mycobacterium leprae
guggaguaaagggug

SEQ ID NO: 1234723 - RNA, 18 nt, Mycobacterium leprae
guggaguaaaggguggug

SEQ ID NO: 1234724 - RNA, 18 nt, Mycobacterium leprae
guggacuucugcgcgcac

SEQ ID NO: 1234725 - RNA, 18 nt, Mycobacterium leprae
guggauaccacugacggg

SEQ ID NO: 1234726 - RNA, 14 nt, Mycobacterium leprae
guggaucuccuaag

SEQ ID NO: 1234727 - RNA, 23 nt, Mycobacterium leprae
guggaucgcacuuggugccgucc

SEQ ID NO: 1234728 - RNA, 12 nt, Mycobacterium leprae
guggcuauaccc

SEQ ID NO: 1234729 - RNA, 21 nt, Mycobacterium leprae
gugggacgugaugcagcaugu

SEQ ID NO: 1234730 - RNA, 17 nt, Mycobacterium leprae
gugggcagccuggacgg

SEQ ID NO: 1234731 - RNA, 16 nt, Mycobacterium leprae
guggcgaguggcuaug

SEQ ID NO: 1234732 - RNA, 13 nt, Mycobacterium leprae
guggcaucgucug

SEQ ID NO: 1234733 - RNA, 12 nt, Mycobacterium leprae
guggcaucagau

SEQ ID NO: 1234734 - RNA, 20 nt, Mycobacterium leprae
guggcaucagauauccuagg

SEQ ID NO: 1234735 - RNA, 13 nt, Mycobacterium leprae
gugaaucagucug

SEQ ID NO: 1234736 - RNA, 16 nt, Mycobacterium leprae
gugaauuacucgucgg

SEQ ID NO: 1234737 - RNA, 21 nt, Mycobacterium leprae
gugaauagcuaaagugcugcu

SEQ ID NO: 1234738 - RNA, 18 nt, Mycobacterium leprae
gugaacuagccgccgggu

SEQ ID NO: 1234739 - RNA, 16 nt, Mycobacterium leprae
gugaccaaaauuuaug

SEQ ID NO: 1234740 - RNA, 20 nt, Mycobacterium leprae
gugaccgcggugcagugccg

SEQ ID NO: 1234741 - RNA, 19 nt, Mycobacterium leprae
gugacggcggcagcuggaa

SEQ ID NO: 1234742 - RNA, 22 nt, Mycobacterium leprae
gugacgccaguguagagggcca

SEQ ID NO: 1234743 - RNA, 21 nt, Mycobacterium leprae
gugacgacuugcccguaguug

SEQ ID NO: 1234744 - RNA, 13 nt, Mycobacterium leprae
gugauucgggaca

SEQ ID NO: 1234745 - RNA, 14 nt, Mycobacterium leprae
gugauuggcugcug

SEQ ID NO: 1234746 - RNA, 14 nt, Mycobacterium leprae
gugaucgugguggg

SEQ ID NO: 1234747 - RNA, 17 nt, Mycobacterium leprae
gugaucgcuaguuuacu

SEQ ID NO: 1234748 - RNA, 14 nt, Mycobacterium leprae
gugcagcugccaac

SEQ ID NO: 1234749 - RNA, 21 nt, Mycobacterium leprae
gugcaggcugcauccugcagc

SEQ ID NO: 1234750 - RNA, 14 nt, Mycobacterium leprae
gugcacggcgagga

SEQ ID NO: 1234751 - RNA, 16 nt, Mycobacterium leprae
gugcacuggugguggc

SEQ ID NO: 1234752 - RNA, 18 nt, Mycobacterium leprae
gugagcucaccggcggcg

SEQ ID NO: 1234753 - RNA, 12 nt, Mycobacterium leprae
gugaggaucugc

SEQ ID NO: 1234754 - RNA, 14 nt, Mycobacterium leprae
gugacugcggcuca

SEQ ID NO: 1234755 - RNA, 15 nt, Mycobacterium leprae
gugacugcguuucau

SEQ ID NO: 1234756 - RNA, 19 nt, Mycobacterium leprae
gugacuacgcuaaucgcgg

SEQ ID NO: 1234757 - RNA, 19 nt, Mycobacterium leprae
gugacuaguccggaaagau

SEQ ID NO: 1234758 - RNA, 23 nt, Mycobacterium leprae
gugagccuaugcggccagccagg

SEQ ID NO: 1234759 - RNA, 17 nt, Mycobacterium leprae
gucuuugcuaacaaggc

SEQ ID NO: 1234760 - RNA, 16 nt, Mycobacterium leprae
gugaaacaagccgagg

SEQ ID NO: 1234761 - RNA, 16 nt, Mycobacterium leprae
gugaaaguaggcacag

SEQ ID NO: 1234762 - RNA, 16 nt, Mycobacterium leprae
gugaaauucuucucgg

SEQ ID NO: 1234763 - RNA, 18 nt, Mycobacterium leprae
gucuguggcggugaguug

SEQ ID NO: 1234764 - RNA, 17 nt, Mycobacterium leprae
gucugucggcuaaaauc

SEQ ID NO: 1234765 - RNA, 13 nt, Mycobacterium leprae
gucuuaagacaca

SEQ ID NO: 1234766 - RNA, 12 nt, Mycobacterium leprae
gucuuagcaacg

SEQ ID NO: 1234767 - RNA, 17 nt, Mycobacterium leprae
gucuucuuggcgcugag

SEQ ID NO: 1234768 - RNA, 20 nt, Mycobacterium leprae
gucuucuguaguagcccaca

SEQ ID NO: 1234769 - RNA, 23 nt, Mycobacterium leprae
gucuuggacaucacuugcugacc

SEQ ID NO: 1234770 - RNA, 17 nt, Mycobacterium leprae
gucguucgucugaacca

SEQ ID NO: 1234771 - RNA, 15 nt, Mycobacterium leprae
gucguggagcaccuc

SEQ ID NO: 1234772 - RNA, 16 nt, Mycobacterium leprae
gucucccacaaguugu

SEQ ID NO: 1234773 - RNA, 21 nt, Mycobacterium leprae
gucucgacggauuucucgugg

SEQ ID NO: 1234774 - RNA, 17 nt, Mycobacterium leprae
gucuccgccguuuuacc

SEQ ID NO: 1234775 - RNA, 18 nt, Mycobacterium leprae
gucuccuggucuccucgc

SEQ ID NO: 1234776 - RNA, 16 nt, Mycobacterium leprae
gucuggcggguggugu

SEQ ID NO: 1234777 - RNA, 17 nt, Mycobacterium leprae
gucugggcuggccccgg

SEQ ID NO: 1234778 - RNA, 19 nt, Mycobacterium leprae
gucugcgguucagggguug

SEQ ID NO: 1234779 - RNA, 17 nt, Mycobacterium leprae
gucugcuggacagugcg

SEQ ID NO: 1234780 - RNA, 13 nt, Mycobacterium leprae
gucgguguggugc

SEQ ID NO: 1234781 - RNA, 23 nt, Mycobacterium leprae
gucggugccgccauugcccccgc

SEQ ID NO: 1234782 - RNA, 12 nt, Mycobacterium leprae
gucggugguggg

SEQ ID NO: 1234783 - RNA, 22 nt, Mycobacterium leprae
gucguaacaccagagacaccug

SEQ ID NO: 1234784 - RNA, 17 nt, Mycobacterium leprae
gucguaaaacaccuagu

SEQ ID NO: 1234785 - RNA, 15 nt, Mycobacterium leprae
gucgcuucaucguga

SEQ ID NO: 1234786 - RNA, 17 nt, Mycobacterium leprae
gucgcugcuacccacug

SEQ ID NO: 1234787 - RNA, 22 nt, Mycobacterium leprae
gucgcugcuacccacugguggu

SEQ ID NO: 1234788 - RNA, 22 nt, Mycobacterium leprae
gucggaaacacagcaagcagau

SEQ ID NO: 1234789 - RNA, 15 nt, Mycobacterium leprae
gucggcuccuccagc

SEQ ID NO: 1234790 - RNA, 19 nt, Mycobacterium leprae
gucggcaugugcauccagu

SEQ ID NO: 1234791 - RNA, 23 nt, Mycobacterium leprae
gucgcagagguaaaucuggcaag

SEQ ID NO: 1234792 - RNA, 14 nt, Mycobacterium leprae
gucgccuacaccag

SEQ ID NO: 1234793 - RNA, 19 nt, Mycobacterium leprae
gucgccgggugcgcugcug

SEQ ID NO: 1234794 - RNA, 17 nt, Mycobacterium leprae
gucgccgguagcagcgg

SEQ ID NO: 1234795 - RNA, 13 nt, Mycobacterium leprae
gucgaaaccaugg

SEQ ID NO: 1234796 - RNA, 20 nt, Mycobacterium leprae
gucgacgaugugcagcagcu

SEQ ID NO: 1234797 - RNA, 16 nt, Mycobacterium leprae
gucgauauccccgacg

SEQ ID NO: 1234798 - RNA, 13 nt, Mycobacterium leprae
gucgaucagggcg

SEQ ID NO: 1234799 - RNA, 16 nt, Mycobacterium leprae
gucgaucagggcgccc

SEQ ID NO: 1234800 - RNA, 13 nt, Mycobacterium leprae
gucgagcagccac

SEQ ID NO: 1234801 - RNA, 20 nt, Mycobacterium leprae
gucgacggcggccgccacgc

SEQ ID NO: 1234802 - RNA, 14 nt, Mycobacterium leprae
guccccgugcacgg

SEQ ID NO: 1234803 - RNA, 15 nt, Mycobacterium leprae
guccgcguggaugcc

SEQ ID NO: 1234804 - RNA, 23 nt, Mycobacterium leprae
guccgcuacauugcuccgcagca

SEQ ID NO: 1234805 - RNA, 20 nt, Mycobacterium leprae
guccgcguaaccaacuaggc

SEQ ID NO: 1234806 - RNA, 17 nt, Mycobacterium leprae
guccggagagcagaugg

SEQ ID NO: 1234807 - RNA, 21 nt, Mycobacterium leprae
gucaagcggguugacuuuaac

SEQ ID NO: 1234808 - RNA, 20 nt, Mycobacterium leprae
ggugaagccggcgcaaaucc

SEQ ID NO: 1234809 - RNA, 18 nt, Mycobacterium leprae
ggugaacuaagcauuuac

SEQ ID NO: 1234810 - RNA, 22 nt, Mycobacterium leprae
gucacgccggucgaagugaccu

SEQ ID NO: 1234811 - RNA, 15 nt, Mycobacterium leprae
gucaccgcuguggca

SEQ ID NO: 1234812 - RNA, 21 nt, Mycobacterium leprae
gucacuacguuggccagcacg

SEQ ID NO: 1234813 - RNA, 21 nt, Mycobacterium leprae
gucacuccacgauucugcugg

SEQ ID NO: 1234814 - RNA, 17 nt, Mycobacterium leprae
gucacgguugcccgcug

SEQ ID NO: 1234815 - RNA, 12 nt, Mycobacterium leprae
gucagccacauc

SEQ ID NO: 1234816 - RNA, 15 nt, Mycobacterium leprae
gucagcaugcccaga

SEQ ID NO: 1234817 - RNA, 22 nt, Mycobacterium leprae
gucaggcugccaacguccagug

SEQ ID NO: 1234818 - RNA, 19 nt, Mycobacterium leprae
gucauguucaucacgggug

SEQ ID NO: 1234819 - RNA, 16 nt, Mycobacterium leprae
gucauguucccugacu

SEQ ID NO: 1234820 - RNA, 20 nt, Mycobacterium leprae
gucauguucccugacuguuu

SEQ ID NO: 1234821 - RNA, 16 nt, Mycobacterium leprae
gucaucgacgaugcca

SEQ ID NO: 1234822 - RNA, 13 nt, Mycobacterium leprae
gucauccacugcg

SEQ ID NO: 1234823 - RNA, 17 nt, Mycobacterium leprae
gucaucagaaauguccu

SEQ ID NO: 1234824 - RNA, 21 nt, Mycobacterium leprae
gucaucagaaauguccuugag

SEQ ID NO: 1234825 - RNA, 12 nt, Mycobacterium leprae
guccacccgcgc

SEQ ID NO: 1234826 - RNA, 14 nt, Mycobacterium leprae
guccaccgccaggc

SEQ ID NO: 1234827 - RNA, 17 nt, Mycobacterium leprae
guccaucgcgucgucuu

SEQ ID NO: 1234828 - RNA, 19 nt, Mycobacterium leprae
guccaugccacugucgcga

SEQ ID NO: 1234829 - RNA, 13 nt, Mycobacterium leprae
guccagcuggccg

SEQ ID NO: 1234830 - RNA, 14 nt, Mycobacterium leprae
uacgacacuucuac

SEQ ID NO: 1234831 - RNA, 18 nt, Mycobacterium leprae
uacguccacuagccagua

SEQ ID NO: 1234832 - RNA, 16 nt, Mycobacterium leprae
uacuaccaaugagcag

SEQ ID NO: 1234833 - RNA, 20 nt, Mycobacterium leprae
uacggcgacguuuugucuuc

SEQ ID NO: 1234834 - RNA, 14 nt, Mycobacterium leprae
uacgcuagagucau

SEQ ID NO: 1234835 - RNA, 23 nt, Mycobacterium leprae
uacgcgacauacaaucgcggcac

SEQ ID NO: 1234836 - RNA, 17 nt, Mycobacterium leprae
uacgcgcgcucacagca

SEQ ID NO: 1234837 - RNA, 13 nt, Mycobacterium leprae
uacucguuucuca

SEQ ID NO: 1234838 - RNA, 14 nt, Mycobacterium leprae
uacucguuucucau

SEQ ID NO: 1234839 - RNA, 21 nt, Mycobacterium leprae
uacugcaauccguggagagca

SEQ ID NO: 1234840 - RNA, 15 nt, Mycobacterium leprae
uacugagguacccgc

SEQ ID NO: 1234841 - RNA, 15 nt, Mycobacterium leprae
uacugaccgacucac

SEQ ID NO: 1234842 - RNA, 21 nt, Mycobacterium leprae
uacuggcaguuagcaugagcu

SEQ ID NO: 1234843 - RNA, 17 nt, Mycobacterium leprae
uacugugaucgcaugcc

SEQ ID NO: 1234844 - RNA, 15 nt, Mycobacterium leprae
uacugcgacagcagc

SEQ ID NO: 1234845 - RNA, 21 nt, Mycobacterium leprae
uacugcgaucgcaaauauaau

SEQ ID NO: 1234846 - RNA, 14 nt, Mycobacterium leprae
uacuuuauauacuu

SEQ ID NO: 1234847 - RNA, 16 nt, Mycobacterium leprae
uacuguugguaaccag

SEQ ID NO: 1234848 - RNA, 22 nt, Mycobacterium leprae
uacccucucagcaaucugcguc

SEQ ID NO: 1234849 - RNA, 20 nt, Mycobacterium leprae
uacccgcuuucgccauagcc

SEQ ID NO: 1234850 - RNA, 23 nt, Mycobacterium leprae
uaccauccauuuauuccagagca

SEQ ID NO: 1234851 - RNA, 23 nt, Mycobacterium leprae
uaccaucuaacccgcaaaccaaa

SEQ ID NO: 1234852 - RNA, 20 nt, Mycobacterium leprae
uaccccgagaucacaguccu

SEQ ID NO: 1234853 - RNA, 14 nt, Mycobacterium leprae
uaccaacaccccga

SEQ ID NO: 1234854 - RNA, 22 nt, Mycobacterium leprae
uaccaacaccccgauuccaccu

SEQ ID NO: 1234855 - RNA, 15 nt, Mycobacterium leprae
uacaucgacaaaaac

SEQ ID NO: 1234856 - RNA, 21 nt, Mycobacterium leprae
uaaucccacucuugacuaaag

SEQ ID NO: 1234857 - RNA, 16 nt, Mycobacterium leprae
uaauaucuuuuuagag

SEQ ID NO: 1234858 - RNA, 16 nt, Mycobacterium leprae
uaauaauauccaaaga

SEQ ID NO: 1234859 - RNA, 22 nt, Mycobacterium leprae
uaauauacgguaacuacuggau

SEQ ID NO: 1234860 - RNA, 20 nt, Mycobacterium leprae
uaauauaccguuaauauacg

SEQ ID NO: 1234861 - RNA, 18 nt, Mycobacterium leprae
uacaacuucaaccaagcc

SEQ ID NO: 1234862 - RNA, 15 nt, Mycobacterium leprae
uaaucgcauuuaccg

SEQ ID NO: 1234863 - RNA, 21 nt, Mycobacterium leprae
uaaugucggcgcgacugcagu

SEQ ID NO: 1234864 - RNA, 20 nt, Mycobacterium leprae
uaacuggcaguacgucugua

SEQ ID NO: 1234865 - RNA, 20 nt, Mycobacterium leprae
uaacucuuucccuauaaccc

SEQ ID NO: 1234866 - RNA, 17 nt, Mycobacterium leprae
uaacucaucaaaaaaca

SEQ ID NO: 1234867 - RNA, 19 nt, Mycobacterium leprae
uaacuacuggauuaauauu

SEQ ID NO: 1234868 - RNA, 11 nt, Mycobacterium leprae
uaacuaaucca

SEQ ID NO: 1234869 - RNA, 16 nt, Mycobacterium leprae
uaagaagcugcccuac

SEQ ID NO: 1234870 - RNA, 22 nt, Mycobacterium leprae
uaagagguuuaccgccaucggc

SEQ ID NO: 1234871 - RNA, 17 nt, Mycobacterium leprae
uaagagaaguagagaaa

SEQ ID NO: 1234872 - RNA, 14 nt, Mycobacterium leprae
uaaggucccccgcu

SEQ ID NO: 1234873 - RNA, 22 nt, Mycobacterium leprae
uaaguaggcggucauguagcua

SEQ ID NO: 1234874 - RNA, 20 nt, Mycobacterium leprae
uaaguggcuggcuuaggagu

SEQ ID NO: 1234875 - RNA, 16 nt, Mycobacterium leprae
uaaguuuucucuaaaa

SEQ ID NO: 1234876 - RNA, 19 nt, Mycobacterium leprae
uaaguuuucucuaaaagaa

SEQ ID NO: 1234877 - RNA, 15 nt, Mycobacterium leprae
uaagcuugcagucuu

SEQ ID NO: 1234878 - RNA, 23 nt, Mycobacterium leprae
uaagccaucaccguggccggccc

SEQ ID NO: 1234879 - RNA, 13 nt, Mycobacterium leprae
uaagcacugcacg

SEQ ID NO: 1234880 - RNA, 17 nt, Mycobacterium leprae
uaagcaggcucagcaga

SEQ ID NO: 1234881 - RNA, 14 nt, Mycobacterium leprae
uaagcagcagcgga

SEQ ID NO: 1234882 - RNA, 14 nt, Mycobacterium leprae
uaaauggacaaaug

SEQ ID NO: 1234883 - RNA, 15 nt, Mycobacterium leprae
uaaauccuagaaaau

SEQ ID NO: 1234884 - RNA, 22 nt, Mycobacterium leprae
uaaauccgggcgcucagcggcc

SEQ ID NO: 1234885 - RNA, 21 nt, Mycobacterium leprae
uaacgguauauuaaccguagu

SEQ ID NO: 1234886 - RNA, 17 nt, Mycobacterium leprae
uaacgcugaccagcaga

SEQ ID NO: 1234887 - RNA, 22 nt, Mycobacterium leprae
uaacgcuggucggauggccaua

SEQ ID NO: 1234888 - RNA, 23 nt, Mycobacterium leprae
uaacccgcaaaccaaacaacaac

SEQ ID NO: 1234889 - RNA, 15 nt, Mycobacterium leprae
uaaccacuugcagua

SEQ ID NO: 1234890 - RNA, 20 nt, Mycobacterium leprae
uaaccagggccgucagagcu

SEQ ID NO: 1234891 - RNA, 16 nt, Mycobacterium leprae
uaacacgauacugcug

SEQ ID NO: 1234892 - RNA, 16 nt, Mycobacterium leprae
uaacagagugcaccac

SEQ ID NO: 1234893 - RNA, 19 nt, Mycobacterium leprae
uaaacauugugcuagcuga

SEQ ID NO: 1234894 - RNA, 20 nt, Mycobacterium leprae
guuuugcuguguugcggggu

SEQ ID NO: 1234895 - RNA, 13 nt, Mycobacterium leprae
uaaagugcugcug

SEQ ID NO: 1234896 - RNA, 15 nt, Mycobacterium leprae
uaaagugcugcugug

SEQ ID NO: 1234897 - RNA, 21 nt, Mycobacterium leprae
uaaauauacuuuacuuuauau

SEQ ID NO: 1234898 - RNA, 17 nt, Mycobacterium leprae
uaaauaguauuauugac

SEQ ID NO: 1234899 - RNA, 19 nt, Mycobacterium leprae
ucaauucgcgaacacccug

SEQ ID NO: 1234900 - RNA, 13 nt, Mycobacterium leprae
ucaauucggcgau

SEQ ID NO: 1234901 - RNA, 21 nt, Mycobacterium leprae
ucaaucacgcccagcgcagcc

SEQ ID NO: 1234902 - RNA, 20 nt, Mycobacterium leprae
ucacaugucccggugcugcc

SEQ ID NO: 1234903 - RNA, 19 nt, Mycobacterium leprae
ucacaucgauuuguaaaau

SEQ ID NO: 1234904 - RNA, 15 nt, Mycobacterium leprae
ucacaguaggccagc

SEQ ID NO: 1234905 - RNA, 14 nt, Mycobacterium leprae
ucacaguccugccc

SEQ ID NO: 1234906 - RNA, 19 nt, Mycobacterium leprae
ucacaguccugcccggaca

SEQ ID NO: 1234907 - RNA, 11 nt, Mycobacterium leprae
ucacagcagag

SEQ ID NO: 1234908 - RNA, 15 nt, Mycobacterium leprae
ucaaccagccaaucu

SEQ ID NO: 1234909 - RNA, 20 nt, Mycobacterium leprae
ucaacauggcgaucugcauu

SEQ ID NO: 1234910 - RNA, 17 nt, Mycobacterium leprae
ucaacauuuguugaagc

SEQ ID NO: 1234911 - RNA, 22 nt, Mycobacterium leprae
ucaacacccaagugacugcguu

SEQ ID NO: 1234912 - RNA, 12 nt, Mycobacterium leprae
ucaacggccuca

SEQ ID NO: 1234913 - RNA, 13 nt, Mycobacterium leprae
ucaacggccucac

SEQ ID NO: 1234914 - RNA, 20 nt, Mycobacterium leprae
ucaacgagauccgagaucag

SEQ ID NO: 1234915 - RNA, 18 nt, Mycobacterium leprae
ucaaccaugccgcgcgcc

SEQ ID NO: 1234916 - RNA, 15 nt, Mycobacterium leprae
ucaaauucaugacgu

SEQ ID NO: 1234917 - RNA, 23 nt, Mycobacterium leprae
ucaaacgucgaauucccaggauu

SEQ ID NO: 1234918 - RNA, 19 nt, Mycobacterium leprae
ucaaacauggacaaccugg

SEQ ID NO: 1234919 - RNA, 16 nt, Mycobacterium leprae
ucacgucgcugcgucc

SEQ ID NO: 1234920 - RNA, 17 nt, Mycobacterium leprae
ucacuauauauauauua

SEQ ID NO: 1234921 - RNA, 20 nt, Mycobacterium leprae
ucacuauauauauauuaauu

SEQ ID NO: 1234922 - RNA, 12 nt, Mycobacterium leprae
ucacgccaggcg

SEQ ID NO: 1234923 - RNA, 20 nt, Mycobacterium leprae
ucacuggcccgcgucgccuu

SEQ ID NO: 1234924 - RNA, 23 nt, Mycobacterium leprae
ucagaaaucguucgaccagauga

SEQ ID NO: 1234925 - RNA, 14 nt, Mycobacterium leprae
ucagcaacuuuccu

SEQ ID NO: 1234926 - RNA, 16 nt, Mycobacterium leprae
aaaucguucgaccaga

SEQ ID NO: 1234927 - RNA, 17 nt, Mycobacterium leprae
ucagauccgguggcgac

SEQ ID NO: 1234928 - RNA, 20 nt, Mycobacterium leprae
ucagaucaaccaaaugcuau

SEQ ID NO: 1234929 - RNA, 14 nt, Mycobacterium leprae
ucagacugcccaga

SEQ ID NO: 1234930 - RNA, 18 nt, Mycobacterium leprae
ucagacugcccagacuca

SEQ ID NO: 1234931 - RNA, 12 nt, Mycobacterium leprae
ucagaguuucau

SEQ ID NO: 1234932 - RNA, 12 nt, Mycobacterium leprae
ucagagugcaga

SEQ ID NO: 1234933 - RNA, 18 nt, Mycobacterium leprae
ucaggcugucaucagaaa

SEQ ID NO: 1234934 - RNA, 16 nt, Mycobacterium leprae
ucagugaagugcucgg

SEQ ID NO: 1234935 - RNA, 16 nt, Mycobacterium leprae
ucaguguauuggcggg

SEQ ID NO: 1234936 - RNA, 17 nt, Mycobacterium leprae
ucaggccaggcagcgcc

SEQ ID NO: 1234937 - RNA, 19 nt, Mycobacterium leprae
ucaggauaccgaacagugg

SEQ ID NO: 1234938 - RNA, 19 nt, Mycobacterium leprae
ucaggaauucagagcugca

SEQ ID NO: 1234939 - RNA, 13 nt, Mycobacterium leprae
ucaggccgucguu

SEQ ID NO: 1234940 - RNA, 20 nt, Mycobacterium leprae
ucagcacauggacuuuggca

SEQ ID NO: 1234941 - RNA, 21 nt, Mycobacterium leprae
ucagcacaaucaaccaggcaa

SEQ ID NO: 1234942 - RNA, 12 nt, Mycobacterium leprae
ucagcagcaguu

SEQ ID NO: 1234943 - RNA, 21 nt, Mycobacterium leprae
ucagcaugucggccacugcac

SEQ ID NO: 1234944 - RNA, 14 nt, Mycobacterium leprae
ucagcaugcccaga

SEQ ID NO: 1234945 - RNA, 21 nt, Mycobacterium leprae
ucagcgguaagcggauccugu

SEQ ID NO: 1234946 - RNA, 13 nt, Mycobacterium leprae
ucagcgcugcuuc

SEQ ID NO: 1234947 - RNA, 14 nt, Mycobacterium leprae
ucagcgcugcuuca

SEQ ID NO: 1234948 - RNA, 20 nt, Mycobacterium leprae
ucagcgcugcuucaaucaac

SEQ ID NO: 1234949 - RNA, 22 nt, Mycobacterium leprae
uauguucgguagucgugggggg

SEQ ID NO: 1234950 - RNA, 16 nt, Mycobacterium leprae
uauguuauuuauagau

SEQ ID NO: 1234951 - RNA, 17 nt, Mycobacterium leprae
uauuaauggagaugcca

SEQ ID NO: 1234952 - RNA, 15 nt, Mycobacterium leprae
uauuaauccaguagu

SEQ ID NO: 1234953 - RNA, 13 nt, Mycobacterium leprae
uauuaagauaaag

SEQ ID NO: 1234954 - RNA, 21 nt, Mycobacterium leprae
aaauccucacccgcgaucucg

SEQ ID NO: 1234955 - RNA, 16 nt, Mycobacterium leprae
uauuggaauagcugug

SEQ ID NO: 1234956 - RNA, 14 nt, Mycobacterium leprae
uauucggucguuag

SEQ ID NO: 1234957 - RNA, 17 nt, Mycobacterium leprae
uauucuuuuagagaaaa

SEQ ID NO: 1234958 - RNA, 14 nt, Mycobacterium leprae
uaugacaagaccac

SEQ ID NO: 1234959 - RNA, 15 nt, Mycobacterium leprae
uauggcgccguggag

SEQ ID NO: 1234960 - RNA, 17 nt, Mycobacterium leprae
uaugcggccagccagga

SEQ ID NO: 1234961 - RNA, 20 nt, Mycobacterium leprae
uaugccucgagcaaaccagg

SEQ ID NO: 1234962 - RNA, 15 nt, Mycobacterium leprae
uaucuugaugcugug

SEQ ID NO: 1234963 - RNA, 16 nt, Mycobacterium leprae
uaucuuuuuagagaag

SEQ ID NO: 1234964 - RNA, 20 nt, Mycobacterium leprae
uaucugggaacauaaccaca

SEQ ID NO: 1234965 - RNA, 20 nt, Mycobacterium leprae
uauauuaacgguauauuaac

SEQ ID NO: 1234966 - RNA, 13 nt, Mycobacterium leprae
uauauucaauuuu

SEQ ID NO: 1234967 - RNA, 22 nt, Mycobacterium leprae
uaucaagggauuccacugccag

SEQ ID NO: 1234968 - RNA, 15 nt, Mycobacterium leprae
uaucaagccacacgg

SEQ ID NO: 1234969 - RNA, 19 nt, Mycobacterium leprae
uauauaguccgaccagucg

SEQ ID NO: 1234970 - RNA, 13 nt, Mycobacterium leprae
uaucgcaggaucg

SEQ ID NO: 1234971 - RNA, 20 nt, Mycobacterium leprae
uaucgaugcuaccgaacuug

SEQ ID NO: 1234972 - RNA, 16 nt, Mycobacterium leprae
uaucgcaugugauacu

SEQ ID NO: 1234973 - RNA, 21 nt, Mycobacterium leprae
uaucgcuacccuugagcaccc

SEQ ID NO: 1234974 - RNA, 14 nt, Mycobacterium leprae
uaucggugucggcg

SEQ ID NO: 1234975 - RNA, 21 nt, Mycobacterium leprae
uaucguccucaagacuucagg

SEQ ID NO: 1234976 - RNA, 12 nt, Mycobacterium leprae
uauccguugcca

SEQ ID NO: 1234977 - RNA, 14 nt, Mycobacterium leprae
uauccucacacuca

SEQ ID NO: 1234978 - RNA, 21 nt, Mycobacterium leprae
uagucagugauauuaauggag

SEQ ID NO: 1234979 - RNA, 17 nt, Mycobacterium leprae
uagucgcuaaauauuaa

SEQ ID NO: 1234980 - RNA, 22 nt, Mycobacterium leprae
uaguuaacgugccaaccuagca

SEQ ID NO: 1234981 - RNA, 21 nt, Mycobacterium leprae
uagugguucgauucugcccgg

SEQ ID NO: 1234982 - RNA, 16 nt, Mycobacterium leprae
uagugguucugcuucg

SEQ ID NO: 1234983 - RNA, 15 nt, Mycobacterium leprae
uauaaagcgucugcu

SEQ ID NO: 1234984 - RNA, 21 nt, Mycobacterium leprae
uauaaguucggaccgcaacug

SEQ ID NO: 1234985 - RNA, 18 nt, Mycobacterium leprae
uccggaaaucgagaauuu

SEQ ID NO: 1234986 - RNA, 14 nt, Mycobacterium leprae
uccgcugcaauucg

SEQ ID NO: 1234987 - RNA, 18 nt, Mycobacterium leprae
uccgggcgcucagcggcc

SEQ ID NO: 1234988 - RNA, 16 nt, Mycobacterium leprae
uccggguuaucuaacu

SEQ ID NO: 1234989 - RNA, 19 nt, Mycobacterium leprae
uccggcgcggguccgcguu

SEQ ID NO: 1234990 - RNA, 15 nt, Mycobacterium leprae
uccguauaaccugcu

SEQ ID NO: 1234991 - RNA, 18 nt, Mycobacterium leprae
uccgguuggcugccgucg

SEQ ID NO: 1234992 - RNA, 22 nt, Mycobacterium leprae
uccgugaucggcaucugguagc

SEQ ID NO: 1234993 - RNA, 20 nt, Mycobacterium leprae
uccguugggguagugcugca

SEQ ID NO: 1234994 - RNA, 12 nt, Mycobacterium leprae
uccuaccggcca

SEQ ID NO: 1234995 - RNA, 12 nt, Mycobacterium leprae
uccuacagcagu

SEQ ID NO: 1234996 - RNA, 13 nt, Mycobacterium leprae
uccuaagagguuu

SEQ ID NO: 1234997 - RNA, 20 nt, Mycobacterium leprae
uccucacguugucgaaaaau

SEQ ID NO: 1234998 - RNA, 14 nt, Mycobacterium leprae
uccuaggaucagaa

SEQ ID NO: 1234999 - RNA, 22 nt, Mycobacterium leprae
uccuaugucgugcugaccaggg

SEQ ID NO: 1235000 - RNA, 16 nt, Mycobacterium leprae
uccuggaugccgaccg

SEQ ID NO: 1235001 - RNA, 19 nt, Mycobacterium leprae
uccuggcgaucgauccagu

SEQ ID NO: 1235002 - RNA, 16 nt, Mycobacterium leprae
uccugcccggacaagu

SEQ ID NO: 1235003 - RNA, 13 nt, Mycobacterium leprae
uccugcagguugc

SEQ ID NO: 1235004 - RNA, 18 nt, Mycobacterium leprae
uccuucaugcuggccucc

SEQ ID NO: 1235005 - RNA, 14 nt, Mycobacterium leprae
uccuguugauuuuu

SEQ ID NO: 1235006 - RNA, 24 nt, Mycobacterium leprae
uccuguguugccaucgacgccgcc

SEQ ID NO: 1235007 - RNA, 20 nt, Mycobacterium leprae
uccucagaguguguguggca

SEQ ID NO: 1235008 - RNA, 14 nt, Mycobacterium leprae
uccucaucccauga

SEQ ID NO: 1235009 - RNA, 16 nt, Mycobacterium leprae
uccucaugcccaugcc

SEQ ID NO: 1235010 - RNA, 14 nt, Mycobacterium leprae
uccucauuacccgc

SEQ ID NO: 1235011 - RNA, 20 nt, Mycobacterium leprae
uccuccaguuguaugcgcua

SEQ ID NO: 1235012 - RNA, 14 nt, Mycobacterium leprae
uccucgcucggcaa

SEQ ID NO: 1235013 - RNA, 14 nt, Mycobacterium leprae
uccucggcccaugg

SEQ ID NO: 1235014 - RNA, 18 nt, Mycobacterium leprae
uccucggcggcaccuccc

SEQ ID NO: 1235015 - RNA, 21 nt, Mycobacterium leprae
uccucgggggugcaagucagu

SEQ ID NO: 1235016 - RNA, 14 nt, Mycobacterium leprae
uccucgacagucaa

SEQ ID NO: 1235017 - RNA, 15 nt, Mycobacterium leprae
uccucgacccaccac

SEQ ID NO: 1235018 - RNA, 21 nt, Mycobacterium leprae
uccugaucuauuuauaauguu

SEQ ID NO: 1235019 - RNA, 22 nt, Mycobacterium leprae
uccugauuaauaacgccggccg

SEQ ID NO: 1235020 - RNA, 16 nt, Mycobacterium leprae
ucgcagguucugcacc

SEQ ID NO: 1235021 - RNA, 21 nt, Mycobacterium leprae
ucgcagguucugcaccccagg

SEQ ID NO: 1235022 - RNA, 21 nt, Mycobacterium leprae
ucgcagagguaaaucuggcaa

SEQ ID NO: 1235023 - RNA, 20 nt, Mycobacterium leprae
ucgcacgauccgugaauaca

SEQ ID NO: 1235024 - RNA, 20 nt, Mycobacterium leprae
ucgcacccugccgccacagc

SEQ ID NO: 1235025 - RNA, 21 nt, Mycobacterium leprae
ucgcacagcaggucgccgacg

SEQ ID NO: 1235026 - RNA, 20 nt, Mycobacterium leprae
ucgauggcgguguuagcaug

SEQ ID NO: 1235027 - RNA, 18 nt, Mycobacterium leprae
ucgauccgucguaggcug

SEQ ID NO: 1235028 - RNA, 16 nt, Mycobacterium leprae
ucgaucggcagccacg

SEQ ID NO: 1235029 - RNA, 15 nt, Mycobacterium leprae
ucgaucgcuggucag

SEQ ID NO: 1235030 - RNA, 12 nt, Mycobacterium leprae
ucgaugaggcuu

SEQ ID NO: 1235031 - RNA, 17 nt, Mycobacterium leprae
ucgauacggccaauacc

SEQ ID NO: 1235032 - RNA, 17 nt, Mycobacterium leprae
ucgauacagucauuguc

SEQ ID NO: 1235033 - RNA, 18 nt, Mycobacterium leprae
ucgaguuuggacuuuaau

SEQ ID NO: 1235034 - RNA, 14 nt, Mycobacterium leprae
ucgauaagcagcag

SEQ ID NO: 1235035 - RNA, 23 nt, Mycobacterium leprae
ucgaggucuuggucucacgcugg

SEQ ID NO: 1235036 - RNA, 12 nt, Mycobacterium leprae
ucgaggugagca

SEQ ID NO: 1235037 - RNA, 14 nt, Mycobacterium leprae
ucgagugcagcuaa

SEQ ID NO: 1235038 - RNA, 14 nt, Mycobacterium leprae
ucgagguaaccaaa

SEQ ID NO: 1235039 - RNA, 15 nt, Mycobacterium leprae
ucgagcuggcugugc

SEQ ID NO: 1235040 - RNA, 16 nt, Mycobacterium leprae
ucgagcggcgcaugcc

SEQ ID NO: 1235041 - RNA, 18 nt, Mycobacterium leprae
ucgagcagccgaccgccc

SEQ ID NO: 1235042 - RNA, 11 nt, Mycobacterium leprae
ucgagcgauug

SEQ ID NO: 1235043 - RNA, 16 nt, Mycobacterium leprae
ucgagcgauugugcgg

SEQ ID NO: 1235044 - RNA, 14 nt, Mycobacterium leprae
ucgagccgcaccgg

SEQ ID NO: 1235045 - RNA, 22 nt, Mycobacterium leprae
ucgagcaacguacugcaaugcu

SEQ ID NO: 1235046 - RNA, 22 nt, Mycobacterium leprae
ucgagcaaugcugagcgaagaa

SEQ ID NO: 1235047 - RNA, 13 nt, Mycobacterium leprae
ucgagcaaaccag

SEQ ID NO: 1235048 - RNA, 16 nt, Mycobacterium leprae
ucgagaaaaauuggca

SEQ ID NO: 1235049 - RNA, 21 nt, Mycobacterium leprae
ucgagaagggagugcagugcc

SEQ ID NO: 1235050 - RNA, 19 nt, Mycobacterium leprae
ucgagaaguacgaaaugaa

SEQ ID NO: 1235051 - RNA, 18 nt, Mycobacterium leprae
ucgacuguuguuguacau

SEQ ID NO: 1235052 - RNA, 14 nt, Mycobacterium leprae
ucgacuugaccuau

SEQ ID NO: 1235053 - RNA, 14 nt, Mycobacterium leprae
ucgacacgaggauc

SEQ ID NO: 1235054 - RNA, 20 nt, Mycobacterium leprae
ucgacauagugcaagugcac

SEQ ID NO: 1235055 - RNA, 19 nt, Mycobacterium leprae
ucgaccaacgguucgcuug

SEQ ID NO: 1235056 - RNA, 13 nt, Mycobacterium leprae
ucgacauugcccg

SEQ ID NO: 1235057 - RNA, 12 nt, Mycobacterium leprae
ucgaccagauga

SEQ ID NO: 1235058 - RNA, 22 nt, Mycobacterium leprae
ucgaccuauuucggcaaaauau

SEQ ID NO: 1235059 - RNA, 22 nt, Mycobacterium leprae
ucgaccgacugcagaaauucag

SEQ ID NO: 1235060 - RNA, 18 nt, Mycobacterium leprae
ucgaccgccgaagcagcc

SEQ ID NO: 1235061 - RNA, 18 nt, Mycobacterium leprae
ucgacgaggucgccgccg

SEQ ID NO: 1235062 - RNA, 20 nt, Mycobacterium leprae
ucgacgcgugcgucauggca

SEQ ID NO: 1235063 - RNA, 21 nt, Mycobacterium leprae
ucgacaaccucguuacgaucc

SEQ ID NO: 1235064 - RNA, 17 nt, Mycobacterium leprae
ucgacaaccucuagcca

SEQ ID NO: 1235065 - RNA, 13 nt, Mycobacterium leprae
ucgacaagcaucu

SEQ ID NO: 1235066 - RNA, 14 nt, Mycobacterium leprae
ucgaaucagcaucg

SEQ ID NO: 1235067 - RNA, 20 nt, Mycobacterium leprae
ucgaacuuuuccaugcugcc

SEQ ID NO: 1235068 - RNA, 14 nt, Mycobacterium leprae
ucgaagcaaccagc

SEQ ID NO: 1235069 - RNA, 20 nt, Mycobacterium leprae
ucgaaacugccaaaguccau

SEQ ID NO: 1235070 - RNA, 22 nt, Mycobacterium leprae
uccuuucagcucgauggugcca

SEQ ID NO: 1235071 - RNA, 16 nt, Mycobacterium leprae
uccuuuaucagcaaga

SEQ ID NO: 1235072 - RNA, 12 nt, Mycobacterium leprae
uccuuccggccu

SEQ ID NO: 1235073 - RNA, 16 nt, Mycobacterium leprae
uccuugaccugauugc

SEQ ID NO: 1235074 - RNA, 19 nt, Mycobacterium leprae
uccgaucgcaccggcugca

SEQ ID NO: 1235075 - RNA, 18 nt, Mycobacterium leprae
uccgaucaauggcagcca

SEQ ID NO: 1235076 - RNA, 19 nt, Mycobacterium leprae
uccgaucaauggcagccac

SEQ ID NO: 1235077 - RNA, 16 nt, Mycobacterium leprae
uccgcaaaaugcuccc

SEQ ID NO: 1235078 - RNA, 14 nt, Mycobacterium leprae
uccgcaaaguuaug

SEQ ID NO: 1235079 - RNA, 14 nt, Mycobacterium leprae
uccgcaagaugccc

SEQ ID NO: 1235080 - RNA, 21 nt, Mycobacterium leprae
uccgcaggacaaagucagcuu

SEQ ID NO: 1235081 - RNA, 23 nt, Mycobacterium leprae
uccgcagcacuaaagucuucaau

SEQ ID NO: 1235082 - RNA, 15 nt, Mycobacterium leprae
uccgccagcgacacc

SEQ ID NO: 1235083 - RNA, 22 nt, Mycobacterium leprae
uccgcuaaggcagcccgcgccg

SEQ ID NO: 1235084 - RNA, 14 nt, Mycobacterium leprae
uccgcggcagcugc

SEQ ID NO: 1235085 - RNA, 16 nt, Mycobacterium leprae
uccgcggcagcugcug

SEQ ID NO: 1235086 - RNA, 15 nt, Mycobacterium leprae
uccgcgccccuuccu

SEQ ID NO: 1235087 - RNA, 17 nt, Mycobacterium leprae
uccgcgccccuuccuga

SEQ ID NO: 1235088 - RNA, 18 nt, Mycobacterium leprae
uccgcgcaacacccaggu

SEQ ID NO: 1235089 - RNA, 17 nt, Mycobacterium leprae
uccgccguucucccgcc

SEQ ID NO: 1235090 - RNA, 16 nt, Mycobacterium leprae
uccgccggccgcaccc

SEQ ID NO: 1235091 - RNA, 14 nt, Mycobacterium leprae
uccgagcuuuucca

SEQ ID NO: 1235092 - RNA, 18 nt, Mycobacterium leprae
uccgagcuuuuccagcgg

SEQ ID NO: 1235093 - RNA, 20 nt, Mycobacterium leprae
uccgacggcuggcugcugca

SEQ ID NO: 1235094 - RNA, 23 nt, Mycobacterium leprae
uccgacggcuggcugcugcagac

SEQ ID NO: 1235095 - RNA, 18 nt, Mycobacterium leprae
uccgacggcuucaucagu

SEQ ID NO: 1235096 - RNA, 19 nt, Mycobacterium leprae
uccgaagcagccaaugcug

SEQ ID NO: 1235097 - RNA, 16 nt, Mycobacterium leprae
uccgacaaaccaggcg

SEQ ID NO: 1235098 - RNA, 22 nt, Mycobacterium leprae
uccgaccagucgagauaguccg

SEQ ID NO: 1235099 - RNA, 17 nt, Mycobacterium leprae
ucccugacgcacaccgu

SEQ ID NO: 1235100 - RNA, 13 nt, Mycobacterium leprae
ucccugacgcgca

SEQ ID NO: 1235101 - RNA, 15 nt, Mycobacterium leprae
ucccugauccuucuu

SEQ ID NO: 1235102 - RNA, 12 nt, Mycobacterium leprae
ucccgcucugcg

SEQ ID NO: 1235103 - RNA, 14 nt, Mycobacterium leprae
ucccggugugcccu

SEQ ID NO: 1235104 - RNA, 18 nt, Mycobacterium leprae
ucccgaaacgccucugcc

SEQ ID NO: 1235105 - RNA, 18 nt, Mycobacterium leprae
ucccgauagcugccagcu

SEQ ID NO: 1235106 - RNA, 20 nt, Mycobacterium leprae
ucccgaugaccuugaaagcg

SEQ ID NO: 1235107 - RNA, 21 nt, Mycobacterium leprae
uccccgucggggaagacguaa

SEQ ID NO: 1235108 - RNA, 23 nt, Mycobacterium leprae
ucccagaacugguccgccagcga

SEQ ID NO: 1235109 - RNA, 15 nt, Mycobacterium leprae
ucccagugagugcau

SEQ ID NO: 1235110 - RNA, 17 nt, Mycobacterium leprae
ucccaucggcugcaccg

SEQ ID NO: 1235111 - RNA, 19 nt, Mycobacterium leprae
uccauuuuucuugaaaaau

SEQ ID NO: 1235112 - RNA, 17 nt, Mycobacterium leprae
uccauugaccucuucag

SEQ ID NO: 1235113 - RNA, 22 nt, Mycobacterium leprae
uccauucgccguccacuggcua

SEQ ID NO: 1235114 - RNA, 20 nt, Mycobacterium leprae
ucccaccacccugcgcugag

SEQ ID NO: 1235115 - RNA, 18 nt, Mycobacterium leprae
uccaugaauuacuaccca

SEQ ID NO: 1235116 - RNA, 22 nt, Mycobacterium leprae
uccaucagcaccgagaauaaau

SEQ ID NO: 1235117 - RNA, 13 nt, Mycobacterium leprae
uccauccugccuc

SEQ ID NO: 1235118 - RNA, 20 nt, Mycobacterium leprae
uccagcaucauaaaaaccug

SEQ ID NO: 1235119 - RNA, 18 nt, Mycobacterium leprae
uccagaaggggcugcggc

SEQ ID NO: 1235120 - RNA, 16 nt, Mycobacterium leprae
uccacuugacuggcuu

SEQ ID NO: 1235121 - RNA, 16 nt, Mycobacterium leprae
uccagaacggucuggc

SEQ ID NO: 1235122 - RNA, 19 nt, Mycobacterium leprae
uccaauucacgaacaacag

SEQ ID NO: 1235123 - RNA, 14 nt, Mycobacterium leprae
uccaccagccggcc

SEQ ID NO: 1235124 - RNA, 23 nt, Mycobacterium leprae
uccaccagccgcaggcaccauug

SEQ ID NO: 1235125 - RNA, 16 nt, Mycobacterium leprae
uccaccauacagcuaa

SEQ ID NO: 1235126 - RNA, 22 nt, Mycobacterium leprae
uccacccaaggauucagccaag

SEQ ID NO: 1235127 - RNA, 14 nt, Mycobacterium leprae
uccaagcacgauga

SEQ ID NO: 1235128 - RNA, 13 nt, Mycobacterium leprae
uccaaguggcugc

SEQ ID NO: 1235129 - RNA, 14 nt, Mycobacterium leprae
uccaaguggcugcu

SEQ ID NO: 1235130 - RNA, 15 nt, Mycobacterium leprae
uccaaguggcugcua

SEQ ID NO: 1235131 - RNA, 14 nt, Mycobacterium leprae
uccaagaccaccug

SEQ ID NO: 1235132 - RNA, 22 nt, Mycobacterium leprae
uccaacgugguuggcacgauga

SEQ ID NO: 1235133 - RNA, 18 nt, Mycobacterium leprae
uccaaccaauugccaucc

SEQ ID NO: 1235134 - RNA, 19 nt, Mycobacterium leprae
uccaacaaacuacuguugu

SEQ ID NO: 1235135 - RNA, 21 nt, Mycobacterium leprae
uccaacaaacuacuguuguca

SEQ ID NO: 1235136 - RNA, 17 nt, Mycobacterium leprae
uccaaacuuccucugcc

SEQ ID NO: 1235137 - RNA, 14 nt, Mycobacterium leprae
ucauuuucgagcaa

SEQ ID NO: 1235138 - RNA, 14 nt, Mycobacterium leprae
ucaguuuacuggca

SEQ ID NO: 1235139 - RNA, 18 nt, Mycobacterium leprae
ucauguucucaaggcaau

SEQ ID NO: 1235140 - RNA, 23 nt, Mycobacterium leprae
ugaaaacgguuagucagagugac

SEQ ID NO: 1235141 - RNA, 20 nt, Mycobacterium leprae
ugaaaacagcgccucaccaa

SEQ ID NO: 1235142 - RNA, 21 nt, Mycobacterium leprae
ugaaguauggcuccauagaac

SEQ ID NO: 1235143 - RNA, 16 nt, Mycobacterium leprae
ugaaccugccauccaa

SEQ ID NO: 1235144 - RNA, 14 nt, Mycobacterium leprae
ugaacuaagcauuu

SEQ ID NO: 1235145 - RNA, 21 nt, Mycobacterium leprae
ugaaccuauugucagguggcu

SEQ ID NO: 1235146 - RNA, 14 nt, Mycobacterium leprae
ugaacaggcgccug

SEQ ID NO: 1235147 - RNA, 13 nt, Mycobacterium leprae
ucuuuuuagagaa

SEQ ID NO: 1235148 - RNA, 17 nt, Mycobacterium leprae
ucuuugccuucgugaug

SEQ ID NO: 1235149 - RNA, 17 nt, Mycobacterium leprae
ucuuugaucagcaagga

SEQ ID NO: 1235150 - RNA, 18 nt, Mycobacterium leprae
ucuuugaccagacaaauu

SEQ ID NO: 1235151 - RNA, 22 nt, Mycobacterium leprae
ucuuguuggcuuccagucuggc

SEQ ID NO: 1235152 - RNA, 17 nt, Mycobacterium leprae
ucuuggggacgccggcg

SEQ ID NO: 1235153 - RNA, 15 nt, Mycobacterium leprae
ucuuuaggugguauu

SEQ ID NO: 1235154 - RNA, 13 nt, Mycobacterium leprae
ucuugaugccaac

SEQ ID NO: 1235155 - RNA, 16 nt, Mycobacterium leprae
ucuugaugccaaccug

SEQ ID NO: 1235156 - RNA, 14 nt, Mycobacterium leprae
ucuugaacucaucg

SEQ ID NO: 1235157 - RNA, 20 nt, Mycobacterium leprae
ucuugacgggaggaacuccg

SEQ ID NO: 1235158 - RNA, 15 nt, Mycobacterium leprae
ucuucgcagccuagg

SEQ ID NO: 1235159 - RNA, 19 nt, Mycobacterium leprae
ucuucgcagccuaggugau

SEQ ID NO: 1235160 - RNA, 14 nt, Mycobacterium leprae
ucuucgaugcucug

SEQ ID NO: 1235161 - RNA, 16 nt, Mycobacterium leprae
ucuucucuaaaaagau

SEQ ID NO: 1235162 - RNA, 21 nt, Mycobacterium leprae
ucuuagcaacguguaaggcca

SEQ ID NO: 1235163 - RNA, 21 nt, Mycobacterium leprae
ucuuacuggggcguccaguga

SEQ ID NO: 1235164 - RNA, 21 nt, Mycobacterium leprae
ucugguaacggaccuggcaaa

SEQ ID NO: 1235165 - RNA, 15 nt, Mycobacterium leprae
ucugggugguguggc

SEQ ID NO: 1235166 - RNA, 12 nt, Mycobacterium leprae
ucugggcuggcc

SEQ ID NO: 1235167 - RNA, 15 nt, Mycobacterium leprae
ucugcccugcacuuc

SEQ ID NO: 1235168 - RNA, 17 nt, Mycobacterium leprae
ucugccaugccaguuca

SEQ ID NO: 1235169 - RNA, 18 nt, Mycobacterium leprae
ucugauugaauccccgau

SEQ ID NO: 1235170 - RNA, 14 nt, Mycobacterium leprae
ucugcgaacacuga

SEQ ID NO: 1235171 - RNA, 14 nt, Mycobacterium leprae
ucugcuggagaucg

SEQ ID NO: 1235172 - RNA, 13 nt, Mycobacterium leprae
ucugcugaucaga

SEQ ID NO: 1235173 - RNA, 15 nt, Mycobacterium leprae
ucugcgugccgagcc

SEQ ID NO: 1235174 - RNA, 14 nt, Mycobacterium leprae
ucugcuacgcuggc

SEQ ID NO: 1235175 - RNA, 19 nt, Mycobacterium leprae
ucugcguaaccgccaucgg

SEQ ID NO: 1235176 - RNA, 22 nt, Mycobacterium leprae
ucugcuggaucuguauuaaucu

SEQ ID NO: 1235177 - RNA, 18 nt, Mycobacterium leprae
ucuggaccacgcaauguc

SEQ ID NO: 1235178 - RNA, 21 nt, Mycobacterium leprae
ucucuguuuauauguagcccu

SEQ ID NO: 1235179 - RNA, 19 nt, Mycobacterium leprae
ucucuggugcgccaacacu

SEQ ID NO: 1235180 - RNA, 22 nt, Mycobacterium leprae
ucgcauccucgacuuccggccc

SEQ ID NO: 1235181 - RNA, 23 nt, Mycobacterium leprae
ucucggugucggacuugucgucg

SEQ ID NO: 1235182 - RNA, 22 nt, Mycobacterium leprae
ugaccacccacaacgccaaacu

SEQ ID NO: 1235183 - RNA, 16 nt, Mycobacterium leprae
ugaccagacaaauuga

SEQ ID NO: 1235184 - RNA, 13 nt, Mycobacterium leprae
ugacccaguaccg

SEQ ID NO: 1235185 - RNA, 18 nt, Mycobacterium leprae
ugaccaaaccgaagauca

SEQ ID NO: 1235186 - RNA, 13 nt, Mycobacterium leprae
ugacaugccgagg

SEQ ID NO: 1235187 - RNA, 13 nt, Mycobacterium leprae
ugaccgugcagcu

SEQ ID NO: 1235188 - RNA, 19 nt, Mycobacterium leprae
ugaccgugcuacgccaggg

SEQ ID NO: 1235189 - RNA, 15 nt, Mycobacterium leprae
ugaccgacagcucgu

SEQ ID NO: 1235190 - RNA, 21 nt, Mycobacterium leprae
ugacgacauugugggccgcua

SEQ ID NO: 1235191 - RNA, 19 nt, Mycobacterium leprae
ugaccuccacguuguccgc

SEQ ID NO: 1235192 - RNA, 20 nt, Mycobacterium leprae
ugacgcccuccuggcgagug

SEQ ID NO: 1235193 - RNA, 17 nt, Mycobacterium leprae
ugagaccgguccaccug

SEQ ID NO: 1235194 - RNA, 22 nt, Mycobacterium leprae
ugagacauuucgacaggcuguc

SEQ ID NO: 1235195 - RNA, 20 nt, Mycobacterium leprae
ugacucgccggcgucaaagu

SEQ ID NO: 1235196 - RNA, 15 nt, Mycobacterium leprae
ugacucgacauagaa

SEQ ID NO: 1235197 - RNA, 16 nt, Mycobacterium leprae
ugacucggcgugccac

SEQ ID NO: 1235198 - RNA, 20 nt, Mycobacterium leprae
ugacuucgucagacgaaauu

SEQ ID NO: 1235199 - RNA, 16 nt, Mycobacterium leprae
ugacggcgcaguugac

SEQ ID NO: 1235200 - RNA, 12 nt, Mycobacterium leprae
ugacggcagaaa

SEQ ID NO: 1235201 - RNA, 13 nt, Mycobacterium leprae
ugacuaaagucau

SEQ ID NO: 1235202 - RNA, 22 nt, Mycobacterium leprae
ugacguuuacaacguugcugcu

SEQ ID NO: 1235203 - RNA, 19 nt, Mycobacterium leprae
ugacguucgaugccccauc

SEQ ID NO: 1235204 - RNA, 21 nt, Mycobacterium leprae
ugacguguuuugcuguguugc

SEQ ID NO: 1235205 - RNA, 16 nt, Mycobacterium leprae
ugacgucgguguggug

SEQ ID NO: 1235206 - RNA, 17 nt, Mycobacterium leprae
ugacgucuucuauacuu

SEQ ID NO: 1235207 - RNA, 18 nt, Mycobacterium leprae
ugaucaggaugauuucgc

SEQ ID NO: 1235208 - RNA, 14 nt, Mycobacterium leprae
ugauccuucuuuuc

SEQ ID NO: 1235209 - RNA, 20 nt, Mycobacterium leprae
ugauagccguaguaagucga

SEQ ID NO: 1235210 - RNA, 15 nt, Mycobacterium leprae
ugauacgugccggcc

SEQ ID NO: 1235211 - RNA, 14 nt, Mycobacterium leprae
ugagugcugccagg

SEQ ID NO: 1235212 - RNA, 19 nt, Mycobacterium leprae
ugagugcgaccugaacauu

SEQ ID NO: 1235213 - RNA, 23 nt, Mycobacterium leprae
ugaggugugaccgugcagcugcc

SEQ ID NO: 1235214 - RNA, 15 nt, Mycobacterium leprae
ugagguguugggagc

SEQ ID NO: 1235215 - RNA, 21 nt, Mycobacterium leprae
ugaggcuucuuacggcuuugc

SEQ ID NO: 1235216 - RNA, 15 nt, Mycobacterium leprae
ugaggcgggucagcg

SEQ ID NO: 1235217 - RNA, 14 nt, Mycobacterium leprae
ugagugugaggaua

SEQ ID NO: 1235218 - RNA, 13 nt, Mycobacterium leprae
ugagcguggcugc

SEQ ID NO: 1235219 - RNA, 16 nt, Mycobacterium leprae
ugagcguggcugcuca

SEQ ID NO: 1235220 - RNA, 20 nt, Mycobacterium leprae
ugaggcggccggcacugaga

SEQ ID NO: 1235221 - RNA, 14 nt, Mycobacterium leprae
ugagcggcagagcc

SEQ ID NO: 1235222 - RNA, 13 nt, Mycobacterium leprae
ugagauuucagcc

SEQ ID NO: 1235223 - RNA, 22 nt, Mycobacterium leprae
ugagaucaccagcaaggguggg

SEQ ID NO: 1235224 - RNA, 19 nt, Mycobacterium leprae
ugcaucgguaaccauaaga

SEQ ID NO: 1235225 - RNA, 12 nt, Mycobacterium leprae
ugcauuggcuga

SEQ ID NO: 1235226 - RNA, 20 nt, Mycobacterium leprae
ugcagguucgcgucgcccgu

SEQ ID NO: 1235227 - RNA, 19 nt, Mycobacterium leprae
ugcagcuaaucccauggga

SEQ ID NO: 1235228 - RNA, 20 nt, Mycobacterium leprae
ugcagcuaauuuuccacagg

SEQ ID NO: 1235229 - RNA, 21 nt, Mycobacterium leprae
ugcaucaagcugugagugugc

SEQ ID NO: 1235230 - RNA, 14 nt, Mycobacterium leprae
ugcaguuauaacca

SEQ ID NO: 1235231 - RNA, 18 nt, Mycobacterium leprae
ugcaguucaccacaucau

SEQ ID NO: 1235232 - RNA, 13 nt, Mycobacterium leprae
ugcacacuaaaac

SEQ ID NO: 1235233 - RNA, 23 nt, Mycobacterium leprae
ugcacacuaaaacgccccuaccc

SEQ ID NO: 1235234 - RNA, 21 nt, Mycobacterium leprae
ugcacaagauugcagcccuga

SEQ ID NO: 1235235 - RNA, 18 nt, Mycobacterium leprae
ugcacaaggaauugcugc

SEQ ID NO: 1235236 - RNA, 18 nt, Mycobacterium leprae
ugcacaacaccuugcgcc

SEQ ID NO: 1235237 - RNA, 21 nt, Mycobacterium leprae
ugcacuaacgugcagcuggcc

SEQ ID NO: 1235238 - RNA, 23 nt, Mycobacterium leprae
ugcacgucggccgaucauggcug

SEQ ID NO: 1235239 - RNA, 23 nt, Mycobacterium leprae
ugcacgugcaaacugcugcgcaa

SEQ ID NO: 1235240 - RNA, 13 nt, Mycobacterium leprae
ugcaccagcucac

SEQ ID NO: 1235241 - RNA, 15 nt, Mycobacterium leprae
ugcaccacggucguc

SEQ ID NO: 1235242 - RNA, 18 nt, Mycobacterium leprae
ugcacugcuucggccagc

SEQ ID NO: 1235243 - RNA, 21 nt, Mycobacterium leprae
ugcacugugucaccugaaaga

SEQ ID NO: 1235244 - RNA, 15 nt, Mycobacterium leprae
ugcagcaacagccac

SEQ ID NO: 1235245 - RNA, 16 nt, Mycobacterium leprae
ugcagcaacgugcagu

SEQ ID NO: 1235246 - RNA, 20 nt, Mycobacterium leprae
ugcagcgugacgacuugccc

SEQ ID NO: 1235247 - RNA, 15 nt, Mycobacterium leprae
ugcaaauggcacuga

SEQ ID NO: 1235248 - RNA, 21 nt, Mycobacterium leprae
ugcaaauggcacugauacuga

SEQ ID NO: 1235249 - RNA, 13 nt, Mycobacterium leprae
ugcaaccacaccc

SEQ ID NO: 1235250 - RNA, 22 nt, Mycobacterium leprae
ugcaaccuccguugucccgccc

SEQ ID NO: 1235251 - RNA, 16 nt, Mycobacterium leprae
ugcaacgacuggauga

SEQ ID NO: 1235252 - RNA, 18 nt, Mycobacterium leprae
ugcaacgcugcaaggugg

SEQ ID NO: 1235253 - RNA, 18 nt, Mycobacterium leprae
ugcaacgcuucgugcauc

SEQ ID NO: 1235254 - RNA, 21 nt, Mycobacterium leprae
ugcaauccgccgaucccgaaa

SEQ ID NO: 1235255 - RNA, 19 nt, Mycobacterium leprae
ugcaagugcaccaucugcu

SEQ ID NO: 1235256 - RNA, 17 nt, Mycobacterium leprae
ugauuuucauuggcauu

SEQ ID NO: 1235257 - RNA, 13 nt, Mycobacterium leprae
ugauugaucggug

SEQ ID NO: 1235258 - RNA, 22 nt, Mycobacterium leprae
ugauugaucggugacuuggcug

SEQ ID NO: 1235259 - RNA, 14 nt, Mycobacterium leprae
ugauucgacaccaa

SEQ ID NO: 1235260 - RNA, 16 nt, Mycobacterium leprae
ugauucgacaccaacu

SEQ ID NO: 1235261 - RNA, 13 nt, Mycobacterium leprae
ugaugacgaaauu

SEQ ID NO: 1235262 - RNA, 18 nt, Mycobacterium leprae
ugccuucugcacccgcca

SEQ ID NO: 1235263 - RNA, 22 nt, Mycobacterium leprae
ugccuucugcacccgccagggc

SEQ ID NO: 1235264 - RNA, 13 nt, Mycobacterium leprae
ugccuugacuucu

SEQ ID NO: 1235265 - RNA, 15 nt, Mycobacterium leprae
ugccuucgugauggc

SEQ ID NO: 1235266 - RNA, 22 nt, Mycobacterium leprae
ugccucgcugucgaaaaccuca

SEQ ID NO: 1235267 - RNA, 12 nt, Mycobacterium leprae
ugccugaugcca

SEQ ID NO: 1235268 - RNA, 15 nt, Mycobacterium leprae
ugccugaugccauca

SEQ ID NO: 1235269 - RNA, 19 nt, Mycobacterium leprae
ugccugaugccaucagaag

SEQ ID NO: 1235270 - RNA, 16 nt, Mycobacterium leprae
ugccaccguauccugg

SEQ ID NO: 1235271 - RNA, 17 nt, Mycobacterium leprae
ugccggugaccgggccg

SEQ ID NO: 1235272 - RNA, 14 nt, Mycobacterium leprae
ugccgguggccagc

SEQ ID NO: 1235273 - RNA, 17 nt, Mycobacterium leprae
ugccggggcugcgcugg

SEQ ID NO: 1235274 - RNA, 16 nt, Mycobacterium leprae
ugcgagugugaaaaag

SEQ ID NO: 1235275 - RNA, 16 nt, Mycobacterium leprae
ugcgacacuugccgcg

SEQ ID NO: 1235276 - RNA, 20 nt, Mycobacterium leprae
ugcgcaccggcugaggcggc

SEQ ID NO: 1235277 - RNA, 16 nt, Mycobacterium leprae
ugcgccaacacuagcg

SEQ ID NO: 1235278 - RNA, 15 nt, Mycobacterium leprae
ugcucacaggcagca

SEQ ID NO: 1235279 - RNA, 22 nt, Mycobacterium leprae
ugcucagugaagugcucgggug

SEQ ID NO: 1235280 - RNA, 14 nt, Mycobacterium leprae
ugcuacgugacugc

SEQ ID NO: 1235281 - RNA, 20 nt, Mycobacterium leprae
ugcuaccaguguccgucgac

SEQ ID NO: 1235282 - RNA, 20 nt, Mycobacterium leprae
ugcuaugauaauuuggcuga

SEQ ID NO: 1235283 - RNA, 13 nt, Mycobacterium leprae
ugcuaugggguug

SEQ ID NO: 1235284 - RNA, 13 nt, Mycobacterium leprae
ugcuaugguuggu

SEQ ID NO: 1235285 - RNA, 21 nt, Mycobacterium leprae
ugcuauccgcggugugucccg

SEQ ID NO: 1235286 - RNA, 17 nt, Mycobacterium leprae
ugcggcuggcuccaucc

SEQ ID NO: 1235287 - RNA, 19 nt, Mycobacterium leprae
ugcggcucguggcagucuc

SEQ ID NO: 1235288 - RNA, 15 nt, Mycobacterium leprae
ugcgcuucaucagcu

SEQ ID NO: 1235289 - RNA, 20 nt, Mycobacterium leprae
ugcgccggcgcgcaggcugc

SEQ ID NO: 1235290 - RNA, 19 nt, Mycobacterium leprae
ugcgcuggaaggagcgcgc

SEQ ID NO: 1235291 - RNA, 18 nt, Mycobacterium leprae
ugcggugacggucgugcu

SEQ ID NO: 1235292 - RNA, 16 nt, Mycobacterium leprae
ugcguuuuaugacugg

SEQ ID NO: 1235293 - RNA, 19 nt, Mycobacterium leprae
ugcgguuuucggccacgac

SEQ ID NO: 1235294 - RNA, 18 nt, Mycobacterium leprae
uggaauccggcaacugac

SEQ ID NO: 1235295 - RNA, 12 nt, Mycobacterium leprae
uggacagaacac

SEQ ID NO: 1235296 - RNA, 19 nt, Mycobacterium leprae
uggacaucacuugcugacc

SEQ ID NO: 1235297 - RNA, 20 nt, Mycobacterium leprae
uggacagaugagcucagucg

SEQ ID NO: 1235298 - RNA, 21 nt, Mycobacterium leprae
uggacagaugagcucagucgg

SEQ ID NO: 1235299 - RNA, 19 nt, Mycobacterium leprae
uggaccugaugacagcgau

SEQ ID NO: 1235300 - RNA, 22 nt, Mycobacterium leprae
uggacgaacugggugaccaccc

SEQ ID NO: 1235301 - RNA, 17 nt, Mycobacterium leprae
uggacgacggcuuugcu

SEQ ID NO: 1235302 - RNA, 17 nt, Mycobacterium leprae
uggaccacaagcaacug

SEQ ID NO: 1235303 - RNA, 13 nt, Mycobacterium leprae
uggaaacgggugg

SEQ ID NO: 1235304 - RNA, 13 nt, Mycobacterium leprae
uggaaagucagca

SEQ ID NO: 1235305 - RNA, 15 nt, Mycobacterium leprae
uggaaagucagcauc

SEQ ID NO: 1235306 - RNA, 12 nt, Mycobacterium leprae
ugcuuugggggu

SEQ ID NO: 1235307 - RNA, 12 nt, Mycobacterium leprae
ugcuugcuguga

SEQ ID NO: 1235308 - RNA, 21 nt, Mycobacterium leprae
ugcuuguugccgccgggacgc

SEQ ID NO: 1235309 - RNA, 12 nt, Mycobacterium leprae
ugcuugagccug

SEQ ID NO: 1235310 - RNA, 16 nt, Mycobacterium leprae
ugcuuagcuaugcagu

SEQ ID NO: 1235311 - RNA, 15 nt, Mycobacterium leprae
ugcugucgugcccag

SEQ ID NO: 1235312 - RNA, 20 nt, Mycobacterium leprae
ugcuguguuugcuggucagg

SEQ ID NO: 1235313 - RNA, 23 nt, Mycobacterium leprae
ugcuguucggugacuucggccgg

SEQ ID NO: 1235314 - RNA, 13 nt, Mycobacterium leprae
ugcuguuggggau

SEQ ID NO: 1235315 - RNA, 20 nt, Mycobacterium leprae
ugcugguucuuggcuugcug

SEQ ID NO: 1235316 - RNA, 16 nt, Mycobacterium leprae
ugcuggugaucaggau

SEQ ID NO: 1235317 - RNA, 17 nt, Mycobacterium leprae
ugcuggugaucaggaug

SEQ ID NO: 1235318 - RNA, 15 nt, Mycobacterium leprae
ugcugccuagaugau

SEQ ID NO: 1235319 - RNA, 18 nt, Mycobacterium leprae
ugcugcggcgcccuagac

SEQ ID NO: 1235320 - RNA, 21 nt, Mycobacterium leprae
ugcugcugguucuuggcuugc

SEQ ID NO: 1235321 - RNA, 14 nt, Mycobacterium leprae
ugcugcuguauucc

SEQ ID NO: 1235322 - RNA, 10 nt, Mycobacterium leprae
ugcuggaggg

SEQ ID NO: 1235323 - RNA, 23 nt, Mycobacterium leprae
ugcuggaugccgggaagcgaccg

SEQ ID NO: 1235324 - RNA, 12 nt, Mycobacterium leprae
ugcuggcagugg

SEQ ID NO: 1235325 - RNA, 22 nt, Mycobacterium leprae
ugcuggcaagcucggguguguc

SEQ ID NO: 1235326 - RNA, 20 nt, Mycobacterium leprae
ugcuggccguguugcugcua

SEQ ID NO: 1235327 - RNA, 22 nt, Mycobacterium leprae
ugcugcauccgacaaagcagca

SEQ ID NO: 1235328 - RNA, 12 nt, Mycobacterium leprae
ugcugcagcugg

SEQ ID NO: 1235329 - RNA, 13 nt, Mycobacterium leprae
ugcugcagcuggg

SEQ ID NO: 1235330 - RNA, 14 nt, Mycobacterium leprae
ugcugauggccggc

SEQ ID NO: 1235331 - RNA, 18 nt, Mycobacterium leprae
ugcugauggccggccugg

SEQ ID NO: 1235332 - RNA, 14 nt, Mycobacterium leprae
ugcugagagcagau

SEQ ID NO: 1235333 - RNA, 23 nt, Mycobacterium leprae
ugcucugaccagagguucuaggu

SEQ ID NO: 1235334 - RNA, 21 nt, Mycobacterium leprae
ugcucugggugguguggcccg

SEQ ID NO: 1235335 - RNA, 17 nt, Mycobacterium leprae
ugcucgaucagugcggu

SEQ ID NO: 1235336 - RNA, 19 nt, Mycobacterium leprae
ugcucgucaucgacgaugc

SEQ ID NO: 1235337 - RNA, 14 nt, Mycobacterium leprae
ugugaagcugaggc

SEQ ID NO: 1235338 - RNA, 16 nt, Mycobacterium leprae
ugugaagcugaggcga

SEQ ID NO: 1235339 - RNA, 22 nt, Mycobacterium leprae
ugucuucuacugagcgcgaaca

SEQ ID NO: 1235340 - RNA, 23 nt, Mycobacterium leprae
ugucuucuagagcugugccgaca

SEQ ID NO: 1235341 - RNA, 16 nt, Mycobacterium leprae
ugucuuccaguggcug

SEQ ID NO: 1235342 - RNA, 17 nt, Mycobacterium leprae
ugugaugccgaagcaga

SEQ ID NO: 1235343 - RNA, 16 nt, Mycobacterium leprae
ugugccgacaccaucc

SEQ ID NO: 1235344 - RNA, 19 nt, Mycobacterium leprae
ugugccgcugcauccgcag

SEQ ID NO: 1235345 - RNA, 17 nt, Mycobacterium leprae
ugugccagcgcucgcug

SEQ ID NO: 1235346 - RNA, 20 nt, Mycobacterium leprae
ugucucggugucggacuugu

SEQ ID NO: 1235347 - RNA, 14 nt, Mycobacterium leprae
ugucggcuaaaauc

SEQ ID NO: 1235348 - RNA, 12 nt, Mycobacterium leprae
ugucgucggccg

SEQ ID NO: 1235349 - RNA, 22 nt, Mycobacterium leprae
ugucgauggcgguguuagcaug

SEQ ID NO: 1235350 - RNA, 19 nt, Mycobacterium leprae
ugucgagcggaccauggcg

SEQ ID NO: 1235351 - RNA, 14 nt, Mycobacterium leprae
uguccuacagcagu

SEQ ID NO: 1235352 - RNA, 20 nt, Mycobacterium leprae
uguccuacagcaguguucag

SEQ ID NO: 1235353 - RNA, 23 nt, Mycobacterium leprae
uguccuacagcaguguucaggcc

SEQ ID NO: 1235354 - RNA, 12 nt, Mycobacterium leprae
uguccauggcuu

SEQ ID NO: 1235355 - RNA, 13 nt, Mycobacterium leprae
ugucagguggcuu

SEQ ID NO: 1235356 - RNA, 22 nt, Mycobacterium leprae
ugucagcagcaguuuccaacaa

SEQ ID NO: 1235357 - RNA, 14 nt, Mycobacterium leprae
ugucacccgucgug

SEQ ID NO: 1235358 - RNA, 17 nt, Mycobacterium leprae
ugucaaugguucagcgg

SEQ ID NO: 1235359 - RNA, 18 nt, Mycobacterium leprae
ugggucaccacugaaccu

SEQ ID NO: 1235360 - RNA, 20 nt, Mycobacterium leprae
ugggucgagugguccccugu

SEQ ID NO: 1235361 - RNA, 12 nt, Mycobacterium leprae
uggguagucagc

SEQ ID NO: 1235362 - RNA, 14 nt, Mycobacterium leprae
uggucuacauguug

SEQ ID NO: 1235363 - RNA, 21 nt, Mycobacterium leprae
uggucuacauguugaugaugc

SEQ ID NO: 1235364 - RNA, 22 nt, Mycobacterium leprae
uggugacucuguggacucagca

SEQ ID NO: 1235365 - RNA, 15 nt, Mycobacterium leprae
uggucucacgcuggg

SEQ ID NO: 1235366 - RNA, 16 nt, Mycobacterium leprae
uggugcgccaacacua

SEQ ID NO: 1235367 - RNA, 16 nt, Mycobacterium leprae
uggugccgagcgcauc

SEQ ID NO: 1235368 - RNA, 18 nt, Mycobacterium leprae
ugguuagguuggugguga

SEQ ID NO: 1235369 - RNA, 12 nt, Mycobacterium leprae
ugguucacuaag

SEQ ID NO: 1235370 - RNA, 17 nt, Mycobacterium leprae
ugguguugucgccgaaa

SEQ ID NO: 1235371 - RNA, 22 nt, Mycobacterium leprae
uggugugcguugccugaaaacu

SEQ ID NO: 1235372 - RNA, 22 nt, Mycobacterium leprae
uggugguuauuuuuugcugguu

SEQ ID NO: 1235373 - RNA, 19 nt, Mycobacterium leprae
ugguggcuggcuacgcagc

SEQ ID NO: 1235374 - RNA, 15 nt, Mycobacterium leprae
uguacucgcgauggc

SEQ ID NO: 1235375 - RNA, 16 nt, Mycobacterium leprae
uguaauuacuucgguc

SEQ ID NO: 1235376 - RNA, 20 nt, Mycobacterium leprae
ugguugucuaauucguccug

SEQ ID NO: 1235377 - RNA, 21 nt, Mycobacterium leprae
ugguucugcuucgauguguug

SEQ ID NO: 1235378 - RNA, 16 nt, Mycobacterium leprae
ugguugacagcagaau

SEQ ID NO: 1235379 - RNA, 16 nt, Mycobacterium leprae
ugguucgauucugccc

SEQ ID NO: 1235380 - RNA, 17 nt, Mycobacterium leprae
ugguuugggugguguug

SEQ ID NO: 1235381 - RNA, 20 nt, Mycobacterium leprae
uggcgacaagcagucccaag

SEQ ID NO: 1235382 - RNA, 16 nt, Mycobacterium leprae
uggcccgucgcugcug

SEQ ID NO: 1235383 - RNA, 21 nt, Mycobacterium leprae
uggcccgucgcugcuggauga

SEQ ID NO: 1235384 - RNA, 21 nt, Mycobacterium leprae
uggcccuguuccucgcgggcg

SEQ ID NO: 1235385 - RNA, 21 nt, Mycobacterium leprae
uggcgacgaccuccgcagcau

SEQ ID NO: 1235386 - RNA, 22 nt, Mycobacterium leprae
uggcgacgaccuccgcagcauc

SEQ ID NO: 1235387 - RNA, 14 nt, Mycobacterium leprae
uggcgacgugaucg

SEQ ID NO: 1235388 - RNA, 17 nt, Mycobacterium leprae
uggcuauggguaggccg

SEQ ID NO: 1235389 - RNA, 23 nt, Mycobacterium leprae
uggcgucaucgacaucccagcaa

SEQ ID NO: 1235390 - RNA, 19 nt, Mycobacterium leprae
uggcguuuggugcugcgcu

SEQ ID NO: 1235391 - RNA, 17 nt, Mycobacterium leprae
uggcuaagacgcucaau

SEQ ID NO: 1235392 - RNA, 20 nt, Mycobacterium leprae
uggcguagcggagcggcggc

SEQ ID NO: 1235393 - RNA, 16 nt, Mycobacterium leprae
uggcgguguuagcaug

SEQ ID NO: 1235394 - RNA, 16 nt, Mycobacterium leprae
ugggacauccgcugau

SEQ ID NO: 1235395 - RNA, 12 nt, Mycobacterium leprae
ugggacuggcgg

SEQ ID NO: 1235396 - RNA, 18 nt, Mycobacterium leprae
ugggacuggcgguauucg

SEQ ID NO: 1235397 - RNA, 22 nt, Mycobacterium leprae
ugggaccgggcguuucccuauc

SEQ ID NO: 1235398 - RNA, 20 nt, Mycobacterium leprae
uggcugucccgggggccagc

SEQ ID NO: 1235399 - RNA, 17 nt, Mycobacterium leprae
ugggaacauagccagca

SEQ ID NO: 1235400 - RNA, 15 nt, Mycobacterium leprae
uggcuccccgagccg

SEQ ID NO: 1235401 - RNA, 20 nt, Mycobacterium leprae
uggcuccaaguggcugcuau

SEQ ID NO: 1235402 - RNA, 20 nt, Mycobacterium leprae
uggcugcucaaccaugccgc

SEQ ID NO: 1235403 - RNA, 15 nt, Mycobacterium leprae
uggcugcugcagacc

SEQ ID NO: 1235404 - RNA, 11 nt, Mycobacterium leprae
uggcugcccaa

SEQ ID NO: 1235405 - RNA, 15 nt, Mycobacterium leprae
uggcugauucgaaau

SEQ ID NO: 1235406 - RNA, 19 nt, Mycobacterium leprae
uggcugcaacgacuggaug

SEQ ID NO: 1235407 - RNA, 15 nt, Mycobacterium leprae
ugggguguggguggu

SEQ ID NO: 1235408 - RNA, 22 nt, Mycobacterium leprae
ugggcgacaaugugucaggcug

SEQ ID NO: 1235409 - RNA, 12 nt, Mycobacterium leprae
ugggcucguguu

SEQ ID NO: 1235410 - RNA, 14 nt, Mycobacterium leprae
ugggcagccuggac

SEQ ID NO: 1235411 - RNA, 22 nt, Mycobacterium leprae
ugggcagcuugaacgccgcgag

SEQ ID NO: 1235412 - RNA, 15 nt, Mycobacterium leprae
ugggcagcuaagaag

SEQ ID NO: 1235413 - RNA, 22 nt, Mycobacterium leprae
ugggcagcuaagaagcugcccu

SEQ ID NO: 1235414 - RNA, 20 nt, Mycobacterium leprae
ugggagaucuuuucggcugc

SEQ ID NO: 1235415 - RNA, 15 nt, Mycobacterium leprae
ugggcaguaucaucg

SEQ ID NO: 1235416 - RNA, 22 nt, Mycobacterium leprae
ugggcauuggcgacaaagaaga

SEQ ID NO: 1235417 - RNA, 23 nt, Mycobacterium leprae
ugggccaggucggcuagccgugc

SEQ ID NO: 1235418 - RNA, 15 nt, Mycobacterium leprae
uggaugguuagcaug

SEQ ID NO: 1235419 - RNA, 22 nt, Mycobacterium leprae
uggaugguuagcaugagcacgc

SEQ ID NO: 1235420 - RNA, 15 nt, Mycobacterium leprae
uggcaacgcugccca

SEQ ID NO: 1235421 - RNA, 14 nt, Mycobacterium leprae
uggcacguuggaug

SEQ ID NO: 1235422 - RNA, 16 nt, Mycobacterium leprae
uggcacugggcugcuc

SEQ ID NO: 1235423 - RNA, 23 nt, Mycobacterium leprae
uggcaacggguuaccugaccgaa

SEQ ID NO: 1235424 - RNA, 14 nt, Mycobacterium leprae
uggcagaggcugca

SEQ ID NO: 1235425 - RNA, 20 nt, Mycobacterium leprae
uggcagaggcugcagucagu

SEQ ID NO: 1235426 - RNA, 20 nt, Mycobacterium leprae
uggcagucggcaagaccgag

SEQ ID NO: 1235427 - RNA, 18 nt, Mycobacterium leprae
uggcagucggcucaacca

SEQ ID NO: 1235428 - RNA, 21 nt, Mycobacterium leprae
uggcaucagauauccuaggcc

SEQ ID NO: 1235429 - RNA, 18 nt, Mycobacterium leprae
uggcauggcgcugguugu

SEQ ID NO: 1235430 - RNA, 18 nt, Mycobacterium leprae
uggcaucuuacuggggcg

SEQ ID NO: 1235431 - RNA, 20 nt, Mycobacterium leprae
uggccccggacccgagccgc

SEQ ID NO: 1235432 - RNA, 20 nt, Mycobacterium leprae
uggccauuguugugcugggc

SEQ ID NO: 1235433 - RNA, 18 nt, Mycobacterium leprae
uggccaccguaacucuau

SEQ ID NO: 1235434 - RNA, 16 nt, Mycobacterium leprae
uggaguucgucugaau

SEQ ID NO: 1235435 - RNA, 17 nt, Mycobacterium leprae
uggauauagcaacagca

SEQ ID NO: 1235436 - RNA, 20 nt, Mycobacterium leprae
uggauaccacugacgggugg

SEQ ID NO: 1235437 - RNA, 16 nt, Mycobacterium leprae
uggaucgcacuuggug

SEQ ID NO: 1235438 - RNA, 18 nt, Mycobacterium leprae
uggaucggggauucaauc

SEQ ID NO: 1235439 - RNA, 15 nt, Mycobacterium leprae
uggaucggucagcca

SEQ ID NO: 1235440 - RNA, 15 nt, Mycobacterium leprae
uggaucggugcuaug

SEQ ID NO: 1235441 - RNA, 22 nt, Mycobacterium leprae
uggagcaauuucauuaacaggu

SEQ ID NO: 1235442 - RNA, 15 nt, Mycobacterium leprae
uggaguaaagggugg

SEQ ID NO: 1235443 - RNA, 23 nt, Mycobacterium leprae
uggaguaaaggguggcggugugu

SEQ ID NO: 1235444 - RNA, 21 nt, Mycobacterium leprae
uggagcgaggggauccgacac

SEQ ID NO: 1235445 - RNA, 13 nt, Mycobacterium leprae
uggacucagcaau

SEQ ID NO: 1235446 - RNA, 16 nt, Mycobacterium leprae
uggacucggucugcug

SEQ ID NO: 1235447 - RNA, 22 nt, Mycobacterium leprae
uggagaauguuguuagugcugc

SEQ ID NO: 1235448 - RNA, 21 nt, Mycobacterium leprae
uucgccuuaagagucuagucc

SEQ ID NO: 1235449 - RNA, 15 nt, Mycobacterium leprae
uucgugugcuuugcc

SEQ ID NO: 1235450 - RNA, 17 nt, Mycobacterium leprae
uucgucaaaaaacucau

SEQ ID NO: 1235451 - RNA, 19 nt, Mycobacterium leprae
uucggacggugcaggugcc

SEQ ID NO: 1235452 - RNA, 18 nt, Mycobacterium leprae
uucggagucuugaugcca

SEQ ID NO: 1235453 - RNA, 20 nt, Mycobacterium leprae
uucggaaucgcgugcuauga

SEQ ID NO: 1235454 - RNA, 20 nt, Mycobacterium leprae
uucucggguuuuaucugcaa

SEQ ID NO: 1235455 - RNA, 13 nt, Mycobacterium leprae
uucucggcagcag

SEQ ID NO: 1235456 - RNA, 16 nt, Mycobacterium leprae
uucucgugguggcugg

SEQ ID NO: 1235457 - RNA, 17 nt, Mycobacterium leprae
uucuaggcggugacuga

SEQ ID NO: 1235458 - RNA, 20 nt, Mycobacterium leprae
uucuaggguguugugggugu

SEQ ID NO: 1235459 - RNA, 19 nt, Mycobacterium leprae
uuccaauugcgacccgguu

SEQ ID NO: 1235460 - RNA, 11 nt, Mycobacterium leprae
uuccaggucaa

SEQ ID NO: 1235461 - RNA, 14 nt, Mycobacterium leprae
uucccgacggugaa

SEQ ID NO: 1235462 - RNA, 17 nt, Mycobacterium leprae
uucccgacggugaauca

SEQ ID NO: 1235463 - RNA, 16 nt, Mycobacterium leprae
uuccgcgugugccgcu

SEQ ID NO: 1235464 - RNA, 20 nt, Mycobacterium leprae
uuccgcgcuagacgucuguc

SEQ ID NO: 1235465 - RNA, 18 nt, Mycobacterium leprae
uugauccgagaaaacucg

SEQ ID NO: 1235466 - RNA, 20 nt, Mycobacterium leprae
uugaugcacgcgcgccuggg

SEQ ID NO: 1235467 - RNA, 18 nt, Mycobacterium leprae
uugaugccuauauugcuu

SEQ ID NO: 1235468 - RNA, 22 nt, Mycobacterium leprae
uugaugcaucaagcugugagug

SEQ ID NO: 1235469 - RNA, 23 nt, Mycobacterium leprae
uugcacggcaaagucauguucau

SEQ ID NO: 1235470 - RNA, 16 nt, Mycobacterium leprae
uugccaccaccacccc

SEQ ID NO: 1235471 - RNA, 13 nt, Mycobacterium leprae
uugccaaggucgu

SEQ ID NO: 1235472 - RNA, 13 nt, Mycobacterium leprae
uugcccgcugcca

SEQ ID NO: 1235473 - RNA, 15 nt, Mycobacterium leprae
uugccgaugauuaca

SEQ ID NO: 1235474 - RNA, 19 nt, Mycobacterium leprae
uugccgacgccgugaaucc

SEQ ID NO: 1235475 - RNA, 14 nt, Mycobacterium leprae
uugccgagcaaguu

SEQ ID NO: 1235476 - RNA, 21 nt, Mycobacterium leprae
uugcucuagccgggcuaaguc

SEQ ID NO: 1235477 - RNA, 15 nt, Mycobacterium leprae
uugcucuuguugacc

SEQ ID NO: 1235478 - RNA, 16 nt, Mycobacterium leprae
uugccugaugccauca

SEQ ID NO: 1235479 - RNA, 23 nt, Mycobacterium leprae
uugacaccgccggcgucaggcca

SEQ ID NO: 1235480 - RNA, 16 nt, Mycobacterium leprae
uugaccaccaccgcca

SEQ ID NO: 1235481 - RNA, 17 nt, Mycobacterium leprae
uugaccaccaccgccac

SEQ ID NO: 1235482 - RNA, 18 nt, Mycobacterium leprae
uugaccaccgaaccgggc

SEQ ID NO: 1235483 - RNA, 12 nt, Mycobacterium leprae
uugacacaaaga

SEQ ID NO: 1235484 - RNA, 15 nt, Mycobacterium leprae
uugacacaaagaagu

SEQ ID NO: 1235485 - RNA, 21 nt, Mycobacterium leprae
uugacaacacgaucgcagccc

SEQ ID NO: 1235486 - RNA, 22 nt, Mycobacterium leprae
uugaccucaucccacagauucg

SEQ ID NO: 1235487 - RNA, 17 nt, Mycobacterium leprae
uugaccucuucaggcaa

SEQ ID NO: 1235488 - RNA, 16 nt, Mycobacterium leprae
uugaccgucaugcugc

SEQ ID NO: 1235489 - RNA, 23 nt, Mycobacterium leprae
uugacgcccuccuggcgaguggc

SEQ ID NO: 1235490 - RNA, 23 nt, Mycobacterium leprae
uugacgccucagccacacucgac

SEQ ID NO: 1235491 - RNA, 19 nt, Mycobacterium leprae
uugacguguuuugcugugu

SEQ ID NO: 1235492 - RNA, 16 nt, Mycobacterium leprae
uugaacugcagguugu

SEQ ID NO: 1235493 - RNA, 20 nt, Mycobacterium leprae
uugaacugcagguuguugac

SEQ ID NO: 1235494 - RNA, 21 nt, Mycobacterium leprae
uugaacugcagguuguugacg

SEQ ID NO: 1235495 - RNA, 11 nt, Mycobacterium leprae
uugaacuuggc

SEQ ID NO: 1235496 - RNA, 18 nt, Mycobacterium leprae
uugaacuuggcacaacaa

SEQ ID NO: 1235497 - RNA, 22 nt, Mycobacterium leprae
uucugcccggauugauggaugc

SEQ ID NO: 1235498 - RNA, 20 nt, Mycobacterium leprae
uuaucaagggauuccacugc

SEQ ID NO: 1235499 - RNA, 21 nt, Mycobacterium leprae
uuauauuguccgagcuuuucc

SEQ ID NO: 1235500 - RNA, 18 nt, Mycobacterium leprae
uuaugcagugauuaagua

SEQ ID NO: 1235501 - RNA, 13 nt, Mycobacterium leprae
uuauuaccgauaa

SEQ ID NO: 1235502 - RNA, 14 nt, Mycobacterium leprae
uuaugacuguggcu

SEQ ID NO: 1235503 - RNA, 14 nt, Mycobacterium leprae
uuaucugcaacuca

SEQ ID NO: 1235504 - RNA, 23 nt, Mycobacterium leprae
uuaucgauuucagccagggucac

SEQ ID NO: 1235505 - RNA, 16 nt, Mycobacterium leprae
uuaucgaucuaccugg

SEQ ID NO: 1235506 - RNA, 19 nt, Mycobacterium leprae
uuaucguuacggucuuucg

SEQ ID NO: 1235507 - RNA, 23 nt, Mycobacterium leprae
uucaacgcaucaccggaaagcug

SEQ ID NO: 1235508 - RNA, 12 nt, Mycobacterium leprae
uucaauaagaaa

SEQ ID NO: 1235509 - RNA, 15 nt, Mycobacterium leprae
uucagccacauugcc

SEQ ID NO: 1235510 - RNA, 14 nt, Mycobacterium leprae
uucaggccaucaga

SEQ ID NO: 1235511 - RNA, 22 nt, Mycobacterium leprae
uucacuaacacgauacugcugc

SEQ ID NO: 1235512 - RNA, 23 nt, Mycobacterium leprae
uucacgaacaacagagcaagccg

SEQ ID NO: 1235513 - RNA, 21 nt, Mycobacterium leprae
uucaccucguucaagauacug

SEQ ID NO: 1235514 - RNA, 12 nt, Mycobacterium leprae
uucaauccgcgc

SEQ ID NO: 1235515 - RNA, 22 nt, Mycobacterium leprae
uuagucaaaucgauguuguagg

SEQ ID NO: 1235516 - RNA, 18 nt, Mycobacterium leprae
uuagucuagauaagauaa

SEQ ID NO: 1235517 - RNA, 18 nt, Mycobacterium leprae
uuaggucgaaacuaagcc

SEQ ID NO: 1235518 - RNA, 16 nt, Mycobacterium leprae
uuauacacggugcgug

SEQ ID NO: 1235519 - RNA, 22 nt, Mycobacterium leprae
uuauacugcugcgauuccagca

SEQ ID NO: 1235520 - RNA, 13 nt, Mycobacterium leprae
uuacucaaugcug

SEQ ID NO: 1235521 - RNA, 22 nt, Mycobacterium leprae
uuacuauuccggucgucaagcu

SEQ ID NO: 1235522 - RNA, 17 nt, Mycobacterium leprae
uuaccgcauguauuacu

SEQ ID NO: 1235523 - RNA, 19 nt, Mycobacterium leprae
uuacugagcuuguauugcu

SEQ ID NO: 1235524 - RNA, 14 nt, Mycobacterium leprae
uuacuuuauauacu

SEQ ID NO: 1235525 - RNA, 15 nt, Mycobacterium leprae
uuagaggcugcaccg

SEQ ID NO: 1235526 - RNA, 12 nt, Mycobacterium leprae
uuagagugcagc

SEQ ID NO: 1235527 - RNA, 14 nt, Mycobacterium leprae
uuagagauacucga

SEQ ID NO: 1235528 - RNA, 20 nt, Mycobacterium leprae
uuaccaagccggugccaggc

SEQ ID NO: 1235529 - RNA, 20 nt, Mycobacterium leprae
uuacaaugguguacuccugu

SEQ ID NO: 1235530 - RNA, 14 nt, Mycobacterium leprae
uuacaaugugucaa

SEQ ID NO: 1235531 - RNA, 19 nt, Mycobacterium leprae
uuaagacacaguuguuggc

SEQ ID NO: 1235532 - RNA, 21 nt, Mycobacterium leprae
ugugccgcugaccagucuucc

SEQ ID NO: 1235533 - RNA, 22 nt, Mycobacterium leprae
uuaauagaccagcgugugaugu

SEQ ID NO: 1235534 - RNA, 17 nt, Mycobacterium leprae
uuaaucguuucagguga

SEQ ID NO: 1235535 - RNA, 23 nt, Mycobacterium leprae
uuaaucgacucgagcaaugcuga

SEQ ID NO: 1235536 - RNA, 15 nt, Mycobacterium leprae
uuuacuguguuguug

SEQ ID NO: 1235537 - RNA, 13 nt, Mycobacterium leprae
uuuaacgccugcu

SEQ ID NO: 1235538 - RNA, 20 nt, Mycobacterium leprae
uuuccaacaaacuacuguug

SEQ ID NO: 1235539 - RNA, 20 nt, Mycobacterium leprae
uuucagcucgauggugccau

SEQ ID NO: 1235540 - RNA, 21 nt, Mycobacterium leprae
uuucagcucgauggugccauu

SEQ ID NO: 1235541 - RNA, 20 nt, Mycobacterium leprae
uuucaaguucucaacaccca

SEQ ID NO: 1235542 - RNA, 17 nt, Mycobacterium leprae
uuucaccaaacuggacu

SEQ ID NO: 1235543 - RNA, 20 nt, Mycobacterium leprae
uuugacgaaaauguuuuguu

SEQ ID NO: 1235544 - RNA, 15 nt, Mycobacterium leprae
uuugcucacguucau

SEQ ID NO: 1235545 - RNA, 18 nt, Mycobacterium leprae
uuugccaugcacgccggc

SEQ ID NO: 1235546 - RNA, 16 nt, Mycobacterium leprae
uuugcaggugcuuucu

SEQ ID NO: 1235547 - RNA, 22 nt, Mycobacterium leprae
uuugccaaucuaucaagccaca

SEQ ID NO: 1235548 - RNA, 23 nt, Mycobacterium leprae
uuugauccagccgaacaaacccc

SEQ ID NO: 1235549 - RNA, 13 nt, Mycobacterium leprae
uuucucuaaaaga

SEQ ID NO: 1235550 - RNA, 22 nt, Mycobacterium leprae
uuucucggugucaucuaucucc

SEQ ID NO: 1235551 - RNA, 20 nt, Mycobacterium leprae
uuucucgguugugaaccacu

SEQ ID NO: 1235552 - RNA, 13 nt, Mycobacterium leprae
uuucugcuaucca

SEQ ID NO: 1235553 - RNA, 22 nt, Mycobacterium leprae
uuucgagcaguaguccucugcg

SEQ ID NO: 1235554 - RNA, 21 nt, Mycobacterium leprae
uuucgacaaggucgagugcga

SEQ ID NO: 1235555 - RNA, 12 nt, Mycobacterium leprae
uuuccuaaaauu

SEQ ID NO: 1235556 - RNA, 23 nt, Mycobacterium leprae
uuuccgcggcauauguaggugcu

SEQ ID NO: 1235557 - RNA, 19 nt, Mycobacterium leprae
uuuccgcuaccauccauuu

SEQ ID NO: 1235558 - RNA, 23 nt, Mycobacterium leprae
uuuccaugaugguuuggcugcca

SEQ ID NO: 1235559 - RNA, 15 nt, Mycobacterium leprae
uuuugcuagauaucu

SEQ ID NO: 1235560 - RNA, 19 nt, Mycobacterium leprae
uuuuggaccccaaccagac

SEQ ID NO: 1235561 - RNA, 13 nt, Mycobacterium leprae
uuuugcguuuuau

SEQ ID NO: 1235562 - RNA, 23 nt, Mycobacterium leprae
uuuuggugucuugucagguaucu

SEQ ID NO: 1235563 - RNA, 19 nt, Mycobacterium leprae
aaauguuuuguuuauguuc

SEQ ID NO: 1235564 - RNA, 22 nt, Mycobacterium leprae
aaauuacguuuaccgauucggu

SEQ ID NO: 1235565 - RNA, 15 nt, Mycobacterium leprae
aaauuagggauugac

SEQ ID NO: 1235566 - RNA, 18 nt, Mycobacterium leprae
aaauuccuacccucucag

SEQ ID NO: 1235567 - RNA, 23 nt, Mycobacterium leprae
aaauuccuacccucucagcaauc

SEQ ID NO: 1235568 - RNA, 14 nt, Mycobacterium leprae
uuuuagagaagaau

SEQ ID NO: 1235569 - RNA, 23 nt, Mycobacterium leprae
uuuuagagaagaauuaauauaua

SEQ ID NO: 1235570 - RNA, 18 nt, Mycobacterium leprae
uuuggccuccaaguauac

SEQ ID NO: 1235571 - RNA, 16 nt, Mycobacterium leprae
uuuggcauacucucuc

SEQ ID NO: 1235572 - RNA, 17 nt, Mycobacterium leprae
uuuggcguaguguagcu

SEQ ID NO: 1235573 - RNA, 21 nt, Mycobacterium leprae
uuugcuucacuuagccauguc

SEQ ID NO: 1235574 - RNA, 13 nt, Mycobacterium leprae
uuugcuggucagg

SEQ ID NO: 1235575 - RNA, 14 nt, Mycobacterium leprae
uuuguccugacaga

SEQ ID NO: 1235576 - RNA, 13 nt, Mycobacterium leprae
uuugucagauaac

SEQ ID NO: 1235577 - RNA, 16 nt, Mycobacterium leprae
uuugugggcaggucag

SEQ ID NO: 1235578 - RNA, 10 nt, Mycobacterium leprae
uuuguuugga

SEQ ID NO: 1235579 - RNA, 22 nt, Mycobacterium leprae
aagauugacaaaagugcaguga

SEQ ID NO: 1235580 - RNA, 22 nt, Mycobacterium leprae
aagauugcagcccugagcacca

SEQ ID NO: 1235581 - RNA, 14 nt, Mycobacterium leprae
aagauugcggacaa

SEQ ID NO: 1235582 - RNA, 17 nt, Mycobacterium leprae
aagaugacaccgaacag

SEQ ID NO: 1235583 - RNA, 20 nt, Mycobacterium leprae
aagaucauguuccgcugaua

SEQ ID NO: 1235584 - RNA, 15 nt, Mycobacterium leprae
aagauaaucgcccug

SEQ ID NO: 1235585 - RNA, 17 nt, Mycobacterium leprae
aagauacuggauucauu

SEQ ID NO: 1235586 - RNA, 19 nt, Mycobacterium leprae
aagcagaauuggagugaag

SEQ ID NO: 1235587 - RNA, 22 nt, Mycobacterium leprae
aagcagugucugggccgggcug

SEQ ID NO: 1235588 - RNA, 21 nt, Mycobacterium leprae
aagcaucuuaacgccaguugc

SEQ ID NO: 1235589 - RNA, 22 nt, Mycobacterium leprae
aagcaucuuaacgccaguugca

SEQ ID NO: 1235590 - RNA, 19 nt, Mycobacterium leprae
aagcauaugggacaacucg

SEQ ID NO: 1235591 - RNA, 18 nt, Mycobacterium leprae
aagcacgaugacauaccg

SEQ ID NO: 1235592 - RNA, 12 nt, Mycobacterium leprae
aagcacugcacg

SEQ ID NO: 1235593 - RNA, 16 nt, Mycobacterium leprae
aagaggccgacagaac

SEQ ID NO: 1235594 - RNA, 23 nt, Mycobacterium leprae
aagagcggcacgauaggcagugc

SEQ ID NO: 1235595 - RNA, 15 nt, Mycobacterium leprae
aagagcccggccccc

SEQ ID NO: 1235596 - RNA, 15 nt, Mycobacterium leprae
aagagcuggucguuu

SEQ ID NO: 1235597 - RNA, 17 nt, Mycobacterium leprae
aagacucaccaagauug

SEQ ID NO: 1235598 - RNA, 19 nt, Mycobacterium leprae
aagagaaguagagaaaaau

SEQ ID NO: 1235599 - RNA, 13 nt, Mycobacterium leprae
aagacacgacagc

SEQ ID NO: 1235600 - RNA, 18 nt, Mycobacterium leprae
aagaccgaguugggccau

SEQ ID NO: 1235601 - RNA, 19 nt, Mycobacterium leprae
aagaaucaugaagaucgag

SEQ ID NO: 1235602 - RNA, 19 nt, Mycobacterium leprae
aagaaucuugaaauucaau

SEQ ID NO: 1235603 - RNA, 16 nt, Mycobacterium leprae
aagucagcaucagaca

SEQ ID NO: 1235604 - RNA, 16 nt, Mycobacterium leprae
aagucagccaaaacuc

SEQ ID NO: 1235605 - RNA, 14 nt, Mycobacterium leprae
aagucggugcuggc

SEQ ID NO: 1235606 - RNA, 14 nt, Mycobacterium leprae
aagucaagaugauc

SEQ ID NO: 1235607 - RNA, 23 nt, Mycobacterium leprae
aaguaacgucgaacccucacuca

SEQ ID NO: 1235608 - RNA, 14 nt, Mycobacterium leprae
aagugaugucuuug

SEQ ID NO: 1235609 - RNA, 18 nt, Mycobacterium leprae
aagugcaccaucugcucu

SEQ ID NO: 1235610 - RNA, 24 nt, Mycobacterium leprae
aagugggguacuucaucaacugag

SEQ ID NO: 1235611 - RNA, 24 nt, Mycobacterium leprae
aaguggaauaacagagugcaccac

SEQ ID NO: 1235612 - RNA, 19 nt, Mycobacterium leprae
aaguuguaagugcaguucc

SEQ ID NO: 1235613 - RNA, 14 nt, Mycobacterium leprae
aaguuuucucuaaa

SEQ ID NO: 1235614 - RNA, 19 nt, Mycobacterium leprae
aauaaaccggcagacgugc

SEQ ID NO: 1235615 - RNA, 20 nt, Mycobacterium leprae
aauaaaccggcagacgugcu

SEQ ID NO: 1235616 - RNA, 14 nt, Mycobacterium leprae
aaggccaagcggaa

SEQ ID NO: 1235617 - RNA, 22 nt, Mycobacterium leprae
aaggccgugucgguaggcuguu

SEQ ID NO: 1235618 - RNA, 18 nt, Mycobacterium leprae
aaggcucccaaggaccgg

SEQ ID NO: 1235619 - RNA, 17 nt, Mycobacterium leprae
aaggucguguugccacc

SEQ ID NO: 1235620 - RNA, 20 nt, Mycobacterium leprae
aagguuucugagucggauuu

SEQ ID NO: 1235621 - RNA, 19 nt, Mycobacterium leprae
aaggugggcgaucaggagg

SEQ ID NO: 1235622 - RNA, 14 nt, Mycobacterium leprae
aagguguugcggug

SEQ ID NO: 1235623 - RNA, 19 nt, Mycobacterium leprae
aaggugcguugugcgguga

SEQ ID NO: 1235624 - RNA, 15 nt, Mycobacterium leprae
aagcugugagugugc

SEQ ID NO: 1235625 - RNA, 13 nt, Mycobacterium leprae
aagcugcccggcg

SEQ ID NO: 1235626 - RNA, 22 nt, Mycobacterium leprae
aagcuguuacgaggacucccuu

SEQ ID NO: 1235627 - RNA, 23 nt, Mycobacterium leprae
aaggagccgaggcacaacaucac

SEQ ID NO: 1235628 - RNA, 19 nt, Mycobacterium leprae
aaggaguucaacaaaacca

SEQ ID NO: 1235629 - RNA, 20 nt, Mycobacterium leprae
aaggaguucaacaaaaccau

SEQ ID NO: 1235630 - RNA, 17 nt, Mycobacterium leprae
aaggaagaugacaccga

SEQ ID NO: 1235631 - RNA, 21 nt, Mycobacterium leprae
aagcucgcccuaguaggaaaa

SEQ ID NO: 1235632 - RNA, 17 nt, Mycobacterium leprae
aaugucaauaacguuug

SEQ ID NO: 1235633 - RNA, 17 nt, Mycobacterium leprae
aauguccaccagccgca

SEQ ID NO: 1235634 - RNA, 17 nt, Mycobacterium leprae
aaugcucugcugaucag

SEQ ID NO: 1235635 - RNA, 14 nt, Mycobacterium leprae
aauggcagccacca

SEQ ID NO: 1235636 - RNA, 20 nt, Mycobacterium leprae
aauggcacugauacugaugu

SEQ ID NO: 1235637 - RNA, 19 nt, Mycobacterium leprae
aaugcucgaccagguugug

SEQ ID NO: 1235638 - RNA, 14 nt, Mycobacterium leprae
aaucgagaauuuac

SEQ ID NO: 1235639 - RNA, 17 nt, Mycobacterium leprae
aaucgacguuugcaggu

SEQ ID NO: 1235640 - RNA, 13 nt, Mycobacterium leprae
aauaguauuauug

SEQ ID NO: 1235641 - RNA, 21 nt, Mycobacterium leprae
aauagaccgaguccccguguu

SEQ ID NO: 1235642 - RNA, 16 nt, Mycobacterium leprae
aauaucaaugagauaa

SEQ ID NO: 1235643 - RNA, 15 nt, Mycobacterium leprae
aauaucgagcuaaac

SEQ ID NO: 1235644 - RNA, 21 nt, Mycobacterium leprae
aauaucgcuacccuugagcac

SEQ ID NO: 1235645 - RNA, 23 nt, Mycobacterium leprae
aauaucgcuacccuugagcaccc

SEQ ID NO: 1235646 - RNA, 14 nt, Mycobacterium leprae
aaucaaccaggcaa

SEQ ID NO: 1235647 - RNA, 21 nt, Mycobacterium leprae
aaucagcaucgacagcaccca

SEQ ID NO: 1235648 - RNA, 22 nt, Mycobacterium leprae
aaucagcaucgacagcacccag

SEQ ID NO: 1235649 - RNA, 18 nt, Mycobacterium leprae
aaucagucgggccaggcc

SEQ ID NO: 1235650 - RNA, 19 nt, Mycobacterium leprae
accgauugccugaugccau

SEQ ID NO: 1235651 - RNA, 22 nt, Mycobacterium leprae
accgauauggcgaucaugagca

SEQ ID NO: 1235652 - RNA, 14 nt, Mycobacterium leprae
accgcaucaccgau

SEQ ID NO: 1235653 - RNA, 16 nt, Mycobacterium leprae
accgccgagcgcacca

SEQ ID NO: 1235654 - RNA, 17 nt, Mycobacterium leprae
accgcccgguagcacca

SEQ ID NO: 1235655 - RNA, 17 nt, Mycobacterium leprae
accgcggugcagugccg

SEQ ID NO: 1235656 - RNA, 16 nt, Mycobacterium leprae
accgcgacgccaggcg

SEQ ID NO: 1235657 - RNA, 19 nt, Mycobacterium leprae
accgccggcaagcccgguu

SEQ ID NO: 1235658 - RNA, 18 nt, Mycobacterium leprae
accgaaaaccacaagcag

SEQ ID NO: 1235659 - RNA, 17 nt, Mycobacterium leprae
accgaaagccgcaccag

SEQ ID NO: 1235660 - RNA, 20 nt, Mycobacterium leprae
accgagccggucgaucgcag

SEQ ID NO: 1235661 - RNA, 23 nt, Mycobacterium leprae
accgagaucuuaaucgagccacu

SEQ ID NO: 1235662 - RNA, 22 nt, Mycobacterium leprae
accgaggaaugccuggguggug

SEQ ID NO: 1235663 - RNA, 22 nt, Mycobacterium leprae
accgacagguugaaaaagaaag

SEQ ID NO: 1235664 - RNA, 13 nt, Mycobacterium leprae
accgaccagagcu

SEQ ID NO: 1235665 - RNA, 12 nt, Mycobacterium leprae
accgaccucuug

SEQ ID NO: 1235666 - RNA, 14 nt, Mycobacterium leprae
accgacgagcaacc

SEQ ID NO: 1235667 - RNA, 21 nt, Mycobacterium leprae
acccuggaauccgcgcagggc

SEQ ID NO: 1235668 - RNA, 23 nt, Mycobacterium leprae
acccugcgcugagagugccaccg

SEQ ID NO: 1235669 - RNA, 15 nt, Mycobacterium leprae
acccuccugcagguu

SEQ ID NO: 1235670 - RNA, 15 nt, Mycobacterium leprae
acccucacccgaccg

SEQ ID NO: 1235671 - RNA, 14 nt, Mycobacterium leprae
acccguugagcugc

SEQ ID NO: 1235672 - RNA, 22 nt, Mycobacterium leprae
acccguugucaagcacugcagu

SEQ ID NO: 1235673 - RNA, 20 nt, Mycobacterium leprae
acccggaaggugucugcgaa

SEQ ID NO: 1235674 - RNA, 15 nt, Mycobacterium leprae
acccgcuugucuuug

SEQ ID NO: 1235675 - RNA, 22 nt, Mycobacterium leprae
acccggcagaggcaccuggaau

SEQ ID NO: 1235676 - RNA, 17 nt, Mycobacterium leprae
acccgcgcgugcacaag

SEQ ID NO: 1235677 - RNA, 18 nt, Mycobacterium leprae
acccgcgccgccugcugc

SEQ ID NO: 1235678 - RNA, 17 nt, Mycobacterium leprae
acccgucccgcagcgca

SEQ ID NO: 1235679 - RNA, 14 nt, Mycobacterium leprae
acccgggagucgac

SEQ ID NO: 1235680 - RNA, 17 nt, Mycobacterium leprae
acccggcggcaugccug

SEQ ID NO: 1235681 - RNA, 22 nt, Mycobacterium leprae
acccgaggcgcuaggacaacag

SEQ ID NO: 1235682 - RNA, 23 nt, Mycobacterium leprae
acccgaggcgcuaggacaacaga

SEQ ID NO: 1235683 - RNA, 16 nt, Mycobacterium leprae
acccgcaugcccuggg

SEQ ID NO: 1235684 - RNA, 23 nt, Mycobacterium leprae
acccgccagggcggcauucccaa

SEQ ID NO: 1235685 - RNA, 22 nt, Mycobacterium leprae
acccacggcugucagagugcag

SEQ ID NO: 1235686 - RNA, 23 nt, Mycobacterium leprae
acccacggcugucagagugcaga

SEQ ID NO: 1235687 - RNA, 23 nt, Mycobacterium leprae
accauggucuuaccgugcgcugc

SEQ ID NO: 1235688 - RNA, 13 nt, Mycobacterium leprae
accaugccaccug

SEQ ID NO: 1235689 - RNA, 13 nt, Mycobacterium leprae
accaucugcucuc

SEQ ID NO: 1235690 - RNA, 24 nt, Mycobacterium leprae
accaucugcucucagcacaucagu

SEQ ID NO: 1235691 - RNA, 18 nt, Mycobacterium leprae
accaucuaacccgcaaac

SEQ ID NO: 1235692 - RNA, 18 nt, Mycobacterium leprae
accaugagcacacgcugc

SEQ ID NO: 1235693 - RNA, 16 nt, Mycobacterium leprae
accaugccgcgcgccu

SEQ ID NO: 1235694 - RNA, 16 nt, Mycobacterium leprae
accaucccaaaaccac

SEQ ID NO: 1235695 - RNA, 16 nt, Mycobacterium leprae
accacgcacacgacag

SEQ ID NO: 1235696 - RNA, 13 nt, Mycobacterium leprae
accacccacaacg

SEQ ID NO: 1235697 - RNA, 14 nt, Mycobacterium leprae
accacccacaacgc

SEQ ID NO: 1235698 - RNA, 23 nt, Mycobacterium leprae
accagcucggcaucggccucacc

SEQ ID NO: 1235699 - RNA, 19 nt, Mycobacterium leprae
accagcgugcaaauggcac

SEQ ID NO: 1235700 - RNA, 14 nt, Mycobacterium leprae
accagcaagggugg

SEQ ID NO: 1235701 - RNA, 13 nt, Mycobacterium leprae
accagcagaucaa

SEQ ID NO: 1235702 - RNA, 21 nt, Mycobacterium leprae
accaagccaauuauuccaauc

SEQ ID NO: 1235703 - RNA, 17 nt, Mycobacterium leprae
accacacccuggcuggg

SEQ ID NO: 1235704 - RNA, 23 nt, Mycobacterium leprae
acauuuuagcuuauacugcugcg

SEQ ID NO: 1235705 - RNA, 15 nt, Mycobacterium leprae
acauuguucugccau

SEQ ID NO: 1235706 - RNA, 16 nt, Mycobacterium leprae
acauuguucugccaug

SEQ ID NO: 1235707 - RNA, 16 nt, Mycobacterium leprae
accaaaucgacuacau

SEQ ID NO: 1235708 - RNA, 22 nt, Mycobacterium leprae
accaaaauuuaugguagucagu

SEQ ID NO: 1235709 - RNA, 13 nt, Mycobacterium leprae
accaaacaacaac

SEQ ID NO: 1235710 - RNA, 22 nt, Mycobacterium leprae
acauugaccacgccgacaccuc

SEQ ID NO: 1235711 - RNA, 20 nt, Mycobacterium leprae
acaucguggaccaagcaucc

SEQ ID NO: 1235712 - RNA, 13 nt, Mycobacterium leprae
acaucgucggccc

SEQ ID NO: 1235713 - RNA, 20 nt, Mycobacterium leprae
acauauccaguguaguguca

SEQ ID NO: 1235714 - RNA, 19 nt, Mycobacterium leprae
acaucaugaaaucccgcua

SEQ ID NO: 1235715 - RNA, 16 nt, Mycobacterium leprae
acauagucauugccua

SEQ ID NO: 1235716 - RNA, 22 nt, Mycobacterium leprae
acagaccucccugacgcacacc

SEQ ID NO: 1235717 - RNA, 19 nt, Mycobacterium leprae
acagcauccucggcacagu

SEQ ID NO: 1235718 - RNA, 19 nt, Mycobacterium leprae
acagcaagucgccuacacc

SEQ ID NO: 1235719 - RNA, 21 nt, Mycobacterium leprae
acagcaagacgggggaugcuu

SEQ ID NO: 1235720 - RNA, 22 nt, Mycobacterium leprae
acacguggguaaucugcccugc

SEQ ID NO: 1235721 - RNA, 21 nt, Mycobacterium leprae
acacgugcaucgagaacugca

SEQ ID NO: 1235722 - RNA, 14 nt, Mycobacterium leprae
acacuaaacugcgu

SEQ ID NO: 1235723 - RNA, 20 nt, Mycobacterium leprae
acacuaacaccgugccgaug

SEQ ID NO: 1235724 - RNA, 21 nt, Mycobacterium leprae
acacgucacacuaaacugcgu

SEQ ID NO: 1235725 - RNA, 22 nt, Mycobacterium leprae
acacuagggaggucaccaaguu

SEQ ID NO: 1235726 - RNA, 13 nt, Mycobacterium leprae
acacuaagccccg

SEQ ID NO: 1235727 - RNA, 19 nt, Mycobacterium leprae
acaccaccaguggcucgcc

SEQ ID NO: 1235728 - RNA, 19 nt, Mycobacterium leprae
acaccacuucuugugcacc

SEQ ID NO: 1235729 - RNA, 12 nt, Mycobacterium leprae
acaccacugcca

SEQ ID NO: 1235730 - RNA, 23 nt, Mycobacterium leprae
acaccagcgacuggcuguaguga

SEQ ID NO: 1235731 - RNA, 14 nt, Mycobacterium leprae
acaccagagacacc

SEQ ID NO: 1235732 - RNA, 22 nt, Mycobacterium leprae
acacccaagugacugcguuuca

SEQ ID NO: 1235733 - RNA, 19 nt, Mycobacterium leprae
acacccgguagcgccgagc

SEQ ID NO: 1235734 - RNA, 14 nt, Mycobacterium leprae
acaccccgcggagu

SEQ ID NO: 1235735 - RNA, 23 nt, Mycobacterium leprae
acaccgaacagcucgacagcagg

SEQ ID NO: 1235736 - RNA, 19 nt, Mycobacterium leprae
acaccgcccgguaucccaa

SEQ ID NO: 1235737 - RNA, 22 nt, Mycobacterium leprae
acaccgcacaguuccagugccu

SEQ ID NO: 1235738 - RNA, 10 nt, Mycobacterium leprae
acaccgccgg

SEQ ID NO: 1235739 - RNA, 17 nt, Mycobacterium leprae
acacgaaauacaaugca

SEQ ID NO: 1235740 - RNA, 15 nt, Mycobacterium leprae
acacgauacugcugc

SEQ ID NO: 1235741 - RNA, 21 nt, Mycobacterium leprae
acacgcaagagaaaaccaagc

SEQ ID NO: 1235742 - RNA, 15 nt, Mycobacterium leprae
acaccucaccaucuu

SEQ ID NO: 1235743 - RNA, 15 nt, Mycobacterium leprae
acaauauaaugccgg

SEQ ID NO: 1235744 - RNA, 17 nt, Mycobacterium leprae
acaaucgagcacggcac

SEQ ID NO: 1235745 - RNA, 20 nt, Mycobacterium leprae
acaauacgcgccuguuuuug

SEQ ID NO: 1235746 - RNA, 21 nt, Mycobacterium leprae
acaaggagccaacgauacuga

SEQ ID NO: 1235747 - RNA, 19 nt, Mycobacterium leprae
acaaggguuagcagaaaca

SEQ ID NO: 1235748 - RNA, 23 nt, Mycobacterium leprae
acaaguagguuguucgacaagcu

SEQ ID NO: 1235749 - RNA, 14 nt, Mycobacterium leprae
acaagucaaaacca

SEQ ID NO: 1235750 - RNA, 19 nt, Mycobacterium leprae
acaauggagaacgcugaaa

SEQ ID NO: 1235751 - RNA, 18 nt, Mycobacterium leprae
acaaugggugugacacca

SEQ ID NO: 1235752 - RNA, 10 nt, Mycobacterium leprae
acaauguuuc

SEQ ID NO: 1235753 - RNA, 14 nt, Mycobacterium leprae
acaaugugucaggc

SEQ ID NO: 1235754 - RNA, 16 nt, Mycobacterium leprae
acaauucggugcgagu

SEQ ID NO: 1235755 - RNA, 21 nt, Mycobacterium leprae
acacaaagaaguaaagcccug

SEQ ID NO: 1235756 - RNA, 17 nt, Mycobacterium leprae
aauuuccguaccagaug

SEQ ID NO: 1235757 - RNA, 14 nt, Mycobacterium leprae
aauuauaaaguuau

SEQ ID NO: 1235758 - RNA, 12 nt, Mycobacterium leprae
aauuugaagcug

SEQ ID NO: 1235759 - RNA, 12 nt, Mycobacterium leprae
acaaaauuugca

SEQ ID NO: 1235760 - RNA, 22 nt, Mycobacterium leprae
acaaaauuugcacgauuggcuu

SEQ ID NO: 1235761 - RNA, 23 nt, Mycobacterium leprae
acaaccuuccgcaaaguuaugca

SEQ ID NO: 1235762 - RNA, 19 nt, Mycobacterium leprae
acaacgccaaccuaagccu

SEQ ID NO: 1235763 - RNA, 17 nt, Mycobacterium leprae
acaaccgcgauguuuug

SEQ ID NO: 1235764 - RNA, 15 nt, Mycobacterium leprae
acaacguugcugcug

SEQ ID NO: 1235765 - RNA, 20 nt, Mycobacterium leprae
acaacgggaucgacaaaauu

SEQ ID NO: 1235766 - RNA, 15 nt, Mycobacterium leprae
acaacggugagcggc

SEQ ID NO: 1235767 - RNA, 17 nt, Mycobacterium leprae
acaagacuucacucacu

SEQ ID NO: 1235768 - RNA, 21 nt, Mycobacterium leprae
acaagccgagggucaaaaugu

SEQ ID NO: 1235769 - RNA, 15 nt, Mycobacterium leprae
acaaagaaguaaagc

SEQ ID NO: 1235770 - RNA, 12 nt, Mycobacterium leprae
acaaagaagaau

SEQ ID NO: 1235771 - RNA, 15 nt, Mycobacterium leprae
acaaagcccacgccu

SEQ ID NO: 1235772 - RNA, 12 nt, Mycobacterium leprae
acaaagcagcau

SEQ ID NO: 1235773 - RNA, 21 nt, Mycobacterium leprae
acaaagcagcauauggaaagu

SEQ ID NO: 1235774 - RNA, 12 nt, Mycobacterium leprae
acaacaccacuu

SEQ ID NO: 1235775 - RNA, 14 nt, Mycobacterium leprae
acaacaccagauca

SEQ ID NO: 1235776 - RNA, 13 nt, Mycobacterium leprae
acaacaagagaag

SEQ ID NO: 1235777 - RNA, 19 nt, Mycobacterium leprae
acaacaagagaagagcugg

SEQ ID NO: 1235778 - RNA, 22 nt, Mycobacterium leprae
acaaaucauagugaccaaaauu

SEQ ID NO: 1235779 - RNA, 18 nt, Mycobacterium leprae
acucuccccacugcagga

SEQ ID NO: 1235780 - RNA, 20 nt, Mycobacterium leprae
acucgguuggcuagcgugcu

SEQ ID NO: 1235781 - RNA, 21 nt, Mycobacterium leprae
acucguuucucauucucugcc

SEQ ID NO: 1235782 - RNA, 23 nt, Mycobacterium leprae
acucguuucucauucucugccuu

SEQ ID NO: 1235783 - RNA, 12 nt, Mycobacterium leprae
acucucaucgcg

SEQ ID NO: 1235784 - RNA, 21 nt, Mycobacterium leprae
acucucaucgcggcugccacu

SEQ ID NO: 1235785 - RNA, 15 nt, Mycobacterium leprae
acucccuucgccggu

SEQ ID NO: 1235786 - RNA, 15 nt, Mycobacterium leprae
acucgcgacgauacu

SEQ ID NO: 1235787 - RNA, 23 nt, Mycobacterium leprae
acucaccgcggcguuauccacgc

SEQ ID NO: 1235788 - RNA, 20 nt, Mycobacterium leprae
acucaauugcagcgcgaaca

SEQ ID NO: 1235789 - RNA, 23 nt, Mycobacterium leprae
acucaucgccaaccgucgggauc

SEQ ID NO: 1235790 - RNA, 21 nt, Mycobacterium leprae
acucaucaaaaaacagcguga

SEQ ID NO: 1235791 - RNA, 16 nt, Mycobacterium leprae
acucaugaucgcaggc

SEQ ID NO: 1235792 - RNA, 16 nt, Mycobacterium leprae
acuccacccaaggauu

SEQ ID NO: 1235793 - RNA, 15 nt, Mycobacterium leprae
acuacuggauuaaua

SEQ ID NO: 1235794 - RNA, 19 nt, Mycobacterium leprae
acuacuggauuaauauuua

SEQ ID NO: 1235795 - RNA, 21 nt, Mycobacterium leprae
acuaggccccagauagcccga

SEQ ID NO: 1235796 - RNA, 16 nt, Mycobacterium leprae
acuauauauauauuaa

SEQ ID NO: 1235797 - RNA, 14 nt, Mycobacterium leprae
acuaacaccgugcc

SEQ ID NO: 1235798 - RNA, 11 nt, Mycobacterium leprae
acuaaaugcca

SEQ ID NO: 1235799 - RNA, 17 nt, Mycobacterium leprae
acguucgaucggcagcc

SEQ ID NO: 1235800 - RNA, 18 nt, Mycobacterium leprae
acgucacgcugcucgagc

SEQ ID NO: 1235801 - RNA, 16 nt, Mycobacterium leprae
acgucagaagcuggug

SEQ ID NO: 1235802 - RNA, 20 nt, Mycobacterium leprae
acguaguccaugaauuacua

SEQ ID NO: 1235803 - RNA, 23 nt, Mycobacterium leprae
acguaguccaugaauuacuaccc

SEQ ID NO: 1235804 - RNA, 16 nt, Mycobacterium leprae
acgggaucgacaaaau

SEQ ID NO: 1235805 - RNA, 17 nt, Mycobacterium leprae
acgggaggaacuccgug

SEQ ID NO: 1235806 - RNA, 21 nt, Mycobacterium leprae
acgggaagugguggcacuuuu

SEQ ID NO: 1235807 - RNA, 17 nt, Mycobacterium leprae
acgucuuuauuagcaug

SEQ ID NO: 1235808 - RNA, 19 nt, Mycobacterium leprae
acgucuuuauuagcaugug

SEQ ID NO: 1235809 - RNA, 19 nt, Mycobacterium leprae
acgugacguacgggugaag

SEQ ID NO: 1235810 - RNA, 17 nt, Mycobacterium leprae
acgugaucgacgaggug

SEQ ID NO: 1235811 - RNA, 14 nt, Mycobacterium leprae
acgugaugcagcau

SEQ ID NO: 1235812 - RNA, 16 nt, Mycobacterium leprae
acgugcaaacugcugc

SEQ ID NO: 1235813 - RNA, 14 nt, Mycobacterium leprae
acguggacuucugc

SEQ ID NO: 1235814 - RNA, 20 nt, Mycobacterium leprae
acgugucugucggcuaaaau

SEQ ID NO: 1235815 - RNA, 16 nt, Mycobacterium leprae
acguguuuaggaaaca

SEQ ID NO: 1235816 - RNA, 15 nt, Mycobacterium leprae
acguuaaacaaccug

SEQ ID NO: 1235817 - RNA, 23 nt, Mycobacterium leprae
acguuccggccuucgucagcugg

SEQ ID NO: 1235818 - RNA, 18 nt, Mycobacterium leprae
acgcgccggcuacuggac

SEQ ID NO: 1235819 - RNA, 20 nt, Mycobacterium leprae
acgcgaucuaccccggcauu

SEQ ID NO: 1235820 - RNA, 13 nt, Mycobacterium leprae
acgcgaugcgcac

SEQ ID NO: 1235821 - RNA, 22 nt, Mycobacterium leprae
acgcucgaggaagcgcagcucg

SEQ ID NO: 1235822 - RNA, 21 nt, Mycobacterium leprae
acgcuagaaacaggcauauaa

SEQ ID NO: 1235823 - RNA, 20 nt, Mycobacterium leprae
acgcuauguuggccagcagc

SEQ ID NO: 1235824 - RNA, 19 nt, Mycobacterium leprae
acgcgugcggcgcccaccu

SEQ ID NO: 1235825 - RNA, 19 nt, Mycobacterium leprae
acgcguugauggccgagga

SEQ ID NO: 1235826 - RNA, 16 nt, Mycobacterium leprae
acggcuucaucagugu

SEQ ID NO: 1235827 - RNA, 17 nt, Mycobacterium leprae
acggcugcguuggcauc

SEQ ID NO: 1235828 - RNA, 16 nt, Mycobacterium leprae
acggcuggcugcugca

SEQ ID NO: 1235829 - RNA, 22 nt, Mycobacterium leprae
acggcgguguuucucgccgacc

SEQ ID NO: 1235830 - RNA, 15 nt, Mycobacterium leprae
acggagcgcaggaac

SEQ ID NO: 1235831 - RNA, 16 nt, Mycobacterium leprae
acgcugauaaggucug

SEQ ID NO: 1235832 - RNA, 15 nt, Mycobacterium leprae
acgcugaccagcaga

SEQ ID NO: 1235833 - RNA, 20 nt, Mycobacterium leprae
acgcugcgcuucuggcuggg

SEQ ID NO: 1235834 - RNA, 16 nt, Mycobacterium leprae
acgcaugacacccccg

SEQ ID NO: 1235835 - RNA, 14 nt, Mycobacterium leprae
acgccaaacagauc

SEQ ID NO: 1235836 - RNA, 22 nt, Mycobacterium leprae
acgcagcgcgaacaagaaaagg

SEQ ID NO: 1235837 - RNA, 21 nt, Mycobacterium leprae
acgcaccggcguuccggccuc

SEQ ID NO: 1235838 - RNA, 16 nt, Mycobacterium leprae
acgcacgccuugcagc

SEQ ID NO: 1235839 - RNA, 13 nt, Mycobacterium leprae
accggauggcugc

SEQ ID NO: 1235840 - RNA, 16 nt, Mycobacterium leprae
acgcacacgacagccg

SEQ ID NO: 1235841 - RNA, 23 nt, Mycobacterium leprae
accggagcacuccuucaugcugg

SEQ ID NO: 1235842 - RNA, 16 nt, Mycobacterium leprae
accggauacagagcca

SEQ ID NO: 1235843 - RNA, 22 nt, Mycobacterium leprae
acgccucugccagggguuccaa

SEQ ID NO: 1235844 - RNA, 18 nt, Mycobacterium leprae
acgccuccacugcuccug

SEQ ID NO: 1235845 - RNA, 19 nt, Mycobacterium leprae
acgccggucgaagugaccu

SEQ ID NO: 1235846 - RNA, 16 nt, Mycobacterium leprae
acgccguagcgcacca

SEQ ID NO: 1235847 - RNA, 17 nt, Mycobacterium leprae
acgccgccguugccaua

SEQ ID NO: 1235848 - RNA, 12 nt, Mycobacterium leprae
acgccgaggguc

SEQ ID NO: 1235849 - RNA, 17 nt, Mycobacterium leprae
acgccgaucgugccccu

SEQ ID NO: 1235850 - RNA, 20 nt, Mycobacterium leprae
acgccgauaucgaccagcca

SEQ ID NO: 1235851 - RNA, 15 nt, Mycobacterium leprae
acgccgacaccucaa

SEQ ID NO: 1235852 - RNA, 13 nt, Mycobacterium leprae
acgcccuccuggc

SEQ ID NO: 1235853 - RNA, 15 nt, Mycobacterium leprae
acuuacuaucacgaa

SEQ ID NO: 1235854 - RNA, 22 nt, Mycobacterium leprae
acuuaccgcggcggccaacugu

SEQ ID NO: 1235855 - RNA, 16 nt, Mycobacterium leprae
acuuagauuggaaggc

SEQ ID NO: 1235856 - RNA, 21 nt, Mycobacterium leprae
acuuaugcacccgcguacagg

SEQ ID NO: 1235857 - RNA, 14 nt, Mycobacterium leprae
acuguugugggcaa

SEQ ID NO: 1235858 - RNA, 16 nt, Mycobacterium leprae
acuuggucaaggugaa

SEQ ID NO: 1235859 - RNA, 14 nt, Mycobacterium leprae
acuuggcacaacaa

SEQ ID NO: 1235860 - RNA, 19 nt, Mycobacterium leprae
acuuggcacaacaagagaa

SEQ ID NO: 1235861 - RNA, 18 nt, Mycobacterium leprae
acuugcaugugucccugg

SEQ ID NO: 1235862 - RNA, 20 nt, Mycobacterium leprae
acuugaccagccgcagcacc

SEQ ID NO: 1235863 - RNA, 18 nt, Mycobacterium leprae
acuugaccuauacuggau

SEQ ID NO: 1235864 - RNA, 14 nt, Mycobacterium leprae
acuugacgaugcug

SEQ ID NO: 1235865 - RNA, 15 nt, Mycobacterium leprae
acuugacgaugcugu

SEQ ID NO: 1235866 - RNA, 15 nt, Mycobacterium leprae
acuucuugugcaccg

SEQ ID NO: 1235867 - RNA, 20 nt, Mycobacterium leprae
acuucuuuuaucaagggauu

SEQ ID NO: 1235868 - RNA, 24 nt, Mycobacterium leprae
acuucggaaucuuugaucugcugc

SEQ ID NO: 1235869 - RNA, 21 nt, Mycobacterium leprae
acuuguucuuugcguccucca

SEQ ID NO: 1235870 - RNA, 13 nt, Mycobacterium leprae
agaaaguugaagu

SEQ ID NO: 1235871 - RNA, 16 nt, Mycobacterium leprae
agaaacaggcauauaa

SEQ ID NO: 1235872 - RNA, 17 nt, Mycobacterium leprae
agaaacaggcauauaau

SEQ ID NO: 1235873 - RNA, 21 nt, Mycobacterium leprae
agaaacagggccgaagcagcc

SEQ ID NO: 1235874 - RNA, 19 nt, Mycobacterium leprae
agaaagaauuuaccggcgu

SEQ ID NO: 1235875 - RNA, 16 nt, Mycobacterium leprae
agaaaacuuaauaucu

SEQ ID NO: 1235876 - RNA, 15 nt, Mycobacterium leprae
agaaacaaaggugcc

SEQ ID NO: 1235877 - RNA, 13 nt, Mycobacterium leprae
agaggcugcaccg

SEQ ID NO: 1235878 - RNA, 19 nt, Mycobacterium leprae
agaguaaccacuugcagua

SEQ ID NO: 1235879 - RNA, 19 nt, Mycobacterium leprae
agaguacggagccaguggc

SEQ ID NO: 1235880 - RNA, 21 nt, Mycobacterium leprae
agauaaagcuuagaaagcugc

SEQ ID NO: 1235881 - RNA, 15 nt, Mycobacterium leprae
agagcucacugggcu

SEQ ID NO: 1235882 - RNA, 11 nt, Mycobacterium leprae
agagcccggca

SEQ ID NO: 1235883 - RNA, 15 nt, Mycobacterium leprae
agagccacggcaaug

SEQ ID NO: 1235884 - RNA, 20 nt, Mycobacterium leprae
agacucgugagcuuacggac

SEQ ID NO: 1235885 - RNA, 21 nt, Mycobacterium leprae
agacuggguggcccgaggaga

SEQ ID NO: 1235886 - RNA, 17 nt, Mycobacterium leprae
agacucaccaagauugc

SEQ ID NO: 1235887 - RNA, 12 nt, Mycobacterium leprae
agacucagaaau

SEQ ID NO: 1235888 - RNA, 17 nt, Mycobacterium leprae
agacgcgaccgccacca

SEQ ID NO: 1235889 - RNA, 13 nt, Mycobacterium leprae
agaccaagcagca

SEQ ID NO: 1235890 - RNA, 21 nt, Mycobacterium leprae
agacccccggauaccgggggu

SEQ ID NO: 1235891 - RNA, 23 nt, Mycobacterium leprae
agacccuuguagcccuccggaaa

SEQ ID NO: 1235892 - RNA, 18 nt, Mycobacterium leprae
agaccgaaaaccacaagc

SEQ ID NO: 1235893 - RNA, 14 nt, Mycobacterium leprae
agacauuucauuau

SEQ ID NO: 1235894 - RNA, 17 nt, Mycobacterium leprae
agaccgccagaccggcg

SEQ ID NO: 1235895 - RNA, 14 nt, Mycobacterium leprae
agaauuaauauaua

SEQ ID NO: 1235896 - RNA, 12 nt, Mycobacterium leprae
agacaucgccac

SEQ ID NO: 1235897 - RNA, 14 nt, Mycobacterium leprae
agacaccguccucg

SEQ ID NO: 1235898 - RNA, 18 nt, Mycobacterium leprae
agacaacccgacggcaca

SEQ ID NO: 1235899 - RNA, 17 nt, Mycobacterium leprae
agaagcgcugcagcgau

SEQ ID NO: 1235900 - RNA, 22 nt, Mycobacterium leprae
agaagugguuuuggcaguacca

SEQ ID NO: 1235901 - RNA, 19 nt, Mycobacterium leprae
agaagaccgugcuccuguu

SEQ ID NO: 1235902 - RNA, 15 nt, Mycobacterium leprae
agcaagucccaggac

SEQ ID NO: 1235903 - RNA, 14 nt, Mycobacterium leprae
agcaaggguggggc

SEQ ID NO: 1235904 - RNA, 19 nt, Mycobacterium leprae
agcaaggguugguagcugg

SEQ ID NO: 1235905 - RNA, 15 nt, Mycobacterium leprae
agcaaggaacaaaau

SEQ ID NO: 1235906 - RNA, 16 nt, Mycobacterium leprae
agcaauaaccagggcc

SEQ ID NO: 1235907 - RNA, 14 nt, Mycobacterium leprae
agcaagcgagccau

SEQ ID NO: 1235908 - RNA, 15 nt, Mycobacterium leprae
agcaagcaggcaugc

SEQ ID NO: 1235909 - RNA, 18 nt, Mycobacterium leprae
agcaagcaggcaugccgc

SEQ ID NO: 1235910 - RNA, 14 nt, Mycobacterium leprae
agcaaugcucugcu

SEQ ID NO: 1235911 - RNA, 12 nt, Mycobacterium leprae
agcaacugcagc

SEQ ID NO: 1235912 - RNA, 18 nt, Mycobacterium leprae
agcaaauugccgagcugg

SEQ ID NO: 1235913 - RNA, 14 nt, Mycobacterium leprae
agcaaaccagguga

SEQ ID NO: 1235914 - RNA, 21 nt, Mycobacterium leprae
agcagaauuggagugaaguga

SEQ ID NO: 1235915 - RNA, 20 nt, Mycobacterium leprae
agcagcacgggguguuggcg

SEQ ID NO: 1235916 - RNA, 21 nt, Mycobacterium leprae
agcacugcacggcgugcaggc

SEQ ID NO: 1235917 - RNA, 14 nt, Mycobacterium leprae
agcacuggcauuac

SEQ ID NO: 1235918 - RNA, 15 nt, Mycobacterium leprae
agcacggcacaaucg

SEQ ID NO: 1235919 - RNA, 20 nt, Mycobacterium leprae
agcaccaaccuguagacgag

SEQ ID NO: 1235920 - RNA, 20 nt, Mycobacterium leprae
agcaccaagucuucgaugcu

SEQ ID NO: 1235921 - RNA, 14 nt, Mycobacterium leprae
agcacaccagggau

SEQ ID NO: 1235922 - RNA, 16 nt, Mycobacterium leprae
agcacacugcggcugc

SEQ ID NO: 1235923 - RNA, 14 nt, Mycobacterium leprae
agcacccggccaca

SEQ ID NO: 1235924 - RNA, 13 nt, Mycobacterium leprae
agcacccagcuca

SEQ ID NO: 1235925 - RNA, 12 nt, Mycobacterium leprae
agcaccagcagu

SEQ ID NO: 1235926 - RNA, 20 nt, Mycobacterium leprae
agcaggucgccgaggcgacu

SEQ ID NO: 1235927 - RNA, 14 nt, Mycobacterium leprae
agcaggaaucccag

SEQ ID NO: 1235928 - RNA, 18 nt, Mycobacterium leprae
agcaggaaucccagcagc

SEQ ID NO: 1235929 - RNA, 13 nt, Mycobacterium leprae
agcagcugggugg

SEQ ID NO: 1235930 - RNA, 21 nt, Mycobacterium leprae
agcagcugcacgaauccgcua

SEQ ID NO: 1235931 - RNA, 21 nt, Mycobacterium leprae
agcagcaguuuccaacaaacu

SEQ ID NO: 1235932 - RNA, 17 nt, Mycobacterium leprae
agcagccggggugguga

SEQ ID NO: 1235933 - RNA, 19 nt, Mycobacterium leprae
agcauagcggccgccagca

SEQ ID NO: 1235934 - RNA, 19 nt, Mycobacterium leprae
agcaguguggcauccgcca

SEQ ID NO: 1235935 - RNA, 17 nt, Mycobacterium leprae
agcaguguucaggccau

SEQ ID NO: 1235936 - RNA, 23 nt, Mycobacterium leprae
agcaguaucguguuagugaacag

SEQ ID NO: 1235937 - RNA, 18 nt, Mycobacterium leprae
agcaucggguaaaucucu

SEQ ID NO: 1235938 - RNA, 15 nt, Mycobacterium leprae
agcaucguauagcac

SEQ ID NO: 1235939 - RNA, 15 nt, Mycobacterium leprae
agcaucagacagagc

SEQ ID NO: 1235940 - RNA, 22 nt, Mycobacterium leprae
agccaggaugcggcccagugca

SEQ ID NO: 1235941 - RNA, 19 nt, Mycobacterium leprae
agccaggagaagcgcugca

SEQ ID NO: 1235942 - RNA, 20 nt, Mycobacterium leprae
agccaugucugucagcacau

SEQ ID NO: 1235943 - RNA, 12 nt, Mycobacterium leprae
agccacuucaga

SEQ ID NO: 1235944 - RNA, 13 nt, Mycobacterium leprae
agccacggcaaug

SEQ ID NO: 1235945 - RNA, 14 nt, Mycobacterium leprae
agccagaccaacau

SEQ ID NO: 1235946 - RNA, 15 nt, Mycobacterium leprae
agccaagcucagcgc

SEQ ID NO: 1235947 - RNA, 20 nt, Mycobacterium leprae
agccaagcucagcgcagugc

SEQ ID NO: 1235948 - RNA, 19 nt, Mycobacterium leprae
agccaaucguguaucgucg

SEQ ID NO: 1235949 - RNA, 22 nt, Mycobacterium leprae
agccacagcgacggaucuguag

SEQ ID NO: 1235950 - RNA, 23 nt, Mycobacterium leprae
agccaccaaguacggcggguugg

SEQ ID NO: 1235951 - RNA, 18 nt, Mycobacterium leprae
agccaccacaaauacuuc

SEQ ID NO: 1235952 - RNA, 22 nt, Mycobacterium leprae
agccaccacaaauacuucacca

SEQ ID NO: 1235953 - RNA, 15 nt, Mycobacterium leprae
agccaacagccaaug

SEQ ID NO: 1235954 - RNA, 22 nt, Mycobacterium leprae
agcauugcguaauucgacaaug

SEQ ID NO: 1235955 - RNA, 23 nt, Mycobacterium leprae
agcaugacgucuucuauacuuua

SEQ ID NO: 1235956 - RNA, 12 nt, Mycobacterium leprae
agcaugcgccuc

SEQ ID NO: 1235957 - RNA, 20 nt, Mycobacterium leprae
agcauguacuuaccugcgcg

SEQ ID NO: 1235958 - RNA, 13 nt, Mycobacterium leprae
agcaugguggcca

SEQ ID NO: 1235959 - RNA, 17 nt, Mycobacterium leprae
agcauguccaagaauca

SEQ ID NO: 1235960 - RNA, 20 nt, Mycobacterium leprae
agcauggacccacugggcaa

SEQ ID NO: 1235961 - RNA, 15 nt, Mycobacterium leprae
agcgaugacauggaa

SEQ ID NO: 1235962 - RNA, 14 nt, Mycobacterium leprae
agcgauaucaagcu

SEQ ID NO: 1235963 - RNA, 15 nt, Mycobacterium leprae
agcgcaccgcggauc

SEQ ID NO: 1235964 - RNA, 18 nt, Mycobacterium leprae
agcgcacaucgauaacga

SEQ ID NO: 1235965 - RNA, 14 nt, Mycobacterium leprae
agcgcagccaccac

SEQ ID NO: 1235966 - RNA, 17 nt, Mycobacterium leprae
agcgccacgccggacug

SEQ ID NO: 1235967 - RNA, 14 nt, Mycobacterium leprae
agcgccaccaugcg

SEQ ID NO: 1235968 - RNA, 19 nt, Mycobacterium leprae
agcgcuaugccauccaccg

SEQ ID NO: 1235969 - RNA, 14 nt, Mycobacterium leprae
agcgccgcuguuca

SEQ ID NO: 1235970 - RNA, 14 nt, Mycobacterium leprae
agcgccucaccaaa

SEQ ID NO: 1235971 - RNA, 23 nt, Mycobacterium leprae
agcgccucaccaaaucgacuaca

SEQ ID NO: 1235972 - RNA, 19 nt, Mycobacterium leprae
agcuacguggucugaagug

SEQ ID NO: 1235973 - RNA, 18 nt, Mycobacterium leprae
agcuaaagugcugcugug

SEQ ID NO: 1235974 - RNA, 18 nt, Mycobacterium leprae
agcguugugggcagcugc

SEQ ID NO: 1235975 - RNA, 23 nt, Mycobacterium leprae
agcguucgauaacaguggucugg

SEQ ID NO: 1235976 - RNA, 14 nt, Mycobacterium leprae
agcgguuccuccca

SEQ ID NO: 1235977 - RNA, 17 nt, Mycobacterium leprae
agcggcagcggcggccg

SEQ ID NO: 1235978 - RNA, 14 nt, Mycobacterium leprae
agcucggacaagau

SEQ ID NO: 1235979 - RNA, 16 nt, Mycobacterium leprae
agcuccgaagcagcca

SEQ ID NO: 1235980 - RNA, 15 nt, Mycobacterium leprae
agcucuucucgcaga

SEQ ID NO: 1235981 - RNA, 15 nt, Mycobacterium leprae
agcugcguauagugg

SEQ ID NO: 1235982 - RNA, 19 nt, Mycobacterium leprae
agcugcugagcguggcugc

SEQ ID NO: 1235983 - RNA, 14 nt, Mycobacterium leprae
agcugcugaacauc

SEQ ID NO: 1235984 - RNA, 12 nt, Mycobacterium leprae
agcgagcucgag

SEQ ID NO: 1235985 - RNA, 21 nt, Mycobacterium leprae
agcgaccggccagugcaaccu

SEQ ID NO: 1235986 - RNA, 17 nt, Mycobacterium leprae
agcgacgguaagcucgc

SEQ ID NO: 1235987 - RNA, 18 nt, Mycobacterium leprae
agcgacgguaagcucgcc

SEQ ID NO: 1235988 - RNA, 21 nt, Mycobacterium leprae
agcgacgguaagcucgcccua

SEQ ID NO: 1235989 - RNA, 11 nt, Mycobacterium leprae
agcgacaggca

SEQ ID NO: 1235990 - RNA, 18 nt, Mycobacterium leprae
agcgaaccuacaguggca

SEQ ID NO: 1235991 - RNA, 17 nt, Mycobacterium leprae
agccuguuguugugccu

SEQ ID NO: 1235992 - RNA, 20 nt, Mycobacterium leprae
agccuguuguugugccuucu

SEQ ID NO: 1235993 - RNA, 16 nt, Mycobacterium leprae
agccuccagaaucaca

SEQ ID NO: 1235994 - RNA, 18 nt, Mycobacterium leprae
agccucaucgaaagcagg

SEQ ID NO: 1235995 - RNA, 19 nt, Mycobacterium leprae
agccucaucgaaagcaggc

SEQ ID NO: 1235996 - RNA, 21 nt, Mycobacterium leprae
agccuccgaaaagcugagccg

SEQ ID NO: 1235997 - RNA, 20 nt, Mycobacterium leprae
agccuaugcggccagccagg

SEQ ID NO: 1235998 - RNA, 23 nt, Mycobacterium leprae
agccuaaccucacgccuaaucua

SEQ ID NO: 1235999 - RNA, 22 nt, Mycobacterium leprae
agccuaaauccggauuuuccug

SEQ ID NO: 1236000 - RNA, 20 nt, Mycobacterium leprae
agccucggucauaacaugau

SEQ ID NO: 1236001 - RNA, 15 nt, Mycobacterium leprae
agccgguggccaccg

SEQ ID NO: 1236002 - RNA, 19 nt, Mycobacterium leprae
agccgguggccaccgccac

SEQ ID NO: 1236003 - RNA, 18 nt, Mycobacterium leprae
agccgucgaagcccugca

SEQ ID NO: 1236004 - RNA, 21 nt, Mycobacterium leprae
agccgucacugugugcagcuu

SEQ ID NO: 1236005 - RNA, 18 nt, Mycobacterium leprae
agccggucgaucgcagcc

SEQ ID NO: 1236006 - RNA, 19 nt, Mycobacterium leprae
agccggucgaucgcagccg

SEQ ID NO: 1236007 - RNA, 18 nt, Mycobacterium leprae
agcccuucuccaccaccg

SEQ ID NO: 1236008 - RNA, 20 nt, Mycobacterium leprae
agccgaacaaacccccaacc

SEQ ID NO: 1236009 - RNA, 21 nt, Mycobacterium leprae
agccgaccgcccgguagcacc

SEQ ID NO: 1236010 - RNA, 23 nt, Mycobacterium leprae
agccgcgguaacggcgguggcag

SEQ ID NO: 1236011 - RNA, 15 nt, Mycobacterium leprae
agccgcguccagaca

SEQ ID NO: 1236012 - RNA, 21 nt, Mycobacterium leprae
agccgccacgaccaaaccucu

SEQ ID NO: 1236013 - RNA, 19 nt, Mycobacterium leprae
agccgcgcgcaagucugga

SEQ ID NO: 1236014 - RNA, 23 nt, Mycobacterium leprae
agccgcgcuagcgauguagccaa

SEQ ID NO: 1236015 - RNA, 22 nt, Mycobacterium leprae
agccauuugcggcuuguggcua

SEQ ID NO: 1236016 - RNA, 13 nt, Mycobacterium leprae
agccauugcucgg

SEQ ID NO: 1236017 - RNA, 15 nt, Mycobacterium leprae
agcccagauugcagu

SEQ ID NO: 1236018 - RNA, 15 nt, Mycobacterium leprae
agcccaggugcccag

SEQ ID NO: 1236019 - RNA, 14 nt, Mycobacterium leprae
agcccugcccggcc

SEQ ID NO: 1236020 - RNA, 14 nt, Mycobacterium leprae
agcccucccagcca

SEQ ID NO: 1236021 - RNA, 22 nt, Mycobacterium leprae
agcccggagugccuguccggag

SEQ ID NO: 1236022 - RNA, 15 nt, Mycobacterium leprae
agccccuggcaucau

SEQ ID NO: 1236023 - RNA, 21 nt, Mycobacterium leprae
agccccuggcaucaucaacau

SEQ ID NO: 1236024 - RNA, 22 nt, Mycobacterium leprae
agcccgcugcugcgaccgacca

SEQ ID NO: 1236025 - RNA, 13 nt, Mycobacterium leprae
agcccgauuugga

SEQ ID NO: 1236026 - RNA, 21 nt, Mycobacterium leprae
agcccgcaucggcccgcaacc

SEQ ID NO: 1236027 - RNA, 15 nt, Mycobacterium leprae
auaaauaguauuauu

SEQ ID NO: 1236028 - RNA, 20 nt, Mycobacterium leprae
auaaaauuuaaaaauuuguu

SEQ ID NO: 1236029 - RNA, 17 nt, Mycobacterium leprae
aguuugguuauugcucu

SEQ ID NO: 1236030 - RNA, 19 nt, Mycobacterium leprae
aguuuucagccacauugcc

SEQ ID NO: 1236031 - RNA, 15 nt, Mycobacterium leprae
aguugcauugucuac

SEQ ID NO: 1236032 - RNA, 15 nt, Mycobacterium leprae
aguuuagagugcagc

SEQ ID NO: 1236033 - RNA, 19 nt, Mycobacterium leprae
aguuguaagugcaguuccu

SEQ ID NO: 1236034 - RNA, 13 nt, Mycobacterium leprae
aguucggccaugg

SEQ ID NO: 1236035 - RNA, 22 nt, Mycobacterium leprae
aguucuugguuagguugguggu

SEQ ID NO: 1236036 - RNA, 15 nt, Mycobacterium leprae
aguuccgcgcugaau

SEQ ID NO: 1236037 - RNA, 19 nt, Mycobacterium leprae
aguggcgacacuacuguug

SEQ ID NO: 1236038 - RNA, 14 nt, Mycobacterium leprae
aguggcgaguggcu

SEQ ID NO: 1236039 - RNA, 21 nt, Mycobacterium leprae
aguggccaauucggcgagcac

SEQ ID NO: 1236040 - RNA, 20 nt, Mycobacterium leprae
aguggcgggcuugaccugga

SEQ ID NO: 1236041 - RNA, 15 nt, Mycobacterium leprae
agugaaaguaggcac

SEQ ID NO: 1236042 - RNA, 19 nt, Mycobacterium leprae
agucguggguacguggugg

SEQ ID NO: 1236043 - RNA, 20 nt, Mycobacterium leprae
agucguggguacgugguggc

SEQ ID NO: 1236044 - RNA, 23 nt, Mycobacterium leprae
agucguggguacgugguggcugc

SEQ ID NO: 1236045 - RNA, 18 nt, Mycobacterium leprae
agugaucagguggagcaa

SEQ ID NO: 1236046 - RNA, 18 nt, Mycobacterium leprae
agugaucggcgacacaga

SEQ ID NO: 1236047 - RNA, 23 nt, Mycobacterium leprae
agugaugcggacgacgcugagag

SEQ ID NO: 1236048 - RNA, 15 nt, Mycobacterium leprae
agugcacugagcagu

SEQ ID NO: 1236049 - RNA, 16 nt, Mycobacterium leprae
agugccacgguggccu

SEQ ID NO: 1236050 - RNA, 13 nt, Mycobacterium leprae
agugccaccgcug

SEQ ID NO: 1236051 - RNA, 18 nt, Mycobacterium leprae
agugcggcgcccagcacc

SEQ ID NO: 1236052 - RNA, 17 nt, Mycobacterium leprae
agucaucgacuugcugc

SEQ ID NO: 1236053 - RNA, 20 nt, Mycobacterium leprae
agucaucgacuugcugccac

SEQ ID NO: 1236054 - RNA, 19 nt, Mycobacterium leprae
aguccaagcacgaugacau

SEQ ID NO: 1236055 - RNA, 20 nt, Mycobacterium leprae
agucgcgucuuugcugguca

SEQ ID NO: 1236056 - RNA, 21 nt, Mycobacterium leprae
agucgcgucuuugcuggucag

SEQ ID NO: 1236057 - RNA, 23 nt, Mycobacterium leprae
agucgauaucgggccgagcuggu

SEQ ID NO: 1236058 - RNA, 16 nt, Mycobacterium leprae
agucggagugucucug

SEQ ID NO: 1236059 - RNA, 22 nt, Mycobacterium leprae
agucggcaaugcucucacccuc

SEQ ID NO: 1236060 - RNA, 16 nt, Mycobacterium leprae
agucgcuaaauauuaa

SEQ ID NO: 1236061 - RNA, 19 nt, Mycobacterium leprae
aguccccguguuugucaaa

SEQ ID NO: 1236062 - RNA, 21 nt, Mycobacterium leprae
agucccgaacaaauugugggg

SEQ ID NO: 1236063 - RNA, 23 nt, Mycobacterium leprae
agucccgaacaaauugugggggu

SEQ ID NO: 1236064 - RNA, 21 nt, Mycobacterium leprae
agucaguuuggcgcugcugcg

SEQ ID NO: 1236065 - RNA, 11 nt, Mycobacterium leprae
agucagcacaa

SEQ ID NO: 1236066 - RNA, 13 nt, Mycobacterium leprae
agucaaaaccagc

SEQ ID NO: 1236067 - RNA, 20 nt, Mycobacterium leprae
agucaccugucauucugaca

SEQ ID NO: 1236068 - RNA, 14 nt, Mycobacterium leprae
aguaucugugggca

SEQ ID NO: 1236069 - RNA, 18 nt, Mycobacterium leprae
aguaugccucgagcaaac

SEQ ID NO: 1236070 - RNA, 14 nt, Mycobacterium leprae
aguagucccgagcg

SEQ ID NO: 1236071 - RNA, 22 nt, Mycobacterium leprae
aguagcuagcuguccaauguca

SEQ ID NO: 1236072 - RNA, 18 nt, Mycobacterium leprae
aguagcuaguuuaccgug

SEQ ID NO: 1236073 - RNA, 15 nt, Mycobacterium leprae
aguagcgacaucggg

SEQ ID NO: 1236074 - RNA, 12 nt, Mycobacterium leprae
aguacuucgccc

SEQ ID NO: 1236075 - RNA, 18 nt, Mycobacterium leprae
aguagagaaaaaugcugc

SEQ ID NO: 1236076 - RNA, 15 nt, Mycobacterium leprae
aguagaugcaacuga

SEQ ID NO: 1236077 - RNA, 16 nt, Mycobacterium leprae
agcuggcgaacaacaa

SEQ ID NO: 1236078 - RNA, 17 nt, Mycobacterium leprae
aguacgaaaugaacguc

SEQ ID NO: 1236079 - RNA, 13 nt, Mycobacterium leprae
aucaauaccuacu

SEQ ID NO: 1236080 - RNA, 13 nt, Mycobacterium leprae
aucaagaucggcc

SEQ ID NO: 1236081 - RNA, 15 nt, Mycobacterium leprae
auauggcuaugacaa

SEQ ID NO: 1236082 - RNA, 20 nt, Mycobacterium leprae
auaugugcuauagcacacca

SEQ ID NO: 1236083 - RNA, 21 nt, Mycobacterium leprae
auauuaaguuuucucuaaaag

SEQ ID NO: 1236084 - RNA, 19 nt, Mycobacterium leprae
auauggaaagucagcauca

SEQ ID NO: 1236085 - RNA, 20 nt, Mycobacterium leprae
auaucguaaucaggacucgg

SEQ ID NO: 1236086 - RNA, 22 nt, Mycobacterium leprae
auaucgcuacccuugagcaccc

SEQ ID NO: 1236087 - RNA, 22 nt, Mycobacterium leprae
auaucgccuucagcacagccca

SEQ ID NO: 1236088 - RNA, 16 nt, Mycobacterium leprae
auagucccuugaugua

SEQ ID NO: 1236089 - RNA, 16 nt, Mycobacterium leprae
auagucagaucaacca

SEQ ID NO: 1236090 - RNA, 20 nt, Mycobacterium leprae
auagcgaaaauaacuauaau

SEQ ID NO: 1236091 - RNA, 22 nt, Mycobacterium leprae
auauaagcgaaguccuugcugg

SEQ ID NO: 1236092 - RNA, 19 nt, Mycobacterium leprae
auaaugucgaagggcuggu

SEQ ID NO: 1236093 - RNA, 21 nt, Mycobacterium leprae
auaauuuggcugauaauaucg

SEQ ID NO: 1236094 - RNA, 20 nt, Mycobacterium leprae
auaaucccacucuugacuaa

SEQ ID NO: 1236095 - RNA, 17 nt, Mycobacterium leprae
auaaucccgcucugcgu

SEQ ID NO: 1236096 - RNA, 21 nt, Mycobacterium leprae
auaaugcacugcgaguaacua

SEQ ID NO: 1236097 - RNA, 14 nt, Mycobacterium leprae
auacagguggcauc

SEQ ID NO: 1236098 - RNA, 18 nt, Mycobacterium leprae
auacagguggcaucagau

SEQ ID NO: 1236099 - RNA, 19 nt, Mycobacterium leprae
auacagagccacauuugac

SEQ ID NO: 1236100 - RNA, 18 nt, Mycobacterium leprae
auacaacaauaaucccgc

SEQ ID NO: 1236101 - RNA, 19 nt, Mycobacterium leprae
auacaaucgcggcacaugc

SEQ ID NO: 1236102 - RNA, 14 nt, Mycobacterium leprae
auaccgaacagugg

SEQ ID NO: 1236103 - RNA, 22 nt, Mycobacterium leprae
auaccgcccaguaaugugcuau

SEQ ID NO: 1236104 - RNA, 17 nt, Mycobacterium leprae
auagaacaccgaagcug

SEQ ID NO: 1236105 - RNA, 21 nt, Mycobacterium leprae
auagaacauccgcagcauggu

SEQ ID NO: 1236106 - RNA, 19 nt, Mycobacterium leprae
aucgaaccgacgaugcugu

SEQ ID NO: 1236107 - RNA, 17 nt, Mycobacterium leprae
aucgacaucccagcaac

SEQ ID NO: 1236108 - RNA, 15 nt, Mycobacterium leprae
aucgacccaagcauc

SEQ ID NO: 1236109 - RNA, 13 nt, Mycobacterium leprae
aucgaccagccaa

SEQ ID NO: 1236110 - RNA, 20 nt, Mycobacterium leprae
aucgacgcaacugagaaggu

SEQ ID NO: 1236111 - RNA, 17 nt, Mycobacterium leprae
aucgacgcagcaacugu

SEQ ID NO: 1236112 - RNA, 18 nt, Mycobacterium leprae
auccuguugacuggaacc

SEQ ID NO: 1236113 - RNA, 21 nt, Mycobacterium leprae
aucgccaacccgggagucgac

SEQ ID NO: 1236114 - RNA, 18 nt, Mycobacterium leprae
aucgagaagggagugcag

SEQ ID NO: 1236115 - RNA, 17 nt, Mycobacterium leprae
aucgaugcacuguucac

SEQ ID NO: 1236116 - RNA, 23 nt, Mycobacterium leprae
aucgaugcuugcucuagccgggc

SEQ ID NO: 1236117 - RNA, 19 nt, Mycobacterium leprae
aucgacguuugcaggugcu

SEQ ID NO: 1236118 - RNA, 22 nt, Mycobacterium leprae
aucgacuacuagaaggcggcuu

SEQ ID NO: 1236119 - RNA, 21 nt, Mycobacterium leprae
aucgacuccgcaagaugcccg

SEQ ID NO: 1236120 - RNA, 13 nt, Mycobacterium leprae
aucgccgaugacc

SEQ ID NO: 1236121 - RNA, 21 nt, Mycobacterium leprae
aucggacacgagcggccucag

SEQ ID NO: 1236122 - RNA, 23 nt, Mycobacterium leprae
aucgcuuggugcugcugcuggug

SEQ ID NO: 1236123 - RNA, 12 nt, Mycobacterium leprae
aucgcuggucag

SEQ ID NO: 1236124 - RNA, 18 nt, Mycobacterium leprae
aucgccugugucgagcug

SEQ ID NO: 1236125 - RNA, 12 nt, Mycobacterium leprae
aucgccuuccaa

SEQ ID NO: 1236126 - RNA, 16 nt, Mycobacterium leprae
aucgugaggugugacc

SEQ ID NO: 1236127 - RNA, 18 nt, Mycobacterium leprae
aucgugaaucagaugacc

SEQ ID NO: 1236128 - RNA, 11 nt, Mycobacterium leprae
aucgucggccg

SEQ ID NO: 1236129 - RNA, 17 nt, Mycobacterium leprae
aucuaacccgcaaacca

SEQ ID NO: 1236130 - RNA, 21 nt, Mycobacterium leprae
aucggcucccaucggcggcca

SEQ ID NO: 1236131 - RNA, 12 nt, Mycobacterium leprae
aucgucagauuc

SEQ ID NO: 1236132 - RNA, 14 nt, Mycobacterium leprae
aucgucagauucau

SEQ ID NO: 1236133 - RNA, 18 nt, Mycobacterium leprae
auccucgaccaccagggc

SEQ ID NO: 1236134 - RNA, 16 nt, Mycobacterium leprae
auccucgacccaccac

SEQ ID NO: 1236135 - RNA, 23 nt, Mycobacterium leprae
auccucgacgggucacagguaaa

SEQ ID NO: 1236136 - RNA, 13 nt, Mycobacterium leprae
auccucggacugc

SEQ ID NO: 1236137 - RNA, 17 nt, Mycobacterium leprae
auccucgggcgcaagcg

SEQ ID NO: 1236138 - RNA, 18 nt, Mycobacterium leprae
auccguacaccaaucagg

SEQ ID NO: 1236139 - RNA, 14 nt, Mycobacterium leprae
auccgguguggagu

SEQ ID NO: 1236140 - RNA, 15 nt, Mycobacterium leprae
auccgggcgcucagc

SEQ ID NO: 1236141 - RNA, 18 nt, Mycobacterium leprae
auccucaaccagcgugca

SEQ ID NO: 1236142 - RNA, 23 nt, Mycobacterium leprae
auccucacacucacgccugcauc

SEQ ID NO: 1236143 - RNA, 14 nt, Mycobacterium leprae
auccuaggccacug

SEQ ID NO: 1236144 - RNA, 15 nt, Mycobacterium leprae
auccguggagagcau

SEQ ID NO: 1236145 - RNA, 19 nt, Mycobacterium leprae
auccgugugaacuugaaac

SEQ ID NO: 1236146 - RNA, 21 nt, Mycobacterium leprae
auccguuccucuuaacaacuu

SEQ ID NO: 1236147 - RNA, 16 nt, Mycobacterium leprae
auccgaaacccgaaac

SEQ ID NO: 1236148 - RNA, 19 nt, Mycobacterium leprae
auccgaaacccgaaaccaa

SEQ ID NO: 1236149 - RNA, 19 nt, Mycobacterium leprae
auccgcaacgaaaccaugc

SEQ ID NO: 1236150 - RNA, 19 nt, Mycobacterium leprae
auccgauuaagcugaucua

SEQ ID NO: 1236151 - RNA, 21 nt, Mycobacterium leprae
auccggaaaucgagaauuuac

SEQ ID NO: 1236152 - RNA, 16 nt, Mycobacterium leprae
auccccgauccagaca

SEQ ID NO: 1236153 - RNA, 18 nt, Mycobacterium leprae
aucccgaaaaccccacac

SEQ ID NO: 1236154 - RNA, 20 nt, Mycobacterium leprae
aucccccaggucaacagcau

SEQ ID NO: 1236155 - RNA, 18 nt, Mycobacterium leprae
auccagcccguugaucga

SEQ ID NO: 1236156 - RNA, 12 nt, Mycobacterium leprae
auccagccaaca

SEQ ID NO: 1236157 - RNA, 19 nt, Mycobacterium leprae
auccaggugcugcaguugg

SEQ ID NO: 1236158 - RNA, 12 nt, Mycobacterium leprae
aucccagugugc

SEQ ID NO: 1236159 - RNA, 12 nt, Mycobacterium leprae
aucccacucuug

SEQ ID NO: 1236160 - RNA, 19 nt, Mycobacterium leprae
aucccagaaucgucggcua

SEQ ID NO: 1236161 - RNA, 16 nt, Mycobacterium leprae
auccauugaccucuuc

SEQ ID NO: 1236162 - RNA, 18 nt, Mycobacterium leprae
auccaucgcaucugccau

SEQ ID NO: 1236163 - RNA, 14 nt, Mycobacterium leprae
aucauuuucaacgc

SEQ ID NO: 1236164 - RNA, 16 nt, Mycobacterium leprae
aucauucgauccaaug

SEQ ID NO: 1236165 - RNA, 13 nt, Mycobacterium leprae
auccaaugacuac

SEQ ID NO: 1236166 - RNA, 19 nt, Mycobacterium leprae
aucauggccgcagugauca

SEQ ID NO: 1236167 - RNA, 22 nt, Mycobacterium leprae
aucauggcuggacagaagcaag

SEQ ID NO: 1236168 - RNA, 22 nt, Mycobacterium leprae
aucauccgcaagcgcgccgagu

SEQ ID NO: 1236169 - RNA, 19 nt, Mycobacterium leprae
aucaguggacgcucgguga

SEQ ID NO: 1236170 - RNA, 15 nt, Mycobacterium leprae
aucagggcgcccccc

SEQ ID NO: 1236171 - RNA, 15 nt, Mycobacterium leprae
aucaggcuggggaag

SEQ ID NO: 1236172 - RNA, 13 nt, Mycobacterium leprae
augcggcgggauc

SEQ ID NO: 1236173 - RNA, 22 nt, Mycobacterium leprae
augcguucgguuucacagcaga

SEQ ID NO: 1236174 - RNA, 13 nt, Mycobacterium leprae
augcucgcagcgg

SEQ ID NO: 1236175 - RNA, 15 nt, Mycobacterium leprae
augcuccgacacugg

SEQ ID NO: 1236176 - RNA, 19 nt, Mycobacterium leprae
augcucguagcgcccagua

SEQ ID NO: 1236177 - RNA, 13 nt, Mycobacterium leprae
augcuuaaggcag

SEQ ID NO: 1236178 - RNA, 20 nt, Mycobacterium leprae
augcugucgcggagcuccgc

SEQ ID NO: 1236179 - RNA, 15 nt, Mycobacterium leprae
augcugugaugcugu

SEQ ID NO: 1236180 - RNA, 19 nt, Mycobacterium leprae
augcuguguggcuguuucu

SEQ ID NO: 1236181 - RNA, 21 nt, Mycobacterium leprae
augcuguguggcuguuucugc

SEQ ID NO: 1236182 - RNA, 14 nt, Mycobacterium leprae
augcuguucgguga

SEQ ID NO: 1236183 - RNA, 14 nt, Mycobacterium leprae
augcugacaucggc

SEQ ID NO: 1236184 - RNA, 16 nt, Mycobacterium leprae
augcuggcaguggcaa

SEQ ID NO: 1236185 - RNA, 14 nt, Mycobacterium leprae
augcugccugcguc

SEQ ID NO: 1236186 - RNA, 13 nt, Mycobacterium leprae
augcugcguucag

SEQ ID NO: 1236187 - RNA, 20 nt, Mycobacterium leprae
auggaguuacuuucgacagc

SEQ ID NO: 1236188 - RNA, 20 nt, Mycobacterium leprae
auggacgaccugcggcauuc

SEQ ID NO: 1236189 - RNA, 19 nt, Mycobacterium leprae
augugugcaggaccgugcu

SEQ ID NO: 1236190 - RNA, 21 nt, Mycobacterium leprae
auguuaauuuauuugguguuu

SEQ ID NO: 1236191 - RNA, 17 nt, Mycobacterium leprae
auguuacaucacaggau

SEQ ID NO: 1236192 - RNA, 14 nt, Mycobacterium leprae
augucgguggugga

SEQ ID NO: 1236193 - RNA, 19 nt, Mycobacterium leprae
augugcgcacuggguggau

SEQ ID NO: 1236194 - RNA, 17 nt, Mycobacterium leprae
augugcuguggaucagg

SEQ ID NO: 1236195 - RNA, 12 nt, Mycobacterium leprae
augugcuggaga

SEQ ID NO: 1236196 - RNA, 20 nt, Mycobacterium leprae
augucgcagagguaaaucug

SEQ ID NO: 1236197 - RNA, 12 nt, Mycobacterium leprae
auguagcccuuc

SEQ ID NO: 1236198 - RNA, 19 nt, Mycobacterium leprae
auguaaccggggaccucau

SEQ ID NO: 1236199 - RNA, 12 nt, Mycobacterium leprae
auggggguggga

SEQ ID NO: 1236200 - RNA, 11 nt, Mycobacterium leprae
augguggugcc

SEQ ID NO: 1236201 - RNA, 18 nt, Mycobacterium leprae
augguccaacgugguugg

SEQ ID NO: 1236202 - RNA, 16 nt, Mycobacterium leprae
auggugcggcgaucau

SEQ ID NO: 1236203 - RNA, 22 nt, Mycobacterium leprae
auggcccgucgcugcuggauga

SEQ ID NO: 1236204 - RNA, 14 nt, Mycobacterium leprae
auggccgaccaaau

SEQ ID NO: 1236205 - RNA, 18 nt, Mycobacterium leprae
auggccugcucauggcac

SEQ ID NO: 1236206 - RNA, 23 nt, Mycobacterium leprae
auggcgacgucgcuugugaucgu

SEQ ID NO: 1236207 - RNA, 16 nt, Mycobacterium leprae
auggcgccguggaggu

SEQ ID NO: 1236208 - RNA, 15 nt, Mycobacterium leprae
auggcgggcuggagg

SEQ ID NO: 1236209 - RNA, 14 nt, Mycobacterium leprae
auggcugccgggcg

SEQ ID NO: 1236210 - RNA, 23 nt, Mycobacterium leprae
augcagcagccagucagccgucg

SEQ ID NO: 1236211 - RNA, 18 nt, Mycobacterium leprae
augcacgugauggcgcgu

SEQ ID NO: 1236212 - RNA, 21 nt, Mycobacterium leprae
augcacgugcauaaguugcgu

SEQ ID NO: 1236213 - RNA, 22 nt, Mycobacterium leprae
augauugcagauguugcagcag

SEQ ID NO: 1236214 - RNA, 16 nt, Mycobacterium leprae
augauucuuaccugag

SEQ ID NO: 1236215 - RNA, 19 nt, Mycobacterium leprae
augauccagcugucagugu

SEQ ID NO: 1236216 - RNA, 12 nt, Mycobacterium leprae
augaucuucuga

SEQ ID NO: 1236217 - RNA, 15 nt, Mycobacterium leprae
augacaagagugaaa

SEQ ID NO: 1236218 - RNA, 12 nt, Mycobacterium leprae
augacaccgaac

SEQ ID NO: 1236219 - RNA, 23 nt, Mycobacterium leprae
augacaccgaacagcucgacagc

SEQ ID NO: 1236220 - RNA, 13 nt, Mycobacterium leprae
augaccgagcugg

SEQ ID NO: 1236221 - RNA, 21 nt, Mycobacterium leprae
augacagcgaugacauggaag

SEQ ID NO: 1236222 - RNA, 21 nt, Mycobacterium leprae
aucuuggagaagguuucccgc

SEQ ID NO: 1236223 - RNA, 17 nt, Mycobacterium leprae
aucuucgcccagcacgc

SEQ ID NO: 1236224 - RNA, 16 nt, Mycobacterium leprae
aucugcuuguggcgga

SEQ ID NO: 1236225 - RNA, 14 nt, Mycobacterium leprae
aucugcugauaauc

SEQ ID NO: 1236226 - RNA, 23 nt, Mycobacterium leprae
aucugguggauccaggugcugca

SEQ ID NO: 1236227 - RNA, 20 nt, Mycobacterium leprae
aucuguacgcguugauggcc

SEQ ID NO: 1236228 - RNA, 13 nt, Mycobacterium leprae
auuccgugugacg

SEQ ID NO: 1236229 - RNA, 17 nt, Mycobacterium leprae
auuccuacccucucagc

SEQ ID NO: 1236230 - RNA, 22 nt, Mycobacterium leprae
auuccgguaacacgucuagcga

SEQ ID NO: 1236231 - RNA, 18 nt, Mycobacterium leprae
auuccgguggggguggac

SEQ ID NO: 1236232 - RNA, 12 nt, Mycobacterium leprae
auucgcaaagcg

SEQ ID NO: 1236233 - RNA, 16 nt, Mycobacterium leprae
auucgcgauccaucag

SEQ ID NO: 1236234 - RNA, 13 nt, Mycobacterium leprae
auucgcaccugau

SEQ ID NO: 1236235 - RNA, 22 nt, Mycobacterium leprae
auucgccggacacaaccagcuu

SEQ ID NO: 1236236 - RNA, 20 nt, Mycobacterium leprae
auucaugacguuuacaacgu

SEQ ID NO: 1236237 - RNA, 12 nt, Mycobacterium leprae
auguucuguugu

SEQ ID NO: 1236238 - RNA, 20 nt, Mycobacterium leprae
auucauuuucguaucaaaac

SEQ ID NO: 1236239 - RNA, 22 nt, Mycobacterium leprae
auucauuuucguaucaaaacua

SEQ ID NO: 1236240 - RNA, 20 nt, Mycobacterium leprae
auuccauuccguugaacuug

SEQ ID NO: 1236241 - RNA, 16 nt, Mycobacterium leprae
auugauggaugcacac

SEQ ID NO: 1236242 - RNA, 19 nt, Mycobacterium leprae
auugaugcacgcgcgccug

SEQ ID NO: 1236243 - RNA, 21 nt, Mycobacterium leprae
auugaccacgccgacaccuca

SEQ ID NO: 1236244 - RNA, 12 nt, Mycobacterium leprae
auugaucacaaa

SEQ ID NO: 1236245 - RNA, 21 nt, Mycobacterium leprae
auuggccauuguugugcuggg

SEQ ID NO: 1236246 - RNA, 12 nt, Mycobacterium leprae
auugcugcaucu

SEQ ID NO: 1236247 - RNA, 21 nt, Mycobacterium leprae
auugcuuuuguccugacagau

SEQ ID NO: 1236248 - RNA, 17 nt, Mycobacterium leprae
auugcggccgaauucga

SEQ ID NO: 1236249 - RNA, 18 nt, Mycobacterium leprae
auugcauuggcugaucaa

SEQ ID NO: 1236250 - RNA, 17 nt, Mycobacterium leprae
auugccaacucaccgca

SEQ ID NO: 1236251 - RNA, 21 nt, Mycobacterium leprae
auugccaacucaccgcaggcg

SEQ ID NO: 1236252 - RNA, 22 nt, Mycobacterium leprae
auucguugggagccgcgcgcau

SEQ ID NO: 1236253 - RNA, 20 nt, Mycobacterium leprae
auucgucaaaaaacucaugc

SEQ ID NO: 1236254 - RNA, 14 nt, Mycobacterium leprae
auucuucucuaaaa

SEQ ID NO: 1236255 - RNA, 18 nt, Mycobacterium leprae
auucugcgguaucaucaa

SEQ ID NO: 1236256 - RNA, 16 nt, Mycobacterium leprae
auucuuuuagagaaaa

SEQ ID NO: 1236257 - RNA, 19 nt, Mycobacterium leprae
auuuucguugugccgcugc

SEQ ID NO: 1236258 - RNA, 15 nt, Mycobacterium leprae
auuuucaagacugca

SEQ ID NO: 1236259 - RNA, 17 nt, Mycobacterium leprae
auuuucaagacugcacc

SEQ ID NO: 1236260 - RNA, 14 nt, Mycobacterium leprae
auuuuccacaggca

SEQ ID NO: 1236261 - RNA, 20 nt, Mycobacterium leprae
auuuguuuuccugugcaggu

SEQ ID NO: 1236262 - RNA, 17 nt, Mycobacterium leprae
auuuauauucaauuuuc

SEQ ID NO: 1236263 - RNA, 21 nt, Mycobacterium leprae
auuuaccacucgucuuuccgu

SEQ ID NO: 1236264 - RNA, 21 nt, Mycobacterium leprae
auuuaccggcguucaauaaga

SEQ ID NO: 1236265 - RNA, 22 nt, Mycobacterium leprae
auuuaccggcguucaauaagaa

SEQ ID NO: 1236266 - RNA, 22 nt, Mycobacterium leprae
auuuaccggcguucgauaagaa

SEQ ID NO: 1236267 - RNA, 22 nt, Mycobacterium leprae
auuuacccgugauaucaaucca

SEQ ID NO: 1236268 - RNA, 16 nt, Mycobacterium leprae
auuuccggaacaacag

SEQ ID NO: 1236269 - RNA, 14 nt, Mycobacterium leprae
auuucgacaggcug

SEQ ID NO: 1236270 - RNA, 19 nt, Mycobacterium leprae
auuucgacggcaacggcac

SEQ ID NO: 1236271 - RNA, 18 nt, Mycobacterium leprae
auuucagggcacacagca

SEQ ID NO: 1236272 - RNA, 12 nt, Mycobacterium leprae
auuucacuggcc

SEQ ID NO: 1236273 - RNA, 16 nt, Mycobacterium leprae
caaagcuagccaccaa

SEQ ID NO: 1236274 - RNA, 20 nt, Mycobacterium leprae
caaagaucgggccauuugga

SEQ ID NO: 1236275 - RNA, 16 nt, Mycobacterium leprae
caaagacgacaacaga

SEQ ID NO: 1236276 - RNA, 19 nt, Mycobacterium leprae
caaagacgacaacagagca

SEQ ID NO: 1236277 - RNA, 16 nt, Mycobacterium leprae
caaacuuccucugcca

SEQ ID NO: 1236278 - RNA, 16 nt, Mycobacterium leprae
caaacugcugcgcaag

SEQ ID NO: 1236279 - RNA, 23 nt, Mycobacterium leprae
caaauuuuccggcuguuacucag

SEQ ID NO: 1236280 - RNA, 17 nt, Mycobacterium leprae
caacaacgaugccucuc

SEQ ID NO: 1236281 - RNA, 18 nt, Mycobacterium leprae
caacaagccgccgacacc

SEQ ID NO: 1236282 - RNA, 19 nt, Mycobacterium leprae
caacaccccgauuccaccu

SEQ ID NO: 1236283 - RNA, 20 nt, Mycobacterium leprae
caacagcggacguacagugg

SEQ ID NO: 1236284 - RNA, 21 nt, Mycobacterium leprae
caaacaacuggaguacuggcg

SEQ ID NO: 1236285 - RNA, 14 nt, Mycobacterium leprae
caaaauuuauggua

SEQ ID NO: 1236286 - RNA, 12 nt, Mycobacterium leprae
caaaauggcacg

SEQ ID NO: 1236287 - RNA, 21 nt, Mycobacterium leprae
caaaccgcaguacuggugcug

SEQ ID NO: 1236288 - RNA, 23 nt, Mycobacterium leprae
caaacggaauaaucacagccucc

SEQ ID NO: 1236289 - RNA, 13 nt, Mycobacterium leprae
caaaccaaacaac

SEQ ID NO: 1236290 - RNA, 22 nt, Mycobacterium leprae
caagcuguuacgaggacucccu

SEQ ID NO: 1236291 - RNA, 20 nt, Mycobacterium leprae
caagcuuacuuggucaaggu

SEQ ID NO: 1236292 - RNA, 23 nt, Mycobacterium leprae
caagcuuacuuggucaaggugaa

SEQ ID NO: 1236293 - RNA, 17 nt, Mycobacterium leprae
caaggauucagccaagg

SEQ ID NO: 1236294 - RNA, 15 nt, Mycobacterium leprae
caagcgaucggaaca

SEQ ID NO: 1236295 - RNA, 17 nt, Mycobacterium leprae
caagcgaucggaacauc

SEQ ID NO: 1236296 - RNA, 18 nt, Mycobacterium leprae
caagcgaucggaacauca

SEQ ID NO: 1236297 - RNA, 22 nt, Mycobacterium leprae
caagcgcuaugccauccaccgc

SEQ ID NO: 1236298 - RNA, 21 nt, Mycobacterium leprae
caagauugcagcccugagcac

SEQ ID NO: 1236299 - RNA, 13 nt, Mycobacterium leprae
caaguggcugcua

SEQ ID NO: 1236300 - RNA, 20 nt, Mycobacterium leprae
caagugccgcgggugcaguu

SEQ ID NO: 1236301 - RNA, 18 nt, Mycobacterium leprae
caaguguguucuacccag

SEQ ID NO: 1236302 - RNA, 16 nt, Mycobacterium leprae
caaguguuuccacacc

SEQ ID NO: 1236303 - RNA, 15 nt, Mycobacterium leprae
caagggauuccacug

SEQ ID NO: 1236304 - RNA, 16 nt, Mycobacterium leprae
caaucacgcccagcgc

SEQ ID NO: 1236305 - RNA, 18 nt, Mycobacterium leprae
caauaagaaagaauuuac

SEQ ID NO: 1236306 - RNA, 22 nt, Mycobacterium leprae
caagacugcguguucaucaucu

SEQ ID NO: 1236307 - RNA, 14 nt, Mycobacterium leprae
caagaucgaggcca

SEQ ID NO: 1236308 - RNA, 21 nt, Mycobacterium leprae
caagagugaaaguaggcacag

SEQ ID NO: 1236309 - RNA, 16 nt, Mycobacterium leprae
caagagcgagcucgag

SEQ ID NO: 1236310 - RNA, 17 nt, Mycobacterium leprae
caacguugaagcggggg

SEQ ID NO: 1236311 - RNA, 19 nt, Mycobacterium leprae
caacguguaaggccagcgc

SEQ ID NO: 1236312 - RNA, 18 nt, Mycobacterium leprae
caacucaucggcucccau

SEQ ID NO: 1236313 - RNA, 14 nt, Mycobacterium leprae
caacgccuccacug

SEQ ID NO: 1236314 - RNA, 23 nt, Mycobacterium leprae
caacgcaccgcguaacagauuau

SEQ ID NO: 1236315 - RNA, 17 nt, Mycobacterium leprae
caacggugagcggcaga

SEQ ID NO: 1236316 - RNA, 23 nt, Mycobacterium leprae
cacuacguuggccagcacggcgu

SEQ ID NO: 1236317 - RNA, 17 nt, Mycobacterium leprae
cacuagggaggucacca

SEQ ID NO: 1236318 - RNA, 21 nt, Mycobacterium leprae
cacuagggaggucaccaaguu

SEQ ID NO: 1236319 - RNA, 18 nt, Mycobacterium leprae
cacuacuguugucagugg

SEQ ID NO: 1236320 - RNA, 16 nt, Mycobacterium leprae
cacucauuggacccag

SEQ ID NO: 1236321 - RNA, 21 nt, Mycobacterium leprae
cacucaugaucgcaggcacca

SEQ ID NO: 1236322 - RNA, 20 nt, Mycobacterium leprae
cacugacggguggucuugau

SEQ ID NO: 1236323 - RNA, 15 nt, Mycobacterium leprae
cacuccgaccgagcg

SEQ ID NO: 1236324 - RNA, 21 nt, Mycobacterium leprae
cacuccgucacugucucacca

SEQ ID NO: 1236325 - RNA, 15 nt, Mycobacterium leprae
cacucucaucgcggc

SEQ ID NO: 1236326 - RNA, 23 nt, Mycobacterium leprae
cacucguagggaccgcugcggug

SEQ ID NO: 1236327 - RNA, 16 nt, Mycobacterium leprae
cacucgucacauuccu

SEQ ID NO: 1236328 - RNA, 16 nt, Mycobacterium leprae
cacuaacaccgugccg

SEQ ID NO: 1236329 - RNA, 12 nt, Mycobacterium leprae
cacuaaacugcg

SEQ ID NO: 1236330 - RNA, 12 nt, Mycobacterium leprae
cacguuggaugc

SEQ ID NO: 1236331 - RNA, 19 nt, Mycobacterium leprae
cacuaaaacuaacacuaac

SEQ ID NO: 1236332 - RNA, 17 nt, Mycobacterium leprae
cacuacccgacacaaag

SEQ ID NO: 1236333 - RNA, 15 nt, Mycobacterium leprae
cacguuacuuaugca

SEQ ID NO: 1236334 - RNA, 15 nt, Mycobacterium leprae
cacgugcaaacugcu

SEQ ID NO: 1236335 - RNA, 15 nt, Mycobacterium leprae
cacgugcugccccuc

SEQ ID NO: 1236336 - RNA, 11 nt, Mycobacterium leprae
cacguguggcc

SEQ ID NO: 1236337 - RNA, 22 nt, Mycobacterium leprae
cacguucgaucggcagccacgg

SEQ ID NO: 1236338 - RNA, 21 nt, Mycobacterium leprae
cacguugacggauuugcccca

SEQ ID NO: 1236339 - RNA, 19 nt, Mycobacterium leprae
cacgguugcccgcugccag

SEQ ID NO: 1236340 - RNA, 20 nt, Mycobacterium leprae
cacgucgccgguagcagcgg

SEQ ID NO: 1236341 - RNA, 22 nt, Mycobacterium leprae
cacgucgauucgcucgccgccc

SEQ ID NO: 1236342 - RNA, 14 nt, Mycobacterium leprae
cacggugcgugcca

SEQ ID NO: 1236343 - RNA, 19 nt, Mycobacterium leprae
cacggugccgaacugcugc

SEQ ID NO: 1236344 - RNA, 20 nt, Mycobacterium leprae
cacgggaggcguugcacugu

SEQ ID NO: 1236345 - RNA, 14 nt, Mycobacterium leprae
cacgcacacgacag

SEQ ID NO: 1236346 - RNA, 17 nt, Mycobacterium leprae
cacgcacacgacagccg

SEQ ID NO: 1236347 - RNA, 22 nt, Mycobacterium leprae
cacgauauccggggggagugau

SEQ ID NO: 1236348 - RNA, 13 nt, Mycobacterium leprae
cacgaugacaaga

SEQ ID NO: 1236349 - RNA, 19 nt, Mycobacterium leprae
cacgaugacaagagugaaa

SEQ ID NO: 1236350 - RNA, 14 nt, Mycobacterium leprae
cacgcaguuauugu

SEQ ID NO: 1236351 - RNA, 13 nt, Mycobacterium leprae
cacgccgacaccu

SEQ ID NO: 1236352 - RNA, 20 nt, Mycobacterium leprae
cacgccgaacagccgcgcca

SEQ ID NO: 1236353 - RNA, 17 nt, Mycobacterium leprae
cacgcugaucgcugaug

SEQ ID NO: 1236354 - RNA, 14 nt, Mycobacterium leprae
cacgcgaccaacgc

SEQ ID NO: 1236355 - RNA, 21 nt, Mycobacterium leprae
cacgccguuaguuucgggccu

SEQ ID NO: 1236356 - RNA, 17 nt, Mycobacterium leprae
cacgcgugcggcgccca

SEQ ID NO: 1236357 - RNA, 19 nt, Mycobacterium leprae
cacgcgugcggcgcccacc

SEQ ID NO: 1236358 - RNA, 11 nt, Mycobacterium leprae
cacgcgcgccu

SEQ ID NO: 1236359 - RNA, 14 nt, Mycobacterium leprae
cacgcuggccgccg

SEQ ID NO: 1236360 - RNA, 18 nt, Mycobacterium leprae
cacggagaucggcgugca

SEQ ID NO: 1236361 - RNA, 22 nt, Mycobacterium leprae
cacggcaacgguuacugccaca

SEQ ID NO: 1236362 - RNA, 13 nt, Mycobacterium leprae
cacggcaaaguca

SEQ ID NO: 1236363 - RNA, 15 nt, Mycobacterium leprae
cacggcggcaucuca

SEQ ID NO: 1236364 - RNA, 12 nt, Mycobacterium leprae
cacggcucgucc

SEQ ID NO: 1236365 - RNA, 19 nt, Mycobacterium leprae
cacccggcggcaugccugc

SEQ ID NO: 1236366 - RNA, 22 nt, Mycobacterium leprae
cacccggcggcaugccugcuug

SEQ ID NO: 1236367 - RNA, 23 nt, Mycobacterium leprae
cacccggcggcaugccugcuugc

SEQ ID NO: 1236368 - RNA, 15 nt, Mycobacterium leprae
cacccgcuggugcgu

SEQ ID NO: 1236369 - RNA, 21 nt, Mycobacterium leprae
cacccgcaugcccugggccag

SEQ ID NO: 1236370 - RNA, 21 nt, Mycobacterium leprae
cacccgcgauagcuugcaguu

SEQ ID NO: 1236371 - RNA, 17 nt, Mycobacterium leprae
cacccuggaauccgcgc

SEQ ID NO: 1236372 - RNA, 23 nt, Mycobacterium leprae
cacccgucgcugauacaacugga

SEQ ID NO: 1236373 - RNA, 20 nt, Mycobacterium leprae
caccgacaaagcucaggccg

SEQ ID NO: 1236374 - RNA, 16 nt, Mycobacterium leprae
caccgaauauuuucaa

SEQ ID NO: 1236375 - RNA, 13 nt, Mycobacterium leprae
caccgaacccaga

SEQ ID NO: 1236376 - RNA, 16 nt, Mycobacterium leprae
caccgaacccagacgc

SEQ ID NO: 1236377 - RNA, 14 nt, Mycobacterium leprae
caccgaucugccca

SEQ ID NO: 1236378 - RNA, 13 nt, Mycobacterium leprae
caccgccaccacg

SEQ ID NO: 1236379 - RNA, 14 nt, Mycobacterium leprae
caccgccaccuagg

SEQ ID NO: 1236380 - RNA, 17 nt, Mycobacterium leprae
caccgacuagcaggucu

SEQ ID NO: 1236381 - RNA, 17 nt, Mycobacterium leprae
caccgagacguugcugg

SEQ ID NO: 1236382 - RNA, 19 nt, Mycobacterium leprae
caccgagacguugcuggga

SEQ ID NO: 1236383 - RNA, 22 nt, Mycobacterium leprae
caccgacggaugcccagccagg

SEQ ID NO: 1236384 - RNA, 14 nt, Mycobacterium leprae
caccggacagcggc

SEQ ID NO: 1236385 - RNA, 21 nt, Mycobacterium leprae
caccgcuacggcgguguuucu

SEQ ID NO: 1236386 - RNA, 17 nt, Mycobacterium leprae
caccggccaaaagccuu

SEQ ID NO: 1236387 - RNA, 18 nt, Mycobacterium leprae
caccggcggcgagcaagc

SEQ ID NO: 1236388 - RNA, 22 nt, Mycobacterium leprae
caccggcgcuuguaaggccagc

SEQ ID NO: 1236389 - RNA, 14 nt, Mycobacterium leprae
caccggcugcaccc

SEQ ID NO: 1236390 - RNA, 16 nt, Mycobacterium leprae
caccggcugcacccgu

SEQ ID NO: 1236391 - RNA, 20 nt, Mycobacterium leprae
caccgccgagcgcaccaacu

SEQ ID NO: 1236392 - RNA, 15 nt, Mycobacterium leprae
caccgcgaagccguu

SEQ ID NO: 1236393 - RNA, 15 nt, Mycobacterium leprae
caccuugcgccccgc

SEQ ID NO: 1236394 - RNA, 15 nt, Mycobacterium leprae
caccugcgacagccg

SEQ ID NO: 1236395 - RNA, 15 nt, Mycobacterium leprae
caccuggugugcgcg

SEQ ID NO: 1236396 - RNA, 18 nt, Mycobacterium leprae
caccuggugugcgcgccg

SEQ ID NO: 1236397 - RNA, 22 nt, Mycobacterium leprae
caccuggugcccgacagccacc

SEQ ID NO: 1236398 - RNA, 15 nt, Mycobacterium leprae
cacgagaaugucgca

SEQ ID NO: 1236399 - RNA, 16 nt, Mycobacterium leprae
cacgagacccagccgu

SEQ ID NO: 1236400 - RNA, 21 nt, Mycobacterium leprae
cacgagcguuuagucaccgcc

SEQ ID NO: 1236401 - RNA, 17 nt, Mycobacterium leprae
cacgaccgucuggaaca

SEQ ID NO: 1236402 - RNA, 20 nt, Mycobacterium leprae
caccucuucgacaccgagca

SEQ ID NO: 1236403 - RNA, 19 nt, Mycobacterium leprae
caccuccacgguuggaugc

SEQ ID NO: 1236404 - RNA, 18 nt, Mycobacterium leprae
caccguaagucagaugga

SEQ ID NO: 1236405 - RNA, 16 nt, Mycobacterium leprae
caccagggauuccugu

SEQ ID NO: 1236406 - RNA, 11 nt, Mycobacterium leprae
caccagcucac

SEQ ID NO: 1236407 - RNA, 20 nt, Mycobacterium leprae
caccagcucacccgcagcac

SEQ ID NO: 1236408 - RNA, 23 nt, Mycobacterium leprae
cacccaguaugcaccgcggcggg

SEQ ID NO: 1236409 - RNA, 22 nt, Mycobacterium leprae
caccccgcggaguuggccgcgg

SEQ ID NO: 1236410 - RNA, 23 nt, Mycobacterium leprae
caccccuacccaaaucagcacca

SEQ ID NO: 1236411 - RNA, 13 nt, Mycobacterium leprae
cacccccgggauc

SEQ ID NO: 1236412 - RNA, 14 nt, Mycobacterium leprae
caccaugugcacag

SEQ ID NO: 1236413 - RNA, 15 nt, Mycobacterium leprae
caccaugugcacagu

SEQ ID NO: 1236414 - RNA, 20 nt, Mycobacterium leprae
cacccaaggauucagccaag

SEQ ID NO: 1236415 - RNA, 17 nt, Mycobacterium leprae
cacccaagggcuuccaa

SEQ ID NO: 1236416 - RNA, 18 nt, Mycobacterium leprae
cacccacaacgccaaacu

SEQ ID NO: 1236417 - RNA, 18 nt, Mycobacterium leprae
cacccacgcugcgcggcu

SEQ ID NO: 1236418 - RNA, 17 nt, Mycobacterium leprae
caccauccggcgggcgu

SEQ ID NO: 1236419 - RNA, 23 nt, Mycobacterium leprae
caccauggugcggcgccgcccgg

SEQ ID NO: 1236420 - RNA, 13 nt, Mycobacterium leprae
caccaucugcucu

SEQ ID NO: 1236421 - RNA, 15 nt, Mycobacterium leprae
caccacccugcgcug

SEQ ID NO: 1236422 - RNA, 20 nt, Mycobacterium leprae
caccaccaugcggcgccuga

SEQ ID NO: 1236423 - RNA, 14 nt, Mycobacterium leprae
caccaccgccaccu

SEQ ID NO: 1236424 - RNA, 23 nt, Mycobacterium leprae
caccacuguacggaauggccaug

SEQ ID NO: 1236425 - RNA, 20 nt, Mycobacterium leprae
caccacgcacacgacagccg

SEQ ID NO: 1236426 - RNA, 18 nt, Mycobacterium leprae
caccacucucaucgcggc

SEQ ID NO: 1236427 - RNA, 16 nt, Mycobacterium leprae
cacauucaaccagcca

SEQ ID NO: 1236428 - RNA, 17 nt, Mycobacterium leprae
cacauugggaucccacc

SEQ ID NO: 1236429 - RNA, 22 nt, Mycobacterium leprae
caccaagcccauccguccaccc

SEQ ID NO: 1236430 - RNA, 22 nt, Mycobacterium leprae
caccaagauugcggacaauuca

SEQ ID NO: 1236431 - RNA, 13 nt, Mycobacterium leprae
caccaacaguccc

SEQ ID NO: 1236432 - RNA, 17 nt, Mycobacterium leprae
cacaugugcgccagggg

SEQ ID NO: 1236433 - RNA, 22 nt, Mycobacterium leprae
cacaucucaacauggaccaccg

SEQ ID NO: 1236434 - RNA, 15 nt, Mycobacterium leprae
cacagaacgguucaa

SEQ ID NO: 1236435 - RNA, 14 nt, Mycobacterium leprae
cacagcaccaugga

SEQ ID NO: 1236436 - RNA, 10 nt, Mycobacterium leprae
cacagcagag

SEQ ID NO: 1236437 - RNA, 19 nt, Mycobacterium leprae
cacagcaagucgccuacac

SEQ ID NO: 1236438 - RNA, 14 nt, Mycobacterium leprae
cacagauucguacc

SEQ ID NO: 1236439 - RNA, 23 nt, Mycobacterium leprae
cacagccgcgcuagcgauguagc

SEQ ID NO: 1236440 - RNA, 18 nt, Mycobacterium leprae
cacagccguugcugcugc

SEQ ID NO: 1236441 - RNA, 15 nt, Mycobacterium leprae
cacagcaucaacgcg

SEQ ID NO: 1236442 - RNA, 22 nt, Mycobacterium leprae
cacaguuguuggccuugcugug

SEQ ID NO: 1236443 - RNA, 18 nt, Mycobacterium leprae
cacaggcagagccaaaca

SEQ ID NO: 1236444 - RNA, 13 nt, Mycobacterium leprae
cacaggacuucaa

SEQ ID NO: 1236445 - RNA, 15 nt, Mycobacterium leprae
cacaagcaacugcag

SEQ ID NO: 1236446 - RNA, 13 nt, Mycobacterium leprae
cacacagcggcca

SEQ ID NO: 1236447 - RNA, 20 nt, Mycobacterium leprae
cacaccuggugugcgcgccg

SEQ ID NO: 1236448 - RNA, 19 nt, Mycobacterium leprae
cacacgaagccucaucgaa

SEQ ID NO: 1236449 - RNA, 18 nt, Mycobacterium leprae
cacaccgacuagcagguc

SEQ ID NO: 1236450 - RNA, 13 nt, Mycobacterium leprae
cacacugugccug

SEQ ID NO: 1236451 - RNA, 20 nt, Mycobacterium leprae
cacacugucacgucggccug

SEQ ID NO: 1236452 - RNA, 17 nt, Mycobacterium leprae
cacacuaaaacgccccu

SEQ ID NO: 1236453 - RNA, 16 nt, Mycobacterium leprae
cacacuaaacugcgug

SEQ ID NO: 1236454 - RNA, 14 nt, Mycobacterium leprae
cacacugacuugca

SEQ ID NO: 1236455 - RNA, 18 nt, Mycobacterium leprae
cacaacgucagaagcugg

SEQ ID NO: 1236456 - RNA, 16 nt, Mycobacterium leprae
cacaacauccaaccaa

SEQ ID NO: 1236457 - RNA, 19 nt, Mycobacterium leprae
cacaacaagcgacuucgau

SEQ ID NO: 1236458 - RNA, 15 nt, Mycobacterium leprae
cacaaccagcuuggg

SEQ ID NO: 1236459 - RNA, 11 nt, Mycobacterium leprae
cacaaacucca

SEQ ID NO: 1236460 - RNA, 20 nt, Mycobacterium leprae
cacaaagaaguaaagcccug

SEQ ID NO: 1236461 - RNA, 14 nt, Mycobacterium leprae
cacaaacuccagag

SEQ ID NO: 1236462 - RNA, 14 nt, Mycobacterium leprae
caauuuggugauca

SEQ ID NO: 1236463 - RNA, 15 nt, Mycobacterium leprae
caauucaacgaauac

SEQ ID NO: 1236464 - RNA, 17 nt, Mycobacterium leprae
caauugacgccgaccgc

SEQ ID NO: 1236465 - RNA, 15 nt, Mycobacterium leprae
caauugaauccgcug

SEQ ID NO: 1236466 - RNA, 21 nt, Mycobacterium leprae
caauugacaacacgaucgcag

SEQ ID NO: 1236467 - RNA, 20 nt, Mycobacterium leprae
caauucggcgagcacuugca

SEQ ID NO: 1236468 - RNA, 18 nt, Mycobacterium leprae
caauucggagagacgugu

SEQ ID NO: 1236469 - RNA, 12 nt, Mycobacterium leprae
caauucgacugc

SEQ ID NO: 1236470 - RNA, 16 nt, Mycobacterium leprae
cauagaacaccgaagc

SEQ ID NO: 1236471 - RNA, 14 nt, Mycobacterium leprae
cauagcggccgcca

SEQ ID NO: 1236472 - RNA, 14 nt, Mycobacterium leprae
cauagugaccaaaa

SEQ ID NO: 1236473 - RNA, 23 nt, Mycobacterium leprae
cauagugcaagugcaccaucugc

SEQ ID NO: 1236474 - RNA, 19 nt, Mycobacterium leprae
caucagauauccuaggcca

SEQ ID NO: 1236475 - RNA, 19 nt, Mycobacterium leprae
caucuaaauccuagaaaau

SEQ ID NO: 1236476 - RNA, 17 nt, Mycobacterium leprae
caucgugaggugugacc

SEQ ID NO: 1236477 - RNA, 12 nt, Mycobacterium leprae
caucggcauccc

SEQ ID NO: 1236478 - RNA, 13 nt, Mycobacterium leprae
caucgaucagacc

SEQ ID NO: 1236479 - RNA, 14 nt, Mycobacterium leprae
caucgcaucugcca

SEQ ID NO: 1236480 - RNA, 21 nt, Mycobacterium leprae
caucgccgugguggcucgcgu

SEQ ID NO: 1236481 - RNA, 19 nt, Mycobacterium leprae
caucggacuaauggcaccc

SEQ ID NO: 1236482 - RNA, 15 nt, Mycobacterium leprae
cauccgccacaugug

SEQ ID NO: 1236483 - RNA, 14 nt, Mycobacterium leprae
cauccgcagcacua

SEQ ID NO: 1236484 - RNA, 20 nt, Mycobacterium leprae
cauccgacggcuucaucagu

SEQ ID NO: 1236485 - RNA, 17 nt, Mycobacterium leprae
cauccaggauagccgau

SEQ ID NO: 1236486 - RNA, 15 nt, Mycobacterium leprae
cauuguacugacugg

SEQ ID NO: 1236487 - RNA, 17 nt, Mycobacterium leprae
cauuggcucgacauugu

SEQ ID NO: 1236488 - RNA, 17 nt, Mycobacterium leprae
cauuggucggggugcug

SEQ ID NO: 1236489 - RNA, 15 nt, Mycobacterium leprae
cauuggugggaugag

SEQ ID NO: 1236490 - RNA, 23 nt, Mycobacterium leprae
cauuggccgcugguagguguucu

SEQ ID NO: 1236491 - RNA, 17 nt, Mycobacterium leprae
cauugcucgagucgauu

SEQ ID NO: 1236492 - RNA, 14 nt, Mycobacterium leprae
cauucaaccagcca

SEQ ID NO: 1236493 - RNA, 19 nt, Mycobacterium leprae
cauuauugucggucugccu

SEQ ID NO: 1236494 - RNA, 17 nt, Mycobacterium leprae
cauuacuacgcuagcaa

SEQ ID NO: 1236495 - RNA, 21 nt, Mycobacterium leprae
cauuaguucgagcgcccaagu

SEQ ID NO: 1236496 - RNA, 15 nt, Mycobacterium leprae
cauguuaaaauaaac

SEQ ID NO: 1236497 - RNA, 22 nt, Mycobacterium leprae
cauucaggugcuauuuguggau

SEQ ID NO: 1236498 - RNA, 13 nt, Mycobacterium leprae
cauucagccgcga

SEQ ID NO: 1236499 - RNA, 19 nt, Mycobacterium leprae
cauucagccgcgaauggac

SEQ ID NO: 1236500 - RNA, 21 nt, Mycobacterium leprae
cauucaccaguaaccacgcau

SEQ ID NO: 1236501 - RNA, 17 nt, Mycobacterium leprae
cauucgccguccacugg

SEQ ID NO: 1236502 - RNA, 20 nt, Mycobacterium leprae
cauuccccuagaacaggggg

SEQ ID NO: 1236503 - RNA, 18 nt, Mycobacterium leprae
caugucgaacaaccgaac

SEQ ID NO: 1236504 - RNA, 20 nt, Mycobacterium leprae
caugucccggugcugccugc

SEQ ID NO: 1236505 - RNA, 23 nt, Mycobacterium leprae
caugucgguggugggugcugcuu

SEQ ID NO: 1236506 - RNA, 14 nt, Mycobacterium leprae
caugucauggccuu

SEQ ID NO: 1236507 - RNA, 15 nt, Mycobacterium leprae
cauguaacacucauu

SEQ ID NO: 1236508 - RNA, 16 nt, Mycobacterium leprae
caugcuccgacacugg

SEQ ID NO: 1236509 - RNA, 16 nt, Mycobacterium leprae
caugcuggccuccagu

SEQ ID NO: 1236510 - RNA, 23 nt, Mycobacterium leprae
caugcugccgucgaucucggugc

SEQ ID NO: 1236511 - RNA, 13 nt, Mycobacterium leprae
caugcugcucccu

SEQ ID NO: 1236512 - RNA, 18 nt, Mycobacterium leprae
cauggcgaugcgcagccg

SEQ ID NO: 1236513 - RNA, 17 nt, Mycobacterium leprae
caugccagguccaaccg

SEQ ID NO: 1236514 - RNA, 16 nt, Mycobacterium leprae
caugccgcuugauuug

SEQ ID NO: 1236515 - RNA, 19 nt, Mycobacterium leprae
caugagcgucgcuccuucu

SEQ ID NO: 1236516 - RNA, 17 nt, Mycobacterium leprae
caugagucuucacucac

SEQ ID NO: 1236517 - RNA, 16 nt, Mycobacterium leprae
caugaucaauaccaca

SEQ ID NO: 1236518 - RNA, 16 nt, Mycobacterium leprae
caugauccguacacca

SEQ ID NO: 1236519 - RNA, 15 nt, Mycobacterium leprae
caugaaccucaccca

SEQ ID NO: 1236520 - RNA, 17 nt, Mycobacterium leprae
caugaaccucacccagu

SEQ ID NO: 1236521 - RNA, 21 nt, Mycobacterium leprae
caugacacccccgggaucucg

SEQ ID NO: 1236522 - RNA, 12 nt, Mycobacterium leprae
caugaauuacua

SEQ ID NO: 1236523 - RNA, 18 nt, Mycobacterium leprae
caugacggcgcaguugac

SEQ ID NO: 1236524 - RNA, 14 nt, Mycobacterium leprae
caugaccgagcugg

SEQ ID NO: 1236525 - RNA, 16 nt, Mycobacterium leprae
cauaaugccugcauug

SEQ ID NO: 1236526 - RNA, 14 nt, Mycobacterium leprae
caguucgugauggu

SEQ ID NO: 1236527 - RNA, 20 nt, Mycobacterium leprae
caguuuugugggcaggucag

SEQ ID NO: 1236528 - RNA, 15 nt, Mycobacterium leprae
cagugaugaucggca

SEQ ID NO: 1236529 - RNA, 15 nt, Mycobacterium leprae
cagugaugcggacga

SEQ ID NO: 1236530 - RNA, 22 nt, Mycobacterium leprae
cagugauuaaguagcaagccgc

SEQ ID NO: 1236531 - RNA, 20 nt, Mycobacterium leprae
cagugggugaaacccuucac

SEQ ID NO: 1236532 - RNA, 17 nt, Mycobacterium leprae
caguggcguggccguga

SEQ ID NO: 1236533 - RNA, 13 nt, Mycobacterium leprae
cagugcuagcagc

SEQ ID NO: 1236534 - RNA, 14 nt, Mycobacterium leprae
cagugccggaaccc

SEQ ID NO: 1236535 - RNA, 13 nt, Mycobacterium leprae
caguuccagugcc

SEQ ID NO: 1236536 - RNA, 12 nt, Mycobacterium leprae
caguucgacugg

SEQ ID NO: 1236537 - RNA, 13 nt, Mycobacterium leprae
caguucgacuggc

SEQ ID NO: 1236538 - RNA, 18 nt, Mycobacterium leprae
caguuagcaugagcugcu

SEQ ID NO: 1236539 - RNA, 20 nt, Mycobacterium leprae
caguucaauggugccgagcg

SEQ ID NO: 1236540 - RNA, 19 nt, Mycobacterium leprae
cagguucugcaccccaggc

SEQ ID NO: 1236541 - RNA, 20 nt, Mycobacterium leprae
cagguucugcaccccaggcu

SEQ ID NO: 1236542 - RNA, 14 nt, Mycobacterium leprae
cagguugaaaaaga

SEQ ID NO: 1236543 - RNA, 20 nt, Mycobacterium leprae
cagguuguggcaccagucgc

SEQ ID NO: 1236544 - RNA, 14 nt, Mycobacterium leprae
caguaucgaccagc

SEQ ID NO: 1236545 - RNA, 13 nt, Mycobacterium leprae
caguaccuccagc

SEQ ID NO: 1236546 - RNA, 15 nt, Mycobacterium leprae
caguccaccagaagu

SEQ ID NO: 1236547 - RNA, 16 nt, Mycobacterium leprae
caguccaccgccaggc

SEQ ID NO: 1236548 - RNA, 12 nt, Mycobacterium leprae
cagucaugaagc

SEQ ID NO: 1236549 - RNA, 21 nt, Mycobacterium leprae
caguaugugaugcagcuggag

SEQ ID NO: 1236550 - RNA, 14 nt, Mycobacterium leprae
caggucgaggacca

SEQ ID NO: 1236551 - RNA, 22 nt, Mycobacterium leprae
caggucgacuaacgcuucugcc

SEQ ID NO: 1236552 - RNA, 21 nt, Mycobacterium leprae
caggugagucgcccagcaggu

SEQ ID NO: 1236553 - RNA, 18 nt, Mycobacterium leprae
caggugaauuuuuuucug

SEQ ID NO: 1236554 - RNA, 18 nt, Mycobacterium leprae
caggugaaucggcgcaca

SEQ ID NO: 1236555 - RNA, 18 nt, Mycobacterium leprae
caggucaguuucaucgac

SEQ ID NO: 1236556 - RNA, 19 nt, Mycobacterium leprae
caggucagcggucacauug

SEQ ID NO: 1236557 - RNA, 14 nt, Mycobacterium leprae
cagguccacccgca

SEQ ID NO: 1236558 - RNA, 23 nt, Mycobacterium leprae
cagguauuuccuaaaauucaugc

SEQ ID NO: 1236559 - RNA, 22 nt, Mycobacterium leprae
caggucacccuccucgcggcgg

SEQ ID NO: 1236560 - RNA, 13 nt, Mycobacterium leprae
caggucaacagca

SEQ ID NO: 1236561 - RNA, 19 nt, Mycobacterium leprae
cagguagacgcgcuaaacc

SEQ ID NO: 1236562 - RNA, 21 nt, Mycobacterium leprae
cagguaauagaccgagucccc

SEQ ID NO: 1236563 - RNA, 19 nt, Mycobacterium leprae
cagggauaagcuugggaaa

SEQ ID NO: 1236564 - RNA, 14 nt, Mycobacterium leprae
caggcguccucauc

SEQ ID NO: 1236565 - RNA, 21 nt, Mycobacterium leprae
caggcuguacacuacuccugc

SEQ ID NO: 1236566 - RNA, 13 nt, Mycobacterium leprae
caggcuucgucac

SEQ ID NO: 1236567 - RNA, 13 nt, Mycobacterium leprae
caggcuguugugg

SEQ ID NO: 1236568 - RNA, 16 nt, Mycobacterium leprae
caggccugaucuccaa

SEQ ID NO: 1236569 - RNA, 21 nt, Mycobacterium leprae
caggccuggucguucauccuc

SEQ ID NO: 1236570 - RNA, 23 nt, Mycobacterium leprae
caggccugcuauccgcggugugu

SEQ ID NO: 1236571 - RNA, 13 nt, Mycobacterium leprae
caggaugcgugcc

SEQ ID NO: 1236572 - RNA, 18 nt, Mycobacterium leprae
caggcaaccgcccgcagu

SEQ ID NO: 1236573 - RNA, 19 nt, Mycobacterium leprae
caggcaccauugauggaac

SEQ ID NO: 1236574 - RNA, 19 nt, Mycobacterium leprae
caggccaccggugaugugg

SEQ ID NO: 1236575 - RNA, 13 nt, Mycobacterium leprae
caggccaggcagc

SEQ ID NO: 1236576 - RNA, 17 nt, Mycobacterium leprae
caggccaggcagcgccu

SEQ ID NO: 1236577 - RNA, 16 nt, Mycobacterium leprae
cagcugcguacggaga

SEQ ID NO: 1236578 - RNA, 16 nt, Mycobacterium leprae
cagcuggugcuggcgu

SEQ ID NO: 1236579 - RNA, 16 nt, Mycobacterium leprae
cagcugguggucacug

SEQ ID NO: 1236580 - RNA, 16 nt, Mycobacterium leprae
cagcuggugaccugac

SEQ ID NO: 1236581 - RNA, 23 nt, Mycobacterium leprae
cagcuggguaccgaugugcugga

SEQ ID NO: 1236582 - RNA, 13 nt, Mycobacterium leprae
cagcuaccagggu

SEQ ID NO: 1236583 - RNA, 17 nt, Mycobacterium leprae
cagcucacaauugacaa

SEQ ID NO: 1236584 - RNA, 21 nt, Mycobacterium leprae
cagcucacaauugacaacacg

SEQ ID NO: 1236585 - RNA, 18 nt, Mycobacterium leprae
cagcugccauuggccgcu

SEQ ID NO: 1236586 - RNA, 18 nt, Mycobacterium leprae
cagcugacgauuaucugc

SEQ ID NO: 1236587 - RNA, 23 nt, Mycobacterium leprae
cagcguaaucgcuuggugcugcu

SEQ ID NO: 1236588 - RNA, 16 nt, Mycobacterium leprae
cagcgucaccaagcgc

SEQ ID NO: 1236589 - RNA, 14 nt, Mycobacterium leprae
cagcggucacauug

SEQ ID NO: 1236590 - RNA, 16 nt, Mycobacterium leprae
cagcgguaacuggcuc

SEQ ID NO: 1236591 - RNA, 19 nt, Mycobacterium leprae
cagcgguacccgccaggau

SEQ ID NO: 1236592 - RNA, 19 nt, Mycobacterium leprae
cagcgucguggcugugaug

SEQ ID NO: 1236593 - RNA, 18 nt, Mycobacterium leprae
cagcgucgcucacggcca

SEQ ID NO: 1236594 - RNA, 23 nt, Mycobacterium leprae
cagcgucggacgccggaccccau

SEQ ID NO: 1236595 - RNA, 15 nt, Mycobacterium leprae
cagcgugaauuacuc

SEQ ID NO: 1236596 - RNA, 15 nt, Mycobacterium leprae
cagcgugacgacuug

SEQ ID NO: 1236597 - RNA, 15 nt, Mycobacterium leprae
cagcgugcaaauggc

SEQ ID NO: 1236598 - RNA, 17 nt, Mycobacterium leprae
cccaguucgugaugguc

SEQ ID NO: 1236599 - RNA, 21 nt, Mycobacterium leprae
cccaucaccggugcaccgucu

SEQ ID NO: 1236600 - RNA, 16 nt, Mycobacterium leprae
cccauccgggccaguc

SEQ ID NO: 1236601 - RNA, 14 nt, Mycobacterium leprae
cccaucggcggcca

SEQ ID NO: 1236602 - RNA, 13 nt, Mycobacterium leprae
cccaucgcugacc

SEQ ID NO: 1236603 - RNA, 22 nt, Mycobacterium leprae
cccaggccuguugcggccaagc

SEQ ID NO: 1236604 - RNA, 21 nt, Mycobacterium leprae
cccaguagucgcggguacccc

SEQ ID NO: 1236605 - RNA, 21 nt, Mycobacterium leprae
cccaggugucuuccaguggcu

SEQ ID NO: 1236606 - RNA, 23 nt, Mycobacterium leprae
ccccauagcgccucaaugcagac

SEQ ID NO: 1236607 - RNA, 18 nt, Mycobacterium leprae
ccccagucgccagagccg

SEQ ID NO: 1236608 - RNA, 22 nt, Mycobacterium leprae
ccccagucgccagagccggcgg

SEQ ID NO: 1236609 - RNA, 12 nt, Mycobacterium leprae
ccccugcggcua

SEQ ID NO: 1236610 - RNA, 12 nt, Mycobacterium leprae
ccccggccgccg

SEQ ID NO: 1236611 - RNA, 19 nt, Mycobacterium leprae
ccccggacccgagccgcag

SEQ ID NO: 1236612 - RNA, 12 nt, Mycobacterium leprae
ccccggccaggu

SEQ ID NO: 1236613 - RNA, 16 nt, Mycobacterium leprae
cccaagcaucccccgu

SEQ ID NO: 1236614 - RNA, 23 nt, Mycobacterium leprae
cccaauagagcagugcugacauc

SEQ ID NO: 1236615 - RNA, 21 nt, Mycobacterium leprae
cccaauucgacugcaacucga

SEQ ID NO: 1236616 - RNA, 18 nt, Mycobacterium leprae
cccaauggcggaggcugg

SEQ ID NO: 1236617 - RNA, 16 nt, Mycobacterium leprae
cccacuugggcaacac

SEQ ID NO: 1236618 - RNA, 21 nt, Mycobacterium leprae
cccacuugggcaacaccucaa

SEQ ID NO: 1236619 - RNA, 16 nt, Mycobacterium leprae
cccagaaccaucccaa

SEQ ID NO: 1236620 - RNA, 18 nt, Mycobacterium leprae
cccaccgcaacgccucca

SEQ ID NO: 1236621 - RNA, 15 nt, Mycobacterium leprae
cccacgacaucuuga

SEQ ID NO: 1236622 - RNA, 22 nt, Mycobacterium leprae
ccauuauuucgucgucagcugc

SEQ ID NO: 1236623 - RNA, 18 nt, Mycobacterium leprae
ccauuaguucgagcgccc

SEQ ID NO: 1236624 - RNA, 21 nt, Mycobacterium leprae
ccauucggaaucgcgugcuau

SEQ ID NO: 1236625 - RNA, 17 nt, Mycobacterium leprae
ccaugucuaagacacuu

SEQ ID NO: 1236626 - RNA, 18 nt, Mycobacterium leprae
ccaugugaccgcggugca

SEQ ID NO: 1236627 - RNA, 18 nt, Mycobacterium leprae
ccaugugcugacagacau

SEQ ID NO: 1236628 - RNA, 14 nt, Mycobacterium leprae
ccauggcagccgau

SEQ ID NO: 1236629 - RNA, 19 nt, Mycobacterium leprae
ccaucugcucucagcacau

SEQ ID NO: 1236630 - RNA, 15 nt, Mycobacterium leprae
ccaugccgcgcgccu

SEQ ID NO: 1236631 - RNA, 20 nt, Mycobacterium leprae
ccaugcagucgcucaggcua

SEQ ID NO: 1236632 - RNA, 14 nt, Mycobacterium leprae
ccaugaucuucuga

SEQ ID NO: 1236633 - RNA, 18 nt, Mycobacterium leprae
ccaugcaaccacacccug

SEQ ID NO: 1236634 - RNA, 19 nt, Mycobacterium leprae
ccaucucaucuugaccagu

SEQ ID NO: 1236635 - RNA, 20 nt, Mycobacterium leprae
ccaucuaacccgcaaaccaa

SEQ ID NO: 1236636 - RNA, 22 nt, Mycobacterium leprae
ccaucuaacccgcaaaccaaac

SEQ ID NO: 1236637 - RNA, 15 nt, Mycobacterium leprae
ccaucucuauuuggu

SEQ ID NO: 1236638 - RNA, 16 nt, Mycobacterium leprae
ccaucgaauccucgau

SEQ ID NO: 1236639 - RNA, 15 nt, Mycobacterium leprae
ccauccgggccaguc

SEQ ID NO: 1236640 - RNA, 22 nt, Mycobacterium leprae
ccauccgguuguguuguuggca

SEQ ID NO: 1236641 - RNA, 21 nt, Mycobacterium leprae
ccauccauuuauuccagagca

SEQ ID NO: 1236642 - RNA, 20 nt, Mycobacterium leprae
ccauagcacccucacccgac

SEQ ID NO: 1236643 - RNA, 14 nt, Mycobacterium leprae
ccauaaugcagcgg

SEQ ID NO: 1236644 - RNA, 18 nt, Mycobacterium leprae
ccauauacaaaccccaga

SEQ ID NO: 1236645 - RNA, 19 nt, Mycobacterium leprae
ccauauacaaaccccagac

SEQ ID NO: 1236646 - RNA, 22 nt, Mycobacterium leprae
ccauauaagcgaaguccuugcu

SEQ ID NO: 1236647 - RNA, 19 nt, Mycobacterium leprae
ccauauagcgucccagcuc

SEQ ID NO: 1236648 - RNA, 18 nt, Mycobacterium leprae
ccaguacaauauugacca

SEQ ID NO: 1236649 - RNA, 21 nt, Mycobacterium leprae
ccaguacccgugcccaagacu

SEQ ID NO: 1236650 - RNA, 13 nt, Mycobacterium leprae
ccaguggcugcac

SEQ ID NO: 1236651 - RNA, 15 nt, Mycobacterium leprae
ccaguggcugcaccg

SEQ ID NO: 1236652 - RNA, 18 nt, Mycobacterium leprae
ccagugugccugucacau

SEQ ID NO: 1236653 - RNA, 17 nt, Mycobacterium leprae
ccaguuuugugggcagg

SEQ ID NO: 1236654 - RNA, 14 nt, Mycobacterium leprae
ccagcuucgcagac

SEQ ID NO: 1236655 - RNA, 18 nt, Mycobacterium leprae
ccagcuucgcagacacag

SEQ ID NO: 1236656 - RNA, 21 nt, Mycobacterium leprae
ccaggagaagcgcugcagcga

SEQ ID NO: 1236657 - RNA, 19 nt, Mycobacterium leprae
ccagcuuucgcacccagca

SEQ ID NO: 1236658 - RNA, 12 nt, Mycobacterium leprae
ccagcuugggag

SEQ ID NO: 1236659 - RNA, 19 nt, Mycobacterium leprae
ccagcguaaacgugaugcu

SEQ ID NO: 1236660 - RNA, 20 nt, Mycobacterium leprae
ccagcucacaauugacaaca

SEQ ID NO: 1236661 - RNA, 17 nt, Mycobacterium leprae
ccaggugucuuccagug

SEQ ID NO: 1236662 - RNA, 12 nt, Mycobacterium leprae
ccaggugcugca

SEQ ID NO: 1236663 - RNA, 22 nt, Mycobacterium leprae
ccaggcgccgcagcaucugucg

SEQ ID NO: 1236664 - RNA, 21 nt, Mycobacterium leprae
ccagggaugcugggucagcau

SEQ ID NO: 1236665 - RNA, 24 nt, Mycobacterium leprae
ccagggauuccuguucuacaucca

SEQ ID NO: 1236666 - RNA, 13 nt, Mycobacterium leprae
ccacgucgcccaa

SEQ ID NO: 1236667 - RNA, 15 nt, Mycobacterium leprae
ccacgucgaucagcg

SEQ ID NO: 1236668 - RNA, 19 nt, Mycobacterium leprae
ccacgucgccguuuccgcu

SEQ ID NO: 1236669 - RNA, 19 nt, Mycobacterium leprae
ccagagauuucgcaggcug

SEQ ID NO: 1236670 - RNA, 16 nt, Mycobacterium leprae
ccagagcuguugucgc

SEQ ID NO: 1236671 - RNA, 21 nt, Mycobacterium leprae
ccagacccuuguagcccuccg

SEQ ID NO: 1236672 - RNA, 12 nt, Mycobacterium leprae
ccagcacccgca

SEQ ID NO: 1236673 - RNA, 21 nt, Mycobacterium leprae
ccagccaggaugcggcccagu

SEQ ID NO: 1236674 - RNA, 14 nt, Mycobacterium leprae
ccagccaacggcua

SEQ ID NO: 1236675 - RNA, 15 nt, Mycobacterium leprae
ccacauguuuccggc

SEQ ID NO: 1236676 - RNA, 17 nt, Mycobacterium leprae
ccacauaugccgccaug

SEQ ID NO: 1236677 - RNA, 22 nt, Mycobacterium leprae
ccacauugaccacgccgacacc

SEQ ID NO: 1236678 - RNA, 13 nt, Mycobacterium leprae
ccaccaccgccac

SEQ ID NO: 1236679 - RNA, 19 nt, Mycobacterium leprae
ccacccaaggauucagcca

SEQ ID NO: 1236680 - RNA, 11 nt, Mycobacterium leprae
ccaccauguuu

SEQ ID NO: 1236681 - RNA, 15 nt, Mycobacterium leprae
ccacccacggcuguc

SEQ ID NO: 1236682 - RNA, 13 nt, Mycobacterium leprae
ccaccacucucau

SEQ ID NO: 1236683 - RNA, 19 nt, Mycobacterium leprae
ccaccguuacggccauguc

SEQ ID NO: 1236684 - RNA, 16 nt, Mycobacterium leprae
ccaccgacaugcuuac

SEQ ID NO: 1236685 - RNA, 18 nt, Mycobacterium leprae
ccacggcgucggcguacu

SEQ ID NO: 1236686 - RNA, 17 nt, Mycobacterium leprae
ccacggcagcgucacca

SEQ ID NO: 1236687 - RNA, 18 nt, Mycobacterium leprae
ccaauucgccgaccacau

SEQ ID NO: 1236688 - RNA, 22 nt, Mycobacterium leprae
ccaauucguaauuccugcagcc

SEQ ID NO: 1236689 - RNA, 18 nt, Mycobacterium leprae
ccaauucacgaacaacag

SEQ ID NO: 1236690 - RNA, 21 nt, Mycobacterium leprae
ccaauguugagugcgaccuga

SEQ ID NO: 1236691 - RNA, 17 nt, Mycobacterium leprae
ccaaugcagcaacgugc

SEQ ID NO: 1236692 - RNA, 21 nt, Mycobacterium leprae
ccaaugcagcaacgugcaguc

SEQ ID NO: 1236693 - RNA, 18 nt, Mycobacterium leprae
ccacaagcaacugcagcu

SEQ ID NO: 1236694 - RNA, 19 nt, Mycobacterium leprae
ccacaagcaacugcagcua

SEQ ID NO: 1236695 - RNA, 23 nt, Mycobacterium leprae
ccacaagcagaauuggagugaag

SEQ ID NO: 1236696 - RNA, 13 nt, Mycobacterium leprae
ccaauugccuggc

SEQ ID NO: 1236697 - RNA, 17 nt, Mycobacterium leprae
ccaauugccauccucga

SEQ ID NO: 1236698 - RNA, 19 nt, Mycobacterium leprae
ccacacucgaccuccgcua

SEQ ID NO: 1236699 - RNA, 19 nt, Mycobacterium leprae
ccacagaaccuucaucgga

SEQ ID NO: 1236700 - RNA, 19 nt, Mycobacterium leprae
ccacagucacgccugaugc

SEQ ID NO: 1236701 - RNA, 15 nt, Mycobacterium leprae
ccacaggcagagcca

SEQ ID NO: 1236702 - RNA, 17 nt, Mycobacterium leprae
ccacagcgacggaucug

SEQ ID NO: 1236703 - RNA, 21 nt, Mycobacterium leprae
ccaauaagagguaaugcugcc

SEQ ID NO: 1236704 - RNA, 22 nt, Mycobacterium leprae
ccaauccaccgugcuggucuug

SEQ ID NO: 1236705 - RNA, 14 nt, Mycobacterium leprae
ccaaucuuugacca

SEQ ID NO: 1236706 - RNA, 22 nt, Mycobacterium leprae
ccaaucuguuccgcgugugccg

SEQ ID NO: 1236707 - RNA, 21 nt, Mycobacterium leprae
ccaagcguuacagccgagggu

SEQ ID NO: 1236708 - RNA, 18 nt, Mycobacterium leprae
ccaagccgcccggccugc

SEQ ID NO: 1236709 - RNA, 14 nt, Mycobacterium leprae
ccaagaaguacagu

SEQ ID NO: 1236710 - RNA, 22 nt, Mycobacterium leprae
ccaagauagcgcagacaauucg

SEQ ID NO: 1236711 - RNA, 17 nt, Mycobacterium leprae
ccaagaccaccugucug

SEQ ID NO: 1236712 - RNA, 23 nt, Mycobacterium leprae
ccaagacucagugaagaccaucu

SEQ ID NO: 1236713 - RNA, 18 nt, Mycobacterium leprae
ccaaguauacuagacuuu

SEQ ID NO: 1236714 - RNA, 16 nt, Mycobacterium leprae
ccaaguggcugcuaug

SEQ ID NO: 1236715 - RNA, 19 nt, Mycobacterium leprae
ccaagcuguuucuguauua

SEQ ID NO: 1236716 - RNA, 18 nt, Mycobacterium leprae
ccaaggaaugguuguagc

SEQ ID NO: 1236717 - RNA, 19 nt, Mycobacterium leprae
ccaacagccaaugucacau

SEQ ID NO: 1236718 - RNA, 15 nt, Mycobacterium leprae
ccaaccacagcaaua

SEQ ID NO: 1236719 - RNA, 12 nt, Mycobacterium leprae
ccaacuguugcu

SEQ ID NO: 1236720 - RNA, 21 nt, Mycobacterium leprae
ccaacuaggauagauccacca

SEQ ID NO: 1236721 - RNA, 14 nt, Mycobacterium leprae
ccaacucggccgcc

SEQ ID NO: 1236722 - RNA, 15 nt, Mycobacterium leprae
ccaacucggccgcca

SEQ ID NO: 1236723 - RNA, 13 nt, Mycobacterium leprae
ccaaccugugcau

SEQ ID NO: 1236724 - RNA, 19 nt, Mycobacterium leprae
ccaacgauacugaugggca

SEQ ID NO: 1236725 - RNA, 22 nt, Mycobacterium leprae
ccaaccguaguguuuuaccagc

SEQ ID NO: 1236726 - RNA, 16 nt, Mycobacterium leprae
ccaaacacggccagcg

SEQ ID NO: 1236727 - RNA, 14 nt, Mycobacterium leprae
ccaaaauggcacga

SEQ ID NO: 1236728 - RNA, 18 nt, Mycobacterium leprae
ccaaaccucugcaaccga

SEQ ID NO: 1236729 - RNA, 19 nt, Mycobacterium leprae
cgacaccucaccaucuuug

SEQ ID NO: 1236730 - RNA, 15 nt, Mycobacterium leprae
cgacacuugccgcgu

SEQ ID NO: 1236731 - RNA, 14 nt, Mycobacterium leprae
cgacacuggacugu

SEQ ID NO: 1236732 - RNA, 21 nt, Mycobacterium leprae
cgaauauggcuaugacaagac

SEQ ID NO: 1236733 - RNA, 21 nt, Mycobacterium leprae
cgaauaugcccagcagauggc

SEQ ID NO: 1236734 - RNA, 13 nt, Mycobacterium leprae
cgaaucaccgcug

SEQ ID NO: 1236735 - RNA, 14 nt, Mycobacterium leprae
cgaauccucgaugg

SEQ ID NO: 1236736 - RNA, 16 nt, Mycobacterium leprae
cgaaucgcuagcgauu

SEQ ID NO: 1236737 - RNA, 13 nt, Mycobacterium leprae
cgaaucgaguggc

SEQ ID NO: 1236738 - RNA, 16 nt, Mycobacterium leprae
cgaauugaccgacggc

SEQ ID NO: 1236739 - RNA, 18 nt, Mycobacterium leprae
cgaagugcuugggcacgc

SEQ ID NO: 1236740 - RNA, 20 nt, Mycobacterium leprae
cgaaggggucgaugaggcuc

SEQ ID NO: 1236741 - RNA, 19 nt, Mycobacterium leprae
cgaagggaaugcgucagug

SEQ ID NO: 1236742 - RNA, 18 nt, Mycobacterium leprae
cgaagcgauugggugggc

SEQ ID NO: 1236743 - RNA, 16 nt, Mycobacterium leprae
cgaagcgcagcgaagc

SEQ ID NO: 1236744 - RNA, 14 nt, Mycobacterium leprae
cgaacgugcugcug

SEQ ID NO: 1236745 - RNA, 15 nt, Mycobacterium leprae
cgaacguaccaccgc

SEQ ID NO: 1236746 - RNA, 15 nt, Mycobacterium leprae
cgaacugggugacca

SEQ ID NO: 1236747 - RNA, 18 nt, Mycobacterium leprae
cgaacugggugaccaccc

SEQ ID NO: 1236748 - RNA, 19 nt, Mycobacterium leprae
cgaacugggugaccaccca

SEQ ID NO: 1236749 - RNA, 21 nt, Mycobacterium leprae
cgaagacaucgaaucgagugg

SEQ ID NO: 1236750 - RNA, 17 nt, Mycobacterium leprae
cgaagacauaucaacaa

SEQ ID NO: 1236751 - RNA, 19 nt, Mycobacterium leprae
cgaagaucaccgccaccac

SEQ ID NO: 1236752 - RNA, 14 nt, Mycobacterium leprae
cgaagccaaaaacu

SEQ ID NO: 1236753 - RNA, 12 nt, Mycobacterium leprae
cgacagccugcc

SEQ ID NO: 1236754 - RNA, 23 nt, Mycobacterium leprae
cgacaggagcuucaacaccaugg

SEQ ID NO: 1236755 - RNA, 19 nt, Mycobacterium leprae
cgacaggaaaccuuccggc

SEQ ID NO: 1236756 - RNA, 24 nt, Mycobacterium leprae
cgacaggaaaccuuccggcgguca

SEQ ID NO: 1236757 - RNA, 14 nt, Mycobacterium leprae
cgacagcacccagc

SEQ ID NO: 1236758 - RNA, 16 nt, Mycobacterium leprae
cgacauucaccaguaa

SEQ ID NO: 1236759 - RNA, 23 nt, Mycobacterium leprae
cgacaugacagcucggacaagau

SEQ ID NO: 1236760 - RNA, 22 nt, Mycobacterium leprae
cgacauagugcaagugcaccau

SEQ ID NO: 1236761 - RNA, 16 nt, Mycobacterium leprae
cgacaucccagcaacg

SEQ ID NO: 1236762 - RNA, 15 nt, Mycobacterium leprae
cgaccaccagggccg

SEQ ID NO: 1236763 - RNA, 14 nt, Mycobacterium leprae
cgaccagccaagcc

SEQ ID NO: 1236764 - RNA, 14 nt, Mycobacterium leprae
cgaccagccacgca

SEQ ID NO: 1236765 - RNA, 20 nt, Mycobacterium leprae
cgaccugucgauacggccaa

SEQ ID NO: 1236766 - RNA, 19 nt, Mycobacterium leprae
cgaccuugccgaagcucug

SEQ ID NO: 1236767 - RNA, 20 nt, Mycobacterium leprae
cgaccuugccgaagcucugg

SEQ ID NO: 1236768 - RNA, 14 nt, Mycobacterium leprae
cgacgaaaacgucc

SEQ ID NO: 1236769 - RNA, 20 nt, Mycobacterium leprae
cgacgaccuccgcagcaucg

SEQ ID NO: 1236770 - RNA, 18 nt, Mycobacterium leprae
cgacgcagaccgggcgcc

SEQ ID NO: 1236771 - RNA, 18 nt, Mycobacterium leprae
cgacgcaacugcuggagg

SEQ ID NO: 1236772 - RNA, 15 nt, Mycobacterium leprae
cgacgaggucgccgc

SEQ ID NO: 1236773 - RNA, 17 nt, Mycobacterium leprae
cgacgaggucgccgccg

SEQ ID NO: 1236774 - RNA, 13 nt, Mycobacterium leprae
cgacgccggccgu

SEQ ID NO: 1236775 - RNA, 19 nt, Mycobacterium leprae
cgaccugcaacgcugcaag

SEQ ID NO: 1236776 - RNA, 16 nt, Mycobacterium leprae
cgaccuccgcagcauc

SEQ ID NO: 1236777 - RNA, 11 nt, Mycobacterium leprae
cgaccuccgcu

SEQ ID NO: 1236778 - RNA, 15 nt, Mycobacterium leprae
cgaccgaccaaccgu

SEQ ID NO: 1236779 - RNA, 15 nt, Mycobacterium leprae
cgaccgcaccggcga

SEQ ID NO: 1236780 - RNA, 11 nt, Mycobacterium leprae
cgaacccucac

SEQ ID NO: 1236781 - RNA, 13 nt, Mycobacterium leprae
cgaaccggacagc

SEQ ID NO: 1236782 - RNA, 15 nt, Mycobacterium leprae
cgaaccggacagcac

SEQ ID NO: 1236783 - RNA, 17 nt, Mycobacterium leprae
cgaaccggacagcaccc

SEQ ID NO: 1236784 - RNA, 21 nt, Mycobacterium leprae
cgaacaggccguuguuggagc

SEQ ID NO: 1236785 - RNA, 22 nt, Mycobacterium leprae
cgaacagcggggauaggagccc

SEQ ID NO: 1236786 - RNA, 13 nt, Mycobacterium leprae
cgaaagaugcugc

SEQ ID NO: 1236787 - RNA, 21 nt, Mycobacterium leprae
cgaaacgcuauggauacucaa

SEQ ID NO: 1236788 - RNA, 21 nt, Mycobacterium leprae
cgaacacccuggaauccgcgc

SEQ ID NO: 1236789 - RNA, 15 nt, Mycobacterium leprae
cgaaaaccacaagca

SEQ ID NO: 1236790 - RNA, 16 nt, Mycobacterium leprae
cgaaaccauggucuua

SEQ ID NO: 1236791 - RNA, 14 nt, Mycobacterium leprae
ccuuuuccauugga

SEQ ID NO: 1236792 - RNA, 19 nt, Mycobacterium leprae
ccuuuugcccaaugcagca

SEQ ID NO: 1236793 - RNA, 18 nt, Mycobacterium leprae
ccuuugacgaaaauguuu

SEQ ID NO: 1236794 - RNA, 21 nt, Mycobacterium leprae
ccuuuagcuugguugacagca

SEQ ID NO: 1236795 - RNA, 17 nt, Mycobacterium leprae
ccuugcuggugaucagg

SEQ ID NO: 1236796 - RNA, 18 nt, Mycobacterium leprae
ccuugcggcgccccucug

SEQ ID NO: 1236797 - RNA, 14 nt, Mycobacterium leprae
ccuugccgcuccgc

SEQ ID NO: 1236798 - RNA, 23 nt, Mycobacterium leprae
ccuugcaaaacgucgaucucgac

SEQ ID NO: 1236799 - RNA, 19 nt, Mycobacterium leprae
ccuuggaaccaucaacggc

SEQ ID NO: 1236800 - RNA, 13 nt, Mycobacterium leprae
ccuuggugcgggc

SEQ ID NO: 1236801 - RNA, 11 nt, Mycobacterium leprae
ccuuggguggu

SEQ ID NO: 1236802 - RNA, 14 nt, Mycobacterium leprae
ccuugguguugcug

SEQ ID NO: 1236803 - RNA, 17 nt, Mycobacterium leprae
ccugugggucaccacug

SEQ ID NO: 1236804 - RNA, 20 nt, Mycobacterium leprae
ccuuccggccuccggugccc

SEQ ID NO: 1236805 - RNA, 19 nt, Mycobacterium leprae
ccuucuaugacaacgguga

SEQ ID NO: 1236806 - RNA, 15 nt, Mycobacterium leprae
cgcaugccaaccugu

SEQ ID NO: 1236807 - RNA, 21 nt, Mycobacterium leprae
cgcaucaacaccaaaugugcu

SEQ ID NO: 1236808 - RNA, 20 nt, Mycobacterium leprae
cgcaguguuucuuaccccgc

SEQ ID NO: 1236809 - RNA, 13 nt, Mycobacterium leprae
cgcagcacuaaag

SEQ ID NO: 1236810 - RNA, 14 nt, Mycobacterium leprae
cgcagcaagcggcc

SEQ ID NO: 1236811 - RNA, 14 nt, Mycobacterium leprae
cgcaggucacccuc

SEQ ID NO: 1236812 - RNA, 18 nt, Mycobacterium leprae
cgcagggcgcgcagcugg

SEQ ID NO: 1236813 - RNA, 23 nt, Mycobacterium leprae
cgcauuaccugguucuuuugauu

SEQ ID NO: 1236814 - RNA, 16 nt, Mycobacterium leprae
cgccaaacacggccag

SEQ ID NO: 1236815 - RNA, 20 nt, Mycobacterium leprae
cgccaaacuggucaacgcag

SEQ ID NO: 1236816 - RNA, 13 nt, Mycobacterium leprae
cgccagaccggcg

SEQ ID NO: 1236817 - RNA, 15 nt, Mycobacterium leprae
cgccagaccugccgg

SEQ ID NO: 1236818 - RNA, 20 nt, Mycobacterium leprae
cgcaaccgccggcaagcccg

SEQ ID NO: 1236819 - RNA, 14 nt, Mycobacterium leprae
cgcaaccccgugcc

SEQ ID NO: 1236820 - RNA, 12 nt, Mycobacterium leprae
cgcaacagucag

SEQ ID NO: 1236821 - RNA, 17 nt, Mycobacterium leprae
cgcaacagucagccgcg

SEQ ID NO: 1236822 - RNA, 19 nt, Mycobacterium leprae
cgcacaucgguaggccuga

SEQ ID NO: 1236823 - RNA, 21 nt, Mycobacterium leprae
cgcaauuuggugaucacgguu

SEQ ID NO: 1236824 - RNA, 18 nt, Mycobacterium leprae
cgcacaaaaauccuccca

SEQ ID NO: 1236825 - RNA, 17 nt, Mycobacterium leprae
cgcaaucuacuggaugc

SEQ ID NO: 1236826 - RNA, 19 nt, Mycobacterium leprae
cgcaaucgaaaaaugccgg

SEQ ID NO: 1236827 - RNA, 18 nt, Mycobacterium leprae
cgcagaaugugcucugac

SEQ ID NO: 1236828 - RNA, 15 nt, Mycobacterium leprae
cgcacguaguuguac

SEQ ID NO: 1236829 - RNA, 16 nt, Mycobacterium leprae
cgcacguaagcauguc

SEQ ID NO: 1236830 - RNA, 16 nt, Mycobacterium leprae
cgcagagcucacuggg

SEQ ID NO: 1236831 - RNA, 20 nt, Mycobacterium leprae
cgcagauaucgcacacagcg

SEQ ID NO: 1236832 - RNA, 17 nt, Mycobacterium leprae
cgcaccggcguuccggc

SEQ ID NO: 1236833 - RNA, 22 nt, Mycobacterium leprae
cgcaccggcugaggcggccggc

SEQ ID NO: 1236834 - RNA, 22 nt, Mycobacterium leprae
cgauuuggauggucggcagcug

SEQ ID NO: 1236835 - RNA, 22 nt, Mycobacterium leprae
cgauugggucagucagcgugcc

SEQ ID NO: 1236836 - RNA, 15 nt, Mycobacterium leprae
cgaugugcagcagcu

SEQ ID NO: 1236837 - RNA, 22 nt, Mycobacterium leprae
cgauguuuuggaccgcgccgcg

SEQ ID NO: 1236838 - RNA, 11 nt, Mycobacterium leprae
cgauucugccc

SEQ ID NO: 1236839 - RNA, 15 nt, Mycobacterium leprae
cgauuccuggaaaga

SEQ ID NO: 1236840 - RNA, 19 nt, Mycobacterium leprae
cgauuccuggaaagaguua

SEQ ID NO: 1236841 - RNA, 14 nt, Mycobacterium leprae
cgaugccgugguga

SEQ ID NO: 1236842 - RNA, 19 nt, Mycobacterium leprae
cgaugcgagugugaaaaag

SEQ ID NO: 1236843 - RNA, 23 nt, Mycobacterium leprae
cgauggcgguguuagcaugcuug

SEQ ID NO: 1236844 - RNA, 18 nt, Mycobacterium leprae
cgauagcacuuaaguggc

SEQ ID NO: 1236845 - RNA, 17 nt, Mycobacterium leprae
cgauaugagcuccacug

SEQ ID NO: 1236846 - RNA, 19 nt, Mycobacterium leprae
cgagugcuggucaacagug

SEQ ID NO: 1236847 - RNA, 14 nt, Mycobacterium leprae
cgagugguccccug

SEQ ID NO: 1236848 - RNA, 12 nt, Mycobacterium leprae
cgaggucuuggu

SEQ ID NO: 1236849 - RNA, 20 nt, Mycobacterium leprae
cgagcgauggcugccgggcg

SEQ ID NO: 1236850 - RNA, 15 nt, Mycobacterium leprae
cgagcuaaacagcaa

SEQ ID NO: 1236851 - RNA, 15 nt, Mycobacterium leprae
cgagcucuggucugg

SEQ ID NO: 1236852 - RNA, 16 nt, Mycobacterium leprae
cgagcggaccauggcg

SEQ ID NO: 1236853 - RNA, 14 nt, Mycobacterium leprae
cgagcggagcuggg

SEQ ID NO: 1236854 - RNA, 15 nt, Mycobacterium leprae
cgagcggagcugggc

SEQ ID NO: 1236855 - RNA, 18 nt, Mycobacterium leprae
cgagcuggggcggccgcc

SEQ ID NO: 1236856 - RNA, 14 nt, Mycobacterium leprae
cgagcuggcugugc

SEQ ID NO: 1236857 - RNA, 16 nt, Mycobacterium leprae
cgaggaaugccugggu

SEQ ID NO: 1236858 - RNA, 18 nt, Mycobacterium leprae
cgaggccuuggguggugg

SEQ ID NO: 1236859 - RNA, 23 nt, Mycobacterium leprae
cgaggcgcuaggacaacagagca

SEQ ID NO: 1236860 - RNA, 13 nt, Mycobacterium leprae
cgaggcaggacug

SEQ ID NO: 1236861 - RNA, 14 nt, Mycobacterium leprae
cgacuacccgagua

SEQ ID NO: 1236862 - RNA, 15 nt, Mycobacterium leprae
cgacuaauuguggcu

SEQ ID NO: 1236863 - RNA, 16 nt, Mycobacterium leprae
cgacguuuugucuucu

SEQ ID NO: 1236864 - RNA, 18 nt, Mycobacterium leprae
cgacuaacgcuucugccu

SEQ ID NO: 1236865 - RNA, 15 nt, Mycobacterium leprae
cgacuaagccgccga

SEQ ID NO: 1236866 - RNA, 23 nt, Mycobacterium leprae
cgacuaagccgccgaacaagcca

SEQ ID NO: 1236867 - RNA, 16 nt, Mycobacterium leprae
cgacuauuagugugga

SEQ ID NO: 1236868 - RNA, 21 nt, Mycobacterium leprae
cgacuucgguccgcucaccgc

SEQ ID NO: 1236869 - RNA, 14 nt, Mycobacterium leprae
cgacuguuguugua

SEQ ID NO: 1236870 - RNA, 20 nt, Mycobacterium leprae
cgacuugaccagccgcagca

SEQ ID NO: 1236871 - RNA, 23 nt, Mycobacterium leprae
cgacuugaccagccgcagcaccc

SEQ ID NO: 1236872 - RNA, 19 nt, Mycobacterium leprae
cgacuugcugccacauguu

SEQ ID NO: 1236873 - RNA, 13 nt, Mycobacterium leprae
cgagaaaacucga

SEQ ID NO: 1236874 - RNA, 17 nt, Mycobacterium leprae
cgagaaaaucagaugua

SEQ ID NO: 1236875 - RNA, 20 nt, Mycobacterium leprae
cgacugaccagcgaucgacc

SEQ ID NO: 1236876 - RNA, 20 nt, Mycobacterium leprae
cgacgcggaaagcuucuggu

SEQ ID NO: 1236877 - RNA, 21 nt, Mycobacterium leprae
cgacgcuauguuggccagcag

SEQ ID NO: 1236878 - RNA, 17 nt, Mycobacterium leprae
cgacggcgcggcugcuu

SEQ ID NO: 1236879 - RNA, 14 nt, Mycobacterium leprae
cgacggcggccgcc

SEQ ID NO: 1236880 - RNA, 22 nt, Mycobacterium leprae
cgacgguaaguuuucagccaca

SEQ ID NO: 1236881 - RNA, 22 nt, Mycobacterium leprae
cgacggcuggcugcugcagacc

SEQ ID NO: 1236882 - RNA, 20 nt, Mycobacterium leprae
cgagacccagccgugguggu

SEQ ID NO: 1236883 - RNA, 20 nt, Mycobacterium leprae
cgagacaugauugcagaugu

SEQ ID NO: 1236884 - RNA, 23 nt, Mycobacterium leprae
cgagaucaacguuuugccgagca

SEQ ID NO: 1236885 - RNA, 21 nt, Mycobacterium leprae
cgagcaguaguccucugcggu

SEQ ID NO: 1236886 - RNA, 16 nt, Mycobacterium leprae
cgagccccggaacggg

SEQ ID NO: 1236887 - RNA, 16 nt, Mycobacterium leprae
cgagcagccacccgca

SEQ ID NO: 1236888 - RNA, 18 nt, Mycobacterium leprae
cgagcaaccaacuucacu

SEQ ID NO: 1236889 - RNA, 11 nt, Mycobacterium leprae
cgagcaaccuu

SEQ ID NO: 1236890 - RNA, 18 nt, Mycobacterium leprae
cgagcaaccuuggucugc

SEQ ID NO: 1236891 - RNA, 20 nt, Mycobacterium leprae
ccugggccagcgaucuaccu

SEQ ID NO: 1236892 - RNA, 20 nt, Mycobacterium leprae
ccugcguucgguagcgcgcu

SEQ ID NO: 1236893 - RNA, 21 nt, Mycobacterium leprae
ccuggguguucauggcgcgcu

SEQ ID NO: 1236894 - RNA, 20 nt, Mycobacterium leprae
ccugggugaaucgccuaaag

SEQ ID NO: 1236895 - RNA, 21 nt, Mycobacterium leprae
ccuggggcugcauugugcugc

SEQ ID NO: 1236896 - RNA, 23 nt, Mycobacterium leprae
ccugggcggcuagucggccggcu

SEQ ID NO: 1236897 - RNA, 19 nt, Mycobacterium leprae
ccugugcuguuggggauau

SEQ ID NO: 1236898 - RNA, 13 nt, Mycobacterium leprae
ccugcagucuuug

SEQ ID NO: 1236899 - RNA, 22 nt, Mycobacterium leprae
ccugcagucuuugggccaucgg

SEQ ID NO: 1236900 - RNA, 22 nt, Mycobacterium leprae
ccugcgacagccgugccucgcu

SEQ ID NO: 1236901 - RNA, 19 nt, Mycobacterium leprae
ccugccggugcggucccau

SEQ ID NO: 1236902 - RNA, 22 nt, Mycobacterium leprae
ccugccggugcggucccaucgc

SEQ ID NO: 1236903 - RNA, 14 nt, Mycobacterium leprae
ccugaaaacuacuc

SEQ ID NO: 1236904 - RNA, 13 nt, Mycobacterium leprae
ccucuugacggga

SEQ ID NO: 1236905 - RNA, 22 nt, Mycobacterium leprae
ccucgugugcuacguuguuguc

SEQ ID NO: 1236906 - RNA, 18 nt, Mycobacterium leprae
ccucgugcugcgugccug

SEQ ID NO: 1236907 - RNA, 13 nt, Mycobacterium leprae
ccucgugcgguca

SEQ ID NO: 1236908 - RNA, 19 nt, Mycobacterium leprae
ccucuccagccaucacuga

SEQ ID NO: 1236909 - RNA, 14 nt, Mycobacterium leprae
ccucgacaaccucg

SEQ ID NO: 1236910 - RNA, 15 nt, Mycobacterium leprae
ccuccuugaccacca

SEQ ID NO: 1236911 - RNA, 12 nt, Mycobacterium leprae
ccucgacccacc

SEQ ID NO: 1236912 - RNA, 16 nt, Mycobacterium leprae
ccucgucggccagcac

SEQ ID NO: 1236913 - RNA, 23 nt, Mycobacterium leprae
ccucggucaccccgagcucggcc

SEQ ID NO: 1236914 - RNA, 19 nt, Mycobacterium leprae
ccucggcggcaccuccccg

SEQ ID NO: 1236915 - RNA, 16 nt, Mycobacterium leprae
ccuacccucucagcaa

SEQ ID NO: 1236916 - RNA, 13 nt, Mycobacterium leprae
ccuccagaaucac

SEQ ID NO: 1236917 - RNA, 20 nt, Mycobacterium leprae
ccuccaggugaagccggcgc

SEQ ID NO: 1236918 - RNA, 19 nt, Mycobacterium leprae
ccuccguugucccgcccgg

SEQ ID NO: 1236919 - RNA, 16 nt, Mycobacterium leprae
ccuccgagcgcccgca

SEQ ID NO: 1236920 - RNA, 19 nt, Mycobacterium leprae
ccguuccauuccagaugcc

SEQ ID NO: 1236921 - RNA, 18 nt, Mycobacterium leprae
ccgugugaacuugaaacc

SEQ ID NO: 1236922 - RNA, 16 nt, Mycobacterium leprae
ccgugguagucagcac

SEQ ID NO: 1236923 - RNA, 13 nt, Mycobacterium leprae
ccguggagagcau

SEQ ID NO: 1236924 - RNA, 17 nt, Mycobacterium leprae
ccguggaggugcggcug

SEQ ID NO: 1236925 - RNA, 16 nt, Mycobacterium leprae
ccgugacucaacauaa

SEQ ID NO: 1236926 - RNA, 22 nt, Mycobacterium leprae
ccgucuuuauucuuuuagagaa

SEQ ID NO: 1236927 - RNA, 17 nt, Mycobacterium leprae
ccgugcccaagacucag

SEQ ID NO: 1236928 - RNA, 16 nt, Mycobacterium leprae
ccuaauuagucuagau

SEQ ID NO: 1236929 - RNA, 18 nt, Mycobacterium leprae
ccguuucgcggggggauc

SEQ ID NO: 1236930 - RNA, 16 nt, Mycobacterium leprae
ccguagcgcaccaauc

SEQ ID NO: 1236931 - RNA, 21 nt, Mycobacterium leprae
ccguagaguucuaucaacauu

SEQ ID NO: 1236932 - RNA, 20 nt, Mycobacterium leprae
ccguaguguuuuaccagcca

SEQ ID NO: 1236933 - RNA, 13 nt, Mycobacterium leprae
ccgucucucaggc

SEQ ID NO: 1236934 - RNA, 14 nt, Mycobacterium leprae
ccgucucucaggcc

SEQ ID NO: 1236935 - RNA, 12 nt, Mycobacterium leprae
ccgucuggaaca

SEQ ID NO: 1236936 - RNA, 19 nt, Mycobacterium leprae
ccgucgcgggauucacacu

SEQ ID NO: 1236937 - RNA, 19 nt, Mycobacterium leprae
ccgucgcgggguuggccac

SEQ ID NO: 1236938 - RNA, 11 nt, Mycobacterium leprae
ccgucagccgu

SEQ ID NO: 1236939 - RNA, 20 nt, Mycobacterium leprae
ccgucagcgugcuccagggu

SEQ ID NO: 1236940 - RNA, 14 nt, Mycobacterium leprae
ccgucgaaauuguu

SEQ ID NO: 1236941 - RNA, 15 nt, Mycobacterium leprae
ccgucgaagcccugc

SEQ ID NO: 1236942 - RNA, 20 nt, Mycobacterium leprae
ccggucuuuucgcgcgcacc

SEQ ID NO: 1236943 - RNA, 22 nt, Mycobacterium leprae
ccgguagucgcuaaauauuaau

SEQ ID NO: 1236944 - RNA, 23 nt, Mycobacterium leprae
ccggucaacaagccgccgacacc

SEQ ID NO: 1236945 - RNA, 14 nt, Mycobacterium leprae
ccgggucagaguuu

SEQ ID NO: 1236946 - RNA, 14 nt, Mycobacterium leprae
ccggcuugggguau

SEQ ID NO: 1236947 - RNA, 16 nt, Mycobacterium leprae
ccggggcaucugucua

SEQ ID NO: 1236948 - RNA, 14 nt, Mycobacterium leprae
ccgggcguuucccu

SEQ ID NO: 1236949 - RNA, 22 nt, Mycobacterium leprae
ccgggcccggacggcccagcac

SEQ ID NO: 1236950 - RNA, 17 nt, Mycobacterium leprae
ccggcgucaggccaggc

SEQ ID NO: 1236951 - RNA, 20 nt, Mycobacterium leprae
ccggcucauuggagugguua

SEQ ID NO: 1236952 - RNA, 21 nt, Mycobacterium leprae
ccggcguguggggguccgcgc

SEQ ID NO: 1236953 - RNA, 12 nt, Mycobacterium leprae
ccggcgucggcc

SEQ ID NO: 1236954 - RNA, 19 nt, Mycobacterium leprae
ccggacagcggcccaaccc

SEQ ID NO: 1236955 - RNA, 15 nt, Mycobacterium leprae
ccggacacaaccagc

SEQ ID NO: 1236956 - RNA, 11 nt, Mycobacterium leprae
ccggacagcac

SEQ ID NO: 1236957 - RNA, 16 nt, Mycobacterium leprae
ccggacaguccaccgc

SEQ ID NO: 1236958 - RNA, 17 nt, Mycobacterium leprae
ccggacaguccaccgcc

SEQ ID NO: 1236959 - RNA, 22 nt, Mycobacterium leprae
ccggaaaagucguggagcaccu

SEQ ID NO: 1236960 - RNA, 16 nt, Mycobacterium leprae
ccggaaauacggcagu

SEQ ID NO: 1236961 - RNA, 14 nt, Mycobacterium leprae
ccggcagcauccgc

SEQ ID NO: 1236962 - RNA, 17 nt, Mycobacterium leprae
ccgcguucguugcugac

SEQ ID NO: 1236963 - RNA, 16 nt, Mycobacterium leprae
ccgcguccagacacca

SEQ ID NO: 1236964 - RNA, 22 nt, Mycobacterium leprae
ccgcuggaagucggucugcggg

SEQ ID NO: 1236965 - RNA, 13 nt, Mycobacterium leprae
ccgcugacaugac

SEQ ID NO: 1236966 - RNA, 11 nt, Mycobacterium leprae
ccgcugcaucc

SEQ ID NO: 1236967 - RNA, 14 nt, Mycobacterium leprae
ccgcucaaagccug

SEQ ID NO: 1236968 - RNA, 16 nt, Mycobacterium leprae
ccgccucgaucagcua

SEQ ID NO: 1236969 - RNA, 16 nt, Mycobacterium leprae
ccgcgacgccaggcgg

SEQ ID NO: 1236970 - RNA, 19 nt, Mycobacterium leprae
ccgcgcacccgagcggcac

SEQ ID NO: 1236971 - RNA, 22 nt, Mycobacterium leprae
ccgcccaggugucuuccagugg

SEQ ID NO: 1236972 - RNA, 21 nt, Mycobacterium leprae
ccgcagucguucgcugacagc

SEQ ID NO: 1236973 - RNA, 19 nt, Mycobacterium leprae
ccgccgaagccgcgcaucu

SEQ ID NO: 1236974 - RNA, 20 nt, Mycobacterium leprae
ccgcccuggaccgcagcacg

SEQ ID NO: 1236975 - RNA, 12 nt, Mycobacterium leprae
ccgccggccgca

SEQ ID NO: 1236976 - RNA, 20 nt, Mycobacterium leprae
ccgacgucucgcggugauug

SEQ ID NO: 1236977 - RNA, 18 nt, Mycobacterium leprae
ccgagaaucaggccgccc

SEQ ID NO: 1236978 - RNA, 16 nt, Mycobacterium leprae
ccgagccgacaaucga

SEQ ID NO: 1236979 - RNA, 21 nt, Mycobacterium leprae
ccgagccgacaaucgagcacg

SEQ ID NO: 1236980 - RNA, 22 nt, Mycobacterium leprae
ccgagaucacaguccugcccgg

SEQ ID NO: 1236981 - RNA, 18 nt, Mycobacterium leprae
ccgagaucgacgcugcgc

SEQ ID NO: 1236982 - RNA, 16 nt, Mycobacterium leprae
ccgagacguugcuggg

SEQ ID NO: 1236983 - RNA, 20 nt, Mycobacterium leprae
ccgauaaacaaggagccgag

SEQ ID NO: 1236984 - RNA, 16 nt, Mycobacterium leprae
ccgaucagccgcaaca

SEQ ID NO: 1236985 - RNA, 22 nt, Mycobacterium leprae
ccgaucgcuugcuaccaguguc

SEQ ID NO: 1236986 - RNA, 13 nt, Mycobacterium leprae
ccgaucgugugca

SEQ ID NO: 1236987 - RNA, 15 nt, Mycobacterium leprae
ccgagcgcagcaagc

SEQ ID NO: 1236988 - RNA, 22 nt, Mycobacterium leprae
ccgagcgcagcaagcggccgcc

SEQ ID NO: 1236989 - RNA, 15 nt, Mycobacterium leprae
ccgaggggccgucgg

SEQ ID NO: 1236990 - RNA, 13 nt, Mycobacterium leprae
ccgauuugggggu

SEQ ID NO: 1236991 - RNA, 18 nt, Mycobacterium leprae
ccgauuguuacugaauca

SEQ ID NO: 1236992 - RNA, 13 nt, Mycobacterium leprae
ccgauuuggaugg

SEQ ID NO: 1236993 - RNA, 15 nt, Mycobacterium leprae
ccgaugauggccgac

SEQ ID NO: 1236994 - RNA, 22 nt, Mycobacterium leprae
ccgcaacugguugaccccgccc

SEQ ID NO: 1236995 - RNA, 18 nt, Mycobacterium leprae
ccgcaggucucacacccg

SEQ ID NO: 1236996 - RNA, 22 nt, Mycobacterium leprae
ccgcaguacuggugcuguguug

SEQ ID NO: 1236997 - RNA, 13 nt, Mycobacterium leprae
cccuugagcaccc

SEQ ID NO: 1236998 - RNA, 22 nt, Mycobacterium leprae
cccuugcagcaacauucacccc

SEQ ID NO: 1236999 - RNA, 14 nt, Mycobacterium leprae
ccgaaaccaagcca

SEQ ID NO: 1237000 - RNA, 17 nt, Mycobacterium leprae
ccgaaacccgaaaccaa

SEQ ID NO: 1237001 - RNA, 15 nt, Mycobacterium leprae
ccgaacagccgcgcc

SEQ ID NO: 1237002 - RNA, 20 nt, Mycobacterium leprae
ccgaauauuuucaagacugc

SEQ ID NO: 1237003 - RNA, 20 nt, Mycobacterium leprae
ccgaagaucaccgccaccac

SEQ ID NO: 1237004 - RNA, 12 nt, Mycobacterium leprae
ccgaacuuggga

SEQ ID NO: 1237005 - RNA, 14 nt, Mycobacterium leprae
cccuucacaagugg

SEQ ID NO: 1237006 - RNA, 13 nt, Mycobacterium leprae
cccuggugagaca

SEQ ID NO: 1237007 - RNA, 21 nt, Mycobacterium leprae
cccugucuguugguccuugca

SEQ ID NO: 1237008 - RNA, 17 nt, Mycobacterium leprae
cccuguuccucgcgggc

SEQ ID NO: 1237009 - RNA, 20 nt, Mycobacterium leprae
cccuggaauccgcgcagggc

SEQ ID NO: 1237010 - RNA, 16 nt, Mycobacterium leprae
cccuggcaucaucaac

SEQ ID NO: 1237011 - RNA, 18 nt, Mycobacterium leprae
cccuggcaucaucaacau

SEQ ID NO: 1237012 - RNA, 15 nt, Mycobacterium leprae
cccugagcaccaucu

SEQ ID NO: 1237013 - RNA, 13 nt, Mycobacterium leprae
cguacagugguga

SEQ ID NO: 1237014 - RNA, 19 nt, Mycobacterium leprae
cguacccaccgaauccucg

SEQ ID NO: 1237015 - RNA, 23 nt, Mycobacterium leprae
cguaccuaagccaagcucagcgc

SEQ ID NO: 1237016 - RNA, 22 nt, Mycobacterium leprae
cguaccuggguuauggaccuga

SEQ ID NO: 1237017 - RNA, 23 nt, Mycobacterium leprae
cguaccgggaugugugcgcgccg

SEQ ID NO: 1237018 - RNA, 15 nt, Mycobacterium leprae
cguaauuccugcagc

SEQ ID NO: 1237019 - RNA, 16 nt, Mycobacterium leprae
cgguguugcgcggcgc

SEQ ID NO: 1237020 - RNA, 18 nt, Mycobacterium leprae
cguaagacacuuccuggc

SEQ ID NO: 1237021 - RNA, 17 nt, Mycobacterium leprae
cguaauaauauccaaag

SEQ ID NO: 1237022 - RNA, 21 nt, Mycobacterium leprae
cggugugggacgugaugcagc

SEQ ID NO: 1237023 - RNA, 16 nt, Mycobacterium leprae
cgguguucgcuccgcc

SEQ ID NO: 1237024 - RNA, 22 nt, Mycobacterium leprae
cgguguguugcaguguugugag

SEQ ID NO: 1237025 - RNA, 21 nt, Mycobacterium leprae
cgguguuagcaugcuugucau

SEQ ID NO: 1237026 - RNA, 13 nt, Mycobacterium leprae
cggugcgugccac

SEQ ID NO: 1237027 - RNA, 18 nt, Mycobacterium leprae
cggugcugucuuuaccac

SEQ ID NO: 1237028 - RNA, 13 nt, Mycobacterium leprae
cgguggcggucgg

SEQ ID NO: 1237029 - RNA, 16 nt, Mycobacterium leprae
cggucugcggugcuga

SEQ ID NO: 1237030 - RNA, 17 nt, Mycobacterium leprae
cggucugcgucgacuga

SEQ ID NO: 1237031 - RNA, 23 nt, Mycobacterium leprae
cggucugauaguguaagccauca

SEQ ID NO: 1237032 - RNA, 17 nt, Mycobacterium leprae
cggucagcucgaaggug

SEQ ID NO: 1237033 - RNA, 14 nt, Mycobacterium leprae
cggugagcggcaga

SEQ ID NO: 1237034 - RNA, 17 nt, Mycobacterium leprae
cggugaaucagucugcg

SEQ ID NO: 1237035 - RNA, 16 nt, Mycobacterium leprae
cggugccgccauugcc

SEQ ID NO: 1237036 - RNA, 18 nt, Mycobacterium leprae
cggggauaggagcccacu

SEQ ID NO: 1237037 - RNA, 20 nt, Mycobacterium leprae
cggggaucaugugucaccug

SEQ ID NO: 1237038 - RNA, 14 nt, Mycobacterium leprae
cgggccacgagacc

SEQ ID NO: 1237039 - RNA, 17 nt, Mycobacterium leprae
cgggccagcaccaaccu

SEQ ID NO: 1237040 - RNA, 14 nt, Mycobacterium leprae
cgggguguggcacg

SEQ ID NO: 1237041 - RNA, 23 nt, Mycobacterium leprae
cgggggagucgauaucgggccga

SEQ ID NO: 1237042 - RNA, 20 nt, Mycobacterium leprae
cgggucagaguuucaugcua

SEQ ID NO: 1237043 - RNA, 22 nt, Mycobacterium leprae
cggguggacgaaccggacagca

SEQ ID NO: 1237044 - RNA, 16 nt, Mycobacterium leprae
cgggugcgcagcaauu

SEQ ID NO: 1237045 - RNA, 14 nt, Mycobacterium leprae
cgguacccgccagg

SEQ ID NO: 1237046 - RNA, 20 nt, Mycobacterium leprae
cgguacauuugcggaugacg

SEQ ID NO: 1237047 - RNA, 17 nt, Mycobacterium leprae
cgguacgaggugacauu

SEQ ID NO: 1237048 - RNA, 16 nt, Mycobacterium leprae
cgguaggccagguuag

SEQ ID NO: 1237049 - RNA, 19 nt, Mycobacterium leprae
cgguagcggaccugcgaga

SEQ ID NO: 1237050 - RNA, 21 nt, Mycobacterium leprae
cgguaacuacuggauuaauau

SEQ ID NO: 1237051 - RNA, 22 nt, Mycobacterium leprae
cgguaacgcugaccagcagauc

SEQ ID NO: 1237052 - RNA, 20 nt, Mycobacterium leprae
cgguaaguuuucagccacau

SEQ ID NO: 1237053 - RNA, 20 nt, Mycobacterium leprae
cggguugacgcugcuugcuc

SEQ ID NO: 1237054 - RNA, 14 nt, Mycobacterium leprae
cggguggugcccag

SEQ ID NO: 1237055 - RNA, 14 nt, Mycobacterium leprae
cgggaacacgucga

SEQ ID NO: 1237056 - RNA, 17 nt, Mycobacterium leprae
cgggacagugucuuagg

SEQ ID NO: 1237057 - RNA, 16 nt, Mycobacterium leprae
cgggaggauggcgacg

SEQ ID NO: 1237058 - RNA, 15 nt, Mycobacterium leprae
cgggaaagcugagau

SEQ ID NO: 1237059 - RNA, 19 nt, Mycobacterium leprae
cggcugcguuaccggcguc

SEQ ID NO: 1237060 - RNA, 16 nt, Mycobacterium leprae
cgggaucgccgaugac

SEQ ID NO: 1237061 - RNA, 14 nt, Mycobacterium leprae
cgggauugcaugca

SEQ ID NO: 1237062 - RNA, 18 nt, Mycobacterium leprae
cgggaugugugcgcgccg

SEQ ID NO: 1237063 - RNA, 19 nt, Mycobacterium leprae
cgggcaagcccugcccggc

SEQ ID NO: 1237064 - RNA, 13 nt, Mycobacterium leprae
cggcgucacccag

SEQ ID NO: 1237065 - RNA, 18 nt, Mycobacterium leprae
cggcgucgacaucaccgg

SEQ ID NO: 1237066 - RNA, 17 nt, Mycobacterium leprae
cggcggguagucggcgc

SEQ ID NO: 1237067 - RNA, 18 nt, Mycobacterium leprae
cggcggcagcuggaaagu

SEQ ID NO: 1237068 - RNA, 15 nt, Mycobacterium leprae
cggcggggcgucgcu

SEQ ID NO: 1237069 - RNA, 17 nt, Mycobacterium leprae
cggcgucgguggcagca

SEQ ID NO: 1237070 - RNA, 17 nt, Mycobacterium leprae
cggcgucgcgucaucag

SEQ ID NO: 1237071 - RNA, 21 nt, Mycobacterium leprae
cggcguugagcgcagccacca

SEQ ID NO: 1237072 - RNA, 15 nt, Mycobacterium leprae
cggcguucgauaaga

SEQ ID NO: 1237073 - RNA, 21 nt, Mycobacterium leprae
cggcucccaucggcggccagc

SEQ ID NO: 1237074 - RNA, 14 nt, Mycobacterium leprae
cggcgaaacguuca

SEQ ID NO: 1237075 - RNA, 16 nt, Mycobacterium leprae
cggcccagugcacuga

SEQ ID NO: 1237076 - RNA, 14 nt, Mycobacterium leprae
cggccuuggcagcc

SEQ ID NO: 1237077 - RNA, 15 nt, Mycobacterium leprae
cggccuuggcagccg

SEQ ID NO: 1237078 - RNA, 20 nt, Mycobacterium leprae
cggcgauauccgccggccgc

SEQ ID NO: 1237079 - RNA, 19 nt, Mycobacterium leprae
cggcgcacguaagcauguc

SEQ ID NO: 1237080 - RNA, 21 nt, Mycobacterium leprae
cggcgcacagguguugggcca

SEQ ID NO: 1237081 - RNA, 13 nt, Mycobacterium leprae
cggcgccgcccgg

SEQ ID NO: 1237082 - RNA, 20 nt, Mycobacterium leprae
cggcgccaggcguccucauc

SEQ ID NO: 1237083 - RNA, 22 nt, Mycobacterium leprae
cggcauugccggggcugcgcug

SEQ ID NO: 1237084 - RNA, 22 nt, Mycobacterium leprae
cggcagcuggaaagucgggauc

SEQ ID NO: 1237085 - RNA, 14 nt, Mycobacterium leprae
cggccagauccagc

SEQ ID NO: 1237086 - RNA, 17 nt, Mycobacterium leprae
cggccagauccagcauc

SEQ ID NO: 1237087 - RNA, 19 nt, Mycobacterium leprae
cggcaacggcaccaaaccc

SEQ ID NO: 1237088 - RNA, 19 nt, Mycobacterium leprae
cggauccaucagaccaccu

SEQ ID NO: 1237089 - RNA, 20 nt, Mycobacterium leprae
cggcaagccaguguucccag

SEQ ID NO: 1237090 - RNA, 21 nt, Mycobacterium leprae
cggcaagcgguuguccggcgc

SEQ ID NO: 1237091 - RNA, 15 nt, Mycobacterium leprae
cggcaagcugaucac

SEQ ID NO: 1237092 - RNA, 20 nt, Mycobacterium leprae
cggcacguucgaucggcagc

SEQ ID NO: 1237093 - RNA, 14 nt, Mycobacterium leprae
cggcaccgcgaagc

SEQ ID NO: 1237094 - RNA, 21 nt, Mycobacterium leprae
cggcacacccaauugccuggc

SEQ ID NO: 1237095 - RNA, 16 nt, Mycobacterium leprae
cggcagcauccgccga

SEQ ID NO: 1237096 - RNA, 15 nt, Mycobacterium leprae
cggcagaucgaucuc

SEQ ID NO: 1237097 - RNA, 17 nt, Mycobacterium leprae
cggcagaggcaccugga

SEQ ID NO: 1237098 - RNA, 17 nt, Mycobacterium leprae
cggaacaacagacacau

SEQ ID NO: 1237099 - RNA, 18 nt, Mycobacterium leprae
cggaacaacagacacauu

SEQ ID NO: 1237100 - RNA, 15 nt, Mycobacterium leprae
cgcuuugccgcugug

SEQ ID NO: 1237101 - RNA, 22 nt, Mycobacterium leprae
cggaacccauauucgucaaaaa

SEQ ID NO: 1237102 - RNA, 16 nt, Mycobacterium leprae
cggaaccauccggcaa

SEQ ID NO: 1237103 - RNA, 18 nt, Mycobacterium leprae
cggaaguuagcgcagcug

SEQ ID NO: 1237104 - RNA, 20 nt, Mycobacterium leprae
cggaagcccucccagccauc

SEQ ID NO: 1237105 - RNA, 18 nt, Mycobacterium leprae
cggacucuccccacugca

SEQ ID NO: 1237106 - RNA, 17 nt, Mycobacterium leprae
cggagauagacaugugu

SEQ ID NO: 1237107 - RNA, 22 nt, Mycobacterium leprae
cggaguacaccaagaacuucaa

SEQ ID NO: 1237108 - RNA, 20 nt, Mycobacterium leprae
cggagucaugauccagcugu

SEQ ID NO: 1237109 - RNA, 12 nt, Mycobacterium leprae
cggaccuggacc

SEQ ID NO: 1237110 - RNA, 13 nt, Mycobacterium leprae
cggacggcaccua

SEQ ID NO: 1237111 - RNA, 14 nt, Mycobacterium leprae
cggaccccauagcg

SEQ ID NO: 1237112 - RNA, 12 nt, Mycobacterium leprae
cgcuccgcccac

SEQ ID NO: 1237113 - RNA, 21 nt, Mycobacterium leprae
cgcuccuucuuaucucaucgu

SEQ ID NO: 1237114 - RNA, 13 nt, Mycobacterium leprae
cgcucccaggggg

SEQ ID NO: 1237115 - RNA, 14 nt, Mycobacterium leprae
cgcugcauccgcag

SEQ ID NO: 1237116 - RNA, 15 nt, Mycobacterium leprae
cgcugcagcaacagc

SEQ ID NO: 1237117 - RNA, 17 nt, Mycobacterium leprae
cgcugcacauucaacca

SEQ ID NO: 1237118 - RNA, 18 nt, Mycobacterium leprae
cgcugcacauucaaccag

SEQ ID NO: 1237119 - RNA, 22 nt, Mycobacterium leprae
cgcugauguccaaagacgccuc

SEQ ID NO: 1237120 - RNA, 14 nt, Mycobacterium leprae
cgcugauuggcaau

SEQ ID NO: 1237121 - RNA, 18 nt, Mycobacterium leprae
cgcugagagugccaccgc

SEQ ID NO: 1237122 - RNA, 14 nt, Mycobacterium leprae
cgcguugaccaaac

SEQ ID NO: 1237123 - RNA, 16 nt, Mycobacterium leprae
cgcguugaccaaaccg

SEQ ID NO: 1237124 - RNA, 19 nt, Mycobacterium leprae
cgcuaaggcagcccgcgcc

SEQ ID NO: 1237125 - RNA, 16 nt, Mycobacterium leprae
cgcuaaggcugcugac

SEQ ID NO: 1237126 - RNA, 14 nt, Mycobacterium leprae
cgcuacaaccuucc

SEQ ID NO: 1237127 - RNA, 23 nt, Mycobacterium leprae
cgcuacaaccuuccgcaaaguua

SEQ ID NO: 1237128 - RNA, 14 nt, Mycobacterium leprae
cgcucacccgcgcc

SEQ ID NO: 1237129 - RNA, 20 nt, Mycobacterium leprae
cgcucacccgcgccgccugc

SEQ ID NO: 1237130 - RNA, 23 nt, Mycobacterium leprae
cgcuagcgauguagccaacagcc

SEQ ID NO: 1237131 - RNA, 22 nt, Mycobacterium leprae
cgcggugggcuuccagcagacc

SEQ ID NO: 1237132 - RNA, 13 nt, Mycobacterium leprae
cgcguagugaugg

SEQ ID NO: 1237133 - RNA, 15 nt, Mycobacterium leprae
cgcggaagcccgccc

SEQ ID NO: 1237134 - RNA, 12 nt, Mycobacterium leprae
cgcggacaagac

SEQ ID NO: 1237135 - RNA, 19 nt, Mycobacterium leprae
cgcggacagauucccgcug

SEQ ID NO: 1237136 - RNA, 18 nt, Mycobacterium leprae
cgcggacucuccccacug

SEQ ID NO: 1237137 - RNA, 19 nt, Mycobacterium leprae
cgcggaguuggccgcggca

SEQ ID NO: 1237138 - RNA, 21 nt, Mycobacterium leprae
cgcggcacguucgaucggcag

SEQ ID NO: 1237139 - RNA, 13 nt, Mycobacterium leprae
cgcggcagcugcu

SEQ ID NO: 1237140 - RNA, 13 nt, Mycobacterium leprae
cgcgggcgccgca

SEQ ID NO: 1237141 - RNA, 19 nt, Mycobacterium leprae
cgcgggcgccgcaguguuu

SEQ ID NO: 1237142 - RNA, 19 nt, Mycobacterium leprae
cgcgcgcuaguucgacacc

SEQ ID NO: 1237143 - RNA, 14 nt, Mycobacterium leprae
cgcgccggcuacug

SEQ ID NO: 1237144 - RNA, 16 nt, Mycobacterium leprae
cgucuuuauuagcaug

SEQ ID NO: 1237145 - RNA, 18 nt, Mycobacterium leprae
cgucuuugcuaacaaggc

SEQ ID NO: 1237146 - RNA, 13 nt, Mycobacterium leprae
cgucuuugcuggu

SEQ ID NO: 1237147 - RNA, 13 nt, Mycobacterium leprae
cgucuucccaaug

SEQ ID NO: 1237148 - RNA, 16 nt, Mycobacterium leprae
cgucuucuauacuuua

SEQ ID NO: 1237149 - RNA, 13 nt, Mycobacterium leprae
cgucugucacccg

SEQ ID NO: 1237150 - RNA, 20 nt, Mycobacterium leprae
cgucuggacucggucugcug

SEQ ID NO: 1237151 - RNA, 22 nt, Mycobacterium leprae
cgucuggacucggucugcugga

SEQ ID NO: 1237152 - RNA, 17 nt, Mycobacterium leprae
cgucucgcgcauacacg

SEQ ID NO: 1237153 - RNA, 22 nt, Mycobacterium leprae
cgucucgacggauuucucgugg

SEQ ID NO: 1237154 - RNA, 12 nt, Mycobacterium leprae
cgucgucucagc

SEQ ID NO: 1237155 - RNA, 22 nt, Mycobacterium leprae
cgucgugaaucaugccgcagca

SEQ ID NO: 1237156 - RNA, 13 nt, Mycobacterium leprae
cgucuccgcgcaa

SEQ ID NO: 1237157 - RNA, 19 nt, Mycobacterium leprae
cgucggcugaaccgcugug

SEQ ID NO: 1237158 - RNA, 21 nt, Mycobacterium leprae
cgucgggaccgggcgcgcgcu

SEQ ID NO: 1237159 - RNA, 13 nt, Mycobacterium leprae
cgucgggcaucga

SEQ ID NO: 1237160 - RNA, 20 nt, Mycobacterium leprae
cgugagaucaccagcaaggg

SEQ ID NO: 1237161 - RNA, 22 nt, Mycobacterium leprae
cgugacugcggcucaccgacug

SEQ ID NO: 1237162 - RNA, 20 nt, Mycobacterium leprae
cgugaaucaugccgcagcau

SEQ ID NO: 1237163 - RNA, 18 nt, Mycobacterium leprae
cgugaggucgaagcugcc

SEQ ID NO: 1237164 - RNA, 20 nt, Mycobacterium leprae
cgugcacaucgguaguggcc

SEQ ID NO: 1237165 - RNA, 21 nt, Mycobacterium leprae
cgugcacaucgguaguggccg

SEQ ID NO: 1237166 - RNA, 21 nt, Mycobacterium leprae
cgugcagcgaccucaugcccg

SEQ ID NO: 1237167 - RNA, 13 nt, Mycobacterium leprae
cgugcagcacuuc

SEQ ID NO: 1237168 - RNA, 15 nt, Mycobacterium leprae
cgugccugguugggc

SEQ ID NO: 1237169 - RNA, 14 nt, Mycobacterium leprae
cgugccggccucgu

SEQ ID NO: 1237170 - RNA, 16 nt, Mycobacterium leprae
cgucgauuuugcaggc

SEQ ID NO: 1237171 - RNA, 24 nt, Mycobacterium leprae
cgucgauucgcucgccgcccgcug

SEQ ID NO: 1237172 - RNA, 15 nt, Mycobacterium leprae
cgucgcccucgccgg

SEQ ID NO: 1237173 - RNA, 14 nt, Mycobacterium leprae
cgucgaggaccgcc

SEQ ID NO: 1237174 - RNA, 17 nt, Mycobacterium leprae
cgucgccgguagcagcg

SEQ ID NO: 1237175 - RNA, 19 nt, Mycobacterium leprae
cgucggaaacacagcaagc

SEQ ID NO: 1237176 - RNA, 19 nt, Mycobacterium leprae
cgucgcugugugcgcgccg

SEQ ID NO: 1237177 - RNA, 16 nt, Mycobacterium leprae
cgucgcugcuggauga

SEQ ID NO: 1237178 - RNA, 22 nt, Mycobacterium leprae
cgucggccuggggcaacacggg

SEQ ID NO: 1237179 - RNA, 18 nt, Mycobacterium leprae
cguccucaucccaugagu

SEQ ID NO: 1237180 - RNA, 15 nt, Mycobacterium leprae
cgucgaaaccauggu

SEQ ID NO: 1237181 - RNA, 18 nt, Mycobacterium leprae
cguccgcggcagcugcug

SEQ ID NO: 1237182 - RNA, 17 nt, Mycobacterium leprae
cguccgcggcggccccu

SEQ ID NO: 1237183 - RNA, 11 nt, Mycobacterium leprae
cgucccgcagc

SEQ ID NO: 1237184 - RNA, 13 nt, Mycobacterium leprae
cguacuccagcag

SEQ ID NO: 1237185 - RNA, 18 nt, Mycobacterium leprae
cguacugaacgagaagca

SEQ ID NO: 1237186 - RNA, 16 nt, Mycobacterium leprae
cguccagacaccacug

SEQ ID NO: 1237187 - RNA, 19 nt, Mycobacterium leprae
cguuggcuugagugcugcc

SEQ ID NO: 1237188 - RNA, 14 nt, Mycobacterium leprae
cguuggcuaacaag

SEQ ID NO: 1237189 - RNA, 16 nt, Mycobacterium leprae
cguuggcuaacaaggu

SEQ ID NO: 1237190 - RNA, 16 nt, Mycobacterium leprae
cguuuccaaaacccac

SEQ ID NO: 1237191 - RNA, 17 nt, Mycobacterium leprae
cguuggcgaucagcagg

SEQ ID NO: 1237192 - RNA, 16 nt, Mycobacterium leprae
cuaaaaagauauuaag

SEQ ID NO: 1237193 - RNA, 20 nt, Mycobacterium leprae
cuaacacgauacugcugcac

SEQ ID NO: 1237194 - RNA, 14 nt, Mycobacterium leprae
cuaagccaagcuca

SEQ ID NO: 1237195 - RNA, 22 nt, Mycobacterium leprae
cuaacccgcaaaccaaacaaca

SEQ ID NO: 1237196 - RNA, 18 nt, Mycobacterium leprae
cguuccagcuuucgggaa

SEQ ID NO: 1237197 - RNA, 15 nt, Mycobacterium leprae
cguucaagagcgagc

SEQ ID NO: 1237198 - RNA, 14 nt, Mycobacterium leprae
cguuagucuggcug

SEQ ID NO: 1237199 - RNA, 17 nt, Mycobacterium leprae
cguuacggucuuucgca

SEQ ID NO: 1237200 - RNA, 14 nt, Mycobacterium leprae
cguguugccaccga

SEQ ID NO: 1237201 - RNA, 12 nt, Mycobacterium leprae
cguguucaucau

SEQ ID NO: 1237202 - RNA, 14 nt, Mycobacterium leprae
cguuaaacaaccug

SEQ ID NO: 1237203 - RNA, 14 nt, Mycobacterium leprae
cguguuuugcugug

SEQ ID NO: 1237204 - RNA, 16 nt, Mycobacterium leprae
cguguuuugcuguguu

SEQ ID NO: 1237205 - RNA, 17 nt, Mycobacterium leprae
cguguuuugcuguguug

SEQ ID NO: 1237206 - RNA, 15 nt, Mycobacterium leprae
cguguaaggccagcg

SEQ ID NO: 1237207 - RNA, 19 nt, Mycobacterium leprae
cguguacagugggaggcgc

SEQ ID NO: 1237208 - RNA, 20 nt, Mycobacterium leprae
cguguaaacuggcgagugga

SEQ ID NO: 1237209 - RNA, 14 nt, Mycobacterium leprae
cgugucgugucgga

SEQ ID NO: 1237210 - RNA, 22 nt, Mycobacterium leprae
cgugugcacugcuucggccagc

SEQ ID NO: 1237211 - RNA, 19 nt, Mycobacterium leprae
cguguggaucaagcggugu

SEQ ID NO: 1237212 - RNA, 19 nt, Mycobacterium leprae
cguggauuuguauggcgcg

SEQ ID NO: 1237213 - RNA, 19 nt, Mycobacterium leprae
cgugcuguugucagcagac

SEQ ID NO: 1237214 - RNA, 18 nt, Mycobacterium leprae
cgugcugaguccgaugau

SEQ ID NO: 1237215 - RNA, 16 nt, Mycobacterium leprae
cgugcugaucaccggc

SEQ ID NO: 1237216 - RNA, 21 nt, Mycobacterium leprae
cgugcuuaacacaugcaaguc

SEQ ID NO: 1237217 - RNA, 21 nt, Mycobacterium leprae
cgugggucgagugguccccug

SEQ ID NO: 1237218 - RNA, 14 nt, Mycobacterium leprae
cgugguggcugcaa

SEQ ID NO: 1237219 - RNA, 22 nt, Mycobacterium leprae
cgugguaaggcaugacggcgca

SEQ ID NO: 1237220 - RNA, 15 nt, Mycobacterium leprae
cgugguagucagcac

SEQ ID NO: 1237221 - RNA, 19 nt, Mycobacterium leprae
cguggcugcacaagcuugu

SEQ ID NO: 1237222 - RNA, 18 nt, Mycobacterium leprae
cguggcuccgcgcugacg

SEQ ID NO: 1237223 - RNA, 13 nt, Mycobacterium leprae
cguggccgugauc

SEQ ID NO: 1237224 - RNA, 18 nt, Mycobacterium leprae
cguggcgagacacccggc

SEQ ID NO: 1237225 - RNA, 12 nt, Mycobacterium leprae
cguggcgagugc

SEQ ID NO: 1237226 - RNA, 22 nt, Mycobacterium leprae
cucaccucgguuaucggggucc

SEQ ID NO: 1237227 - RNA, 15 nt, Mycobacterium leprae
cucaccugcgacagc

SEQ ID NO: 1237228 - RNA, 18 nt, Mycobacterium leprae
cucaucgcggcugccacu

SEQ ID NO: 1237229 - RNA, 21 nt, Mycobacterium leprae
cucaucgcggcugccacugug

SEQ ID NO: 1237230 - RNA, 16 nt, Mycobacterium leprae
cucaucgaaagcaggc

SEQ ID NO: 1237231 - RNA, 20 nt, Mycobacterium leprae
cucauauuuagcgaccggcc

SEQ ID NO: 1237232 - RNA, 21 nt, Mycobacterium leprae
cucaauuuaguuaacgugcca

SEQ ID NO: 1237233 - RNA, 14 nt, Mycobacterium leprae
cucaaugcacguga

SEQ ID NO: 1237234 - RNA, 23 nt, Mycobacterium leprae
cucaaugaccgcaccgaucugcc

SEQ ID NO: 1237235 - RNA, 21 nt, Mycobacterium leprae
cucaagggcguguuuuaaacc

SEQ ID NO: 1237236 - RNA, 18 nt, Mycobacterium leprae
cuaugcugagcuaauaaa

SEQ ID NO: 1237237 - RNA, 16 nt, Mycobacterium leprae
cuaugcggccagccag

SEQ ID NO: 1237238 - RNA, 18 nt, Mycobacterium leprae
cuaugcggccagccagga

SEQ ID NO: 1237239 - RNA, 14 nt, Mycobacterium leprae
cuaugacaagacca

SEQ ID NO: 1237240 - RNA, 17 nt, Mycobacterium leprae
cuaugacaagaccaccg

SEQ ID NO: 1237241 - RNA, 19 nt, Mycobacterium leprae
cuaugauagcgaccaucga

SEQ ID NO: 1237242 - RNA, 16 nt, Mycobacterium leprae
cuauauauauauuaau

SEQ ID NO: 1237243 - RNA, 13 nt, Mycobacterium leprae
cuauaauuuaaau

SEQ ID NO: 1237244 - RNA, 17 nt, Mycobacterium leprae
cuauaauuuaaauuuca

SEQ ID NO: 1237245 - RNA, 17 nt, Mycobacterium leprae
cuaggacgccgcccucu

SEQ ID NO: 1237246 - RNA, 16 nt, Mycobacterium leprae
cuaggacaacagagca

SEQ ID NO: 1237247 - RNA, 14 nt, Mycobacterium leprae
cuaggauagaucca

SEQ ID NO: 1237248 - RNA, 17 nt, Mycobacterium leprae
cuaggccacccgccaga

SEQ ID NO: 1237249 - RNA, 16 nt, Mycobacterium leprae
cuaggccagugucggu

SEQ ID NO: 1237250 - RNA, 16 nt, Mycobacterium leprae
cuagaaaauccaaguc

SEQ ID NO: 1237251 - RNA, 18 nt, Mycobacterium leprae
cuacguggucugaagugg

SEQ ID NO: 1237252 - RNA, 14 nt, Mycobacterium leprae
cuagaaauugaaaa

SEQ ID NO: 1237253 - RNA, 20 nt, Mycobacterium leprae
cuagcauuccucgugugugu

SEQ ID NO: 1237254 - RNA, 18 nt, Mycobacterium leprae
cuagccucggucauaaca

SEQ ID NO: 1237255 - RNA, 23 nt, Mycobacterium leprae
cuagcgauucgggagaggaucag

SEQ ID NO: 1237256 - RNA, 23 nt, Mycobacterium leprae
cuagcaaggcgcgguaucucaau

SEQ ID NO: 1237257 - RNA, 16 nt, Mycobacterium leprae
cuagcagcgcgcagaa

SEQ ID NO: 1237258 - RNA, 20 nt, Mycobacterium leprae
cuacgcuaaucgcgggcaag

SEQ ID NO: 1237259 - RNA, 16 nt, Mycobacterium leprae
cuacgggaacacgucg

SEQ ID NO: 1237260 - RNA, 18 nt, Mycobacterium leprae
cuacggucaggugucuga

SEQ ID NO: 1237261 - RNA, 13 nt, Mycobacterium leprae
cuaauagccgaac

SEQ ID NO: 1237262 - RNA, 21 nt, Mycobacterium leprae
cuaccucggucggcaugugca

SEQ ID NO: 1237263 - RNA, 17 nt, Mycobacterium leprae
cucgcuaucgccacacu

SEQ ID NO: 1237264 - RNA, 21 nt, Mycobacterium leprae
cucgcgcaggucacccuccuc

SEQ ID NO: 1237265 - RNA, 13 nt, Mycobacterium leprae
cucgaugugcuua

SEQ ID NO: 1237266 - RNA, 13 nt, Mycobacterium leprae
cucgagcaaugcu

SEQ ID NO: 1237267 - RNA, 23 nt, Mycobacterium leprae
cucgaguugguuaaucaccucau

SEQ ID NO: 1237268 - RNA, 21 nt, Mycobacterium leprae
cuccugcagguugcugucgug

SEQ ID NO: 1237269 - RNA, 14 nt, Mycobacterium leprae
cucgacagcaggua

SEQ ID NO: 1237270 - RNA, 16 nt, Mycobacterium leprae
cuccugagacaucgcc

SEQ ID NO: 1237271 - RNA, 19 nt, Mycobacterium leprae
cuccugagacaucgccacc

SEQ ID NO: 1237272 - RNA, 19 nt, Mycobacterium leprae
cucgacgggucacagguaa

SEQ ID NO: 1237273 - RNA, 21 nt, Mycobacterium leprae
cucgucccaugucucuugguc

SEQ ID NO: 1237274 - RNA, 15 nt, Mycobacterium leprae
cucgucgacaaggcg

SEQ ID NO: 1237275 - RNA, 14 nt, Mycobacterium leprae
cucgucgcacaaau

SEQ ID NO: 1237276 - RNA, 19 nt, Mycobacterium leprae
cucgguguucgcuccgccc

SEQ ID NO: 1237277 - RNA, 20 nt, Mycobacterium leprae
cucgugcgucgucucagcgg

SEQ ID NO: 1237278 - RNA, 18 nt, Mycobacterium leprae
cucuaaaaagauauuaag

SEQ ID NO: 1237279 - RNA, 21 nt, Mycobacterium leprae
cucggugagauagcggcggua

SEQ ID NO: 1237280 - RNA, 17 nt, Mycobacterium leprae
cucggcgcgcucucugg

SEQ ID NO: 1237281 - RNA, 19 nt, Mycobacterium leprae
cucggcggcaccuccccgc

SEQ ID NO: 1237282 - RNA, 13 nt, Mycobacterium leprae
cucgcuggaauuu

SEQ ID NO: 1237283 - RNA, 19 nt, Mycobacterium leprae
cucggauccaucagaccac

SEQ ID NO: 1237284 - RNA, 14 nt, Mycobacterium leprae
cucggccaggugug

SEQ ID NO: 1237285 - RNA, 13 nt, Mycobacterium leprae
cuccauuaaaccu

SEQ ID NO: 1237286 - RNA, 17 nt, Mycobacterium leprae
cuccauugcguuugaug

SEQ ID NO: 1237287 - RNA, 21 nt, Mycobacterium leprae
cucccaaggaccggugcugca

SEQ ID NO: 1237288 - RNA, 19 nt, Mycobacterium leprae
cuccguugucccgcccggc

SEQ ID NO: 1237289 - RNA, 15 nt, Mycobacterium leprae
cuccggguuaucuaa

SEQ ID NO: 1237290 - RNA, 13 nt, Mycobacterium leprae
cuccgggcuggga

SEQ ID NO: 1237291 - RNA, 18 nt, Mycobacterium leprae
cuccggcuaucaggaucu

SEQ ID NO: 1237292 - RNA, 19 nt, Mycobacterium leprae
cuccgcagcaccugccgca

SEQ ID NO: 1237293 - RNA, 20 nt, Mycobacterium leprae
cuccgcagcaccugccgcag

SEQ ID NO: 1237294 - RNA, 16 nt, Mycobacterium leprae
cuccacgauucugcug

SEQ ID NO: 1237295 - RNA, 22 nt, Mycobacterium leprae
cuccaguuuugugggcagguca

SEQ ID NO: 1237296 - RNA, 23 nt, Mycobacterium leprae
cuccaguuuugugggcaggucag

SEQ ID NO: 1237297 - RNA, 21 nt, Mycobacterium leprae
cugcaaugccggacuggcuga

SEQ ID NO: 1237298 - RNA, 17 nt, Mycobacterium leprae
cugcaauccguggagag

SEQ ID NO: 1237299 - RNA, 14 nt, Mycobacterium leprae
cugcacggcgugca

SEQ ID NO: 1237300 - RNA, 17 nt, Mycobacterium leprae
cugcagugcuacgaagg

SEQ ID NO: 1237301 - RNA, 18 nt, Mycobacterium leprae
cugcagguugcugucgug

SEQ ID NO: 1237302 - RNA, 20 nt, Mycobacterium leprae
cugcaaggucguguugccac

SEQ ID NO: 1237303 - RNA, 20 nt, Mycobacterium leprae
cugcaacucaucggcuccca

SEQ ID NO: 1237304 - RNA, 12 nt, Mycobacterium leprae
cugcaacgcugc

SEQ ID NO: 1237305 - RNA, 18 nt, Mycobacterium leprae
cugauugucaacaaccga

SEQ ID NO: 1237306 - RNA, 22 nt, Mycobacterium leprae
cugauguuaucccuugcaccau

SEQ ID NO: 1237307 - RNA, 23 nt, Mycobacterium leprae
cugaucuuggagaagguuucccg

SEQ ID NO: 1237308 - RNA, 14 nt, Mycobacterium leprae
cugaucgggcugcg

SEQ ID NO: 1237309 - RNA, 16 nt, Mycobacterium leprae
cugaggcagcagcucg

SEQ ID NO: 1237310 - RNA, 22 nt, Mycobacterium leprae
cucuaucgaacuuuuccaugcu

SEQ ID NO: 1237311 - RNA, 15 nt, Mycobacterium leprae
cugagcguggcugcu

SEQ ID NO: 1237312 - RNA, 16 nt, Mycobacterium leprae
cugaguucgcaagcaa

SEQ ID NO: 1237313 - RNA, 12 nt, Mycobacterium leprae
cugagguacccg

SEQ ID NO: 1237314 - RNA, 19 nt, Mycobacterium leprae
cugagguacccgccucgau

SEQ ID NO: 1237315 - RNA, 14 nt, Mycobacterium leprae
cugaggguggcgcc

SEQ ID NO: 1237316 - RNA, 21 nt, Mycobacterium leprae
cugaggguguuggucuguuug

SEQ ID NO: 1237317 - RNA, 17 nt, Mycobacterium leprae
cugaggucaccggccac

SEQ ID NO: 1237318 - RNA, 20 nt, Mycobacterium leprae
cugagguguugggagcgaag

SEQ ID NO: 1237319 - RNA, 19 nt, Mycobacterium leprae
cugauaaggucuggcaccg

SEQ ID NO: 1237320 - RNA, 21 nt, Mycobacterium leprae
cugcguggccuccgagcgccc

SEQ ID NO: 1237321 - RNA, 15 nt, Mycobacterium leprae
cugcguguucaucau

SEQ ID NO: 1237322 - RNA, 17 nt, Mycobacterium leprae
cugcguguucaucaucu

SEQ ID NO: 1237323 - RNA, 18 nt, Mycobacterium leprae
cugcguguaaacuggcga

SEQ ID NO: 1237324 - RNA, 17 nt, Mycobacterium leprae
cugcgugucgugucgga

SEQ ID NO: 1237325 - RNA, 16 nt, Mycobacterium leprae
cugcguucagcgaaga

SEQ ID NO: 1237326 - RNA, 14 nt, Mycobacterium leprae
cugcguucgguagc

SEQ ID NO: 1237327 - RNA, 20 nt, Mycobacterium leprae
cugcgguaucaucaagcacc

SEQ ID NO: 1237328 - RNA, 21 nt, Mycobacterium leprae
cugcgcgcacccaagccaugu

SEQ ID NO: 1237329 - RNA, 14 nt, Mycobacterium leprae
cugcgcgcagugca

SEQ ID NO: 1237330 - RNA, 16 nt, Mycobacterium leprae
cugccagacacugcca

SEQ ID NO: 1237331 - RNA, 20 nt, Mycobacterium leprae
cugccacugacgaggugucg

SEQ ID NO: 1237332 - RNA, 12 nt, Mycobacterium leprae
cugccaugccag

SEQ ID NO: 1237333 - RNA, 19 nt, Mycobacterium leprae
cugcccagagaucgccgcu

SEQ ID NO: 1237334 - RNA, 14 nt, Mycobacterium leprae
cugcccgcgggggu

SEQ ID NO: 1237335 - RNA, 20 nt, Mycobacterium leprae
cugcccaugcuuaaggcaga

SEQ ID NO: 1237336 - RNA, 16 nt, Mycobacterium leprae
cugccuagcaacguca

SEQ ID NO: 1237337 - RNA, 18 nt, Mycobacterium leprae
cugccgucgaauucuuaa

SEQ ID NO: 1237338 - RNA, 15 nt, Mycobacterium leprae
cugccgguagccugg

SEQ ID NO: 1237339 - RNA, 21 nt, Mycobacterium leprae
cugccggugcggucccaucgc

SEQ ID NO: 1237340 - RNA, 17 nt, Mycobacterium leprae
cugccggugaccgggcc

SEQ ID NO: 1237341 - RNA, 18 nt, Mycobacterium leprae
cugccggugaccgggccg

SEQ ID NO: 1237342 - RNA, 12 nt, Mycobacterium leprae
cugccgcuggua

SEQ ID NO: 1237343 - RNA, 23 nt, Mycobacterium leprae
cugccgcugguaucggugucggc

SEQ ID NO: 1237344 - RNA, 20 nt, Mycobacterium leprae
cugccgaaccuccaccacuc

SEQ ID NO: 1237345 - RNA, 20 nt, Mycobacterium leprae
cugccgaccgccucgaugug

SEQ ID NO: 1237346 - RNA, 12 nt, Mycobacterium leprae
cugucagagugc

SEQ ID NO: 1237347 - RNA, 23 nt, Mycobacterium leprae
cugucacuacguccacuagccag

SEQ ID NO: 1237348 - RNA, 23 nt, Mycobacterium leprae
cugucaaggcgguuccgacuggu

SEQ ID NO: 1237349 - RNA, 15 nt, Mycobacterium leprae
cugucaaccaugguc

SEQ ID NO: 1237350 - RNA, 19 nt, Mycobacterium leprae
cuguccgcacaaacuucga

SEQ ID NO: 1237351 - RNA, 19 nt, Mycobacterium leprae
cugucccgggggccagcgu

SEQ ID NO: 1237352 - RNA, 20 nt, Mycobacterium leprae
cuguaauuacuucggucagg

SEQ ID NO: 1237353 - RNA, 21 nt, Mycobacterium leprae
cuguauaacaaaucauaguga

SEQ ID NO: 1237354 - RNA, 22 nt, Mycobacterium leprae
cuguauaacaaaucauagugac

SEQ ID NO: 1237355 - RNA, 16 nt, Mycobacterium leprae
cugggugaccacccac

SEQ ID NO: 1237356 - RNA, 16 nt, Mycobacterium leprae
cuggggcguccaguga

SEQ ID NO: 1237357 - RNA, 13 nt, Mycobacterium leprae
cugggugggugca

SEQ ID NO: 1237358 - RNA, 15 nt, Mycobacterium leprae
cuggcggugggugca

SEQ ID NO: 1237359 - RNA, 12 nt, Mycobacterium leprae
cugggcugugcu

SEQ ID NO: 1237360 - RNA, 15 nt, Mycobacterium leprae
cuggucuuguggaac

SEQ ID NO: 1237361 - RNA, 22 nt, Mycobacterium leprae
cuggucuucuuggcgcugagca

SEQ ID NO: 1237362 - RNA, 14 nt, Mycobacterium leprae
cuggucaacgcagc

SEQ ID NO: 1237363 - RNA, 16 nt, Mycobacterium leprae
cuggucaucuguagcu

SEQ ID NO: 1237364 - RNA, 16 nt, Mycobacterium leprae
cuggcaagcucgggug

SEQ ID NO: 1237365 - RNA, 13 nt, Mycobacterium leprae
cuggaggccaacc

SEQ ID NO: 1237366 - RNA, 22 nt, Mycobacterium leprae
cuggcaguuagcaugagcugcu

SEQ ID NO: 1237367 - RNA, 22 nt, Mycobacterium leprae
cuggcacccacgcugcgcggcu

SEQ ID NO: 1237368 - RNA, 19 nt, Mycobacterium leprae
cuggcgcuuaauguagcau

SEQ ID NO: 1237369 - RNA, 20 nt, Mycobacterium leprae
cuggcgcuuaauguagcaug

SEQ ID NO: 1237370 - RNA, 15 nt, Mycobacterium leprae
cuggcggaguugagc

SEQ ID NO: 1237371 - RNA, 15 nt, Mycobacterium leprae
cuggcggauuuugac

SEQ ID NO: 1237372 - RNA, 21 nt, Mycobacterium leprae
cuggccuguucaugguguguu

SEQ ID NO: 1237373 - RNA, 14 nt, Mycobacterium leprae
cuggcgaguggagu

SEQ ID NO: 1237374 - RNA, 16 nt, Mycobacterium leprae
cuggcgaguggaguga

SEQ ID NO: 1237375 - RNA, 13 nt, Mycobacterium leprae
cuggcgcaacagu

SEQ ID NO: 1237376 - RNA, 24 nt, Mycobacterium leprae
cugcucaaccaugccgcgcgccug

SEQ ID NO: 1237377 - RNA, 15 nt, Mycobacterium leprae
cugcucauggcaccg

SEQ ID NO: 1237378 - RNA, 17 nt, Mycobacterium leprae
cugcuuuaccuucaggu

SEQ ID NO: 1237379 - RNA, 22 nt, Mycobacterium leprae
cuggacucggucugcuggacag

SEQ ID NO: 1237380 - RNA, 17 nt, Mycobacterium leprae
cuggagcgccaccaugc

SEQ ID NO: 1237381 - RNA, 13 nt, Mycobacterium leprae
cuggaccgcagca

SEQ ID NO: 1237382 - RNA, 15 nt, Mycobacterium leprae
cuggaccgcagcacg

SEQ ID NO: 1237383 - RNA, 13 nt, Mycobacterium leprae
cuggacaaagucu

SEQ ID NO: 1237384 - RNA, 22 nt, Mycobacterium leprae
cuggaauuuauuguccacgucg

SEQ ID NO: 1237385 - RNA, 17 nt, Mycobacterium leprae
cuggaauccggcaacug

SEQ ID NO: 1237386 - RNA, 18 nt, Mycobacterium leprae
cuuagccaugucuaccug

SEQ ID NO: 1237387 - RNA, 18 nt, Mycobacterium leprae
cuuagcauagcggccgcc

SEQ ID NO: 1237388 - RNA, 22 nt, Mycobacterium leprae
cuuagcaacguguaaggccagc

SEQ ID NO: 1237389 - RNA, 17 nt, Mycobacterium leprae
cuuacagucacuauaau

SEQ ID NO: 1237390 - RNA, 18 nt, Mycobacterium leprae
cuuacagucacuauaauu

SEQ ID NO: 1237391 - RNA, 19 nt, Mycobacterium leprae
cuuacagucacuauaauuu

SEQ ID NO: 1237392 - RNA, 19 nt, Mycobacterium leprae
cuuacaccaacauagucag

SEQ ID NO: 1237393 - RNA, 21 nt, Mycobacterium leprae
cuuaccucagugucagcagca

SEQ ID NO: 1237394 - RNA, 20 nt, Mycobacterium leprae
cuuacggcuuugcaaagcag

SEQ ID NO: 1237395 - RNA, 17 nt, Mycobacterium leprae
cuuaauaucuuuuuaga

SEQ ID NO: 1237396 - RNA, 13 nt, Mycobacterium leprae
cuguuucugcuau

SEQ ID NO: 1237397 - RNA, 15 nt, Mycobacterium leprae
cuguugacuuguacu

SEQ ID NO: 1237398 - RNA, 21 nt, Mycobacterium leprae
cuguugacuuguacuuugugu

SEQ ID NO: 1237399 - RNA, 16 nt, Mycobacterium leprae
cugucuggaucgggga

SEQ ID NO: 1237400 - RNA, 14 nt, Mycobacterium leprae
cugucuaucacauc

SEQ ID NO: 1237401 - RNA, 15 nt, Mycobacterium leprae
cugucuauuugagau

SEQ ID NO: 1237402 - RNA, 20 nt, Mycobacterium leprae
cugucuacggucaggugucu

SEQ ID NO: 1237403 - RNA, 14 nt, Mycobacterium leprae
cugucgugcccaga

SEQ ID NO: 1237404 - RNA, 14 nt, Mycobacterium leprae
cuguugcaggcuuc

SEQ ID NO: 1237405 - RNA, 17 nt, Mycobacterium leprae
cuguuggugugugagga

SEQ ID NO: 1237406 - RNA, 16 nt, Mycobacterium leprae
cuguuguaagcacugc

SEQ ID NO: 1237407 - RNA, 17 nt, Mycobacterium leprae
cuguuguaagcacugca

SEQ ID NO: 1237408 - RNA, 22 nt, Mycobacterium leprae
cuguuggugagauuucagccgg

SEQ ID NO: 1237409 - RNA, 18 nt, Mycobacterium leprae
cuguugguaaccagccac

SEQ ID NO: 1237410 - RNA, 16 nt, Mycobacterium leprae
cuguugugggggugga

SEQ ID NO: 1237411 - RNA, 22 nt, Mycobacterium leprae
cuguuguggucaacgggacuga

SEQ ID NO: 1237412 - RNA, 16 nt, Mycobacterium leprae
cuguugucagcagacc

SEQ ID NO: 1237413 - RNA, 16 nt, Mycobacterium leprae
cuucaauuuuccaguu

SEQ ID NO: 1237414 - RNA, 14 nt, Mycobacterium leprae
cuucaucagcucug

SEQ ID NO: 1237415 - RNA, 14 nt, Mycobacterium leprae
cuucgcagccaccg

SEQ ID NO: 1237416 - RNA, 21 nt, Mycobacterium leprae
cuucgcagacacagccgucag

SEQ ID NO: 1237417 - RNA, 15 nt, Mycobacterium leprae
cuucgccuuagcacg

SEQ ID NO: 1237418 - RNA, 21 nt, Mycobacterium leprae
cuuccggaaaacugccgguag

SEQ ID NO: 1237419 - RNA, 14 nt, Mycobacterium leprae
cuucgauccaggcg

SEQ ID NO: 1237420 - RNA, 16 nt, Mycobacterium leprae
cuucccuugaacugca

SEQ ID NO: 1237421 - RNA, 16 nt, Mycobacterium leprae
cuuccgcuuugccgcu

SEQ ID NO: 1237422 - RNA, 18 nt, Mycobacterium leprae
cuuccgcuuugccgcugu

SEQ ID NO: 1237423 - RNA, 19 nt, Mycobacterium leprae
cuuccgcuuugccgcugug

SEQ ID NO: 1237424 - RNA, 16 nt, Mycobacterium leprae
cuucauguccuacaca

SEQ ID NO: 1237425 - RNA, 15 nt, Mycobacterium leprae
cuuccagucuggcgg

SEQ ID NO: 1237426 - RNA, 19 nt, Mycobacterium leprae
cuuucgcagaagaccgugc

SEQ ID NO: 1237427 - RNA, 18 nt, Mycobacterium leprae
cuuucgacagcuaagccu

SEQ ID NO: 1237428 - RNA, 14 nt, Mycobacterium leprae
cuuuauauacuuug

SEQ ID NO: 1237429 - RNA, 15 nt, Mycobacterium leprae
cuuuauauacuuugu

SEQ ID NO: 1237430 - RNA, 23 nt, Mycobacterium leprae
cuuggaaccaucaacggcuacaa

SEQ ID NO: 1237431 - RNA, 20 nt, Mycobacterium leprae
cuuguaccuucuguauggcu

SEQ ID NO: 1237432 - RNA, 12 nt, Mycobacterium leprae
cuuguuggccau

SEQ ID NO: 1237433 - RNA, 20 nt, Mycobacterium leprae
cuugcaccauuucugccgcu

SEQ ID NO: 1237434 - RNA, 22 nt, Mycobacterium leprae
cuugaugccaaccugcgcggcu

SEQ ID NO: 1237435 - RNA, 13 nt, Mycobacterium leprae
cuugaggucgcac

SEQ ID NO: 1237436 - RNA, 15 nt, Mycobacterium leprae
cuugaggucgcacag

SEQ ID NO: 1237437 - RNA, 14 nt, Mycobacterium leprae
cuugaggugucggc

SEQ ID NO: 1237438 - RNA, 16 nt, Mycobacterium leprae
cuugaggugucggcgu

SEQ ID NO: 1237439 - RNA, 17 nt, Mycobacterium leprae
cuucuguuauuucuggc

SEQ ID NO: 1237440 - RNA, 14 nt, Mycobacterium leprae
cuucuguauggcuc

SEQ ID NO: 1237441 - RNA, 14 nt, Mycobacterium leprae
cuucugcacccgcc

SEQ ID NO: 1237442 - RNA, 16 nt, Mycobacterium leprae
cuucugcacccgccag

SEQ ID NO: 1237443 - RNA, 21 nt, Mycobacterium leprae
cuucugcgcgcacccaagcca

SEQ ID NO: 1237444 - RNA, 20 nt, Mycobacterium leprae
cuucuccguucacagugccg

SEQ ID NO: 1237445 - RNA, 19 nt, Mycobacterium leprae
cuucucgaccauaaggauu

SEQ ID NO: 1237446 - RNA, 23 nt, Mycobacterium leprae
cuucucggggcgaugaaauccgc

SEQ ID NO: 1237447 - RNA, 15 nt, Mycobacterium leprae
gaagaucaccgccac

SEQ ID NO: 1237448 - RNA, 16 nt, Mycobacterium leprae
gaagcacuaaaugcca

SEQ ID NO: 1237449 - RNA, 19 nt, Mycobacterium leprae
gaagccguugggcugcccu

SEQ ID NO: 1237450 - RNA, 18 nt, Mycobacterium leprae
gaagcgcugauccucucc

SEQ ID NO: 1237451 - RNA, 22 nt, Mycobacterium leprae
gaagcgcugcagcgauaccagc

SEQ ID NO: 1237452 - RNA, 16 nt, Mycobacterium leprae
gaagcggauaguaugc

SEQ ID NO: 1237453 - RNA, 23 nt, Mycobacterium leprae
gaagcgcagcucgccaaggucga

SEQ ID NO: 1237454 - RNA, 14 nt, Mycobacterium leprae
gaaggcauaauaca

SEQ ID NO: 1237455 - RNA, 16 nt, Mycobacterium leprae
gaaggagccgaggcac

SEQ ID NO: 1237456 - RNA, 20 nt, Mycobacterium leprae
gaagcgguugaucuggugga

SEQ ID NO: 1237457 - RNA, 17 nt, Mycobacterium leprae
gaagcugaauggucauu

SEQ ID NO: 1237458 - RNA, 12 nt, Mycobacterium leprae
gaagcucuggcu

SEQ ID NO: 1237459 - RNA, 18 nt, Mycobacterium leprae
gaagcugaccacucgcga

SEQ ID NO: 1237460 - RNA, 14 nt, Mycobacterium leprae
gaagcucaacuagg

SEQ ID NO: 1237461 - RNA, 21 nt, Mycobacterium leprae
gaacugcacuauaaggcagcu

SEQ ID NO: 1237462 - RNA, 16 nt, Mycobacterium leprae
gaacugacuucaguca

SEQ ID NO: 1237463 - RNA, 20 nt, Mycobacterium leprae
gaacuggaucggucagccac

SEQ ID NO: 1237464 - RNA, 14 nt, Mycobacterium leprae
gaacugggugacca

SEQ ID NO: 1237465 - RNA, 17 nt, Mycobacterium leprae
gaacucgucguccggca

SEQ ID NO: 1237466 - RNA, 18 nt, Mycobacterium leprae
gaacguccaucuuguugg

SEQ ID NO: 1237467 - RNA, 18 nt, Mycobacterium leprae
gaacguccgacuacccga

SEQ ID NO: 1237468 - RNA, 17 nt, Mycobacterium leprae
gaacgggccucaugacg

SEQ ID NO: 1237469 - RNA, 18 nt, Mycobacterium leprae
gaaccguucgacuucugg

SEQ ID NO: 1237470 - RNA, 14 nt, Mycobacterium leprae
gaacgagaagcagc

SEQ ID NO: 1237471 - RNA, 22 nt, Mycobacterium leprae
gaacgcagucugaucgcucacc

SEQ ID NO: 1237472 - RNA, 15 nt, Mycobacterium leprae
gaaccgcagcugcuc

SEQ ID NO: 1237473 - RNA, 20 nt, Mycobacterium leprae
gaauuaggcggauggggcau

SEQ ID NO: 1237474 - RNA, 17 nt, Mycobacterium leprae
gaauucagagcugcagg

SEQ ID NO: 1237475 - RNA, 19 nt, Mycobacterium leprae
gaauucaguucaauggugc

SEQ ID NO: 1237476 - RNA, 15 nt, Mycobacterium leprae
gaauucuauaucuau

SEQ ID NO: 1237477 - RNA, 18 nt, Mycobacterium leprae
gaauugcacggucucuuu

SEQ ID NO: 1237478 - RNA, 17 nt, Mycobacterium leprae
gaauugucuucuacuga

SEQ ID NO: 1237479 - RNA, 23 nt, Mycobacterium leprae
gaauguccaccagccgcaggcac

SEQ ID NO: 1237480 - RNA, 23 nt, Mycobacterium leprae
gaaucggcgcacagcuggcuugu

SEQ ID NO: 1237481 - RNA, 15 nt, Mycobacterium leprae
gaaucaccgcugggu

SEQ ID NO: 1237482 - RNA, 16 nt, Mycobacterium leprae
gaaucaugaagaucga

SEQ ID NO: 1237483 - RNA, 20 nt, Mycobacterium leprae
gaaucccgcgacggccggcg

SEQ ID NO: 1237484 - RNA, 18 nt, Mycobacterium leprae
gaaucccagcagcugggu

SEQ ID NO: 1237485 - RNA, 18 nt, Mycobacterium leprae
gaauccgcgcagggccug

SEQ ID NO: 1237486 - RNA, 15 nt, Mycobacterium leprae
gaauccuacauccac

SEQ ID NO: 1237487 - RNA, 22 nt, Mycobacterium leprae
gaauccuguugacguguuuugc

SEQ ID NO: 1237488 - RNA, 17 nt, Mycobacterium leprae
gaagugguuuuggcagu

SEQ ID NO: 1237489 - RNA, 14 nt, Mycobacterium leprae
gaaguccuugcugg

SEQ ID NO: 1237490 - RNA, 23 nt, Mycobacterium leprae
gaaguggcuugucacgccggucg

SEQ ID NO: 1237491 - RNA, 21 nt, Mycobacterium leprae
gaagugauucgaaggcgguga

SEQ ID NO: 1237492 - RNA, 13 nt, Mycobacterium leprae
gaaguaauaaaua

SEQ ID NO: 1237493 - RNA, 16 nt, Mycobacterium leprae
gaaggggucgaugagg

SEQ ID NO: 1237494 - RNA, 12 nt, Mycobacterium leprae
gaagggaaugcg

SEQ ID NO: 1237495 - RNA, 22 nt, Mycobacterium leprae
gaaggcgauaucgaugcaggcg

SEQ ID NO: 1237496 - RNA, 16 nt, Mycobacterium leprae
gaauacacuauuuccc

SEQ ID NO: 1237497 - RNA, 19 nt, Mycobacterium leprae
gaauaacugccaaucagca

SEQ ID NO: 1237498 - RNA, 19 nt, Mycobacterium leprae
gaauagcugugggguauug

SEQ ID NO: 1237499 - RNA, 18 nt, Mycobacterium leprae
gaauaugcccagcagaug

SEQ ID NO: 1237500 - RNA, 13 nt, Mycobacterium leprae
gaauauugcgaca

SEQ ID NO: 1237501 - RNA, 15 nt, Mycobacterium leprae
gaauauuuucaagac

SEQ ID NO: 1237502 - RNA, 18 nt, Mycobacterium leprae
gaacagccuugcaaaacg

SEQ ID NO: 1237503 - RNA, 21 nt, Mycobacterium leprae
gaacagcaucguauagcacac

SEQ ID NO: 1237504 - RNA, 14 nt, Mycobacterium leprae
gaaaucgguggcag

SEQ ID NO: 1237505 - RNA, 17 nt, Mycobacterium leprae
gaaaucgagaauuuacc

SEQ ID NO: 1237506 - RNA, 17 nt, Mycobacterium leprae
gaaaguaggcacagccc

SEQ ID NO: 1237507 - RNA, 13 nt, Mycobacterium leprae
gaaaggguagccg

SEQ ID NO: 1237508 - RNA, 22 nt, Mycobacterium leprae
gaaauacccacccaguuaggua

SEQ ID NO: 1237509 - RNA, 24 nt, Mycobacterium leprae
gaaacgucaucgacagaugcgauc

SEQ ID NO: 1237510 - RNA, 16 nt, Mycobacterium leprae
gaaacggcgucgaauu

SEQ ID NO: 1237511 - RNA, 17 nt, Mycobacterium leprae
gaaacgcuauggauacu

SEQ ID NO: 1237512 - RNA, 21 nt, Mycobacterium leprae
gaaaccaugccgccgaagccg

SEQ ID NO: 1237513 - RNA, 13 nt, Mycobacterium leprae
gaaacccuucaca

SEQ ID NO: 1237514 - RNA, 17 nt, Mycobacterium leprae
gaaacccgaaaccaagc

SEQ ID NO: 1237515 - RNA, 17 nt, Mycobacterium leprae
gaaaacucgaucgaggu

SEQ ID NO: 1237516 - RNA, 14 nt, Mycobacterium leprae
gaaaacuuaauauc

SEQ ID NO: 1237517 - RNA, 18 nt, Mycobacterium leprae
gaaaaaugaguugcaaca

SEQ ID NO: 1237518 - RNA, 13 nt, Mycobacterium leprae
gaaaaaugccuau

SEQ ID NO: 1237519 - RNA, 16 nt, Mycobacterium leprae
gaaaaccguguagugc

SEQ ID NO: 1237520 - RNA, 13 nt, Mycobacterium leprae
gaaaaccucacga

SEQ ID NO: 1237521 - RNA, 16 nt, Mycobacterium leprae
gaaaaccccacacuga

SEQ ID NO: 1237522 - RNA, 23 nt, Mycobacterium leprae
gaaaacccgcgcgugcacaagga

SEQ ID NO: 1237523 - RNA, 12 nt, Mycobacterium leprae
gaaaacauucag

SEQ ID NO: 1237524 - RNA, 20 nt, Mycobacterium leprae
gaaaacacuuacaccaacau

SEQ ID NO: 1237525 - RNA, 21 nt, Mycobacterium leprae
gaaaacacuuacaccaacaua

SEQ ID NO: 1237526 - RNA, 18 nt, Mycobacterium leprae
gaaaacagcgccucacca

SEQ ID NO: 1237527 - RNA, 20 nt, Mycobacterium leprae
cuuuugaguuuaugcggcuc

SEQ ID NO: 1237528 - RNA, 20 nt, Mycobacterium leprae
cuuuuguccugacagauacu

SEQ ID NO: 1237529 - RNA, 22 nt, Mycobacterium leprae
cuuuuguccugacagauacuca

SEQ ID NO: 1237530 - RNA, 15 nt, Mycobacterium leprae
cuuuucgacauugcc

SEQ ID NO: 1237531 - RNA, 14 nt, Mycobacterium leprae
cuuuucgagggcag

SEQ ID NO: 1237532 - RNA, 13 nt, Mycobacterium leprae
cuuuuuagagaag

SEQ ID NO: 1237533 - RNA, 15 nt, Mycobacterium leprae
cuuuuaggugugguc

SEQ ID NO: 1237534 - RNA, 13 nt, Mycobacterium leprae
aaaaacucauguu

SEQ ID NO: 1237535 - RNA, 11 nt, Mycobacterium leprae
aaaaacuaggu

SEQ ID NO: 1237536 - RNA, 15 nt, Mycobacterium leprae
aaaaacucauguucu

SEQ ID NO: 1237537 - RNA, 12 nt, Mycobacterium leprae
aaaaccccacac

SEQ ID NO: 1237538 - RNA, 16 nt, Mycobacterium leprae
aaaaccacaaacucca

SEQ ID NO: 1237539 - RNA, 13 nt, Mycobacterium leprae
aaaaccacaagca

SEQ ID NO: 1237540 - RNA, 16 nt, Mycobacterium leprae
aaaacaacguaccuaa

SEQ ID NO: 1237541 - RNA, 15 nt, Mycobacterium leprae
aaaccacaaacucca

SEQ ID NO: 1237542 - RNA, 17 nt, Mycobacterium leprae
aaaccccacacugagaa

SEQ ID NO: 1237543 - RNA, 22 nt, Mycobacterium leprae
aaaccgaagaucaccgccacca

SEQ ID NO: 1237544 - RNA, 21 nt, Mycobacterium leprae
aaaccgcaguacuggugcugu

SEQ ID NO: 1237545 - RNA, 20 nt, Mycobacterium leprae
aaacagugccacagucacgc

SEQ ID NO: 1237546 - RNA, 14 nt, Mycobacterium leprae
aaacaccuaguugg

SEQ ID NO: 1237547 - RNA, 12 nt, Mycobacterium leprae
aaacacagcaag

SEQ ID NO: 1237548 - RNA, 14 nt, Mycobacterium leprae
aaacacagcaagca

SEQ ID NO: 1237549 - RNA, 13 nt, Mycobacterium leprae
aaaauaacuauaa

SEQ ID NO: 1237550 - RNA, 22 nt, Mycobacterium leprae
aaaaucucugugcgaaaacacu

SEQ ID NO: 1237551 - RNA, 21 nt, Mycobacterium leprae
aaaaucagguauuuccuaaaa

SEQ ID NO: 1237552 - RNA, 18 nt, Mycobacterium leprae
aaaaugaguugcaacauc

SEQ ID NO: 1237553 - RNA, 17 nt, Mycobacterium leprae
aaagaggccgacagaac

SEQ ID NO: 1237554 - RNA, 17 nt, Mycobacterium leprae
aaagaaagcucacugug

SEQ ID NO: 1237555 - RNA, 20 nt, Mycobacterium leprae
aaagaacgcgaccuguuggu

SEQ ID NO: 1237556 - RNA, 17 nt, Mycobacterium leprae
aaagcacacgaagccuc

SEQ ID NO: 1237557 - RNA, 15 nt, Mycobacterium leprae
aaagccugcuuccaa

SEQ ID NO: 1237558 - RNA, 15 nt, Mycobacterium leprae
aaagcgguuccuccc

SEQ ID NO: 1237559 - RNA, 20 nt, Mycobacterium leprae
aaaggaguucaacaaaacca

SEQ ID NO: 1237560 - RNA, 22 nt, Mycobacterium leprae
aaagucuugugcguagucgacc

SEQ ID NO: 1237561 - RNA, 22 nt, Mycobacterium leprae
aaauccgcugacaaaaccgcgg

SEQ ID NO: 1237562 - RNA, 21 nt, Mycobacterium leprae
aaaucggcaugaugugcucgg

SEQ ID NO: 1237563 - RNA, 19 nt, Mycobacterium leprae
aaaucgacguuugcaggug

SEQ ID NO: 1237564 - RNA, 19 nt, Mycobacterium leprae
aaauuuucaggcugucauc

SEQ ID NO: 1237565 - RNA, 17 nt, Mycobacterium leprae
aacaagaaaaggaccca

SEQ ID NO: 1237566 - RNA, 21 nt, Mycobacterium leprae
aacaagcgaucggaacaucac

SEQ ID NO: 1237567 - RNA, 14 nt, Mycobacterium leprae
aacaaccgaacaac

SEQ ID NO: 1237568 - RNA, 20 nt, Mycobacterium leprae
aacaacagacacauuguuuu

SEQ ID NO: 1237569 - RNA, 22 nt, Mycobacterium leprae
aacaaaucauagugaccaaaau

SEQ ID NO: 1237570 - RNA, 14 nt, Mycobacterium leprae
aaauugugggggug

SEQ ID NO: 1237571 - RNA, 16 nt, Mycobacterium leprae
aagauacuccgcgaaa

SEQ ID NO: 1237572 - RNA, 19 nt, Mycobacterium leprae
aagauacuggauucauugu

SEQ ID NO: 1237573 - RNA, 14 nt, Mycobacterium leprae
aagauaaauaguau

SEQ ID NO: 1237574 - RNA, 21 nt, Mycobacterium leprae
aagagagagcacaugaaaacc

SEQ ID NO: 1237575 - RNA, 17 nt, Mycobacterium leprae
aagacauaucaacaacu

SEQ ID NO: 1237576 - RNA, 14 nt, Mycobacterium leprae
aagacacgacagcc

SEQ ID NO: 1237577 - RNA, 15 nt, Mycobacterium leprae
aagaaacgacgcaua

SEQ ID NO: 1237578 - RNA, 21 nt, Mycobacterium leprae
aagacucagugaagaccaucu

SEQ ID NO: 1237579 - RNA, 20 nt, Mycobacterium leprae
aagacgagaucagugcaaua

SEQ ID NO: 1237580 - RNA, 13 nt, Mycobacterium leprae
aacuccugaucgg

SEQ ID NO: 1237581 - RNA, 15 nt, Mycobacterium leprae
aacucgaacaucccu

SEQ ID NO: 1237582 - RNA, 22 nt, Mycobacterium leprae
aacugacauauuugggagccag

SEQ ID NO: 1237583 - RNA, 15 nt, Mycobacterium leprae
aacggcggcaagguc

SEQ ID NO: 1237584 - RNA, 14 nt, Mycobacterium leprae
aacuauccucacac

SEQ ID NO: 1237585 - RNA, 15 nt, Mycobacterium leprae
aacucaucggcuccc

SEQ ID NO: 1237586 - RNA, 22 nt, Mycobacterium leprae
aacuuccuaugucgugcugacc

SEQ ID NO: 1237587 - RNA, 18 nt, Mycobacterium leprae
aacuguucggcuaugaga

SEQ ID NO: 1237588 - RNA, 22 nt, Mycobacterium leprae
aacuguucggcuaugagacgaa

SEQ ID NO: 1237589 - RNA, 17 nt, Mycobacterium leprae
aacgcucaacuguucgg

SEQ ID NO: 1237590 - RNA, 23 nt, Mycobacterium leprae
aacgcugaaaccgggguacaaua

SEQ ID NO: 1237591 - RNA, 16 nt, Mycobacterium leprae
aacgcugaccagcaga

SEQ ID NO: 1237592 - RNA, 17 nt, Mycobacterium leprae
aacgcgaugcgcaccuc

SEQ ID NO: 1237593 - RNA, 22 nt, Mycobacterium leprae
aacgaauaacugccaaucagca

SEQ ID NO: 1237594 - RNA, 17 nt, Mycobacterium leprae
aacgaagaguaucacaa

SEQ ID NO: 1237595 - RNA, 23 nt, Mycobacterium leprae
aacgagauccgagaucaguguga

SEQ ID NO: 1237596 - RNA, 19 nt, Mycobacterium leprae
aacgcacguaguuguacac

SEQ ID NO: 1237597 - RNA, 22 nt, Mycobacterium leprae
aacgcacuggagagcgccgcua

SEQ ID NO: 1237598 - RNA, 21 nt, Mycobacterium leprae
aaccguaguguuuuaccagcc

SEQ ID NO: 1237599 - RNA, 21 nt, Mycobacterium leprae
aacccgcaaaccaaacaacaa

SEQ ID NO: 1237600 - RNA, 16 nt, Mycobacterium leprae
aaccucggccgaggcg

SEQ ID NO: 1237601 - RNA, 18 nt, Mycobacterium leprae
aaccguucgacuucuggu

SEQ ID NO: 1237602 - RNA, 14 nt, Mycobacterium leprae
aaccuuacagucac

SEQ ID NO: 1237603 - RNA, 16 nt, Mycobacterium leprae
aaccugaucuuggaga

SEQ ID NO: 1237604 - RNA, 12 nt, Mycobacterium leprae
aaccuuggucug

SEQ ID NO: 1237605 - RNA, 14 nt, Mycobacterium leprae
aacccgaaaccaag

SEQ ID NO: 1237606 - RNA, 21 nt, Mycobacterium leprae
aaccacuuagcgugagccugg

SEQ ID NO: 1237607 - RNA, 14 nt, Mycobacterium leprae
aaccaaacaacaac

SEQ ID NO: 1237608 - RNA, 18 nt, Mycobacterium leprae
aacauuuuaaaacuggau

SEQ ID NO: 1237609 - RNA, 19 nt, Mycobacterium leprae
aacauggacaaccugggcg

SEQ ID NO: 1237610 - RNA, 23 nt, Mycobacterium leprae
aacaguuuaaguagaccagaagc

SEQ ID NO: 1237611 - RNA, 15 nt, Mycobacterium leprae
aacauagccagcauc

SEQ ID NO: 1237612 - RNA, 12 nt, Mycobacterium leprae
aacauagucaga

SEQ ID NO: 1237613 - RNA, 18 nt, Mycobacterium leprae
aacauagucagaucaacc

SEQ ID NO: 1237614 - RNA, 22 nt, Mycobacterium leprae
aacauagucagaucaaccaaau

SEQ ID NO: 1237615 - RNA, 14 nt, Mycobacterium leprae
aacauauccagugu

SEQ ID NO: 1237616 - RNA, 16 nt, Mycobacterium leprae
aacagcuugacaucag

SEQ ID NO: 1237617 - RNA, 20 nt, Mycobacterium leprae
aacagcucgacagcagguag

SEQ ID NO: 1237618 - RNA, 20 nt, Mycobacterium leprae
aacagcggggauaggagccc

SEQ ID NO: 1237619 - RNA, 21 nt, Mycobacterium leprae
aacagggccgaagcagccggg

SEQ ID NO: 1237620 - RNA, 15 nt, Mycobacterium leprae
aagcucaagcuugag

SEQ ID NO: 1237621 - RNA, 18 nt, Mycobacterium leprae
aagcucacugacaugucg

SEQ ID NO: 1237622 - RNA, 15 nt, Mycobacterium leprae
aagcuaucgguccau

SEQ ID NO: 1237623 - RNA, 19 nt, Mycobacterium leprae
aagcuagaucaacagcgca

SEQ ID NO: 1237624 - RNA, 17 nt, Mycobacterium leprae
aagcggguucccgcgau

SEQ ID NO: 1237625 - RNA, 20 nt, Mycobacterium leprae
aagccgugacucaacauaac

SEQ ID NO: 1237626 - RNA, 17 nt, Mycobacterium leprae
aagccggugccaggcag

SEQ ID NO: 1237627 - RNA, 19 nt, Mycobacterium leprae
aagcgaccggaugaacacg

SEQ ID NO: 1237628 - RNA, 16 nt, Mycobacterium leprae
aagcuggcgaacaaca

SEQ ID NO: 1237629 - RNA, 17 nt, Mycobacterium leprae
aagcugguggccccaau

SEQ ID NO: 1237630 - RNA, 17 nt, Mycobacterium leprae
aaggaccggugcugcag

SEQ ID NO: 1237631 - RNA, 20 nt, Mycobacterium leprae
aaggaucgagcggagcuggg

SEQ ID NO: 1237632 - RNA, 12 nt, Mycobacterium leprae
aaggaagaugac

SEQ ID NO: 1237633 - RNA, 21 nt, Mycobacterium leprae
aaggcucagcgcugaucaacg

SEQ ID NO: 1237634 - RNA, 21 nt, Mycobacterium leprae
aaggccgugucgguaggcugu

SEQ ID NO: 1237635 - RNA, 20 nt, Mycobacterium leprae
aaggccaugacaugcacacu

SEQ ID NO: 1237636 - RNA, 15 nt, Mycobacterium leprae
aagugcgaaguaaag

SEQ ID NO: 1237637 - RNA, 12 nt, Mycobacterium leprae
aagugacugcgu

SEQ ID NO: 1237638 - RNA, 18 nt, Mycobacterium leprae
aagugaccaccagggaug

SEQ ID NO: 1237639 - RNA, 19 nt, Mycobacterium leprae
aagucggucgccgagcuga

SEQ ID NO: 1237640 - RNA, 22 nt, Mycobacterium leprae
aagucgaggggacuggauaugc

SEQ ID NO: 1237641 - RNA, 16 nt, Mycobacterium leprae
aaguccuugcugguga

SEQ ID NO: 1237642 - RNA, 22 nt, Mycobacterium leprae
aagucacuccgacgguguauaa

SEQ ID NO: 1237643 - RNA, 13 nt, Mycobacterium leprae
aagucaaaaccag

SEQ ID NO: 1237644 - RNA, 16 nt, Mycobacterium leprae
aaguauucgaucucgu

SEQ ID NO: 1237645 - RNA, 23 nt, Mycobacterium leprae
aaguagcaguguggcauccgcca

SEQ ID NO: 1237646 - RNA, 19 nt, Mycobacterium leprae
aagggcuuucgcuggcucu

SEQ ID NO: 1237647 - RNA, 14 nt, Mycobacterium leprae
aaguagagaaaaau

SEQ ID NO: 1237648 - RNA, 15 nt, Mycobacterium leprae
aaguagagaaaaaug

SEQ ID NO: 1237649 - RNA, 17 nt, Mycobacterium leprae
aauaguauuauugacau

SEQ ID NO: 1237650 - RNA, 15 nt, Mycobacterium leprae
aauaguggcugaugu

SEQ ID NO: 1237651 - RNA, 19 nt, Mycobacterium leprae
aauaguggcugaugucuug

SEQ ID NO: 1237652 - RNA, 18 nt, Mycobacterium leprae
aauaccuaucgacauccu

SEQ ID NO: 1237653 - RNA, 20 nt, Mycobacterium leprae
aauacagagcguagaaacgc

SEQ ID NO: 1237654 - RNA, 21 nt, Mycobacterium leprae
aauaagcucgugggcggcggc

SEQ ID NO: 1237655 - RNA, 17 nt, Mycobacterium leprae
aaguuggugucaacagu

SEQ ID NO: 1237656 - RNA, 20 nt, Mycobacterium leprae
aaguuguaagugcaguuccu

SEQ ID NO: 1237657 - RNA, 18 nt, Mycobacterium leprae
aauaacugugcauaucaa

SEQ ID NO: 1237658 - RNA, 16 nt, Mycobacterium leprae
accaccgacaugcuua

SEQ ID NO: 1237659 - RNA, 13 nt, Mycobacterium leprae
accacccugcgcu

SEQ ID NO: 1237660 - RNA, 18 nt, Mycobacterium leprae
accaccgcggugagcggu

SEQ ID NO: 1237661 - RNA, 17 nt, Mycobacterium leprae
accacugaaccugccau

SEQ ID NO: 1237662 - RNA, 23 nt, Mycobacterium leprae
accacucucaucgcggcugccac

SEQ ID NO: 1237663 - RNA, 15 nt, Mycobacterium leprae
accacugcgcccuga

SEQ ID NO: 1237664 - RNA, 21 nt, Mycobacterium leprae
accacugccgaucgacauagu

SEQ ID NO: 1237665 - RNA, 19 nt, Mycobacterium leprae
accacuugcaguacaaugu

SEQ ID NO: 1237666 - RNA, 16 nt, Mycobacterium leprae
accacgccgacaccuc

SEQ ID NO: 1237667 - RNA, 15 nt, Mycobacterium leprae
accaagccggugcca

SEQ ID NO: 1237668 - RNA, 20 nt, Mycobacterium leprae
accacauugugugaccagcc

SEQ ID NO: 1237669 - RNA, 14 nt, Mycobacterium leprae
accaccaccgccac

SEQ ID NO: 1237670 - RNA, 15 nt, Mycobacterium leprae
accacacugugccug

SEQ ID NO: 1237671 - RNA, 12 nt, Mycobacterium leprae
accacacccugg

SEQ ID NO: 1237672 - RNA, 14 nt, Mycobacterium leprae
acaucccugggccg

SEQ ID NO: 1237673 - RNA, 19 nt, Mycobacterium leprae
acaucgaguccaagcucaa

SEQ ID NO: 1237674 - RNA, 21 nt, Mycobacterium leprae
acaucgauuuguaaaauuccu

SEQ ID NO: 1237675 - RNA, 21 nt, Mycobacterium leprae
acauccgagcaggucauaaac

SEQ ID NO: 1237676 - RNA, 20 nt, Mycobacterium leprae
acaucgccaccgaccgccuu

SEQ ID NO: 1237677 - RNA, 23 nt, Mycobacterium leprae
acaucgcaggugucgacggugaa

SEQ ID NO: 1237678 - RNA, 17 nt, Mycobacterium leprae
acaugauugcagauguu

SEQ ID NO: 1237679 - RNA, 13 nt, Mycobacterium leprae
acaugcacacuaa

SEQ ID NO: 1237680 - RNA, 14 nt, Mycobacterium leprae
acaugcacacuaaa

SEQ ID NO: 1237681 - RNA, 18 nt, Mycobacterium leprae
acaugcuuacgugcgccg

SEQ ID NO: 1237682 - RNA, 21 nt, Mycobacterium leprae
acauugcccgcguucauggca

SEQ ID NO: 1237683 - RNA, 15 nt, Mycobacterium leprae
acauucaggaugcug

SEQ ID NO: 1237684 - RNA, 16 nt, Mycobacterium leprae
acauucaggaugcugu

SEQ ID NO: 1237685 - RNA, 12 nt, Mycobacterium leprae
acaucagccuau

SEQ ID NO: 1237686 - RNA, 13 nt, Mycobacterium leprae
acauaucaacaac

SEQ ID NO: 1237687 - RNA, 19 nt, Mycobacterium leprae
acaggcauauaaucgcuuc

SEQ ID NO: 1237688 - RNA, 20 nt, Mycobacterium leprae
acauagucagaucaaccaaa

SEQ ID NO: 1237689 - RNA, 21 nt, Mycobacterium leprae
acauagucagaucaaccaaau

SEQ ID NO: 1237690 - RNA, 15 nt, Mycobacterium leprae
acauagguagauaaa

SEQ ID NO: 1237691 - RNA, 21 nt, Mycobacterium leprae
acagaagugguuuuggcagua

SEQ ID NO: 1237692 - RNA, 14 nt, Mycobacterium leprae
acagaagcaagucc

SEQ ID NO: 1237693 - RNA, 16 nt, Mycobacterium leprae
acagaacccauccgaa

SEQ ID NO: 1237694 - RNA, 23 nt, Mycobacterium leprae
acagaacccauccgaaucaccgc

SEQ ID NO: 1237695 - RNA, 23 nt, Mycobacterium leprae
acagaaccuucaucggaggcgaa

SEQ ID NO: 1237696 - RNA, 20 nt, Mycobacterium leprae
acacuucuacgaaaaaugag

SEQ ID NO: 1237697 - RNA, 15 nt, Mycobacterium leprae
acacguuucugcaug

SEQ ID NO: 1237698 - RNA, 22 nt, Mycobacterium leprae
acacuacagcgugaaccaaagc

SEQ ID NO: 1237699 - RNA, 18 nt, Mycobacterium leprae
acacuacuccugcugacg

SEQ ID NO: 1237700 - RNA, 18 nt, Mycobacterium leprae
acacuacuguugucagug

SEQ ID NO: 1237701 - RNA, 15 nt, Mycobacterium leprae
acacuagggagguca

SEQ ID NO: 1237702 - RNA, 16 nt, Mycobacterium leprae
acacccuggcugggcu

SEQ ID NO: 1237703 - RNA, 19 nt, Mycobacterium leprae
acacugaaccgggcagucu

SEQ ID NO: 1237704 - RNA, 18 nt, Mycobacterium leprae
acagcacccccggccagg

SEQ ID NO: 1237705 - RNA, 21 nt, Mycobacterium leprae
acagcacccccggccaggugg

SEQ ID NO: 1237706 - RNA, 15 nt, Mycobacterium leprae
acagcacggcgcuca

SEQ ID NO: 1237707 - RNA, 21 nt, Mycobacterium leprae
acagcagagggcaauacgcug

SEQ ID NO: 1237708 - RNA, 21 nt, Mycobacterium leprae
acagaugcgaucgcagucauc

SEQ ID NO: 1237709 - RNA, 19 nt, Mycobacterium leprae
acagaggcgcgccgugcca

SEQ ID NO: 1237710 - RNA, 15 nt, Mycobacterium leprae
acaggacccagcgau

SEQ ID NO: 1237711 - RNA, 24 nt, Mycobacterium leprae
acaggacccagcgauaucaagcug

SEQ ID NO: 1237712 - RNA, 13 nt, Mycobacterium leprae
acagcugguucau

SEQ ID NO: 1237713 - RNA, 13 nt, Mycobacterium leprae
acagcccaggugc

SEQ ID NO: 1237714 - RNA, 18 nt, Mycobacterium leprae
acagcccaguaggcacca

SEQ ID NO: 1237715 - RNA, 15 nt, Mycobacterium leprae
acaccagagacaccu

SEQ ID NO: 1237716 - RNA, 18 nt, Mycobacterium leprae
acacacccuccugcaggu

SEQ ID NO: 1237717 - RNA, 19 nt, Mycobacterium leprae
acacagaacgguucaacgg

SEQ ID NO: 1237718 - RNA, 20 nt, Mycobacterium leprae
acacaggaauuuagaggcug

SEQ ID NO: 1237719 - RNA, 20 nt, Mycobacterium leprae
acacagccguugcugcugcc

SEQ ID NO: 1237720 - RNA, 14 nt, Mycobacterium leprae
acacagccgucagg

SEQ ID NO: 1237721 - RNA, 22 nt, Mycobacterium leprae
acacaaguugucguuccagcuu

SEQ ID NO: 1237722 - RNA, 15 nt, Mycobacterium leprae
acaagagaagagcug

SEQ ID NO: 1237723 - RNA, 13 nt, Mycobacterium leprae
acaagccaauuag

SEQ ID NO: 1237724 - RNA, 18 nt, Mycobacterium leprae
acaagauugcagcccuga

SEQ ID NO: 1237725 - RNA, 12 nt, Mycobacterium leprae
acaauaaacugg

SEQ ID NO: 1237726 - RNA, 13 nt, Mycobacterium leprae
acaagucaaaacc

SEQ ID NO: 1237727 - RNA, 15 nt, Mycobacterium leprae
acaagucaaaaccag

SEQ ID NO: 1237728 - RNA, 20 nt, Mycobacterium leprae
acaacggugccgggucagag

SEQ ID NO: 1237729 - RNA, 12 nt, Mycobacterium leprae
acaacggaccac

SEQ ID NO: 1237730 - RNA, 14 nt, Mycobacterium leprae
acaacggaccacua

SEQ ID NO: 1237731 - RNA, 16 nt, Mycobacterium leprae
acaacuucaaccaagc

SEQ ID NO: 1237732 - RNA, 18 nt, Mycobacterium leprae
acaacuugacgaugcugu

SEQ ID NO: 1237733 - RNA, 16 nt, Mycobacterium leprae
aauuccgcuacaguaa

SEQ ID NO: 1237734 - RNA, 15 nt, Mycobacterium leprae
aauucuucucuaaaa

SEQ ID NO: 1237735 - RNA, 17 nt, Mycobacterium leprae
aauucuucucuaaaaag

SEQ ID NO: 1237736 - RNA, 20 nt, Mycobacterium leprae
aauugcgauaaugcacugcg

SEQ ID NO: 1237737 - RNA, 12 nt, Mycobacterium leprae
aauugaucacaa

SEQ ID NO: 1237738 - RNA, 13 nt, Mycobacterium leprae
aauggugcaaggg

SEQ ID NO: 1237739 - RNA, 14 nt, Mycobacterium leprae
aauuaauauauaua

SEQ ID NO: 1237740 - RNA, 20 nt, Mycobacterium leprae
aauuugccaucaaaugggga

SEQ ID NO: 1237741 - RNA, 20 nt, Mycobacterium leprae
aauuuuguguacuggacccg

SEQ ID NO: 1237742 - RNA, 19 nt, Mycobacterium leprae
aauuucuucucguccaggc

SEQ ID NO: 1237743 - RNA, 21 nt, Mycobacterium leprae
aaugcugccugcgucaguaag

SEQ ID NO: 1237744 - RNA, 22 nt, Mycobacterium leprae
aaugcugccugcgucaguaagu

SEQ ID NO: 1237745 - RNA, 16 nt, Mycobacterium leprae
aaugcugcagcuggga

SEQ ID NO: 1237746 - RNA, 15 nt, Mycobacterium leprae
aaugcuaugauaauu

SEQ ID NO: 1237747 - RNA, 17 nt, Mycobacterium leprae
aaugcuaugauaauuug

SEQ ID NO: 1237748 - RNA, 14 nt, Mycobacterium leprae
aaugccgggcugca

SEQ ID NO: 1237749 - RNA, 20 nt, Mycobacterium leprae
aaucauagugaccaaaauuu

SEQ ID NO: 1237750 - RNA, 22 nt, Mycobacterium leprae
aauccuuugcugguggaaggcc

SEQ ID NO: 1237751 - RNA, 12 nt, Mycobacterium leprae
aaucgaaaaaug

SEQ ID NO: 1237752 - RNA, 17 nt, Mycobacterium leprae
aaucgcuagcgauucgg

SEQ ID NO: 1237753 - RNA, 14 nt, Mycobacterium leprae
acucugccgccucg

SEQ ID NO: 1237754 - RNA, 22 nt, Mycobacterium leprae
acucucaucgcggcugccacug

SEQ ID NO: 1237755 - RNA, 14 nt, Mycobacterium leprae
acucuucugcugga

SEQ ID NO: 1237756 - RNA, 15 nt, Mycobacterium leprae
acucuucugcuggaa

SEQ ID NO: 1237757 - RNA, 21 nt, Mycobacterium leprae
acucuugacuaaagucaugca

SEQ ID NO: 1237758 - RNA, 19 nt, Mycobacterium leprae
acucggagcaaggugguga

SEQ ID NO: 1237759 - RNA, 12 nt, Mycobacterium leprae
acucggcagagc

SEQ ID NO: 1237760 - RNA, 13 nt, Mycobacterium leprae
acucggcagagcg

SEQ ID NO: 1237761 - RNA, 18 nt, Mycobacterium leprae
acucggcagagcguucga

SEQ ID NO: 1237762 - RNA, 14 nt, Mycobacterium leprae
acuccguacucacg

SEQ ID NO: 1237763 - RNA, 15 nt, Mycobacterium leprae
acuccguacucacgu

SEQ ID NO: 1237764 - RNA, 15 nt, Mycobacterium leprae
acuggacguggcggu

SEQ ID NO: 1237765 - RNA, 19 nt, Mycobacterium leprae
acuggaguacuggcggccg

SEQ ID NO: 1237766 - RNA, 11 nt, Mycobacterium leprae
acugcuggagg

SEQ ID NO: 1237767 - RNA, 13 nt, Mycobacterium leprae
acugcugcacccg

SEQ ID NO: 1237768 - RNA, 18 nt, Mycobacterium leprae
acugcgacagcagccacu

SEQ ID NO: 1237769 - RNA, 24 nt, Mycobacterium leprae
acugccaaaguccaugugcugaca

SEQ ID NO: 1237770 - RNA, 19 nt, Mycobacterium leprae
acugaggauccugaccuug

SEQ ID NO: 1237771 - RNA, 23 nt, Mycobacterium leprae
acuucgcccucuuugaucagcaa

SEQ ID NO: 1237772 - RNA, 23 nt, Mycobacterium leprae
acuuccuaugucgugcugaccag

SEQ ID NO: 1237773 - RNA, 13 nt, Mycobacterium leprae
acuuccucugcca

SEQ ID NO: 1237774 - RNA, 17 nt, Mycobacterium leprae
acuucgacgaucaccgc

SEQ ID NO: 1237775 - RNA, 12 nt, Mycobacterium leprae
acuugacacaaa

SEQ ID NO: 1237776 - RNA, 14 nt, Mycobacterium leprae
acuugacuccucug

SEQ ID NO: 1237777 - RNA, 22 nt, Mycobacterium leprae
acuugacuccucugcuggaucu

SEQ ID NO: 1237778 - RNA, 21 nt, Mycobacterium leprae
acuggcaguuagcaugagcug

SEQ ID NO: 1237779 - RNA, 14 nt, Mycobacterium leprae
acuguugcuugccc

SEQ ID NO: 1237780 - RNA, 21 nt, Mycobacterium leprae
acugucuaccguugacguggu

SEQ ID NO: 1237781 - RNA, 20 nt, Mycobacterium leprae
acugugaaucugaugacgcg

SEQ ID NO: 1237782 - RNA, 13 nt, Mycobacterium leprae
acugugcauauca

SEQ ID NO: 1237783 - RNA, 13 nt, Mycobacterium leprae
acuuaaugugucu

SEQ ID NO: 1237784 - RNA, 12 nt, Mycobacterium leprae
acuuacaccaac

SEQ ID NO: 1237785 - RNA, 20 nt, Mycobacterium leprae
acuuaccgcggcggccaacu

SEQ ID NO: 1237786 - RNA, 17 nt, Mycobacterium leprae
acuucaucaacugagua

SEQ ID NO: 1237787 - RNA, 22 nt, Mycobacterium leprae
acuucagcgacaggcagcugca

SEQ ID NO: 1237788 - RNA, 21 nt, Mycobacterium leprae
acuucagcgagcgugucaugg

SEQ ID NO: 1237789 - RNA, 19 nt, Mycobacterium leprae
acuuauuuauauucaauuu

SEQ ID NO: 1237790 - RNA, 12 nt, Mycobacterium leprae
acuuacuucugu

SEQ ID NO: 1237791 - RNA, 18 nt, Mycobacterium leprae
acuuagauuggaaggcau

SEQ ID NO: 1237792 - RNA, 19 nt, Mycobacterium leprae
acguuggacgaccacguca

SEQ ID NO: 1237793 - RNA, 13 nt, Mycobacterium leprae
acguugucgaaaa

SEQ ID NO: 1237794 - RNA, 18 nt, Mycobacterium leprae
acguuggccggcaugcga

SEQ ID NO: 1237795 - RNA, 14 nt, Mycobacterium leprae
acguuggcgcucug

SEQ ID NO: 1237796 - RNA, 14 nt, Mycobacterium leprae
acuaaaacgccccu

SEQ ID NO: 1237797 - RNA, 17 nt, Mycobacterium leprae
acgugcugucaccaagc

SEQ ID NO: 1237798 - RNA, 23 nt, Mycobacterium leprae
acgugcggcggccuuggcagccg

SEQ ID NO: 1237799 - RNA, 15 nt, Mycobacterium leprae
acgugccgugaucag

SEQ ID NO: 1237800 - RNA, 14 nt, Mycobacterium leprae
acgugccuguucag

SEQ ID NO: 1237801 - RNA, 18 nt, Mycobacterium leprae
acgugccuguucaggugc

SEQ ID NO: 1237802 - RNA, 15 nt, Mycobacterium leprae
acgucugucacccgu

SEQ ID NO: 1237803 - RNA, 20 nt, Mycobacterium leprae
acuaacguucggugacgaac

SEQ ID NO: 1237804 - RNA, 23 nt, Mycobacterium leprae
acuaagccccgucgcgagcugaa

SEQ ID NO: 1237805 - RNA, 23 nt, Mycobacterium leprae
acuaagccgaguugaagugcugc

SEQ ID NO: 1237806 - RNA, 13 nt, Mycobacterium leprae
acuaauaagcucg

SEQ ID NO: 1237807 - RNA, 16 nt, Mycobacterium leprae
acuaauuagaggccaa

SEQ ID NO: 1237808 - RNA, 19 nt, Mycobacterium leprae
acuauauauauauuaauuc

SEQ ID NO: 1237809 - RNA, 17 nt, Mycobacterium leprae
acuauuucccacuggau

SEQ ID NO: 1237810 - RNA, 20 nt, Mycobacterium leprae
acuauuccggucgucaagcu

SEQ ID NO: 1237811 - RNA, 18 nt, Mycobacterium leprae
acggauaaguccacaccu

SEQ ID NO: 1237812 - RNA, 19 nt, Mycobacterium leprae
acgcugcacauucaaccag

SEQ ID NO: 1237813 - RNA, 15 nt, Mycobacterium leprae
acgcugaaccgcguc

SEQ ID NO: 1237814 - RNA, 21 nt, Mycobacterium leprae
acgcuauguuggccagcagcg

SEQ ID NO: 1237815 - RNA, 15 nt, Mycobacterium leprae
acggcuuugcaaagc

SEQ ID NO: 1237816 - RNA, 22 nt, Mycobacterium leprae
acggcuacggggugggcagccu

SEQ ID NO: 1237817 - RNA, 21 nt, Mycobacterium leprae
acggcaaccuucuagcgcaga

SEQ ID NO: 1237818 - RNA, 12 nt, Mycobacterium leprae
acggugcaggug

SEQ ID NO: 1237819 - RNA, 18 nt, Mycobacterium leprae
acggugccgaacugcugc

SEQ ID NO: 1237820 - RNA, 14 nt, Mycobacterium leprae
acggugcaccagcu

SEQ ID NO: 1237821 - RNA, 20 nt, Mycobacterium leprae
acggugcugauggccggccu

SEQ ID NO: 1237822 - RNA, 16 nt, Mycobacterium leprae
acgguggcaccagugu

SEQ ID NO: 1237823 - RNA, 13 nt, Mycobacterium leprae
acguaaucgccuu

SEQ ID NO: 1237824 - RNA, 12 nt, Mycobacterium leprae
acgcaugacacc

SEQ ID NO: 1237825 - RNA, 22 nt, Mycobacterium leprae
acgcaccgcguaacagauuauu

SEQ ID NO: 1237826 - RNA, 18 nt, Mycobacterium leprae
acgcaaccaaggcuccca

SEQ ID NO: 1237827 - RNA, 20 nt, Mycobacterium leprae
acgcaacgagguaagacaag

SEQ ID NO: 1237828 - RNA, 13 nt, Mycobacterium leprae
acgcaaguucgac

SEQ ID NO: 1237829 - RNA, 21 nt, Mycobacterium leprae
acgcaaguucgacguggucga

SEQ ID NO: 1237830 - RNA, 13 nt, Mycobacterium leprae
acgcagcucugga

SEQ ID NO: 1237831 - RNA, 16 nt, Mycobacterium leprae
acgagaucagugcaau

SEQ ID NO: 1237832 - RNA, 22 nt, Mycobacterium leprae
acgaaggggucgaugaggcucg

SEQ ID NO: 1237833 - RNA, 13 nt, Mycobacterium leprae
acgacuugaccag

SEQ ID NO: 1237834 - RNA, 21 nt, Mycobacterium leprae
acgacuugcccguaguugugu

SEQ ID NO: 1237835 - RNA, 21 nt, Mycobacterium leprae
acgaacugggugaccacccac

SEQ ID NO: 1237836 - RNA, 15 nt, Mycobacterium leprae
acgaagaugaugccu

SEQ ID NO: 1237837 - RNA, 13 nt, Mycobacterium leprae
acgaagccucauc

SEQ ID NO: 1237838 - RNA, 13 nt, Mycobacterium leprae
acgauuuugcaac

SEQ ID NO: 1237839 - RNA, 16 nt, Mycobacterium leprae
acgauuucggcucagc

SEQ ID NO: 1237840 - RNA, 15 nt, Mycobacterium leprae
acgauuccuggaaag

SEQ ID NO: 1237841 - RNA, 19 nt, Mycobacterium leprae
acgauuggcuuaaugaucg

SEQ ID NO: 1237842 - RNA, 17 nt, Mycobacterium leprae
acgaugugcagcagcuc

SEQ ID NO: 1237843 - RNA, 18 nt, Mycobacterium leprae
acgaugcgugccccggcc

SEQ ID NO: 1237844 - RNA, 17 nt, Mycobacterium leprae
acgaugcuugaugucgu

SEQ ID NO: 1237845 - RNA, 18 nt, Mycobacterium leprae
acgauccacuugacgguc

SEQ ID NO: 1237846 - RNA, 23 nt, Mycobacterium leprae
accuguuggugagauuucagccg

SEQ ID NO: 1237847 - RNA, 17 nt, Mycobacterium leprae
accuguguaucagugcu

SEQ ID NO: 1237848 - RNA, 16 nt, Mycobacterium leprae
accuggucaccaaccg

SEQ ID NO: 1237849 - RNA, 22 nt, Mycobacterium leprae
accugguccgucgaguggcuug

SEQ ID NO: 1237850 - RNA, 19 nt, Mycobacterium leprae
accuuacaaagaucaagau

SEQ ID NO: 1237851 - RNA, 17 nt, Mycobacterium leprae
acgaaauucggcggcca

SEQ ID NO: 1237852 - RNA, 22 nt, Mycobacterium leprae
acgaacccgucgaugaucuaac

SEQ ID NO: 1237853 - RNA, 14 nt, Mycobacterium leprae
accggugcugcagc

SEQ ID NO: 1237854 - RNA, 21 nt, Mycobacterium leprae
accgguggguuugacgcauga

SEQ ID NO: 1237855 - RNA, 16 nt, Mycobacterium leprae
accuagucgaggcuca

SEQ ID NO: 1237856 - RNA, 22 nt, Mycobacterium leprae
accuccguugucccgcccggcc

SEQ ID NO: 1237857 - RNA, 14 nt, Mycobacterium leprae
accucagcaacuuc

SEQ ID NO: 1237858 - RNA, 22 nt, Mycobacterium leprae
accucacgauuucggcucagca

SEQ ID NO: 1237859 - RNA, 21 nt, Mycobacterium leprae
accucaaggccaugacaugca

SEQ ID NO: 1237860 - RNA, 15 nt, Mycobacterium leprae
accucguauggcgcc

SEQ ID NO: 1237861 - RNA, 21 nt, Mycobacterium leprae
accucgccaacgguaucuccc

SEQ ID NO: 1237862 - RNA, 20 nt, Mycobacterium leprae
accgcgguaggccagguuag

SEQ ID NO: 1237863 - RNA, 22 nt, Mycobacterium leprae
accgcgguaauagcaauaacca

SEQ ID NO: 1237864 - RNA, 19 nt, Mycobacterium leprae
accgggcgcccgaacaggc

SEQ ID NO: 1237865 - RNA, 21 nt, Mycobacterium leprae
accggcuuagcccgcugcugc

SEQ ID NO: 1237866 - RNA, 13 nt, Mycobacterium leprae
accggcugcaccu

SEQ ID NO: 1237867 - RNA, 15 nt, Mycobacterium leprae
accggcugaggcggc

SEQ ID NO: 1237868 - RNA, 16 nt, Mycobacterium leprae
accggcgaucuugccc

SEQ ID NO: 1237869 - RNA, 15 nt, Mycobacterium leprae
acccguugagcugca

SEQ ID NO: 1237870 - RNA, 19 nt, Mycobacterium leprae
acccgugcccaagacucag

SEQ ID NO: 1237871 - RNA, 15 nt, Mycobacterium leprae
acccucucagcaauc

SEQ ID NO: 1237872 - RNA, 19 nt, Mycobacterium leprae
acccucuucuaggcaugaa

SEQ ID NO: 1237873 - RNA, 14 nt, Mycobacterium leprae
accgaugcagggcc

SEQ ID NO: 1237874 - RNA, 20 nt, Mycobacterium leprae
accgcacaguuccagugccu

SEQ ID NO: 1237875 - RNA, 15 nt, Mycobacterium leprae
accgcaacugguuga

SEQ ID NO: 1237876 - RNA, 19 nt, Mycobacterium leprae
accgauagaccgcuacaac

SEQ ID NO: 1237877 - RNA, 12 nt, Mycobacterium leprae
accgagccgguc

SEQ ID NO: 1237878 - RNA, 16 nt, Mycobacterium leprae
accgccgaagcagcca

SEQ ID NO: 1237879 - RNA, 23 nt, Mycobacterium leprae
accgccgacgaaugcagcagcca

SEQ ID NO: 1237880 - RNA, 17 nt, Mycobacterium leprae
accgcccgguaucccaa

SEQ ID NO: 1237881 - RNA, 16 nt, Mycobacterium leprae
acccgcgcgugcacaa

SEQ ID NO: 1237882 - RNA, 14 nt, Mycobacterium leprae
acccggcagaggca

SEQ ID NO: 1237883 - RNA, 16 nt, Mycobacterium leprae
acccggaaggugucug

SEQ ID NO: 1237884 - RNA, 22 nt, Mycobacterium leprae
acccgggggcgguggaaggauc

SEQ ID NO: 1237885 - RNA, 22 nt, Mycobacterium leprae
acccgggacuugacuccucugc

SEQ ID NO: 1237886 - RNA, 15 nt, Mycobacterium leprae
acccgggagucgaca

SEQ ID NO: 1237887 - RNA, 12 nt, Mycobacterium leprae
accccggcauuu

SEQ ID NO: 1237888 - RNA, 14 nt, Mycobacterium leprae
accccggacggcca

SEQ ID NO: 1237889 - RNA, 18 nt, Mycobacterium leprae
accccagucgagccaccu

SEQ ID NO: 1237890 - RNA, 20 nt, Mycobacterium leprae
accccagacgucaaccuuug

SEQ ID NO: 1237891 - RNA, 19 nt, Mycobacterium leprae
acccaaggauucagccaag

SEQ ID NO: 1237892 - RNA, 18 nt, Mycobacterium leprae
acccaauagagcagugcu

SEQ ID NO: 1237893 - RNA, 20 nt, Mycobacterium leprae
accauuuccgcuaaugccaa

SEQ ID NO: 1237894 - RNA, 23 nt, Mycobacterium leprae
accauuuccgcuaaugccaagca

SEQ ID NO: 1237895 - RNA, 20 nt, Mycobacterium leprae
accaugagcacacgcugcgu

SEQ ID NO: 1237896 - RNA, 16 nt, Mycobacterium leprae
accaucagaaaaccgu

SEQ ID NO: 1237897 - RNA, 21 nt, Mycobacterium leprae
agcagugccuuguguucggca

SEQ ID NO: 1237898 - RNA, 15 nt, Mycobacterium leprae
agcaguguggcaucc

SEQ ID NO: 1237899 - RNA, 11 nt, Mycobacterium leprae
agcaugacagg

SEQ ID NO: 1237900 - RNA, 17 nt, Mycobacterium leprae
agcaucggcaacgcugu

SEQ ID NO: 1237901 - RNA, 11 nt, Mycobacterium leprae
agcaucggcag

SEQ ID NO: 1237902 - RNA, 18 nt, Mycobacterium leprae
agcagcucucuacucguc

SEQ ID NO: 1237903 - RNA, 16 nt, Mycobacterium leprae
agcagcgcgcagaaca

SEQ ID NO: 1237904 - RNA, 15 nt, Mycobacterium leprae
agcacugcaguaacc

SEQ ID NO: 1237905 - RNA, 13 nt, Mycobacterium leprae
agcagcaggcuga

SEQ ID NO: 1237906 - RNA, 17 nt, Mycobacterium leprae
agcagcaguuuccaaca

SEQ ID NO: 1237907 - RNA, 14 nt, Mycobacterium leprae
agcagcacggggug

SEQ ID NO: 1237908 - RNA, 13 nt, Mycobacterium leprae
agcacuaguaauc

SEQ ID NO: 1237909 - RNA, 16 nt, Mycobacterium leprae
agcaccggcauggccg

SEQ ID NO: 1237910 - RNA, 17 nt, Mycobacterium leprae
agcaccggcauggccgc

SEQ ID NO: 1237911 - RNA, 20 nt, Mycobacterium leprae
agcaccggcauggccgcugg

SEQ ID NO: 1237912 - RNA, 17 nt, Mycobacterium leprae
agcaccugccgcagcgg

SEQ ID NO: 1237913 - RNA, 15 nt, Mycobacterium leprae
agcaccucagcaacu

SEQ ID NO: 1237914 - RNA, 14 nt, Mycobacterium leprae
agccauucuagguu

SEQ ID NO: 1237915 - RNA, 16 nt, Mycobacterium leprae
agccaggagaagcgcu

SEQ ID NO: 1237916 - RNA, 21 nt, Mycobacterium leprae
agccaugcaaccacacccugg

SEQ ID NO: 1237917 - RNA, 23 nt, Mycobacterium leprae
agccaugcaaccacacccuggcu

SEQ ID NO: 1237918 - RNA, 13 nt, Mycobacterium leprae
agccaucucuauu

SEQ ID NO: 1237919 - RNA, 18 nt, Mycobacterium leprae
agccaucucuauuuggua

SEQ ID NO: 1237920 - RNA, 17 nt, Mycobacterium leprae
agcaugcccagaccgaa

SEQ ID NO: 1237921 - RNA, 22 nt, Mycobacterium leprae
agcaugcccagaccgaaaacca

SEQ ID NO: 1237922 - RNA, 14 nt, Mycobacterium leprae
agcaugagcugcug

SEQ ID NO: 1237923 - RNA, 15 nt, Mycobacterium leprae
agcaugagcugcugg

SEQ ID NO: 1237924 - RNA, 17 nt, Mycobacterium leprae
agcaugcgccuccagcu

SEQ ID NO: 1237925 - RNA, 14 nt, Mycobacterium leprae
agccagcaaggcaa

SEQ ID NO: 1237926 - RNA, 22 nt, Mycobacterium leprae
agccagaauggaguuggugucu

SEQ ID NO: 1237927 - RNA, 22 nt, Mycobacterium leprae
agccccuggcaucaucaacaug

SEQ ID NO: 1237928 - RNA, 23 nt, Mycobacterium leprae
agcccacguccugaauucagccg

SEQ ID NO: 1237929 - RNA, 16 nt, Mycobacterium leprae
agcccacgccuagcua

SEQ ID NO: 1237930 - RNA, 22 nt, Mycobacterium leprae
agcccauccguccaccccgggc

SEQ ID NO: 1237931 - RNA, 22 nt, Mycobacterium leprae
agcccaggugcccagccccugg

SEQ ID NO: 1237932 - RNA, 18 nt, Mycobacterium leprae
agccgagguucccggcgg

SEQ ID NO: 1237933 - RNA, 23 nt, Mycobacterium leprae
agccgagguucccggcggccaau

SEQ ID NO: 1237934 - RNA, 22 nt, Mycobacterium leprae
agccgaggggccgucggcaacu

SEQ ID NO: 1237935 - RNA, 17 nt, Mycobacterium leprae
agcccuucacuuccgcu

SEQ ID NO: 1237936 - RNA, 13 nt, Mycobacterium leprae
agcccugcccggc

SEQ ID NO: 1237937 - RNA, 20 nt, Mycobacterium leprae
agcccgcaucggcccgcaac

SEQ ID NO: 1237938 - RNA, 15 nt, Mycobacterium leprae
agcccgcgccgccgu

SEQ ID NO: 1237939 - RNA, 18 nt, Mycobacterium leprae
agcuauagggcacgcugu

SEQ ID NO: 1237940 - RNA, 13 nt, Mycobacterium leprae
agcuaugcaguga

SEQ ID NO: 1237941 - RNA, 23 nt, Mycobacterium leprae
agcuaguuuaccgugguugcuga

SEQ ID NO: 1237942 - RNA, 19 nt, Mycobacterium leprae
agcucaugacuuauaguca

SEQ ID NO: 1237943 - RNA, 17 nt, Mycobacterium leprae
agcucagcaacuuuccu

SEQ ID NO: 1237944 - RNA, 15 nt, Mycobacterium leprae
agcuaaagugcugcu

SEQ ID NO: 1237945 - RNA, 16 nt, Mycobacterium leprae
agcuaaagugcugcug

SEQ ID NO: 1237946 - RNA, 15 nt, Mycobacterium leprae
agcuaaacagcaauu

SEQ ID NO: 1237947 - RNA, 19 nt, Mycobacterium leprae
agcguuuaaguaacaugcu

SEQ ID NO: 1237948 - RNA, 16 nt, Mycobacterium leprae
agcguucguagagcug

SEQ ID NO: 1237949 - RNA, 20 nt, Mycobacterium leprae
agcuacuuuucgugcugccg

SEQ ID NO: 1237950 - RNA, 20 nt, Mycobacterium leprae
agcgguucaucgacaggaaa

SEQ ID NO: 1237951 - RNA, 19 nt, Mycobacterium leprae
agcggcggccgugauuuuc

SEQ ID NO: 1237952 - RNA, 14 nt, Mycobacterium leprae
agcgcuaaauggac

SEQ ID NO: 1237953 - RNA, 19 nt, Mycobacterium leprae
agcgucccaaccaaucucc

SEQ ID NO: 1237954 - RNA, 13 nt, Mycobacterium leprae
agcgugaauuacu

SEQ ID NO: 1237955 - RNA, 14 nt, Mycobacterium leprae
agcgugaauuacuc

SEQ ID NO: 1237956 - RNA, 23 nt, Mycobacterium leprae
agcgugcuuuggauuuuccaguu

SEQ ID NO: 1237957 - RNA, 23 nt, Mycobacterium leprae
agcgcacacguacucuggugaau

SEQ ID NO: 1237958 - RNA, 15 nt, Mycobacterium leprae
agcgcaucagccaac

SEQ ID NO: 1237959 - RNA, 16 nt, Mycobacterium leprae
agcgcaucagccaaca

SEQ ID NO: 1237960 - RNA, 12 nt, Mycobacterium leprae
agcgauuuggac

SEQ ID NO: 1237961 - RNA, 14 nt, Mycobacterium leprae
agcgauucgggaga

SEQ ID NO: 1237962 - RNA, 18 nt, Mycobacterium leprae
agcgccgagcacuagcuu

SEQ ID NO: 1237963 - RNA, 20 nt, Mycobacterium leprae
agcgagaagccccauggcac

SEQ ID NO: 1237964 - RNA, 20 nt, Mycobacterium leprae
agcgagccaucgcaauuaac

SEQ ID NO: 1237965 - RNA, 19 nt, Mycobacterium leprae
agcgacggaucuguaggga

SEQ ID NO: 1237966 - RNA, 12 nt, Mycobacterium leprae
agcgaucuaccu

SEQ ID NO: 1237967 - RNA, 16 nt, Mycobacterium leprae
agcgaucgacccaagc

SEQ ID NO: 1237968 - RNA, 23 nt, Mycobacterium leprae
agcgaugugugcaggaccgugcu

SEQ ID NO: 1237969 - RNA, 22 nt, Mycobacterium leprae
agccgccacgaccaaaccucug

SEQ ID NO: 1237970 - RNA, 17 nt, Mycobacterium leprae
agcgaaaaugaaaacaa

SEQ ID NO: 1237971 - RNA, 23 nt, Mycobacterium leprae
agccuguuguugugccuucugca

SEQ ID NO: 1237972 - RNA, 13 nt, Mycobacterium leprae
agccugcuuccaa

SEQ ID NO: 1237973 - RNA, 14 nt, Mycobacterium leprae
agcaaauuugugcc

SEQ ID NO: 1237974 - RNA, 18 nt, Mycobacterium leprae
agauugcggacaauucaa

SEQ ID NO: 1237975 - RNA, 15 nt, Mycobacterium leprae
agauguucaagcgaa

SEQ ID NO: 1237976 - RNA, 16 nt, Mycobacterium leprae
agauguucaagcgaac

SEQ ID NO: 1237977 - RNA, 23 nt, Mycobacterium leprae
agaugcgaucgcagucaucaccc

SEQ ID NO: 1237978 - RNA, 22 nt, Mycobacterium leprae
agauggcuccccgagccgcuuu

SEQ ID NO: 1237979 - RNA, 22 nt, Mycobacterium leprae
agauggcgucaccgugcagcgu

SEQ ID NO: 1237980 - RNA, 19 nt, Mycobacterium leprae
agaugacucggcgugccac

SEQ ID NO: 1237981 - RNA, 15 nt, Mycobacterium leprae
agaugacggcaaaaa

SEQ ID NO: 1237982 - RNA, 19 nt, Mycobacterium leprae
aaaacccacuucggcacag

SEQ ID NO: 1237983 - RNA, 13 nt, Mycobacterium leprae
agauacuggauuc

SEQ ID NO: 1237984 - RNA, 17 nt, Mycobacterium leprae
agauaucuacugggccg

SEQ ID NO: 1237985 - RNA, 17 nt, Mycobacterium leprae
agaggcggucggcggcu

SEQ ID NO: 1237986 - RNA, 12 nt, Mycobacterium leprae
agaggcaccugg

SEQ ID NO: 1237987 - RNA, 14 nt, Mycobacterium leprae
agagguucuaggua

SEQ ID NO: 1237988 - RNA, 20 nt, Mycobacterium leprae
agagguuuuccacugcauug

SEQ ID NO: 1237989 - RNA, 22 nt, Mycobacterium leprae
agagguuuuccacugcauugca

SEQ ID NO: 1237990 - RNA, 14 nt, Mycobacterium leprae
agaggcugcaguca

SEQ ID NO: 1237991 - RNA, 15 nt, Mycobacterium leprae
agagguccugcaguc

SEQ ID NO: 1237992 - RNA, 18 nt, Mycobacterium leprae
agaggguccggaccugga

SEQ ID NO: 1237993 - RNA, 15 nt, Mycobacterium leprae
agagcagugcugaca

SEQ ID NO: 1237994 - RNA, 13 nt, Mycobacterium leprae
agagcugcgacaa

SEQ ID NO: 1237995 - RNA, 20 nt, Mycobacterium leprae
aaaacaugaacacgcuuaau

SEQ ID NO: 1237996 - RNA, 18 nt, Mycobacterium leprae
agacgugcacaagauugc

SEQ ID NO: 1237997 - RNA, 19 nt, Mycobacterium leprae
agagaucgccgcuccgauc

SEQ ID NO: 1237998 - RNA, 16 nt, Mycobacterium leprae
agagaucguccucaug

SEQ ID NO: 1237999 - RNA, 14 nt, Mycobacterium leprae
agaccaagcagcau

SEQ ID NO: 1238000 - RNA, 20 nt, Mycobacterium leprae
agaccaccguaagucagaug

SEQ ID NO: 1238001 - RNA, 20 nt, Mycobacterium leprae
agaccaggugaugauggcau

SEQ ID NO: 1238002 - RNA, 13 nt, Mycobacterium leprae
agaccaugagcac

SEQ ID NO: 1238003 - RNA, 14 nt, Mycobacterium leprae
agaccaugagcaca

SEQ ID NO: 1238004 - RNA, 10 nt, Mycobacterium leprae
agaccaucac

SEQ ID NO: 1238005 - RNA, 20 nt, Mycobacterium leprae
agaccagagauuucgcaggc

SEQ ID NO: 1238006 - RNA, 14 nt, Mycobacterium leprae
agacagugaugauc

SEQ ID NO: 1238007 - RNA, 16 nt, Mycobacterium leprae
agacaugauugcagau

SEQ ID NO: 1238008 - RNA, 19 nt, Mycobacterium leprae
agacaugauugcagauguu

SEQ ID NO: 1238009 - RNA, 17 nt, Mycobacterium leprae
agacauggcuguaucuc

SEQ ID NO: 1238010 - RNA, 16 nt, Mycobacterium leprae
agaccgaguccccgug

SEQ ID NO: 1238011 - RNA, 14 nt, Mycobacterium leprae
agaccgcccgggga

SEQ ID NO: 1238012 - RNA, 21 nt, Mycobacterium leprae
agaauguuguuagugcugcug

SEQ ID NO: 1238013 - RNA, 16 nt, Mycobacterium leprae
agaaugaaaacuauac

SEQ ID NO: 1238014 - RNA, 18 nt, Mycobacterium leprae
agaaugauaacuaggcua

SEQ ID NO: 1238015 - RNA, 16 nt, Mycobacterium leprae
agaaguaaagcccugu

SEQ ID NO: 1238016 - RNA, 15 nt, Mycobacterium leprae
agaagggagugcagu

SEQ ID NO: 1238017 - RNA, 15 nt, Mycobacterium leprae
agaauuuaccggcgu

SEQ ID NO: 1238018 - RNA, 16 nt, Mycobacterium leprae
agaauuuucagcgguc

SEQ ID NO: 1238019 - RNA, 18 nt, Mycobacterium leprae
agacacaguuguuggccu

SEQ ID NO: 1238020 - RNA, 16 nt, Mycobacterium leprae
agacacuccacgcacc

SEQ ID NO: 1238021 - RNA, 20 nt, Mycobacterium leprae
agaacagcaucguauagcac

SEQ ID NO: 1238022 - RNA, 21 nt, Mycobacterium leprae
agaacucaauaguguguuugg

SEQ ID NO: 1238023 - RNA, 18 nt, Mycobacterium leprae
agaaggaugauucgucug

SEQ ID NO: 1238024 - RNA, 13 nt, Mycobacterium leprae
agaaagaauuuac

SEQ ID NO: 1238025 - RNA, 16 nt, Mycobacterium leprae
agaaauacccacccag

SEQ ID NO: 1238026 - RNA, 16 nt, Mycobacterium leprae
aggaacgacuugacca

SEQ ID NO: 1238027 - RNA, 16 nt, Mycobacterium leprae
aggagaggcagggcug

SEQ ID NO: 1238028 - RNA, 15 nt, Mycobacterium leprae
aggaccaaccgcgca

SEQ ID NO: 1238029 - RNA, 14 nt, Mycobacterium leprae
aggacaacagagca

SEQ ID NO: 1238030 - RNA, 11 nt, Mycobacterium leprae
aggacaaaguc

SEQ ID NO: 1238031 - RNA, 16 nt, Mycobacterium leprae
agcuuguauugcuuag

SEQ ID NO: 1238032 - RNA, 23 nt, Mycobacterium leprae
agcuucgcagacacagccgucag

SEQ ID NO: 1238033 - RNA, 20 nt, Mycobacterium leprae
agcuuccauuucaaagcugc

SEQ ID NO: 1238034 - RNA, 21 nt, Mycobacterium leprae
agcuuccaaguggcugcgccg

SEQ ID NO: 1238035 - RNA, 23 nt, Mycobacterium leprae
agcuuccaaguggcugcgccgga

SEQ ID NO: 1238036 - RNA, 13 nt, Mycobacterium leprae
agcuuauacugcu

SEQ ID NO: 1238037 - RNA, 16 nt, Mycobacterium leprae
agcuuauacugcugcg

SEQ ID NO: 1238038 - RNA, 18 nt, Mycobacterium leprae
agcugugccggaggcgaa

SEQ ID NO: 1238039 - RNA, 22 nt, Mycobacterium leprae
agcuccauuuuucuugaaaaau

SEQ ID NO: 1238040 - RNA, 14 nt, Mycobacterium leprae
agcugcgacaacac

SEQ ID NO: 1238041 - RNA, 18 nt, Mycobacterium leprae
agcugcccgugcucagug

SEQ ID NO: 1238042 - RNA, 19 nt, Mycobacterium leprae
agcugcccuacacucaacu

SEQ ID NO: 1238043 - RNA, 13 nt, Mycobacterium leprae
agcugcccggcga

SEQ ID NO: 1238044 - RNA, 15 nt, Mycobacterium leprae
aggauuugcacgaau

SEQ ID NO: 1238045 - RNA, 21 nt, Mycobacterium leprae
aggagcuacuuuucgugcugc

SEQ ID NO: 1238046 - RNA, 14 nt, Mycobacterium leprae
aggagccgaggcac

SEQ ID NO: 1238047 - RNA, 16 nt, Mycobacterium leprae
aggagcgcgcgcgccc

SEQ ID NO: 1238048 - RNA, 14 nt, Mycobacterium leprae
aggagcgugggucg

SEQ ID NO: 1238049 - RNA, 21 nt, Mycobacterium leprae
aggcaugggcauuggcgacaa

SEQ ID NO: 1238050 - RNA, 19 nt, Mycobacterium leprae
aggcaugaaccucacccag

SEQ ID NO: 1238051 - RNA, 21 nt, Mycobacterium leprae
aggccacugggcugagccgcc

SEQ ID NO: 1238052 - RNA, 20 nt, Mycobacterium leprae
aggccaauccgcagucgguu

SEQ ID NO: 1238053 - RNA, 18 nt, Mycobacterium leprae
aggcgccgcagcaucugu

SEQ ID NO: 1238054 - RNA, 17 nt, Mycobacterium leprae
aggcgacgucacgcugc

SEQ ID NO: 1238055 - RNA, 19 nt, Mycobacterium leprae
aggcgaauugcuaccuggu

SEQ ID NO: 1238056 - RNA, 11 nt, Mycobacterium leprae
aggccuagcug

SEQ ID NO: 1238057 - RNA, 16 nt, Mycobacterium leprae
aggccuagcuggcagu

SEQ ID NO: 1238058 - RNA, 18 nt, Mycobacterium leprae
aggccgcccacguucaga

SEQ ID NO: 1238059 - RNA, 21 nt, Mycobacterium leprae
aggguacgccagguagugagu

SEQ ID NO: 1238060 - RNA, 15 nt, Mycobacterium leprae
aggguggcgccggcg

SEQ ID NO: 1238061 - RNA, 13 nt, Mycobacterium leprae
agguagugugaca

SEQ ID NO: 1238062 - RNA, 13 nt, Mycobacterium leprae
agguacgcgucga

SEQ ID NO: 1238063 - RNA, 15 nt, Mycobacterium leprae
agguccaauucacga

SEQ ID NO: 1238064 - RNA, 22 nt, Mycobacterium leprae
agguccaauucacgaacaacag

SEQ ID NO: 1238065 - RNA, 21 nt, Mycobacterium leprae
aggugaucaaaugacuugcgg

SEQ ID NO: 1238066 - RNA, 18 nt, Mycobacterium leprae
aggucguuagcgccgaga

SEQ ID NO: 1238067 - RNA, 17 nt, Mycobacterium leprae
aggugcuuaucgaguac

SEQ ID NO: 1238068 - RNA, 16 nt, Mycobacterium leprae
aggugcugcaguugga

SEQ ID NO: 1238069 - RNA, 17 nt, Mycobacterium leprae
aggugcuggcugcgccg

SEQ ID NO: 1238070 - RNA, 23 nt, Mycobacterium leprae
aggugcaggagcgugggucggaa

SEQ ID NO: 1238071 - RNA, 22 nt, Mycobacterium leprae
aggggccaacacgucacgacuc

SEQ ID NO: 1238072 - RNA, 19 nt, Mycobacterium leprae
agggcggcauucccaaccg

SEQ ID NO: 1238073 - RNA, 17 nt, Mycobacterium leprae
agggacgcaaaggccaa

SEQ ID NO: 1238074 - RNA, 16 nt, Mycobacterium leprae
agggagaaugccacag

SEQ ID NO: 1238075 - RNA, 14 nt, Mycobacterium leprae
aggcggauggggca

SEQ ID NO: 1238076 - RNA, 22 nt, Mycobacterium leprae
aguauguuuggauugucauggc

SEQ ID NO: 1238077 - RNA, 19 nt, Mycobacterium leprae
aguaguccucugcgguauc

SEQ ID NO: 1238078 - RNA, 11 nt, Mycobacterium leprae
aguaaagggug

SEQ ID NO: 1238079 - RNA, 16 nt, Mycobacterium leprae
aguaaagggugguggg

SEQ ID NO: 1238080 - RNA, 19 nt, Mycobacterium leprae
aguaaagggugguggguca

SEQ ID NO: 1238081 - RNA, 20 nt, Mycobacterium leprae
agguuguuuguucagugccg

SEQ ID NO: 1238082 - RNA, 22 nt, Mycobacterium leprae
agguugaggaggugcuggaugc

SEQ ID NO: 1238083 - RNA, 16 nt, Mycobacterium leprae
agguggccuagucggg

SEQ ID NO: 1238084 - RNA, 16 nt, Mycobacterium leprae
aguaaacaaacguuuc

SEQ ID NO: 1238085 - RNA, 22 nt, Mycobacterium leprae
aguccgucacuuuuccaccggc

SEQ ID NO: 1238086 - RNA, 16 nt, Mycobacterium leprae
aguccgcuaaggcagc

SEQ ID NO: 1238087 - RNA, 21 nt, Mycobacterium leprae
agucgaggccagauggcgcca

SEQ ID NO: 1238088 - RNA, 16 nt, Mycobacterium leprae
agucgagggcucagug

SEQ ID NO: 1238089 - RNA, 14 nt, Mycobacterium leprae
agucgaaggugagu

SEQ ID NO: 1238090 - RNA, 21 nt, Mycobacterium leprae
agucgaccgccgaagcagcca

SEQ ID NO: 1238091 - RNA, 17 nt, Mycobacterium leprae
agucgacgccgcggcug

SEQ ID NO: 1238092 - RNA, 19 nt, Mycobacterium leprae
agucugaaggcaaaauccu

SEQ ID NO: 1238093 - RNA, 13 nt, Mycobacterium leprae
agucggagugucu

SEQ ID NO: 1238094 - RNA, 18 nt, Mycobacterium leprae
agucggaaccgcagcugc

SEQ ID NO: 1238095 - RNA, 18 nt, Mycobacterium leprae
agucggcuuugcgguuga

SEQ ID NO: 1238096 - RNA, 24 nt, Mycobacterium leprae
agugcagcacaagacuucacucac

SEQ ID NO: 1238097 - RNA, 18 nt, Mycobacterium leprae
agugcacagaauuugcca

SEQ ID NO: 1238098 - RNA, 14 nt, Mycobacterium leprae
agugcaccaucugc

SEQ ID NO: 1238099 - RNA, 13 nt, Mycobacterium leprae
agugcagaucacc

SEQ ID NO: 1238100 - RNA, 18 nt, Mycobacterium leprae
agugaucgccgaugcuga

SEQ ID NO: 1238101 - RNA, 16 nt, Mycobacterium leprae
aguggauuaccaccgc

SEQ ID NO: 1238102 - RNA, 19 nt, Mycobacterium leprae
aguggcaacugaagauuug

SEQ ID NO: 1238103 - RNA, 18 nt, Mycobacterium leprae
agugcuggucaacagugg

SEQ ID NO: 1238104 - RNA, 14 nt, Mycobacterium leprae
agugcuucccuuga

SEQ ID NO: 1238105 - RNA, 22 nt, Mycobacterium leprae
agugcugcugcggcgccugcau

SEQ ID NO: 1238106 - RNA, 16 nt, Mycobacterium leprae
agugcugcugugguug

SEQ ID NO: 1238107 - RNA, 17 nt, Mycobacterium leprae
agugcugacgccgggca

SEQ ID NO: 1238108 - RNA, 14 nt, Mycobacterium leprae
agugcucggguggu

SEQ ID NO: 1238109 - RNA, 15 nt, Mycobacterium leprae
agugccguaaaucgu

SEQ ID NO: 1238110 - RNA, 14 nt, Mycobacterium leprae
aguuuggcugacac

SEQ ID NO: 1238111 - RNA, 18 nt, Mycobacterium leprae
aguuuccgccguucuccc

SEQ ID NO: 1238112 - RNA, 13 nt, Mycobacterium leprae
aguuuaccgugcc

SEQ ID NO: 1238113 - RNA, 16 nt, Mycobacterium leprae
aguuuaccgugguugc

SEQ ID NO: 1238114 - RNA, 14 nt, Mycobacterium leprae
aguuuagagugcag

SEQ ID NO: 1238115 - RNA, 18 nt, Mycobacterium leprae
aguuguacuggcgugcau

SEQ ID NO: 1238116 - RNA, 21 nt, Mycobacterium leprae
aguuguugacaaagcccacgc

SEQ ID NO: 1238117 - RNA, 19 nt, Mycobacterium leprae
aguuguguuccgguuccag

SEQ ID NO: 1238118 - RNA, 20 nt, Mycobacterium leprae
aguucauuccccuagaacag

SEQ ID NO: 1238119 - RNA, 21 nt, Mycobacterium leprae
aguucggguaccggcaaacca

SEQ ID NO: 1238120 - RNA, 21 nt, Mycobacterium leprae
aguucgugcgcgcauuggcca

SEQ ID NO: 1238121 - RNA, 18 nt, Mycobacterium leprae
aguugcacaucagcaaag

SEQ ID NO: 1238122 - RNA, 16 nt, Mycobacterium leprae
aguuagcaugagcugc

SEQ ID NO: 1238123 - RNA, 23 nt, Mycobacterium leprae
aguuagaggguccggaccuggac

SEQ ID NO: 1238124 - RNA, 12 nt, Mycobacterium leprae
aguucacgcugg

SEQ ID NO: 1238125 - RNA, 16 nt, Mycobacterium leprae
aguucacggucaccgg

SEQ ID NO: 1238126 - RNA, 14 nt, Mycobacterium leprae
agugucagcagcag

SEQ ID NO: 1238127 - RNA, 22 nt, Mycobacterium leprae
aguguccgcaaaaugcuccccc

SEQ ID NO: 1238128 - RNA, 13 nt, Mycobacterium leprae
auaaaccggcaga

SEQ ID NO: 1238129 - RNA, 22 nt, Mycobacterium leprae
auaacguacccgcgagcagcgg

SEQ ID NO: 1238130 - RNA, 16 nt, Mycobacterium leprae
auaacccgauaggggu

SEQ ID NO: 1238131 - RNA, 15 nt, Mycobacterium leprae
auacacggugcgugc

SEQ ID NO: 1238132 - RNA, 18 nt, Mycobacterium leprae
auacacgcggacagauuc

SEQ ID NO: 1238133 - RNA, 16 nt, Mycobacterium leprae
auacaaguagguuguu

SEQ ID NO: 1238134 - RNA, 18 nt, Mycobacterium leprae
auaauauacuugacugcc

SEQ ID NO: 1238135 - RNA, 16 nt, Mycobacterium leprae
aucaccggaaagcuga

SEQ ID NO: 1238136 - RNA, 22 nt, Mycobacterium leprae
aucacgguugcuuccaacccgu

SEQ ID NO: 1238137 - RNA, 14 nt, Mycobacterium leprae
aucagcaagaaauu

SEQ ID NO: 1238138 - RNA, 13 nt, Mycobacterium leprae
aucagauguaauc

SEQ ID NO: 1238139 - RNA, 17 nt, Mycobacterium leprae
aucagacguugggagca

SEQ ID NO: 1238140 - RNA, 11 nt, Mycobacterium leprae
aucagauaucc

SEQ ID NO: 1238141 - RNA, 15 nt, Mycobacterium leprae
aucagcaaggaacaa

SEQ ID NO: 1238142 - RNA, 23 nt, Mycobacterium leprae
aucaucgcccaccgcaacgccuc

SEQ ID NO: 1238143 - RNA, 15 nt, Mycobacterium leprae
aucaggaaggagccg

SEQ ID NO: 1238144 - RNA, 16 nt, Mycobacterium leprae
aucagugcaauaccua

SEQ ID NO: 1238145 - RNA, 15 nt, Mycobacterium leprae
aucagugcucuagaa

SEQ ID NO: 1238146 - RNA, 16 nt, Mycobacterium leprae
aucauagugaccaaaa

SEQ ID NO: 1238147 - RNA, 17 nt, Mycobacterium leprae
aucauagugaccaaaau

SEQ ID NO: 1238148 - RNA, 14 nt, Mycobacterium leprae
auauuccaggucaa

SEQ ID NO: 1238149 - RNA, 21 nt, Mycobacterium leprae
aucaauggcagccaccaucug

SEQ ID NO: 1238150 - RNA, 20 nt, Mycobacterium leprae
aucaagcugugagugugcag

SEQ ID NO: 1238151 - RNA, 14 nt, Mycobacterium leprae
aucaacgccagcaa

SEQ ID NO: 1238152 - RNA, 15 nt, Mycobacterium leprae
aucaacgccagcaag

SEQ ID NO: 1238153 - RNA, 16 nt, Mycobacterium leprae
auaugagcuccacugu

SEQ ID NO: 1238154 - RNA, 16 nt, Mycobacterium leprae
auaucguaaucaggac

SEQ ID NO: 1238155 - RNA, 16 nt, Mycobacterium leprae
auaucgcggcgcgcuc

SEQ ID NO: 1238156 - RNA, 22 nt, Mycobacterium leprae
auaucgaugcaggcgugggugu

SEQ ID NO: 1238157 - RNA, 22 nt, Mycobacterium leprae
auagugcgcuauacuugcugca

SEQ ID NO: 1238158 - RNA, 14 nt, Mycobacterium leprae
auauaccuucuaac

SEQ ID NO: 1238159 - RNA, 16 nt, Mycobacterium leprae
auauaccguuaauaua

SEQ ID NO: 1238160 - RNA, 14 nt, Mycobacterium leprae
auagcgaaaauaac

SEQ ID NO: 1238161 - RNA, 18 nt, Mycobacterium leprae
auagcguuuaaguaacau

SEQ ID NO: 1238162 - RNA, 17 nt, Mycobacterium leprae
auagccgguggccaccg

SEQ ID NO: 1238163 - RNA, 22 nt, Mycobacterium leprae
auacugcaauccguggagagca

SEQ ID NO: 1238164 - RNA, 22 nt, Mycobacterium leprae
auacgcugauaaggucuggcac

SEQ ID NO: 1238165 - RNA, 23 nt, Mycobacterium leprae
auaccuucuaaccggucaaucag

SEQ ID NO: 1238166 - RNA, 12 nt, Mycobacterium leprae
aucgaggugagc

SEQ ID NO: 1238167 - RNA, 15 nt, Mycobacterium leprae
aucgaggugagcaga

SEQ ID NO: 1238168 - RNA, 15 nt, Mycobacterium leprae
aucgacggcagcgcu

SEQ ID NO: 1238169 - RNA, 15 nt, Mycobacterium leprae
aucgacguccacaua

SEQ ID NO: 1238170 - RNA, 13 nt, Mycobacterium leprae
aucgacgaugcca

SEQ ID NO: 1238171 - RNA, 14 nt, Mycobacterium leprae
aucgacgaugccau

SEQ ID NO: 1238172 - RNA, 19 nt, Mycobacterium leprae
aucgacccguuguucggca

SEQ ID NO: 1238173 - RNA, 21 nt, Mycobacterium leprae
aucgacaggcaaccgcccgca

SEQ ID NO: 1238174 - RNA, 18 nt, Mycobacterium leprae
auccgcgugaugauggcc

SEQ ID NO: 1238175 - RNA, 14 nt, Mycobacterium leprae
auccgcuggagcac

SEQ ID NO: 1238176 - RNA, 17 nt, Mycobacterium leprae
auccgcuggagcaccug

SEQ ID NO: 1238177 - RNA, 16 nt, Mycobacterium leprae
auccgcgguguguccc

SEQ ID NO: 1238178 - RNA, 22 nt, Mycobacterium leprae
aucgaacuuuuccaugcugccg

SEQ ID NO: 1238179 - RNA, 17 nt, Mycobacterium leprae
aucggguaaagccgcgc

SEQ ID NO: 1238180 - RNA, 20 nt, Mycobacterium leprae
aucggggauucaaucagaca

SEQ ID NO: 1238181 - RNA, 17 nt, Mycobacterium leprae
aucgggccagagcugcg

SEQ ID NO: 1238182 - RNA, 14 nt, Mycobacterium leprae
aucggcgacuggga

SEQ ID NO: 1238183 - RNA, 15 nt, Mycobacterium leprae
aucggccucaccugc

SEQ ID NO: 1238184 - RNA, 22 nt, Mycobacterium leprae
aucgguuccgcaauuucggcgu

SEQ ID NO: 1238185 - RNA, 14 nt, Mycobacterium leprae
aucguacgaaagau

SEQ ID NO: 1238186 - RNA, 15 nt, Mycobacterium leprae
aucggucagcucgaa

SEQ ID NO: 1238187 - RNA, 12 nt, Mycobacterium leprae
aucggugaucaa

SEQ ID NO: 1238188 - RNA, 22 nt, Mycobacterium leprae
aucgguguuguccgucagccgu

SEQ ID NO: 1238189 - RNA, 23 nt, Mycobacterium leprae
aucggugucggcggcuuguugac

SEQ ID NO: 1238190 - RNA, 22 nt, Mycobacterium leprae
aucggaagcguuguaaggucac

SEQ ID NO: 1238191 - RNA, 22 nt, Mycobacterium leprae
aucggcaggcuguacacuacuc

SEQ ID NO: 1238192 - RNA, 18 nt, Mycobacterium leprae
aucgcuacccuugagcac

SEQ ID NO: 1238193 - RNA, 19 nt, Mycobacterium leprae
aucgcuacccuugagcacc

SEQ ID NO: 1238194 - RNA, 18 nt, Mycobacterium leprae
aucgcuaagacucaccaa

SEQ ID NO: 1238195 - RNA, 19 nt, Mycobacterium leprae
aucgcuaagacucaccaag

SEQ ID NO: 1238196 - RNA, 12 nt, Mycobacterium leprae
auccgccgugcg

SEQ ID NO: 1238197 - RNA, 11 nt, Mycobacterium leprae
aucccagccua

SEQ ID NO: 1238198 - RNA, 17 nt, Mycobacterium leprae
aucccagugugcugcau

SEQ ID NO: 1238199 - RNA, 22 nt, Mycobacterium leprae
aucccagaauuuucggcggcac

SEQ ID NO: 1238200 - RNA, 12 nt, Mycobacterium leprae
aaaacuuaauau

SEQ ID NO: 1238201 - RNA, 17 nt, Mycobacterium leprae
auccagcgaagguagcc

SEQ ID NO: 1238202 - RNA, 22 nt, Mycobacterium leprae
auccacuugacggucgagcugg

SEQ ID NO: 1238203 - RNA, 17 nt, Mycobacterium leprae
auccaccauacagcuaa

SEQ ID NO: 1238204 - RNA, 13 nt, Mycobacterium leprae
auccacccaggac

SEQ ID NO: 1238205 - RNA, 17 nt, Mycobacterium leprae
aucugcgucgcccucgc

SEQ ID NO: 1238206 - RNA, 21 nt, Mycobacterium leprae
aucugcgucgcccucgccggc

SEQ ID NO: 1238207 - RNA, 22 nt, Mycobacterium leprae
aucuguacgcguugauggccga

SEQ ID NO: 1238208 - RNA, 13 nt, Mycobacterium leprae
aucuucagucagg

SEQ ID NO: 1238209 - RNA, 15 nt, Mycobacterium leprae
aucgucagucggccu

SEQ ID NO: 1238210 - RNA, 14 nt, Mycobacterium leprae
aucgucaaauuuuc

SEQ ID NO: 1238211 - RNA, 16 nt, Mycobacterium leprae
aucuagcguaaggacc

SEQ ID NO: 1238212 - RNA, 21 nt, Mycobacterium leprae
aucuauaguugaucauucgau

SEQ ID NO: 1238213 - RNA, 18 nt, Mycobacterium leprae
aucucacgcccgacgaac

SEQ ID NO: 1238214 - RNA, 11 nt, Mycobacterium leprae
aucucaucguc

SEQ ID NO: 1238215 - RNA, 23 nt, Mycobacterium leprae
aucucgcgucgugcguuguugau

SEQ ID NO: 1238216 - RNA, 16 nt, Mycobacterium leprae
augaucgauccagugc

SEQ ID NO: 1238217 - RNA, 17 nt, Mycobacterium leprae
augaguugugcagcuga

SEQ ID NO: 1238218 - RNA, 19 nt, Mycobacterium leprae
augaggcuucgugugcuuu

SEQ ID NO: 1238219 - RNA, 15 nt, Mycobacterium leprae
augagucuucacuca

SEQ ID NO: 1238220 - RNA, 13 nt, Mycobacterium leprae
augagugaucugc

SEQ ID NO: 1238221 - RNA, 13 nt, Mycobacterium leprae
augagccgacuga

SEQ ID NO: 1238222 - RNA, 13 nt, Mycobacterium leprae
augagcucagucg

SEQ ID NO: 1238223 - RNA, 16 nt, Mycobacterium leprae
augacuguggcuauga

SEQ ID NO: 1238224 - RNA, 20 nt, Mycobacterium leprae
augaauuugccgcgagcacu

SEQ ID NO: 1238225 - RNA, 23 nt, Mycobacterium leprae
augaaaucccgcuaugugcaauc

SEQ ID NO: 1238226 - RNA, 16 nt, Mycobacterium leprae
auuaaguuuucucuaa

SEQ ID NO: 1238227 - RNA, 16 nt, Mycobacterium leprae
auuaauucuucucuaa

SEQ ID NO: 1238228 - RNA, 15 nt, Mycobacterium leprae
auguuguucaacaac

SEQ ID NO: 1238229 - RNA, 17 nt, Mycobacterium leprae
auguuguuagugcugcu

SEQ ID NO: 1238230 - RNA, 18 nt, Mycobacterium leprae
auguuguuagugcugcug

SEQ ID NO: 1238231 - RNA, 17 nt, Mycobacterium leprae
auguuauuuauagaugc

SEQ ID NO: 1238232 - RNA, 16 nt, Mycobacterium leprae
augucccggugcugcc

SEQ ID NO: 1238233 - RNA, 12 nt, Mycobacterium leprae
auuauugacaua

SEQ ID NO: 1238234 - RNA, 17 nt, Mycobacterium leprae
auucagccgugcccaag

SEQ ID NO: 1238235 - RNA, 16 nt, Mycobacterium leprae
auucacccuuucggga

SEQ ID NO: 1238236 - RNA, 16 nt, Mycobacterium leprae
auucacgaacaacaga

SEQ ID NO: 1238237 - RNA, 18 nt, Mycobacterium leprae
auucagagcugcagguca

SEQ ID NO: 1238238 - RNA, 22 nt, Mycobacterium leprae
auucagagcugcaggucaggau

SEQ ID NO: 1238239 - RNA, 20 nt, Mycobacterium leprae
auucagaauucuauaucuau

SEQ ID NO: 1238240 - RNA, 23 nt, Mycobacterium leprae
auuagggauugacuaauauguuc

SEQ ID NO: 1238241 - RNA, 18 nt, Mycobacterium leprae
auuacgacgacucagugg

SEQ ID NO: 1238242 - RNA, 18 nt, Mycobacterium leprae
auuacccgcugaugcugc

SEQ ID NO: 1238243 - RNA, 20 nt, Mycobacterium leprae
auuacccgcugaugcugccu

SEQ ID NO: 1238244 - RNA, 14 nt, Mycobacterium leprae
augucaugaacgua

SEQ ID NO: 1238245 - RNA, 15 nt, Mycobacterium leprae
augucacuucccacc

SEQ ID NO: 1238246 - RNA, 16 nt, Mycobacterium leprae
augucacuucccaccg

SEQ ID NO: 1238247 - RNA, 13 nt, Mycobacterium leprae
aaaagauauuaag

SEQ ID NO: 1238248 - RNA, 13 nt, Mycobacterium leprae
auguaacuguuga

SEQ ID NO: 1238249 - RNA, 20 nt, Mycobacterium leprae
auggucauuggaaaggggcc

SEQ ID NO: 1238250 - RNA, 15 nt, Mycobacterium leprae
auggucauuggaagc

SEQ ID NO: 1238251 - RNA, 19 nt, Mycobacterium leprae
auggucggcagcugguugu

SEQ ID NO: 1238252 - RNA, 20 nt, Mycobacterium leprae
augggcauuggcgacaaaga

SEQ ID NO: 1238253 - RNA, 16 nt, Mycobacterium leprae
auggcggaggcugggc

SEQ ID NO: 1238254 - RNA, 18 nt, Mycobacterium leprae
auggcgcgguacaaucag

SEQ ID NO: 1238255 - RNA, 16 nt, Mycobacterium leprae
auggcgggcuggagga

SEQ ID NO: 1238256 - RNA, 19 nt, Mycobacterium leprae
augcuggagcgaugucgag

SEQ ID NO: 1238257 - RNA, 15 nt, Mycobacterium leprae
auggcgagcaucugg

SEQ ID NO: 1238258 - RNA, 16 nt, Mycobacterium leprae
auggccuugagguguc

SEQ ID NO: 1238259 - RNA, 13 nt, Mycobacterium leprae
auggccagccguc

SEQ ID NO: 1238260 - RNA, 19 nt, Mycobacterium leprae
augcguugucgucggccgc

SEQ ID NO: 1238261 - RNA, 19 nt, Mycobacterium leprae
augcuagggcugcuguuca

SEQ ID NO: 1238262 - RNA, 20 nt, Mycobacterium leprae
augcuagggcugcuguucau

SEQ ID NO: 1238263 - RNA, 23 nt, Mycobacterium leprae
augcgcugaggcagcagcucgac

SEQ ID NO: 1238264 - RNA, 21 nt, Mycobacterium leprae
augcgucguacucuggcuggu

SEQ ID NO: 1238265 - RNA, 12 nt, Mycobacterium leprae
augcgugaagua

SEQ ID NO: 1238266 - RNA, 17 nt, Mycobacterium leprae
augccaggggcugggca

SEQ ID NO: 1238267 - RNA, 19 nt, Mycobacterium leprae
augcccagaccgaaaacca

SEQ ID NO: 1238268 - RNA, 13 nt, Mycobacterium leprae
augcccaugccag

SEQ ID NO: 1238269 - RNA, 19 nt, Mycobacterium leprae
augccacuaaacauuuuag

SEQ ID NO: 1238270 - RNA, 19 nt, Mycobacterium leprae
augccaaccugugcaugca

SEQ ID NO: 1238271 - RNA, 14 nt, Mycobacterium leprae
augccaacgcuauu

SEQ ID NO: 1238272 - RNA, 14 nt, Mycobacterium leprae
augccggugcagcu

SEQ ID NO: 1238273 - RNA, 19 nt, Mycobacterium leprae
augcacugugucaccugaa

SEQ ID NO: 1238274 - RNA, 16 nt, Mycobacterium leprae
augcacuguucacuaa

SEQ ID NO: 1238275 - RNA, 16 nt, Mycobacterium leprae
augcaggaggugcaga

SEQ ID NO: 1238276 - RNA, 14 nt, Mycobacterium leprae
augaucuaaccgac

SEQ ID NO: 1238277 - RNA, 16 nt, Mycobacterium leprae
augaucgucauaggcu

SEQ ID NO: 1238278 - RNA, 16 nt, Mycobacterium leprae
augcagguggucugca

SEQ ID NO: 1238279 - RNA, 18 nt, Mycobacterium leprae
augcagucgcucaggcua

SEQ ID NO: 1238280 - RNA, 16 nt, Mycobacterium leprae
augcagugagcagugg

SEQ ID NO: 1238281 - RNA, 20 nt, Mycobacterium leprae
augcagugcacgagcgggug

SEQ ID NO: 1238282 - RNA, 13 nt, Mycobacterium leprae
augcaguacgugu

SEQ ID NO: 1238283 - RNA, 19 nt, Mycobacterium leprae
auugaguacaucugauuga

SEQ ID NO: 1238284 - RNA, 14 nt, Mycobacterium leprae
auugaccgacggcg

SEQ ID NO: 1238285 - RNA, 20 nt, Mycobacterium leprae
auugaccgacggcgccgcac

SEQ ID NO: 1238286 - RNA, 20 nt, Mycobacterium leprae
auugacguaagaauacacua

SEQ ID NO: 1238287 - RNA, 21 nt, Mycobacterium leprae
auucgccgacucgcgauccca

SEQ ID NO: 1238288 - RNA, 17 nt, Mycobacterium leprae
auucgcccgagucucug

SEQ ID NO: 1238289 - RNA, 18 nt, Mycobacterium leprae
auucgcaccugauguuau

SEQ ID NO: 1238290 - RNA, 17 nt, Mycobacterium leprae
auucgggacagugucuu

SEQ ID NO: 1238291 - RNA, 19 nt, Mycobacterium leprae
auucggaucguuugaggaa

SEQ ID NO: 1238292 - RNA, 20 nt, Mycobacterium leprae
auuccgacgaagguggcauu

SEQ ID NO: 1238293 - RNA, 22 nt, Mycobacterium leprae
auuccgcuacaguaauggcauu

SEQ ID NO: 1238294 - RNA, 18 nt, Mycobacterium leprae
auugcgauaaugcacugc

SEQ ID NO: 1238295 - RNA, 19 nt, Mycobacterium leprae
auugcucagugagccgucu

SEQ ID NO: 1238296 - RNA, 16 nt, Mycobacterium leprae
auugcuaccugguugg

SEQ ID NO: 1238297 - RNA, 15 nt, Mycobacterium leprae
auuggguaaagugaa

SEQ ID NO: 1238298 - RNA, 17 nt, Mycobacterium leprae
auuggcagagcauucgg

SEQ ID NO: 1238299 - RNA, 21 nt, Mycobacterium leprae
auuggcagagcauucggcugu

SEQ ID NO: 1238300 - RNA, 21 nt, Mycobacterium leprae
auuuaccgagaucgacgcugc

SEQ ID NO: 1238301 - RNA, 14 nt, Mycobacterium leprae
auuuagaggcugca

SEQ ID NO: 1238302 - RNA, 13 nt, Mycobacterium leprae
auuuuccaguuga

SEQ ID NO: 1238303 - RNA, 15 nt, Mycobacterium leprae
auuuugggugaucaa

SEQ ID NO: 1238304 - RNA, 12 nt, Mycobacterium leprae
auuuguguuggc

SEQ ID NO: 1238305 - RNA, 13 nt, Mycobacterium leprae
auuuggugaucac

SEQ ID NO: 1238306 - RNA, 11 nt, Mycobacterium leprae
auuugcuggcu

SEQ ID NO: 1238307 - RNA, 16 nt, Mycobacterium leprae
auuugcuggcugccgc

SEQ ID NO: 1238308 - RNA, 18 nt, Mycobacterium leprae
auuugcugucguggcugc

SEQ ID NO: 1238309 - RNA, 16 nt, Mycobacterium leprae
auuugccccagccgac

SEQ ID NO: 1238310 - RNA, 15 nt, Mycobacterium leprae
auuugcacaacaucc

SEQ ID NO: 1238311 - RNA, 16 nt, Mycobacterium leprae
auuucgacaggcuguc

SEQ ID NO: 1238312 - RNA, 18 nt, Mycobacterium leprae
cacgucccagguuuccgu

SEQ ID NO: 1238313 - RNA, 18 nt, Mycobacterium leprae
cacgguauaaaggcgcca

SEQ ID NO: 1238314 - RNA, 20 nt, Mycobacterium leprae
cacggucccgggucacgcuc

SEQ ID NO: 1238315 - RNA, 22 nt, Mycobacterium leprae
cacgcugauggcacuacccgac

SEQ ID NO: 1238316 - RNA, 17 nt, Mycobacterium leprae
cacgcuggcacuccgac

SEQ ID NO: 1238317 - RNA, 18 nt, Mycobacterium leprae
cacgcuggcacuccgacc

SEQ ID NO: 1238318 - RNA, 23 nt, Mycobacterium leprae
cacgcugggguuguacagcgauu

SEQ ID NO: 1238319 - RNA, 13 nt, Mycobacterium leprae
cacggaagcccuc

SEQ ID NO: 1238320 - RNA, 18 nt, Mycobacterium leprae
cacggacaagcagugucu

SEQ ID NO: 1238321 - RNA, 21 nt, Mycobacterium leprae
cacgaauaucgcuacccuuga

SEQ ID NO: 1238322 - RNA, 23 nt, Mycobacterium leprae
caccugcgacagccgugccucgc

SEQ ID NO: 1238323 - RNA, 21 nt, Mycobacterium leprae
cacgcaccugaucggucagcu

SEQ ID NO: 1238324 - RNA, 16 nt, Mycobacterium leprae
cacgcacacgacagcc

SEQ ID NO: 1238325 - RNA, 14 nt, Mycobacterium leprae
cacgcaaugucgcc

SEQ ID NO: 1238326 - RNA, 22 nt, Mycobacterium leprae
caccguaacucuauaaaauuua

SEQ ID NO: 1238327 - RNA, 12 nt, Mycobacterium leprae
caccugaacagg

SEQ ID NO: 1238328 - RNA, 14 nt, Mycobacterium leprae
caccugaacaggca

SEQ ID NO: 1238329 - RNA, 20 nt, Mycobacterium leprae
caccucuguugugauccuca

SEQ ID NO: 1238330 - RNA, 17 nt, Mycobacterium leprae
caccugaucggucagcu

SEQ ID NO: 1238331 - RNA, 20 nt, Mycobacterium leprae
caccugaucggucagcucga

SEQ ID NO: 1238332 - RNA, 17 nt, Mycobacterium leprae
caccguuacggccaugu

SEQ ID NO: 1238333 - RNA, 14 nt, Mycobacterium leprae
caccguggucacgg

SEQ ID NO: 1238334 - RNA, 16 nt, Mycobacterium leprae
caccucgcugcagcau

SEQ ID NO: 1238335 - RNA, 21 nt, Mycobacterium leprae
caccgaacagcucgacagcag

SEQ ID NO: 1238336 - RNA, 13 nt, Mycobacterium leprae
caccgaacccauc

SEQ ID NO: 1238337 - RNA, 23 nt, Mycobacterium leprae
caccgaagcugaugacaguaagu

SEQ ID NO: 1238338 - RNA, 22 nt, Mycobacterium leprae
caccgaauauuuucaagacugc

SEQ ID NO: 1238339 - RNA, 17 nt, Mycobacterium leprae
caccauuucugccgcug

SEQ ID NO: 1238340 - RNA, 19 nt, Mycobacterium leprae
caccauuuccggaacaaca

SEQ ID NO: 1238341 - RNA, 16 nt, Mycobacterium leprae
cacccaauugccuggc

SEQ ID NO: 1238342 - RNA, 15 nt, Mycobacterium leprae
cacccucacccgacc

SEQ ID NO: 1238343 - RNA, 18 nt, Mycobacterium leprae
cacccuccucgcggcggu

SEQ ID NO: 1238344 - RNA, 19 nt, Mycobacterium leprae
caccagggauuccuguucu

SEQ ID NO: 1238345 - RNA, 21 nt, Mycobacterium leprae
caccagggauuccuguucuac

SEQ ID NO: 1238346 - RNA, 16 nt, Mycobacterium leprae
caccauagcacccuca

SEQ ID NO: 1238347 - RNA, 13 nt, Mycobacterium leprae
caccauaccgacg

SEQ ID NO: 1238348 - RNA, 14 nt, Mycobacterium leprae
caccauccacaacg

SEQ ID NO: 1238349 - RNA, 20 nt, Mycobacterium leprae
caccauggugcggcgccgcc

SEQ ID NO: 1238350 - RNA, 22 nt, Mycobacterium leprae
caccauggugcggcgccgcccg

SEQ ID NO: 1238351 - RNA, 18 nt, Mycobacterium leprae
caccaucugcucucagca

SEQ ID NO: 1238352 - RNA, 20 nt, Mycobacterium leprae
cacauggggcuaaucguucc

SEQ ID NO: 1238353 - RNA, 19 nt, Mycobacterium leprae
cacaugucccggugcugcc

SEQ ID NO: 1238354 - RNA, 21 nt, Mycobacterium leprae
cacauugaccacgccgacacc

SEQ ID NO: 1238355 - RNA, 24 nt, Mycobacterium leprae
cacaguuaccacgacguagcccac

SEQ ID NO: 1238356 - RNA, 22 nt, Mycobacterium leprae
caauuguucgacaagcccccgc

SEQ ID NO: 1238357 - RNA, 19 nt, Mycobacterium leprae
cacagccguugcugcugcc

SEQ ID NO: 1238358 - RNA, 20 nt, Mycobacterium leprae
cacaggacuucaaauaccaa

SEQ ID NO: 1238359 - RNA, 18 nt, Mycobacterium leprae
cacaggaauuuagaggcu

SEQ ID NO: 1238360 - RNA, 16 nt, Mycobacterium leprae
cacagaccgaaaucaa

SEQ ID NO: 1238361 - RNA, 21 nt, Mycobacterium leprae
cacaacaagagaagagcuggu

SEQ ID NO: 1238362 - RNA, 19 nt, Mycobacterium leprae
cacaauucuucgcucagca

SEQ ID NO: 1238363 - RNA, 22 nt, Mycobacterium leprae
cacacugucacgucggccuggg

SEQ ID NO: 1238364 - RNA, 15 nt, Mycobacterium leprae
caaguuuagcaacaa

SEQ ID NO: 1238365 - RNA, 21 nt, Mycobacterium leprae
caauaacguuugcugcaaugc

SEQ ID NO: 1238366 - RNA, 21 nt, Mycobacterium leprae
caaucaucgcagagcucacug

SEQ ID NO: 1238367 - RNA, 23 nt, Mycobacterium leprae
caaucgguccuugaccucauccc

SEQ ID NO: 1238368 - RNA, 22 nt, Mycobacterium leprae
caauccugcguagcaagguguu

SEQ ID NO: 1238369 - RNA, 22 nt, Mycobacterium leprae
caauccuggaugugugcacucg

SEQ ID NO: 1238370 - RNA, 15 nt, Mycobacterium leprae
caaucgcggcacaug

SEQ ID NO: 1238371 - RNA, 16 nt, Mycobacterium leprae
caagagccgcggguuu

SEQ ID NO: 1238372 - RNA, 23 nt, Mycobacterium leprae
caagauugcagcccugagcacca

SEQ ID NO: 1238373 - RNA, 19 nt, Mycobacterium leprae
caagcccggauacagcacg

SEQ ID NO: 1238374 - RNA, 14 nt, Mycobacterium leprae
caagcggccgccca

SEQ ID NO: 1238375 - RNA, 15 nt, Mycobacterium leprae
caagcgcuuuuccuu

SEQ ID NO: 1238376 - RNA, 22 nt, Mycobacterium leprae
caagcgcuuuuccuuggaacca

SEQ ID NO: 1238377 - RNA, 14 nt, Mycobacterium leprae
caagcggguugacu

SEQ ID NO: 1238378 - RNA, 20 nt, Mycobacterium leprae
caagcccccgcggaucgguu

SEQ ID NO: 1238379 - RNA, 18 nt, Mycobacterium leprae
caagccaugcaaccacac

SEQ ID NO: 1238380 - RNA, 20 nt, Mycobacterium leprae
caagccaugcaaccacaccc

SEQ ID NO: 1238381 - RNA, 20 nt, Mycobacterium leprae
caagcagaucgacagcggcc

SEQ ID NO: 1238382 - RNA, 15 nt, Mycobacterium leprae
caagcagcaccacag

SEQ ID NO: 1238383 - RNA, 18 nt, Mycobacterium leprae
caaggcuuggccagcaag

SEQ ID NO: 1238384 - RNA, 18 nt, Mycobacterium leprae
caaggcgguuccgacugg

SEQ ID NO: 1238385 - RNA, 19 nt, Mycobacterium leprae
caaggaccggugcugcagc

SEQ ID NO: 1238386 - RNA, 16 nt, Mycobacterium leprae
caagguuaacauuuua

SEQ ID NO: 1238387 - RNA, 16 nt, Mycobacterium leprae
caagguguugcgguga

SEQ ID NO: 1238388 - RNA, 21 nt, Mycobacterium leprae
caagguguugcggugaguaaa

SEQ ID NO: 1238389 - RNA, 19 nt, Mycobacterium leprae
caaggucgagugcgagcca

SEQ ID NO: 1238390 - RNA, 22 nt, Mycobacterium leprae
caaggugagcguugugggcagc

SEQ ID NO: 1238391 - RNA, 16 nt, Mycobacterium leprae
caaggucgcgcugccg

SEQ ID NO: 1238392 - RNA, 17 nt, Mycobacterium leprae
caagggauuccacugcc

SEQ ID NO: 1238393 - RNA, 20 nt, Mycobacterium leprae
caagggauuccacugccaga

SEQ ID NO: 1238394 - RNA, 17 nt, Mycobacterium leprae
caacuugacgaugcugu

SEQ ID NO: 1238395 - RNA, 18 nt, Mycobacterium leprae
caagagccacggcaaugu

SEQ ID NO: 1238396 - RNA, 17 nt, Mycobacterium leprae
caagacgcuuucgagca

SEQ ID NO: 1238397 - RNA, 17 nt, Mycobacterium leprae
caagacguugugacagu

SEQ ID NO: 1238398 - RNA, 21 nt, Mycobacterium leprae
caacguuuuggcguaccuggg

SEQ ID NO: 1238399 - RNA, 15 nt, Mycobacterium leprae
caacgccuccacugc

SEQ ID NO: 1238400 - RNA, 20 nt, Mycobacterium leprae
caacgccggucugauagugu

SEQ ID NO: 1238401 - RNA, 16 nt, Mycobacterium leprae
caacuguuagaucuug

SEQ ID NO: 1238402 - RNA, 13 nt, Mycobacterium leprae
caacuguugcuug

SEQ ID NO: 1238403 - RNA, 21 nt, Mycobacterium leprae
caacauagucagaucaaccaa

SEQ ID NO: 1238404 - RNA, 20 nt, Mycobacterium leprae
caacaggaugcgugcccaua

SEQ ID NO: 1238405 - RNA, 16 nt, Mycobacterium leprae
caaccagacccacagc

SEQ ID NO: 1238406 - RNA, 20 nt, Mycobacterium leprae
caaccgaugcagggccagcc

SEQ ID NO: 1238407 - RNA, 21 nt, Mycobacterium leprae
caaccgaugcagggccagccc

SEQ ID NO: 1238408 - RNA, 16 nt, Mycobacterium leprae
caaccgauacgccagu

SEQ ID NO: 1238409 - RNA, 20 nt, Mycobacterium leprae
caacccggccgaucgugugc

SEQ ID NO: 1238410 - RNA, 19 nt, Mycobacterium leprae
caaccuuccgcaaaguuau

SEQ ID NO: 1238411 - RNA, 21 nt, Mycobacterium leprae
caaccuuugucgccaguaugu

SEQ ID NO: 1238412 - RNA, 14 nt, Mycobacterium leprae
caacgacuggauga

SEQ ID NO: 1238413 - RNA, 21 nt, Mycobacterium leprae
caacgcaccgcguaacagauu

SEQ ID NO: 1238414 - RNA, 20 nt, Mycobacterium leprae
caacgcaucaccggaaagcu

SEQ ID NO: 1238415 - RNA, 22 nt, Mycobacterium leprae
caacgccaaacuggucaacgca

SEQ ID NO: 1238416 - RNA, 17 nt, Mycobacterium leprae
caaauugccgagcuggu

SEQ ID NO: 1238417 - RNA, 15 nt, Mycobacterium leprae
caaauacuucaccaa

SEQ ID NO: 1238418 - RNA, 14 nt, Mycobacterium leprae
caaaugcuaugaua

SEQ ID NO: 1238419 - RNA, 21 nt, Mycobacterium leprae
caacaacggaucggcuacauc

SEQ ID NO: 1238420 - RNA, 16 nt, Mycobacterium leprae
caacaagagaagagcu

SEQ ID NO: 1238421 - RNA, 18 nt, Mycobacterium leprae
caacaagagaagagcugg

SEQ ID NO: 1238422 - RNA, 13 nt, Mycobacterium leprae
caacaagccgccg

SEQ ID NO: 1238423 - RNA, 21 nt, Mycobacterium leprae
caacagcuugacaucagucag

SEQ ID NO: 1238424 - RNA, 14 nt, Mycobacterium leprae
caacaccucaagca

SEQ ID NO: 1238425 - RNA, 14 nt, Mycobacterium leprae
caacacguuucugc

SEQ ID NO: 1238426 - RNA, 14 nt, Mycobacterium leprae
caaacucgcugaac

SEQ ID NO: 1238427 - RNA, 15 nt, Mycobacterium leprae
caaacuauugacggu

SEQ ID NO: 1238428 - RNA, 18 nt, Mycobacterium leprae
caaagcccacgccuagcu

SEQ ID NO: 1238429 - RNA, 19 nt, Mycobacterium leprae
caaagcuagccaccaagua

SEQ ID NO: 1238430 - RNA, 15 nt, Mycobacterium leprae
caaagcucaggccgu

SEQ ID NO: 1238431 - RNA, 18 nt, Mycobacterium leprae
caaagcuggcgaacaaca

SEQ ID NO: 1238432 - RNA, 19 nt, Mycobacterium leprae
caaagcuggcgaacaacaa

SEQ ID NO: 1238433 - RNA, 22 nt, Mycobacterium leprae
caaagcuggcgaacaacaaaaa

SEQ ID NO: 1238434 - RNA, 20 nt, Mycobacterium leprae
caaaguuagcggagaccccc

SEQ ID NO: 1238435 - RNA, 19 nt, Mycobacterium leprae
caaaacaugaacacgcuua

SEQ ID NO: 1238436 - RNA, 15 nt, Mycobacterium leprae
caaaaccaucgucga

SEQ ID NO: 1238437 - RNA, 12 nt, Mycobacterium leprae
caaaaccagccg

SEQ ID NO: 1238438 - RNA, 21 nt, Mycobacterium leprae
caaacgacaugacauauugua

SEQ ID NO: 1238439 - RNA, 20 nt, Mycobacterium leprae
caaacuacuguugucagugg

SEQ ID NO: 1238440 - RNA, 23 nt, Mycobacterium leprae
caaacgccguagcgcaccaaucc

SEQ ID NO: 1238441 - RNA, 13 nt, Mycobacterium leprae
cagcaaaaagucc

SEQ ID NO: 1238442 - RNA, 21 nt, Mycobacterium leprae
cagauggcuccccgagccgcu

SEQ ID NO: 1238443 - RNA, 12 nt, Mycobacterium leprae
cagauggaacaa

SEQ ID NO: 1238444 - RNA, 23 nt, Mycobacterium leprae
aaaaucucugugcgaaaacacuu

SEQ ID NO: 1238445 - RNA, 20 nt, Mycobacterium leprae
cagaugauacguucgaucac

SEQ ID NO: 1238446 - RNA, 19 nt, Mycobacterium leprae
cagaugccguuuucaccaa

SEQ ID NO: 1238447 - RNA, 22 nt, Mycobacterium leprae
cagaugcgaucgcagucaucac

SEQ ID NO: 1238448 - RNA, 18 nt, Mycobacterium leprae
cagaucgacuccgcaaga

SEQ ID NO: 1238449 - RNA, 22 nt, Mycobacterium leprae
cagaucgaucucgacggcagug

SEQ ID NO: 1238450 - RNA, 14 nt, Mycobacterium leprae
cagcacgcgcgaca

SEQ ID NO: 1238451 - RNA, 13 nt, Mycobacterium leprae
cagcacgauggcc

SEQ ID NO: 1238452 - RNA, 16 nt, Mycobacterium leprae
cagcacgauggccggu

SEQ ID NO: 1238453 - RNA, 17 nt, Mycobacterium leprae
cagcacccccggccagg

SEQ ID NO: 1238454 - RNA, 19 nt, Mycobacterium leprae
cagcacccgcuugucuuug

SEQ ID NO: 1238455 - RNA, 15 nt, Mycobacterium leprae
cagcaagcggccgcc

SEQ ID NO: 1238456 - RNA, 14 nt, Mycobacterium leprae
cagagugcaccacu

SEQ ID NO: 1238457 - RNA, 17 nt, Mycobacterium leprae
cagagugcaccacugua

SEQ ID NO: 1238458 - RNA, 22 nt, Mycobacterium leprae
cagagugcaccacuguaucuug

SEQ ID NO: 1238459 - RNA, 16 nt, Mycobacterium leprae
cagaguguguguggca

SEQ ID NO: 1238460 - RNA, 22 nt, Mycobacterium leprae
cagaggacgggcggccaggcag

SEQ ID NO: 1238461 - RNA, 14 nt, Mycobacterium leprae
cagagcccagcacg

SEQ ID NO: 1238462 - RNA, 20 nt, Mycobacterium leprae
cagagcuguugucgcggaag

SEQ ID NO: 1238463 - RNA, 23 nt, Mycobacterium leprae
cagagcauucggcuguuaaccga

SEQ ID NO: 1238464 - RNA, 16 nt, Mycobacterium leprae
cagagacgguguugcu

SEQ ID NO: 1238465 - RNA, 18 nt, Mycobacterium leprae
cagagacgguguugcuga

SEQ ID NO: 1238466 - RNA, 16 nt, Mycobacterium leprae
aaaauccaagucuuuc

SEQ ID NO: 1238467 - RNA, 21 nt, Mycobacterium leprae
cagaauggaguuggugucugg

SEQ ID NO: 1238468 - RNA, 18 nt, Mycobacterium leprae
cagaacaccccgcggagu

SEQ ID NO: 1238469 - RNA, 15 nt, Mycobacterium leprae
cagacaccacugcca

SEQ ID NO: 1238470 - RNA, 18 nt, Mycobacterium leprae
cagacacggaagcccucc

SEQ ID NO: 1238471 - RNA, 19 nt, Mycobacterium leprae
cacgucgauucgcucgccg

SEQ ID NO: 1238472 - RNA, 20 nt, Mycobacterium leprae
cagcauggcgaugcgcagcc

SEQ ID NO: 1238473 - RNA, 14 nt, Mycobacterium leprae
cagcaugucggcca

SEQ ID NO: 1238474 - RNA, 13 nt, Mycobacterium leprae
cagcaucaacgcg

SEQ ID NO: 1238475 - RNA, 12 nt, Mycobacterium leprae
cagcauccgccg

SEQ ID NO: 1238476 - RNA, 21 nt, Mycobacterium leprae
cagcaucgcgucuuccaaacu

SEQ ID NO: 1238477 - RNA, 17 nt, Mycobacterium leprae
cagcaucgacagcaccc

SEQ ID NO: 1238478 - RNA, 19 nt, Mycobacterium leprae
cagccaccacucucaucgc

SEQ ID NO: 1238479 - RNA, 14 nt, Mycobacterium leprae
cagccacacccgag

SEQ ID NO: 1238480 - RNA, 16 nt, Mycobacterium leprae
cagcaguuuccaacaa

SEQ ID NO: 1238481 - RNA, 20 nt, Mycobacterium leprae
cagcaguggguugcuauuug

SEQ ID NO: 1238482 - RNA, 23 nt, Mycobacterium leprae
cagcagguagacgcgcuaaaccu

SEQ ID NO: 1238483 - RNA, 22 nt, Mycobacterium leprae
cagcaggaaucccagcagcugg

SEQ ID NO: 1238484 - RNA, 17 nt, Mycobacterium leprae
cagcagcgggaccaaga

SEQ ID NO: 1238485 - RNA, 14 nt, Mycobacterium leprae
cagccgcaacaacg

SEQ ID NO: 1238486 - RNA, 13 nt, Mycobacterium leprae
cagccgagguucc

SEQ ID NO: 1238487 - RNA, 19 nt, Mycobacterium leprae
cagccgagguucccggcgg

SEQ ID NO: 1238488 - RNA, 14 nt, Mycobacterium leprae
cagccgcgaaugga

SEQ ID NO: 1238489 - RNA, 19 nt, Mycobacterium leprae
cagccgcaggcaccauuga

SEQ ID NO: 1238490 - RNA, 16 nt, Mycobacterium leprae
cagcgcacccauccga

SEQ ID NO: 1238491 - RNA, 16 nt, Mycobacterium leprae
cagcgccaauuccucc

SEQ ID NO: 1238492 - RNA, 21 nt, Mycobacterium leprae
cagcgagaaucccaguguauu

SEQ ID NO: 1238493 - RNA, 12 nt, Mycobacterium leprae
cagcgacuggcu

SEQ ID NO: 1238494 - RNA, 18 nt, Mycobacterium leprae
cagcgagaagccccaugg

SEQ ID NO: 1238495 - RNA, 19 nt, Mycobacterium leprae
cagcgagaagccccauggc

SEQ ID NO: 1238496 - RNA, 21 nt, Mycobacterium leprae
cagcgacuccacuccacccaa

SEQ ID NO: 1238497 - RNA, 21 nt, Mycobacterium leprae
cagcgacgugccgugaucagu

SEQ ID NO: 1238498 - RNA, 19 nt, Mycobacterium leprae
cagcgccagaccugccggu

SEQ ID NO: 1238499 - RNA, 16 nt, Mycobacterium leprae
cagcgcgcacagcucu

SEQ ID NO: 1238500 - RNA, 18 nt, Mycobacterium leprae
caguacuggugcuguguu

SEQ ID NO: 1238501 - RNA, 19 nt, Mycobacterium leprae
caguacuggugcuguguug

SEQ ID NO: 1238502 - RNA, 22 nt, Mycobacterium leprae
caguacuggugcuguguugugg

SEQ ID NO: 1238503 - RNA, 22 nt, Mycobacterium leprae
caguaggccagcccggcgugca

SEQ ID NO: 1238504 - RNA, 14 nt, Mycobacterium leprae
caguaguccucugc

SEQ ID NO: 1238505 - RNA, 21 nt, Mycobacterium leprae
cagucaacauggcgaucugca

SEQ ID NO: 1238506 - RNA, 14 nt, Mycobacterium leprae
caguaugucgucaa

SEQ ID NO: 1238507 - RNA, 13 nt, Mycobacterium leprae
cagucagucacca

SEQ ID NO: 1238508 - RNA, 16 nt, Mycobacterium leprae
cagucagucaccacug

SEQ ID NO: 1238509 - RNA, 18 nt, Mycobacterium leprae
cagucagcgugccugagg

SEQ ID NO: 1238510 - RNA, 16 nt, Mycobacterium leprae
cagucaguuuggcgcu

SEQ ID NO: 1238511 - RNA, 19 nt, Mycobacterium leprae
cagucaguuuggcgcugcu

SEQ ID NO: 1238512 - RNA, 12 nt, Mycobacterium leprae
cagucaucaccc

SEQ ID NO: 1238513 - RNA, 15 nt, Mycobacterium leprae
cagucaucaccccgg

SEQ ID NO: 1238514 - RNA, 12 nt, Mycobacterium leprae
cagucgaagaga

SEQ ID NO: 1238515 - RNA, 20 nt, Mycobacterium leprae
cagucguucgcugacagcaa

SEQ ID NO: 1238516 - RNA, 14 nt, Mycobacterium leprae
cagucguugacgau

SEQ ID NO: 1238517 - RNA, 16 nt, Mycobacterium leprae
cagucucgcuggcgcu

SEQ ID NO: 1238518 - RNA, 14 nt, Mycobacterium leprae
cagucggcaagacc

SEQ ID NO: 1238519 - RNA, 20 nt, Mycobacterium leprae
cagucggcacggguuggguu

SEQ ID NO: 1238520 - RNA, 15 nt, Mycobacterium leprae
cagucgcgcaccgcg

SEQ ID NO: 1238521 - RNA, 13 nt, Mycobacterium leprae
cagucgcagggcg

SEQ ID NO: 1238522 - RNA, 16 nt, Mycobacterium leprae
cagugaacacgcugau

SEQ ID NO: 1238523 - RNA, 19 nt, Mycobacterium leprae
cagugaugaucggcaaaau

SEQ ID NO: 1238524 - RNA, 18 nt, Mycobacterium leprae
cagugagugcauucugac

SEQ ID NO: 1238525 - RNA, 23 nt, Mycobacterium leprae
cagugaucacaucagugcugugg

SEQ ID NO: 1238526 - RNA, 23 nt, Mycobacterium leprae
cagugagcagugggccaguggcu

SEQ ID NO: 1238527 - RNA, 11 nt, Mycobacterium leprae
caggugucuga

SEQ ID NO: 1238528 - RNA, 20 nt, Mycobacterium leprae
caggugucuuccaguggcug

SEQ ID NO: 1238529 - RNA, 22 nt, Mycobacterium leprae
caggugugccuggaugggcagc

SEQ ID NO: 1238530 - RNA, 17 nt, Mycobacterium leprae
caggugcuggcugcgcc

SEQ ID NO: 1238531 - RNA, 20 nt, Mycobacterium leprae
caggugcgguaaucccagcg

SEQ ID NO: 1238532 - RNA, 16 nt, Mycobacterium leprae
caggugacgguguugg

SEQ ID NO: 1238533 - RNA, 20 nt, Mycobacterium leprae
cagguccaucgagcucugag

SEQ ID NO: 1238534 - RNA, 21 nt, Mycobacterium leprae
cagguccaucgagcucugaga

SEQ ID NO: 1238535 - RNA, 23 nt, Mycobacterium leprae
cagguccaucgagcucugagagu

SEQ ID NO: 1238536 - RNA, 12 nt, Mycobacterium leprae
caggucauccuu

SEQ ID NO: 1238537 - RNA, 13 nt, Mycobacterium leprae
caggucauccuug

SEQ ID NO: 1238538 - RNA, 22 nt, Mycobacterium leprae
cagggguuccaagauggcguca

SEQ ID NO: 1238539 - RNA, 14 nt, Mycobacterium leprae
caggucacccuccu

SEQ ID NO: 1238540 - RNA, 17 nt, Mycobacterium leprae
caggucucacacccgca

SEQ ID NO: 1238541 - RNA, 16 nt, Mycobacterium leprae
cagguugaaaaagaaa

SEQ ID NO: 1238542 - RNA, 15 nt, Mycobacterium leprae
caguaauccaguccg

SEQ ID NO: 1238543 - RNA, 17 nt, Mycobacterium leprae
caggauauggcagagua

SEQ ID NO: 1238544 - RNA, 15 nt, Mycobacterium leprae
caggaucugcucgau

SEQ ID NO: 1238545 - RNA, 15 nt, Mycobacterium leprae
caggcaugccgccgg

SEQ ID NO: 1238546 - RNA, 17 nt, Mycobacterium leprae
caggcaugggcauuggc

SEQ ID NO: 1238547 - RNA, 16 nt, Mycobacterium leprae
caggccgagugcagga

SEQ ID NO: 1238548 - RNA, 16 nt, Mycobacterium leprae
caggccggccuggaaa

SEQ ID NO: 1238549 - RNA, 21 nt, Mycobacterium leprae
cagggcggcauucccaaccgc

SEQ ID NO: 1238550 - RNA, 14 nt, Mycobacterium leprae
cagggccagcccgc

SEQ ID NO: 1238551 - RNA, 16 nt, Mycobacterium leprae
caggcugucaucagaa

SEQ ID NO: 1238552 - RNA, 15 nt, Mycobacterium leprae
caggaagugcucaau

SEQ ID NO: 1238553 - RNA, 13 nt, Mycobacterium leprae
aaaauuuguucug

SEQ ID NO: 1238554 - RNA, 22 nt, Mycobacterium leprae
caggagaaacaaaggugcccac

SEQ ID NO: 1238555 - RNA, 18 nt, Mycobacterium leprae
caggacuacgccacagaa

SEQ ID NO: 1238556 - RNA, 21 nt, Mycobacterium leprae
caggacucggauccaucagac

SEQ ID NO: 1238557 - RNA, 16 nt, Mycobacterium leprae
cagcugguuguccacg

SEQ ID NO: 1238558 - RNA, 20 nt, Mycobacterium leprae
cagcuguugacugcgaaaaa

SEQ ID NO: 1238559 - RNA, 16 nt, Mycobacterium leprae
cagcuucaaaccggcc

SEQ ID NO: 1238560 - RNA, 24 nt, Mycobacterium leprae
cagcuaagccugcacuuuacgugc

SEQ ID NO: 1238561 - RNA, 17 nt, Mycobacterium leprae
cagcuaaccuccacggu

SEQ ID NO: 1238562 - RNA, 16 nt, Mycobacterium leprae
cagcuaagaagcugcc

SEQ ID NO: 1238563 - RNA, 16 nt, Mycobacterium leprae
cagcuauccccgaucg

SEQ ID NO: 1238564 - RNA, 18 nt, Mycobacterium leprae
cagcucacccgcagcacc

SEQ ID NO: 1238565 - RNA, 19 nt, Mycobacterium leprae
cagcucacccgcagcaccu

SEQ ID NO: 1238566 - RNA, 19 nt, Mycobacterium leprae
aaaauuuaaaaauuuguuc

SEQ ID NO: 1238567 - RNA, 16 nt, Mycobacterium leprae
cagcuccagcucgcgg

SEQ ID NO: 1238568 - RNA, 22 nt, Mycobacterium leprae
cagcucgaacuaacugccuauc

SEQ ID NO: 1238569 - RNA, 20 nt, Mycobacterium leprae
cagcucgacgggcggcaccu

SEQ ID NO: 1238570 - RNA, 14 nt, Mycobacterium leprae
cagcucggacaaga

SEQ ID NO: 1238571 - RNA, 19 nt, Mycobacterium leprae
cagcucgugguccacggcu

SEQ ID NO: 1238572 - RNA, 17 nt, Mycobacterium leprae
cagcucggcaucggccu

SEQ ID NO: 1238573 - RNA, 20 nt, Mycobacterium leprae
ccagcauuauccgggcugga

SEQ ID NO: 1238574 - RNA, 22 nt, Mycobacterium leprae
ccagcaucaacgccagcaagca

SEQ ID NO: 1238575 - RNA, 21 nt, Mycobacterium leprae
ccagcccgcuagcaucgacca

SEQ ID NO: 1238576 - RNA, 19 nt, Mycobacterium leprae
ccagccccuggcaucauca

SEQ ID NO: 1238577 - RNA, 22 nt, Mycobacterium leprae
ccagccccucgacaaccucguu

SEQ ID NO: 1238578 - RNA, 15 nt, Mycobacterium leprae
ccagccacggcgucg

SEQ ID NO: 1238579 - RNA, 22 nt, Mycobacterium leprae
ccagccaccagggaagaucuca

SEQ ID NO: 1238580 - RNA, 15 nt, Mycobacterium leprae
ccagcaagcaggcau

SEQ ID NO: 1238581 - RNA, 14 nt, Mycobacterium leprae
ccagcagaccgcua

SEQ ID NO: 1238582 - RNA, 17 nt, Mycobacterium leprae
ccagcagaucaaacaug

SEQ ID NO: 1238583 - RNA, 12 nt, Mycobacterium leprae
ccagcagauggc

SEQ ID NO: 1238584 - RNA, 22 nt, Mycobacterium leprae
ccagagacgaagacauaucaac

SEQ ID NO: 1238585 - RNA, 18 nt, Mycobacterium leprae
ccagagaugcguagccau

SEQ ID NO: 1238586 - RNA, 13 nt, Mycobacterium leprae
ccagacgucaacc

SEQ ID NO: 1238587 - RNA, 20 nt, Mycobacterium leprae
ccagagcugcgacggacagg

SEQ ID NO: 1238588 - RNA, 17 nt, Mycobacterium leprae
ccagaccgaaaaccaca

SEQ ID NO: 1238589 - RNA, 21 nt, Mycobacterium leprae
ccagaccgaaaaccacaagca

SEQ ID NO: 1238590 - RNA, 17 nt, Mycobacterium leprae
ccagacgcgaccgccac

SEQ ID NO: 1238591 - RNA, 13 nt, Mycobacterium leprae
ccagauggcuccc

SEQ ID NO: 1238592 - RNA, 15 nt, Mycobacterium leprae
ccagaugaacagccc

SEQ ID NO: 1238593 - RNA, 20 nt, Mycobacterium leprae
ccagaaaguacugaccggcu

SEQ ID NO: 1238594 - RNA, 15 nt, Mycobacterium leprae
ccagacaccacugcc

SEQ ID NO: 1238595 - RNA, 16 nt, Mycobacterium leprae
ccagacaccacugcca

SEQ ID NO: 1238596 - RNA, 21 nt, Mycobacterium leprae
ccagaagcuguugugaagcug

SEQ ID NO: 1238597 - RNA, 21 nt, Mycobacterium leprae
ccacuugacuauauaguccga

SEQ ID NO: 1238598 - RNA, 19 nt, Mycobacterium leprae
ccacuucuugugcaccguu

SEQ ID NO: 1238599 - RNA, 18 nt, Mycobacterium leprae
ccacuguuuuaagcgaaa

SEQ ID NO: 1238600 - RNA, 22 nt, Mycobacterium leprae
ccacuucagaucgacuccgcaa

SEQ ID NO: 1238601 - RNA, 16 nt, Mycobacterium leprae
ccacugcggcaaagca

SEQ ID NO: 1238602 - RNA, 22 nt, Mycobacterium leprae
ccacugcagggcgagcugcgcc

SEQ ID NO: 1238603 - RNA, 15 nt, Mycobacterium leprae
ccacaauucuucgcu

SEQ ID NO: 1238604 - RNA, 20 nt, Mycobacterium leprae
ccacaauucuucgcucagca

SEQ ID NO: 1238605 - RNA, 20 nt, Mycobacterium leprae
ccacaucgauugggucaguc

SEQ ID NO: 1238606 - RNA, 16 nt, Mycobacterium leprae
ccacauugaccacgcc

SEQ ID NO: 1238607 - RNA, 13 nt, Mycobacterium leprae
ccacauuugcgaa

SEQ ID NO: 1238608 - RNA, 17 nt, Mycobacterium leprae
ccaauucguaauuccug

SEQ ID NO: 1238609 - RNA, 15 nt, Mycobacterium leprae
ccacaacgccaaacu

SEQ ID NO: 1238610 - RNA, 17 nt, Mycobacterium leprae
ccaaguaagacagguaa

SEQ ID NO: 1238611 - RNA, 12 nt, Mycobacterium leprae
ccaaugcagcgu

SEQ ID NO: 1238612 - RNA, 13 nt, Mycobacterium leprae
ccaccgacaugcu

SEQ ID NO: 1238613 - RNA, 15 nt, Mycobacterium leprae
ccacgaaaaucuggc

SEQ ID NO: 1238614 - RNA, 22 nt, Mycobacterium leprae
ccaccuggucaccaaccggccg

SEQ ID NO: 1238615 - RNA, 19 nt, Mycobacterium leprae
ccaccguuggacaccaccg

SEQ ID NO: 1238616 - RNA, 22 nt, Mycobacterium leprae
ccaccggcgcuuguaaggccag

SEQ ID NO: 1238617 - RNA, 15 nt, Mycobacterium leprae
ccaccggcggcuggu

SEQ ID NO: 1238618 - RNA, 22 nt, Mycobacterium leprae
ccaaccgacgauuccuggaaag

SEQ ID NO: 1238619 - RNA, 22 nt, Mycobacterium leprae
ccaagaaguuaccgagccgguc

SEQ ID NO: 1238620 - RNA, 18 nt, Mycobacterium leprae
ccaagaccaccugucugg

SEQ ID NO: 1238621 - RNA, 18 nt, Mycobacterium leprae
ccaagccgccagucgcag

SEQ ID NO: 1238622 - RNA, 18 nt, Mycobacterium leprae
ccaaggggcuacaaucua

SEQ ID NO: 1238623 - RNA, 20 nt, Mycobacterium leprae
ccaaggucacgaugcuugau

SEQ ID NO: 1238624 - RNA, 18 nt, Mycobacterium leprae
ccaaacuugguuaauauc

SEQ ID NO: 1238625 - RNA, 22 nt, Mycobacterium leprae
ccaaacuugguuaauaucaaug

SEQ ID NO: 1238626 - RNA, 17 nt, Mycobacterium leprae
cauugaugaaugucaau

SEQ ID NO: 1238627 - RNA, 15 nt, Mycobacterium leprae
cauugaucgcucgug

SEQ ID NO: 1238628 - RNA, 19 nt, Mycobacterium leprae
cauuuucguaucaaaacua

SEQ ID NO: 1238629 - RNA, 18 nt, Mycobacterium leprae
cauuuugaugguaacgaa

SEQ ID NO: 1238630 - RNA, 19 nt, Mycobacterium leprae
cauuuugaugguaacgaag

SEQ ID NO: 1238631 - RNA, 20 nt, Mycobacterium leprae
cauuuugaugguaacgaagu

SEQ ID NO: 1238632 - RNA, 18 nt, Mycobacterium leprae
cauucuggucgagcgccc

SEQ ID NO: 1238633 - RNA, 23 nt, Mycobacterium leprae
cauugaccacgccgacaccucaa

SEQ ID NO: 1238634 - RNA, 12 nt, Mycobacterium leprae
cauucccaaccg

SEQ ID NO: 1238635 - RNA, 20 nt, Mycobacterium leprae
cauucugaaugcuccucaac

SEQ ID NO: 1238636 - RNA, 16 nt, Mycobacterium leprae
cauuauggggguggga

SEQ ID NO: 1238637 - RNA, 14 nt, Mycobacterium leprae
cauuaucgcaugug

SEQ ID NO: 1238638 - RNA, 18 nt, Mycobacterium leprae
caugcgcugaggcagcag

SEQ ID NO: 1238639 - RNA, 18 nt, Mycobacterium leprae
cauggcgagcaucuggcc

SEQ ID NO: 1238640 - RNA, 23 nt, Mycobacterium leprae
cauggcgcugguuguucaugcuc

SEQ ID NO: 1238641 - RNA, 16 nt, Mycobacterium leprae
caugauugcagauguu

SEQ ID NO: 1238642 - RNA, 15 nt, Mycobacterium leprae
caugaucaauaccac

SEQ ID NO: 1238643 - RNA, 19 nt, Mycobacterium leprae
caugauccagcugucagug

SEQ ID NO: 1238644 - RNA, 17 nt, Mycobacterium leprae
caugauccguacaccaa

SEQ ID NO: 1238645 - RNA, 14 nt, Mycobacterium leprae
caugcccaugccag

SEQ ID NO: 1238646 - RNA, 15 nt, Mycobacterium leprae
caugcccaugccagc

SEQ ID NO: 1238647 - RNA, 22 nt, Mycobacterium leprae
caugccuugaccuucucgacca

SEQ ID NO: 1238648 - RNA, 19 nt, Mycobacterium leprae
caugccugcuugcuggcug

SEQ ID NO: 1238649 - RNA, 18 nt, Mycobacterium leprae
caucuuguuggccggugc

SEQ ID NO: 1238650 - RNA, 17 nt, Mycobacterium leprae
caucuugaccugccguc

SEQ ID NO: 1238651 - RNA, 15 nt, Mycobacterium leprae
caugaacugacuuca

SEQ ID NO: 1238652 - RNA, 14 nt, Mycobacterium leprae
caugacaugcacac

SEQ ID NO: 1238653 - RNA, 18 nt, Mycobacterium leprae
caugacaugcacacuaaa

SEQ ID NO: 1238654 - RNA, 16 nt, Mycobacterium leprae
caugaguuguuugcua

SEQ ID NO: 1238655 - RNA, 12 nt, Mycobacterium leprae
caugagcugcug

SEQ ID NO: 1238656 - RNA, 14 nt, Mycobacterium leprae
caugacgggccgcg

SEQ ID NO: 1238657 - RNA, 21 nt, Mycobacterium leprae
caugacgucuucuauacuuua

SEQ ID NO: 1238658 - RNA, 19 nt, Mycobacterium leprae
cauccagaaaguacugacc

SEQ ID NO: 1238659 - RNA, 14 nt, Mycobacterium leprae
cauccaacacgccg

SEQ ID NO: 1238660 - RNA, 17 nt, Mycobacterium leprae
caucagccaacaccacc

SEQ ID NO: 1238661 - RNA, 22 nt, Mycobacterium leprae
caucccgauaagcaaaaaauag

SEQ ID NO: 1238662 - RNA, 17 nt, Mycobacterium leprae
cauccgcaagcgcgccg

SEQ ID NO: 1238663 - RNA, 22 nt, Mycobacterium leprae
cauccgcaagcgcgccgagugg

SEQ ID NO: 1238664 - RNA, 22 nt, Mycobacterium leprae
cauccccgaaaggauggggcca

SEQ ID NO: 1238665 - RNA, 20 nt, Mycobacterium leprae
caucgaaccgacgaugcugu

SEQ ID NO: 1238666 - RNA, 13 nt, Mycobacterium leprae
caucgaauaccuu

SEQ ID NO: 1238667 - RNA, 19 nt, Mycobacterium leprae
caucgcccaccgcaacgcc

SEQ ID NO: 1238668 - RNA, 16 nt, Mycobacterium leprae
caucggacugaagcuc

SEQ ID NO: 1238669 - RNA, 18 nt, Mycobacterium leprae
caucggcagaucgaucuc

SEQ ID NO: 1238670 - RNA, 20 nt, Mycobacterium leprae
caucggcaucccagugugcu

SEQ ID NO: 1238671 - RNA, 19 nt, Mycobacterium leprae
caucgugaaucagaugacc

SEQ ID NO: 1238672 - RNA, 16 nt, Mycobacterium leprae
caucgucggcaaauuu

SEQ ID NO: 1238673 - RNA, 17 nt, Mycobacterium leprae
caucgguaguggccggc

SEQ ID NO: 1238674 - RNA, 16 nt, Mycobacterium leprae
caucggcgugccuggc

SEQ ID NO: 1238675 - RNA, 15 nt, Mycobacterium leprae
caucggcuacggcaa

SEQ ID NO: 1238676 - RNA, 21 nt, Mycobacterium leprae
caucggcucccaucggcggcc

SEQ ID NO: 1238677 - RNA, 14 nt, Mycobacterium leprae
caucggcugcaccg

SEQ ID NO: 1238678 - RNA, 23 nt, Mycobacterium leprae
caucggcugugguuggggcgcca

SEQ ID NO: 1238679 - RNA, 13 nt, Mycobacterium leprae
caucagcaccgcg

SEQ ID NO: 1238680 - RNA, 19 nt, Mycobacterium leprae
caucaccacgaucaccgcg

SEQ ID NO: 1238681 - RNA, 19 nt, Mycobacterium leprae
cauaucgcgcaacgacugu

SEQ ID NO: 1238682 - RNA, 22 nt, Mycobacterium leprae
cauauucgucaaaaaacucaug

SEQ ID NO: 1238683 - RNA, 15 nt, Mycobacterium leprae
cauagccgugguagg

SEQ ID NO: 1238684 - RNA, 14 nt, Mycobacterium leprae
cauagguggugggu

SEQ ID NO: 1238685 - RNA, 18 nt, Mycobacterium leprae
cauagggagaaugccaca

SEQ ID NO: 1238686 - RNA, 22 nt, Mycobacterium leprae
cauagggagaaugccacaggcg

SEQ ID NO: 1238687 - RNA, 19 nt, Mycobacterium leprae
cauagaaccugccuagcaa

SEQ ID NO: 1238688 - RNA, 16 nt, Mycobacterium leprae
cgacaagcaucuuaac

SEQ ID NO: 1238689 - RNA, 15 nt, Mycobacterium leprae
cgacaccgagcagcc

SEQ ID NO: 1238690 - RNA, 21 nt, Mycobacterium leprae
cgacaccggccaaaagccuug

SEQ ID NO: 1238691 - RNA, 18 nt, Mycobacterium leprae
cgacaaagagaacuucuu

SEQ ID NO: 1238692 - RNA, 13 nt, Mycobacterium leprae
cgacaaagcucag

SEQ ID NO: 1238693 - RNA, 20 nt, Mycobacterium leprae
cgacaaaauuuucaggcugu

SEQ ID NO: 1238694 - RNA, 15 nt, Mycobacterium leprae
cgacagcagccacug

SEQ ID NO: 1238695 - RNA, 17 nt, Mycobacterium leprae
cgacagcucguggucca

SEQ ID NO: 1238696 - RNA, 18 nt, Mycobacterium leprae
cgacaucguugcacggca

SEQ ID NO: 1238697 - RNA, 20 nt, Mycobacterium leprae
cgacaguuuaccgugccuug

SEQ ID NO: 1238698 - RNA, 18 nt, Mycobacterium leprae
cgacagugucccuguccu

SEQ ID NO: 1238699 - RNA, 15 nt, Mycobacterium leprae
cgaauccucgauggc

SEQ ID NO: 1238700 - RNA, 15 nt, Mycobacterium leprae
cgaauccuacaucca

SEQ ID NO: 1238701 - RNA, 22 nt, Mycobacterium leprae
cgaaucgguacauuugcggaug

SEQ ID NO: 1238702 - RNA, 23 nt, Mycobacterium leprae
cgaauauuuucaagacugcaccc

SEQ ID NO: 1238703 - RNA, 21 nt, Mycobacterium leprae
cgaaucaccgcuggguguguc

SEQ ID NO: 1238704 - RNA, 23 nt, Mycobacterium leprae
cgaauaucgcuacccuugagcac

SEQ ID NO: 1238705 - RNA, 18 nt, Mycobacterium leprae
cgaagugcgccagcgaca

SEQ ID NO: 1238706 - RNA, 16 nt, Mycobacterium leprae
cgaaccuccaccacuc

SEQ ID NO: 1238707 - RNA, 21 nt, Mycobacterium leprae
cgaagaaucuugaaauucaau

SEQ ID NO: 1238708 - RNA, 13 nt, Mycobacterium leprae
cgaagcagccggg

SEQ ID NO: 1238709 - RNA, 16 nt, Mycobacterium leprae
cgaagcaccagcagug

SEQ ID NO: 1238710 - RNA, 19 nt, Mycobacterium leprae
cgaagcacccggaaggugu

SEQ ID NO: 1238711 - RNA, 21 nt, Mycobacterium leprae
cgaccgcccgguagcaccaag

SEQ ID NO: 1238712 - RNA, 17 nt, Mycobacterium leprae
cgacccggugguguucc

SEQ ID NO: 1238713 - RNA, 12 nt, Mycobacterium leprae
cgaccgacuggc

SEQ ID NO: 1238714 - RNA, 13 nt, Mycobacterium leprae
cgaccagccaagc

SEQ ID NO: 1238715 - RNA, 13 nt, Mycobacterium leprae
cgaccagccacgc

SEQ ID NO: 1238716 - RNA, 23 nt, Mycobacterium leprae
cgaccaggauguuauucgggagc

SEQ ID NO: 1238717 - RNA, 15 nt, Mycobacterium leprae
cgacgaaaacgucca

SEQ ID NO: 1238718 - RNA, 19 nt, Mycobacterium leprae
cgaccuugcggcgccccuc

SEQ ID NO: 1238719 - RNA, 18 nt, Mycobacterium leprae
cgaccuccuugaccacca

SEQ ID NO: 1238720 - RNA, 22 nt, Mycobacterium leprae
cgaccuccuugaccaccaccgc

SEQ ID NO: 1238721 - RNA, 16 nt, Mycobacterium leprae
cgacgaugugcagcag

SEQ ID NO: 1238722 - RNA, 17 nt, Mycobacterium leprae
cgacgauuccuggaaag

SEQ ID NO: 1238723 - RNA, 23 nt, Mycobacterium leprae
cgacgaguuccaggacaacggcg

SEQ ID NO: 1238724 - RNA, 15 nt, Mycobacterium leprae
cgacgacgugaaaca

SEQ ID NO: 1238725 - RNA, 19 nt, Mycobacterium leprae
cgacggugaaucagucugc

SEQ ID NO: 1238726 - RNA, 23 nt, Mycobacterium leprae
cgacgguaaguuuucagccacau

SEQ ID NO: 1238727 - RNA, 14 nt, Mycobacterium leprae
cgacggaugcccag

SEQ ID NO: 1238728 - RNA, 19 nt, Mycobacterium leprae
cgacggaugcccagccagg

SEQ ID NO: 1238729 - RNA, 17 nt, Mycobacterium leprae
cgacggcaacggcacca

SEQ ID NO: 1238730 - RNA, 15 nt, Mycobacterium leprae
cgacggccgcacagc

SEQ ID NO: 1238731 - RNA, 13 nt, Mycobacterium leprae
cgacggcgccgca

SEQ ID NO: 1238732 - RNA, 17 nt, Mycobacterium leprae
cgacggcgccgcacagc

SEQ ID NO: 1238733 - RNA, 18 nt, Mycobacterium leprae
cgacggcuggcugcugca

SEQ ID NO: 1238734 - RNA, 13 nt, Mycobacterium leprae
cgacgcggaacgc

SEQ ID NO: 1238735 - RNA, 13 nt, Mycobacterium leprae
cgacgccgcggcu

SEQ ID NO: 1238736 - RNA, 22 nt, Mycobacterium leprae
ccuuucaggugugcugcagcau

SEQ ID NO: 1238737 - RNA, 16 nt, Mycobacterium leprae
ccuuucacgccaggcg

SEQ ID NO: 1238738 - RNA, 16 nt, Mycobacterium leprae
ccuuguugcaaaccug

SEQ ID NO: 1238739 - RNA, 14 nt, Mycobacterium leprae
ccuugaccaccacc

SEQ ID NO: 1238740 - RNA, 17 nt, Mycobacterium leprae
ccuugaccaccaccgcc

SEQ ID NO: 1238741 - RNA, 17 nt, Mycobacterium leprae
ccuugaccucaucccac

SEQ ID NO: 1238742 - RNA, 14 nt, Mycobacterium leprae
ccuucagcacagcc

SEQ ID NO: 1238743 - RNA, 15 nt, Mycobacterium leprae
ccuuccggcggucac

SEQ ID NO: 1238744 - RNA, 13 nt, Mycobacterium leprae
ccuucgauuccag

SEQ ID NO: 1238745 - RNA, 22 nt, Mycobacterium leprae
ccuucggagucuugaugccaac

SEQ ID NO: 1238746 - RNA, 15 nt, Mycobacterium leprae
ccuuaccgguucagg

SEQ ID NO: 1238747 - RNA, 13 nt, Mycobacterium leprae
ccuucacuuccgc

SEQ ID NO: 1238748 - RNA, 20 nt, Mycobacterium leprae
ccugcuuguuaucgaagcuu

SEQ ID NO: 1238749 - RNA, 21 nt, Mycobacterium leprae
ccugcuugaggucgcacagca

SEQ ID NO: 1238750 - RNA, 16 nt, Mycobacterium leprae
ccuggacccaccuuga

SEQ ID NO: 1238751 - RNA, 21 nt, Mycobacterium leprae
ccuggauugucgacaagcugg

SEQ ID NO: 1238752 - RNA, 23 nt, Mycobacterium leprae
ccuggauugucgacaagcugguc

SEQ ID NO: 1238753 - RNA, 13 nt, Mycobacterium leprae
ccuggcaccgugu

SEQ ID NO: 1238754 - RNA, 22 nt, Mycobacterium leprae
ccuggccaguuuuuaggcacgc

SEQ ID NO: 1238755 - RNA, 12 nt, Mycobacterium leprae
ccuggcugggcu

SEQ ID NO: 1238756 - RNA, 19 nt, Mycobacterium leprae
ccuggcguuuggugcugcg

SEQ ID NO: 1238757 - RNA, 16 nt, Mycobacterium leprae
ccuggugugcgcgccg

SEQ ID NO: 1238758 - RNA, 19 nt, Mycobacterium leprae
ccuggugugcgcgccgccc

SEQ ID NO: 1238759 - RNA, 22 nt, Mycobacterium leprae
ccugccgacaguuuaccgugcc

SEQ ID NO: 1238760 - RNA, 16 nt, Mycobacterium leprae
ccugccgauauaccug

SEQ ID NO: 1238761 - RNA, 20 nt, Mycobacterium leprae
ccugcgacaucucggucagg

SEQ ID NO: 1238762 - RNA, 24 nt, Mycobacterium leprae
ccugcgagaucggguugacgcugc

SEQ ID NO: 1238763 - RNA, 20 nt, Mycobacterium leprae
ccugcgacagccgugccucg

SEQ ID NO: 1238764 - RNA, 21 nt, Mycobacterium leprae
ccugcacuucagggauaagcu

SEQ ID NO: 1238765 - RNA, 23 nt, Mycobacterium leprae
ccucgaaccgauccagcauucag

SEQ ID NO: 1238766 - RNA, 16 nt, Mycobacterium leprae
ccuccuuuucgccggc

SEQ ID NO: 1238767 - RNA, 21 nt, Mycobacterium leprae
ccucgaggugcaggagcgugg

SEQ ID NO: 1238768 - RNA, 14 nt, Mycobacterium leprae
ccucgacuuccggc

SEQ ID NO: 1238769 - RNA, 23 nt, Mycobacterium leprae
ccucgcugcagcauaacccgauc

SEQ ID NO: 1238770 - RNA, 19 nt, Mycobacterium leprae
ccuccggagguauccacgu

SEQ ID NO: 1238771 - RNA, 12 nt, Mycobacterium leprae
ccuccacugcuc

SEQ ID NO: 1238772 - RNA, 14 nt, Mycobacterium leprae
ccucagcgucccaa

SEQ ID NO: 1238773 - RNA, 15 nt, Mycobacterium leprae
ccuagcuucgaucca

SEQ ID NO: 1238774 - RNA, 22 nt, Mycobacterium leprae
ccucaaucaucgcagagcucac

SEQ ID NO: 1238775 - RNA, 19 nt, Mycobacterium leprae
ccuauugucagguggcuug

SEQ ID NO: 1238776 - RNA, 20 nt, Mycobacterium leprae
ccuauuuuuccgcagcgacg

SEQ ID NO: 1238777 - RNA, 20 nt, Mycobacterium leprae
ccucagccagcaagcaggca

SEQ ID NO: 1238778 - RNA, 15 nt, Mycobacterium leprae
ccucacccaguccug

SEQ ID NO: 1238779 - RNA, 20 nt, Mycobacterium leprae
ccucacccaugccucuagca

SEQ ID NO: 1238780 - RNA, 19 nt, Mycobacterium leprae
ccucacaguaggccagccc

SEQ ID NO: 1238781 - RNA, 17 nt, Mycobacterium leprae
ccuaccggccaaccaca

SEQ ID NO: 1238782 - RNA, 20 nt, Mycobacterium leprae
ccuaccggccaaccacagca

SEQ ID NO: 1238783 - RNA, 21 nt, Mycobacterium leprae
ccuaccggccaaccacagcaa

SEQ ID NO: 1238784 - RNA, 13 nt, Mycobacterium leprae
ccuaccccgcggc

SEQ ID NO: 1238785 - RNA, 14 nt, Mycobacterium leprae
ccgucgcgcgugcc

SEQ ID NO: 1238786 - RNA, 16 nt, Mycobacterium leprae
ccgucgcgagcugaac

SEQ ID NO: 1238787 - RNA, 16 nt, Mycobacterium leprae
ccgguuggccaacugu

SEQ ID NO: 1238788 - RNA, 17 nt, Mycobacterium leprae
ccgguuggcugccgucg

SEQ ID NO: 1238789 - RNA, 24 nt, Mycobacterium leprae
ccgguuacguccgcggcagcugcu

SEQ ID NO: 1238790 - RNA, 12 nt, Mycobacterium leprae
ccguguagugca

SEQ ID NO: 1238791 - RNA, 13 nt, Mycobacterium leprae
ccgugucaagucg

SEQ ID NO: 1238792 - RNA, 20 nt, Mycobacterium leprae
ccgugcccaagacucaguga

SEQ ID NO: 1238793 - RNA, 15 nt, Mycobacterium leprae
ccgucucucaggccg

SEQ ID NO: 1238794 - RNA, 20 nt, Mycobacterium leprae
ccgucuaguggcgcggcacg

SEQ ID NO: 1238795 - RNA, 17 nt, Mycobacterium leprae
ccguuuccgcuaccauc

SEQ ID NO: 1238796 - RNA, 17 nt, Mycobacterium leprae
ccguuacggccaugucu

SEQ ID NO: 1238797 - RNA, 13 nt, Mycobacterium leprae
ccguuaucgaucu

SEQ ID NO: 1238798 - RNA, 12 nt, Mycobacterium leprae
ccguucaguggc

SEQ ID NO: 1238799 - RNA, 14 nt, Mycobacterium leprae
ccguuccugagugu

SEQ ID NO: 1238800 - RNA, 15 nt, Mycobacterium leprae
ccguuuacuguguug

SEQ ID NO: 1238801 - RNA, 19 nt, Mycobacterium leprae
ccguugucaagcacugcag

SEQ ID NO: 1238802 - RNA, 18 nt, Mycobacterium leprae
ccguuggcgaucagcagg

SEQ ID NO: 1238803 - RNA, 22 nt, Mycobacterium leprae
ccguucucgcgcaggucacccu

SEQ ID NO: 1238804 - RNA, 17 nt, Mycobacterium leprae
ccggcaagcugcccggc

SEQ ID NO: 1238805 - RNA, 13 nt, Mycobacterium leprae
ccggcaagcccgg

SEQ ID NO: 1238806 - RNA, 20 nt, Mycobacterium leprae
ccggaucgacggcagcgcug

SEQ ID NO: 1238807 - RNA, 23 nt, Mycobacterium leprae
ccggauaggucgcgauucguaua

SEQ ID NO: 1238808 - RNA, 23 nt, Mycobacterium leprae
ccgcugucgauggacaagguguu

SEQ ID NO: 1238809 - RNA, 13 nt, Mycobacterium leprae
ccgcuucaacguu

SEQ ID NO: 1238810 - RNA, 18 nt, Mycobacterium leprae
ccgcuucagagugcaccg

SEQ ID NO: 1238811 - RNA, 12 nt, Mycobacterium leprae
ccggaccuggac

SEQ ID NO: 1238812 - RNA, 22 nt, Mycobacterium leprae
ccggccaggugguaucugcacc

SEQ ID NO: 1238813 - RNA, 19 nt, Mycobacterium leprae
ccggcgaagacgccgccgg

SEQ ID NO: 1238814 - RNA, 18 nt, Mycobacterium leprae
ccggcguuccggccucgg

SEQ ID NO: 1238815 - RNA, 20 nt, Mycobacterium leprae
ccggcuauguggcgcgucgg

SEQ ID NO: 1238816 - RNA, 19 nt, Mycobacterium leprae
ccggcuagguaccccaguc

SEQ ID NO: 1238817 - RNA, 19 nt, Mycobacterium leprae
ccggcuaguugccuggccu

SEQ ID NO: 1238818 - RNA, 17 nt, Mycobacterium leprae
ccggcggcgagcaagcg

SEQ ID NO: 1238819 - RNA, 14 nt, Mycobacterium leprae
ccggcgucaggcca

SEQ ID NO: 1238820 - RNA, 15 nt, Mycobacterium leprae
ccgggauggcugggc

SEQ ID NO: 1238821 - RNA, 14 nt, Mycobacterium leprae
ccgggcacuugggu

SEQ ID NO: 1238822 - RNA, 16 nt, Mycobacterium leprae
ccgguaagcgugcgau

SEQ ID NO: 1238823 - RNA, 18 nt, Mycobacterium leprae
ccgguggccaccgccacc

SEQ ID NO: 1238824 - RNA, 18 nt, Mycobacterium leprae
ccggugauguggccgugg

SEQ ID NO: 1238825 - RNA, 13 nt, Mycobacterium leprae
ccggugagggacg

SEQ ID NO: 1238826 - RNA, 16 nt, Mycobacterium leprae
ccggucaagagccgcg

SEQ ID NO: 1238827 - RNA, 14 nt, Mycobacterium leprae
ccgcaggcaccauu

SEQ ID NO: 1238828 - RNA, 14 nt, Mycobacterium leprae
ccgcagucgguuga

SEQ ID NO: 1238829 - RNA, 19 nt, Mycobacterium leprae
ccgcauaccaugacaugac

SEQ ID NO: 1238830 - RNA, 21 nt, Mycobacterium leprae
ccgcaucgauaagcagcagcg

SEQ ID NO: 1238831 - RNA, 19 nt, Mycobacterium leprae
ccgcaugcccugggccagc

SEQ ID NO: 1238832 - RNA, 22 nt, Mycobacterium leprae
ccgcaucuucgcccagcacgca

SEQ ID NO: 1238833 - RNA, 20 nt, Mycobacterium leprae
ccgagcguacuggugauaaa

SEQ ID NO: 1238834 - RNA, 15 nt, Mycobacterium leprae
ccgauuuucgauccg

SEQ ID NO: 1238835 - RNA, 15 nt, Mycobacterium leprae
ccgcacaguuccagu

SEQ ID NO: 1238836 - RNA, 23 nt, Mycobacterium leprae
ccgccagucgcagggcgcgcagc

SEQ ID NO: 1238837 - RNA, 22 nt, Mycobacterium leprae
ccgccagggcggcauucccaac

SEQ ID NO: 1238838 - RNA, 22 nt, Mycobacterium leprae
aaaccaucgucgacgaguucca

SEQ ID NO: 1238839 - RNA, 23 nt, Mycobacterium leprae
aaaccagccgggugaucccgcug

SEQ ID NO: 1238840 - RNA, 18 nt, Mycobacterium leprae
ccgccacagcaagucgcc

SEQ ID NO: 1238841 - RNA, 15 nt, Mycobacterium leprae
ccgccacgccgugcu

SEQ ID NO: 1238842 - RNA, 18 nt, Mycobacterium leprae
aaacccgcgcgugcacaa

SEQ ID NO: 1238843 - RNA, 16 nt, Mycobacterium leprae
ccgccgaagccgcgca

SEQ ID NO: 1238844 - RNA, 16 nt, Mycobacterium leprae
ccgccauugcccccgc

SEQ ID NO: 1238845 - RNA, 16 nt, Mycobacterium leprae
ccgcccaagaaggucc

SEQ ID NO: 1238846 - RNA, 12 nt, Mycobacterium leprae
ccgccaucucug

SEQ ID NO: 1238847 - RNA, 15 nt, Mycobacterium leprae
ccgccgggugcagca

SEQ ID NO: 1238848 - RNA, 11 nt, Mycobacterium leprae
ccgccggcguc

SEQ ID NO: 1238849 - RNA, 22 nt, Mycobacterium leprae
ccgccggcgucaggccaggcag

SEQ ID NO: 1238850 - RNA, 19 nt, Mycobacterium leprae
ccgccgugguggcugucgg

SEQ ID NO: 1238851 - RNA, 15 nt, Mycobacterium leprae
ccgaccagagcuguu

SEQ ID NO: 1238852 - RNA, 14 nt, Mycobacterium leprae
ccgaccgcccggua

SEQ ID NO: 1238853 - RNA, 20 nt, Mycobacterium leprae
ccgaccgcccgguagcacca

SEQ ID NO: 1238854 - RNA, 22 nt, Mycobacterium leprae
ccgaccgcccgguagcaccaag

SEQ ID NO: 1238855 - RNA, 17 nt, Mycobacterium leprae
ccgacgcgcacuagcau

SEQ ID NO: 1238856 - RNA, 17 nt, Mycobacterium leprae
ccgagccgcaggucuca

SEQ ID NO: 1238857 - RNA, 23 nt, Mycobacterium leprae
ccgagccgcaggucucacacccg

SEQ ID NO: 1238858 - RNA, 21 nt, Mycobacterium leprae
ccgacgaugcgugccccggcc

SEQ ID NO: 1238859 - RNA, 16 nt, Mycobacterium leprae
ccgaccgaaagccgca

SEQ ID NO: 1238860 - RNA, 13 nt, Mycobacterium leprae
aaacaucgaguga

SEQ ID NO: 1238861 - RNA, 21 nt, Mycobacterium leprae
ccgaaaacacgggcaccagau

SEQ ID NO: 1238862 - RNA, 15 nt, Mycobacterium leprae
cccuucacuuccgcu

SEQ ID NO: 1238863 - RNA, 18 nt, Mycobacterium leprae
cccguuaacgaguugacc

SEQ ID NO: 1238864 - RNA, 15 nt, Mycobacterium leprae
cccgucguggccgag

SEQ ID NO: 1238865 - RNA, 23 nt, Mycobacterium leprae
cccguaguuguguuccgguucca

SEQ ID NO: 1238866 - RNA, 15 nt, Mycobacterium leprae
cccggugucacccgg

SEQ ID NO: 1238867 - RNA, 19 nt, Mycobacterium leprae
cccuccuuuucgccggcgu

SEQ ID NO: 1238868 - RNA, 12 nt, Mycobacterium leprae
cccucucagcaa

SEQ ID NO: 1238869 - RNA, 19 nt, Mycobacterium leprae
cccucguugacgcccuccu

SEQ ID NO: 1238870 - RNA, 15 nt, Mycobacterium leprae
cccucacccgaccgg

SEQ ID NO: 1238871 - RNA, 16 nt, Mycobacterium leprae
cccugccgccacagca

SEQ ID NO: 1238872 - RNA, 22 nt, Mycobacterium leprae
cccucuucuaggcaugaaccuc

SEQ ID NO: 1238873 - RNA, 12 nt, Mycobacterium leprae
cccugagcacca

SEQ ID NO: 1238874 - RNA, 13 nt, Mycobacterium leprae
cccgaguucucag

SEQ ID NO: 1238875 - RNA, 21 nt, Mycobacterium leprae
cccgccagggcggcauuccca

SEQ ID NO: 1238876 - RNA, 20 nt, Mycobacterium leprae
cccgaggcgcuaggacaaca

SEQ ID NO: 1238877 - RNA, 18 nt, Mycobacterium leprae
cccgaaaggauggggcca

SEQ ID NO: 1238878 - RNA, 12 nt, Mycobacterium leprae
cccaucugcuug

SEQ ID NO: 1238879 - RNA, 13 nt, Mycobacterium leprae
cccaucucaucuu

SEQ ID NO: 1238880 - RNA, 16 nt, Mycobacterium leprae
cccaucucaucuugac

SEQ ID NO: 1238881 - RNA, 18 nt, Mycobacterium leprae
cccaugcuuaaggcagaa

SEQ ID NO: 1238882 - RNA, 15 nt, Mycobacterium leprae
cccaugggaguuuau

SEQ ID NO: 1238883 - RNA, 12 nt, Mycobacterium leprae
ccccaaccagac

SEQ ID NO: 1238884 - RNA, 17 nt, Mycobacterium leprae
ccccgaguucucagucg

SEQ ID NO: 1238885 - RNA, 13 nt, Mycobacterium leprae
cccaaggggagca

SEQ ID NO: 1238886 - RNA, 22 nt, Mycobacterium leprae
cccagcaccacugcggugugug

SEQ ID NO: 1238887 - RNA, 16 nt, Mycobacterium leprae
cccagcacgcgcgaca

SEQ ID NO: 1238888 - RNA, 19 nt, Mycobacterium leprae
cccagcuccagaacggucu

SEQ ID NO: 1238889 - RNA, 24 nt, Mycobacterium leprae
cccagcuccagaacggucuggcgc

SEQ ID NO: 1238890 - RNA, 20 nt, Mycobacterium leprae
cccagcgauaucaagcugcg

SEQ ID NO: 1238891 - RNA, 15 nt, Mycobacterium leprae
cccauccgggccagu

SEQ ID NO: 1238892 - RNA, 16 nt, Mycobacterium leprae
cccauccguccacccc

SEQ ID NO: 1238893 - RNA, 13 nt, Mycobacterium leprae
aaacacagcaagc

SEQ ID NO: 1238894 - RNA, 19 nt, Mycobacterium leprae
cccaggugucuuccagugg

SEQ ID NO: 1238895 - RNA, 16 nt, Mycobacterium leprae
cccaguaggcaccacg

SEQ ID NO: 1238896 - RNA, 23 nt, Mycobacterium leprae
cccagugugcugcauccgacaaa

SEQ ID NO: 1238897 - RNA, 19 nt, Mycobacterium leprae
cccaggccuguugcggcca

SEQ ID NO: 1238898 - RNA, 20 nt, Mycobacterium leprae
ccauuugucaucggcgugcc

SEQ ID NO: 1238899 - RNA, 16 nt, Mycobacterium leprae
cccaaccgcgacgcca

SEQ ID NO: 1238900 - RNA, 13 nt, Mycobacterium leprae
cccaacugguuga

SEQ ID NO: 1238901 - RNA, 19 nt, Mycobacterium leprae
ccauucggaaucgcgugcu

SEQ ID NO: 1238902 - RNA, 18 nt, Mycobacterium leprae
ccauggucgucgcugcuu

SEQ ID NO: 1238903 - RNA, 20 nt, Mycobacterium leprae
ccauggucgucgcugcuucc

SEQ ID NO: 1238904 - RNA, 23 nt, Mycobacterium leprae
ccauggucgucgcugcuuccuga

SEQ ID NO: 1238905 - RNA, 21 nt, Mycobacterium leprae
ccaugugcugacagacauggc

SEQ ID NO: 1238906 - RNA, 13 nt, Mycobacterium leprae
ccaugucuaccug

SEQ ID NO: 1238907 - RNA, 14 nt, Mycobacterium leprae
ccauccaacgugac

SEQ ID NO: 1238908 - RNA, 14 nt, Mycobacterium leprae
ccauccaccgccga

SEQ ID NO: 1238909 - RNA, 14 nt, Mycobacterium leprae
ccauggcagucuug

SEQ ID NO: 1238910 - RNA, 23 nt, Mycobacterium leprae
ccaugacaugacgccugggaacc

SEQ ID NO: 1238911 - RNA, 16 nt, Mycobacterium leprae
ccaucggcggccagcu

SEQ ID NO: 1238912 - RNA, 22 nt, Mycobacterium leprae
ccaucggcagaucgaucucgac

SEQ ID NO: 1238913 - RNA, 22 nt, Mycobacterium leprae
ccaucgugaggugugaccgugc

SEQ ID NO: 1238914 - RNA, 19 nt, Mycobacterium leprae
ccaucgucgacgaguucca

SEQ ID NO: 1238915 - RNA, 14 nt, Mycobacterium leprae
ccaguaaugugcua

SEQ ID NO: 1238916 - RNA, 23 nt, Mycobacterium leprae
ccaguaggcaccacgcacacgac

SEQ ID NO: 1238917 - RNA, 18 nt, Mycobacterium leprae
ccaggugcuggcugcgcc

SEQ ID NO: 1238918 - RNA, 17 nt, Mycobacterium leprae
ccaggugcugcaguugg

SEQ ID NO: 1238919 - RNA, 19 nt, Mycobacterium leprae
ccagggucauuacucacga

SEQ ID NO: 1238920 - RNA, 23 nt, Mycobacterium leprae
ccauacccaggguagcugacggu

SEQ ID NO: 1238921 - RNA, 20 nt, Mycobacterium leprae
ccauaaacacgugcaucgag

SEQ ID NO: 1238922 - RNA, 18 nt, Mycobacterium leprae
ccagucgagauaguccga

SEQ ID NO: 1238923 - RNA, 16 nt, Mycobacterium leprae
ccaguccggugcuguc

SEQ ID NO: 1238924 - RNA, 15 nt, Mycobacterium leprae
ccagugcacugagca

SEQ ID NO: 1238925 - RNA, 15 nt, Mycobacterium leprae
cgcagucauccacug

SEQ ID NO: 1238926 - RNA, 20 nt, Mycobacterium leprae
cgcaguacuggugcuguguu

SEQ ID NO: 1238927 - RNA, 14 nt, Mycobacterium leprae
cgcagugugcuuuc

SEQ ID NO: 1238928 - RNA, 21 nt, Mycobacterium leprae
cgcagugugcuuucggcucaa

SEQ ID NO: 1238929 - RNA, 23 nt, Mycobacterium leprae
cgcaguuaguuuaacgccugcuu

SEQ ID NO: 1238930 - RNA, 12 nt, Mycobacterium leprae
cgcagccaccac

SEQ ID NO: 1238931 - RNA, 19 nt, Mycobacterium leprae
cgcagcaagcggccgccca

SEQ ID NO: 1238932 - RNA, 21 nt, Mycobacterium leprae
cgcagcacuaaagucuucaau

SEQ ID NO: 1238933 - RNA, 19 nt, Mycobacterium leprae
cgcaagugcggcgcccagc

SEQ ID NO: 1238934 - RNA, 22 nt, Mycobacterium leprae
cgcaagucuggagucaucccca

SEQ ID NO: 1238935 - RNA, 13 nt, Mycobacterium leprae
cgcaagcgcgccg

SEQ ID NO: 1238936 - RNA, 16 nt, Mycobacterium leprae
cgcacccggcagcauc

SEQ ID NO: 1238937 - RNA, 16 nt, Mycobacterium leprae
cgcagaccucuuccgc

SEQ ID NO: 1238938 - RNA, 13 nt, Mycobacterium leprae
cgcagcaacuguu

SEQ ID NO: 1238939 - RNA, 23 nt, Mycobacterium leprae
cgcacgggauggccaagccgccc

SEQ ID NO: 1238940 - RNA, 13 nt, Mycobacterium leprae
cgcaccggcugca

SEQ ID NO: 1238941 - RNA, 15 nt, Mycobacterium leprae
cgcaccgaucugccc

SEQ ID NO: 1238942 - RNA, 22 nt, Mycobacterium leprae
cgauuguguaacgauuagcaug

SEQ ID NO: 1238943 - RNA, 15 nt, Mycobacterium leprae
cgauuccgccgucga

SEQ ID NO: 1238944 - RNA, 13 nt, Mycobacterium leprae
cgauucaccgauc

SEQ ID NO: 1238945 - RNA, 19 nt, Mycobacterium leprae
cgaucuggauggccgccag

SEQ ID NO: 1238946 - RNA, 15 nt, Mycobacterium leprae
cgaucuuccaccauu

SEQ ID NO: 1238947 - RNA, 20 nt, Mycobacterium leprae
cgaucugcccagcauuaucc

SEQ ID NO: 1238948 - RNA, 21 nt, Mycobacterium leprae
cgaucucgcauauucagaauu

SEQ ID NO: 1238949 - RNA, 14 nt, Mycobacterium leprae
cgaucuugccccgu

SEQ ID NO: 1238950 - RNA, 13 nt, Mycobacterium leprae
cgaugcagcuggu

SEQ ID NO: 1238951 - RNA, 17 nt, Mycobacterium leprae
cgaugcagggccagccc

SEQ ID NO: 1238952 - RNA, 20 nt, Mycobacterium leprae
cgaucagcaggaaucccagc

SEQ ID NO: 1238953 - RNA, 13 nt, Mycobacterium leprae
cgaucaggaggug

SEQ ID NO: 1238954 - RNA, 12 nt, Mycobacterium leprae
cgauccacuuga

SEQ ID NO: 1238955 - RNA, 15 nt, Mycobacterium leprae
cgaucgcagucauca

SEQ ID NO: 1238956 - RNA, 16 nt, Mycobacterium leprae
cgauccggcggccggc

SEQ ID NO: 1238957 - RNA, 15 nt, Mycobacterium leprae
cgauccgugaauaca

SEQ ID NO: 1238958 - RNA, 16 nt, Mycobacterium leprae
cgauccgcgugaugau

SEQ ID NO: 1238959 - RNA, 17 nt, Mycobacterium leprae
cgaucccaucggcugca

SEQ ID NO: 1238960 - RNA, 19 nt, Mycobacterium leprae
cgauccagugccggaaccc

SEQ ID NO: 1238961 - RNA, 13 nt, Mycobacterium leprae
cgauaaucaaagg

SEQ ID NO: 1238962 - RNA, 23 nt, Mycobacterium leprae
cgauaacucauaguguucgcauu

SEQ ID NO: 1238963 - RNA, 22 nt, Mycobacterium leprae
cgauaagaaguuguagcugugg

SEQ ID NO: 1238964 - RNA, 14 nt, Mycobacterium leprae
cgacguauccaagg

SEQ ID NO: 1238965 - RNA, 18 nt, Mycobacterium leprae
cgauaucgaugcaggcgu

SEQ ID NO: 1238966 - RNA, 17 nt, Mycobacterium leprae
cgaucagcaacacuggc

SEQ ID NO: 1238967 - RNA, 16 nt, Mycobacterium leprae
cgccacgaccaaaccu

SEQ ID NO: 1238968 - RNA, 17 nt, Mycobacterium leprae
cgcauccucggacugcc

SEQ ID NO: 1238969 - RNA, 14 nt, Mycobacterium leprae
cgccagguuccccg

SEQ ID NO: 1238970 - RNA, 16 nt, Mycobacterium leprae
cgccaggggaaccauc

SEQ ID NO: 1238971 - RNA, 22 nt, Mycobacterium leprae
cgccaggcgguaggaaucaccg

SEQ ID NO: 1238972 - RNA, 16 nt, Mycobacterium leprae
cgccaucgaauccucg

SEQ ID NO: 1238973 - RNA, 13 nt, Mycobacterium leprae
cgccauugccccc

SEQ ID NO: 1238974 - RNA, 13 nt, Mycobacterium leprae
cgcccaacacaag

SEQ ID NO: 1238975 - RNA, 18 nt, Mycobacterium leprae
cgcccaagugaugucuuu

SEQ ID NO: 1238976 - RNA, 19 nt, Mycobacterium leprae
cgccccuaccccgcggcgc

SEQ ID NO: 1238977 - RNA, 23 nt, Mycobacterium leprae
cgccgaucccaucggcugcaccg

SEQ ID NO: 1238978 - RNA, 18 nt, Mycobacterium leprae
cgccgacauuugggauuc

SEQ ID NO: 1238979 - RNA, 15 nt, Mycobacterium leprae
cgcgagcugaacagg

SEQ ID NO: 1238980 - RNA, 19 nt, Mycobacterium leprae
cgcgcaucaucgcccaccg

SEQ ID NO: 1238981 - RNA, 20 nt, Mycobacterium leprae
cgcgcaucaucgcccaccgc

SEQ ID NO: 1238982 - RNA, 21 nt, Mycobacterium leprae
cgcggcgaccuggucgagcag

SEQ ID NO: 1238983 - RNA, 24 nt, Mycobacterium leprae
cgcgcuccgccggcgacaacuguu

SEQ ID NO: 1238984 - RNA, 19 nt, Mycobacterium leprae
cgccucgaucagcaacacu

SEQ ID NO: 1238985 - RNA, 16 nt, Mycobacterium leprae
cgccugggaacccauu

SEQ ID NO: 1238986 - RNA, 18 nt, Mycobacterium leprae
cgccuuccaacgcggccg

SEQ ID NO: 1238987 - RNA, 20 nt, Mycobacterium leprae
cgccuucgaaccgauuuucu

SEQ ID NO: 1238988 - RNA, 22 nt, Mycobacterium leprae
cgccuucgaaccgauuuucucg

SEQ ID NO: 1238989 - RNA, 17 nt, Mycobacterium leprae
cgcgacaguaucgacca

SEQ ID NO: 1238990 - RNA, 22 nt, Mycobacterium leprae
cgcgacaguaucgaccagccac

SEQ ID NO: 1238991 - RNA, 21 nt, Mycobacterium leprae
cgcgacauacaaucgcggcac

SEQ ID NO: 1238992 - RNA, 20 nt, Mycobacterium leprae
cgcuguucgugaucgacggc

SEQ ID NO: 1238993 - RNA, 17 nt, Mycobacterium leprae
cgcugugcgcaugcacg

SEQ ID NO: 1238994 - RNA, 17 nt, Mycobacterium leprae
cgcugggacaugaagcc

SEQ ID NO: 1238995 - RNA, 22 nt, Mycobacterium leprae
cgcugauaaggucuggcaccgc

SEQ ID NO: 1238996 - RNA, 16 nt, Mycobacterium leprae
cgcugauggcacuacc

SEQ ID NO: 1238997 - RNA, 16 nt, Mycobacterium leprae
cgcugcaaggugggcg

SEQ ID NO: 1238998 - RNA, 15 nt, Mycobacterium leprae
cgcugcauccgcagc

SEQ ID NO: 1238999 - RNA, 12 nt, Mycobacterium leprae
cgcugccaaagu

SEQ ID NO: 1239000 - RNA, 18 nt, Mycobacterium leprae
cgcugccaucgacgccgu

SEQ ID NO: 1239001 - RNA, 18 nt, Mycobacterium leprae
cgcuggcacuccgaccga

SEQ ID NO: 1239002 - RNA, 16 nt, Mycobacterium leprae
cgcugcuugcucuggg

SEQ ID NO: 1239003 - RNA, 13 nt, Mycobacterium leprae
cgcugcgcgcagu

SEQ ID NO: 1239004 - RNA, 19 nt, Mycobacterium leprae
cgcugccggaguacaccaa

SEQ ID NO: 1239005 - RNA, 16 nt, Mycobacterium leprae
cgcugcccaccaguag

SEQ ID NO: 1239006 - RNA, 15 nt, Mycobacterium leprae
cgcguuggcucgacg

SEQ ID NO: 1239007 - RNA, 16 nt, Mycobacterium leprae
cgcgugcggcgcccac

SEQ ID NO: 1239008 - RNA, 21 nt, Mycobacterium leprae
cgcgggcccgucguggugugc

SEQ ID NO: 1239009 - RNA, 15 nt, Mycobacterium leprae
cgcuaggacaacaga

SEQ ID NO: 1239010 - RNA, 20 nt, Mycobacterium leprae
cgcuacggcgguguuucucg

SEQ ID NO: 1239011 - RNA, 20 nt, Mycobacterium leprae
cgcuaugaguuucggcgccu

SEQ ID NO: 1239012 - RNA, 21 nt, Mycobacterium leprae
cgcuaugccauccaccgccga

SEQ ID NO: 1239013 - RNA, 19 nt, Mycobacterium leprae
cgcuauguuggccagcagc

SEQ ID NO: 1239014 - RNA, 17 nt, Mycobacterium leprae
cgcucacccgcgccgcc

SEQ ID NO: 1239015 - RNA, 20 nt, Mycobacterium leprae
cgcucagcggccagacacca

SEQ ID NO: 1239016 - RNA, 12 nt, Mycobacterium leprae
cgcuccacaucg

SEQ ID NO: 1239017 - RNA, 17 nt, Mycobacterium leprae
cgcucgucgcgggcggu

SEQ ID NO: 1239018 - RNA, 14 nt, Mycobacterium leprae
cgcugaccagcaga

SEQ ID NO: 1239019 - RNA, 19 nt, Mycobacterium leprae
cgcugaaccgcgucggcgu

SEQ ID NO: 1239020 - RNA, 18 nt, Mycobacterium leprae
cgcucgcuuuccgcgccc

SEQ ID NO: 1239021 - RNA, 22 nt, Mycobacterium leprae
cgcucggugagauagcggcggu

SEQ ID NO: 1239022 - RNA, 18 nt, Mycobacterium leprae
cgcucuaauacagagcgu

SEQ ID NO: 1239023 - RNA, 21 nt, Mycobacterium leprae
cggcaucugguagccguucgg

SEQ ID NO: 1239024 - RNA, 16 nt, Mycobacterium leprae
cggccagccguggcuc

SEQ ID NO: 1239025 - RNA, 14 nt, Mycobacterium leprae
cggcagagcccggc

SEQ ID NO: 1239026 - RNA, 18 nt, Mycobacterium leprae
cggcacuucgcugagcga

SEQ ID NO: 1239027 - RNA, 18 nt, Mycobacterium leprae
cggcauaaucagcgucgg

SEQ ID NO: 1239028 - RNA, 22 nt, Mycobacterium leprae
cggcagugguaaucgacaggca

SEQ ID NO: 1239029 - RNA, 15 nt, Mycobacterium leprae
cggcagcuggaaagu

SEQ ID NO: 1239030 - RNA, 14 nt, Mycobacterium leprae
cggcagcugguugu

SEQ ID NO: 1239031 - RNA, 17 nt, Mycobacterium leprae
cggcaggccggccugga

SEQ ID NO: 1239032 - RNA, 14 nt, Mycobacterium leprae
cggccgccaggucc

SEQ ID NO: 1239033 - RNA, 15 nt, Mycobacterium leprae
cggccgccaggucca

SEQ ID NO: 1239034 - RNA, 15 nt, Mycobacterium leprae
cggcgcgcaggcugc

SEQ ID NO: 1239035 - RNA, 16 nt, Mycobacterium leprae
cggcgccugaacugga

SEQ ID NO: 1239036 - RNA, 23 nt, Mycobacterium leprae
cggcgccugaacuggaucgguca

SEQ ID NO: 1239037 - RNA, 20 nt, Mycobacterium leprae
cggcgccucacccaugccuc

SEQ ID NO: 1239038 - RNA, 17 nt, Mycobacterium leprae
cggcgcaguugaccgga

SEQ ID NO: 1239039 - RNA, 16 nt, Mycobacterium leprae
cggcgauauccgccgg

SEQ ID NO: 1239040 - RNA, 19 nt, Mycobacterium leprae
cggcgauauccgccggccg

SEQ ID NO: 1239041 - RNA, 21 nt, Mycobacterium leprae
cggcgauauccgccggccgca

SEQ ID NO: 1239042 - RNA, 23 nt, Mycobacterium leprae
cggcgauccucaaccagcgugca

SEQ ID NO: 1239043 - RNA, 23 nt, Mycobacterium leprae
cggcggguugggaaccggcggca

SEQ ID NO: 1239044 - RNA, 16 nt, Mycobacterium leprae
cggcggggugucuggg

SEQ ID NO: 1239045 - RNA, 16 nt, Mycobacterium leprae
cggcggcgccgauccc

SEQ ID NO: 1239046 - RNA, 23 nt, Mycobacterium leprae
uuuuuggaccccaaccagaccca

SEQ ID NO: 1239047 - RNA, 20 nt, Mycobacterium leprae
uuuucguugugccgcugcau

SEQ ID NO: 1239048 - RNA, 23 nt, Mycobacterium leprae
uuuggugaucacgguugcuucca

SEQ ID NO: 1239049 - RNA, 13 nt, Mycobacterium leprae
uuuggugcugccc

SEQ ID NO: 1239050 - RNA, 13 nt, Mycobacterium leprae
uuugggccagguc

SEQ ID NO: 1239051 - RNA, 14 nt, Mycobacterium leprae
uuuggggucuagga

SEQ ID NO: 1239052 - RNA, 21 nt, Mycobacterium leprae
uuugguuauugcucugucuac

SEQ ID NO: 1239053 - RNA, 22 nt, Mycobacterium leprae
uuuggcaguaccaaaguggauu

SEQ ID NO: 1239054 - RNA, 14 nt, Mycobacterium leprae
uuugcuaacaaggc

SEQ ID NO: 1239055 - RNA, 20 nt, Mycobacterium leprae
uuugcugucguggcugcaca

SEQ ID NO: 1239056 - RNA, 16 nt, Mycobacterium leprae
uuuuaagcgaaaauga

SEQ ID NO: 1239057 - RNA, 18 nt, Mycobacterium leprae
uuuuaagcgaaaaugaaa

SEQ ID NO: 1239058 - RNA, 20 nt, Mycobacterium leprae
uucggugacgaacaugcagu

SEQ ID NO: 1239059 - RNA, 18 nt, Mycobacterium leprae
uucgguagucgugggggg

SEQ ID NO: 1239060 - RNA, 16 nt, Mycobacterium leprae
uucugccucgucgaug

SEQ ID NO: 1239061 - RNA, 15 nt, Mycobacterium leprae
uucugccaugccagu

SEQ ID NO: 1239062 - RNA, 22 nt, Mycobacterium leprae
uucugcaugcauauauuuguau

SEQ ID NO: 1239063 - RNA, 15 nt, Mycobacterium leprae
uucuucucuaaaaag

SEQ ID NO: 1239064 - RNA, 21 nt, Mycobacterium leprae
uucugcgccggggauuucagg

SEQ ID NO: 1239065 - RNA, 23 nt, Mycobacterium leprae
uucuguauggcuccaaguggcug

SEQ ID NO: 1239066 - RNA, 15 nt, Mycobacterium leprae
uucuguugugggggu

SEQ ID NO: 1239067 - RNA, 23 nt, Mycobacterium leprae
uugaucauucgauccaaugacua

SEQ ID NO: 1239068 - RNA, 23 nt, Mycobacterium leprae
uugaucacaaauugucagcuaaa

SEQ ID NO: 1239069 - RNA, 18 nt, Mycobacterium leprae
uugcacaacauccaacca

SEQ ID NO: 1239070 - RNA, 15 nt, Mycobacterium leprae
uugcacauugggauc

SEQ ID NO: 1239071 - RNA, 18 nt, Mycobacterium leprae
uugaggugucggcguggu

SEQ ID NO: 1239072 - RNA, 17 nt, Mycobacterium leprae
uugacuacaucuagcau

SEQ ID NO: 1239073 - RNA, 20 nt, Mycobacterium leprae
uugacgugaucgcagaagcc

SEQ ID NO: 1239074 - RNA, 17 nt, Mycobacterium leprae
uugacuggcuugaagcc

SEQ ID NO: 1239075 - RNA, 16 nt, Mycobacterium leprae
uucuuuuagagaaaac

SEQ ID NO: 1239076 - RNA, 15 nt, Mycobacterium leprae
uucuugaaaaauaag

SEQ ID NO: 1239077 - RNA, 18 nt, Mycobacterium leprae
uugacaccgcagggcugu

SEQ ID NO: 1239078 - RNA, 23 nt, Mycobacterium leprae
uugacacaaagaaguaaagcccu

SEQ ID NO: 1239079 - RNA, 13 nt, Mycobacterium leprae
uugaccagacaaa

SEQ ID NO: 1239080 - RNA, 12 nt, Mycobacterium leprae
uugaccaggcaa

SEQ ID NO: 1239081 - RNA, 21 nt, Mycobacterium leprae
uugucauggccgcuucugcgu

SEQ ID NO: 1239082 - RNA, 15 nt, Mycobacterium leprae
uugucaucgacuacu

SEQ ID NO: 1239083 - RNA, 17 nt, Mycobacterium leprae
uugucagcuaaaagacg

SEQ ID NO: 1239084 - RNA, 12 nt, Mycobacterium leprae
uugucagaucuc

SEQ ID NO: 1239085 - RNA, 22 nt, Mycobacterium leprae
uugucacgccggucgaagugac

SEQ ID NO: 1239086 - RNA, 23 nt, Mycobacterium leprae
uugucaccagauuggaaaucgcu

SEQ ID NO: 1239087 - RNA, 16 nt, Mycobacterium leprae
uuguaugcgcuaaggu

SEQ ID NO: 1239088 - RNA, 15 nt, Mycobacterium leprae
uuguacuuugugugc

SEQ ID NO: 1239089 - RNA, 15 nt, Mycobacterium leprae
uugguuaaucaccuc

SEQ ID NO: 1239090 - RNA, 13 nt, Mycobacterium leprae
uugucguacccaa

SEQ ID NO: 1239091 - RNA, 14 nt, Mycobacterium leprae
uugucguacccaau

SEQ ID NO: 1239092 - RNA, 24 nt, Mycobacterium leprae
uugucuaccacauaaacauugugc

SEQ ID NO: 1239093 - RNA, 14 nt, Mycobacterium leprae
uugugccgcugcau

SEQ ID NO: 1239094 - RNA, 13 nt, Mycobacterium leprae
uugugcuccugac

SEQ ID NO: 1239095 - RNA, 23 nt, Mycobacterium leprae
uuguuguacauaccgaacucgau

SEQ ID NO: 1239096 - RNA, 19 nt, Mycobacterium leprae
uuuaaauauacuuuacuuu

SEQ ID NO: 1239097 - RNA, 15 nt, Mycobacterium leprae
uugguggguggcuga

SEQ ID NO: 1239098 - RNA, 17 nt, Mycobacterium leprae
uuggucaaggugaaacu

SEQ ID NO: 1239099 - RNA, 17 nt, Mycobacterium leprae
uuggcgaguaaaccucg

SEQ ID NO: 1239100 - RNA, 21 nt, Mycobacterium leprae
uuggcauggcgcugguuguuc

SEQ ID NO: 1239101 - RNA, 13 nt, Mycobacterium leprae
uuggaaugugcca

SEQ ID NO: 1239102 - RNA, 15 nt, Mycobacterium leprae
uuggcagugugcaug

SEQ ID NO: 1239103 - RNA, 12 nt, Mycobacterium leprae
uugcuuaacuuu

SEQ ID NO: 1239104 - RNA, 13 nt, Mycobacterium leprae
uugcauuggcuga

SEQ ID NO: 1239105 - RNA, 16 nt, Mycobacterium leprae
uugccgaauuaccauu

SEQ ID NO: 1239106 - RNA, 20 nt, Mycobacterium leprae
uugccaaggucguuagcgcc

SEQ ID NO: 1239107 - RNA, 22 nt, Mycobacterium leprae
uugccgcuccgcgcacagugug

SEQ ID NO: 1239108 - RNA, 20 nt, Mycobacterium leprae
uugcgauaauuaugaguggu

SEQ ID NO: 1239109 - RNA, 22 nt, Mycobacterium leprae
uugcgcggcguaaacguugacu

SEQ ID NO: 1239110 - RNA, 13 nt, Mycobacterium leprae
uugcucaacuacu

SEQ ID NO: 1239111 - RNA, 21 nt, Mycobacterium leprae
uuuagcuugguugacagcaga

SEQ ID NO: 1239112 - RNA, 13 nt, Mycobacterium leprae
uuuagcgacuacc

SEQ ID NO: 1239113 - RNA, 17 nt, Mycobacterium leprae
uuuagagaaaacuuaau

SEQ ID NO: 1239114 - RNA, 12 nt, Mycobacterium leprae
uuuagagauacu

SEQ ID NO: 1239115 - RNA, 12 nt, Mycobacterium leprae
uuuccaaaaccc

SEQ ID NO: 1239116 - RNA, 15 nt, Mycobacterium leprae
uuucagccacauugc

SEQ ID NO: 1239117 - RNA, 21 nt, Mycobacterium leprae
uuucacggucaacggccucac

SEQ ID NO: 1239118 - RNA, 14 nt, Mycobacterium leprae
uuugagaacagccu

SEQ ID NO: 1239119 - RNA, 13 nt, Mycobacterium leprae
uuugaggucgaca

SEQ ID NO: 1239120 - RNA, 16 nt, Mycobacterium leprae
uuugaggugcaggcac

SEQ ID NO: 1239121 - RNA, 15 nt, Mycobacterium leprae
uuugcacaacaucca

SEQ ID NO: 1239122 - RNA, 12 nt, Mycobacterium leprae
uuucgaugaggc

SEQ ID NO: 1239123 - RNA, 13 nt, Mycobacterium leprae
uuucgacauugcc

SEQ ID NO: 1239124 - RNA, 22 nt, Mycobacterium leprae
uuucgcauuauuuuuuagaucc

SEQ ID NO: 1239125 - RNA, 15 nt, Mycobacterium leprae
uuuccgcgccccuuc

SEQ ID NO: 1239126 - RNA, 21 nt, Mycobacterium leprae
uuuccgauguagcacagugga

SEQ ID NO: 1239127 - RNA, 17 nt, Mycobacterium leprae
uuucccgcuuagaugcu

SEQ ID NO: 1239128 - RNA, 18 nt, Mycobacterium leprae
uuucguguuuucaguuca

SEQ ID NO: 1239129 - RNA, 12 nt, Mycobacterium leprae
uuucgguuagug

SEQ ID NO: 1239130 - RNA, 11 nt, Mycobacterium leprae
uuucucuaaaa

SEQ ID NO: 1239131 - RNA, 12 nt, Mycobacterium leprae
uuucucuaaaag

SEQ ID NO: 1239132 - RNA, 19 nt, Mycobacterium leprae
ucauguauucguacaacgu

SEQ ID NO: 1239133 - RNA, 15 nt, Mycobacterium leprae
ucauguuccgcugau

SEQ ID NO: 1239134 - RNA, 15 nt, Mycobacterium leprae
ucauggcuugcugca

SEQ ID NO: 1239135 - RNA, 15 nt, Mycobacterium leprae
ucauucuugugucca

SEQ ID NO: 1239136 - RNA, 19 nt, Mycobacterium leprae
ucauucgauccaaugacua

SEQ ID NO: 1239137 - RNA, 21 nt, Mycobacterium leprae
ucauuauugucggucugccuu

SEQ ID NO: 1239138 - RNA, 22 nt, Mycobacterium leprae
ucauuguccaagccgagacuga

SEQ ID NO: 1239139 - RNA, 19 nt, Mycobacterium leprae
ucauuggagugguuagaca

SEQ ID NO: 1239140 - RNA, 22 nt, Mycobacterium leprae
ucaugccuggugcgcauccucg

SEQ ID NO: 1239141 - RNA, 14 nt, Mycobacterium leprae
ucaugcuagggcug

SEQ ID NO: 1239142 - RNA, 15 nt, Mycobacterium leprae
ucaugcauccuccua

SEQ ID NO: 1239143 - RNA, 12 nt, Mycobacterium leprae
ucaugccagggc

SEQ ID NO: 1239144 - RNA, 22 nt, Mycobacterium leprae
ucaugccgcuugauuugcacaa

SEQ ID NO: 1239145 - RNA, 16 nt, Mycobacterium leprae
ucaugcccaugccagc

SEQ ID NO: 1239146 - RNA, 19 nt, Mycobacterium leprae
ucaucuugggcaucggcuu

SEQ ID NO: 1239147 - RNA, 18 nt, Mycobacterium leprae
ucaucgcuucgugguuag

SEQ ID NO: 1239148 - RNA, 15 nt, Mycobacterium leprae
ucaucgcugccaucg

SEQ ID NO: 1239149 - RNA, 17 nt, Mycobacterium leprae
ucaucggcgugccuggc

SEQ ID NO: 1239150 - RNA, 17 nt, Mycobacterium leprae
ucaucggcgacugggau

SEQ ID NO: 1239151 - RNA, 23 nt, Mycobacterium leprae
ucaucuaaacugacgcugcgcug

SEQ ID NO: 1239152 - RNA, 12 nt, Mycobacterium leprae
ucaucuagagaa

SEQ ID NO: 1239153 - RNA, 20 nt, Mycobacterium leprae
ucaucuagagaaacaccuuu

SEQ ID NO: 1239154 - RNA, 14 nt, Mycobacterium leprae
ucauccacugcgaa

SEQ ID NO: 1239155 - RNA, 14 nt, Mycobacterium leprae
ucaucagcucugcc

SEQ ID NO: 1239156 - RNA, 18 nt, Mycobacterium leprae
ucaucccagaacuggucc

SEQ ID NO: 1239157 - RNA, 15 nt, Mycobacterium leprae
ucaucgaugcacugu

SEQ ID NO: 1239158 - RNA, 18 nt, Mycobacterium leprae
ucaucgaugcacuguuca

SEQ ID NO: 1239159 - RNA, 15 nt, Mycobacterium leprae
ucaucgaucagaccc

SEQ ID NO: 1239160 - RNA, 23 nt, Mycobacterium leprae
ucaucgcggcugccacuguguca

SEQ ID NO: 1239161 - RNA, 12 nt, Mycobacterium leprae
ucaucgcuaaga

SEQ ID NO: 1239162 - RNA, 16 nt, Mycobacterium leprae
ucaucgcuaagacuca

SEQ ID NO: 1239163 - RNA, 14 nt, Mycobacterium leprae
ucauaggugguggg

SEQ ID NO: 1239164 - RNA, 23 nt, Mycobacterium leprae
ucauaggcuucaucauuuucaac

SEQ ID NO: 1239165 - RNA, 14 nt, Mycobacterium leprae
ucaguuuggcgcug

SEQ ID NO: 1239166 - RNA, 16 nt, Mycobacterium leprae
ucaguuuggcgcugcu

SEQ ID NO: 1239167 - RNA, 14 nt, Mycobacterium leprae
ucagugaagaccau

SEQ ID NO: 1239168 - RNA, 18 nt, Mycobacterium leprae
ucagugagccgucuuggc

SEQ ID NO: 1239169 - RNA, 12 nt, Mycobacterium leprae
ucaguaaguccc

SEQ ID NO: 1239170 - RNA, 13 nt, Mycobacterium leprae
ucagcuggugcug

SEQ ID NO: 1239171 - RNA, 21 nt, Mycobacterium leprae
ucaggacggugaaaucaucua

SEQ ID NO: 1239172 - RNA, 19 nt, Mycobacterium leprae
ucagcgcgauguuggaacg

SEQ ID NO: 1239173 - RNA, 18 nt, Mycobacterium leprae
ucagcgcgcacagcucuc

SEQ ID NO: 1239174 - RNA, 18 nt, Mycobacterium leprae
ucagcgguaagcggaucc

SEQ ID NO: 1239175 - RNA, 14 nt, Mycobacterium leprae
ucagcgugccugag

SEQ ID NO: 1239176 - RNA, 16 nt, Mycobacterium leprae
ucagcgggggugggcu

SEQ ID NO: 1239177 - RNA, 19 nt, Mycobacterium leprae
ucaggauuuugacgccgcc

SEQ ID NO: 1239178 - RNA, 22 nt, Mycobacterium leprae
ucaggacucggauccaucagac

SEQ ID NO: 1239179 - RNA, 18 nt, Mycobacterium leprae
ucaggccuugauucucgu

SEQ ID NO: 1239180 - RNA, 13 nt, Mycobacterium leprae
ucaggcugucauc

SEQ ID NO: 1239181 - RNA, 16 nt, Mycobacterium leprae
ucaggcugucaucaga

SEQ ID NO: 1239182 - RNA, 20 nt, Mycobacterium leprae
ucaggucuacucgccugauc

SEQ ID NO: 1239183 - RNA, 21 nt, Mycobacterium leprae
ucaggucuacucgccugaucc

SEQ ID NO: 1239184 - RNA, 22 nt, Mycobacterium leprae
ucagguauuuccuaaaauucau

SEQ ID NO: 1239185 - RNA, 20 nt, Mycobacterium leprae
uccaagccgagacugaaugc

SEQ ID NO: 1239186 - RNA, 19 nt, Mycobacterium leprae
uccaauagcagaguaacca

SEQ ID NO: 1239187 - RNA, 15 nt, Mycobacterium leprae
uccaagccggucggg

SEQ ID NO: 1239188 - RNA, 13 nt, Mycobacterium leprae
uccaagcucaacc

SEQ ID NO: 1239189 - RNA, 16 nt, Mycobacterium leprae
uccacaggcagagcca

SEQ ID NO: 1239190 - RNA, 21 nt, Mycobacterium leprae
uccacaggcagagccaaacau

SEQ ID NO: 1239191 - RNA, 22 nt, Mycobacterium leprae
uccaccagccgcaggcaccauu

SEQ ID NO: 1239192 - RNA, 14 nt, Mycobacterium leprae
uccaccgaaacgca

SEQ ID NO: 1239193 - RNA, 13 nt, Mycobacterium leprae
uccaccgccaggc

SEQ ID NO: 1239194 - RNA, 15 nt, Mycobacterium leprae
uccacguuacuuaug

SEQ ID NO: 1239195 - RNA, 17 nt, Mycobacterium leprae
uccagaaucacagcuac

SEQ ID NO: 1239196 - RNA, 16 nt, Mycobacterium leprae
uccagaaggggcugcg

SEQ ID NO: 1239197 - RNA, 20 nt, Mycobacterium leprae
uccagaugccguuuucacca

SEQ ID NO: 1239198 - RNA, 18 nt, Mycobacterium leprae
uccagcgguaacuggcuc

SEQ ID NO: 1239199 - RNA, 14 nt, Mycobacterium leprae
uccagccgcgggcg

SEQ ID NO: 1239200 - RNA, 12 nt, Mycobacterium leprae
uccagccgaggg

SEQ ID NO: 1239201 - RNA, 18 nt, Mycobacterium leprae
uccagccaucacugaucc

SEQ ID NO: 1239202 - RNA, 14 nt, Mycobacterium leprae
uccagccgaacaaa

SEQ ID NO: 1239203 - RNA, 16 nt, Mycobacterium leprae
uccaguggcugcaccg

SEQ ID NO: 1239204 - RNA, 15 nt, Mycobacterium leprae
uccaguguaguguca

SEQ ID NO: 1239205 - RNA, 17 nt, Mycobacterium leprae
uccaguguagugucaau

SEQ ID NO: 1239206 - RNA, 15 nt, Mycobacterium leprae
uccaguaaguggagg

SEQ ID NO: 1239207 - RNA, 14 nt, Mycobacterium leprae
uccauccguggcga

SEQ ID NO: 1239208 - RNA, 22 nt, Mycobacterium leprae
uccauagagcauagaucuucuc

SEQ ID NO: 1239209 - RNA, 22 nt, Mycobacterium leprae
ucccaccggcggcuggugcggc

SEQ ID NO: 1239210 - RNA, 18 nt, Mycobacterium leprae
ucccacggcggcaucuca

SEQ ID NO: 1239211 - RNA, 17 nt, Mycobacterium leprae
ucccaaccgcgacgcca

SEQ ID NO: 1239212 - RNA, 20 nt, Mycobacterium leprae
ucccaaccgcgacgccaggc

SEQ ID NO: 1239213 - RNA, 21 nt, Mycobacterium leprae
ucccaaccgcgacgccaggcg

SEQ ID NO: 1239214 - RNA, 19 nt, Mycobacterium leprae
uccauucgcgauccaucag

SEQ ID NO: 1239215 - RNA, 23 nt, Mycobacterium leprae
uccaucgugaggugugaccgugc

SEQ ID NO: 1239216 - RNA, 12 nt, Mycobacterium leprae
uccaugaugguu

SEQ ID NO: 1239217 - RNA, 17 nt, Mycobacterium leprae
ucccaucggcggccagc

SEQ ID NO: 1239218 - RNA, 13 nt, Mycobacterium leprae
ucccaucggcugc

SEQ ID NO: 1239219 - RNA, 19 nt, Mycobacterium leprae
ucccaugucucuuggucga

SEQ ID NO: 1239220 - RNA, 10 nt, Mycobacterium leprae
ucccagagcu

SEQ ID NO: 1239221 - RNA, 17 nt, Mycobacterium leprae
uccccgcccaaggcucc

SEQ ID NO: 1239222 - RNA, 20 nt, Mycobacterium leprae
uccgaaacccgaaaccaagc

SEQ ID NO: 1239223 - RNA, 21 nt, Mycobacterium leprae
uccgaaacccgaaaccaagcc

SEQ ID NO: 1239224 - RNA, 16 nt, Mycobacterium leprae
uccgacaaagcagcau

SEQ ID NO: 1239225 - RNA, 15 nt, Mycobacterium leprae
uccgaugugggucug

SEQ ID NO: 1239226 - RNA, 19 nt, Mycobacterium leprae
uccgauuaagcugaucuac

SEQ ID NO: 1239227 - RNA, 18 nt, Mycobacterium leprae
uccgcaaaaugcuccccc

SEQ ID NO: 1239228 - RNA, 16 nt, Mycobacterium leprae
uccgagcuuuuccagc

SEQ ID NO: 1239229 - RNA, 16 nt, Mycobacterium leprae
ucccuugaacugcagg

SEQ ID NO: 1239230 - RNA, 22 nt, Mycobacterium leprae
ucccucagcggcauuucgcagu

SEQ ID NO: 1239231 - RNA, 16 nt, Mycobacterium leprae
ucccugauccuucuuu

SEQ ID NO: 1239232 - RNA, 16 nt, Mycobacterium leprae
ucccgggggccagcgu

SEQ ID NO: 1239233 - RNA, 18 nt, Mycobacterium leprae
ucccggugcugccugcgg

SEQ ID NO: 1239234 - RNA, 21 nt, Mycobacterium leprae
ucccgguuacguccgcggcag

SEQ ID NO: 1239235 - RNA, 15 nt, Mycobacterium leprae
ucccgcugagcaauu

SEQ ID NO: 1239236 - RNA, 17 nt, Mycobacterium leprae
uccccucgcuccaacaa

SEQ ID NO: 1239237 - RNA, 15 nt, Mycobacterium leprae
uccccggugucaccc

SEQ ID NO: 1239238 - RNA, 17 nt, Mycobacterium leprae
uccccggugucacccgg

SEQ ID NO: 1239239 - RNA, 21 nt, Mycobacterium leprae
ucccgcagccgcguccagaca

SEQ ID NO: 1239240 - RNA, 16 nt, Mycobacterium leprae
uccgucucucaggccg

SEQ ID NO: 1239241 - RNA, 19 nt, Mycobacterium leprae
uccuaccggccaaccacag

SEQ ID NO: 1239242 - RNA, 14 nt, Mycobacterium leprae
uccuccaccuuuuu

SEQ ID NO: 1239243 - RNA, 18 nt, Mycobacterium leprae
uccucaagacuucaggaa

SEQ ID NO: 1239244 - RNA, 19 nt, Mycobacterium leprae
uccuauaaaacacuucaac

SEQ ID NO: 1239245 - RNA, 22 nt, Mycobacterium leprae
uccuagggugccuugacuucuu

SEQ ID NO: 1239246 - RNA, 23 nt, Mycobacterium leprae
uccuaucgaaauacgagucgugg

SEQ ID NO: 1239247 - RNA, 15 nt, Mycobacterium leprae
uccugaauucagccg

SEQ ID NO: 1239248 - RNA, 16 nt, Mycobacterium leprae
uccucuuaacaacuug

SEQ ID NO: 1239249 - RNA, 21 nt, Mycobacterium leprae
uccucggcggcaccuccccgc

SEQ ID NO: 1239250 - RNA, 14 nt, Mycobacterium leprae
uccugguggcaacg

SEQ ID NO: 1239251 - RNA, 18 nt, Mycobacterium leprae
uccugguggcaacgcugc

SEQ ID NO: 1239252 - RNA, 21 nt, Mycobacterium leprae
uccugagaugccagccaacgg

SEQ ID NO: 1239253 - RNA, 19 nt, Mycobacterium leprae
uccgcggcggccccuuuca

SEQ ID NO: 1239254 - RNA, 21 nt, Mycobacterium leprae
uccgcggcggccccuuucacg

SEQ ID NO: 1239255 - RNA, 18 nt, Mycobacterium leprae
uccgcguaggcgcacgcu

SEQ ID NO: 1239256 - RNA, 13 nt, Mycobacterium leprae
uccgcgccggcgu

SEQ ID NO: 1239257 - RNA, 18 nt, Mycobacterium leprae
uccgcgcagggccugggg

SEQ ID NO: 1239258 - RNA, 22 nt, Mycobacterium leprae
uccggaaagaucgcccaccgca

SEQ ID NO: 1239259 - RNA, 19 nt, Mycobacterium leprae
uccgcucaaagccugcguc

SEQ ID NO: 1239260 - RNA, 19 nt, Mycobacterium leprae
uccgcagaaugugcucuga

SEQ ID NO: 1239261 - RNA, 18 nt, Mycobacterium leprae
uccggugcccuagaacaa

SEQ ID NO: 1239262 - RNA, 14 nt, Mycobacterium leprae
uccgggccagucgg

SEQ ID NO: 1239263 - RNA, 14 nt, Mycobacterium leprae
uccggacuauacuu

SEQ ID NO: 1239264 - RNA, 15 nt, Mycobacterium leprae
uccggcuaucaggau

SEQ ID NO: 1239265 - RNA, 15 nt, Mycobacterium leprae
uccggccuauuggga

SEQ ID NO: 1239266 - RNA, 20 nt, Mycobacterium leprae
ucgauggugucguguuacaa

SEQ ID NO: 1239267 - RNA, 23 nt, Mycobacterium leprae
ucgauucaccgaucgacaauguc

SEQ ID NO: 1239268 - RNA, 17 nt, Mycobacterium leprae
ucgauccgcucaaagcc

SEQ ID NO: 1239269 - RNA, 16 nt, Mycobacterium leprae
ucgaugcaggcguggg

SEQ ID NO: 1239270 - RNA, 18 nt, Mycobacterium leprae
ucgaugauuggccauugu

SEQ ID NO: 1239271 - RNA, 15 nt, Mycobacterium leprae
ucgauccaaugacua

SEQ ID NO: 1239272 - RNA, 23 nt, Mycobacterium leprae
ucgagcgcccaagugaugucuuu

SEQ ID NO: 1239273 - RNA, 19 nt, Mycobacterium leprae
ucgagcgaggagcacggcu

SEQ ID NO: 1239274 - RNA, 17 nt, Mycobacterium leprae
ucgagcgauggcugccg

SEQ ID NO: 1239275 - RNA, 21 nt, Mycobacterium leprae
ucgccacugaccuauuuuucc

SEQ ID NO: 1239276 - RNA, 20 nt, Mycobacterium leprae
ucgcaggaguaauaacugug

SEQ ID NO: 1239277 - RNA, 20 nt, Mycobacterium leprae
ucgcaugugauacugcauuc

SEQ ID NO: 1239278 - RNA, 16 nt, Mycobacterium leprae
uccuguugacguguuu

SEQ ID NO: 1239279 - RNA, 16 nt, Mycobacterium leprae
ucgacaucccagcaac

SEQ ID NO: 1239280 - RNA, 19 nt, Mycobacterium leprae
ucgacauccugaugcucua

SEQ ID NO: 1239281 - RNA, 14 nt, Mycobacterium leprae
ucgacagcagguag

SEQ ID NO: 1239282 - RNA, 16 nt, Mycobacterium leprae
ucgacauacaggacga

SEQ ID NO: 1239283 - RNA, 21 nt, Mycobacterium leprae
ucgacucgaaacgcgaagcac

SEQ ID NO: 1239284 - RNA, 22 nt, Mycobacterium leprae
ucgacuugaccuauacuggaua

SEQ ID NO: 1239285 - RNA, 20 nt, Mycobacterium leprae
ucgacuucugguugacauuu

SEQ ID NO: 1239286 - RNA, 15 nt, Mycobacterium leprae
ucgacggccgcacag

SEQ ID NO: 1239287 - RNA, 19 nt, Mycobacterium leprae
ucgacgggucacagguaaa

SEQ ID NO: 1239288 - RNA, 22 nt, Mycobacterium leprae
ucgacgguguaaugcugcugcc

SEQ ID NO: 1239289 - RNA, 15 nt, Mycobacterium leprae
ucgacggcuggcagc

SEQ ID NO: 1239290 - RNA, 17 nt, Mycobacterium leprae
ucgacgacugccgaccg

SEQ ID NO: 1239291 - RNA, 13 nt, Mycobacterium leprae
ucgagaauuuacc

SEQ ID NO: 1239292 - RNA, 19 nt, Mycobacterium leprae
ucgagaauuuaccggcguu

SEQ ID NO: 1239293 - RNA, 18 nt, Mycobacterium leprae
ucgagaagggagugcagu

SEQ ID NO: 1239294 - RNA, 17 nt, Mycobacterium leprae
ucgagcaaaccagguga

SEQ ID NO: 1239295 - RNA, 22 nt, Mycobacterium leprae
ucgagcaguaguccucugcggu

SEQ ID NO: 1239296 - RNA, 15 nt, Mycobacterium leprae
ucgcgggcuugcucc

SEQ ID NO: 1239297 - RNA, 20 nt, Mycobacterium leprae
ucgcgggacaacaccacuuc

SEQ ID NO: 1239298 - RNA, 17 nt, Mycobacterium leprae
ucgcggcugccacugug

SEQ ID NO: 1239299 - RNA, 12 nt, Mycobacterium leprae
ucgcgcgcaccc

SEQ ID NO: 1239300 - RNA, 17 nt, Mycobacterium leprae
ucgccagugccuucguc

SEQ ID NO: 1239301 - RNA, 17 nt, Mycobacterium leprae
ucgccgcccgcuggauc

SEQ ID NO: 1239302 - RNA, 16 nt, Mycobacterium leprae
ucgccgccuucuccgu

SEQ ID NO: 1239303 - RNA, 14 nt, Mycobacterium leprae
ucgccgccggcgug

SEQ ID NO: 1239304 - RNA, 17 nt, Mycobacterium leprae
ucggagaauauagccuu

SEQ ID NO: 1239305 - RNA, 22 nt, Mycobacterium leprae
ucggcaaugucaaagcccuuca

SEQ ID NO: 1239306 - RNA, 18 nt, Mycobacterium leprae
ucggcaccaaaggcgcug

SEQ ID NO: 1239307 - RNA, 15 nt, Mycobacterium leprae
ucggcagaucgaucu

SEQ ID NO: 1239308 - RNA, 16 nt, Mycobacterium leprae
ucggcagaugcccuuu

SEQ ID NO: 1239309 - RNA, 16 nt, Mycobacterium leprae
ucggcacuucgcugag

SEQ ID NO: 1239310 - RNA, 19 nt, Mycobacterium leprae
ucggaaacacagcaagcag

SEQ ID NO: 1239311 - RNA, 18 nt, Mycobacterium leprae
ucgcuuccgaugggacug

SEQ ID NO: 1239312 - RNA, 18 nt, Mycobacterium leprae
ucgcuugcuaccaguguc

SEQ ID NO: 1239313 - RNA, 11 nt, Mycobacterium leprae
ucgcucagcau

SEQ ID NO: 1239314 - RNA, 19 nt, Mycobacterium leprae
ucgcugauacaacuggaag

SEQ ID NO: 1239315 - RNA, 13 nt, Mycobacterium leprae
ucgcuaaauauua

SEQ ID NO: 1239316 - RNA, 22 nt, Mycobacterium leprae
ucgcuaaauauuaauccaguag

SEQ ID NO: 1239317 - RNA, 19 nt, Mycobacterium leprae
ucuauugcggucuugguga

SEQ ID NO: 1239318 - RNA, 20 nt, Mycobacterium leprae
ucucaacacccaagugacug

SEQ ID NO: 1239319 - RNA, 16 nt, Mycobacterium leprae
ucuccaccaccgagau

SEQ ID NO: 1239320 - RNA, 20 nt, Mycobacterium leprae
ucucagcuccgaagcagcca

SEQ ID NO: 1239321 - RNA, 20 nt, Mycobacterium leprae
ucucagccaggagaagcgcu

SEQ ID NO: 1239322 - RNA, 18 nt, Mycobacterium leprae
ucuccgugaugaacuucg

SEQ ID NO: 1239323 - RNA, 14 nt, Mycobacterium leprae
ucucccaauccugg

SEQ ID NO: 1239324 - RNA, 19 nt, Mycobacterium leprae
ucuagcccagaagcucacu

SEQ ID NO: 1239325 - RNA, 20 nt, Mycobacterium leprae
ucuaccacuuccuacuucug

SEQ ID NO: 1239326 - RNA, 15 nt, Mycobacterium leprae
ucuaccagcacccgc

SEQ ID NO: 1239327 - RNA, 21 nt, Mycobacterium leprae
ucuaccccggcauuuacgugc

SEQ ID NO: 1239328 - RNA, 17 nt, Mycobacterium leprae
ucuacccacgacaucuu

SEQ ID NO: 1239329 - RNA, 14 nt, Mycobacterium leprae
ucuacgaaaaauga

SEQ ID NO: 1239330 - RNA, 14 nt, Mycobacterium leprae
ucuacccuuuuugu

SEQ ID NO: 1239331 - RNA, 18 nt, Mycobacterium leprae
ucuacggucaggugucug

SEQ ID NO: 1239332 - RNA, 17 nt, Mycobacterium leprae
ucguugcugacugcgau

SEQ ID NO: 1239333 - RNA, 19 nt, Mycobacterium leprae
ucguuucucauucucugcc

SEQ ID NO: 1239334 - RNA, 22 nt, Mycobacterium leprae
ucguuuggguugggugggggug

SEQ ID NO: 1239335 - RNA, 22 nt, Mycobacterium leprae
ucguagaccucuucagacugga

SEQ ID NO: 1239336 - RNA, 18 nt, Mycobacterium leprae
ucguacucguauuccucg

SEQ ID NO: 1239337 - RNA, 14 nt, Mycobacterium leprae
ucgguuuccucauu

SEQ ID NO: 1239338 - RNA, 14 nt, Mycobacterium leprae
ucgguuucacagca

SEQ ID NO: 1239339 - RNA, 22 nt, Mycobacterium leprae
ucgguucgacauacaggacgau

SEQ ID NO: 1239340 - RNA, 18 nt, Mycobacterium leprae
ucggcauugccggggcug

SEQ ID NO: 1239341 - RNA, 15 nt, Mycobacterium leprae
ucggcauauccgccc

SEQ ID NO: 1239342 - RNA, 19 nt, Mycobacterium leprae
ucggcaggccggccuggaa

SEQ ID NO: 1239343 - RNA, 15 nt, Mycobacterium leprae
ucgucugaaccaggg

SEQ ID NO: 1239344 - RNA, 18 nt, Mycobacterium leprae
ucguccucaagacuucag

SEQ ID NO: 1239345 - RNA, 18 nt, Mycobacterium leprae
ucgucgaguaugucguca

SEQ ID NO: 1239346 - RNA, 13 nt, Mycobacterium leprae
ucguggagcaccu

SEQ ID NO: 1239347 - RNA, 15 nt, Mycobacterium leprae
ucguggcagaggcug

SEQ ID NO: 1239348 - RNA, 22 nt, Mycobacterium leprae
ucguggcagcuguauaacaaau

SEQ ID NO: 1239349 - RNA, 17 nt, Mycobacterium leprae
ucgugggcaacaccagc

SEQ ID NO: 1239350 - RNA, 18 nt, Mycobacterium leprae
ucgugggcaacaccagcg

SEQ ID NO: 1239351 - RNA, 22 nt, Mycobacterium leprae
ucgugggcaacaccagcgacug

SEQ ID NO: 1239352 - RNA, 14 nt, Mycobacterium leprae
ucgugugcuuugcc

SEQ ID NO: 1239353 - RNA, 20 nt, Mycobacterium leprae
ucgugcggucaaaggcuguc

SEQ ID NO: 1239354 - RNA, 15 nt, Mycobacterium leprae
ucgugcgucgucuca

SEQ ID NO: 1239355 - RNA, 21 nt, Mycobacterium leprae
ucgugcguuguugaugguguc

SEQ ID NO: 1239356 - RNA, 20 nt, Mycobacterium leprae
ucgugcaggcgcucaauguc

SEQ ID NO: 1239357 - RNA, 22 nt, Mycobacterium leprae
ucgugccgagcuggccggggcc

SEQ ID NO: 1239358 - RNA, 14 nt, Mycobacterium leprae
ucugccagggguuc

SEQ ID NO: 1239359 - RNA, 16 nt, Mycobacterium leprae
ucugccagggguucca

SEQ ID NO: 1239360 - RNA, 14 nt, Mycobacterium leprae
ucugcgaacagccg

SEQ ID NO: 1239361 - RNA, 13 nt, Mycobacterium leprae
ucugcccuugccc

SEQ ID NO: 1239362 - RNA, 21 nt, Mycobacterium leprae
ucucgcgcaggucacccuccu

SEQ ID NO: 1239363 - RNA, 20 nt, Mycobacterium leprae
ucugaacuggugagacauuu

SEQ ID NO: 1239364 - RNA, 21 nt, Mycobacterium leprae
ucugaggucaccggccaccgg

SEQ ID NO: 1239365 - RNA, 18 nt, Mycobacterium leprae
ucugugcgaaaacacuua

SEQ ID NO: 1239366 - RNA, 15 nt, Mycobacterium leprae
ucuguugugggggug

SEQ ID NO: 1239367 - RNA, 20 nt, Mycobacterium leprae
ucugguaaagccguuggcuu

SEQ ID NO: 1239368 - RNA, 15 nt, Mycobacterium leprae
ucuggguagaccgcc

SEQ ID NO: 1239369 - RNA, 23 nt, Mycobacterium leprae
ucuuguaguagcaggucgaggac

SEQ ID NO: 1239370 - RNA, 19 nt, Mycobacterium leprae
ucuugaaauucaauacuuu

SEQ ID NO: 1239371 - RNA, 12 nt, Mycobacterium leprae
ucuucucuaaaa

SEQ ID NO: 1239372 - RNA, 13 nt, Mycobacterium leprae
ucuucucuaaaaa

SEQ ID NO: 1239373 - RNA, 23 nt, Mycobacterium leprae
ucuuccuguagaugaguugugca

SEQ ID NO: 1239374 - RNA, 21 nt, Mycobacterium leprae
ucuuccaaacuuccucugcca

SEQ ID NO: 1239375 - RNA, 17 nt, Mycobacterium leprae
ucuuccuacggcuucca

SEQ ID NO: 1239376 - RNA, 17 nt, Mycobacterium leprae
ucuuccgccgcuacacu

SEQ ID NO: 1239377 - RNA, 15 nt, Mycobacterium leprae
uguacuuugugugca

SEQ ID NO: 1239378 - RNA, 13 nt, Mycobacterium leprae
uguacaacgccag

SEQ ID NO: 1239379 - RNA, 22 nt, Mycobacterium leprae
ugguucaccaaucagaucacgu

SEQ ID NO: 1239380 - RNA, 18 nt, Mycobacterium leprae
ugguuaucgauuucagcc

SEQ ID NO: 1239381 - RNA, 15 nt, Mycobacterium leprae
uguauaacaaaucau

SEQ ID NO: 1239382 - RNA, 13 nt, Mycobacterium leprae
uguaucguugcgg

SEQ ID NO: 1239383 - RNA, 13 nt, Mycobacterium leprae
uguagaccaagca

SEQ ID NO: 1239384 - RNA, 18 nt, Mycobacterium leprae
uguagaccaagcagcauc

SEQ ID NO: 1239385 - RNA, 14 nt, Mycobacterium leprae
uguagcugcgaguc

SEQ ID NO: 1239386 - RNA, 13 nt, Mycobacterium leprae
uguaguuuauuau

SEQ ID NO: 1239387 - RNA, 15 nt, Mycobacterium leprae
uggguuggguggggg

SEQ ID NO: 1239388 - RNA, 14 nt, Mycobacterium leprae
uggguuuggguggu

SEQ ID NO: 1239389 - RNA, 19 nt, Mycobacterium leprae
ugguaaagccguuggcuug

SEQ ID NO: 1239390 - RNA, 17 nt, Mycobacterium leprae
ugggugaccacccacaa

SEQ ID NO: 1239391 - RNA, 17 nt, Mycobacterium leprae
uggguggugguguugug

SEQ ID NO: 1239392 - RNA, 17 nt, Mycobacterium leprae
uggucagcaugcccaga

SEQ ID NO: 1239393 - RNA, 17 nt, Mycobacterium leprae
ugguacuugugauucag

SEQ ID NO: 1239394 - RNA, 22 nt, Mycobacterium leprae
ugguaguggcgaguggcuauga

SEQ ID NO: 1239395 - RNA, 16 nt, Mycobacterium leprae
uggugugcaguaacau

SEQ ID NO: 1239396 - RNA, 23 nt, Mycobacterium leprae
ugguggccauaccuagagaauaa

SEQ ID NO: 1239397 - RNA, 12 nt, Mycobacterium leprae
uggugauaaauu

SEQ ID NO: 1239398 - RNA, 17 nt, Mycobacterium leprae
uggugaccugacaucaa

SEQ ID NO: 1239399 - RNA, 22 nt, Mycobacterium leprae
uggugaauagcuaaagugcugc

SEQ ID NO: 1239400 - RNA, 21 nt, Mycobacterium leprae
uggucgacgguaaguuuucag

SEQ ID NO: 1239401 - RNA, 19 nt, Mycobacterium leprae
uggggcugcauugugcugc

SEQ ID NO: 1239402 - RNA, 19 nt, Mycobacterium leprae
ugggcaccugggcugugcu

SEQ ID NO: 1239403 - RNA, 18 nt, Mycobacterium leprae
ugggcacggagcggccgc

SEQ ID NO: 1239404 - RNA, 13 nt, Mycobacterium leprae
ugggcagccgagg

SEQ ID NO: 1239405 - RNA, 18 nt, Mycobacterium leprae
ugggaaaagcaggcggaa

SEQ ID NO: 1239406 - RNA, 18 nt, Mycobacterium leprae
uggcuuugggaucuuuug

SEQ ID NO: 1239407 - RNA, 22 nt, Mycobacterium leprae
uggcggcagcgccaauuccucc

SEQ ID NO: 1239408 - RNA, 14 nt, Mycobacterium leprae
uggcggaguugagc

SEQ ID NO: 1239409 - RNA, 22 nt, Mycobacterium leprae
uggcggacugaaaacagcgccu

SEQ ID NO: 1239410 - RNA, 14 nt, Mycobacterium leprae
uggcgccugccacu

SEQ ID NO: 1239411 - RNA, 14 nt, Mycobacterium leprae
uggcgagcaucugg

SEQ ID NO: 1239412 - RNA, 19 nt, Mycobacterium leprae
uggccucgaggugcaggag

SEQ ID NO: 1239413 - RNA, 17 nt, Mycobacterium leprae
uggccuaaacuccgggc

SEQ ID NO: 1239414 - RNA, 13 nt, Mycobacterium leprae
uggccuaccgggc

SEQ ID NO: 1239415 - RNA, 23 nt, Mycobacterium leprae
uggccuccgacaggucaguuuca

SEQ ID NO: 1239416 - RNA, 22 nt, Mycobacterium leprae
uggccuuaauagaccagcgugu

SEQ ID NO: 1239417 - RNA, 16 nt, Mycobacterium leprae
uggccuguucauggug

SEQ ID NO: 1239418 - RNA, 18 nt, Mycobacterium leprae
uggccuugcggacuggcu

SEQ ID NO: 1239419 - RNA, 14 nt, Mycobacterium leprae
uggccuugcuguga

SEQ ID NO: 1239420 - RNA, 21 nt, Mycobacterium leprae
uggcgaaaacccgcgcgugca

SEQ ID NO: 1239421 - RNA, 18 nt, Mycobacterium leprae
uggccgcggucgugcugc

SEQ ID NO: 1239422 - RNA, 17 nt, Mycobacterium leprae
uggccgcucuagaaauu

SEQ ID NO: 1239423 - RNA, 13 nt, Mycobacterium leprae
uggccgcuggggc

SEQ ID NO: 1239424 - RNA, 19 nt, Mycobacterium leprae
uggccggauguuuggcugu

SEQ ID NO: 1239425 - RNA, 23 nt, Mycobacterium leprae
uggccaaacuaucggugaugguc

SEQ ID NO: 1239426 - RNA, 14 nt, Mycobacterium leprae
uggccaagccgccc

SEQ ID NO: 1239427 - RNA, 16 nt, Mycobacterium leprae
uggcaucggacugaag

SEQ ID NO: 1239428 - RNA, 15 nt, Mycobacterium leprae
uggcaucggcauugc

SEQ ID NO: 1239429 - RNA, 22 nt, Mycobacterium leprae
uggccgaacgugagcgacagcu

SEQ ID NO: 1239430 - RNA, 20 nt, Mycobacterium leprae
uggcccgucgcugcuggaug

SEQ ID NO: 1239431 - RNA, 18 nt, Mycobacterium leprae
uggccgcagugaucacau

SEQ ID NO: 1239432 - RNA, 18 nt, Mycobacterium leprae
uggcccauccgggccagu

SEQ ID NO: 1239433 - RNA, 17 nt, Mycobacterium leprae
uggccccaauggcggag

SEQ ID NO: 1239434 - RNA, 21 nt, Mycobacterium leprae
uggcccggcuccgguguggag

SEQ ID NO: 1239435 - RNA, 22 nt, Mycobacterium leprae
uggcccgacggcgcggcugcuu

SEQ ID NO: 1239436 - RNA, 18 nt, Mycobacterium leprae
uggcaccagugugccagc

SEQ ID NO: 1239437 - RNA, 22 nt, Mycobacterium leprae
uggcaccgugucgucuuccgga

SEQ ID NO: 1239438 - RNA, 21 nt, Mycobacterium leprae
uggcagcaaggcuuggccagc

SEQ ID NO: 1239439 - RNA, 16 nt, Mycobacterium leprae
uggcagccgccagcgu

SEQ ID NO: 1239440 - RNA, 18 nt, Mycobacterium leprae
uggcaguccacaggacuu

SEQ ID NO: 1239441 - RNA, 18 nt, Mycobacterium leprae
uggcagucuuggcucaca

SEQ ID NO: 1239442 - RNA, 17 nt, Mycobacterium leprae
uggauccaggugcugca

SEQ ID NO: 1239443 - RNA, 14 nt, Mycobacterium leprae
uggaugcgguggug

SEQ ID NO: 1239444 - RNA, 20 nt, Mycobacterium leprae
uggauaaggucaaggcugga

SEQ ID NO: 1239445 - RNA, 16 nt, Mycobacterium leprae
uggaguuauuuggcgc

SEQ ID NO: 1239446 - RNA, 23 nt, Mycobacterium leprae
uggauacucaauugcagcgcgaa

SEQ ID NO: 1239447 - RNA, 23 nt, Mycobacterium leprae
uggagucauaccguuuacugugu

SEQ ID NO: 1239448 - RNA, 17 nt, Mycobacterium leprae
uguuucagcguggcuag

SEQ ID NO: 1239449 - RNA, 12 nt, Mycobacterium leprae
uguuugggucuu

SEQ ID NO: 1239450 - RNA, 18 nt, Mycobacterium leprae
uguuuuaccagccagacc

SEQ ID NO: 1239451 - RNA, 18 nt, Mycobacterium leprae
uguuuuaagcgaaaauga

SEQ ID NO: 1239452 - RNA, 18 nt, Mycobacterium leprae
uuaaaauaaaccggcaga

SEQ ID NO: 1239453 - RNA, 16 nt, Mycobacterium leprae
uguuuugcuguguugc

SEQ ID NO: 1239454 - RNA, 13 nt, Mycobacterium leprae
uguugguaaccag

SEQ ID NO: 1239455 - RNA, 16 nt, Mycobacterium leprae
uguugguccuugcacc

SEQ ID NO: 1239456 - RNA, 13 nt, Mycobacterium leprae
uguuggucugcuc

SEQ ID NO: 1239457 - RNA, 19 nt, Mycobacterium leprae
uguuguggugggcuggugg

SEQ ID NO: 1239458 - RNA, 17 nt, Mycobacterium leprae
uguugcuugcccugcgg

SEQ ID NO: 1239459 - RNA, 12 nt, Mycobacterium leprae
uguugcagccug

SEQ ID NO: 1239460 - RNA, 22 nt, Mycobacterium leprae
uguuccuauguuggucugcuca

SEQ ID NO: 1239461 - RNA, 13 nt, Mycobacterium leprae
uguuccgguucca

SEQ ID NO: 1239462 - RNA, 19 nt, Mycobacterium leprae
uguuauuucuggcuauugu

SEQ ID NO: 1239463 - RNA, 13 nt, Mycobacterium leprae
uguucacuaacac

SEQ ID NO: 1239464 - RNA, 16 nt, Mycobacterium leprae
ugugcgacaucuuuuc

SEQ ID NO: 1239465 - RNA, 22 nt, Mycobacterium leprae
ugugcgcugcuccguggcccaa

SEQ ID NO: 1239466 - RNA, 17 nt, Mycobacterium leprae
ugugcaugucauggccu

SEQ ID NO: 1239467 - RNA, 18 nt, Mycobacterium leprae
ugugcaggaccgugcuau

SEQ ID NO: 1239468 - RNA, 15 nt, Mycobacterium leprae
ugugaggguaguugu

SEQ ID NO: 1239469 - RNA, 14 nt, Mycobacterium leprae
ugugcaaucgaucc

SEQ ID NO: 1239470 - RNA, 20 nt, Mycobacterium leprae
ugucaccuguuucagcgugg

SEQ ID NO: 1239471 - RNA, 15 nt, Mycobacterium leprae
ugucaccagauugga

SEQ ID NO: 1239472 - RNA, 13 nt, Mycobacterium leprae
ugucagagugcag

SEQ ID NO: 1239473 - RNA, 14 nt, Mycobacterium leprae
ugucagagugcaga

SEQ ID NO: 1239474 - RNA, 23 nt, Mycobacterium leprae
ugugacagcgugccgaaguguaa

SEQ ID NO: 1239475 - RNA, 21 nt, Mycobacterium leprae
uguggccguggauaccacuga

SEQ ID NO: 1239476 - RNA, 13 nt, Mycobacterium leprae
ugugggugguuga

SEQ ID NO: 1239477 - RNA, 16 nt, Mycobacterium leprae
uguggccgcaccugaa

SEQ ID NO: 1239478 - RNA, 13 nt, Mycobacterium leprae
uguggccgcacgg

SEQ ID NO: 1239479 - RNA, 14 nt, Mycobacterium leprae
uguggccgcacggg

SEQ ID NO: 1239480 - RNA, 16 nt, Mycobacterium leprae
uguggccgcgcuggcc

SEQ ID NO: 1239481 - RNA, 17 nt, Mycobacterium leprae
uguggccgcgcuggccu

SEQ ID NO: 1239482 - RNA, 14 nt, Mycobacterium leprae
uguggcauccgcca

SEQ ID NO: 1239483 - RNA, 13 nt, Mycobacterium leprae
ugugcuccugacu

SEQ ID NO: 1239484 - RNA, 20 nt, Mycobacterium leprae
uguuaaacaguuaaagguaa

SEQ ID NO: 1239485 - RNA, 18 nt, Mycobacterium leprae
uguuaaaauaaaccggca

SEQ ID NO: 1239486 - RNA, 13 nt, Mycobacterium leprae
ugugugaccagcc

SEQ ID NO: 1239487 - RNA, 15 nt, Mycobacterium leprae
ugugucacuguuacu

SEQ ID NO: 1239488 - RNA, 18 nt, Mycobacterium leprae
uuaccacucgucuuuccg

SEQ ID NO: 1239489 - RNA, 15 nt, Mycobacterium leprae
uuacagucacuauaa

SEQ ID NO: 1239490 - RNA, 19 nt, Mycobacterium leprae
uuacaauaguaaguggcca

SEQ ID NO: 1239491 - RNA, 16 nt, Mycobacterium leprae
uuaauucuucucuaaa

SEQ ID NO: 1239492 - RNA, 19 nt, Mycobacterium leprae
uuaaugucggcgcgacugc

SEQ ID NO: 1239493 - RNA, 19 nt, Mycobacterium leprae
uuaaguggcuggcuuagga

SEQ ID NO: 1239494 - RNA, 17 nt, Mycobacterium leprae
uuaggauuucgcuaagu

SEQ ID NO: 1239495 - RNA, 14 nt, Mycobacterium leprae
uuagcgugcugugc

SEQ ID NO: 1239496 - RNA, 22 nt, Mycobacterium leprae
uuagcaugacgucuucuauacu

SEQ ID NO: 1239497 - RNA, 19 nt, Mycobacterium leprae
uuagcauagcggccgccag

SEQ ID NO: 1239498 - RNA, 23 nt, Mycobacterium leprae
uuagcaacguguaaggccagcgc

SEQ ID NO: 1239499 - RNA, 24 nt, Mycobacterium leprae
uuaccuucaggucuacucgccuga

SEQ ID NO: 1239500 - RNA, 13 nt, Mycobacterium leprae
uuagaaagcugcg

SEQ ID NO: 1239501 - RNA, 23 nt, Mycobacterium leprae
uuauacugcugcgauuccagcaa

SEQ ID NO: 1239502 - RNA, 15 nt, Mycobacterium leprae
uuagugcugcugcgg

SEQ ID NO: 1239503 - RNA, 12 nt, Mycobacterium leprae
uuagugaacagu

SEQ ID NO: 1239504 - RNA, 13 nt, Mycobacterium leprae
uuaggugugcuag

SEQ ID NO: 1239505 - RNA, 15 nt, Mycobacterium leprae
uuagggcgauucgag

SEQ ID NO: 1239506 - RNA, 22 nt, Mycobacterium leprae
uggaauccgcgcagggccuggg

SEQ ID NO: 1239507 - RNA, 20 nt, Mycobacterium leprae
uggaauaacagagugcacca

SEQ ID NO: 1239508 - RNA, 18 nt, Mycobacterium leprae
uggacaacacguuucugc

SEQ ID NO: 1239509 - RNA, 16 nt, Mycobacterium leprae
uggacaaccugggcgg

SEQ ID NO: 1239510 - RNA, 21 nt, Mycobacterium leprae
uggaccacaagcaacugcagc

SEQ ID NO: 1239511 - RNA, 21 nt, Mycobacterium leprae
uggaccgaacaggucagcggu

SEQ ID NO: 1239512 - RNA, 12 nt, Mycobacterium leprae
uggaacaaccgg

SEQ ID NO: 1239513 - RNA, 14 nt, Mycobacterium leprae
ugcuuguugccgcc

SEQ ID NO: 1239514 - RNA, 18 nt, Mycobacterium leprae
ugcuugcuauguccaaca

SEQ ID NO: 1239515 - RNA, 23 nt, Mycobacterium leprae
ugcuuccaacccguugucaagca

SEQ ID NO: 1239516 - RNA, 14 nt, Mycobacterium leprae
ugcuucgaggcauu

SEQ ID NO: 1239517 - RNA, 20 nt, Mycobacterium leprae
ugcuuaccucagugucagca

SEQ ID NO: 1239518 - RNA, 22 nt, Mycobacterium leprae
ugcugcgauuccagcaacucuc

SEQ ID NO: 1239519 - RNA, 16 nt, Mycobacterium leprae
ugcuggagggcaucaa

SEQ ID NO: 1239520 - RNA, 19 nt, Mycobacterium leprae
ugcugcgugccugguuggg

SEQ ID NO: 1239521 - RNA, 19 nt, Mycobacterium leprae
ugcugucguggcugcacaa

SEQ ID NO: 1239522 - RNA, 16 nt, Mycobacterium leprae
ugcugguggaguacug

SEQ ID NO: 1239523 - RNA, 19 nt, Mycobacterium leprae
ugcuggccguguugcugcu

SEQ ID NO: 1239524 - RNA, 20 nt, Mycobacterium leprae
ugcuggccaagaaguacagu

SEQ ID NO: 1239525 - RNA, 14 nt, Mycobacterium leprae
ugcugggucagcau

SEQ ID NO: 1239526 - RNA, 14 nt, Mycobacterium leprae
ugcgcugagcccgg

SEQ ID NO: 1239527 - RNA, 18 nt, Mycobacterium leprae
ugcgcugaggcagcagcu

SEQ ID NO: 1239528 - RNA, 18 nt, Mycobacterium leprae
ugcggauuugcagagcau

SEQ ID NO: 1239529 - RNA, 16 nt, Mycobacterium leprae
ugcgcuucuggcuggg

SEQ ID NO: 1239530 - RNA, 24 nt, Mycobacterium leprae
ugcggcggccuuggcagccgcugc

SEQ ID NO: 1239531 - RNA, 13 nt, Mycobacterium leprae
ugcggcagcugcc

SEQ ID NO: 1239532 - RNA, 21 nt, Mycobacterium leprae
ugcguacggagauagacaugu

SEQ ID NO: 1239533 - RNA, 17 nt, Mycobacterium leprae
ugcgguaaacacuucuu

SEQ ID NO: 1239534 - RNA, 16 nt, Mycobacterium leprae
ugcgggacagaagcau

SEQ ID NO: 1239535 - RNA, 15 nt, Mycobacterium leprae
ugcgucgcccucgcc

SEQ ID NO: 1239536 - RNA, 21 nt, Mycobacterium leprae
ugcgucgcugugugcgcgccg

SEQ ID NO: 1239537 - RNA, 12 nt, Mycobacterium leprae
ugcgucaaagcu

SEQ ID NO: 1239538 - RNA, 15 nt, Mycobacterium leprae
ugcguucagcgaaga

SEQ ID NO: 1239539 - RNA, 24 nt, Mycobacterium leprae
ugcguggcugcuuacucgcgccgu

SEQ ID NO: 1239540 - RNA, 12 nt, Mycobacterium leprae
ugcuaacaaggc

SEQ ID NO: 1239541 - RNA, 17 nt, Mycobacterium leprae
ugcuagacagcucggau

SEQ ID NO: 1239542 - RNA, 21 nt, Mycobacterium leprae
ugcuagcagcgcgcagaacac

SEQ ID NO: 1239543 - RNA, 17 nt, Mycobacterium leprae
ugcuauuuggugaagau

SEQ ID NO: 1239544 - RNA, 15 nt, Mycobacterium leprae
ugcucggccagagcu

SEQ ID NO: 1239545 - RNA, 22 nt, Mycobacterium leprae
ugcucggcgaagucaagaugau

SEQ ID NO: 1239546 - RNA, 19 nt, Mycobacterium leprae
ugcucuaucgaacuuuucc

SEQ ID NO: 1239547 - RNA, 12 nt, Mycobacterium leprae
ugcucucagcac

SEQ ID NO: 1239548 - RNA, 20 nt, Mycobacterium leprae
ugcugaaggcgauaucgaug

SEQ ID NO: 1239549 - RNA, 21 nt, Mycobacterium leprae
ugcucacguucauuauggggg

SEQ ID NO: 1239550 - RNA, 16 nt, Mycobacterium leprae
ugcucgcugcugcugg

SEQ ID NO: 1239551 - RNA, 15 nt, Mycobacterium leprae
ugcgaacagccgagc

SEQ ID NO: 1239552 - RNA, 23 nt, Mycobacterium leprae
ugcgaaaacacuuacaccaacau

SEQ ID NO: 1239553 - RNA, 15 nt, Mycobacterium leprae
ugcgacccgguuguc

SEQ ID NO: 1239554 - RNA, 22 nt, Mycobacterium leprae
ugcgaccgccgguuucgcccca

SEQ ID NO: 1239555 - RNA, 22 nt, Mycobacterium leprae
ugcgacauucaccaguaaccac

SEQ ID NO: 1239556 - RNA, 23 nt, Mycobacterium leprae
ugcgacaucucggucaggugcgc

SEQ ID NO: 1239557 - RNA, 22 nt, Mycobacterium leprae
ugcgaccugaacauuaguuccu

SEQ ID NO: 1239558 - RNA, 18 nt, Mycobacterium leprae
ugcgaguagucgugcuga

SEQ ID NO: 1239559 - RNA, 13 nt, Mycobacterium leprae
ugcgauuccagca

SEQ ID NO: 1239560 - RNA, 15 nt, Mycobacterium leprae
ugcgcaacuucaacu

SEQ ID NO: 1239561 - RNA, 17 nt, Mycobacterium leprae
ugcgcaccucgcugcag

SEQ ID NO: 1239562 - RNA, 19 nt, Mycobacterium leprae
ugccucaacuauccagccc

SEQ ID NO: 1239563 - RNA, 17 nt, Mycobacterium leprae
ugccuugggcacggagc

SEQ ID NO: 1239564 - RNA, 19 nt, Mycobacterium leprae
ugccggcaaccagccccuc

SEQ ID NO: 1239565 - RNA, 13 nt, Mycobacterium leprae
ugccggcgccgcu

SEQ ID NO: 1239566 - RNA, 17 nt, Mycobacterium leprae
ugccggcggcagauguu

SEQ ID NO: 1239567 - RNA, 21 nt, Mycobacterium leprae
ugccgaauucgcccgagucuc

SEQ ID NO: 1239568 - RNA, 13 nt, Mycobacterium leprae
ugccccgcuggug

SEQ ID NO: 1239569 - RNA, 20 nt, Mycobacterium leprae
ugcccagaccgaaaaccaca

SEQ ID NO: 1239570 - RNA, 21 nt, Mycobacterium leprae
ugcccagccccuggcaucauc

SEQ ID NO: 1239571 - RNA, 13 nt, Mycobacterium leprae
ugcagucgcucag

SEQ ID NO: 1239572 - RNA, 16 nt, Mycobacterium leprae
ugcaguacguguggug

SEQ ID NO: 1239573 - RNA, 17 nt, Mycobacterium leprae
ugccaacucaccgcagg

SEQ ID NO: 1239574 - RNA, 21 nt, Mycobacterium leprae
ugccaacucggccgccagguc

SEQ ID NO: 1239575 - RNA, 23 nt, Mycobacterium leprae
ugcagguugcugucguguuugug

SEQ ID NO: 1239576 - RNA, 20 nt, Mycobacterium leprae
ugcaggugacgguguuggug

SEQ ID NO: 1239577 - RNA, 23 nt, Mycobacterium leprae
ugcagguccaauucacgaacaac

SEQ ID NO: 1239578 - RNA, 16 nt, Mycobacterium leprae
ugcagguacuagcacg

SEQ ID NO: 1239579 - RNA, 16 nt, Mycobacterium leprae
ugccaaucagcacucg

SEQ ID NO: 1239580 - RNA, 20 nt, Mycobacterium leprae
ugccaccaccaccccuaccc

SEQ ID NO: 1239581 - RNA, 14 nt, Mycobacterium leprae
ugcacuugcacuau

SEQ ID NO: 1239582 - RNA, 14 nt, Mycobacterium leprae
ugcacgugauggcg

SEQ ID NO: 1239583 - RNA, 16 nt, Mycobacterium leprae
ugcacgugcaaacugc

SEQ ID NO: 1239584 - RNA, 14 nt, Mycobacterium leprae
ugcacgucggccga

SEQ ID NO: 1239585 - RNA, 20 nt, Mycobacterium leprae
ugcacggggacgugccuguu

SEQ ID NO: 1239586 - RNA, 15 nt, Mycobacterium leprae
ugcacggcgugcagg

SEQ ID NO: 1239587 - RNA, 15 nt, Mycobacterium leprae
ugcacaagcuuguuu

SEQ ID NO: 1239588 - RNA, 20 nt, Mycobacterium leprae
ugcacacggccgugcauuaa

SEQ ID NO: 1239589 - RNA, 15 nt, Mycobacterium leprae
ugcaaggucccccgc

SEQ ID NO: 1239590 - RNA, 20 nt, Mycobacterium leprae
ugcaaggucguguugccacc

SEQ ID NO: 1239591 - RNA, 22 nt, Mycobacterium leprae
ugcaaggugggcgaucaggagg

SEQ ID NO: 1239592 - RNA, 13 nt, Mycobacterium leprae
ugcagaucaccaa

SEQ ID NO: 1239593 - RNA, 14 nt, Mycobacterium leprae
ugcagaucaccaac

SEQ ID NO: 1239594 - RNA, 20 nt, Mycobacterium leprae
ugcagauguugcagcaguuc

SEQ ID NO: 1239595 - RNA, 23 nt, Mycobacterium leprae
ugcagcaucaggguacucagcug

SEQ ID NO: 1239596 - RNA, 22 nt, Mycobacterium leprae
ugcagcacaagacuucacucac

SEQ ID NO: 1239597 - RNA, 20 nt, Mycobacterium leprae
ugcagcacucauugcuguua

SEQ ID NO: 1239598 - RNA, 14 nt, Mycobacterium leprae
ugcagcagccaguc

SEQ ID NO: 1239599 - RNA, 20 nt, Mycobacterium leprae
ugcagcgaccucaugcccgg

SEQ ID NO: 1239600 - RNA, 23 nt, Mycobacterium leprae
ugcagcgaccucaugcccgggau

SEQ ID NO: 1239601 - RNA, 22 nt, Mycobacterium leprae
ugcagcuaauuuuccacaggca

SEQ ID NO: 1239602 - RNA, 21 nt, Mycobacterium leprae
ugcaggcugcauccugcagca

SEQ ID NO: 1239603 - RNA, 13 nt, Mycobacterium leprae
ugcaggaccgugc

SEQ ID NO: 1239604 - RNA, 15 nt, Mycobacterium leprae
ugcaggaggugcaga

SEQ ID NO: 1239605 - RNA, 20 nt, Mycobacterium leprae
ugaugucuuugcguaguguu

SEQ ID NO: 1239606 - RNA, 22 nt, Mycobacterium leprae
ugaugguaaccgguuuccauga

SEQ ID NO: 1239607 - RNA, 19 nt, Mycobacterium leprae
ugaugguuuggcugccaga

SEQ ID NO: 1239608 - RNA, 20 nt, Mycobacterium leprae
ugaugguugguacgcuccca

SEQ ID NO: 1239609 - RNA, 17 nt, Mycobacterium leprae
ugauggccggccuggcu

SEQ ID NO: 1239610 - RNA, 22 nt, Mycobacterium leprae
ugauggccaaagugcgaaguaa

SEQ ID NO: 1239611 - RNA, 22 nt, Mycobacterium leprae
ugauggccgaccuaccgcaucc

SEQ ID NO: 1239612 - RNA, 16 nt, Mycobacterium leprae
ugauuguguguaggug

SEQ ID NO: 1239613 - RNA, 21 nt, Mycobacterium leprae
ugauucgggacagugucuuag

SEQ ID NO: 1239614 - RNA, 18 nt, Mycobacterium leprae
ugaucgggcccagcaccc

SEQ ID NO: 1239615 - RNA, 19 nt, Mycobacterium leprae
ugaucgacgcaacugagaa

SEQ ID NO: 1239616 - RNA, 19 nt, Mycobacterium leprae
ugaucgagaagggagugca

SEQ ID NO: 1239617 - RNA, 21 nt, Mycobacterium leprae
ugaucgacaucgugugguguu

SEQ ID NO: 1239618 - RNA, 21 nt, Mycobacterium leprae
ugaucgaccgcugaaguuauc

SEQ ID NO: 1239619 - RNA, 19 nt, Mycobacterium leprae
ugaugcagcaugugugaac

SEQ ID NO: 1239620 - RNA, 18 nt, Mycobacterium leprae
ugaugccaggggcugggc

SEQ ID NO: 1239621 - RNA, 20 nt, Mycobacterium leprae
ugagugcugccagggcucga

SEQ ID NO: 1239622 - RNA, 16 nt, Mycobacterium leprae
ugagugaucugcucgg

SEQ ID NO: 1239623 - RNA, 19 nt, Mycobacterium leprae
ugauccagccgaacaaacc

SEQ ID NO: 1239624 - RNA, 17 nt, Mycobacterium leprae
ugagcgcagccaccacu

SEQ ID NO: 1239625 - RNA, 19 nt, Mycobacterium leprae
ugagcgcagccaccacucu

SEQ ID NO: 1239626 - RNA, 18 nt, Mycobacterium leprae
ugagcggcagagcccggc

SEQ ID NO: 1239627 - RNA, 19 nt, Mycobacterium leprae
ugagcggcagagcccggca

SEQ ID NO: 1239628 - RNA, 17 nt, Mycobacterium leprae
ugagcgggccagcacca

SEQ ID NO: 1239629 - RNA, 23 nt, Mycobacterium leprae
ugagcgguucaucgacaggaaac

SEQ ID NO: 1239630 - RNA, 19 nt, Mycobacterium leprae
ugagcguugugggcagcug

SEQ ID NO: 1239631 - RNA, 16 nt, Mycobacterium leprae
ugagcuuacggacuga

SEQ ID NO: 1239632 - RNA, 19 nt, Mycobacterium leprae
ugagcuuacggacugacac

SEQ ID NO: 1239633 - RNA, 21 nt, Mycobacterium leprae
ugaggauccugaccuugagga

SEQ ID NO: 1239634 - RNA, 22 nt, Mycobacterium leprae
ugaggugucggcguggucaaug

SEQ ID NO: 1239635 - RNA, 21 nt, Mycobacterium leprae
ugaggugugaccgugcagcug

SEQ ID NO: 1239636 - RNA, 21 nt, Mycobacterium leprae
ugagguuacuaucugcgugcc

SEQ ID NO: 1239637 - RNA, 16 nt, Mycobacterium leprae
ugagggccggucaaca

SEQ ID NO: 1239638 - RNA, 20 nt, Mycobacterium leprae
ugaggguguuggucuguuug

SEQ ID NO: 1239639 - RNA, 18 nt, Mycobacterium leprae
ugaggcgggucagcggcu

SEQ ID NO: 1239640 - RNA, 13 nt, Mycobacterium leprae
ugaggcucgugca

SEQ ID NO: 1239641 - RNA, 16 nt, Mycobacterium leprae
ugaggcucgugcacug

SEQ ID NO: 1239642 - RNA, 12 nt, Mycobacterium leprae
ugagaugccagc

SEQ ID NO: 1239643 - RNA, 16 nt, Mycobacterium leprae
ugagccauuuggcacc

SEQ ID NO: 1239644 - RNA, 21 nt, Mycobacterium leprae
ugagcgacagcucagcggcua

SEQ ID NO: 1239645 - RNA, 19 nt, Mycobacterium leprae
ugacugccugcuuucgaug

SEQ ID NO: 1239646 - RNA, 15 nt, Mycobacterium leprae
ugacggcacagugcu

SEQ ID NO: 1239647 - RNA, 22 nt, Mycobacterium leprae
ugagaacucaauaguguguuug

SEQ ID NO: 1239648 - RNA, 14 nt, Mycobacterium leprae
ugacgaugcagugg

SEQ ID NO: 1239649 - RNA, 19 nt, Mycobacterium leprae
ugacgacuucuucugccug

SEQ ID NO: 1239650 - RNA, 16 nt, Mycobacterium leprae
ugaccugacaucaagc

SEQ ID NO: 1239651 - RNA, 14 nt, Mycobacterium leprae
ugaccucuucaggc

SEQ ID NO: 1239652 - RNA, 21 nt, Mycobacterium leprae
ugaccucgaacuuguucuuug

SEQ ID NO: 1239653 - RNA, 22 nt, Mycobacterium leprae
ugacccaagcgccagcucagga

SEQ ID NO: 1239654 - RNA, 22 nt, Mycobacterium leprae
ugaccauugaacuacgugugcu

SEQ ID NO: 1239655 - RNA, 16 nt, Mycobacterium leprae
ugaccgucaugcugcu

SEQ ID NO: 1239656 - RNA, 18 nt, Mycobacterium leprae
ugaccggcuaccggcccg

SEQ ID NO: 1239657 - RNA, 13 nt, Mycobacterium leprae
ugacaccgaacag

SEQ ID NO: 1239658 - RNA, 15 nt, Mycobacterium leprae
ugacaccgcaguuga

SEQ ID NO: 1239659 - RNA, 16 nt, Mycobacterium leprae
ugacaccgccggcguc

SEQ ID NO: 1239660 - RNA, 20 nt, Mycobacterium leprae
ugacagcgcgaacguagucc

SEQ ID NO: 1239661 - RNA, 20 nt, Mycobacterium leprae
ugacaggcgcguuugucggc

SEQ ID NO: 1239662 - RNA, 20 nt, Mycobacterium leprae
ugacagugcugcaagcaguu

SEQ ID NO: 1239663 - RNA, 19 nt, Mycobacterium leprae
ugaauucagccgugcccaa

SEQ ID NO: 1239664 - RNA, 18 nt, Mycobacterium leprae
ugaauuguacuuugugug

SEQ ID NO: 1239665 - RNA, 23 nt, Mycobacterium leprae
gacauauuugggagccagggcag

SEQ ID NO: 1239666 - RNA, 16 nt, Mycobacterium leprae
gacaguaucgaccagc

SEQ ID NO: 1239667 - RNA, 17 nt, Mycobacterium leprae
gacaggcaaccgcccgc

SEQ ID NO: 1239668 - RNA, 20 nt, Mycobacterium leprae
gacaugccgagguggcagcu

SEQ ID NO: 1239669 - RNA, 21 nt, Mycobacterium leprae
gacaugacgcucgaggaagcg

SEQ ID NO: 1239670 - RNA, 18 nt, Mycobacterium leprae
gacaucacuggguggcac

SEQ ID NO: 1239671 - RNA, 18 nt, Mycobacterium leprae
gacaucagucagcaucgg

SEQ ID NO: 1239672 - RNA, 16 nt, Mycobacterium leprae
gacauccccgaaagga

SEQ ID NO: 1239673 - RNA, 14 nt, Mycobacterium leprae
gacauguucacagg

SEQ ID NO: 1239674 - RNA, 16 nt, Mycobacterium leprae
gacauggaagccgccg

SEQ ID NO: 1239675 - RNA, 20 nt, Mycobacterium leprae
gacauuguccgucgcagcag

SEQ ID NO: 1239676 - RNA, 17 nt, Mycobacterium leprae
gaccagcuccgaagcac

SEQ ID NO: 1239677 - RNA, 18 nt, Mycobacterium leprae
gaccagagguucuaggua

SEQ ID NO: 1239678 - RNA, 17 nt, Mycobacterium leprae
gaccagccaagccgcca

SEQ ID NO: 1239679 - RNA, 20 nt, Mycobacterium leprae
gaccaggcaaugugugccgu

SEQ ID NO: 1239680 - RNA, 13 nt, Mycobacterium leprae
gaccaacccggcg

SEQ ID NO: 1239681 - RNA, 23 nt, Mycobacterium leprae
gaccacgucgggcagcaaccgca

SEQ ID NO: 1239682 - RNA, 21 nt, Mycobacterium leprae
gaccacggcagcgucaccaag

SEQ ID NO: 1239683 - RNA, 14 nt, Mycobacterium leprae
gaccacccacaacg

SEQ ID NO: 1239684 - RNA, 22 nt, Mycobacterium leprae
gaccaccgaaccgggcagcgcc

SEQ ID NO: 1239685 - RNA, 20 nt, Mycobacterium leprae
cuuugggaucuuuugaccag

SEQ ID NO: 1239686 - RNA, 19 nt, Mycobacterium leprae
gacaaaauuuucaggcugu

SEQ ID NO: 1239687 - RNA, 14 nt, Mycobacterium leprae
gacaaagaaaaaga

SEQ ID NO: 1239688 - RNA, 21 nt, Mycobacterium leprae
gacaaagaaaaagagcccggc

SEQ ID NO: 1239689 - RNA, 18 nt, Mycobacterium leprae
gacaaagagaacuucuuc

SEQ ID NO: 1239690 - RNA, 12 nt, Mycobacterium leprae
gacaaagcucag

SEQ ID NO: 1239691 - RNA, 15 nt, Mycobacterium leprae
gacaaaccaggcgac

SEQ ID NO: 1239692 - RNA, 21 nt, Mycobacterium leprae
gacaacacgaucgcagcccag

SEQ ID NO: 1239693 - RNA, 18 nt, Mycobacterium leprae
gacaagcagugucugggc

SEQ ID NO: 1239694 - RNA, 19 nt, Mycobacterium leprae
gacaagcagugucugggcc

SEQ ID NO: 1239695 - RNA, 15 nt, Mycobacterium leprae
gacaaccugggcggc

SEQ ID NO: 1239696 - RNA, 15 nt, Mycobacterium leprae
gacaauucaacgaau

SEQ ID NO: 1239697 - RNA, 15 nt, Mycobacterium leprae
gacaagucaaaacca

SEQ ID NO: 1239698 - RNA, 13 nt, Mycobacterium leprae
gacaaguucgucu

SEQ ID NO: 1239699 - RNA, 23 nt, Mycobacterium leprae
gacagaugcgaucgcagucauca

SEQ ID NO: 1239700 - RNA, 13 nt, Mycobacterium leprae
gacagcacccagc

SEQ ID NO: 1239701 - RNA, 14 nt, Mycobacterium leprae
gacagcacccagcu

SEQ ID NO: 1239702 - RNA, 15 nt, Mycobacterium leprae
gacagaagcaagucc

SEQ ID NO: 1239703 - RNA, 14 nt, Mycobacterium leprae
gacagcagguagac

SEQ ID NO: 1239704 - RNA, 14 nt, Mycobacterium leprae
gacagcgaugacau

SEQ ID NO: 1239705 - RNA, 18 nt, Mycobacterium leprae
gacacccggguggcguca

SEQ ID NO: 1239706 - RNA, 23 nt, Mycobacterium leprae
gacaccagcgacgaaauccucac

SEQ ID NO: 1239707 - RNA, 12 nt, Mycobacterium leprae
gacacaaagaag

SEQ ID NO: 1239708 - RNA, 23 nt, Mycobacterium leprae
gacacagccgucagggcagcagg

SEQ ID NO: 1239709 - RNA, 16 nt, Mycobacterium leprae
gacacuacuguuguca

SEQ ID NO: 1239710 - RNA, 20 nt, Mycobacterium leprae
gacacuagcuccuuaaugaa

SEQ ID NO: 1239711 - RNA, 16 nt, Mycobacterium leprae
gacacguucucgcugg

SEQ ID NO: 1239712 - RNA, 21 nt, Mycobacterium leprae
gacaccucaaggccaugacau

SEQ ID NO: 1239713 - RNA, 12 nt, Mycobacterium leprae
gacacgacagcc

SEQ ID NO: 1239714 - RNA, 13 nt, Mycobacterium leprae
gacacgagcggcc

SEQ ID NO: 1239715 - RNA, 14 nt, Mycobacterium leprae
gacaccgagcagcc

SEQ ID NO: 1239716 - RNA, 12 nt, Mycobacterium leprae
gacaccgcccgg

SEQ ID NO: 1239717 - RNA, 20 nt, Mycobacterium leprae
gacgaggugacucgccggcg

SEQ ID NO: 1239718 - RNA, 15 nt, Mycobacterium leprae
gacgcaacugagaag

SEQ ID NO: 1239719 - RNA, 16 nt, Mycobacterium leprae
gacgcaacugagaagg

SEQ ID NO: 1239720 - RNA, 19 nt, Mycobacterium leprae
gacgcaaucuacuggaugc

SEQ ID NO: 1239721 - RNA, 18 nt, Mycobacterium leprae
gacgaacaugcaguacuu

SEQ ID NO: 1239722 - RNA, 18 nt, Mycobacterium leprae
gacgacgugaaacaagcc

SEQ ID NO: 1239723 - RNA, 19 nt, Mycobacterium leprae
gacgaccuccgcagcaucg

SEQ ID NO: 1239724 - RNA, 12 nt, Mycobacterium leprae
gacggcacagug

SEQ ID NO: 1239725 - RNA, 23 nt, Mycobacterium leprae
gacggauuucucgugguggcugg

SEQ ID NO: 1239726 - RNA, 18 nt, Mycobacterium leprae
gacggacaggccguagcg

SEQ ID NO: 1239727 - RNA, 23 nt, Mycobacterium leprae
gacggccaaucuuugaccagaca

SEQ ID NO: 1239728 - RNA, 11 nt, Mycobacterium leprae
gacgccaggcg

SEQ ID NO: 1239729 - RNA, 22 nt, Mycobacterium leprae
gacgccgacuaauuguggcuuc

SEQ ID NO: 1239730 - RNA, 18 nt, Mycobacterium leprae
gacgcggaaagcuucugg

SEQ ID NO: 1239731 - RNA, 13 nt, Mycobacterium leprae
gacgccggcggcc

SEQ ID NO: 1239732 - RNA, 13 nt, Mycobacterium leprae
gacgcgaccgcca

SEQ ID NO: 1239733 - RNA, 14 nt, Mycobacterium leprae
gacccacagcugcg

SEQ ID NO: 1239734 - RNA, 18 nt, Mycobacterium leprae
gacccaagcaucccccgu

SEQ ID NO: 1239735 - RNA, 16 nt, Mycobacterium leprae
gaccaucuggcgacuc

SEQ ID NO: 1239736 - RNA, 17 nt, Mycobacterium leprae
gaccaugaccagggaag

SEQ ID NO: 1239737 - RNA, 17 nt, Mycobacterium leprae
gacccagccgugguggu

SEQ ID NO: 1239738 - RNA, 19 nt, Mycobacterium leprae
gacccagcgauaucaagcu

SEQ ID NO: 1239739 - RNA, 18 nt, Mycobacterium leprae
gacccacugggcaagcag

SEQ ID NO: 1239740 - RNA, 14 nt, Mycobacterium leprae
gaccccaaccagac

SEQ ID NO: 1239741 - RNA, 18 nt, Mycobacterium leprae
gaccccaaccagacccac

SEQ ID NO: 1239742 - RNA, 13 nt, Mycobacterium leprae
gacccccgucgug

SEQ ID NO: 1239743 - RNA, 13 nt, Mycobacterium leprae
gaccgaaccccga

SEQ ID NO: 1239744 - RNA, 13 nt, Mycobacterium leprae
gaccgaccaaccg

SEQ ID NO: 1239745 - RNA, 13 nt, Mycobacterium leprae
gacccgguggugu

SEQ ID NO: 1239746 - RNA, 21 nt, Mycobacterium leprae
gacccgugcuuaccucagugu

SEQ ID NO: 1239747 - RNA, 20 nt, Mycobacterium leprae
gaccugggcgauuucuucau

SEQ ID NO: 1239748 - RNA, 20 nt, Mycobacterium leprae
gaccucuuccgccgcuacac

SEQ ID NO: 1239749 - RNA, 23 nt, Mycobacterium leprae
gaccgugcuauccgcugauaauu

SEQ ID NO: 1239750 - RNA, 18 nt, Mycobacterium leprae
gaccgucgcgcgugccac

SEQ ID NO: 1239751 - RNA, 20 nt, Mycobacterium leprae
gaccgucgcgcgugccacca

SEQ ID NO: 1239752 - RNA, 18 nt, Mycobacterium leprae
gaccuccgcuauaagugu

SEQ ID NO: 1239753 - RNA, 17 nt, Mycobacterium leprae
gaccucgaacuuguucu

SEQ ID NO: 1239754 - RNA, 17 nt, Mycobacterium leprae
gaccucggcgcuggggc

SEQ ID NO: 1239755 - RNA, 12 nt, Mycobacterium leprae
gaccgcccugga

SEQ ID NO: 1239756 - RNA, 16 nt, Mycobacterium leprae
gaccgggccggccgcg

SEQ ID NO: 1239757 - RNA, 15 nt, Mycobacterium leprae
gagaaucaggccgcc

SEQ ID NO: 1239758 - RNA, 21 nt, Mycobacterium leprae
gagaauguuguuagugcugcu

SEQ ID NO: 1239759 - RNA, 16 nt, Mycobacterium leprae
gagacaccguccucgg

SEQ ID NO: 1239760 - RNA, 15 nt, Mycobacterium leprae
gagaagaauuaauau

SEQ ID NO: 1239761 - RNA, 14 nt, Mycobacterium leprae
gagaauaauggugg

SEQ ID NO: 1239762 - RNA, 13 nt, Mycobacterium leprae
gagagcauggacc

SEQ ID NO: 1239763 - RNA, 17 nt, Mycobacterium leprae
gagagcagauggaaggc

SEQ ID NO: 1239764 - RNA, 23 nt, Mycobacterium leprae
gagagcaauccucagagugugug

SEQ ID NO: 1239765 - RNA, 12 nt, Mycobacterium leprae
gagagcgccgcu

SEQ ID NO: 1239766 - RNA, 17 nt, Mycobacterium leprae
gagacgaaugcugacca

SEQ ID NO: 1239767 - RNA, 11 nt, Mycobacterium leprae
gagacccccgu

SEQ ID NO: 1239768 - RNA, 15 nt, Mycobacterium leprae
gagacguugcuggga

SEQ ID NO: 1239769 - RNA, 19 nt, Mycobacterium leprae
gagacgguguugcugagug

SEQ ID NO: 1239770 - RNA, 14 nt, Mycobacterium leprae
gagaaauuaucguu

SEQ ID NO: 1239771 - RNA, 19 nt, Mycobacterium leprae
gacuuguacuuugugugca

SEQ ID NO: 1239772 - RNA, 15 nt, Mycobacterium leprae
gacuguguacgaagc

SEQ ID NO: 1239773 - RNA, 17 nt, Mycobacterium leprae
gacuguguacgaagccu

SEQ ID NO: 1239774 - RNA, 22 nt, Mycobacterium leprae
gacuggggaguggcaucgucug

SEQ ID NO: 1239775 - RNA, 20 nt, Mycobacterium leprae
gacuguagagacguaccacu

SEQ ID NO: 1239776 - RNA, 12 nt, Mycobacterium leprae
gacuugcgggua

SEQ ID NO: 1239777 - RNA, 22 nt, Mycobacterium leprae
gacuugcaucaggaaggagccg

SEQ ID NO: 1239778 - RNA, 14 nt, Mycobacterium leprae
gacuucuucgauua

SEQ ID NO: 1239779 - RNA, 15 nt, Mycobacterium leprae
gacuucuucugccug

SEQ ID NO: 1239780 - RNA, 15 nt, Mycobacterium leprae
gacucaacauaacac

SEQ ID NO: 1239781 - RNA, 17 nt, Mycobacterium leprae
gacucaacauaacaccc

SEQ ID NO: 1239782 - RNA, 12 nt, Mycobacterium leprae
gacuauggcucu

SEQ ID NO: 1239783 - RNA, 21 nt, Mycobacterium leprae
gacucgccgguggggauuuga

SEQ ID NO: 1239784 - RNA, 19 nt, Mycobacterium leprae
gacucggcgugccacuuca

SEQ ID NO: 1239785 - RNA, 15 nt, Mycobacterium leprae
gacucgagucccgaa

SEQ ID NO: 1239786 - RNA, 19 nt, Mycobacterium leprae
gacucagggcccagaucca

SEQ ID NO: 1239787 - RNA, 16 nt, Mycobacterium leprae
gacugcagugucuaca

SEQ ID NO: 1239788 - RNA, 15 nt, Mycobacterium leprae
gacugccugcuuucg

SEQ ID NO: 1239789 - RNA, 15 nt, Mycobacterium leprae
gacugaaaucauugc

SEQ ID NO: 1239790 - RNA, 19 nt, Mycobacterium leprae
gacugacccaagcgccagc

SEQ ID NO: 1239791 - RNA, 13 nt, Mycobacterium leprae
gacucggucugcu

SEQ ID NO: 1239792 - RNA, 14 nt, Mycobacterium leprae
gacucggucugcug

SEQ ID NO: 1239793 - RNA, 17 nt, Mycobacterium leprae
gacucuccccacugcag

SEQ ID NO: 1239794 - RNA, 14 nt, Mycobacterium leprae
gacugaaaacagcg

SEQ ID NO: 1239795 - RNA, 20 nt, Mycobacterium leprae
gacguugggagcaucuucag

SEQ ID NO: 1239796 - RNA, 16 nt, Mycobacterium leprae
gacguuccggccuucg

SEQ ID NO: 1239797 - RNA, 13 nt, Mycobacterium leprae
gacguguuuugcu

SEQ ID NO: 1239798 - RNA, 22 nt, Mycobacterium leprae
gacguguucacgcagucaucca

SEQ ID NO: 1239799 - RNA, 21 nt, Mycobacterium leprae
gacuaagccgccgaacaagcc

SEQ ID NO: 1239800 - RNA, 13 nt, Mycobacterium leprae
gacgugcuacugc

SEQ ID NO: 1239801 - RNA, 17 nt, Mycobacterium leprae
gacgugaucgcagaagc

SEQ ID NO: 1239802 - RNA, 15 nt, Mycobacterium leprae
gacgugccgcaggca

SEQ ID NO: 1239803 - RNA, 16 nt, Mycobacterium leprae
gacgugccgcaggcac

SEQ ID NO: 1239804 - RNA, 15 nt, Mycobacterium leprae
gacgguguauaauuu

SEQ ID NO: 1239805 - RNA, 18 nt, Mycobacterium leprae
gacgguuucgggaaagcu

SEQ ID NO: 1239806 - RNA, 19 nt, Mycobacterium leprae
gacgguuucacaacccggc

SEQ ID NO: 1239807 - RNA, 17 nt, Mycobacterium leprae
gacgguccugguggcaa

SEQ ID NO: 1239808 - RNA, 15 nt, Mycobacterium leprae
gacggucgcacgacc

SEQ ID NO: 1239809 - RNA, 12 nt, Mycobacterium leprae
gacggcuggcag

SEQ ID NO: 1239810 - RNA, 20 nt, Mycobacterium leprae
gacggcuaggguuggauggu

SEQ ID NO: 1239811 - RNA, 16 nt, Mycobacterium leprae
gacggcggcagcugga

SEQ ID NO: 1239812 - RNA, 22 nt, Mycobacterium leprae
gacgggcggccaggcaggaucu

SEQ ID NO: 1239813 - RNA, 15 nt, Mycobacterium leprae
gacgggaggaacucc

SEQ ID NO: 1239814 - RNA, 15 nt, Mycobacterium leprae
gaggcaaagugcggu

SEQ ID NO: 1239815 - RNA, 21 nt, Mycobacterium leprae
gaggauuugcuggcugccgcc

SEQ ID NO: 1239816 - RNA, 16 nt, Mycobacterium leprae
gaggcagggcugggga

SEQ ID NO: 1239817 - RNA, 11 nt, Mycobacterium leprae
gaggcagcagc

SEQ ID NO: 1239818 - RNA, 21 nt, Mycobacterium leprae
gaggcagcagcucgacgggcg

SEQ ID NO: 1239819 - RNA, 14 nt, Mycobacterium leprae
gaggccuugggugg

SEQ ID NO: 1239820 - RNA, 14 nt, Mycobacterium leprae
gaggccaaucgcaa

SEQ ID NO: 1239821 - RNA, 23 nt, Mycobacterium leprae
gagcuguugcuuguugccgccgg

SEQ ID NO: 1239822 - RNA, 14 nt, Mycobacterium leprae
gagcuggccggggc

SEQ ID NO: 1239823 - RNA, 14 nt, Mycobacterium leprae
gagcuggggcggcc

SEQ ID NO: 1239824 - RNA, 18 nt, Mycobacterium leprae
gaggaaugccuggguggu

SEQ ID NO: 1239825 - RNA, 18 nt, Mycobacterium leprae
gaggagaggcagggcugg

SEQ ID NO: 1239826 - RNA, 20 nt, Mycobacterium leprae
gaggaacgacuugaccagcc

SEQ ID NO: 1239827 - RNA, 22 nt, Mycobacterium leprae
gaggaacguuggcuugagugcu

SEQ ID NO: 1239828 - RNA, 21 nt, Mycobacterium leprae
gagcgcccaagugaugucuuu

SEQ ID NO: 1239829 - RNA, 17 nt, Mycobacterium leprae
gagcgcggagcugguga

SEQ ID NO: 1239830 - RNA, 21 nt, Mycobacterium leprae
gagcgucgugaccgcggggcu

SEQ ID NO: 1239831 - RNA, 18 nt, Mycobacterium leprae
gagcugaacaggcgccug

SEQ ID NO: 1239832 - RNA, 23 nt, Mycobacterium leprae
gagcugacuaugauuucaucugc

SEQ ID NO: 1239833 - RNA, 23 nt, Mycobacterium leprae
gagcugcugggccacagcaucuc

SEQ ID NO: 1239834 - RNA, 17 nt, Mycobacterium leprae
gagcugcaggucaggau

SEQ ID NO: 1239835 - RNA, 12 nt, Mycobacterium leprae
gagcuacuuuuc

SEQ ID NO: 1239836 - RNA, 23 nt, Mycobacterium leprae
gagcagcuccagcucgcgguggg

SEQ ID NO: 1239837 - RNA, 23 nt, Mycobacterium leprae
gagcagucccuuagucugcgugu

SEQ ID NO: 1239838 - RNA, 20 nt, Mycobacterium leprae
gagcauggacccacugggca

SEQ ID NO: 1239839 - RNA, 20 nt, Mycobacterium leprae
gagccacauuugacgccaau

SEQ ID NO: 1239840 - RNA, 20 nt, Mycobacterium leprae
gagcccggaaauaguggcug

SEQ ID NO: 1239841 - RNA, 22 nt, Mycobacterium leprae
gagccgcauagcgcuaaaugga

SEQ ID NO: 1239842 - RNA, 15 nt, Mycobacterium leprae
gagccgccagacugg

SEQ ID NO: 1239843 - RNA, 17 nt, Mycobacterium leprae
gagccggucggcggcgc

SEQ ID NO: 1239844 - RNA, 21 nt, Mycobacterium leprae
gagauagcggcgguaaacaga

SEQ ID NO: 1239845 - RNA, 13 nt, Mycobacterium leprae
gagauacucugaa

SEQ ID NO: 1239846 - RNA, 20 nt, Mycobacterium leprae
gagauagacaugugugcugg

SEQ ID NO: 1239847 - RNA, 18 nt, Mycobacterium leprae
gagauaaccuuugcccug

SEQ ID NO: 1239848 - RNA, 19 nt, Mycobacterium leprae
gagaguuagaugucgcagc

SEQ ID NO: 1239849 - RNA, 18 nt, Mycobacterium leprae
gagagguuuuccacugca

SEQ ID NO: 1239850 - RNA, 19 nt, Mycobacterium leprae
gagagugcagagaguuguu

SEQ ID NO: 1239851 - RNA, 18 nt, Mycobacterium leprae
gagaucacaguccugccc

SEQ ID NO: 1239852 - RNA, 20 nt, Mycobacterium leprae
gagaucaccagcaagggugg

SEQ ID NO: 1239853 - RNA, 19 nt, Mycobacterium leprae
gagaugccagccaacggcu

SEQ ID NO: 1239854 - RNA, 17 nt, Mycobacterium leprae
gagaucguccucaugcc

SEQ ID NO: 1239855 - RNA, 21 nt, Mycobacterium leprae
gagaucguccucaugcccaug

SEQ ID NO: 1239856 - RNA, 21 nt, Mycobacterium leprae
gagcaaccaacuucacuggcu

SEQ ID NO: 1239857 - RNA, 18 nt, Mycobacterium leprae
gagcaacguacugcaaug

SEQ ID NO: 1239858 - RNA, 19 nt, Mycobacterium leprae
gagcaccacacggucgugu

SEQ ID NO: 1239859 - RNA, 17 nt, Mycobacterium leprae
gagcacggcucguccau

SEQ ID NO: 1239860 - RNA, 22 nt, Mycobacterium leprae
gagcacuugcagcacucauugc

SEQ ID NO: 1239861 - RNA, 16 nt, Mycobacterium leprae
gagcagauggaaggcg

SEQ ID NO: 1239862 - RNA, 20 nt, Mycobacterium leprae
gagcagauggugcacuugca

SEQ ID NO: 1239863 - RNA, 14 nt, Mycobacterium leprae
gauaaauaguauua

SEQ ID NO: 1239864 - RNA, 21 nt, Mycobacterium leprae
gauaaauaguauuauugacau

SEQ ID NO: 1239865 - RNA, 14 nt, Mycobacterium leprae
gauaacccgugucg

SEQ ID NO: 1239866 - RNA, 20 nt, Mycobacterium leprae
gagugugaugccgaagcaga

SEQ ID NO: 1239867 - RNA, 20 nt, Mycobacterium leprae
gaguguagcaaggugcuguu

SEQ ID NO: 1239868 - RNA, 15 nt, Mycobacterium leprae
gaguugggccaugca

SEQ ID NO: 1239869 - RNA, 20 nt, Mycobacterium leprae
gaguugggccaugcagucgc

SEQ ID NO: 1239870 - RNA, 14 nt, Mycobacterium leprae
gaguuggugucugg

SEQ ID NO: 1239871 - RNA, 17 nt, Mycobacterium leprae
gagucugcgguucaggg

SEQ ID NO: 1239872 - RNA, 16 nt, Mycobacterium leprae
gagucuugaugccaac

SEQ ID NO: 1239873 - RNA, 21 nt, Mycobacterium leprae
gaguagaugcaacugagcgcg

SEQ ID NO: 1239874 - RNA, 20 nt, Mycobacterium leprae
gaguacaccaagaacuucaa

SEQ ID NO: 1239875 - RNA, 16 nt, Mycobacterium leprae
gaguaaugcaggugac

SEQ ID NO: 1239876 - RNA, 13 nt, Mycobacterium leprae
gaggucgcacagc

SEQ ID NO: 1239877 - RNA, 17 nt, Mycobacterium leprae
gaggucgcacagcaggu

SEQ ID NO: 1239878 - RNA, 22 nt, Mycobacterium leprae
gaggugcagacuuugagcuguu

SEQ ID NO: 1239879 - RNA, 21 nt, Mycobacterium leprae
gaggugcaggagcgugggucg

SEQ ID NO: 1239880 - RNA, 19 nt, Mycobacterium leprae
gagguggccuagucgggca

SEQ ID NO: 1239881 - RNA, 14 nt, Mycobacterium leprae
gaggcucugcucgg

SEQ ID NO: 1239882 - RNA, 21 nt, Mycobacterium leprae
gaggcugucuugcggcgugcu

SEQ ID NO: 1239883 - RNA, 21 nt, Mycobacterium leprae
gaggggucuggucuggcgggu

SEQ ID NO: 1239884 - RNA, 20 nt, Mycobacterium leprae
gagggucgagcuacccgccu

SEQ ID NO: 1239885 - RNA, 17 nt, Mycobacterium leprae
gauaaggucaaggcugg

SEQ ID NO: 1239886 - RNA, 14 nt, Mycobacterium leprae
gauaagcacuagaa

SEQ ID NO: 1239887 - RNA, 13 nt, Mycobacterium leprae
gauagcgacuguu

SEQ ID NO: 1239888 - RNA, 20 nt, Mycobacterium leprae
gauagcggcgguaaacagag

SEQ ID NO: 1239889 - RNA, 11 nt, Mycobacterium leprae
gauagcgcaga

SEQ ID NO: 1239890 - RNA, 19 nt, Mycobacterium leprae
gauagugguucgauucugc

SEQ ID NO: 1239891 - RNA, 15 nt, Mycobacterium leprae
gauccaggugcugca

SEQ ID NO: 1239892 - RNA, 21 nt, Mycobacterium leprae
gaucauccgcaagcgcgccga

SEQ ID NO: 1239893 - RNA, 19 nt, Mycobacterium leprae
gaucaugccuggugcgcau

SEQ ID NO: 1239894 - RNA, 13 nt, Mycobacterium leprae
gaucacgguguau

SEQ ID NO: 1239895 - RNA, 18 nt, Mycobacterium leprae
gaucaccuagaacagcau

SEQ ID NO: 1239896 - RNA, 19 nt, Mycobacterium leprae
gaucuugccccguuguggu

SEQ ID NO: 1239897 - RNA, 18 nt, Mycobacterium leprae
gaucuuaaucgagccacu

SEQ ID NO: 1239898 - RNA, 19 nt, Mycobacterium leprae
gaucugcgucgcccucgcc

SEQ ID NO: 1239899 - RNA, 22 nt, Mycobacterium leprae
gaucugcucguagcggcggcgg

SEQ ID NO: 1239900 - RNA, 17 nt, Mycobacterium leprae
gaucuuuugaccagcac

SEQ ID NO: 1239901 - RNA, 14 nt, Mycobacterium leprae
gaucgugugcacug

SEQ ID NO: 1239902 - RNA, 23 nt, Mycobacterium leprae
gaucguguuccacugucgcccga

SEQ ID NO: 1239903 - RNA, 18 nt, Mycobacterium leprae
gaucucgacggcagugau

SEQ ID NO: 1239904 - RNA, 20 nt, Mycobacterium leprae
gaugauacguucgaucacgu

SEQ ID NO: 1239905 - RNA, 12 nt, Mycobacterium leprae
gaugauuggcca

SEQ ID NO: 1239906 - RNA, 19 nt, Mycobacterium leprae
gauggccgccuucacgaau

SEQ ID NO: 1239907 - RNA, 13 nt, Mycobacterium leprae
gaugcccaucaug

SEQ ID NO: 1239908 - RNA, 13 nt, Mycobacterium leprae
gaugccuuacaau

SEQ ID NO: 1239909 - RNA, 15 nt, Mycobacterium leprae
gauuucgcaggcugu

SEQ ID NO: 1239910 - RNA, 16 nt, Mycobacterium leprae
gauuuuuguucugucc

SEQ ID NO: 1239911 - RNA, 16 nt, Mycobacterium leprae
gauuccacugccagag

SEQ ID NO: 1239912 - RNA, 17 nt, Mycobacterium leprae
gauuccagcaauuguuc

SEQ ID NO: 1239913 - RNA, 18 nt, Mycobacterium leprae
gauuccagcuuggcacgc

SEQ ID NO: 1239914 - RNA, 16 nt, Mycobacterium leprae
gauuccaaugucccac

SEQ ID NO: 1239915 - RNA, 19 nt, Mycobacterium leprae
gauucgaaggcggugauca

SEQ ID NO: 1239916 - RNA, 17 nt, Mycobacterium leprae
gauucacacuugcgaua

SEQ ID NO: 1239917 - RNA, 16 nt, Mycobacterium leprae
gauucaaaggucgaca

SEQ ID NO: 1239918 - RNA, 19 nt, Mycobacterium leprae
gauuagcuugaaggcagcg

SEQ ID NO: 1239919 - RNA, 12 nt, Mycobacterium leprae
gauggcuccccg

SEQ ID NO: 1239920 - RNA, 18 nt, Mycobacterium leprae
gaugugggucuguuaucg

SEQ ID NO: 1239921 - RNA, 23 nt, Mycobacterium leprae
gcagggcuguuuggccuccaagu

SEQ ID NO: 1239922 - RNA, 22 nt, Mycobacterium leprae
gcagguacuagcacgcugucuu

SEQ ID NO: 1239923 - RNA, 16 nt, Mycobacterium leprae
gcaggucacccuccuc

SEQ ID NO: 1239924 - RNA, 17 nt, Mycobacterium leprae
gcagguccaauucacga

SEQ ID NO: 1239925 - RNA, 21 nt, Mycobacterium leprae
gcagguccaucgagcucugag

SEQ ID NO: 1239926 - RNA, 21 nt, Mycobacterium leprae
gcagguugaggaggugcugga

SEQ ID NO: 1239927 - RNA, 11 nt, Mycobacterium leprae
gcaggugcuuu

SEQ ID NO: 1239928 - RNA, 15 nt, Mycobacterium leprae
gcaggucgaggacca

SEQ ID NO: 1239929 - RNA, 14 nt, Mycobacterium leprae
gcagugaacacgcu

SEQ ID NO: 1239930 - RNA, 21 nt, Mycobacterium leprae
gcagugaacacgcugaucgcu

SEQ ID NO: 1239931 - RNA, 19 nt, Mycobacterium leprae
gcagugucugggccgggcu

SEQ ID NO: 1239932 - RNA, 16 nt, Mycobacterium leprae
gcaguuauaaccacga

SEQ ID NO: 1239933 - RNA, 19 nt, Mycobacterium leprae
gcaguacuggugcuguguu

SEQ ID NO: 1239934 - RNA, 18 nt, Mycobacterium leprae
gcagucucgcuggcgcuu

SEQ ID NO: 1239935 - RNA, 19 nt, Mycobacterium leprae
gcagcuaauuuuccacagg

SEQ ID NO: 1239936 - RNA, 20 nt, Mycobacterium leprae
gcagcuaauuuuccacaggc

SEQ ID NO: 1239937 - RNA, 14 nt, Mycobacterium leprae
gcagcuccagcucg

SEQ ID NO: 1239938 - RNA, 12 nt, Mycobacterium leprae
gcagcuggccaa

SEQ ID NO: 1239939 - RNA, 19 nt, Mycobacterium leprae
gcagcucgggcucgcacac

SEQ ID NO: 1239940 - RNA, 16 nt, Mycobacterium leprae
gcaggaucacgugugg

SEQ ID NO: 1239941 - RNA, 22 nt, Mycobacterium leprae
gcaggauugcguugaccgccgc

SEQ ID NO: 1239942 - RNA, 16 nt, Mycobacterium leprae
gcagcaacgugcaguc

SEQ ID NO: 1239943 - RNA, 16 nt, Mycobacterium leprae
gcagaucgaucucgac

SEQ ID NO: 1239944 - RNA, 21 nt, Mycobacterium leprae
gcagccucauugaccgcauca

SEQ ID NO: 1239945 - RNA, 14 nt, Mycobacterium leprae
gcagccagucagcc

SEQ ID NO: 1239946 - RNA, 13 nt, Mycobacterium leprae
gcacuucgacggu

SEQ ID NO: 1239947 - RNA, 23 nt, Mycobacterium leprae
gcagaauauugcgacauccaaag

SEQ ID NO: 1239948 - RNA, 18 nt, Mycobacterium leprae
gcagaauuggagugaagu

SEQ ID NO: 1239949 - RNA, 14 nt, Mycobacterium leprae
gcagagcucacugg

SEQ ID NO: 1239950 - RNA, 17 nt, Mycobacterium leprae
gcagagcucacugggcu

SEQ ID NO: 1239951 - RNA, 13 nt, Mycobacterium leprae
gcagaggcaccug

SEQ ID NO: 1239952 - RNA, 15 nt, Mycobacterium leprae
gcagaggcaccugga

SEQ ID NO: 1239953 - RNA, 17 nt, Mycobacterium leprae
gcagaggacgggcggcc

SEQ ID NO: 1239954 - RNA, 20 nt, Mycobacterium leprae
gcacaucgaaccgacgaugc

SEQ ID NO: 1239955 - RNA, 15 nt, Mycobacterium leprae
gcacauucaaccagc

SEQ ID NO: 1239956 - RNA, 16 nt, Mycobacterium leprae
gcacauucaaccagcc

SEQ ID NO: 1239957 - RNA, 19 nt, Mycobacterium leprae
gcaccagugugccagcgcu

SEQ ID NO: 1239958 - RNA, 21 nt, Mycobacterium leprae
gcacagcccaguaggcaccac

SEQ ID NO: 1239959 - RNA, 17 nt, Mycobacterium leprae
gcacagguguugggcca

SEQ ID NO: 1239960 - RNA, 16 nt, Mycobacterium leprae
gcacagcucuccggcu

SEQ ID NO: 1239961 - RNA, 14 nt, Mycobacterium leprae
gcacagugccugac

SEQ ID NO: 1239962 - RNA, 14 nt, Mycobacterium leprae
gcacccgagcggca

SEQ ID NO: 1239963 - RNA, 21 nt, Mycobacterium leprae
gcacccggccacaacgcggcc

SEQ ID NO: 1239964 - RNA, 23 nt, Mycobacterium leprae
gcacccggccacaacgcggccuu

SEQ ID NO: 1239965 - RNA, 17 nt, Mycobacterium leprae
gcacccgcuugucuuug

SEQ ID NO: 1239966 - RNA, 18 nt, Mycobacterium leprae
gcaccgcgccggucgugc

SEQ ID NO: 1239967 - RNA, 16 nt, Mycobacterium leprae
gcaccgcggcggguag

SEQ ID NO: 1239968 - RNA, 14 nt, Mycobacterium leprae
gcaccugccgcagc

SEQ ID NO: 1239969 - RNA, 17 nt, Mycobacterium leprae
gcaccggcauggccgcu

SEQ ID NO: 1239970 - RNA, 15 nt, Mycobacterium leprae
gcaccgugucgucuu

SEQ ID NO: 1239971 - RNA, 23 nt, Mycobacterium leprae
gcaccuacaacuucaaccaagcc

SEQ ID NO: 1239972 - RNA, 17 nt, Mycobacterium leprae
gcacgcaaucggcuggu

SEQ ID NO: 1239973 - RNA, 18 nt, Mycobacterium leprae
gcaaccaaggcucccaag

SEQ ID NO: 1239974 - RNA, 18 nt, Mycobacterium leprae
gcaacacgcgccuuagau

SEQ ID NO: 1239975 - RNA, 15 nt, Mycobacterium leprae
gcaacagccacaccc

SEQ ID NO: 1239976 - RNA, 18 nt, Mycobacterium leprae
gcaacggcaccaaacccg

SEQ ID NO: 1239977 - RNA, 13 nt, Mycobacterium leprae
gcaacgcugcaag

SEQ ID NO: 1239978 - RNA, 17 nt, Mycobacterium leprae
gcaacgccuccacugcu

SEQ ID NO: 1239979 - RNA, 16 nt, Mycobacterium leprae
gcaacgacuguggcac

SEQ ID NO: 1239980 - RNA, 19 nt, Mycobacterium leprae
gcaaccgccggcaagcccg

SEQ ID NO: 1239981 - RNA, 14 nt, Mycobacterium leprae
gcaauacggugcac

SEQ ID NO: 1239982 - RNA, 14 nt, Mycobacterium leprae
gcaaggcuuggcca

SEQ ID NO: 1239983 - RNA, 22 nt, Mycobacterium leprae
gcaaggcuuggccagcaaguga

SEQ ID NO: 1239984 - RNA, 15 nt, Mycobacterium leprae
gcaacucgaccuauu

SEQ ID NO: 1239985 - RNA, 16 nt, Mycobacterium leprae
gcaacucaucggcucc

SEQ ID NO: 1239986 - RNA, 17 nt, Mycobacterium leprae
gcaacgguuacugccac

SEQ ID NO: 1239987 - RNA, 18 nt, Mycobacterium leprae
gcaacguguaaggccagc

SEQ ID NO: 1239988 - RNA, 15 nt, Mycobacterium leprae
gcaagcugcccggcg

SEQ ID NO: 1239989 - RNA, 16 nt, Mycobacterium leprae
gcaagaccgaguuggg

SEQ ID NO: 1239990 - RNA, 13 nt, Mycobacterium leprae
gcggcagcggcgg

SEQ ID NO: 1239991 - RNA, 21 nt, Mycobacterium leprae
gcgcuggugcuuggcagcccu

SEQ ID NO: 1239992 - RNA, 20 nt, Mycobacterium leprae
gcgcugugauuggcugcugg

SEQ ID NO: 1239993 - RNA, 16 nt, Mycobacterium leprae
gcggcagaaauggugc

SEQ ID NO: 1239994 - RNA, 11 nt, Mycobacterium leprae
gcggccgcagc

SEQ ID NO: 1239995 - RNA, 15 nt, Mycobacterium leprae
gcggccgcccaggug

SEQ ID NO: 1239996 - RNA, 23 nt, Mycobacterium leprae
gcggccgcccaggugucuuccag

SEQ ID NO: 1239997 - RNA, 19 nt, Mycobacterium leprae
gcggcgaucaugguggugu

SEQ ID NO: 1239998 - RNA, 15 nt, Mycobacterium leprae
gcggcgaugaccgga

SEQ ID NO: 1239999 - RNA, 22 nt, Mycobacterium leprae
gcgguguccaaaugcgguggcu

SEQ ID NO: 1240000 - RNA, 17 nt, Mycobacterium leprae
gcgguguguugcagugu

SEQ ID NO: 1240001 - RNA, 17 nt, Mycobacterium leprae
gcgguguugcgcggcgc

SEQ ID NO: 1240002 - RNA, 17 nt, Mycobacterium leprae
gcggugugcgucggaug

SEQ ID NO: 1240003 - RNA, 19 nt, Mycobacterium leprae
gcguaaucgcuuggugcug

SEQ ID NO: 1240004 - RNA, 14 nt, Mycobacterium leprae
gcggugggugcaca

SEQ ID NO: 1240005 - RNA, 19 nt, Mycobacterium leprae
gcggugggcuuccagcaga

SEQ ID NO: 1240006 - RNA, 22 nt, Mycobacterium leprae
gcggucgucaagugcgcaccgg

SEQ ID NO: 1240007 - RNA, 18 nt, Mycobacterium leprae
gcgguggcagccgccagc

SEQ ID NO: 1240008 - RNA, 18 nt, Mycobacterium leprae
gcggugcugagucggcgc

SEQ ID NO: 1240009 - RNA, 18 nt, Mycobacterium leprae
gcggucacagagcugugu

SEQ ID NO: 1240010 - RNA, 19 nt, Mycobacterium leprae
gcgggugguguacucgcga

SEQ ID NO: 1240011 - RNA, 22 nt, Mycobacterium leprae
gcggguugacuuuaacgacauc

SEQ ID NO: 1240012 - RNA, 14 nt, Mycobacterium leprae
gcgguauccauccg

SEQ ID NO: 1240013 - RNA, 17 nt, Mycobacterium leprae
gcgguauugacguggug

SEQ ID NO: 1240014 - RNA, 17 nt, Mycobacterium leprae
gcggguuucccagagcu

SEQ ID NO: 1240015 - RNA, 16 nt, Mycobacterium leprae
gcggcuucgucaagcu

SEQ ID NO: 1240016 - RNA, 20 nt, Mycobacterium leprae
gcgggaugaugauugccgcc

SEQ ID NO: 1240017 - RNA, 22 nt, Mycobacterium leprae
gcgggaugaugauugccgccgg

SEQ ID NO: 1240018 - RNA, 17 nt, Mycobacterium leprae
gcggcggccgugauuuu

SEQ ID NO: 1240019 - RNA, 14 nt, Mycobacterium leprae
gcggcggcggccag

SEQ ID NO: 1240020 - RNA, 21 nt, Mycobacterium leprae
gcgggcuugcuccgaggaacg

SEQ ID NO: 1240021 - RNA, 17 nt, Mycobacterium leprae
gcggggcuaugccgcgc

SEQ ID NO: 1240022 - RNA, 18 nt, Mycobacterium leprae
gcggggcuaugccgcgcg

SEQ ID NO: 1240023 - RNA, 20 nt, Mycobacterium leprae
gcgggcuugaccuggaugcc

SEQ ID NO: 1240024 - RNA, 23 nt, Mycobacterium leprae
gcgggccaacuaggauagaucca

SEQ ID NO: 1240025 - RNA, 16 nt, Mycobacterium leprae
gcucagugaagugcuc

SEQ ID NO: 1240026 - RNA, 21 nt, Mycobacterium leprae
gcucagugaucagguggagca

SEQ ID NO: 1240027 - RNA, 17 nt, Mycobacterium leprae
gcuccaaguggcugcua

SEQ ID NO: 1240028 - RNA, 14 nt, Mycobacterium leprae
gcucacugugucuu

SEQ ID NO: 1240029 - RNA, 19 nt, Mycobacterium leprae
gcucaggacgaacgcuggc

SEQ ID NO: 1240030 - RNA, 18 nt, Mycobacterium leprae
gcucacccgcagcaccuu

SEQ ID NO: 1240031 - RNA, 13 nt, Mycobacterium leprae
gcucaccgcggcc

SEQ ID NO: 1240032 - RNA, 17 nt, Mycobacterium leprae
gcucaccggcggcgagc

SEQ ID NO: 1240033 - RNA, 12 nt, Mycobacterium leprae
gcuagcugucca

SEQ ID NO: 1240034 - RNA, 17 nt, Mycobacterium leprae
gcuaggacaacagagca

SEQ ID NO: 1240035 - RNA, 22 nt, Mycobacterium leprae
gcuacugcgaucgcaaauauaa

SEQ ID NO: 1240036 - RNA, 15 nt, Mycobacterium leprae
gcucaaucagcgacu

SEQ ID NO: 1240037 - RNA, 21 nt, Mycobacterium leprae
gcuccgaagcaccagcagugg

SEQ ID NO: 1240038 - RNA, 16 nt, Mycobacterium leprae
gcuccauagaacaccg

SEQ ID NO: 1240039 - RNA, 21 nt, Mycobacterium leprae
gcuccgaucucaucuaugcug

SEQ ID NO: 1240040 - RNA, 22 nt, Mycobacterium leprae
gcuccgcagcaccugccgcagc

SEQ ID NO: 1240041 - RNA, 12 nt, Mycobacterium leprae
gcuccuccagca

SEQ ID NO: 1240042 - RNA, 17 nt, Mycobacterium leprae
gcucgauggccagccgu

SEQ ID NO: 1240043 - RNA, 20 nt, Mycobacterium leprae
gcucgauucucgagcggcgc

SEQ ID NO: 1240044 - RNA, 14 nt, Mycobacterium leprae
gcucgacagcaggu

SEQ ID NO: 1240045 - RNA, 18 nt, Mycobacterium leprae
gcucgcacacaacgccga

SEQ ID NO: 1240046 - RNA, 13 nt, Mycobacterium leprae
gcucgcggugggc

SEQ ID NO: 1240047 - RNA, 17 nt, Mycobacterium leprae
gcucgcuuuccgcgccc

SEQ ID NO: 1240048 - RNA, 18 nt, Mycobacterium leprae
gcucgcuuugcuggcaag

SEQ ID NO: 1240049 - RNA, 23 nt, Mycobacterium leprae
gcucggacaagaucgaggccagc

SEQ ID NO: 1240050 - RNA, 18 nt, Mycobacterium leprae
gcucggcgaagucaagau

SEQ ID NO: 1240051 - RNA, 17 nt, Mycobacterium leprae
gcuaaauggacaaaugg

SEQ ID NO: 1240052 - RNA, 15 nt, Mycobacterium leprae
gcuaaccgauccggu

SEQ ID NO: 1240053 - RNA, 22 nt, Mycobacterium leprae
gcuaaggugcguugugcgguga

SEQ ID NO: 1240054 - RNA, 14 nt, Mycobacterium leprae
gcuaaguccggccu

SEQ ID NO: 1240055 - RNA, 18 nt, Mycobacterium leprae
gcuaaguccuccaguugu

SEQ ID NO: 1240056 - RNA, 17 nt, Mycobacterium leprae
gcuacaacaaaguuaua

SEQ ID NO: 1240057 - RNA, 21 nt, Mycobacterium leprae
gcuacggcaaccgcaacaaug

SEQ ID NO: 1240058 - RNA, 17 nt, Mycobacterium leprae
gcuacgccaggguaccc

SEQ ID NO: 1240059 - RNA, 22 nt, Mycobacterium leprae
gcuaccucgacucgucagccuu

SEQ ID NO: 1240060 - RNA, 16 nt, Mycobacterium leprae
gcuacccacugguggu

SEQ ID NO: 1240061 - RNA, 18 nt, Mycobacterium leprae
gcguaugaccgcggucgg

SEQ ID NO: 1240062 - RNA, 19 nt, Mycobacterium leprae
gcgugcugucgugcccaga

SEQ ID NO: 1240063 - RNA, 24 nt, Mycobacterium leprae
gcguuaccggcgucuggcuggccu

SEQ ID NO: 1240064 - RNA, 17 nt, Mycobacterium leprae
gcguggucaauguggcc

SEQ ID NO: 1240065 - RNA, 16 nt, Mycobacterium leprae
gcguucgauaagaagu

SEQ ID NO: 1240066 - RNA, 15 nt, Mycobacterium leprae
gcguucaauaagaaa

SEQ ID NO: 1240067 - RNA, 20 nt, Mycobacterium leprae
gcguugauggccgaggaguc

SEQ ID NO: 1240068 - RNA, 16 nt, Mycobacterium leprae
gcgccauuucgacggc

SEQ ID NO: 1240069 - RNA, 20 nt, Mycobacterium leprae
gcgcccaagugaugucuuug

SEQ ID NO: 1240070 - RNA, 17 nt, Mycobacterium leprae
gcgccaggggaaccauc

SEQ ID NO: 1240071 - RNA, 22 nt, Mycobacterium leprae
gcgccagccuuucacgccaggc

SEQ ID NO: 1240072 - RNA, 23 nt, Mycobacterium leprae
gcgccguggaggugcggcuggcu

SEQ ID NO: 1240073 - RNA, 15 nt, Mycobacterium leprae
gcgccgcccagcagu

SEQ ID NO: 1240074 - RNA, 21 nt, Mycobacterium leprae
gcgccgaucccaucggcugca

SEQ ID NO: 1240075 - RNA, 19 nt, Mycobacterium leprae
gcgccgaagccgggcgagc

SEQ ID NO: 1240076 - RNA, 22 nt, Mycobacterium leprae
gcgcucaacuaguacgcccccc

SEQ ID NO: 1240077 - RNA, 12 nt, Mycobacterium leprae
gcgcuaggacaa

SEQ ID NO: 1240078 - RNA, 16 nt, Mycobacterium leprae
gcgcuauacuugcugc

SEQ ID NO: 1240079 - RNA, 15 nt, Mycobacterium leprae
gcgcuaugccaucca

SEQ ID NO: 1240080 - RNA, 17 nt, Mycobacterium leprae
gcgcucgucgcgggcgg

SEQ ID NO: 1240081 - RNA, 12 nt, Mycobacterium leprae
gcgcgagaugug

SEQ ID NO: 1240082 - RNA, 23 nt, Mycobacterium leprae
gcgcgacaguaucgaccagccac

SEQ ID NO: 1240083 - RNA, 13 nt, Mycobacterium leprae
gcgauugccacca

SEQ ID NO: 1240084 - RNA, 16 nt, Mycobacterium leprae
gcgauugccaccacca

SEQ ID NO: 1240085 - RNA, 20 nt, Mycobacterium leprae
gcgauuccagcaacucucaa

SEQ ID NO: 1240086 - RNA, 22 nt, Mycobacterium leprae
gcgcaacacccaggucggugga

SEQ ID NO: 1240087 - RNA, 19 nt, Mycobacterium leprae
gcgcagcaauugacgccga

SEQ ID NO: 1240088 - RNA, 22 nt, Mycobacterium leprae
gcgcagcaauugacgccgaccg

SEQ ID NO: 1240089 - RNA, 18 nt, Mycobacterium leprae
gcgacgaucugugacacu

SEQ ID NO: 1240090 - RNA, 15 nt, Mycobacterium leprae
gcgacgaccuccucg

SEQ ID NO: 1240091 - RNA, 20 nt, Mycobacterium leprae
gcgaggcguccguuuuucac

SEQ ID NO: 1240092 - RNA, 19 nt, Mycobacterium leprae
gcgagcccagugugucggc

SEQ ID NO: 1240093 - RNA, 24 nt, Mycobacterium leprae
gcgagcaaauugccgagcugguag

SEQ ID NO: 1240094 - RNA, 15 nt, Mycobacterium leprae
gcgaggaccaccugg

SEQ ID NO: 1240095 - RNA, 16 nt, Mycobacterium leprae
gcgaugaaauccgcag

SEQ ID NO: 1240096 - RNA, 18 nt, Mycobacterium leprae
gccuuuuguacuuguuga

SEQ ID NO: 1240097 - RNA, 22 nt, Mycobacterium leprae
gcgaaaacacuuacaccaacau

SEQ ID NO: 1240098 - RNA, 17 nt, Mycobacterium leprae
gcgaaguccuugcuggu

SEQ ID NO: 1240099 - RNA, 20 nt, Mycobacterium leprae
gcgaagucgacgccgcggcu

SEQ ID NO: 1240100 - RNA, 12 nt, Mycobacterium leprae
gcgaagugagac

SEQ ID NO: 1240101 - RNA, 17 nt, Mycobacterium leprae
gcgacacagccggccgg

SEQ ID NO: 1240102 - RNA, 16 nt, Mycobacterium leprae
gcgacacggcugucac

SEQ ID NO: 1240103 - RNA, 15 nt, Mycobacterium leprae
gcgaccugaacauua

SEQ ID NO: 1240104 - RNA, 18 nt, Mycobacterium leprae
gcgaccuggucgagcagc

SEQ ID NO: 1240105 - RNA, 15 nt, Mycobacterium leprae
gcgacacuugccgcg

SEQ ID NO: 1240106 - RNA, 21 nt, Mycobacterium leprae
gccuguuguugugccuucugc

SEQ ID NO: 1240107 - RNA, 21 nt, Mycobacterium leprae
gccuuggugcuuaacgccgcc

SEQ ID NO: 1240108 - RNA, 22 nt, Mycobacterium leprae
gccuuggugcuuaacgccgccu

SEQ ID NO: 1240109 - RNA, 11 nt, Mycobacterium leprae
gccuugccgcu

SEQ ID NO: 1240110 - RNA, 20 nt, Mycobacterium leprae
gccuugcggacuggcugucc

SEQ ID NO: 1240111 - RNA, 18 nt, Mycobacterium leprae
gccuucuccguucacagu

SEQ ID NO: 1240112 - RNA, 13 nt, Mycobacterium leprae
gccuucugcaccc

SEQ ID NO: 1240113 - RNA, 14 nt, Mycobacterium leprae
gccuggacgguuuc

SEQ ID NO: 1240114 - RNA, 15 nt, Mycobacterium leprae
gccuggaaacgggug

SEQ ID NO: 1240115 - RNA, 18 nt, Mycobacterium leprae
gccugcuuccaauagcag

SEQ ID NO: 1240116 - RNA, 21 nt, Mycobacterium leprae
gccuguucaggugcggccaca

SEQ ID NO: 1240117 - RNA, 24 nt, Mycobacterium leprae
gccuggcgucaucgacaucccagc

SEQ ID NO: 1240118 - RNA, 21 nt, Mycobacterium leprae
gccuggguguucauggcgcgc

SEQ ID NO: 1240119 - RNA, 17 nt, Mycobacterium leprae
gccugcaucgcagcgau

SEQ ID NO: 1240120 - RNA, 12 nt, Mycobacterium leprae
gccuagacugac

SEQ ID NO: 1240121 - RNA, 18 nt, Mycobacterium leprae
gccucacaguaggccagc

SEQ ID NO: 1240122 - RNA, 23 nt, Mycobacterium leprae
gccucacaguaggccagcccggc

SEQ ID NO: 1240123 - RNA, 14 nt, Mycobacterium leprae
gccguugaccuggg

SEQ ID NO: 1240124 - RNA, 20 nt, Mycobacterium leprae
gccgggguauaguacagacc

SEQ ID NO: 1240125 - RNA, 20 nt, Mycobacterium leprae
gccgucgggaccgggcgcgc

SEQ ID NO: 1240126 - RNA, 17 nt, Mycobacterium leprae
gccgugcccgcagagga

SEQ ID NO: 1240127 - RNA, 16 nt, Mycobacterium leprae
gccucaguuaucccac

SEQ ID NO: 1240128 - RNA, 22 nt, Mycobacterium leprae
gccucaccugcgacagccgugc

SEQ ID NO: 1240129 - RNA, 14 nt, Mycobacterium leprae
gccucauugaccgc

SEQ ID NO: 1240130 - RNA, 14 nt, Mycobacterium leprae
gccuccacugcucc

SEQ ID NO: 1240131 - RNA, 21 nt, Mycobacterium leprae
gccuccgaaaagcugagccga

SEQ ID NO: 1240132 - RNA, 23 nt, Mycobacterium leprae
gccuccgaaaagcugagccgaca

SEQ ID NO: 1240133 - RNA, 23 nt, Mycobacterium leprae
gccucgaucagcaacacuggcga

SEQ ID NO: 1240134 - RNA, 14 nt, Mycobacterium leprae
gccucgaugugcuu

SEQ ID NO: 1240135 - RNA, 17 nt, Mycobacterium leprae
gccucgucggccagcac

SEQ ID NO: 1240136 - RNA, 18 nt, Mycobacterium leprae
gccucgucggccagcacu

SEQ ID NO: 1240137 - RNA, 20 nt, Mycobacterium leprae
gccucgucggccagcacuug

SEQ ID NO: 1240138 - RNA, 22 nt, Mycobacterium leprae
gccggaaaccuucgauuccagc

SEQ ID NO: 1240139 - RNA, 15 nt, Mycobacterium leprae
gccggacggcaccua

SEQ ID NO: 1240140 - RNA, 13 nt, Mycobacterium leprae
gccggaacagcau

SEQ ID NO: 1240141 - RNA, 16 nt, Mycobacterium leprae
gccggaacagcauccu

SEQ ID NO: 1240142 - RNA, 15 nt, Mycobacterium leprae
gccgcgggugcaguu

SEQ ID NO: 1240143 - RNA, 23 nt, Mycobacterium leprae
gccgcggguaaccuugccggccu

SEQ ID NO: 1240144 - RNA, 24 nt, Mycobacterium leprae
gccgcggguaaccuugccggccuu

SEQ ID NO: 1240145 - RNA, 21 nt, Mycobacterium leprae
gccgcuacacugcagcgguca

SEQ ID NO: 1240146 - RNA, 17 nt, Mycobacterium leprae
gccgcuacucgucaaga

SEQ ID NO: 1240147 - RNA, 13 nt, Mycobacterium leprae
gccggcuuggggu

SEQ ID NO: 1240148 - RNA, 20 nt, Mycobacterium leprae
gccggcucgcggggaugcug

SEQ ID NO: 1240149 - RNA, 16 nt, Mycobacterium leprae
gccggcucgcauccgc

SEQ ID NO: 1240150 - RNA, 15 nt, Mycobacterium leprae
gccggcggccaccgc

SEQ ID NO: 1240151 - RNA, 16 nt, Mycobacterium leprae
gccggccuggcuggug

SEQ ID NO: 1240152 - RNA, 15 nt, Mycobacterium leprae
gccggccggcaagcu

SEQ ID NO: 1240153 - RNA, 16 nt, Mycobacterium leprae
gccggccccugagcaa

SEQ ID NO: 1240154 - RNA, 16 nt, Mycobacterium leprae
gccgcacccggcagca

SEQ ID NO: 1240155 - RNA, 17 nt, Mycobacterium leprae
gcccugggugaccagga

SEQ ID NO: 1240156 - RNA, 19 nt, Mycobacterium leprae
gccgauacccaucacgucc

SEQ ID NO: 1240157 - RNA, 17 nt, Mycobacterium leprae
gccgaucucggcgcgcu

SEQ ID NO: 1240158 - RNA, 21 nt, Mycobacterium leprae
gccgaucuccgacuggcugcc

SEQ ID NO: 1240159 - RNA, 14 nt, Mycobacterium leprae
gccgcagcgcggcc

SEQ ID NO: 1240160 - RNA, 16 nt, Mycobacterium leprae
gccgcagcaucugucg

SEQ ID NO: 1240161 - RNA, 17 nt, Mycobacterium leprae
gccgccguccacugcag

SEQ ID NO: 1240162 - RNA, 15 nt, Mycobacterium leprae
gccgcgaccgccaga

SEQ ID NO: 1240163 - RNA, 15 nt, Mycobacterium leprae
gccgccagguccacc

SEQ ID NO: 1240164 - RNA, 17 nt, Mycobacterium leprae
gccgccagguuccccgg

SEQ ID NO: 1240165 - RNA, 13 nt, Mycobacterium leprae
gccgccauugccc

SEQ ID NO: 1240166 - RNA, 23 nt, Mycobacterium leprae
gccaccgguagcggucuggcgcu

SEQ ID NO: 1240167 - RNA, 17 nt, Mycobacterium leprae
gcauagaucuucucgac

SEQ ID NO: 1240168 - RNA, 23 nt, Mycobacterium leprae
gccaccacucucaucgcggcugc

SEQ ID NO: 1240169 - RNA, 13 nt, Mycobacterium leprae
gccacuaaacauu

SEQ ID NO: 1240170 - RNA, 22 nt, Mycobacterium leprae
gccacuaauuagaggccaaaga

SEQ ID NO: 1240171 - RNA, 14 nt, Mycobacterium leprae
gccacggccccgga

SEQ ID NO: 1240172 - RNA, 17 nt, Mycobacterium leprae
gccacggccccggaugc

SEQ ID NO: 1240173 - RNA, 13 nt, Mycobacterium leprae
gccagaccaacau

SEQ ID NO: 1240174 - RNA, 19 nt, Mycobacterium leprae
gccagaauggaguuggugu

SEQ ID NO: 1240175 - RNA, 17 nt, Mycobacterium leprae
gccagauccagcaucau

SEQ ID NO: 1240176 - RNA, 18 nt, Mycobacterium leprae
gccaucgggccagagcug

SEQ ID NO: 1240177 - RNA, 20 nt, Mycobacterium leprae
gccauccaccgccgagcgca

SEQ ID NO: 1240178 - RNA, 14 nt, Mycobacterium leprae
gccaguaccuccag

SEQ ID NO: 1240179 - RNA, 12 nt, Mycobacterium leprae
gccagguccacc

SEQ ID NO: 1240180 - RNA, 14 nt, Mycobacterium leprae
gccagguagugagu

SEQ ID NO: 1240181 - RNA, 19 nt, Mycobacterium leprae
gccagcuuucgcacccagc

SEQ ID NO: 1240182 - RNA, 16 nt, Mycobacterium leprae
gccaggcagcgccugc

SEQ ID NO: 1240183 - RNA, 20 nt, Mycobacterium leprae
gccaggcagcugugcacgug

SEQ ID NO: 1240184 - RNA, 11 nt, Mycobacterium leprae
gccaggcagga

SEQ ID NO: 1240185 - RNA, 21 nt, Mycobacterium leprae
gccagcucgucccaugucucu

SEQ ID NO: 1240186 - RNA, 16 nt, Mycobacterium leprae
gccagcgcaucagcca

SEQ ID NO: 1240187 - RNA, 17 nt, Mycobacterium leprae
gccagcgaucuaccucg

SEQ ID NO: 1240188 - RNA, 20 nt, Mycobacterium leprae
gccagcgaucuaccucgcca

SEQ ID NO: 1240189 - RNA, 14 nt, Mycobacterium leprae
gccccaucucaucu

SEQ ID NO: 1240190 - RNA, 20 nt, Mycobacterium leprae
gccccgcaucuucgcccagc

SEQ ID NO: 1240191 - RNA, 21 nt, Mycobacterium leprae
gcccaugcuuaaggcagaacu

SEQ ID NO: 1240192 - RNA, 14 nt, Mycobacterium leprae
gcccagcagauggc

SEQ ID NO: 1240193 - RNA, 15 nt, Mycobacterium leprae
gcccagcacgcgcga

SEQ ID NO: 1240194 - RNA, 20 nt, Mycobacterium leprae
gcccagauugcaguccacca

SEQ ID NO: 1240195 - RNA, 16 nt, Mycobacterium leprae
gcccauccgggccagu

SEQ ID NO: 1240196 - RNA, 23 nt, Mycobacterium leprae
gcccaggugcuggcugcgccggc

SEQ ID NO: 1240197 - RNA, 18 nt, Mycobacterium leprae
gcccuccuuuucgccggc

SEQ ID NO: 1240198 - RNA, 22 nt, Mycobacterium leprae
gcccucguugacgcccuccugg

SEQ ID NO: 1240199 - RNA, 23 nt, Mycobacterium leprae
gcccucguugacgcccuccuggc

SEQ ID NO: 1240200 - RNA, 15 nt, Mycobacterium leprae
gcccugaagcugagu

SEQ ID NO: 1240201 - RNA, 23 nt, Mycobacterium leprae
gcccggcgugcaggauucacccg

SEQ ID NO: 1240202 - RNA, 17 nt, Mycobacterium leprae
gccccggacccgagccg

SEQ ID NO: 1240203 - RNA, 12 nt, Mycobacterium leprae
gccccggccgcc

SEQ ID NO: 1240204 - RNA, 16 nt, Mycobacterium leprae
uagaacauccgcagca

SEQ ID NO: 1240205 - RNA, 16 nt, Mycobacterium leprae
uagaacaagugcaaug

SEQ ID NO: 1240206 - RNA, 17 nt, Mycobacterium leprae
uagaacacguucuugcc

SEQ ID NO: 1240207 - RNA, 11 nt, Mycobacterium leprae
uagaacaaacg

SEQ ID NO: 1240208 - RNA, 15 nt, Mycobacterium leprae
uagagcugcgacaac

SEQ ID NO: 1240209 - RNA, 17 nt, Mycobacterium leprae
uagagagguuuuccacu

SEQ ID NO: 1240210 - RNA, 11 nt, Mycobacterium leprae
uagagugcagc

SEQ ID NO: 1240211 - RNA, 12 nt, Mycobacterium leprae
uagagugcagca

SEQ ID NO: 1240212 - RNA, 12 nt, Mycobacterium leprae
uagacgugcaca

SEQ ID NO: 1240213 - RNA, 20 nt, Mycobacterium leprae
uagacgggaggaagauaucc

SEQ ID NO: 1240214 - RNA, 14 nt, Mycobacterium leprae
uagacgcucggcca

SEQ ID NO: 1240215 - RNA, 16 nt, Mycobacterium leprae
uagacuaugaagacca

SEQ ID NO: 1240216 - RNA, 16 nt, Mycobacterium leprae
uagagaagaauuaaua

SEQ ID NO: 1240217 - RNA, 17 nt, Mycobacterium leprae
uagagaagaauuaauau

SEQ ID NO: 1240218 - RNA, 17 nt, Mycobacterium leprae
uagagaaaaaugcugca

SEQ ID NO: 1240219 - RNA, 17 nt, Mycobacterium leprae
uagagaaaacuuaauau

SEQ ID NO: 1240220 - RNA, 14 nt, Mycobacterium leprae
uagaccaagcagca

SEQ ID NO: 1240221 - RNA, 15 nt, Mycobacterium leprae
uagaccaugagcaca

SEQ ID NO: 1240222 - RNA, 22 nt, Mycobacterium leprae
uaggggcguuuuagugugcaug

SEQ ID NO: 1240223 - RNA, 20 nt, Mycobacterium leprae
uagggugauagauggagcca

SEQ ID NO: 1240224 - RNA, 16 nt, Mycobacterium leprae
uaggguguugugggug

SEQ ID NO: 1240225 - RNA, 15 nt, Mycobacterium leprae
uaggcggauggggca

SEQ ID NO: 1240226 - RNA, 17 nt, Mycobacterium leprae
uagggagaaugccacag

SEQ ID NO: 1240227 - RNA, 17 nt, Mycobacterium leprae
uagcugcaucggcaggc

SEQ ID NO: 1240228 - RNA, 20 nt, Mycobacterium leprae
uagcugauuuggccgccauc

SEQ ID NO: 1240229 - RNA, 19 nt, Mycobacterium leprae
uaggaaacauuguucugcc

SEQ ID NO: 1240230 - RNA, 18 nt, Mycobacterium leprae
uagcgauucgggagagga

SEQ ID NO: 1240231 - RNA, 12 nt, Mycobacterium leprae
uagcguggguuc

SEQ ID NO: 1240232 - RNA, 14 nt, Mycobacterium leprae
uagcuaaagugcug

SEQ ID NO: 1240233 - RNA, 16 nt, Mycobacterium leprae
uagcguucguagagcu

SEQ ID NO: 1240234 - RNA, 13 nt, Mycobacterium leprae
uagcaguguggca

SEQ ID NO: 1240235 - RNA, 13 nt, Mycobacterium leprae
uagcauaacauuu

SEQ ID NO: 1240236 - RNA, 16 nt, Mycobacterium leprae
uagcaaguuguuaaga

SEQ ID NO: 1240237 - RNA, 18 nt, Mycobacterium leprae
uagcaauaaccagggccg

SEQ ID NO: 1240238 - RNA, 13 nt, Mycobacterium leprae
uagccgcuugccu

SEQ ID NO: 1240239 - RNA, 17 nt, Mycobacterium leprae
uagccgcuugccucaac

SEQ ID NO: 1240240 - RNA, 13 nt, Mycobacterium leprae
uaucugcaacuca

SEQ ID NO: 1240241 - RNA, 12 nt, Mycobacterium leprae
uaucgaugcagg

SEQ ID NO: 1240242 - RNA, 14 nt, Mycobacterium leprae
uaucgaugccgugg

SEQ ID NO: 1240243 - RNA, 24 nt, Mycobacterium leprae
uaucgcaggaucggguagcugcau

SEQ ID NO: 1240244 - RNA, 19 nt, Mycobacterium leprae
uauccaguguagugucaau

SEQ ID NO: 1240245 - RNA, 13 nt, Mycobacterium leprae
uaucaugcauccu

SEQ ID NO: 1240246 - RNA, 21 nt, Mycobacterium leprae
uauccaguaaguggaggugau

SEQ ID NO: 1240247 - RNA, 15 nt, Mycobacterium leprae
uauauauauauuaau

SEQ ID NO: 1240248 - RNA, 20 nt, Mycobacterium leprae
uauauuaaccguagucacua

SEQ ID NO: 1240249 - RNA, 22 nt, Mycobacterium leprae
uauauuaaccguagucacuaua

SEQ ID NO: 1240250 - RNA, 17 nt, Mycobacterium leprae
uaucagcgcgcacagcu

SEQ ID NO: 1240251 - RNA, 21 nt, Mycobacterium leprae
uauacugcuaucgcccaggug

SEQ ID NO: 1240252 - RNA, 19 nt, Mycobacterium leprae
uauagcaacagcaagcgag

SEQ ID NO: 1240253 - RNA, 15 nt, Mycobacterium leprae
uauagcacacgaccg

SEQ ID NO: 1240254 - RNA, 14 nt, Mycobacterium leprae
uaguuacugaaucu

SEQ ID NO: 1240255 - RNA, 15 nt, Mycobacterium leprae
uaguuauaccgugca

SEQ ID NO: 1240256 - RNA, 18 nt, Mycobacterium leprae
uaguuauaccgugcacgg

SEQ ID NO: 1240257 - RNA, 13 nt, Mycobacterium leprae
uaguguguuuggu

SEQ ID NO: 1240258 - RNA, 19 nt, Mycobacterium leprae
uagugguucgauucugccc

SEQ ID NO: 1240259 - RNA, 18 nt, Mycobacterium leprae
uaguuauugauggaguuu

SEQ ID NO: 1240260 - RNA, 14 nt, Mycobacterium leprae
uacgguuaauauac

SEQ ID NO: 1240261 - RNA, 20 nt, Mycobacterium leprae
uacgguuaccgucgggccug

SEQ ID NO: 1240262 - RNA, 22 nt, Mycobacterium leprae
uacgccaaacagauccugcuca

SEQ ID NO: 1240263 - RNA, 14 nt, Mycobacterium leprae
uaccugggccaggg

SEQ ID NO: 1240264 - RNA, 18 nt, Mycobacterium leprae
uaccaguugcuugucuuc

SEQ ID NO: 1240265 - RNA, 22 nt, Mycobacterium leprae
uaccauccauuuauuccagagc

SEQ ID NO: 1240266 - RNA, 16 nt, Mycobacterium leprae
uacccaggccuguugc

SEQ ID NO: 1240267 - RNA, 15 nt, Mycobacterium leprae
uacccgcgagcagcg

SEQ ID NO: 1240268 - RNA, 20 nt, Mycobacterium leprae
uaccucagugucagcagcag

SEQ ID NO: 1240269 - RNA, 13 nt, Mycobacterium leprae
uaccugagucggc

SEQ ID NO: 1240270 - RNA, 17 nt, Mycobacterium leprae
uaccgaaguccaccgga

SEQ ID NO: 1240271 - RNA, 20 nt, Mycobacterium leprae
uaccggcguucaauaagaaa

SEQ ID NO: 1240272 - RNA, 15 nt, Mycobacterium leprae
uacauucaggugcua

SEQ ID NO: 1240273 - RNA, 23 nt, Mycobacterium leprae
uacaugcuggcaguggcaacuga

SEQ ID NO: 1240274 - RNA, 21 nt, Mycobacterium leprae
uacaacggaccacuauuucaa

SEQ ID NO: 1240275 - RNA, 14 nt, Mycobacterium leprae
uacaacguugcugc

SEQ ID NO: 1240276 - RNA, 16 nt, Mycobacterium leprae
uacaaucccaccaccc

SEQ ID NO: 1240277 - RNA, 22 nt, Mycobacterium leprae
uacaaagucugcuuccaaguaa

SEQ ID NO: 1240278 - RNA, 15 nt, Mycobacterium leprae
uacaacaaaguuaua

SEQ ID NO: 1240279 - RNA, 23 nt, Mycobacterium leprae
uacagccgaggguacucggaagg

SEQ ID NO: 1240280 - RNA, 18 nt, Mycobacterium leprae
uaaucaaagguuaucgau

SEQ ID NO: 1240281 - RNA, 14 nt, Mycobacterium leprae
uaauuccugcagcc

SEQ ID NO: 1240282 - RNA, 14 nt, Mycobacterium leprae
uaauucuucucuaa

SEQ ID NO: 1240283 - RNA, 16 nt, Mycobacterium leprae
uaaggagucgcacugg

SEQ ID NO: 1240284 - RNA, 18 nt, Mycobacterium leprae
uaaggccaggauggugcc

SEQ ID NO: 1240285 - RNA, 14 nt, Mycobacterium leprae
uaaguuuucucuaa

SEQ ID NO: 1240286 - RNA, 13 nt, Mycobacterium leprae
uaaguccacaccu

SEQ ID NO: 1240287 - RNA, 11 nt, Mycobacterium leprae
uaauaauaucc

SEQ ID NO: 1240288 - RNA, 17 nt, Mycobacterium leprae
uaagauuuaagcaggcu

SEQ ID NO: 1240289 - RNA, 17 nt, Mycobacterium leprae
uaagcgaaaaugaaaac

SEQ ID NO: 1240290 - RNA, 13 nt, Mycobacterium leprae
uaagacaaggugu

SEQ ID NO: 1240291 - RNA, 18 nt, Mycobacterium leprae
uaagagaaguagagaaaa

SEQ ID NO: 1240292 - RNA, 12 nt, Mycobacterium leprae
uaacuuguccgu

SEQ ID NO: 1240293 - RNA, 12 nt, Mycobacterium leprae
uaagaagcugcc

SEQ ID NO: 1240294 - RNA, 13 nt, Mycobacterium leprae
uaagaaagaauuu

SEQ ID NO: 1240295 - RNA, 16 nt, Mycobacterium leprae
uaagaaagaauuuacc

SEQ ID NO: 1240296 - RNA, 17 nt, Mycobacterium leprae
uaacuuuauaaguuguu

SEQ ID NO: 1240297 - RNA, 18 nt, Mycobacterium leprae
uaacaucauucacccuuu

SEQ ID NO: 1240298 - RNA, 17 nt, Mycobacterium leprae
uaacuacuggauuaaua

SEQ ID NO: 1240299 - RNA, 18 nt, Mycobacterium leprae
uaacuacuggauuaauau

SEQ ID NO: 1240300 - RNA, 17 nt, Mycobacterium leprae
uaacuauugugccacaa

SEQ ID NO: 1240301 - RNA, 16 nt, Mycobacterium leprae
uaaacggaauacagcg

SEQ ID NO: 1240302 - RNA, 20 nt, Mycobacterium leprae
uaaaggaguucaacaaaacc

SEQ ID NO: 1240303 - RNA, 16 nt, Mycobacterium leprae
uaaauaguauuauuga

SEQ ID NO: 1240304 - RNA, 17 nt, Mycobacterium leprae
uaaaguuauaaguuaua

SEQ ID NO: 1240305 - RNA, 13 nt, Mycobacterium leprae
uaaagucuucaau

SEQ ID NO: 1240306 - RNA, 11 nt, Mycobacterium leprae
uaaauauuaau

SEQ ID NO: 1240307 - RNA, 17 nt, Mycobacterium leprae
uaaaucggcaugaugug

SEQ ID NO: 1240308 - RNA, 18 nt, Mycobacterium leprae
uaaaauucaugccgcgca

SEQ ID NO: 1240309 - RNA, 15 nt, Mycobacterium leprae
uaaaaagauauuaag

SEQ ID NO: 1240310 - RNA, 16 nt, Mycobacterium leprae
guuuaggaaacauugu

SEQ ID NO: 1240311 - RNA, 12 nt, Mycobacterium leprae
guuuaucagccu

SEQ ID NO: 1240312 - RNA, 15 nt, Mycobacterium leprae
guuuacaacguugcu

SEQ ID NO: 1240313 - RNA, 13 nt, Mycobacterium leprae
guuguuuuuguug

SEQ ID NO: 1240314 - RNA, 17 nt, Mycobacterium leprae
guuguaguagaccuuga

SEQ ID NO: 1240315 - RNA, 17 nt, Mycobacterium leprae
guuugacgcaugacacc

SEQ ID NO: 1240316 - RNA, 16 nt, Mycobacterium leprae
guuugagaacagccuu

SEQ ID NO: 1240317 - RNA, 21 nt, Mycobacterium leprae
guuugaagucgcuguuggugu

SEQ ID NO: 1240318 - RNA, 14 nt, Mycobacterium leprae
guuucccagagcuc

SEQ ID NO: 1240319 - RNA, 13 nt, Mycobacterium leprae
guugguggguggc

SEQ ID NO: 1240320 - RNA, 17 nt, Mycobacterium leprae
guugguuaaucaccuca

SEQ ID NO: 1240321 - RNA, 16 nt, Mycobacterium leprae
guuggucggcgcuggc

SEQ ID NO: 1240322 - RNA, 17 nt, Mycobacterium leprae
guuggucggcgcuggcg

SEQ ID NO: 1240323 - RNA, 20 nt, Mycobacterium leprae
guuggucggcgcuggcggug

SEQ ID NO: 1240324 - RNA, 14 nt, Mycobacterium leprae
guugggugggggug

SEQ ID NO: 1240325 - RNA, 15 nt, Mycobacterium leprae
guuggcucgacguga

SEQ ID NO: 1240326 - RNA, 23 nt, Mycobacterium leprae
guugggagaucuuuucggcugca

SEQ ID NO: 1240327 - RNA, 16 nt, Mycobacterium leprae
guuggcgccugccacu

SEQ ID NO: 1240328 - RNA, 19 nt, Mycobacterium leprae
guugcuuuggggguugcac

SEQ ID NO: 1240329 - RNA, 18 nt, Mycobacterium leprae
guuggauuaccggcugcg

SEQ ID NO: 1240330 - RNA, 14 nt, Mycobacterium leprae
guuggccagcacgg

SEQ ID NO: 1240331 - RNA, 21 nt, Mycobacterium leprae
guugccagauagucgagggcu

SEQ ID NO: 1240332 - RNA, 17 nt, Mycobacterium leprae
guugcggugaguaaaca

SEQ ID NO: 1240333 - RNA, 22 nt, Mycobacterium leprae
guugcguaauggccggcgccug

SEQ ID NO: 1240334 - RNA, 15 nt, Mycobacterium leprae
guugcucgucaucga

SEQ ID NO: 1240335 - RNA, 22 nt, Mycobacterium leprae
guugaauuguacuuugugugca

SEQ ID NO: 1240336 - RNA, 20 nt, Mycobacterium leprae
guugaccaaaccgaagauca

SEQ ID NO: 1240337 - RNA, 16 nt, Mycobacterium leprae
guugagcucgaggaga

SEQ ID NO: 1240338 - RNA, 16 nt, Mycobacterium leprae
guugacgcccuccugg

SEQ ID NO: 1240339 - RNA, 16 nt, Mycobacterium leprae
guugaccugggggauu

SEQ ID NO: 1240340 - RNA, 22 nt, Mycobacterium leprae
guugcacggcaauggcccgagc

SEQ ID NO: 1240341 - RNA, 18 nt, Mycobacterium leprae
guugcacaucagcaaaga

SEQ ID NO: 1240342 - RNA, 18 nt, Mycobacterium leprae
guugaucuggaucagcgc

SEQ ID NO: 1240343 - RNA, 21 nt, Mycobacterium leprae
guucauggcaguccacaggac

SEQ ID NO: 1240344 - RNA, 23 nt, Mycobacterium leprae
guuagcaacuggccugaaggcua

SEQ ID NO: 1240345 - RNA, 17 nt, Mycobacterium leprae
guuagagcaccacacgg

SEQ ID NO: 1240346 - RNA, 21 nt, Mycobacterium leprae
guuccccgguuccgucucuca

SEQ ID NO: 1240347 - RNA, 21 nt, Mycobacterium leprae
guuccuauguuggucugcuca

SEQ ID NO: 1240348 - RNA, 23 nt, Mycobacterium leprae
guucgaucacguuucguggcaag

SEQ ID NO: 1240349 - RNA, 13 nt, Mycobacterium leprae
guuccuggcuggc

SEQ ID NO: 1240350 - RNA, 16 nt, Mycobacterium leprae
guuacguccgcggcag

SEQ ID NO: 1240351 - RNA, 12 nt, Mycobacterium leprae
guuacugccaca

SEQ ID NO: 1240352 - RNA, 18 nt, Mycobacterium leprae
guuaccggcgaagacgcc

SEQ ID NO: 1240353 - RNA, 15 nt, Mycobacterium leprae
guuaccguauauuaa

SEQ ID NO: 1240354 - RNA, 21 nt, Mycobacterium leprae
guuaccgucgggccugagugg

SEQ ID NO: 1240355 - RNA, 20 nt, Mycobacterium leprae
guuaauauaccguuaauaua

SEQ ID NO: 1240356 - RNA, 17 nt, Mycobacterium leprae
guguugcuggcgguggg

SEQ ID NO: 1240357 - RNA, 14 nt, Mycobacterium leprae
guguguugcagugu

SEQ ID NO: 1240358 - RNA, 22 nt, Mycobacterium leprae
guguucuuaggcacuggccagu

SEQ ID NO: 1240359 - RNA, 15 nt, Mycobacterium leprae
guguugaacaguacu

SEQ ID NO: 1240360 - RNA, 22 nt, Mycobacterium leprae
guguuuaucuggugaaacugca

SEQ ID NO: 1240361 - RNA, 12 nt, Mycobacterium leprae
guguuguggugg

SEQ ID NO: 1240362 - RNA, 15 nt, Mycobacterium leprae
guguguguggcaccg

SEQ ID NO: 1240363 - RNA, 19 nt, Mycobacterium leprae
guguguccuuaacugacug

SEQ ID NO: 1240364 - RNA, 21 nt, Mycobacterium leprae
gugugguguucuuaggcacug

SEQ ID NO: 1240365 - RNA, 13 nt, Mycobacterium leprae
gugugggugguug

SEQ ID NO: 1240366 - RNA, 16 nt, Mycobacterium leprae
gugugcaggaccgugc

SEQ ID NO: 1240367 - RNA, 21 nt, Mycobacterium leprae
gugugagcuaugcuagacagc

SEQ ID NO: 1240368 - RNA, 16 nt, Mycobacterium leprae
gugugaggauaguugu

SEQ ID NO: 1240369 - RNA, 12 nt, Mycobacterium leprae
gugucuguggcg

SEQ ID NO: 1240370 - RNA, 16 nt, Mycobacterium leprae
gugucuguggcgguga

SEQ ID NO: 1240371 - RNA, 13 nt, Mycobacterium leprae
guguaaggccagc

SEQ ID NO: 1240372 - RNA, 15 nt, Mycobacterium leprae
gugguguuccaguga

SEQ ID NO: 1240373 - RNA, 19 nt, Mycobacterium leprae
gugguguucuuaggcacug

SEQ ID NO: 1240374 - RNA, 20 nt, Mycobacterium leprae
gugguguucauaucgcgcaa

SEQ ID NO: 1240375 - RNA, 19 nt, Mycobacterium leprae
gugguggucgaccgcggug

SEQ ID NO: 1240376 - RNA, 22 nt, Mycobacterium leprae
gugguuauuuuuugcugguuug

SEQ ID NO: 1240377 - RNA, 19 nt, Mycobacterium leprae
gugguugaucauggccgca

SEQ ID NO: 1240378 - RNA, 23 nt, Mycobacterium leprae
gugguugaucauggccgcaguga

SEQ ID NO: 1240379 - RNA, 23 nt, Mycobacterium leprae
gugguugucggaccacucuggcu

SEQ ID NO: 1240380 - RNA, 20 nt, Mycobacterium leprae
guggcuuuaaaggccggcaa

SEQ ID NO: 1240381 - RNA, 15 nt, Mycobacterium leprae
gugggaaaagcaggc

SEQ ID NO: 1240382 - RNA, 18 nt, Mycobacterium leprae
guggcugaugucuuggcu

SEQ ID NO: 1240383 - RNA, 18 nt, Mycobacterium leprae
guggguuauccccacaug

SEQ ID NO: 1240384 - RNA, 15 nt, Mycobacterium leprae
gugguacaaucccac

SEQ ID NO: 1240385 - RNA, 19 nt, Mycobacterium leprae
guggucaauguggccgcac

SEQ ID NO: 1240386 - RNA, 18 nt, Mycobacterium leprae
guggucacacugguggug

SEQ ID NO: 1240387 - RNA, 19 nt, Mycobacterium leprae
guggguacgugguggcugc

SEQ ID NO: 1240388 - RNA, 12 nt, Mycobacterium leprae
guggggguggag

SEQ ID NO: 1240389 - RNA, 13 nt, Mycobacterium leprae
guggcaacgcugc

SEQ ID NO: 1240390 - RNA, 19 nt, Mycobacterium leprae
gugcuuagcauagcggccg

SEQ ID NO: 1240391 - RNA, 17 nt, Mycobacterium leprae
gugcuuaacgccgccuu

SEQ ID NO: 1240392 - RNA, 17 nt, Mycobacterium leprae
gugcuuggcagcccuug

SEQ ID NO: 1240393 - RNA, 21 nt, Mycobacterium leprae
guggcuaggccagugucggug

SEQ ID NO: 1240394 - RNA, 21 nt, Mycobacterium leprae
guggcccgacggcgcggcugc

SEQ ID NO: 1240395 - RNA, 23 nt, Mycobacterium leprae
guggcccgacggcgcggcugcuu

SEQ ID NO: 1240396 - RNA, 19 nt, Mycobacterium leprae
guggcgauacgcgcuugcc

SEQ ID NO: 1240397 - RNA, 13 nt, Mycobacterium leprae
gucgcugugccaa

SEQ ID NO: 1240398 - RNA, 21 nt, Mycobacterium leprae
gucgcugucaguugcgggaca

SEQ ID NO: 1240399 - RNA, 20 nt, Mycobacterium leprae
gucgcugugucgauagaaau

SEQ ID NO: 1240400 - RNA, 14 nt, Mycobacterium leprae
gucgcuugaugccu

SEQ ID NO: 1240401 - RNA, 15 nt, Mycobacterium leprae
gucgcugcuggauga

SEQ ID NO: 1240402 - RNA, 23 nt, Mycobacterium leprae
gugaugccgaagcagacugaguc

SEQ ID NO: 1240403 - RNA, 17 nt, Mycobacterium leprae
gugauggucgugucuac

SEQ ID NO: 1240404 - RNA, 21 nt, Mycobacterium leprae
gugcaagugcaccaucugcuc

SEQ ID NO: 1240405 - RNA, 23 nt, Mycobacterium leprae
gugcauguucuguugugggggug

SEQ ID NO: 1240406 - RNA, 22 nt, Mycobacterium leprae
gugcccgggaaacuagcgggcu

SEQ ID NO: 1240407 - RNA, 22 nt, Mycobacterium leprae
gugcccucgcugccgugugcuu

SEQ ID NO: 1240408 - RNA, 19 nt, Mycobacterium leprae
gugccccagucgccagagc

SEQ ID NO: 1240409 - RNA, 23 nt, Mycobacterium leprae
gugcgucauggcacugggcugcu

SEQ ID NO: 1240410 - RNA, 14 nt, Mycobacterium leprae
gugcguuguugaug

SEQ ID NO: 1240411 - RNA, 14 nt, Mycobacterium leprae
gugcggucuuagca

SEQ ID NO: 1240412 - RNA, 19 nt, Mycobacterium leprae
gugcguaaggaagaugaca

SEQ ID NO: 1240413 - RNA, 19 nt, Mycobacterium leprae
gugcugacagacauggcug

SEQ ID NO: 1240414 - RNA, 22 nt, Mycobacterium leprae
gugcugcgcgguugguccuuac

SEQ ID NO: 1240415 - RNA, 15 nt, Mycobacterium leprae
gugcugcgugccugg

SEQ ID NO: 1240416 - RNA, 18 nt, Mycobacterium leprae
gugcugcgugccugguug

SEQ ID NO: 1240417 - RNA, 17 nt, Mycobacterium leprae
gugcugagagcagaugg

SEQ ID NO: 1240418 - RNA, 16 nt, Mycobacterium leprae
gugcugcacggcugcg

SEQ ID NO: 1240419 - RNA, 21 nt, Mycobacterium leprae
gugcugcauccgacaaagcag

SEQ ID NO: 1240420 - RNA, 22 nt, Mycobacterium leprae
gugcugcccgacgaggcgguga

SEQ ID NO: 1240421 - RNA, 17 nt, Mycobacterium leprae
gugcgaccugaacauua

SEQ ID NO: 1240422 - RNA, 15 nt, Mycobacterium leprae
gugccgcgaccgcca

SEQ ID NO: 1240423 - RNA, 14 nt, Mycobacterium leprae
gugccgcugaccag

SEQ ID NO: 1240424 - RNA, 18 nt, Mycobacterium leprae
gugccgcugcauccgcag

SEQ ID NO: 1240425 - RNA, 23 nt, Mycobacterium leprae
gugcgcugcgggacggguggggu

SEQ ID NO: 1240426 - RNA, 23 nt, Mycobacterium leprae
gugcggucccaucgcugaccggu

SEQ ID NO: 1240427 - RNA, 23 nt, Mycobacterium leprae
gucauagacaaggguuagcagaa

SEQ ID NO: 1240428 - RNA, 21 nt, Mycobacterium leprae
gucauacacgugguccuuccg

SEQ ID NO: 1240429 - RNA, 17 nt, Mycobacterium leprae
gucagucagcgugccug

SEQ ID NO: 1240430 - RNA, 19 nt, Mycobacterium leprae
gucaguuuggcgcugcugc

SEQ ID NO: 1240431 - RNA, 21 nt, Mycobacterium leprae
gucaguaguuuuuggauccug

SEQ ID NO: 1240432 - RNA, 23 nt, Mycobacterium leprae
gucaggucaugccagggcaugcu

SEQ ID NO: 1240433 - RNA, 17 nt, Mycobacterium leprae
gucagccacauccucgg

SEQ ID NO: 1240434 - RNA, 12 nt, Mycobacterium leprae
gucagcgauuug

SEQ ID NO: 1240435 - RNA, 16 nt, Mycobacterium leprae
gucaggccaggcagcg

SEQ ID NO: 1240436 - RNA, 21 nt, Mycobacterium leprae
gucagcuggaaucccccauuc

SEQ ID NO: 1240437 - RNA, 16 nt, Mycobacterium leprae
gucacgggucggcggg

SEQ ID NO: 1240438 - RNA, 18 nt, Mycobacterium leprae
gucacgucgacggcggcc

SEQ ID NO: 1240439 - RNA, 20 nt, Mycobacterium leprae
gucacgcuagaaacaggcau

SEQ ID NO: 1240440 - RNA, 13 nt, Mycobacterium leprae
gucacgcugcucg

SEQ ID NO: 1240441 - RNA, 14 nt, Mycobacterium leprae
gucacccuccucgc

SEQ ID NO: 1240442 - RNA, 14 nt, Mycobacterium leprae
gucacuauaauuua

SEQ ID NO: 1240443 - RNA, 18 nt, Mycobacterium leprae
gucacuccacgauucugc

SEQ ID NO: 1240444 - RNA, 14 nt, Mycobacterium leprae
gucacuccgacggu

SEQ ID NO: 1240445 - RNA, 18 nt, Mycobacterium leprae
gucagacgaaauuugucg

SEQ ID NO: 1240446 - RNA, 12 nt, Mycobacterium leprae
gucagagugcag

SEQ ID NO: 1240447 - RNA, 13 nt, Mycobacterium leprae
gucagaguuucau

SEQ ID NO: 1240448 - RNA, 10 nt, Mycobacterium leprae
gucagauaac

SEQ ID NO: 1240449 - RNA, 15 nt, Mycobacterium leprae
gucagauaacgggug

SEQ ID NO: 1240450 - RNA, 18 nt, Mycobacterium leprae
gucagauccggccguuga

SEQ ID NO: 1240451 - RNA, 18 nt, Mycobacterium leprae
gucaacgcgaaaggguag

SEQ ID NO: 1240452 - RNA, 13 nt, Mycobacterium leprae
gucaacggccuca

SEQ ID NO: 1240453 - RNA, 17 nt, Mycobacterium leprae
gucaaggugaaacuccc

SEQ ID NO: 1240454 - RNA, 14 nt, Mycobacterium leprae
gucaaugcaggugg

SEQ ID NO: 1240455 - RNA, 22 nt, Mycobacterium leprae
gucaaugcguccaccgagacgu

SEQ ID NO: 1240456 - RNA, 15 nt, Mycobacterium leprae
guauaucggacacga

SEQ ID NO: 1240457 - RNA, 16 nt, Mycobacterium leprae
guccugcgacaucucg

SEQ ID NO: 1240458 - RNA, 21 nt, Mycobacterium leprae
guccugcccggacaagucagc

SEQ ID NO: 1240459 - RNA, 15 nt, Mycobacterium leprae
guccugacagauacu

SEQ ID NO: 1240460 - RNA, 11 nt, Mycobacterium leprae
gucccgagcgg

SEQ ID NO: 1240461 - RNA, 22 nt, Mycobacterium leprae
gucccgcagccgcguccagaca

SEQ ID NO: 1240462 - RNA, 14 nt, Mycobacterium leprae
guccgccagcgaca

SEQ ID NO: 1240463 - RNA, 23 nt, Mycobacterium leprae
gucauuaucgagauuggcgaaaa

SEQ ID NO: 1240464 - RNA, 23 nt, Mycobacterium leprae
gucccaggacauauuaagacgcu

SEQ ID NO: 1240465 - RNA, 16 nt, Mycobacterium leprae
gucgaucgcuggucag

SEQ ID NO: 1240466 - RNA, 20 nt, Mycobacterium leprae
gucgaucagggcgcccccca

SEQ ID NO: 1240467 - RNA, 12 nt, Mycobacterium leprae
gucgcagcggcg

SEQ ID NO: 1240468 - RNA, 22 nt, Mycobacterium leprae
guccuugagcuaacagauacca

SEQ ID NO: 1240469 - RNA, 15 nt, Mycobacterium leprae
gucgagcuggcugug

SEQ ID NO: 1240470 - RNA, 16 nt, Mycobacterium leprae
gucgaggaccgccaug

SEQ ID NO: 1240471 - RNA, 21 nt, Mycobacterium leprae
guccugugggucgacccggug

SEQ ID NO: 1240472 - RNA, 17 nt, Mycobacterium leprae
guccuuaacugacuggu

SEQ ID NO: 1240473 - RNA, 16 nt, Mycobacterium leprae
guccugguggcaacgc

SEQ ID NO: 1240474 - RNA, 22 nt, Mycobacterium leprae
gucgcccgcuuaaccaucagaa

SEQ ID NO: 1240475 - RNA, 19 nt, Mycobacterium leprae
guagagguccugcagucuu

SEQ ID NO: 1240476 - RNA, 13 nt, Mycobacterium leprae
guaggccagguua

SEQ ID NO: 1240477 - RNA, 18 nt, Mycobacterium leprae
guaggcguccgcggcggc

SEQ ID NO: 1240478 - RNA, 13 nt, Mycobacterium leprae
guagugcugcagg

SEQ ID NO: 1240479 - RNA, 13 nt, Mycobacterium leprae
guagguguaguuu

SEQ ID NO: 1240480 - RNA, 13 nt, Mycobacterium leprae
guaguuguacacg

SEQ ID NO: 1240481 - RNA, 23 nt, Mycobacterium leprae
guacgguguagcugcgagucuca

SEQ ID NO: 1240482 - RNA, 21 nt, Mycobacterium leprae
guacucaauggccugcucaug

SEQ ID NO: 1240483 - RNA, 15 nt, Mycobacterium leprae
guacuggugauaaau

SEQ ID NO: 1240484 - RNA, 15 nt, Mycobacterium leprae
guacuggugcugugu

SEQ ID NO: 1240485 - RNA, 17 nt, Mycobacterium leprae
guagagccuacucccgg

SEQ ID NO: 1240486 - RNA, 16 nt, Mycobacterium leprae
guagaccaugagcaca

SEQ ID NO: 1240487 - RNA, 21 nt, Mycobacterium leprae
guagaccucuucagacuggau

SEQ ID NO: 1240488 - RNA, 16 nt, Mycobacterium leprae
guaaucgcuuggugcu

SEQ ID NO: 1240489 - RNA, 17 nt, Mycobacterium leprae
guaaucgccgguggcaa

SEQ ID NO: 1240490 - RNA, 15 nt, Mycobacterium leprae
guaaugugcuaucac

SEQ ID NO: 1240491 - RNA, 20 nt, Mycobacterium leprae
gguguuucucgccgaccggu

SEQ ID NO: 1240492 - RNA, 20 nt, Mycobacterium leprae
gguguuuugucggugguggg

SEQ ID NO: 1240493 - RNA, 22 nt, Mycobacterium leprae
guaaaggaguucaacaaaacca

SEQ ID NO: 1240494 - RNA, 16 nt, Mycobacterium leprae
guaaagccguuggcuu

SEQ ID NO: 1240495 - RNA, 14 nt, Mycobacterium leprae
guaaaggguggugg

SEQ ID NO: 1240496 - RNA, 21 nt, Mycobacterium leprae
guaacacucauuggacccagc

SEQ ID NO: 1240497 - RNA, 21 nt, Mycobacterium leprae
guaacugaugguccuggcugc

SEQ ID NO: 1240498 - RNA, 16 nt, Mycobacterium leprae
guaacuaauccagaca

SEQ ID NO: 1240499 - RNA, 23 nt, Mycobacterium leprae
guaaccggggaccucauccucgg

SEQ ID NO: 1240500 - RNA, 17 nt, Mycobacterium leprae
guaacgcugaccagcag

SEQ ID NO: 1240501 - RNA, 21 nt, Mycobacterium leprae
guaacgcugauugccaacuca

SEQ ID NO: 1240502 - RNA, 23 nt, Mycobacterium leprae
guaaguugcuuaacgaucgcacu

SEQ ID NO: 1240503 - RNA, 18 nt, Mycobacterium leprae
guaaguggaggugaucaa

SEQ ID NO: 1240504 - RNA, 15 nt, Mycobacterium leprae
guaaggcucagcgcu

SEQ ID NO: 1240505 - RNA, 21 nt, Mycobacterium leprae
guaaggguaucgaugcuaccg

SEQ ID NO: 1240506 - RNA, 14 nt, Mycobacterium leprae
ggucguugagcggc

SEQ ID NO: 1240507 - RNA, 15 nt, Mycobacterium leprae
ggucguuagcgccga

SEQ ID NO: 1240508 - RNA, 15 nt, Mycobacterium leprae
ggugaaauggcuguu

SEQ ID NO: 1240509 - RNA, 15 nt, Mycobacterium leprae
ggugacuuggcuggu

SEQ ID NO: 1240510 - RNA, 17 nt, Mycobacterium leprae
ggucaguacgcuagagu

SEQ ID NO: 1240511 - RNA, 14 nt, Mycobacterium leprae
gguccugguggcaa

SEQ ID NO: 1240512 - RNA, 20 nt, Mycobacterium leprae
ggucgacuaacgcuucugcc

SEQ ID NO: 1240513 - RNA, 13 nt, Mycobacterium leprae
ggucgagcagcuc

SEQ ID NO: 1240514 - RNA, 13 nt, Mycobacterium leprae
ggucgagcuggac

SEQ ID NO: 1240515 - RNA, 16 nt, Mycobacterium leprae
ggugccgaggcucugc

SEQ ID NO: 1240516 - RNA, 20 nt, Mycobacterium leprae
ggugccgccauugcccccgc

SEQ ID NO: 1240517 - RNA, 15 nt, Mycobacterium leprae
ggugcgcugcugacg

SEQ ID NO: 1240518 - RNA, 18 nt, Mycobacterium leprae
gguggaguaaaggguggc

SEQ ID NO: 1240519 - RNA, 20 nt, Mycobacterium leprae
gguggaguaaaggguggcgg

SEQ ID NO: 1240520 - RNA, 21 nt, Mycobacterium leprae
gguggaguaaagggugguggg

SEQ ID NO: 1240521 - RNA, 14 nt, Mycobacterium leprae
gguguccguaagcg

SEQ ID NO: 1240522 - RNA, 16 nt, Mycobacterium leprae
ggugucugcgaacagc

SEQ ID NO: 1240523 - RNA, 17 nt, Mycobacterium leprae
gguacgugguggcugca

SEQ ID NO: 1240524 - RNA, 14 nt, Mycobacterium leprae
gguacucagcuggu

SEQ ID NO: 1240525 - RNA, 22 nt, Mycobacterium leprae
gguacuguugguaaccagccac

SEQ ID NO: 1240526 - RNA, 20 nt, Mycobacterium leprae
gguaccggcaaaccagagau

SEQ ID NO: 1240527 - RNA, 15 nt, Mycobacterium leprae
gguaccgaugugcug

SEQ ID NO: 1240528 - RNA, 13 nt, Mycobacterium leprae
ggucacccuccuc

SEQ ID NO: 1240529 - RNA, 13 nt, Mycobacterium leprae
ggguugggugggg

SEQ ID NO: 1240530 - RNA, 23 nt, Mycobacterium leprae
ggguugcuuguaccuucuguaug

SEQ ID NO: 1240531 - RNA, 16 nt, Mycobacterium leprae
ggguguuuugucggug

SEQ ID NO: 1240532 - RNA, 14 nt, Mycobacterium leprae
ggguggcgccggcg

SEQ ID NO: 1240533 - RNA, 14 nt, Mycobacterium leprae
ggguguugugggug

SEQ ID NO: 1240534 - RNA, 14 nt, Mycobacterium leprae
ggguacucagcugg

SEQ ID NO: 1240535 - RNA, 23 nt, Mycobacterium leprae
ggguccagcguaaucgcuuggug

SEQ ID NO: 1240536 - RNA, 17 nt, Mycobacterium leprae
gggugaaauggcuguuu

SEQ ID NO: 1240537 - RNA, 12 nt, Mycobacterium leprae
gggcaggucagc

SEQ ID NO: 1240538 - RNA, 23 nt, Mycobacterium leprae
gggccagcaccaaccuguagacg

SEQ ID NO: 1240539 - RNA, 13 nt, Mycobacterium leprae
gggccaacuagga

SEQ ID NO: 1240540 - RNA, 16 nt, Mycobacterium leprae
gggccacuaauggcgu

SEQ ID NO: 1240541 - RNA, 23 nt, Mycobacterium leprae
gggccagagcugcgacggacagg

SEQ ID NO: 1240542 - RNA, 19 nt, Mycobacterium leprae
gggaguuuccgccucaggg

SEQ ID NO: 1240543 - RNA, 19 nt, Mycobacterium leprae
gggaucuuuugaccagcac

SEQ ID NO: 1240544 - RNA, 19 nt, Mycobacterium leprae
gggaugagucagacacuug

SEQ ID NO: 1240545 - RNA, 16 nt, Mycobacterium leprae
gggcaccugggcugug

SEQ ID NO: 1240546 - RNA, 13 nt, Mycobacterium leprae
gggccggccgcgg

SEQ ID NO: 1240547 - RNA, 19 nt, Mycobacterium leprae
gggccgcuauaggcgagcu

SEQ ID NO: 1240548 - RNA, 18 nt, Mycobacterium leprae
gggcgauucgggccgcua

SEQ ID NO: 1240549 - RNA, 23 nt, Mycobacterium leprae
gggcgccaccaugaaacgcgcga

SEQ ID NO: 1240550 - RNA, 13 nt, Mycobacterium leprae
gggcuuugccaau

SEQ ID NO: 1240551 - RNA, 12 nt, Mycobacterium leprae
gggcugggacgg

SEQ ID NO: 1240552 - RNA, 24 nt, Mycobacterium leprae
gggcugcuguguuugcuggucagg

SEQ ID NO: 1240553 - RNA, 16 nt, Mycobacterium leprae
gggcgcucagcggcca

SEQ ID NO: 1240554 - RNA, 14 nt, Mycobacterium leprae
ggcuuggccagcaa

SEQ ID NO: 1240555 - RNA, 15 nt, Mycobacterium leprae
ggcuuggccagcaag

SEQ ID NO: 1240556 - RNA, 15 nt, Mycobacterium leprae
ggcugguggccgagg

SEQ ID NO: 1240557 - RNA, 12 nt, Mycobacterium leprae
ggcugguggggu

SEQ ID NO: 1240558 - RNA, 13 nt, Mycobacterium leprae
ggcugggcaccug

SEQ ID NO: 1240559 - RNA, 23 nt, Mycobacterium leprae
ggcugggcaccugggcugugcug

SEQ ID NO: 1240560 - RNA, 11 nt, Mycobacterium leprae
ggcuggcuucc

SEQ ID NO: 1240561 - RNA, 11 nt, Mycobacterium leprae
ggcuggcugua

SEQ ID NO: 1240562 - RNA, 17 nt, Mycobacterium leprae
ggcuggcuacgcagcuc

SEQ ID NO: 1240563 - RNA, 20 nt, Mycobacterium leprae
ggcugccgcaccgcuucaga

SEQ ID NO: 1240564 - RNA, 17 nt, Mycobacterium leprae
ggcugcugcagaccgga

SEQ ID NO: 1240565 - RNA, 16 nt, Mycobacterium leprae
ggcugacugccugcuu

SEQ ID NO: 1240566 - RNA, 15 nt, Mycobacterium leprae
ggcugagaaguggcu

SEQ ID NO: 1240567 - RNA, 22 nt, Mycobacterium leprae
ggcugagaccgguccaccugcc

SEQ ID NO: 1240568 - RNA, 18 nt, Mycobacterium leprae
ggcucgcggggaugcuga

SEQ ID NO: 1240569 - RNA, 19 nt, Mycobacterium leprae
ggcucgcggggaugcugag

SEQ ID NO: 1240570 - RNA, 16 nt, Mycobacterium leprae
ggcucuuucggcgaga

SEQ ID NO: 1240571 - RNA, 20 nt, Mycobacterium leprae
ggcucccaucggcggccagc

SEQ ID NO: 1240572 - RNA, 21 nt, Mycobacterium leprae
ggcucccaucggcggccagcu

SEQ ID NO: 1240573 - RNA, 13 nt, Mycobacterium leprae
ggcuccauccugc

SEQ ID NO: 1240574 - RNA, 18 nt, Mycobacterium leprae
ggcuccauccugccucac

SEQ ID NO: 1240575 - RNA, 22 nt, Mycobacterium leprae
ggcucgaguugguuaaucaccu

SEQ ID NO: 1240576 - RNA, 17 nt, Mycobacterium leprae
ggcucacacugagacca

SEQ ID NO: 1240577 - RNA, 21 nt, Mycobacterium leprae
ggcucacacugagaccauggu

SEQ ID NO: 1240578 - RNA, 15 nt, Mycobacterium leprae
ggcuccaaguggcug

SEQ ID NO: 1240579 - RNA, 16 nt, Mycobacterium leprae
ggcuccaaguggcugc

SEQ ID NO: 1240580 - RNA, 21 nt, Mycobacterium leprae
ggcgauuucgauccaucguga

SEQ ID NO: 1240581 - RNA, 14 nt, Mycobacterium leprae
ggcgcaaagucgac

SEQ ID NO: 1240582 - RNA, 19 nt, Mycobacterium leprae
ggcgcaacagucagccgcg

SEQ ID NO: 1240583 - RNA, 16 nt, Mycobacterium leprae
ggcgauucgggccgcu

SEQ ID NO: 1240584 - RNA, 13 nt, Mycobacterium leprae
ggcgaucagcagg

SEQ ID NO: 1240585 - RNA, 21 nt, Mycobacterium leprae
ggcgauagaggaucugcacaa

SEQ ID NO: 1240586 - RNA, 14 nt, Mycobacterium leprae
ggcgcacguaagca

SEQ ID NO: 1240587 - RNA, 23 nt, Mycobacterium leprae
ggcgcacguaagcaugucggugg

SEQ ID NO: 1240588 - RNA, 18 nt, Mycobacterium leprae
ggcgcagaccucuuccgc

SEQ ID NO: 1240589 - RNA, 16 nt, Mycobacterium leprae
ggcgcaagcgugcagg

SEQ ID NO: 1240590 - RNA, 19 nt, Mycobacterium leprae
ggcgcacaaaaauccuccc

SEQ ID NO: 1240591 - RNA, 14 nt, Mycobacterium leprae
ggcgcgcaggcugc

SEQ ID NO: 1240592 - RNA, 20 nt, Mycobacterium leprae
ggcgccucgucggccagcac

SEQ ID NO: 1240593 - RNA, 21 nt, Mycobacterium leprae
ggcgccucgucggccagcacu

SEQ ID NO: 1240594 - RNA, 14 nt, Mycobacterium leprae
ggcgccgcugcuuc

SEQ ID NO: 1240595 - RNA, 13 nt, Mycobacterium leprae
ggcgccccucugc

SEQ ID NO: 1240596 - RNA, 12 nt, Mycobacterium leprae
ggcgccgcccgg

SEQ ID NO: 1240597 - RNA, 20 nt, Mycobacterium leprae
ggccucacaguaggccagcc

SEQ ID NO: 1240598 - RNA, 15 nt, Mycobacterium leprae
ggccgugcuagucgu

SEQ ID NO: 1240599 - RNA, 23 nt, Mycobacterium leprae
ggccgugcuagucguaacgcuga

SEQ ID NO: 1240600 - RNA, 14 nt, Mycobacterium leprae
ggccgucggcaacu

SEQ ID NO: 1240601 - RNA, 14 nt, Mycobacterium leprae
ggccgucggcggca

SEQ ID NO: 1240602 - RNA, 18 nt, Mycobacterium leprae
ggccuccgacaggucagu

SEQ ID NO: 1240603 - RNA, 16 nt, Mycobacterium leprae
ggccugcucauggcac

SEQ ID NO: 1240604 - RNA, 18 nt, Mycobacterium leprae
ggccuucgucagcuggaa

SEQ ID NO: 1240605 - RNA, 21 nt, Mycobacterium leprae
ggccuggucguucauccucgg

SEQ ID NO: 1240606 - RNA, 17 nt, Mycobacterium leprae
ggcgagcuggggcggcc

SEQ ID NO: 1240607 - RNA, 22 nt, Mycobacterium leprae
ggcgaccuggucgagcagcucc

SEQ ID NO: 1240608 - RNA, 21 nt, Mycobacterium leprae
ggcgaagacgccgccggagcg

SEQ ID NO: 1240609 - RNA, 23 nt, Mycobacterium leprae
ggcgaaaacccgcgcgugcacaa

SEQ ID NO: 1240610 - RNA, 19 nt, Mycobacterium leprae
ggcuaaggugcguugugcg

SEQ ID NO: 1240611 - RNA, 17 nt, Mycobacterium leprae
ggcuaagguggcuagcu

SEQ ID NO: 1240612 - RNA, 20 nt, Mycobacterium leprae
ggcuacggggugggcagccu

SEQ ID NO: 1240613 - RNA, 22 nt, Mycobacterium leprae
ggcuacucugcguaggccaggu

SEQ ID NO: 1240614 - RNA, 13 nt, Mycobacterium leprae
ggcuauccucggg

SEQ ID NO: 1240615 - RNA, 16 nt, Mycobacterium leprae
ggcuagccgugcagcc

SEQ ID NO: 1240616 - RNA, 15 nt, Mycobacterium leprae
ggcguugccgucccc

SEQ ID NO: 1240617 - RNA, 15 nt, Mycobacterium leprae
ggcguuccggccucg

SEQ ID NO: 1240618 - RNA, 13 nt, Mycobacterium leprae
ggcguggguguga

SEQ ID NO: 1240619 - RNA, 22 nt, Mycobacterium leprae
ggcguggucaauguggccgcac

SEQ ID NO: 1240620 - RNA, 15 nt, Mycobacterium leprae
ggcgucgguggcggu

SEQ ID NO: 1240621 - RNA, 16 nt, Mycobacterium leprae
ggcguccgcggcggcc

SEQ ID NO: 1240622 - RNA, 17 nt, Mycobacterium leprae
ggcgguguguugcagug

SEQ ID NO: 1240623 - RNA, 18 nt, Mycobacterium leprae
ggcgguguguugcagugu

SEQ ID NO: 1240624 - RNA, 17 nt, Mycobacterium leprae
ggcgguguuucucgccg

SEQ ID NO: 1240625 - RNA, 22 nt, Mycobacterium leprae
ggcgguugcguaauggccggcg

SEQ ID NO: 1240626 - RNA, 14 nt, Mycobacterium leprae
ggcgguggcagcgu

SEQ ID NO: 1240627 - RNA, 23 nt, Mycobacterium leprae
ggcgucaucgacaucccagcaac

SEQ ID NO: 1240628 - RNA, 13 nt, Mycobacterium leprae
ggcgucacccagu

SEQ ID NO: 1240629 - RNA, 23 nt, Mycobacterium leprae
ggcggucguugauuuccgcggcg

SEQ ID NO: 1240630 - RNA, 17 nt, Mycobacterium leprae
ggcggguagucggcgcg

SEQ ID NO: 1240631 - RNA, 19 nt, Mycobacterium leprae
ggcgguaaacagagcugau

SEQ ID NO: 1240632 - RNA, 22 nt, Mycobacterium leprae
ggcggguuucccagagcucccg

SEQ ID NO: 1240633 - RNA, 13 nt, Mycobacterium leprae
ggcgcuuaaugua

SEQ ID NO: 1240634 - RNA, 18 nt, Mycobacterium leprae
ggcgcuuguaaggccagc

SEQ ID NO: 1240635 - RNA, 14 nt, Mycobacterium leprae
ggcgcugcugcgga

SEQ ID NO: 1240636 - RNA, 11 nt, Mycobacterium leprae
ggcgcuaacaa

SEQ ID NO: 1240637 - RNA, 20 nt, Mycobacterium leprae
ggcgcuccaauuuggagccu

SEQ ID NO: 1240638 - RNA, 18 nt, Mycobacterium leprae
ggcggcgacacggcuguc

SEQ ID NO: 1240639 - RNA, 18 nt, Mycobacterium leprae
ggcggcgauccucaacca

SEQ ID NO: 1240640 - RNA, 18 nt, Mycobacterium leprae
ggcggaugcgggcuuccu

SEQ ID NO: 1240641 - RNA, 16 nt, Mycobacterium leprae
ggcggcaccuccccgc

SEQ ID NO: 1240642 - RNA, 12 nt, Mycobacterium leprae
ggcggcauuccc

SEQ ID NO: 1240643 - RNA, 15 nt, Mycobacterium leprae
ggcggccagcucagc

SEQ ID NO: 1240644 - RNA, 21 nt, Mycobacterium leprae
ggcagugauuuuuggugucuu

SEQ ID NO: 1240645 - RNA, 15 nt, Mycobacterium leprae
ggcagaaauggugca

SEQ ID NO: 1240646 - RNA, 14 nt, Mycobacterium leprae
ggcacuucgcugag

SEQ ID NO: 1240647 - RNA, 20 nt, Mycobacterium leprae
ggcauugaucgcucguggca

SEQ ID NO: 1240648 - RNA, 23 nt, Mycobacterium leprae
ggcaucuuacuggggcguccagu

SEQ ID NO: 1240649 - RNA, 15 nt, Mycobacterium leprae
ggcaucucaacuuuc

SEQ ID NO: 1240650 - RNA, 14 nt, Mycobacterium leprae
ggcaugaaccucac

SEQ ID NO: 1240651 - RNA, 21 nt, Mycobacterium leprae
ggccaaagagcgggcggcagc

SEQ ID NO: 1240652 - RNA, 23 nt, Mycobacterium leprae
ggccaagccgcccggccugccga

SEQ ID NO: 1240653 - RNA, 23 nt, Mycobacterium leprae
ggccaacuaggauagauccacca

SEQ ID NO: 1240654 - RNA, 13 nt, Mycobacterium leprae
ggccacgucgccg

SEQ ID NO: 1240655 - RNA, 14 nt, Mycobacterium leprae
ggccacgucgccgu

SEQ ID NO: 1240656 - RNA, 19 nt, Mycobacterium leprae
ggccacuaguggaggggcg

SEQ ID NO: 1240657 - RNA, 14 nt, Mycobacterium leprae
ggccagccguccca

SEQ ID NO: 1240658 - RNA, 23 nt, Mycobacterium leprae
ggccaauaccgaaguccaccgga

SEQ ID NO: 1240659 - RNA, 14 nt, Mycobacterium leprae
ggccaggccgagug

SEQ ID NO: 1240660 - RNA, 18 nt, Mycobacterium leprae
ggccaggccgagugcagg

SEQ ID NO: 1240661 - RNA, 17 nt, Mycobacterium leprae
ggccagcgcacccaucc

SEQ ID NO: 1240662 - RNA, 17 nt, Mycobacterium leprae
ggccgccguccacugca

SEQ ID NO: 1240663 - RNA, 20 nt, Mycobacterium leprae
ggcccgaggagaggcagggc

SEQ ID NO: 1240664 - RNA, 15 nt, Mycobacterium leprae
ggcccgucgcugcug

SEQ ID NO: 1240665 - RNA, 20 nt, Mycobacterium leprae
ggccggaucaucgaugcacu

SEQ ID NO: 1240666 - RNA, 13 nt, Mycobacterium leprae
ggccgcggcgacc

SEQ ID NO: 1240667 - RNA, 16 nt, Mycobacterium leprae
ggccgcgcuggccucc

SEQ ID NO: 1240668 - RNA, 23 nt, Mycobacterium leprae
ggccguaaucaagaucggccagc

SEQ ID NO: 1240669 - RNA, 14 nt, Mycobacterium leprae
ggccgggucuuccu

SEQ ID NO: 1240670 - RNA, 23 nt, Mycobacterium leprae
ggccgggucuuccuacggcuucc

SEQ ID NO: 1240671 - RNA, 14 nt, Mycobacterium leprae
ggcaagcagauucg

SEQ ID NO: 1240672 - RNA, 21 nt, Mycobacterium leprae
ggcaagcagauucgagcucau

SEQ ID NO: 1240673 - RNA, 15 nt, Mycobacterium leprae
ggcaagaccgcccgg

SEQ ID NO: 1240674 - RNA, 22 nt, Mycobacterium leprae
ggcaacugacauauuugggagc

SEQ ID NO: 1240675 - RNA, 14 nt, Mycobacterium leprae
ggcaagcgguuguc

SEQ ID NO: 1240676 - RNA, 21 nt, Mycobacterium leprae
ggcaagcgguuguccggcgcg

SEQ ID NO: 1240677 - RNA, 17 nt, Mycobacterium leprae
ggcaagccauugcucgg

SEQ ID NO: 1240678 - RNA, 14 nt, Mycobacterium leprae
ggcaagugguugga

SEQ ID NO: 1240679 - RNA, 20 nt, Mycobacterium leprae
ggcaauguggacgcuagugu

SEQ ID NO: 1240680 - RNA, 14 nt, Mycobacterium leprae
ggcacacagcaaug

SEQ ID NO: 1240681 - RNA, 12 nt, Mycobacterium leprae
ggcaccgugucg

SEQ ID NO: 1240682 - RNA, 18 nt, Mycobacterium leprae
ggcaccuggugcccgaca

SEQ ID NO: 1240683 - RNA, 15 nt, Mycobacterium leprae
ggcaacacagcugau

SEQ ID NO: 1240684 - RNA, 23 nt, Mycobacterium leprae
ggcaacaccagcgacuggcugua

SEQ ID NO: 1240685 - RNA, 20 nt, Mycobacterium leprae
ggcaaccuucuagcgcagau

SEQ ID NO: 1240686 - RNA, 19 nt, Mycobacterium leprae
ggauuucucgugguggcug

SEQ ID NO: 1240687 - RNA, 16 nt, Mycobacterium leprae
ggauggcugagcggca

SEQ ID NO: 1240688 - RNA, 23 nt, Mycobacterium leprae
ggauggcugcaacgacuggauga

SEQ ID NO: 1240689 - RNA, 13 nt, Mycobacterium leprae
ggaucugguuuuu

SEQ ID NO: 1240690 - RNA, 21 nt, Mycobacterium leprae
ggaucucuucgucgugcaauu

SEQ ID NO: 1240691 - RNA, 11 nt, Mycobacterium leprae
ggaugcccagc

SEQ ID NO: 1240692 - RNA, 14 nt, Mycobacterium leprae
ggagugaagugagu

SEQ ID NO: 1240693 - RNA, 13 nt, Mycobacterium leprae
ggagucaucccca

SEQ ID NO: 1240694 - RNA, 15 nt, Mycobacterium leprae
ggauacucaauugca

SEQ ID NO: 1240695 - RNA, 13 nt, Mycobacterium leprae
ggauagcgacugu

SEQ ID NO: 1240696 - RNA, 14 nt, Mycobacterium leprae
ggaguaaagggugg

SEQ ID NO: 1240697 - RNA, 13 nt, Mycobacterium leprae
ggacuucugcgcg

SEQ ID NO: 1240698 - RNA, 21 nt, Mycobacterium leprae
ggacugucaaccauggucucg

SEQ ID NO: 1240699 - RNA, 15 nt, Mycobacterium leprae
ggagaguuugauccu

SEQ ID NO: 1240700 - RNA, 22 nt, Mycobacterium leprae
ggacugaaaacagcgccucacc

SEQ ID NO: 1240701 - RNA, 16 nt, Mycobacterium leprae
ggacgaucgagaagua

SEQ ID NO: 1240702 - RNA, 19 nt, Mycobacterium leprae
ggacgacgugccgcaggca

SEQ ID NO: 1240703 - RNA, 19 nt, Mycobacterium leprae
ggaaucgaguucugcaccg

SEQ ID NO: 1240704 - RNA, 23 nt, Mycobacterium leprae
ggaaucggcacuucgcugagcga

SEQ ID NO: 1240705 - RNA, 18 nt, Mycobacterium leprae
ggacaagaucgaggccag

SEQ ID NO: 1240706 - RNA, 23 nt, Mycobacterium leprae
ggacaagcagugucugggccggg

SEQ ID NO: 1240707 - RNA, 21 nt, Mycobacterium leprae
ggaagugacgccacaguuagc

SEQ ID NO: 1240708 - RNA, 20 nt, Mycobacterium leprae
gcucgguaagcuggcucggu

SEQ ID NO: 1240709 - RNA, 16 nt, Mycobacterium leprae
ggacagauucccgcug

SEQ ID NO: 1240710 - RNA, 17 nt, Mycobacterium leprae
ggacagcguaucucagc

SEQ ID NO: 1240711 - RNA, 20 nt, Mycobacterium leprae
ggaccacgcaaugucgccgg

SEQ ID NO: 1240712 - RNA, 19 nt, Mycobacterium leprae
ggaccacuauuucaaagcg

SEQ ID NO: 1240713 - RNA, 16 nt, Mycobacterium leprae
ggaccuuucccgcaga

SEQ ID NO: 1240714 - RNA, 23 nt, Mycobacterium leprae
ggaccgcaacugguugaccccgc

SEQ ID NO: 1240715 - RNA, 20 nt, Mycobacterium leprae
ggaccgggcguuucccuauc

SEQ ID NO: 1240716 - RNA, 13 nt, Mycobacterium leprae
cugccaugccagu

SEQ ID NO: 1240717 - RNA, 21 nt, Mycobacterium leprae
cugcccggacaagucagccua

SEQ ID NO: 1240718 - RNA, 23 nt, Mycobacterium leprae
cugcccgacgaggcggugaccga

SEQ ID NO: 1240719 - RNA, 16 nt, Mycobacterium leprae
cugcagguuguugacg

SEQ ID NO: 1240720 - RNA, 11 nt, Mycobacterium leprae
cugcaggucag

SEQ ID NO: 1240721 - RNA, 21 nt, Mycobacterium leprae
cugcaauccguggagagcaug

SEQ ID NO: 1240722 - RNA, 19 nt, Mycobacterium leprae
cugcaucgguaaccauaag

SEQ ID NO: 1240723 - RNA, 16 nt, Mycobacterium leprae
cugcgaucgcaaauau

SEQ ID NO: 1240724 - RNA, 23 nt, Mycobacterium leprae
cugcgcaauacggugcaccagcu

SEQ ID NO: 1240725 - RNA, 14 nt, Mycobacterium leprae
cugccgugugcuuc

SEQ ID NO: 1240726 - RNA, 19 nt, Mycobacterium leprae
cugccggugaccgggccgg

SEQ ID NO: 1240727 - RNA, 13 nt, Mycobacterium leprae
cugccgguagccu

SEQ ID NO: 1240728 - RNA, 18 nt, Mycobacterium leprae
cugcgcggcugccgcacc

SEQ ID NO: 1240729 - RNA, 16 nt, Mycobacterium leprae
cugcgcgcacccaagc

SEQ ID NO: 1240730 - RNA, 22 nt, Mycobacterium leprae
cugcguacggaccccgccacuc

SEQ ID NO: 1240731 - RNA, 23 nt, Mycobacterium leprae
cugcguacggaccccgccacuca

SEQ ID NO: 1240732 - RNA, 20 nt, Mycobacterium leprae
cugcgcuucuggcugggaca

SEQ ID NO: 1240733 - RNA, 21 nt, Mycobacterium leprae
cugcgcuucuggcugggacac

SEQ ID NO: 1240734 - RNA, 15 nt, Mycobacterium leprae
cugcggcucaccgac

SEQ ID NO: 1240735 - RNA, 14 nt, Mycobacterium leprae
cugcugcacccggc

SEQ ID NO: 1240736 - RNA, 14 nt, Mycobacterium leprae
cugcugcauguugu

SEQ ID NO: 1240737 - RNA, 17 nt, Mycobacterium leprae
cugcugcgcaagguugu

SEQ ID NO: 1240738 - RNA, 16 nt, Mycobacterium leprae
cugcuccugagacauc

SEQ ID NO: 1240739 - RNA, 22 nt, Mycobacterium leprae
cugcuccugagacaucgccacc

SEQ ID NO: 1240740 - RNA, 15 nt, Mycobacterium leprae
cuggcaugagccgac

SEQ ID NO: 1240741 - RNA, 19 nt, Mycobacterium leprae
cuggcaagugccgcgggug

SEQ ID NO: 1240742 - RNA, 22 nt, Mycobacterium leprae
cuggaugaccauaaugcagcgg

SEQ ID NO: 1240743 - RNA, 19 nt, Mycobacterium leprae
cuggaucacacucuguugg

SEQ ID NO: 1240744 - RNA, 21 nt, Mycobacterium leprae
cuggaucagcgcgccaaacac

SEQ ID NO: 1240745 - RNA, 18 nt, Mycobacterium leprae
cuggaaagaguuacuaua

SEQ ID NO: 1240746 - RNA, 15 nt, Mycobacterium leprae
cugcuggcccuguuc

SEQ ID NO: 1240747 - RNA, 11 nt, Mycobacterium leprae
cugcuggagau

SEQ ID NO: 1240748 - RNA, 13 nt, Mycobacterium leprae
cugcaagcccccu

SEQ ID NO: 1240749 - RNA, 18 nt, Mycobacterium leprae
cugcaagcccccucggcg

SEQ ID NO: 1240750 - RNA, 19 nt, Mycobacterium leprae
cugcaagcccccucggcga

SEQ ID NO: 1240751 - RNA, 17 nt, Mycobacterium leprae
cugcaacucaucggcuc

SEQ ID NO: 1240752 - RNA, 22 nt, Mycobacterium leprae
cugcaacucaucggcucccauc

SEQ ID NO: 1240753 - RNA, 15 nt, Mycobacterium leprae
cugaucuauuuauaa

SEQ ID NO: 1240754 - RNA, 20 nt, Mycobacterium leprae
cugauugaucggugacuugg

SEQ ID NO: 1240755 - RNA, 17 nt, Mycobacterium leprae
cugaucgggcugcggug

SEQ ID NO: 1240756 - RNA, 16 nt, Mycobacterium leprae
cugaucggucagcucg

SEQ ID NO: 1240757 - RNA, 14 nt, Mycobacterium leprae
cugaucgcucaccc

SEQ ID NO: 1240758 - RNA, 19 nt, Mycobacterium leprae
cugagugugaugccgaagc

SEQ ID NO: 1240759 - RNA, 15 nt, Mycobacterium leprae
cugagucggauuuau

SEQ ID NO: 1240760 - RNA, 17 nt, Mycobacterium leprae
cugagccgacaaucuca

SEQ ID NO: 1240761 - RNA, 15 nt, Mycobacterium leprae
cugauacaacuggaa

SEQ ID NO: 1240762 - RNA, 16 nt, Mycobacterium leprae
cugauacaacuggaag

SEQ ID NO: 1240763 - RNA, 21 nt, Mycobacterium leprae
cugauacugaugugcugagag

SEQ ID NO: 1240764 - RNA, 21 nt, Mycobacterium leprae
cugacccaagcgccagcucag

SEQ ID NO: 1240765 - RNA, 23 nt, Mycobacterium leprae
cugaccacucgcgacgauacuuc

SEQ ID NO: 1240766 - RNA, 15 nt, Mycobacterium leprae
cugagagugccaccg

SEQ ID NO: 1240767 - RNA, 16 nt, Mycobacterium leprae
cugaacgagaagcagc

SEQ ID NO: 1240768 - RNA, 17 nt, Mycobacterium leprae
cugaaaggaacgacgga

SEQ ID NO: 1240769 - RNA, 16 nt, Mycobacterium leprae
cugaacauuaguuccu

SEQ ID NO: 1240770 - RNA, 21 nt, Mycobacterium leprae
cucuggcuggucguguugcuu

SEQ ID NO: 1240771 - RNA, 23 nt, Mycobacterium leprae
cucugggccgauuuggcggucag

SEQ ID NO: 1240772 - RNA, 21 nt, Mycobacterium leprae
cucugggugguguggcccgac

SEQ ID NO: 1240773 - RNA, 17 nt, Mycobacterium leprae
cucuguucaucacccag

SEQ ID NO: 1240774 - RNA, 12 nt, Mycobacterium leprae
cucugguggcca

SEQ ID NO: 1240775 - RNA, 13 nt, Mycobacterium leprae
cucuucagacugg

SEQ ID NO: 1240776 - RNA, 19 nt, Mycobacterium leprae
cucuuaacaacuugacgau

SEQ ID NO: 1240777 - RNA, 18 nt, Mycobacterium leprae
cucuuccgccgcuacacu

SEQ ID NO: 1240778 - RNA, 14 nt, Mycobacterium leprae
cucuucgugcagca

SEQ ID NO: 1240779 - RNA, 14 nt, Mycobacterium leprae
cucuuguugaccaa

SEQ ID NO: 1240780 - RNA, 20 nt, Mycobacterium leprae
cucucugguaacggaccugg

SEQ ID NO: 1240781 - RNA, 14 nt, Mycobacterium leprae
cucuauaaaauuua

SEQ ID NO: 1240782 - RNA, 16 nt, Mycobacterium leprae
cucgucggccagcacu

SEQ ID NO: 1240783 - RNA, 20 nt, Mycobacterium leprae
cucgucggccagcacuugca

SEQ ID NO: 1240784 - RNA, 11 nt, Mycobacterium leprae
cucucaggccg

SEQ ID NO: 1240785 - RNA, 14 nt, Mycobacterium leprae
cucucaucgcggcu

SEQ ID NO: 1240786 - RNA, 23 nt, Mycobacterium leprae
cucuccauaagcgggugccgcgu

SEQ ID NO: 1240787 - RNA, 12 nt, Mycobacterium leprae
cucggugagaua

SEQ ID NO: 1240788 - RNA, 14 nt, Mycobacterium leprae
cucguccaggccug

SEQ ID NO: 1240789 - RNA, 21 nt, Mycobacterium leprae
cucggcgaaagucgcuacgau

SEQ ID NO: 1240790 - RNA, 18 nt, Mycobacterium leprae
cucggucugcuggacagu

SEQ ID NO: 1240791 - RNA, 19 nt, Mycobacterium leprae
cucggauaggugcaauccc

SEQ ID NO: 1240792 - RNA, 16 nt, Mycobacterium leprae
cucgcuugguugcggg

SEQ ID NO: 1240793 - RNA, 15 nt, Mycobacterium leprae
cucgcgucguugcgc

SEQ ID NO: 1240794 - RNA, 13 nt, Mycobacterium leprae
cucgaaagccucg

SEQ ID NO: 1240795 - RNA, 17 nt, Mycobacterium leprae
cuccuuuagcuugguug

SEQ ID NO: 1240796 - RNA, 20 nt, Mycobacterium leprae
cuccuucuuaucucaucguc

SEQ ID NO: 1240797 - RNA, 23 nt, Mycobacterium leprae
cucgacguugaugucccuggcga

SEQ ID NO: 1240798 - RNA, 13 nt, Mycobacterium leprae
cucgacauagaac

SEQ ID NO: 1240799 - RNA, 14 nt, Mycobacterium leprae
cucgacauagaaca

SEQ ID NO: 1240800 - RNA, 15 nt, Mycobacterium leprae
cucgagcgagcccag

SEQ ID NO: 1240801 - RNA, 21 nt, Mycobacterium leprae
cucgagcggcgcaugccaacc

SEQ ID NO: 1240802 - RNA, 20 nt, Mycobacterium leprae
cuccugagacaucgccaccg

SEQ ID NO: 1240803 - RNA, 22 nt, Mycobacterium leprae
cucaugcccgggauggcugggc

SEQ ID NO: 1240804 - RNA, 23 nt, Mycobacterium leprae
cuccagcucgcggugggcuucca

SEQ ID NO: 1240805 - RNA, 22 nt, Mycobacterium leprae
cucccacgacggugcggcuggc

SEQ ID NO: 1240806 - RNA, 17 nt, Mycobacterium leprae
cucccaaggaccggugc

SEQ ID NO: 1240807 - RNA, 22 nt, Mycobacterium leprae
cucccacaaguuguccgccccg

SEQ ID NO: 1240808 - RNA, 22 nt, Mycobacterium leprae
cucccugaacugguggcagcca

SEQ ID NO: 1240809 - RNA, 17 nt, Mycobacterium leprae
cucccgaaucgcuagcg

SEQ ID NO: 1240810 - RNA, 15 nt, Mycobacterium leprae
cucccuucuccgcaa

SEQ ID NO: 1240811 - RNA, 23 nt, Mycobacterium leprae
cucagugaucagguggagcaauu

SEQ ID NO: 1240812 - RNA, 18 nt, Mycobacterium leprae
cucagugacguguugguc

SEQ ID NO: 1240813 - RNA, 14 nt, Mycobacterium leprae
cucagucgaagaga

SEQ ID NO: 1240814 - RNA, 16 nt, Mycobacterium leprae
cucagugaagaccauc

SEQ ID NO: 1240815 - RNA, 12 nt, Mycobacterium leprae
cucagugaagug

SEQ ID NO: 1240816 - RNA, 20 nt, Mycobacterium leprae
cucagugaagugcucgggug

SEQ ID NO: 1240817 - RNA, 23 nt, Mycobacterium leprae
cucaguggcgggcuugaccugga

SEQ ID NO: 1240818 - RNA, 14 nt, Mycobacterium leprae
cucagugucagcag

SEQ ID NO: 1240819 - RNA, 16 nt, Mycobacterium leprae
cucagaucugauucag

SEQ ID NO: 1240820 - RNA, 16 nt, Mycobacterium leprae
cucagcaacuuuccug

SEQ ID NO: 1240821 - RNA, 16 nt, Mycobacterium leprae
cucaugaucgcaggca

SEQ ID NO: 1240822 - RNA, 15 nt, Mycobacterium leprae
cucaugacgggccgc

SEQ ID NO: 1240823 - RNA, 18 nt, Mycobacterium leprae
cucaucuugaccagugug

SEQ ID NO: 1240824 - RNA, 16 nt, Mycobacterium leprae
cucaucgcggcugcca

SEQ ID NO: 1240825 - RNA, 17 nt, Mycobacterium leprae
cucaucgcggcugccac

SEQ ID NO: 1240826 - RNA, 14 nt, Mycobacterium leprae
cucaucggcuccca

SEQ ID NO: 1240827 - RNA, 15 nt, Mycobacterium leprae
cucaacuaguacgcc

SEQ ID NO: 1240828 - RNA, 18 nt, Mycobacterium leprae
cucaacuaguacgccccc

SEQ ID NO: 1240829 - RNA, 16 nt, Mycobacterium leprae
cucaaccaugccgcgc

SEQ ID NO: 1240830 - RNA, 21 nt, Mycobacterium leprae
cucaagacuucaggaauucag

SEQ ID NO: 1240831 - RNA, 14 nt, Mycobacterium leprae
cucaaccgugcugu

SEQ ID NO: 1240832 - RNA, 17 nt, Mycobacterium leprae
cucaacauggaccaccg

SEQ ID NO: 1240833 - RNA, 20 nt, Mycobacterium leprae
cucaacauggaccaccguug

SEQ ID NO: 1240834 - RNA, 21 nt, Mycobacterium leprae
cucacguugucgaaaaaucag

SEQ ID NO: 1240835 - RNA, 21 nt, Mycobacterium leprae
cucaccgguacacaccgcaca

SEQ ID NO: 1240836 - RNA, 21 nt, Mycobacterium leprae
cucaccgcggccgacuauuag

SEQ ID NO: 1240837 - RNA, 20 nt, Mycobacterium leprae
cucaccgaaucguuccaccc

SEQ ID NO: 1240838 - RNA, 20 nt, Mycobacterium leprae
cucaccgacggaugcccagc

SEQ ID NO: 1240839 - RNA, 14 nt, Mycobacterium leprae
cucacccgcagcac

SEQ ID NO: 1240840 - RNA, 20 nt, Mycobacterium leprae
cucaccaaaucgacuacauc

SEQ ID NO: 1240841 - RNA, 13 nt, Mycobacterium leprae
cucacaggcagca

SEQ ID NO: 1240842 - RNA, 19 nt, Mycobacterium leprae
cucacagguaaacgagacc

SEQ ID NO: 1240843 - RNA, 22 nt, Mycobacterium leprae
cucacagguaaacgagaccagg

SEQ ID NO: 1240844 - RNA, 19 nt, Mycobacterium leprae
cuaucgacauccugaugcu

SEQ ID NO: 1240845 - RNA, 21 nt, Mycobacterium leprae
cuaugucacuucccaccgugg

SEQ ID NO: 1240846 - RNA, 16 nt, Mycobacterium leprae
cuaugcucaaccgugc

SEQ ID NO: 1240847 - RNA, 15 nt, Mycobacterium leprae
cuaugcggccagcca

SEQ ID NO: 1240848 - RNA, 18 nt, Mycobacterium leprae
cuagguaccccagucgag

SEQ ID NO: 1240849 - RNA, 22 nt, Mycobacterium leprae
cuaggggggcggugaacuaagc

SEQ ID NO: 1240850 - RNA, 23 nt, Mycobacterium leprae
cuaggcugaugcggucaugcguc

SEQ ID NO: 1240851 - RNA, 20 nt, Mycobacterium leprae
cuauaaucccacucuugacu

SEQ ID NO: 1240852 - RNA, 15 nt, Mycobacterium leprae
cuauauauauauuaa

SEQ ID NO: 1240853 - RNA, 14 nt, Mycobacterium leprae
cuauaucuauaguu

SEQ ID NO: 1240854 - RNA, 17 nt, Mycobacterium leprae
cuaucaacauuuguuga

SEQ ID NO: 1240855 - RNA, 14 nt, Mycobacterium leprae
cuagauaagauaaa

SEQ ID NO: 1240856 - RNA, 21 nt, Mycobacterium leprae
cuagagucgaccgccgaagca

SEQ ID NO: 1240857 - RNA, 23 nt, Mycobacterium leprae
cuagagucgaccgccgaagcagc

SEQ ID NO: 1240858 - RNA, 14 nt, Mycobacterium leprae
cuagaucaacagcg

SEQ ID NO: 1240859 - RNA, 14 nt, Mycobacterium leprae
cuacuuuucgugcu

SEQ ID NO: 1240860 - RNA, 18 nt, Mycobacterium leprae
cuagcugauuuggccgcc

SEQ ID NO: 1240861 - RNA, 21 nt, Mycobacterium leprae
cuagcugauuuggccgccauc

SEQ ID NO: 1240862 - RNA, 18 nt, Mycobacterium leprae
cuagcggccuaggacgcc

SEQ ID NO: 1240863 - RNA, 22 nt, Mycobacterium leprae
cuacgaaaaaugaguugcaaca

SEQ ID NO: 1240864 - RNA, 17 nt, Mycobacterium leprae
cuacgcagcucuggauc

SEQ ID NO: 1240865 - RNA, 22 nt, Mycobacterium leprae
cuacucguuucucauucucugc

SEQ ID NO: 1240866 - RNA, 20 nt, Mycobacterium leprae
cuacugcgacagcagccacu

SEQ ID NO: 1240867 - RNA, 11 nt, Mycobacterium leprae
cuacuggaugc

SEQ ID NO: 1240868 - RNA, 14 nt, Mycobacterium leprae
cguuucaugacgag

SEQ ID NO: 1240869 - RNA, 21 nt, Mycobacterium leprae
cuaaacugacgcugcgcugag

SEQ ID NO: 1240870 - RNA, 19 nt, Mycobacterium leprae
cuaaaugccauaucguucc

SEQ ID NO: 1240871 - RNA, 14 nt, Mycobacterium leprae
cuaaagucuucaau

SEQ ID NO: 1240872 - RNA, 16 nt, Mycobacterium leprae
cuaaagugcugcugug

SEQ ID NO: 1240873 - RNA, 13 nt, Mycobacterium leprae
cguuggccggcau

SEQ ID NO: 1240874 - RNA, 21 nt, Mycobacterium leprae
cguugcuaaaaccaccguaaa

SEQ ID NO: 1240875 - RNA, 14 nt, Mycobacterium leprae
cguuggcaucggac

SEQ ID NO: 1240876 - RNA, 19 nt, Mycobacterium leprae
cguuggaucccgacagcau

SEQ ID NO: 1240877 - RNA, 14 nt, Mycobacterium leprae
cguugacuauggcu

SEQ ID NO: 1240878 - RNA, 17 nt, Mycobacterium leprae
cguguugcuugcuguga

SEQ ID NO: 1240879 - RNA, 20 nt, Mycobacterium leprae
cguguugcuugcugugacca

SEQ ID NO: 1240880 - RNA, 13 nt, Mycobacterium leprae
cguguuugugucu

SEQ ID NO: 1240881 - RNA, 16 nt, Mycobacterium leprae
cguguuugugucugug

SEQ ID NO: 1240882 - RNA, 14 nt, Mycobacterium leprae
cgugugcuaugcuc

SEQ ID NO: 1240883 - RNA, 23 nt, Mycobacterium leprae
cgugugaacuugaaaccggccgc

SEQ ID NO: 1240884 - RNA, 23 nt, Mycobacterium leprae
cguggucaauguggccgcaccug

SEQ ID NO: 1240885 - RNA, 22 nt, Mycobacterium leprae
cguggucgagucgacagugucc

SEQ ID NO: 1240886 - RNA, 18 nt, Mycobacterium leprae
cguggucaccgcuguggc

SEQ ID NO: 1240887 - RNA, 18 nt, Mycobacterium leprae
cguggucggugccgaggc

SEQ ID NO: 1240888 - RNA, 13 nt, Mycobacterium leprae
cgugguggcuggc

SEQ ID NO: 1240889 - RNA, 17 nt, Mycobacterium leprae
cguggcgagugcugacg

SEQ ID NO: 1240890 - RNA, 17 nt, Mycobacterium leprae
cgugguaaggcaugacg

SEQ ID NO: 1240891 - RNA, 14 nt, Mycobacterium leprae
cgugggugugagga

SEQ ID NO: 1240892 - RNA, 18 nt, Mycobacterium leprae
cguggggggcagcccgga

SEQ ID NO: 1240893 - RNA, 18 nt, Mycobacterium leprae
cguggcuaggccaguguc

SEQ ID NO: 1240894 - RNA, 22 nt, Mycobacterium leprae
cgugaggugugaccgugcagcu

SEQ ID NO: 1240895 - RNA, 22 nt, Mycobacterium leprae
cgugaucgacaucguguggugu

SEQ ID NO: 1240896 - RNA, 14 nt, Mycobacterium leprae
cgugcaauguuaca

SEQ ID NO: 1240897 - RNA, 18 nt, Mycobacterium leprae
cgugcaucggguuauggu

SEQ ID NO: 1240898 - RNA, 20 nt, Mycobacterium leprae
cgugcaucggguuauggucc

SEQ ID NO: 1240899 - RNA, 18 nt, Mycobacterium leprae
cgugccaacacuuaucac

SEQ ID NO: 1240900 - RNA, 21 nt, Mycobacterium leprae
cgugcggucaaaggcuguccu

SEQ ID NO: 1240901 - RNA, 16 nt, Mycobacterium leprae
cgugcggcgcccaccu

SEQ ID NO: 1240902 - RNA, 20 nt, Mycobacterium leprae
cgugcgucauggcacugggc

SEQ ID NO: 1240903 - RNA, 12 nt, Mycobacterium leprae
cgugcggcggcc

SEQ ID NO: 1240904 - RNA, 15 nt, Mycobacterium leprae
cgugacgcgggcgcc

SEQ ID NO: 1240905 - RNA, 19 nt, Mycobacterium leprae
cgugacgcgggcgccgcag

SEQ ID NO: 1240906 - RNA, 14 nt, Mycobacterium leprae
cgucuuccaaacuu

SEQ ID NO: 1240907 - RNA, 18 nt, Mycobacterium leprae
cguaacucuauaaaauuu

SEQ ID NO: 1240908 - RNA, 12 nt, Mycobacterium leprae
cgguucaacggg

SEQ ID NO: 1240909 - RNA, 19 nt, Mycobacterium leprae
cgguuaguccgaccgcauc

SEQ ID NO: 1240910 - RNA, 23 nt, Mycobacterium leprae
cgguugguuucauaggugguggg

SEQ ID NO: 1240911 - RNA, 19 nt, Mycobacterium leprae
cggugccaggcagcugugc

SEQ ID NO: 1240912 - RNA, 21 nt, Mycobacterium leprae
cggugaucgcugccggcggca

SEQ ID NO: 1240913 - RNA, 21 nt, Mycobacterium leprae
cggugccgccauugcccccgc

SEQ ID NO: 1240914 - RNA, 19 nt, Mycobacterium leprae
cggugccgaggcucugcuc

SEQ ID NO: 1240915 - RNA, 18 nt, Mycobacterium leprae
cgguguauggcgugacgg

SEQ ID NO: 1240916 - RNA, 16 nt, Mycobacterium leprae
cgguguuccgcccagu

SEQ ID NO: 1240917 - RNA, 15 nt, Mycobacterium leprae
cgguguucgcuccgc

SEQ ID NO: 1240918 - RNA, 22 nt, Mycobacterium leprae
cgguguucgcuccgcccacuaa

SEQ ID NO: 1240919 - RNA, 16 nt, Mycobacterium leprae
cgguguuagcaugcuu

SEQ ID NO: 1240920 - RNA, 15 nt, Mycobacterium leprae
cgguguccaaaugcg

SEQ ID NO: 1240921 - RNA, 18 nt, Mycobacterium leprae
cggugguacaaucccacc

SEQ ID NO: 1240922 - RNA, 21 nt, Mycobacterium leprae
cggugguacaaucccaccacc

SEQ ID NO: 1240923 - RNA, 13 nt, Mycobacterium leprae
cggugggugcaca

SEQ ID NO: 1240924 - RNA, 13 nt, Mycobacterium leprae
cgguggcaccagu

SEQ ID NO: 1240925 - RNA, 14 nt, Mycobacterium leprae
cguagcgucggcgg

SEQ ID NO: 1240926 - RNA, 18 nt, Mycobacterium leprae
cguagcgucggcggucag

SEQ ID NO: 1240927 - RNA, 20 nt, Mycobacterium leprae
cguaaucaagaucggccagc

SEQ ID NO: 1240928 - RNA, 15 nt, Mycobacterium leprae
cguaagucagaugga

SEQ ID NO: 1240929 - RNA, 16 nt, Mycobacterium leprae
cguaugccgccaaaau

SEQ ID NO: 1240930 - RNA, 23 nt, Mycobacterium leprae
cguaguguagcugcagcgacugg

SEQ ID NO: 1240931 - RNA, 23 nt, Mycobacterium leprae
cgucaagcucaaucgcaacccuu

SEQ ID NO: 1240932 - RNA, 19 nt, Mycobacterium leprae
cgucacgcugcucgagcag

SEQ ID NO: 1240933 - RNA, 19 nt, Mycobacterium leprae
cgucacggucgacuucgca

SEQ ID NO: 1240934 - RNA, 14 nt, Mycobacterium leprae
cguccgcggcggcc

SEQ ID NO: 1240935 - RNA, 12 nt, Mycobacterium leprae
cguccgcggcgg

SEQ ID NO: 1240936 - RNA, 14 nt, Mycobacterium leprae
cguccgcggcagcu

SEQ ID NO: 1240937 - RNA, 18 nt, Mycobacterium leprae
cguccucggcccaugggg

SEQ ID NO: 1240938 - RNA, 18 nt, Mycobacterium leprae
cguccauuuucguggcga

SEQ ID NO: 1240939 - RNA, 14 nt, Mycobacterium leprae
cgucaucagauuca

SEQ ID NO: 1240940 - RNA, 15 nt, Mycobacterium leprae
cgucgaauucccagg

SEQ ID NO: 1240941 - RNA, 18 nt, Mycobacterium leprae
cgucgacaucaugaaauc

SEQ ID NO: 1240942 - RNA, 13 nt, Mycobacterium leprae
cguccuguguguc

SEQ ID NO: 1240943 - RNA, 15 nt, Mycobacterium leprae
cguccugccggugcg

SEQ ID NO: 1240944 - RNA, 15 nt, Mycobacterium leprae
cguccucgucgguga

SEQ ID NO: 1240945 - RNA, 16 nt, Mycobacterium leprae
cgucgauggccgccuu

SEQ ID NO: 1240946 - RNA, 18 nt, Mycobacterium leprae
cgggcuuggccucgaggu

SEQ ID NO: 1240947 - RNA, 16 nt, Mycobacterium leprae
cgggcuugaccuggau

SEQ ID NO: 1240948 - RNA, 12 nt, Mycobacterium leprae
cgggcuggagga

SEQ ID NO: 1240949 - RNA, 16 nt, Mycobacterium leprae
cgggcugcaccgagcg

SEQ ID NO: 1240950 - RNA, 15 nt, Mycobacterium leprae
cgggcugcggugacg

SEQ ID NO: 1240951 - RNA, 21 nt, Mycobacterium leprae
cggggcaggccugaucuccaa

SEQ ID NO: 1240952 - RNA, 18 nt, Mycobacterium leprae
cggggauguuggcgccug

SEQ ID NO: 1240953 - RNA, 19 nt, Mycobacterium leprae
cggggauguuggcgccugc

SEQ ID NO: 1240954 - RNA, 18 nt, Mycobacterium leprae
cggggaugguuuccaggg

SEQ ID NO: 1240955 - RNA, 13 nt, Mycobacterium leprae
cgggguaggggcg

SEQ ID NO: 1240956 - RNA, 19 nt, Mycobacterium leprae
cgggguacaauaaacuggc

SEQ ID NO: 1240957 - RNA, 17 nt, Mycobacterium leprae
cggggugggcagccugg

SEQ ID NO: 1240958 - RNA, 15 nt, Mycobacterium leprae
cggguugcuuugggg

SEQ ID NO: 1240959 - RNA, 17 nt, Mycobacterium leprae
cgggugcgcugcugacg

SEQ ID NO: 1240960 - RNA, 13 nt, Mycobacterium leprae
cgggugcgcagca

SEQ ID NO: 1240961 - RNA, 14 nt, Mycobacterium leprae
cgggugggucgaug

SEQ ID NO: 1240962 - RNA, 16 nt, Mycobacterium leprae
cgggugaacgccaggc

SEQ ID NO: 1240963 - RNA, 16 nt, Mycobacterium leprae
cgggugcagcaguauc

SEQ ID NO: 1240964 - RNA, 20 nt, Mycobacterium leprae
cgggugaugaucacccgcgg

SEQ ID NO: 1240965 - RNA, 16 nt, Mycobacterium leprae
cgggucacgcucaaca

SEQ ID NO: 1240966 - RNA, 20 nt, Mycobacterium leprae
aaacuacuguugucaguggc

SEQ ID NO: 1240967 - RNA, 19 nt, Mycobacterium leprae
cggucaccggaucaugccc

SEQ ID NO: 1240968 - RNA, 18 nt, Mycobacterium leprae
cggucaacaagccgccga

SEQ ID NO: 1240969 - RNA, 14 nt, Mycobacterium leprae
cggucaaaggcauc

SEQ ID NO: 1240970 - RNA, 15 nt, Mycobacterium leprae
cggucaacggccuca

SEQ ID NO: 1240971 - RNA, 16 nt, Mycobacterium leprae
cggucacagagcugug

SEQ ID NO: 1240972 - RNA, 16 nt, Mycobacterium leprae
cgguaguuggcuaagg

SEQ ID NO: 1240973 - RNA, 19 nt, Mycobacterium leprae
cgguaguuccgcgcugaau

SEQ ID NO: 1240974 - RNA, 16 nt, Mycobacterium leprae
cgguaucgucaaauuu

SEQ ID NO: 1240975 - RNA, 12 nt, Mycobacterium leprae
cgguaucucccc

SEQ ID NO: 1240976 - RNA, 18 nt, Mycobacterium leprae
cgguagcguggaccguac

SEQ ID NO: 1240977 - RNA, 15 nt, Mycobacterium leprae
cgguacgcugcauga

SEQ ID NO: 1240978 - RNA, 16 nt, Mycobacterium leprae
cgguacgcugcaugau

SEQ ID NO: 1240979 - RNA, 22 nt, Mycobacterium leprae
cgguaccugugggucaccacug

SEQ ID NO: 1240980 - RNA, 15 nt, Mycobacterium leprae
cgguacgaggugaca

SEQ ID NO: 1240981 - RNA, 16 nt, Mycobacterium leprae
cgguaccagcggcagc

SEQ ID NO: 1240982 - RNA, 18 nt, Mycobacterium leprae
cgguaauaguugccuauc

SEQ ID NO: 1240983 - RNA, 19 nt, Mycobacterium leprae
cgguaaguuuucagccaca

SEQ ID NO: 1240984 - RNA, 22 nt, Mycobacterium leprae
cgguaacggcgguggcagccgc

SEQ ID NO: 1240985 - RNA, 15 nt, Mycobacterium leprae
cgguccaggccaccg

SEQ ID NO: 1240986 - RNA, 16 nt, Mycobacterium leprae
cggucgaucgcagccg

SEQ ID NO: 1240987 - RNA, 14 nt, Mycobacterium leprae
cggucgccgaugcg

SEQ ID NO: 1240988 - RNA, 17 nt, Mycobacterium leprae
cggucggaguucuucac

SEQ ID NO: 1240989 - RNA, 17 nt, Mycobacterium leprae
cgguccuguccaggugc

SEQ ID NO: 1240990 - RNA, 19 nt, Mycobacterium leprae
cggugacgcuaccgaggaa

SEQ ID NO: 1240991 - RNA, 18 nt, Mycobacterium leprae
cggugacgaacaugcagu

SEQ ID NO: 1240992 - RNA, 24 nt, Mycobacterium leprae
cggugaaaauauccaccauacagc

SEQ ID NO: 1240993 - RNA, 12 nt, Mycobacterium leprae
cggucuuagcaa

SEQ ID NO: 1240994 - RNA, 11 nt, Mycobacterium leprae
cggucgguaaa

SEQ ID NO: 1240995 - RNA, 17 nt, Mycobacterium leprae
cgggaugugugcgcgcc

SEQ ID NO: 1240996 - RNA, 14 nt, Mycobacterium leprae
cgggcaagcccugc

SEQ ID NO: 1240997 - RNA, 16 nt, Mycobacterium leprae
cgggagaucuugccau

SEQ ID NO: 1240998 - RNA, 21 nt, Mycobacterium leprae
cgggacgugcacugguggugg

SEQ ID NO: 1240999 - RNA, 17 nt, Mycobacterium leprae
cgggaccgggcgcgcgc

SEQ ID NO: 1241000 - RNA, 18 nt, Mycobacterium leprae
cgggauaggucaguucuc

SEQ ID NO: 1241001 - RNA, 17 nt, Mycobacterium leprae
cgggaggccuuaagcug

SEQ ID NO: 1241002 - RNA, 22 nt, Mycobacterium leprae
cgggaugccgaaacgcugagga

SEQ ID NO: 1241003 - RNA, 18 nt, Mycobacterium leprae
cgggauggcugggcaagc

SEQ ID NO: 1241004 - RNA, 14 nt, Mycobacterium leprae
cgggcgaacuggac

SEQ ID NO: 1241005 - RNA, 12 nt, Mycobacterium leprae
cgggcggcagcc

SEQ ID NO: 1241006 - RNA, 13 nt, Mycobacterium leprae
cgggccggccgcg

SEQ ID NO: 1241007 - RNA, 21 nt, Mycobacterium leprae
cggcuaugcucaaccgugcug

SEQ ID NO: 1241008 - RNA, 17 nt, Mycobacterium leprae
cggcuaccgaguugucc

SEQ ID NO: 1241009 - RNA, 17 nt, Mycobacterium leprae
cggcuacugcgacagca

SEQ ID NO: 1241010 - RNA, 17 nt, Mycobacterium leprae
cggcguucgauaagaag

SEQ ID NO: 1241011 - RNA, 17 nt, Mycobacterium leprae
cggcguucaauaagaaa

SEQ ID NO: 1241012 - RNA, 16 nt, Mycobacterium leprae
cggcgucgguggcagc

SEQ ID NO: 1241013 - RNA, 19 nt, Mycobacterium leprae
cggcuugauguccaagggg

SEQ ID NO: 1241014 - RNA, 18 nt, Mycobacterium leprae
cggcugucagagugcaga

SEQ ID NO: 1241015 - RNA, 23 nt, Mycobacterium leprae
cggcuucauucuuguguccauaa

SEQ ID NO: 1241016 - RNA, 21 nt, Mycobacterium leprae
cggcugacuucgucagacgaa

SEQ ID NO: 1241017 - RNA, 17 nt, Mycobacterium leprae
cggcugccacuguguca

SEQ ID NO: 1241018 - RNA, 16 nt, Mycobacterium leprae
cggcugaaaggaacga

SEQ ID NO: 1241019 - RNA, 16 nt, Mycobacterium leprae
cggcuccuccagcauc

SEQ ID NO: 1241020 - RNA, 15 nt, Mycobacterium leprae
cuucaauccgcgcau

SEQ ID NO: 1241021 - RNA, 21 nt, Mycobacterium leprae
cuucaggucuacucgccugau

SEQ ID NO: 1241022 - RNA, 12 nt, Mycobacterium leprae
cuucaggcaaca

SEQ ID NO: 1241023 - RNA, 13 nt, Mycobacterium leprae
cuucagcacagcc

SEQ ID NO: 1241024 - RNA, 13 nt, Mycobacterium leprae
cuucagucaggca

SEQ ID NO: 1241025 - RNA, 14 nt, Mycobacterium leprae
cuucaucaacugag

SEQ ID NO: 1241026 - RNA, 13 nt, Mycobacterium leprae
cuucaucagugug

SEQ ID NO: 1241027 - RNA, 19 nt, Mycobacterium leprae
cuucauuggcuagccagac

SEQ ID NO: 1241028 - RNA, 14 nt, Mycobacterium leprae
cuuccugcuggccc

SEQ ID NO: 1241029 - RNA, 15 nt, Mycobacterium leprae
cuuccguacgccgcu

SEQ ID NO: 1241030 - RNA, 19 nt, Mycobacterium leprae
cuuccuaugucgugcugac

SEQ ID NO: 1241031 - RNA, 15 nt, Mycobacterium leprae
cuuccuacggcuucc

SEQ ID NO: 1241032 - RNA, 23 nt, Mycobacterium leprae
cuucggucaugagcgucgcuccu

SEQ ID NO: 1241033 - RNA, 15 nt, Mycobacterium leprae
cuuccaguggcugca

SEQ ID NO: 1241034 - RNA, 21 nt, Mycobacterium leprae
cuuagcaacguguaaggccag

SEQ ID NO: 1241035 - RNA, 14 nt, Mycobacterium leprae
cuuaugcgugcuga

SEQ ID NO: 1241036 - RNA, 15 nt, Mycobacterium leprae
cuuaccucaguguca

SEQ ID NO: 1241037 - RNA, 13 nt, Mycobacterium leprae
cuuacgaucucag

SEQ ID NO: 1241038 - RNA, 16 nt, Mycobacterium leprae
cuuagauuggaaggca

SEQ ID NO: 1241039 - RNA, 17 nt, Mycobacterium leprae
cuuaaucgagccacuua

SEQ ID NO: 1241040 - RNA, 22 nt, Mycobacterium leprae
cuuaaucgagccacuuaaguua

SEQ ID NO: 1241041 - RNA, 20 nt, Mycobacterium leprae
cuuaacgcucacagcagucc

SEQ ID NO: 1241042 - RNA, 14 nt, Mycobacterium leprae
cuuaauaucuuuuu

SEQ ID NO: 1241043 - RNA, 19 nt, Mycobacterium leprae
cuuaacaacuugacgaugc

SEQ ID NO: 1241044 - RNA, 17 nt, Mycobacterium leprae
cuguugucaccccagac

SEQ ID NO: 1241045 - RNA, 19 nt, Mycobacterium leprae
cuguucgaucuaguuuugu

SEQ ID NO: 1241046 - RNA, 16 nt, Mycobacterium leprae
cuguuagaucuugagu

SEQ ID NO: 1241047 - RNA, 14 nt, Mycobacterium leprae
cuguuauauagugc

SEQ ID NO: 1241048 - RNA, 15 nt, Mycobacterium leprae
cuguuaugugguugu

SEQ ID NO: 1241049 - RNA, 13 nt, Mycobacterium leprae
cuggccccgucgu

SEQ ID NO: 1241050 - RNA, 17 nt, Mycobacterium leprae
cuggcccauccgggcca

SEQ ID NO: 1241051 - RNA, 16 nt, Mycobacterium leprae
cuugcugccacauguu

SEQ ID NO: 1241052 - RNA, 15 nt, Mycobacterium leprae
cuugcggcgccccuc

SEQ ID NO: 1241053 - RNA, 14 nt, Mycobacterium leprae
cuugcguagaauua

SEQ ID NO: 1241054 - RNA, 20 nt, Mycobacterium leprae
cuugccgaacguaccaccgc

SEQ ID NO: 1241055 - RNA, 21 nt, Mycobacterium leprae
cuugccggccuuaaugcagga

SEQ ID NO: 1241056 - RNA, 22 nt, Mycobacterium leprae
cuugccggccuuaaugcaggag

SEQ ID NO: 1241057 - RNA, 19 nt, Mycobacterium leprae
cuugccgcuccgcgcacag

SEQ ID NO: 1241058 - RNA, 19 nt, Mycobacterium leprae
cuugcacugaucgaucugg

SEQ ID NO: 1241059 - RNA, 16 nt, Mycobacterium leprae
cuugcagcacucauug

SEQ ID NO: 1241060 - RNA, 13 nt, Mycobacterium leprae
cuugcagcuggcg

SEQ ID NO: 1241061 - RNA, 22 nt, Mycobacterium leprae
cuugccaaggucguuagcgccg

SEQ ID NO: 1241062 - RNA, 19 nt, Mycobacterium leprae
cuugauugcugcaucugaa

SEQ ID NO: 1241063 - RNA, 13 nt, Mycobacterium leprae
cuugaccugccgu

SEQ ID NO: 1241064 - RNA, 16 nt, Mycobacterium leprae
cuugaccugccguccc

SEQ ID NO: 1241065 - RNA, 12 nt, Mycobacterium leprae
cuugaccuggau

SEQ ID NO: 1241066 - RNA, 19 nt, Mycobacterium leprae
cuugagcacccgcccaagc

SEQ ID NO: 1241067 - RNA, 20 nt, Mycobacterium leprae
cuugagucuuggacaucacu

SEQ ID NO: 1241068 - RNA, 16 nt, Mycobacterium leprae
cuugagugcugccagg

SEQ ID NO: 1241069 - RNA, 20 nt, Mycobacterium leprae
cuugagugcugccagggcuc

SEQ ID NO: 1241070 - RNA, 14 nt, Mycobacterium leprae
cuugaguguagcag

SEQ ID NO: 1241071 - RNA, 15 nt, Mycobacterium leprae
cuugaucgaccucga

SEQ ID NO: 1241072 - RNA, 20 nt, Mycobacterium leprae
cuugauccgagaaaacucga

SEQ ID NO: 1241073 - RNA, 18 nt, Mycobacterium leprae
cuugauauucaagucaca

SEQ ID NO: 1241074 - RNA, 19 nt, Mycobacterium leprae
cuucuuuuaucaagggauu

SEQ ID NO: 1241075 - RNA, 20 nt, Mycobacterium leprae
cuugaagccgccaaaauuuu

SEQ ID NO: 1241076 - RNA, 18 nt, Mycobacterium leprae
cuugaccagccgcagcac

SEQ ID NO: 1241077 - RNA, 22 nt, Mycobacterium leprae
cuugaccagugugccugucaca

SEQ ID NO: 1241078 - RNA, 15 nt, Mycobacterium leprae
cuucuucgauuacgu

SEQ ID NO: 1241079 - RNA, 14 nt, Mycobacterium leprae
cuucuuacacgugc

SEQ ID NO: 1241080 - RNA, 20 nt, Mycobacterium leprae
cuucgucagcuggaaucccc

SEQ ID NO: 1241081 - RNA, 23 nt, Mycobacterium leprae
cuucgguugggacagaagugguu

SEQ ID NO: 1241082 - RNA, 18 nt, Mycobacterium leprae
cuucuaaccggucaauca

SEQ ID NO: 1241083 - RNA, 16 nt, Mycobacterium leprae
cuucuccgggcuggga

SEQ ID NO: 1241084 - RNA, 20 nt, Mycobacterium leprae
cuucucggggcgaugaaauc

SEQ ID NO: 1241085 - RNA, 16 nt, Mycobacterium leprae
cuucuccguucacagu

SEQ ID NO: 1241086 - RNA, 23 nt, Mycobacterium leprae
cuucuggauuuugggugaucaac

SEQ ID NO: 1241087 - RNA, 15 nt, Mycobacterium leprae
aaagaauuuaccggc

SEQ ID NO: 1241088 - RNA, 23 nt, Mycobacterium leprae
aaagaaguuugucguacccaaua

SEQ ID NO: 1241089 - RNA, 21 nt, Mycobacterium leprae
cuuuacgugcguaagguggcc

SEQ ID NO: 1241090 - RNA, 15 nt, Mycobacterium leprae
cuuucacgccaggcg

SEQ ID NO: 1241091 - RNA, 15 nt, Mycobacterium leprae
cuuuccagccacggc

SEQ ID NO: 1241092 - RNA, 13 nt, Mycobacterium leprae
cuuucggcagcga

SEQ ID NO: 1241093 - RNA, 20 nt, Mycobacterium leprae
cuuucgcagaagaccgugcu

SEQ ID NO: 1241094 - RNA, 22 nt, Mycobacterium leprae
cuuugcuucacuuagccauguc

SEQ ID NO: 1241095 - RNA, 16 nt, Mycobacterium leprae
cuuugccgcugugaua

SEQ ID NO: 1241096 - RNA, 17 nt, Mycobacterium leprae
cuuggcagugugcaugu

SEQ ID NO: 1241097 - RNA, 18 nt, Mycobacterium leprae
cuuggcugguuaacuuaa

SEQ ID NO: 1241098 - RNA, 13 nt, Mycobacterium leprae
cuuggcugacggc

SEQ ID NO: 1241099 - RNA, 20 nt, Mycobacterium leprae
cuuggcgucgaucagggcgc

SEQ ID NO: 1241100 - RNA, 16 nt, Mycobacterium leprae
cuuggcgcugagcagu

SEQ ID NO: 1241101 - RNA, 16 nt, Mycobacterium leprae
cuuguaguagcagguc

SEQ ID NO: 1241102 - RNA, 22 nt, Mycobacterium leprae
cuuguagcguucguagagcugc

SEQ ID NO: 1241103 - RNA, 17 nt, Mycobacterium leprae
cuugucagguaucucua

SEQ ID NO: 1241104 - RNA, 18 nt, Mycobacterium leprae
cuuggugcccacgagggg

SEQ ID NO: 1241105 - RNA, 22 nt, Mycobacterium leprae
cuugguccgacggcuggcugcu

SEQ ID NO: 1241106 - RNA, 16 nt, Mycobacterium leprae
cuuggugcgggcacac

SEQ ID NO: 1241107 - RNA, 23 nt, Mycobacterium leprae
cuuggugcgggcacacagauccu

SEQ ID NO: 1241108 - RNA, 18 nt, Mycobacterium leprae
cuugguugacagcagaau

SEQ ID NO: 1241109 - RNA, 17 nt, Mycobacterium leprae
cuuggguaacaauccug

SEQ ID NO: 1241110 - RNA, 13 nt, Mycobacterium leprae
cuugggugguggu

SEQ ID NO: 1241111 - RNA, 15 nt, Mycobacterium leprae
cuugggucaccgccu

SEQ ID NO: 1241112 - RNA, 19 nt, Mycobacterium leprae
cuuggggacgccggcggcc

SEQ ID NO: 1241113 - RNA, 19 nt, Mycobacterium leprae
cuuggucaaggugaaacuc

SEQ ID NO: 1241114 - RNA, 21 nt, Mycobacterium leprae
cuugucgauguugguguggcg

SEQ ID NO: 1241115 - RNA, 21 nt, Mycobacterium leprae
cuuguuuggucacaccuggug

SEQ ID NO: 1241116 - RNA, 16 nt, Mycobacterium leprae
cuuguucuuguuggcu

SEQ ID NO: 1241117 - RNA, 23 nt, Mycobacterium leprae
aaagaacgcgaccuguuggugag

SEQ ID NO: 1241118 - RNA, 13 nt, Mycobacterium leprae
cuuuugauuggug

SEQ ID NO: 1241119 - RNA, 19 nt, Mycobacterium leprae
cuuuuugugaacauaucca

SEQ ID NO: 1241120 - RNA, 14 nt, Mycobacterium leprae
gaaaaagaaagcuc

SEQ ID NO: 1241121 - RNA, 17 nt, Mycobacterium leprae
gaaaaacggcuggcugu

SEQ ID NO: 1241122 - RNA, 16 nt, Mycobacterium leprae
gaaaccaagccaauua

SEQ ID NO: 1241123 - RNA, 22 nt, Mycobacterium leprae
gaaacagggccgaagcagccgg

SEQ ID NO: 1241124 - RNA, 22 nt, Mycobacterium leprae
gaaaauauccaccauacagcua

SEQ ID NO: 1241125 - RNA, 22 nt, Mycobacterium leprae
gaaaagucguggagcaccucag

SEQ ID NO: 1241126 - RNA, 13 nt, Mycobacterium leprae
gaaagaauuuacc

SEQ ID NO: 1241127 - RNA, 14 nt, Mycobacterium leprae
gaaagaauuuaccg

SEQ ID NO: 1241128 - RNA, 21 nt, Mycobacterium leprae
gaacacccuggaauccgcgca

SEQ ID NO: 1241129 - RNA, 19 nt, Mycobacterium leprae
gaacaagaaaaggacccac

SEQ ID NO: 1241130 - RNA, 20 nt, Mycobacterium leprae
gaacaaccgguaaacagugc

SEQ ID NO: 1241131 - RNA, 22 nt, Mycobacterium leprae
gaacaaccgguaaacagugcca

SEQ ID NO: 1241132 - RNA, 12 nt, Mycobacterium leprae
gaacaacagaca

SEQ ID NO: 1241133 - RNA, 16 nt, Mycobacterium leprae
gaacaacagagcaagc

SEQ ID NO: 1241134 - RNA, 17 nt, Mycobacterium leprae
gaaaucguccaggguga

SEQ ID NO: 1241135 - RNA, 17 nt, Mycobacterium leprae
gaaauggcuguuuuugc

SEQ ID NO: 1241136 - RNA, 23 nt, Mycobacterium leprae
gauauccuaggccacugggcuga

SEQ ID NO: 1241137 - RNA, 14 nt, Mycobacterium leprae
gaucaauggcagcc

SEQ ID NO: 1241138 - RNA, 19 nt, Mycobacterium leprae
gauauugcggcauugcggc

SEQ ID NO: 1241139 - RNA, 23 nt, Mycobacterium leprae
gauagcgaccaucgaaacugcca

SEQ ID NO: 1241140 - RNA, 15 nt, Mycobacterium leprae
gauagcguuaggcgc

SEQ ID NO: 1241141 - RNA, 13 nt, Mycobacterium leprae
gauaucaauccau

SEQ ID NO: 1241142 - RNA, 17 nt, Mycobacterium leprae
gauaccgggcucgguga

SEQ ID NO: 1241143 - RNA, 22 nt, Mycobacterium leprae
gauaaugccgguggccagcgca

SEQ ID NO: 1241144 - RNA, 13 nt, Mycobacterium leprae
gauaccagcggca

SEQ ID NO: 1241145 - RNA, 14 nt, Mycobacterium leprae
gauaauuuggcuga

SEQ ID NO: 1241146 - RNA, 21 nt, Mycobacterium leprae
gauaauuuggcugauaauauc

SEQ ID NO: 1241147 - RNA, 13 nt, Mycobacterium leprae
gaguuggccgcgg

SEQ ID NO: 1241148 - RNA, 14 nt, Mycobacterium leprae
gauaaagcuuagaa

SEQ ID NO: 1241149 - RNA, 11 nt, Mycobacterium leprae
gagugcugacg

SEQ ID NO: 1241150 - RNA, 13 nt, Mycobacterium leprae
gaguugacccaca

SEQ ID NO: 1241151 - RNA, 16 nt, Mycobacterium leprae
gaguucaacaaaacca

SEQ ID NO: 1241152 - RNA, 15 nt, Mycobacterium leprae
gagucaugauccagc

SEQ ID NO: 1241153 - RNA, 18 nt, Mycobacterium leprae
gaguccagguuugcgguc

SEQ ID NO: 1241154 - RNA, 17 nt, Mycobacterium leprae
gagucccucagcggcau

SEQ ID NO: 1241155 - RNA, 18 nt, Mycobacterium leprae
gaguccgcuaaggcagcc

SEQ ID NO: 1241156 - RNA, 20 nt, Mycobacterium leprae
gaguccgcuaaggcagcccg

SEQ ID NO: 1241157 - RNA, 19 nt, Mycobacterium leprae
gaguccggcgccaacugga

SEQ ID NO: 1241158 - RNA, 14 nt, Mycobacterium leprae
gaguccggcgugga

SEQ ID NO: 1241159 - RNA, 15 nt, Mycobacterium leprae
gagguuaccagcgcc

SEQ ID NO: 1241160 - RNA, 21 nt, Mycobacterium leprae
gagguguucgggauccuggcc

SEQ ID NO: 1241161 - RNA, 15 nt, Mycobacterium leprae
gagcuggcugugccc

SEQ ID NO: 1241162 - RNA, 20 nt, Mycobacterium leprae
gagcgacaucgauacacuuu

SEQ ID NO: 1241163 - RNA, 17 nt, Mycobacterium leprae
gaggaccaccugguaga

SEQ ID NO: 1241164 - RNA, 13 nt, Mycobacterium leprae
gaggaccgccaug

SEQ ID NO: 1241165 - RNA, 19 nt, Mycobacterium leprae
gaggaucucuacggcgugu

SEQ ID NO: 1241166 - RNA, 18 nt, Mycobacterium leprae
gaggauuugcuggcugcc

SEQ ID NO: 1241167 - RNA, 18 nt, Mycobacterium leprae
gagggacgcaaaggccaa

SEQ ID NO: 1241168 - RNA, 16 nt, Mycobacterium leprae
gaggcuucgugugcuu

SEQ ID NO: 1241169 - RNA, 15 nt, Mycobacterium leprae
gaggcagggcugggg

SEQ ID NO: 1241170 - RNA, 23 nt, Mycobacterium leprae
gaggugcuggaugccgggaagcg

SEQ ID NO: 1241171 - RNA, 14 nt, Mycobacterium leprae
gagguggcagcugg

SEQ ID NO: 1241172 - RNA, 19 nt, Mycobacterium leprae
gaggugcaggagcgugggu

SEQ ID NO: 1241173 - RNA, 21 nt, Mycobacterium leprae
gagcaugaccgagcuggcgcc

SEQ ID NO: 1241174 - RNA, 19 nt, Mycobacterium leprae
gagccuguuguugugccuu

SEQ ID NO: 1241175 - RNA, 21 nt, Mycobacterium leprae
gagccggucgaucgcagccgc

SEQ ID NO: 1241176 - RNA, 12 nt, Mycobacterium leprae
gagcccagugug

SEQ ID NO: 1241177 - RNA, 20 nt, Mycobacterium leprae
gagcacuucgguaacgcuga

SEQ ID NO: 1241178 - RNA, 18 nt, Mycobacterium leprae
gagcacuccuucaugcug

SEQ ID NO: 1241179 - RNA, 17 nt, Mycobacterium leprae
gagcacuagcuugugcu

SEQ ID NO: 1241180 - RNA, 17 nt, Mycobacterium leprae
gagauggucacauucca

SEQ ID NO: 1241181 - RNA, 19 nt, Mycobacterium leprae
gagauagacaugugugcug

SEQ ID NO: 1241182 - RNA, 21 nt, Mycobacterium leprae
gagaucaacguuuugccgagc

SEQ ID NO: 1241183 - RNA, 11 nt, Mycobacterium leprae
gagagcaaucc

SEQ ID NO: 1241184 - RNA, 15 nt, Mycobacterium leprae
gagagccacuucaga

SEQ ID NO: 1241185 - RNA, 19 nt, Mycobacterium leprae
gagagcauggacccacugg

SEQ ID NO: 1241186 - RNA, 12 nt, Mycobacterium leprae
gagagccgagcg

SEQ ID NO: 1241187 - RNA, 15 nt, Mycobacterium leprae
gagacguaccacuca

SEQ ID NO: 1241188 - RNA, 20 nt, Mycobacterium leprae
gagacgugucucuucgcugu

SEQ ID NO: 1241189 - RNA, 14 nt, Mycobacterium leprae
gagacgggugcucg

SEQ ID NO: 1241190 - RNA, 20 nt, Mycobacterium leprae
gagacgguguugcugagugu

SEQ ID NO: 1241191 - RNA, 16 nt, Mycobacterium leprae
gagacucgugagcuua

SEQ ID NO: 1241192 - RNA, 16 nt, Mycobacterium leprae
gagaauaaugguggug

SEQ ID NO: 1241193 - RNA, 20 nt, Mycobacterium leprae
gagaacucaauaguguguuu

SEQ ID NO: 1241194 - RNA, 18 nt, Mycobacterium leprae
gagaaguagagaaaaaug

SEQ ID NO: 1241195 - RNA, 12 nt, Mycobacterium leprae
gagaauuuaccg

SEQ ID NO: 1241196 - RNA, 13 nt, Mycobacterium leprae
gagacaucgccac

SEQ ID NO: 1241197 - RNA, 19 nt, Mycobacterium leprae
gacuugccgaagccgggac

SEQ ID NO: 1241198 - RNA, 20 nt, Mycobacterium leprae
gacuugccgaagccgggacc

SEQ ID NO: 1241199 - RNA, 15 nt, Mycobacterium leprae
gacuucugguugaca

SEQ ID NO: 1241200 - RNA, 23 nt, Mycobacterium leprae
gacuugacugggucguuggcaac

SEQ ID NO: 1241201 - RNA, 23 nt, Mycobacterium leprae
gacuuuagcaacgacgccacagc

SEQ ID NO: 1241202 - RNA, 18 nt, Mycobacterium leprae
gacuccuuuagcuugguu

SEQ ID NO: 1241203 - RNA, 14 nt, Mycobacterium leprae
gacguuuuguugcu

SEQ ID NO: 1241204 - RNA, 19 nt, Mycobacterium leprae
gacguugugacaguucagc

SEQ ID NO: 1241205 - RNA, 18 nt, Mycobacterium leprae
gacgugcacugguggugg

SEQ ID NO: 1241206 - RNA, 17 nt, Mycobacterium leprae
gacugaaaucauugcuc

SEQ ID NO: 1241207 - RNA, 21 nt, Mycobacterium leprae
gacugaaugcgaugcuggccg

SEQ ID NO: 1241208 - RNA, 20 nt, Mycobacterium leprae
gacugccugcuuucgaugag

SEQ ID NO: 1241209 - RNA, 14 nt, Mycobacterium leprae
gacugcgaaaaauc

SEQ ID NO: 1241210 - RNA, 21 nt, Mycobacterium leprae
gacuggguggcccgaggagag

SEQ ID NO: 1241211 - RNA, 13 nt, Mycobacterium leprae
gacuggcuguagu

SEQ ID NO: 1241212 - RNA, 17 nt, Mycobacterium leprae
gaccuagucgaggcuca

SEQ ID NO: 1241213 - RNA, 23 nt, Mycobacterium leprae
gaccuccacguuguccgcgugga

SEQ ID NO: 1241214 - RNA, 15 nt, Mycobacterium leprae
gaccucaucccacag

SEQ ID NO: 1241215 - RNA, 12 nt, Mycobacterium leprae
gaccuccucggg

SEQ ID NO: 1241216 - RNA, 17 nt, Mycobacterium leprae
gaccuccuugaccacca

SEQ ID NO: 1241217 - RNA, 17 nt, Mycobacterium leprae
gaccuccgcagcaucgg

SEQ ID NO: 1241218 - RNA, 14 nt, Mycobacterium leprae
gaccgggccggccg

SEQ ID NO: 1241219 - RNA, 12 nt, Mycobacterium leprae
gaccgcagcacg

SEQ ID NO: 1241220 - RNA, 12 nt, Mycobacterium leprae
gaccgaaagccg

SEQ ID NO: 1241221 - RNA, 21 nt, Mycobacterium leprae
gaccgaguugggccaugcagu

SEQ ID NO: 1241222 - RNA, 17 nt, Mycobacterium leprae
gaccgaaagccgcacca

SEQ ID NO: 1241223 - RNA, 18 nt, Mycobacterium leprae
gacgauuccuggaaagag

SEQ ID NO: 1241224 - RNA, 21 nt, Mycobacterium leprae
gacgaugccauagacuucugg

SEQ ID NO: 1241225 - RNA, 15 nt, Mycobacterium leprae
gacgagacacugacg

SEQ ID NO: 1241226 - RNA, 19 nt, Mycobacterium leprae
gacgaccuccucgggggug

SEQ ID NO: 1241227 - RNA, 17 nt, Mycobacterium leprae
gacgcaacugcuggagg

SEQ ID NO: 1241228 - RNA, 14 nt, Mycobacterium leprae
gacgcgcuaaaccu

SEQ ID NO: 1241229 - RNA, 14 nt, Mycobacterium leprae
gacggauaagucca

SEQ ID NO: 1241230 - RNA, 22 nt, Mycobacterium leprae
gacgcugcuugcucuggguggu

SEQ ID NO: 1241231 - RNA, 19 nt, Mycobacterium leprae
gacggugcugauggccggc

SEQ ID NO: 1241232 - RNA, 22 nt, Mycobacterium leprae
gacgguguugcugaguguuggu

SEQ ID NO: 1241233 - RNA, 22 nt, Mycobacterium leprae
gacgguuucacaacccggcaga

SEQ ID NO: 1241234 - RNA, 15 nt, Mycobacterium leprae
gacggcacagugcuu

SEQ ID NO: 1241235 - RNA, 20 nt, Mycobacterium leprae
gacggcagcgauugggaucg

SEQ ID NO: 1241236 - RNA, 20 nt, Mycobacterium leprae
gacggauuucucgugguggc

SEQ ID NO: 1241237 - RNA, 13 nt, Mycobacterium leprae
gacggcagugauu

SEQ ID NO: 1241238 - RNA, 15 nt, Mycobacterium leprae
gacggcagugauuuu

SEQ ID NO: 1241239 - RNA, 15 nt, Mycobacterium leprae
gacgggaaguggugg

SEQ ID NO: 1241240 - RNA, 17 nt, Mycobacterium leprae
gacgggaagugguggca

SEQ ID NO: 1241241 - RNA, 15 nt, Mycobacterium leprae
gacgggcggccaggc

SEQ ID NO: 1241242 - RNA, 20 nt, Mycobacterium leprae
gacagcggccaccagggcgu

SEQ ID NO: 1241243 - RNA, 18 nt, Mycobacterium leprae
gacagcuaagccugcacu

SEQ ID NO: 1241244 - RNA, 22 nt, Mycobacterium leprae
gacaucggcuacggcaaccgca

SEQ ID NO: 1241245 - RNA, 17 nt, Mycobacterium leprae
gacaucacuugcugacc

SEQ ID NO: 1241246 - RNA, 20 nt, Mycobacterium leprae
gacacuacuguugucagugg

SEQ ID NO: 1241247 - RNA, 22 nt, Mycobacterium leprae
gacacagaucgagcgauugugc

SEQ ID NO: 1241248 - RNA, 19 nt, Mycobacterium leprae
gacaccguccucggcggca

SEQ ID NO: 1241249 - RNA, 22 nt, Mycobacterium leprae
gacaccgucuuuauucuuuuag

SEQ ID NO: 1241250 - RNA, 17 nt, Mycobacterium leprae
gacacgagcggccucag

SEQ ID NO: 1241251 - RNA, 19 nt, Mycobacterium leprae
gacacgagcggccucagca

SEQ ID NO: 1241252 - RNA, 20 nt, Mycobacterium leprae
gacacgauuagcgcggcgca

SEQ ID NO: 1241253 - RNA, 22 nt, Mycobacterium leprae
gacagcaacggcuacggggugg

SEQ ID NO: 1241254 - RNA, 17 nt, Mycobacterium leprae
gacagcgaugacaugga

SEQ ID NO: 1241255 - RNA, 16 nt, Mycobacterium leprae
gaccaagcagcaucca

SEQ ID NO: 1241256 - RNA, 18 nt, Mycobacterium leprae
gaccaagcagcauccacc

SEQ ID NO: 1241257 - RNA, 14 nt, Mycobacterium leprae
gaccaacgccgagc

SEQ ID NO: 1241258 - RNA, 23 nt, Mycobacterium leprae
gaccaacccggcgauugccacca

SEQ ID NO: 1241259 - RNA, 16 nt, Mycobacterium leprae
gaccaaccuaaaauuu

SEQ ID NO: 1241260 - RNA, 22 nt, Mycobacterium leprae
gaccagagauuucgcaggcugu

SEQ ID NO: 1241261 - RNA, 18 nt, Mycobacterium leprae
gaccacuauuucaaagcg

SEQ ID NO: 1241262 - RNA, 21 nt, Mycobacterium leprae
gaccacgucgggcagcaaccg

SEQ ID NO: 1241263 - RNA, 14 nt, Mycobacterium leprae
gaccagggaaguga

SEQ ID NO: 1241264 - RNA, 20 nt, Mycobacterium leprae
gaccagggaagugacgccac

SEQ ID NO: 1241265 - RNA, 21 nt, Mycobacterium leprae
gaccagcgcauguuaaaauaa

SEQ ID NO: 1241266 - RNA, 13 nt, Mycobacterium leprae
gaccagccgcagc

SEQ ID NO: 1241267 - RNA, 14 nt, Mycobacterium leprae
gaccagccgcagca

SEQ ID NO: 1241268 - RNA, 16 nt, Mycobacterium leprae
gaccagaugaacagcc

SEQ ID NO: 1241269 - RNA, 20 nt, Mycobacterium leprae
gacccguuguucggcaggcc

SEQ ID NO: 1241270 - RNA, 21 nt, Mycobacterium leprae
gacccguuguucggcaggccg

SEQ ID NO: 1241271 - RNA, 23 nt, Mycobacterium leprae
gacccgugcuuaccucaguguca

SEQ ID NO: 1241272 - RNA, 22 nt, Mycobacterium leprae
gaccaggugaugauggcaucca

SEQ ID NO: 1241273 - RNA, 16 nt, Mycobacterium leprae
gaccagggguguugca

SEQ ID NO: 1241274 - RNA, 19 nt, Mycobacterium leprae
gaauucagccgugcccaag

SEQ ID NO: 1241275 - RNA, 22 nt, Mycobacterium leprae
gaauucagagcugcaggucagg

SEQ ID NO: 1241276 - RNA, 18 nt, Mycobacterium leprae
gaauggucauuggaaagg

SEQ ID NO: 1241277 - RNA, 18 nt, Mycobacterium leprae
gaauggucauuggaagcu

SEQ ID NO: 1241278 - RNA, 15 nt, Mycobacterium leprae
gaauggcggcagcgc

SEQ ID NO: 1241279 - RNA, 21 nt, Mycobacterium leprae
gacaacacguuucugcaugca

SEQ ID NO: 1241280 - RNA, 23 nt, Mycobacterium leprae
gacaaagcucaggccguggacga

SEQ ID NO: 1241281 - RNA, 14 nt, Mycobacterium leprae
gacaaaggacuuga

SEQ ID NO: 1241282 - RNA, 21 nt, Mycobacterium leprae
gacaaagcagcauauggaaag

SEQ ID NO: 1241283 - RNA, 13 nt, Mycobacterium leprae
gacacagccggcc

SEQ ID NO: 1241284 - RNA, 12 nt, Mycobacterium leprae
gacaagagugaa

SEQ ID NO: 1241285 - RNA, 14 nt, Mycobacterium leprae
gacaagagugaaag

SEQ ID NO: 1241286 - RNA, 18 nt, Mycobacterium leprae
gacaagagugaaaguagg

SEQ ID NO: 1241287 - RNA, 17 nt, Mycobacterium leprae
gacaagaucgaggccag

SEQ ID NO: 1241288 - RNA, 13 nt, Mycobacterium leprae
gacaagcccccgc

SEQ ID NO: 1241289 - RNA, 20 nt, Mycobacterium leprae
gaauaucgagcuaaacagca

SEQ ID NO: 1241290 - RNA, 19 nt, Mycobacterium leprae
gaauaguuauaccgugcac

SEQ ID NO: 1241291 - RNA, 22 nt, Mycobacterium leprae
gaauaguuauaccgugcacggg

SEQ ID NO: 1241292 - RNA, 17 nt, Mycobacterium leprae
gaauccucgacccacca

SEQ ID NO: 1241293 - RNA, 23 nt, Mycobacterium leprae
gaaucguugacguggacuucugc

SEQ ID NO: 1241294 - RNA, 15 nt, Mycobacterium leprae
gaaucagaugaccgg

SEQ ID NO: 1241295 - RNA, 16 nt, Mycobacterium leprae
gaaucagaugaccggc

SEQ ID NO: 1241296 - RNA, 16 nt, Mycobacterium leprae
gaauccgccucggugu

SEQ ID NO: 1241297 - RNA, 20 nt, Mycobacterium leprae
gaaguguuguuugagaacuc

SEQ ID NO: 1241298 - RNA, 14 nt, Mycobacterium leprae
gaaguggugauaca

SEQ ID NO: 1241299 - RNA, 14 nt, Mycobacterium leprae
gaaguuaccgagcc

SEQ ID NO: 1241300 - RNA, 22 nt, Mycobacterium leprae
gaaguuguucgucgggugccga

SEQ ID NO: 1241301 - RNA, 21 nt, Mycobacterium leprae
gaaguucucuucgugcagcac

SEQ ID NO: 1241302 - RNA, 14 nt, Mycobacterium leprae
gaagggagugcagu

SEQ ID NO: 1241303 - RNA, 15 nt, Mycobacterium leprae
gaagggagugcagug

SEQ ID NO: 1241304 - RNA, 20 nt, Mycobacterium leprae
gaagcucuggcuaagaucuu

SEQ ID NO: 1241305 - RNA, 24 nt, Mycobacterium leprae
gaagccggcucgcggggaugcuga

SEQ ID NO: 1241306 - RNA, 14 nt, Mycobacterium leprae
gaagccugagacca

SEQ ID NO: 1241307 - RNA, 16 nt, Mycobacterium leprae
gaagacauaucaacaa

SEQ ID NO: 1241308 - RNA, 21 nt, Mycobacterium leprae
gaagacauaucaacaacugcg

SEQ ID NO: 1241309 - RNA, 20 nt, Mycobacterium leprae
gaagaaucuugaaauucaau

SEQ ID NO: 1241310 - RNA, 14 nt, Mycobacterium leprae
gaagaauuaauaua

SEQ ID NO: 1241311 - RNA, 22 nt, Mycobacterium leprae
gaacaugacggucgcacgaccu

SEQ ID NO: 1241312 - RNA, 18 nt, Mycobacterium leprae
gaacaugaucaauaccac

SEQ ID NO: 1241313 - RNA, 22 nt, Mycobacterium leprae
gaacaucgaagaacauggaugu

SEQ ID NO: 1241314 - RNA, 21 nt, Mycobacterium leprae
gaagaugacaccgaacagcuc

SEQ ID NO: 1241315 - RNA, 13 nt, Mycobacterium leprae
gaagaucucagcc

SEQ ID NO: 1241316 - RNA, 22 nt, Mycobacterium leprae
gaagagcggcacgauaggcagu

SEQ ID NO: 1241317 - RNA, 14 nt, Mycobacterium leprae
gaagaucaccgcca

SEQ ID NO: 1241318 - RNA, 12 nt, Mycobacterium leprae
gaagaccgugcu

SEQ ID NO: 1241319 - RNA, 13 nt, Mycobacterium leprae
ggcguaccugggu

SEQ ID NO: 1241320 - RNA, 14 nt, Mycobacterium leprae
ggcgucaggccagg

SEQ ID NO: 1241321 - RNA, 18 nt, Mycobacterium leprae
ggcgucaggccaggcagc

SEQ ID NO: 1241322 - RNA, 21 nt, Mycobacterium leprae
ggcgucgacaucaccggcggu

SEQ ID NO: 1241323 - RNA, 22 nt, Mycobacterium leprae
ggcgucgacaucaccggcggug

SEQ ID NO: 1241324 - RNA, 14 nt, Mycobacterium leprae
ggcggucggcggcu

SEQ ID NO: 1241325 - RNA, 12 nt, Mycobacterium leprae
ggcggucggcgc

SEQ ID NO: 1241326 - RNA, 13 nt, Mycobacterium leprae
ggcggucggcgcu

SEQ ID NO: 1241327 - RNA, 19 nt, Mycobacterium leprae
ggcgcuuguaaggccagca

SEQ ID NO: 1241328 - RNA, 14 nt, Mycobacterium leprae
ggcgcuucaccgac

SEQ ID NO: 1241329 - RNA, 21 nt, Mycobacterium leprae
ggcggaaacguuuguggugcu

SEQ ID NO: 1241330 - RNA, 18 nt, Mycobacterium leprae
ggcuaauggcgggcugga

SEQ ID NO: 1241331 - RNA, 12 nt, Mycobacterium leprae
ggcuacacggua

SEQ ID NO: 1241332 - RNA, 18 nt, Mycobacterium leprae
ggcuacaucgacaaaaac

SEQ ID NO: 1241333 - RNA, 14 nt, Mycobacterium leprae
ggcucaaucgcccg

SEQ ID NO: 1241334 - RNA, 23 nt, Mycobacterium leprae
ggcgucuggauggcugagcggca

SEQ ID NO: 1241335 - RNA, 22 nt, Mycobacterium leprae
ggcgaguacguccgcgccggcg

SEQ ID NO: 1241336 - RNA, 16 nt, Mycobacterium leprae
ggcgagugcugacgcc

SEQ ID NO: 1241337 - RNA, 19 nt, Mycobacterium leprae
ggcgagugcugacgccggg

SEQ ID NO: 1241338 - RNA, 15 nt, Mycobacterium leprae
ggcgaguggagugag

SEQ ID NO: 1241339 - RNA, 15 nt, Mycobacterium leprae
ggcgacaaagaagaa

SEQ ID NO: 1241340 - RNA, 17 nt, Mycobacterium leprae
ggcgcacaaaaauccuc

SEQ ID NO: 1241341 - RNA, 13 nt, Mycobacterium leprae
ggcgaucgaucca

SEQ ID NO: 1241342 - RNA, 17 nt, Mycobacterium leprae
ggcgcguggucucccaa

SEQ ID NO: 1241343 - RNA, 12 nt, Mycobacterium leprae
ggcgccgcagca

SEQ ID NO: 1241344 - RNA, 20 nt, Mycobacterium leprae
ggcgccgauuugggggucua

SEQ ID NO: 1241345 - RNA, 18 nt, Mycobacterium leprae
ggcgccugcaucgcagcg

SEQ ID NO: 1241346 - RNA, 17 nt, Mycobacterium leprae
ggcgccucgucggccag

SEQ ID NO: 1241347 - RNA, 22 nt, Mycobacterium leprae
ggcgccguggaggugcggcugg

SEQ ID NO: 1241348 - RNA, 21 nt, Mycobacterium leprae
ggccugccgaacucacaggua

SEQ ID NO: 1241349 - RNA, 16 nt, Mycobacterium leprae
ggccguuauccacagc

SEQ ID NO: 1241350 - RNA, 20 nt, Mycobacterium leprae
ggccucagcagcaggcugac

SEQ ID NO: 1241351 - RNA, 15 nt, Mycobacterium leprae
ggccuccaggugaag

SEQ ID NO: 1241352 - RNA, 12 nt, Mycobacterium leprae
ggccuaggacgc

SEQ ID NO: 1241353 - RNA, 13 nt, Mycobacterium leprae
ggccuccuaggcc

SEQ ID NO: 1241354 - RNA, 17 nt, Mycobacterium leprae
ggccucgaggugcagga

SEQ ID NO: 1241355 - RNA, 15 nt, Mycobacterium leprae
ggccucgugcugcgu

SEQ ID NO: 1241356 - RNA, 17 nt, Mycobacterium leprae
ggccucgugcugcgugc

SEQ ID NO: 1241357 - RNA, 12 nt, Mycobacterium leprae
ggccgccagcac

SEQ ID NO: 1241358 - RNA, 14 nt, Mycobacterium leprae
ggccgccaggucag

SEQ ID NO: 1241359 - RNA, 18 nt, Mycobacterium leprae
ggccauuguugugcuggg

SEQ ID NO: 1241360 - RNA, 18 nt, Mycobacterium leprae
ggccgcuauaggcgagcu

SEQ ID NO: 1241361 - RNA, 19 nt, Mycobacterium leprae
ggccgcuggucaagcuggg

SEQ ID NO: 1241362 - RNA, 19 nt, Mycobacterium leprae
ggccggcaagcugcccggc

SEQ ID NO: 1241363 - RNA, 16 nt, Mycobacterium leprae
ggccgggaucggcggc

SEQ ID NO: 1241364 - RNA, 21 nt, Mycobacterium leprae
ggccgggaucggcggcaccug

SEQ ID NO: 1241365 - RNA, 19 nt, Mycobacterium leprae
ggccggcucgcauccgcaa

SEQ ID NO: 1241366 - RNA, 12 nt, Mycobacterium leprae
ggccggccugga

SEQ ID NO: 1241367 - RNA, 12 nt, Mycobacterium leprae
ggccggccuggc

SEQ ID NO: 1241368 - RNA, 11 nt, Mycobacterium leprae
ggcaacgcugc

SEQ ID NO: 1241369 - RNA, 17 nt, Mycobacterium leprae
ggcaacgcugcccacca

SEQ ID NO: 1241370 - RNA, 20 nt, Mycobacterium leprae
ggauugcguugaccgccgcc

SEQ ID NO: 1241371 - RNA, 22 nt, Mycobacterium leprae
ggauugggcauccugcuguaau

SEQ ID NO: 1241372 - RNA, 18 nt, Mycobacterium leprae
ggaucgacggcagcgcug

SEQ ID NO: 1241373 - RNA, 16 nt, Mycobacterium leprae
ggauugauccggucac

SEQ ID NO: 1241374 - RNA, 22 nt, Mycobacterium leprae
ggauugauccggucaccgcuug

SEQ ID NO: 1241375 - RNA, 15 nt, Mycobacterium leprae
ggcaaugcucucacc

SEQ ID NO: 1241376 - RNA, 23 nt, Mycobacterium leprae
ggcacaugcaacuaugcggcggg

SEQ ID NO: 1241377 - RNA, 13 nt, Mycobacterium leprae
ggcacaccguguc

SEQ ID NO: 1241378 - RNA, 22 nt, Mycobacterium leprae
ggcacaacaagagaagagcugg

SEQ ID NO: 1241379 - RNA, 15 nt, Mycobacterium leprae
ggcagcagcucgacg

SEQ ID NO: 1241380 - RNA, 14 nt, Mycobacterium leprae
ggcagcauccgccg

SEQ ID NO: 1241381 - RNA, 17 nt, Mycobacterium leprae
ggcagcauccgccgacg

SEQ ID NO: 1241382 - RNA, 15 nt, Mycobacterium leprae
ggcacgugcggcggc

SEQ ID NO: 1241383 - RNA, 23 nt, Mycobacterium leprae
ggcaccugggcugugcugaaggc

SEQ ID NO: 1241384 - RNA, 12 nt, Mycobacterium leprae
ggcacggcgaca

SEQ ID NO: 1241385 - RNA, 18 nt, Mycobacterium leprae
ggcacccauaacgugcug

SEQ ID NO: 1241386 - RNA, 15 nt, Mycobacterium leprae
ggcaugaaccucacc

SEQ ID NO: 1241387 - RNA, 19 nt, Mycobacterium leprae
ggcauccugcuguaauaua

SEQ ID NO: 1241388 - RNA, 15 nt, Mycobacterium leprae
ggcagcuacagcggg

SEQ ID NO: 1241389 - RNA, 23 nt, Mycobacterium leprae
ggcagucucguugccggggcucg

SEQ ID NO: 1241390 - RNA, 17 nt, Mycobacterium leprae
ggcagucggcucaacca

SEQ ID NO: 1241391 - RNA, 13 nt, Mycobacterium leprae
ggcagugccuggc

SEQ ID NO: 1241392 - RNA, 15 nt, Mycobacterium leprae
ggcaugagccgacug

SEQ ID NO: 1241393 - RNA, 15 nt, Mycobacterium leprae
ggccacaacgcggcc

SEQ ID NO: 1241394 - RNA, 19 nt, Mycobacterium leprae
ggccaacccuacgggaaca

SEQ ID NO: 1241395 - RNA, 12 nt, Mycobacterium leprae
ggccaaccacag

SEQ ID NO: 1241396 - RNA, 19 nt, Mycobacterium leprae
ggccaaccacagcaauaga

SEQ ID NO: 1241397 - RNA, 16 nt, Mycobacterium leprae
ggccaccagggcgugg

SEQ ID NO: 1241398 - RNA, 15 nt, Mycobacterium leprae
ggccaggcagcgccu

SEQ ID NO: 1241399 - RNA, 19 nt, Mycobacterium leprae
ggccaggccgagugcagga

SEQ ID NO: 1241400 - RNA, 19 nt, Mycobacterium leprae
ggccaguaccuccagccgc

SEQ ID NO: 1241401 - RNA, 22 nt, Mycobacterium leprae
ggccaguaccuccagccgcggg

SEQ ID NO: 1241402 - RNA, 15 nt, Mycobacterium leprae
ggccaccgccaccga

SEQ ID NO: 1241403 - RNA, 15 nt, Mycobacterium leprae
ggccacgucgugcug

SEQ ID NO: 1241404 - RNA, 22 nt, Mycobacterium leprae
ggccacgugcacaucagcgcga

SEQ ID NO: 1241405 - RNA, 13 nt, Mycobacterium leprae
ggccagccugcga

SEQ ID NO: 1241406 - RNA, 17 nt, Mycobacterium leprae
ggccagcgaucuaccuc

SEQ ID NO: 1241407 - RNA, 22 nt, Mycobacterium leprae
ggaggugcagacuuugagcugu

SEQ ID NO: 1241408 - RNA, 12 nt, Mycobacterium leprae
ggaguacuggcg

SEQ ID NO: 1241409 - RNA, 15 nt, Mycobacterium leprae
ggaguaauaacugug

SEQ ID NO: 1241410 - RNA, 21 nt, Mycobacterium leprae
ggagggcaucaacuggaucac

SEQ ID NO: 1241411 - RNA, 14 nt, Mycobacterium leprae
ggaucagccgcgca

SEQ ID NO: 1241412 - RNA, 19 nt, Mycobacterium leprae
ggagauagacaugugugcu

SEQ ID NO: 1241413 - RNA, 11 nt, Mycobacterium leprae
ggaggcuguac

SEQ ID NO: 1241414 - RNA, 17 nt, Mycobacterium leprae
ggagaauauagccuugg

SEQ ID NO: 1241415 - RNA, 22 nt, Mycobacterium leprae
ggagaauguuguuagugcugcu

SEQ ID NO: 1241416 - RNA, 19 nt, Mycobacterium leprae
ggacucagcaaugcucugc

SEQ ID NO: 1241417 - RNA, 16 nt, Mycobacterium leprae
ggacgugaugcagcau

SEQ ID NO: 1241418 - RNA, 13 nt, Mycobacterium leprae
ggacgccggcggc

SEQ ID NO: 1241419 - RNA, 23 nt, Mycobacterium leprae
ggaaucuuugaucugcugcaggu

SEQ ID NO: 1241420 - RNA, 18 nt, Mycobacterium leprae
ggaaucccagcagcuggg

SEQ ID NO: 1241421 - RNA, 19 nt, Mycobacterium leprae
ggaauccacuugagcggcc

SEQ ID NO: 1241422 - RNA, 12 nt, Mycobacterium leprae
ggacccagcgau

SEQ ID NO: 1241423 - RNA, 23 nt, Mycobacterium leprae
ggacccgagccgcaggucucaca

SEQ ID NO: 1241424 - RNA, 16 nt, Mycobacterium leprae
aaagggaccgggcucu

SEQ ID NO: 1241425 - RNA, 13 nt, Mycobacterium leprae
ggaccaccugaga

SEQ ID NO: 1241426 - RNA, 15 nt, Mycobacterium leprae
ggaccacgcaauguc

SEQ ID NO: 1241427 - RNA, 13 nt, Mycobacterium leprae
ggaccaucgucag

SEQ ID NO: 1241428 - RNA, 19 nt, Mycobacterium leprae
ggaacgacggauaagucca

SEQ ID NO: 1241429 - RNA, 20 nt, Mycobacterium leprae
ggaacgacggauaaguccac

SEQ ID NO: 1241430 - RNA, 23 nt, Mycobacterium leprae
ggaagaugacucggcgugccacu

SEQ ID NO: 1241431 - RNA, 23 nt, Mycobacterium leprae
ggaaggccuagcuggcagucggc

SEQ ID NO: 1241432 - RNA, 19 nt, Mycobacterium leprae
ggaaagucgggaucggcac

SEQ ID NO: 1241433 - RNA, 15 nt, Mycobacterium leprae
ggaaaagcaggcgga

SEQ ID NO: 1241434 - RNA, 17 nt, Mycobacterium leprae
ggaaaagucguggagca

SEQ ID NO: 1241435 - RNA, 16 nt, Mycobacterium leprae
ggaaacacagcaagca

SEQ ID NO: 1241436 - RNA, 14 nt, Mycobacterium leprae
gcuguggcggucgg

SEQ ID NO: 1241437 - RNA, 13 nt, Mycobacterium leprae
gcuuucgcuggcu

SEQ ID NO: 1241438 - RNA, 17 nt, Mycobacterium leprae
gcuuucgcuggcucugu

SEQ ID NO: 1241439 - RNA, 16 nt, Mycobacterium leprae
gcuuugcuggcaagcu

SEQ ID NO: 1241440 - RNA, 14 nt, Mycobacterium leprae
gcuuuggcggacug

SEQ ID NO: 1241441 - RNA, 17 nt, Mycobacterium leprae
gcuuuucgacauugccc

SEQ ID NO: 1241442 - RNA, 12 nt, Mycobacterium leprae
gcuuuuugugaa

SEQ ID NO: 1241443 - RNA, 13 nt, Mycobacterium leprae
gcuggcaguggca

SEQ ID NO: 1241444 - RNA, 14 nt, Mycobacterium leprae
gcuggcccuguucc

SEQ ID NO: 1241445 - RNA, 12 nt, Mycobacterium leprae
gcuggccuugcg

SEQ ID NO: 1241446 - RNA, 20 nt, Mycobacterium leprae
gcuggcgcagaccucuuccg

SEQ ID NO: 1241447 - RNA, 12 nt, Mycobacterium leprae
gcugcuugcucu

SEQ ID NO: 1241448 - RNA, 14 nt, Mycobacterium leprae
gcugcuugcucugg

SEQ ID NO: 1241449 - RNA, 15 nt, Mycobacterium leprae
gcugcugaacaucag

SEQ ID NO: 1241450 - RNA, 14 nt, Mycobacterium leprae
gcugcucggccaga

SEQ ID NO: 1241451 - RNA, 16 nt, Mycobacterium leprae
gcugcucggccagagc

SEQ ID NO: 1241452 - RNA, 23 nt, Mycobacterium leprae
gcugcgguguccguaagcgucuc

SEQ ID NO: 1241453 - RNA, 15 nt, Mycobacterium leprae
gcugggugagcugug

SEQ ID NO: 1241454 - RNA, 19 nt, Mycobacterium leprae
gcugguaacugaugguccu

SEQ ID NO: 1241455 - RNA, 13 nt, Mycobacterium leprae
gcuggggcggccg

SEQ ID NO: 1241456 - RNA, 12 nt, Mycobacterium leprae
gcugggaaugcc

SEQ ID NO: 1241457 - RNA, 13 nt, Mycobacterium leprae
gcugggcaccacc

SEQ ID NO: 1241458 - RNA, 22 nt, Mycobacterium leprae
gcugggcaccugggcugugcug

SEQ ID NO: 1241459 - RNA, 14 nt, Mycobacterium leprae
gcuggcggugggug

SEQ ID NO: 1241460 - RNA, 16 nt, Mycobacterium leprae
gcuggcggugugugca

SEQ ID NO: 1241461 - RNA, 15 nt, Mycobacterium leprae
gcuggcugcugcaga

SEQ ID NO: 1241462 - RNA, 16 nt, Mycobacterium leprae
gcuggcuccauccugc

SEQ ID NO: 1241463 - RNA, 20 nt, Mycobacterium leprae
gcuggcuccauccugccuca

SEQ ID NO: 1241464 - RNA, 15 nt, Mycobacterium leprae
gcuggcucuggucac

SEQ ID NO: 1241465 - RNA, 23 nt, Mycobacterium leprae
gcuggcuaauggcgggcuggagg

SEQ ID NO: 1241466 - RNA, 18 nt, Mycobacterium leprae
gcugucgggcaccuggug

SEQ ID NO: 1241467 - RNA, 12 nt, Mycobacterium leprae
gcugucguggcu

SEQ ID NO: 1241468 - RNA, 14 nt, Mycobacterium leprae
gcugucguggcugc

SEQ ID NO: 1241469 - RNA, 19 nt, Mycobacterium leprae
gcugguggaguacugggca

SEQ ID NO: 1241470 - RNA, 21 nt, Mycobacterium leprae
gcuggugguccuguugauuuu

SEQ ID NO: 1241471 - RNA, 13 nt, Mycobacterium leprae
gcugcacggcugc

SEQ ID NO: 1241472 - RNA, 21 nt, Mycobacterium leprae
gcugcagucaguuuggcgcug

SEQ ID NO: 1241473 - RNA, 23 nt, Mycobacterium leprae
gcugcacaagcuuguuuggucac

SEQ ID NO: 1241474 - RNA, 16 nt, Mycobacterium leprae
gcugcauguugugggu

SEQ ID NO: 1241475 - RNA, 12 nt, Mycobacterium leprae
gcugcauugugc

SEQ ID NO: 1241476 - RNA, 13 nt, Mycobacterium leprae
gcugcauccgaca

SEQ ID NO: 1241477 - RNA, 22 nt, Mycobacterium leprae
gcugcauccgacaaagcagcau

SEQ ID NO: 1241478 - RNA, 15 nt, Mycobacterium leprae
gcugcauccugcagc

SEQ ID NO: 1241479 - RNA, 21 nt, Mycobacterium leprae
gcugcccaugcuuaaggcaga

SEQ ID NO: 1241480 - RNA, 12 nt, Mycobacterium leprae
gcucuuucuugu

SEQ ID NO: 1241481 - RNA, 17 nt, Mycobacterium leprae
gcugacggaaagugccg

SEQ ID NO: 1241482 - RNA, 14 nt, Mycobacterium leprae
gcugagguguuggg

SEQ ID NO: 1241483 - RNA, 13 nt, Mycobacterium leprae
gcugaggcagcag

SEQ ID NO: 1241484 - RNA, 18 nt, Mycobacterium leprae
gcugaggguggcgccggc

SEQ ID NO: 1241485 - RNA, 18 nt, Mycobacterium leprae
gcugacuccguacucacg

SEQ ID NO: 1241486 - RNA, 19 nt, Mycobacterium leprae
gcugacuccguacucacgu

SEQ ID NO: 1241487 - RNA, 17 nt, Mycobacterium leprae
gcucuguccagaagggg

SEQ ID NO: 1241488 - RNA, 21 nt, Mycobacterium leprae
gcucguuggguaucagcgcgc

SEQ ID NO: 1241489 - RNA, 15 nt, Mycobacterium leprae
gcucguagcggcggc

SEQ ID NO: 1241490 - RNA, 17 nt, Mycobacterium leprae
gcucguauaaaugaaca

SEQ ID NO: 1241491 - RNA, 12 nt, Mycobacterium leprae
gcucggcgaagu

SEQ ID NO: 1241492 - RNA, 16 nt, Mycobacterium leprae
gcuagacgucugucac

SEQ ID NO: 1241493 - RNA, 23 nt, Mycobacterium leprae
gcuagacgucugucacccgucgu

SEQ ID NO: 1241494 - RNA, 15 nt, Mycobacterium leprae
gcuagaucaacagcg

SEQ ID NO: 1241495 - RNA, 21 nt, Mycobacterium leprae
gcuaguucgacaccggccaaa

SEQ ID NO: 1241496 - RNA, 20 nt, Mycobacterium leprae
gcuaugaguuucggcgccuc

SEQ ID NO: 1241497 - RNA, 14 nt, Mycobacterium leprae
gcuaugguucuguu

SEQ ID NO: 1241498 - RNA, 13 nt, Mycobacterium leprae
gcuauguuggcca

SEQ ID NO: 1241499 - RNA, 21 nt, Mycobacterium leprae
gcuauugcagacuuuggagca

SEQ ID NO: 1241500 - RNA, 18 nt, Mycobacterium leprae
gcuauugcauuggcugau

SEQ ID NO: 1241501 - RNA, 21 nt, Mycobacterium leprae
gcuccccgagccgcuuuuugu

SEQ ID NO: 1241502 - RNA, 15 nt, Mycobacterium leprae
gcucccaucggcggc

SEQ ID NO: 1241503 - RNA, 19 nt, Mycobacterium leprae
gcucccaucggcggccagc

SEQ ID NO: 1241504 - RNA, 22 nt, Mycobacterium leprae
gcucccaucggcggccagcuca

SEQ ID NO: 1241505 - RNA, 18 nt, Mycobacterium leprae
gcucagugaagugcucgg

SEQ ID NO: 1241506 - RNA, 18 nt, Mycobacterium leprae
gcucagaucugauucaga

SEQ ID NO: 1241507 - RNA, 18 nt, Mycobacterium leprae
gcucagcaccauucuggu

SEQ ID NO: 1241508 - RNA, 12 nt, Mycobacterium leprae
gcucagcggcua

SEQ ID NO: 1241509 - RNA, 16 nt, Mycobacterium leprae
gcucagcggccagaca

SEQ ID NO: 1241510 - RNA, 19 nt, Mycobacterium leprae
gcucacaauugacaacacg

SEQ ID NO: 1241511 - RNA, 19 nt, Mycobacterium leprae
gcucacacugagaccaugg

SEQ ID NO: 1241512 - RNA, 16 nt, Mycobacterium leprae
gcucacagcaggcgag

SEQ ID NO: 1241513 - RNA, 14 nt, Mycobacterium leprae
gcucaaucagcgac

SEQ ID NO: 1241514 - RNA, 22 nt, Mycobacterium leprae
gcucaaucagcgacuccacucc

SEQ ID NO: 1241515 - RNA, 16 nt, Mycobacterium leprae
gcucacggggcugggu

SEQ ID NO: 1241516 - RNA, 13 nt, Mycobacterium leprae
gcucacggccacc

SEQ ID NO: 1241517 - RNA, 23 nt, Mycobacterium leprae
gcucaccgacggaugcccagcca

SEQ ID NO: 1241518 - RNA, 15 nt, Mycobacterium leprae
gcucaccgacugaga

SEQ ID NO: 1241519 - RNA, 22 nt, Mycobacterium leprae
gcguguggggguccgcgcacgg

SEQ ID NO: 1241520 - RNA, 13 nt, Mycobacterium leprae
gcgugugcaaccg

SEQ ID NO: 1241521 - RNA, 15 nt, Mycobacterium leprae
gcguggucaaugugg

SEQ ID NO: 1241522 - RNA, 14 nt, Mycobacterium leprae
gcguugugcgguga

SEQ ID NO: 1241523 - RNA, 17 nt, Mycobacterium leprae
gcguucgguuucacagc

SEQ ID NO: 1241524 - RNA, 20 nt, Mycobacterium leprae
gcguugagcgcagccaccac

SEQ ID NO: 1241525 - RNA, 20 nt, Mycobacterium leprae
gcguuggaucccgacagcau

SEQ ID NO: 1241526 - RNA, 14 nt, Mycobacterium leprae
gcuaccaugccacc

SEQ ID NO: 1241527 - RNA, 23 nt, Mycobacterium leprae
gcuacauugcuccgcagcaccug

SEQ ID NO: 1241528 - RNA, 20 nt, Mycobacterium leprae
gcuacucguuucucauucuc

SEQ ID NO: 1241529 - RNA, 20 nt, Mycobacterium leprae
gcuaacaaggugaugcccau

SEQ ID NO: 1241530 - RNA, 12 nt, Mycobacterium leprae
gcuaaagugcug

SEQ ID NO: 1241531 - RNA, 13 nt, Mycobacterium leprae
gcuaaauauuaau

SEQ ID NO: 1241532 - RNA, 12 nt, Mycobacterium leprae
gcuaaaagacgg

SEQ ID NO: 1241533 - RNA, 16 nt, Mycobacterium leprae
gcuaagacgcucaauc

SEQ ID NO: 1241534 - RNA, 12 nt, Mycobacterium leprae
gcuaaccgggcc

SEQ ID NO: 1241535 - RNA, 12 nt, Mycobacterium leprae
gcuaaggcagcc

SEQ ID NO: 1241536 - RNA, 13 nt, Mycobacterium leprae
gcuaaggcugcug

SEQ ID NO: 1241537 - RNA, 14 nt, Mycobacterium leprae
gcuaaucccauggg

SEQ ID NO: 1241538 - RNA, 18 nt, Mycobacterium leprae
gcuaaucgcgggcaagcc

SEQ ID NO: 1241539 - RNA, 15 nt, Mycobacterium leprae
gcgguuuccgcggca

SEQ ID NO: 1241540 - RNA, 18 nt, Mycobacterium leprae
gcgguuuauggcuaagcu

SEQ ID NO: 1241541 - RNA, 21 nt, Mycobacterium leprae
gcggugguacaaucccaccac

SEQ ID NO: 1241542 - RNA, 21 nt, Mycobacterium leprae
gcgguggugacgguaauaagg

SEQ ID NO: 1241543 - RNA, 16 nt, Mycobacterium leprae
gcgguuccgacuggug

SEQ ID NO: 1241544 - RNA, 22 nt, Mycobacterium leprae
gcgguugcguaauggccggcgc

SEQ ID NO: 1241545 - RNA, 20 nt, Mycobacterium leprae
gcggugaccgaacuguggau

SEQ ID NO: 1241546 - RNA, 18 nt, Mycobacterium leprae
gcggugcagugccgccga

SEQ ID NO: 1241547 - RNA, 22 nt, Mycobacterium leprae
gcggugcuuuagcccgccgcgg

SEQ ID NO: 1241548 - RNA, 24 nt, Mycobacterium leprae
gcggugcuuuagcccgccgcggcg

SEQ ID NO: 1241549 - RNA, 14 nt, Mycobacterium leprae
gcgguggcagccgc

SEQ ID NO: 1241550 - RNA, 22 nt, Mycobacterium leprae
gcgguggcagcguagaaccagu

SEQ ID NO: 1241551 - RNA, 17 nt, Mycobacterium leprae
gcgguccgguuuucgga

SEQ ID NO: 1241552 - RNA, 15 nt, Mycobacterium leprae
gcggucgugcugcug

SEQ ID NO: 1241553 - RNA, 14 nt, Mycobacterium leprae
gcggucgccgaugc

SEQ ID NO: 1241554 - RNA, 15 nt, Mycobacterium leprae
gcgguaccugugggu

SEQ ID NO: 1241555 - RNA, 19 nt, Mycobacterium leprae
gcggguugcuuuggggguu

SEQ ID NO: 1241556 - RNA, 22 nt, Mycobacterium leprae
gcgggguucuggaugcgguggu

SEQ ID NO: 1241557 - RNA, 12 nt, Mycobacterium leprae
gcgggguuggcc

SEQ ID NO: 1241558 - RNA, 14 nt, Mycobacterium leprae
gcgggggaccuugc

SEQ ID NO: 1241559 - RNA, 18 nt, Mycobacterium leprae
gcgggguaauucuugaca

SEQ ID NO: 1241560 - RNA, 20 nt, Mycobacterium leprae
gcggcuggcuaauggcgggc

SEQ ID NO: 1241561 - RNA, 15 nt, Mycobacterium leprae
gcgggcaacaggcgg

SEQ ID NO: 1241562 - RNA, 16 nt, Mycobacterium leprae
gcgggcaagcccugcc

SEQ ID NO: 1241563 - RNA, 21 nt, Mycobacterium leprae
gcgggcccgucguggugugca

SEQ ID NO: 1241564 - RNA, 21 nt, Mycobacterium leprae
gcgucuggauggcugagcggc

SEQ ID NO: 1241565 - RNA, 22 nt, Mycobacterium leprae
gcgucuggcuggccucgugcgg

SEQ ID NO: 1241566 - RNA, 14 nt, Mycobacterium leprae
gcgucguagcucuc

SEQ ID NO: 1241567 - RNA, 19 nt, Mycobacterium leprae
gcgucggguuaugcaguga

SEQ ID NO: 1241568 - RNA, 13 nt, Mycobacterium leprae
gcgugaagcaggu

SEQ ID NO: 1241569 - RNA, 15 nt, Mycobacterium leprae
gcgugagccuggcac

SEQ ID NO: 1241570 - RNA, 15 nt, Mycobacterium leprae
gcgugcaaauggcac

SEQ ID NO: 1241571 - RNA, 14 nt, Mycobacterium leprae
gcguggauggcuuc

SEQ ID NO: 1241572 - RNA, 18 nt, Mycobacterium leprae
gcguggccuccgagcgcc

SEQ ID NO: 1241573 - RNA, 19 nt, Mycobacterium leprae
gcguggccuccgagcgccc

SEQ ID NO: 1241574 - RNA, 18 nt, Mycobacterium leprae
gcgugcuaugaccucgcc

SEQ ID NO: 1241575 - RNA, 22 nt, Mycobacterium leprae
gcgugcuaugaccucgccgucg

SEQ ID NO: 1241576 - RNA, 15 nt, Mycobacterium leprae
gcguagucgaccgga

SEQ ID NO: 1241577 - RNA, 16 nt, Mycobacterium leprae
gcguagaaccaguucu

SEQ ID NO: 1241578 - RNA, 17 nt, Mycobacterium leprae
gcgucaggccaggcagc

SEQ ID NO: 1241579 - RNA, 12 nt, Mycobacterium leprae
gcguccuccacc

SEQ ID NO: 1241580 - RNA, 16 nt, Mycobacterium leprae
gcguccgcggcggccc

SEQ ID NO: 1241581 - RNA, 13 nt, Mycobacterium leprae
gcgucauggcacu

SEQ ID NO: 1241582 - RNA, 19 nt, Mycobacterium leprae
gcggacaauucaacgaaua

SEQ ID NO: 1241583 - RNA, 16 nt, Mycobacterium leprae
gcggacugauccccag

SEQ ID NO: 1241584 - RNA, 19 nt, Mycobacterium leprae
gcggacugaaaacagcgcc

SEQ ID NO: 1241585 - RNA, 22 nt, Mycobacterium leprae
gcgcugaauggucauuggaagc

SEQ ID NO: 1241586 - RNA, 21 nt, Mycobacterium leprae
gcgcugacaggcuuagcuucc

SEQ ID NO: 1241587 - RNA, 21 nt, Mycobacterium leprae
gcgcuccgccggcgacaacug

SEQ ID NO: 1241588 - RNA, 15 nt, Mycobacterium leprae
gcggcaaguagggug

SEQ ID NO: 1241589 - RNA, 23 nt, Mycobacterium leprae
gcggaugugucagcaccggcaug

SEQ ID NO: 1241590 - RNA, 18 nt, Mycobacterium leprae
gcggagcuugagcagcac

SEQ ID NO: 1241591 - RNA, 20 nt, Mycobacterium leprae
gcggagcgcggagcugguga

SEQ ID NO: 1241592 - RNA, 19 nt, Mycobacterium leprae
gcggcgagcuuacgcgcgu

SEQ ID NO: 1241593 - RNA, 14 nt, Mycobacterium leprae
gcggcgacugugcu

SEQ ID NO: 1241594 - RNA, 18 nt, Mycobacterium leprae
gcgcuaaaucuggccaac

SEQ ID NO: 1241595 - RNA, 12 nt, Mycobacterium leprae
gcgcucacagca

SEQ ID NO: 1241596 - RNA, 21 nt, Mycobacterium leprae
gcgcuauucgggccaguuuca

SEQ ID NO: 1241597 - RNA, 22 nt, Mycobacterium leprae
gcgcggggcgaugucgaccuga

SEQ ID NO: 1241598 - RNA, 12 nt, Mycobacterium leprae
gcgcggcugcuu

SEQ ID NO: 1241599 - RNA, 17 nt, Mycobacterium leprae
gcgcgguucuugccaag

SEQ ID NO: 1241600 - RNA, 16 nt, Mycobacterium leprae
gcgcgguaugcggccg

SEQ ID NO: 1241601 - RNA, 17 nt, Mycobacterium leprae
gcgcgguaugcggccgc

SEQ ID NO: 1241602 - RNA, 13 nt, Mycobacterium leprae
gcgauccgcguga

SEQ ID NO: 1241603 - RNA, 11 nt, Mycobacterium leprae
gcgauccauca

SEQ ID NO: 1241604 - RNA, 17 nt, Mycobacterium leprae
gcgaucaugagcaacac

SEQ ID NO: 1241605 - RNA, 14 nt, Mycobacterium leprae
gcgcgccuggguga

SEQ ID NO: 1241606 - RNA, 21 nt, Mycobacterium leprae
gcgcggacucuccccacugca

SEQ ID NO: 1241607 - RNA, 16 nt, Mycobacterium leprae
gcgcgcucagaucuga

SEQ ID NO: 1241608 - RNA, 16 nt, Mycobacterium leprae
gcgcgcuccgccggcg

SEQ ID NO: 1241609 - RNA, 19 nt, Mycobacterium leprae
gccuuguguucggcaagcc

SEQ ID NO: 1241610 - RNA, 19 nt, Mycobacterium leprae
gccuucugcacccgccagg

SEQ ID NO: 1241611 - RNA, 13 nt, Mycobacterium leprae
gccugcccgcagg

SEQ ID NO: 1241612 - RNA, 15 nt, Mycobacterium leprae
gccugcccgcaggga

SEQ ID NO: 1241613 - RNA, 14 nt, Mycobacterium leprae
gccugcucauggca

SEQ ID NO: 1241614 - RNA, 14 nt, Mycobacterium leprae
gccugcgucaguaa

SEQ ID NO: 1241615 - RNA, 17 nt, Mycobacterium leprae
gccucaacuauccagcc

SEQ ID NO: 1241616 - RNA, 15 nt, Mycobacterium leprae
gccucacaguaggcc

SEQ ID NO: 1241617 - RNA, 19 nt, Mycobacterium leprae
gccucacaguaggccagcc

SEQ ID NO: 1241618 - RNA, 16 nt, Mycobacterium leprae
gccuaugcggccagcc

SEQ ID NO: 1241619 - RNA, 18 nt, Mycobacterium leprae
gccuaugcggguucggug

SEQ ID NO: 1241620 - RNA, 23 nt, Mycobacterium leprae
gccuauugguuggggaaaugaca

SEQ ID NO: 1241621 - RNA, 19 nt, Mycobacterium leprae
gcgagugcugacgccgggc

SEQ ID NO: 1241622 - RNA, 20 nt, Mycobacterium leprae
gcgagugcugacgccgggca

SEQ ID NO: 1241623 - RNA, 12 nt, Mycobacterium leprae
gcgagugcuggu

SEQ ID NO: 1241624 - RNA, 17 nt, Mycobacterium leprae
gcgagggucgagcuacc

SEQ ID NO: 1241625 - RNA, 16 nt, Mycobacterium leprae
gcgaggccuugggugg

SEQ ID NO: 1241626 - RNA, 17 nt, Mycobacterium leprae
gcgacgucccaagcgcu

SEQ ID NO: 1241627 - RNA, 19 nt, Mycobacterium leprae
gcgagaucggguugacgcu

SEQ ID NO: 1241628 - RNA, 17 nt, Mycobacterium leprae
gcgacgaaauccucacc

SEQ ID NO: 1241629 - RNA, 15 nt, Mycobacterium leprae
gcgaccuugcggcgc

SEQ ID NO: 1241630 - RNA, 17 nt, Mycobacterium leprae
gcgaccuugcggcgccc

SEQ ID NO: 1241631 - RNA, 13 nt, Mycobacterium leprae
gcgaccagcgagc

SEQ ID NO: 1241632 - RNA, 20 nt, Mycobacterium leprae
gcgaccaguuuacaucggag

SEQ ID NO: 1241633 - RNA, 19 nt, Mycobacterium leprae
gcgacacagccggccggca

SEQ ID NO: 1241634 - RNA, 16 nt, Mycobacterium leprae
gcgacacuacuguugu

SEQ ID NO: 1241635 - RNA, 14 nt, Mycobacterium leprae
gccgcggacaagac

SEQ ID NO: 1241636 - RNA, 16 nt, Mycobacterium leprae
gccggcaaccagcccc

SEQ ID NO: 1241637 - RNA, 13 nt, Mycobacterium leprae
gccggauguguug

SEQ ID NO: 1241638 - RNA, 19 nt, Mycobacterium leprae
gccggcagggaugccaaac

SEQ ID NO: 1241639 - RNA, 16 nt, Mycobacterium leprae
gccggcauagaauccg

SEQ ID NO: 1241640 - RNA, 21 nt, Mycobacterium leprae
gccggccccgaaccauccagc

SEQ ID NO: 1241641 - RNA, 16 nt, Mycobacterium leprae
gccggcgcgcaggcug

SEQ ID NO: 1241642 - RNA, 13 nt, Mycobacterium leprae
gccggccuggcug

SEQ ID NO: 1241643 - RNA, 20 nt, Mycobacterium leprae
gccgggaccuuucccgcaga

SEQ ID NO: 1241644 - RNA, 20 nt, Mycobacterium leprae
gccgggcaaaccacuuagcg

SEQ ID NO: 1241645 - RNA, 20 nt, Mycobacterium leprae
gccggcuuuggcggacugcu

SEQ ID NO: 1241646 - RNA, 18 nt, Mycobacterium leprae
gccggcuguuucuugggu

SEQ ID NO: 1241647 - RNA, 13 nt, Mycobacterium leprae
gccggcguguggg

SEQ ID NO: 1241648 - RNA, 17 nt, Mycobacterium leprae
gccggcucgcauccgca

SEQ ID NO: 1241649 - RNA, 14 nt, Mycobacterium leprae
gccggcgucaggcc

SEQ ID NO: 1241650 - RNA, 20 nt, Mycobacterium leprae
gccggcgucaggccaggcag

SEQ ID NO: 1241651 - RNA, 15 nt, Mycobacterium leprae
gccggcgucgcguca

SEQ ID NO: 1241652 - RNA, 19 nt, Mycobacterium leprae
gccggcgguacugcacguc

SEQ ID NO: 1241653 - RNA, 14 nt, Mycobacterium leprae
gccguccacuggcu

SEQ ID NO: 1241654 - RNA, 17 nt, Mycobacterium leprae
gccuaagcucucgagga

SEQ ID NO: 1241655 - RNA, 13 nt, Mycobacterium leprae
gccgugugcuucg

SEQ ID NO: 1241656 - RNA, 21 nt, Mycobacterium leprae
gccgugcacacgucgagauug

SEQ ID NO: 1241657 - RNA, 13 nt, Mycobacterium leprae
gccgugcccaagg

SEQ ID NO: 1241658 - RNA, 16 nt, Mycobacterium leprae
gccgggucuuccuacg

SEQ ID NO: 1241659 - RNA, 17 nt, Mycobacterium leprae
gccggggcugcgcuggg

SEQ ID NO: 1241660 - RNA, 17 nt, Mycobacterium leprae
gccgggcacuuggguca

SEQ ID NO: 1241661 - RNA, 18 nt, Mycobacterium leprae
gccgggcuaaguccggcc

SEQ ID NO: 1241662 - RNA, 16 nt, Mycobacterium leprae
gccgguagccuggaag

SEQ ID NO: 1241663 - RNA, 17 nt, Mycobacterium leprae
gccgguacucggaaugg

SEQ ID NO: 1241664 - RNA, 14 nt, Mycobacterium leprae
gccgguggccagcg

SEQ ID NO: 1241665 - RNA, 15 nt, Mycobacterium leprae
gccggugcgguccca

SEQ ID NO: 1241666 - RNA, 21 nt, Mycobacterium leprae
gccgcgcgcaagucuggaguc

SEQ ID NO: 1241667 - RNA, 17 nt, Mycobacterium leprae
gccgccauugcccccgc

SEQ ID NO: 1241668 - RNA, 21 nt, Mycobacterium leprae
gccgaucauggagguucuggg

SEQ ID NO: 1241669 - RNA, 19 nt, Mycobacterium leprae
gccgaucccaucggcugca

SEQ ID NO: 1241670 - RNA, 22 nt, Mycobacterium leprae
gccgaucccaucggcugcaccg

SEQ ID NO: 1241671 - RNA, 13 nt, Mycobacterium leprae
gccgaucccgaaa

SEQ ID NO: 1241672 - RNA, 24 nt, Mycobacterium leprae
gccgaguccgcuaaggcagcccgc

SEQ ID NO: 1241673 - RNA, 18 nt, Mycobacterium leprae
gccgaggcucugcucggc

SEQ ID NO: 1241674 - RNA, 15 nt, Mycobacterium leprae
gccgaccaaccuaaa

SEQ ID NO: 1241675 - RNA, 21 nt, Mycobacterium leprae
gcccucguugacgcccuccug

SEQ ID NO: 1241676 - RNA, 14 nt, Mycobacterium leprae
gcccugggccagcg

SEQ ID NO: 1241677 - RNA, 16 nt, Mycobacterium leprae
gcccugggccagcgau

SEQ ID NO: 1241678 - RNA, 15 nt, Mycobacterium leprae
gcccgugcucaguga

SEQ ID NO: 1241679 - RNA, 20 nt, Mycobacterium leprae
gcccuccggaaauacggcag

SEQ ID NO: 1241680 - RNA, 19 nt, Mycobacterium leprae
gcccuagacgggaggaaga

SEQ ID NO: 1241681 - RNA, 14 nt, Mycobacterium leprae
gcccgcccaagaag

SEQ ID NO: 1241682 - RNA, 22 nt, Mycobacterium leprae
gcccgguaccguccguccugcc

SEQ ID NO: 1241683 - RNA, 13 nt, Mycobacterium leprae
gccauucuagguu

SEQ ID NO: 1241684 - RNA, 20 nt, Mycobacterium leprae
gccauucuagguucgagucc

SEQ ID NO: 1241685 - RNA, 17 nt, Mycobacterium leprae
gccaugacaugcacacu

SEQ ID NO: 1241686 - RNA, 19 nt, Mycobacterium leprae
gccaucgguaaccccgcgg

SEQ ID NO: 1241687 - RNA, 15 nt, Mycobacterium leprae
gccaugcacgccggc

SEQ ID NO: 1241688 - RNA, 20 nt, Mycobacterium leprae
gccaucagaagaccagguga

SEQ ID NO: 1241689 - RNA, 15 nt, Mycobacterium leprae
gccaucaccguggcc

SEQ ID NO: 1241690 - RNA, 18 nt, Mycobacterium leprae
gccauccgaaacccgaaa

SEQ ID NO: 1241691 - RNA, 15 nt, Mycobacterium leprae
gccaggggcugggca

SEQ ID NO: 1241692 - RNA, 19 nt, Mycobacterium leprae
gccaggggcugggcaccug

SEQ ID NO: 1241693 - RNA, 20 nt, Mycobacterium leprae
gccagggggcgucaagucca

SEQ ID NO: 1241694 - RNA, 23 nt, Mycobacterium leprae
gccagggguuccaagauggcguc

SEQ ID NO: 1241695 - RNA, 15 nt, Mycobacterium leprae
gccagguagugagua

SEQ ID NO: 1241696 - RNA, 21 nt, Mycobacterium leprae
gccaggucggcuagccgugca

SEQ ID NO: 1241697 - RNA, 13 nt, Mycobacterium leprae
gccagucagccgu

SEQ ID NO: 1241698 - RNA, 16 nt, Mycobacterium leprae
gccagugcaaccuccg

SEQ ID NO: 1241699 - RNA, 20 nt, Mycobacterium leprae
gcccaguuaucuagcccaga

SEQ ID NO: 1241700 - RNA, 15 nt, Mycobacterium leprae
gcccaagugaugucu

SEQ ID NO: 1241701 - RNA, 13 nt, Mycobacterium leprae
gcccaaggcucca

SEQ ID NO: 1241702 - RNA, 16 nt, Mycobacterium leprae
gcccaaucccccaggu

SEQ ID NO: 1241703 - RNA, 15 nt, Mycobacterium leprae
gcccagagaucgccg

SEQ ID NO: 1241704 - RNA, 20 nt, Mycobacterium leprae
gcccagaugaauucgcugau

SEQ ID NO: 1241705 - RNA, 20 nt, Mycobacterium leprae
gccccucucgaguugccgau

SEQ ID NO: 1241706 - RNA, 19 nt, Mycobacterium leprae
gccccucgauuugcucagu

SEQ ID NO: 1241707 - RNA, 19 nt, Mycobacterium leprae
gccccggacccgagccgca

SEQ ID NO: 1241708 - RNA, 15 nt, Mycobacterium leprae
gcccgacagccacca

SEQ ID NO: 1241709 - RNA, 16 nt, Mycobacterium leprae
gcccgcacagcaccau

SEQ ID NO: 1241710 - RNA, 20 nt, Mycobacterium leprae
gccccagauagcccgauuug

SEQ ID NO: 1241711 - RNA, 15 nt, Mycobacterium leprae
gccccagucgccaga

SEQ ID NO: 1241712 - RNA, 17 nt, Mycobacterium leprae
gccccagucgccagagc

SEQ ID NO: 1241713 - RNA, 19 nt, Mycobacterium leprae
gccccagucgccagagccg

SEQ ID NO: 1241714 - RNA, 20 nt, Mycobacterium leprae
gccacuccgguugcggcgag

SEQ ID NO: 1241715 - RNA, 22 nt, Mycobacterium leprae
gccacuccgguugcggcgagcu

SEQ ID NO: 1241716 - RNA, 17 nt, Mycobacterium leprae
gccacgaaaaucuggcg

SEQ ID NO: 1241717 - RNA, 15 nt, Mycobacterium leprae
gccacgaccaaaccu

SEQ ID NO: 1241718 - RNA, 15 nt, Mycobacterium leprae
gccacgagacccagc

SEQ ID NO: 1241719 - RNA, 20 nt, Mycobacterium leprae
gccacaggcgauucauggcu

SEQ ID NO: 1241720 - RNA, 19 nt, Mycobacterium leprae
gccacacgcgacgccgcca

SEQ ID NO: 1241721 - RNA, 22 nt, Mycobacterium leprae
gccacccgccagaucacauugg

SEQ ID NO: 1241722 - RNA, 23 nt, Mycobacterium leprae
gccaccggugauguggccgugga

SEQ ID NO: 1241723 - RNA, 23 nt, Mycobacterium leprae
gccaccggcgcuuguaaggccag

SEQ ID NO: 1241724 - RNA, 16 nt, Mycobacterium leprae
gccaccgacaaagcuc

SEQ ID NO: 1241725 - RNA, 19 nt, Mycobacterium leprae
gccaaccgguggagguacg

SEQ ID NO: 1241726 - RNA, 17 nt, Mycobacterium leprae
gccaacgcgcaccuggu

SEQ ID NO: 1241727 - RNA, 18 nt, Mycobacterium leprae
gccaacgcgcaccuggug

SEQ ID NO: 1241728 - RNA, 22 nt, Mycobacterium leprae
gccaacgcgcaccugguggugc

SEQ ID NO: 1241729 - RNA, 18 nt, Mycobacterium leprae
gccaaacagauccugcuc

SEQ ID NO: 1241730 - RNA, 16 nt, Mycobacterium leprae
gccaauucgccgacca

SEQ ID NO: 1241731 - RNA, 16 nt, Mycobacterium leprae
gccaagaccuaccugc

SEQ ID NO: 1241732 - RNA, 18 nt, Mycobacterium leprae
gccaagccgcccggccug

SEQ ID NO: 1241733 - RNA, 21 nt, Mycobacterium leprae
gccaagcucagcgcagugcca

SEQ ID NO: 1241734 - RNA, 13 nt, Mycobacterium leprae
gcauaucaaacca

SEQ ID NO: 1241735 - RNA, 18 nt, Mycobacterium leprae
gcaucaccggaaagcuga

SEQ ID NO: 1241736 - RNA, 15 nt, Mycobacterium leprae
gcaucggccucaccu

SEQ ID NO: 1241737 - RNA, 16 nt, Mycobacterium leprae
gcaucggcggcggagc

SEQ ID NO: 1241738 - RNA, 14 nt, Mycobacterium leprae
gcaucggcuugaug

SEQ ID NO: 1241739 - RNA, 15 nt, Mycobacterium leprae
gcauguucgaccagg

SEQ ID NO: 1241740 - RNA, 16 nt, Mycobacterium leprae
gcauguuaaaauaaac

SEQ ID NO: 1241741 - RNA, 13 nt, Mycobacterium leprae
gcauuauuuuuua

SEQ ID NO: 1241742 - RNA, 14 nt, Mycobacterium leprae
gcauucagccgcga

SEQ ID NO: 1241743 - RNA, 13 nt, Mycobacterium leprae
gcauuguccagcg

SEQ ID NO: 1241744 - RNA, 20 nt, Mycobacterium leprae
gcauuggucggggugcugca

SEQ ID NO: 1241745 - RNA, 18 nt, Mycobacterium leprae
gcaugaaccucacccagu

SEQ ID NO: 1241746 - RNA, 13 nt, Mycobacterium leprae
gcaucgguggcac

SEQ ID NO: 1241747 - RNA, 17 nt, Mycobacterium leprae
gcaugcgcugaggcagc

SEQ ID NO: 1241748 - RNA, 21 nt, Mycobacterium leprae
gcaugcgcugaggcagcagcu

SEQ ID NO: 1241749 - RNA, 13 nt, Mycobacterium leprae
gcaugagcugcug

SEQ ID NO: 1241750 - RNA, 15 nt, Mycobacterium leprae
gcaugagcugcuggg

SEQ ID NO: 1241751 - RNA, 17 nt, Mycobacterium leprae
gcaugcccugggccagc

SEQ ID NO: 1241752 - RNA, 15 nt, Mycobacterium leprae
gcaugcuaacaucau

SEQ ID NO: 1241753 - RNA, 24 nt, Mycobacterium leprae
gcaugggccgguguacacgugcug

SEQ ID NO: 1241754 - RNA, 16 nt, Mycobacterium leprae
gcagguguccuauaaa

SEQ ID NO: 1241755 - RNA, 21 nt, Mycobacterium leprae
gcaggucgccgacgucuucaa

SEQ ID NO: 1241756 - RNA, 16 nt, Mycobacterium leprae
gcaggucgccgaggcg

SEQ ID NO: 1241757 - RNA, 13 nt, Mycobacterium leprae
gcagggaugccaa

SEQ ID NO: 1241758 - RNA, 21 nt, Mycobacterium leprae
gcaggcaccauugauggaacu

SEQ ID NO: 1241759 - RNA, 13 nt, Mycobacterium leprae
gcagcucuggauc

SEQ ID NO: 1241760 - RNA, 22 nt, Mycobacterium leprae
gcagcugacgauuaucugcaac

SEQ ID NO: 1241761 - RNA, 19 nt, Mycobacterium leprae
gcaggaucggguagcugca

SEQ ID NO: 1241762 - RNA, 15 nt, Mycobacterium leprae
gcagcucgacgggcg

SEQ ID NO: 1241763 - RNA, 15 nt, Mycobacterium leprae
gcagcgacuggaucc

SEQ ID NO: 1241764 - RNA, 16 nt, Mycobacterium leprae
gcagcccuugcagcaa

SEQ ID NO: 1241765 - RNA, 17 nt, Mycobacterium leprae
gcagcccgcgccgccgu

SEQ ID NO: 1241766 - RNA, 18 nt, Mycobacterium leprae
gcagccgagguucccggc

SEQ ID NO: 1241767 - RNA, 15 nt, Mycobacterium leprae
gcagcguggucaccg

SEQ ID NO: 1241768 - RNA, 23 nt, Mycobacterium leprae
gcagcaacauucaccccccagga

SEQ ID NO: 1241769 - RNA, 14 nt, Mycobacterium leprae
gcagcacaaaauuc

SEQ ID NO: 1241770 - RNA, 12 nt, Mycobacterium leprae
gcagcaaucaau

SEQ ID NO: 1241771 - RNA, 15 nt, Mycobacterium leprae
gcagcaccugccgca

SEQ ID NO: 1241772 - RNA, 17 nt, Mycobacterium leprae
gcagcacccgcuugucu

SEQ ID NO: 1241773 - RNA, 22 nt, Mycobacterium leprae
gcagcacgggguguuggcgcuc

SEQ ID NO: 1241774 - RNA, 19 nt, Mycobacterium leprae
gcagcaucgcgucuuccaa

SEQ ID NO: 1241775 - RNA, 23 nt, Mycobacterium leprae
gcagcccagauugcaguccacca

SEQ ID NO: 1241776 - RNA, 22 nt, Mycobacterium leprae
gcagcauccgccgacgaugcgu

SEQ ID NO: 1241777 - RNA, 17 nt, Mycobacterium leprae
gcagcaguuuucugcgc

SEQ ID NO: 1241778 - RNA, 13 nt, Mycobacterium leprae
gcagaagccggcu

SEQ ID NO: 1241779 - RNA, 22 nt, Mycobacterium leprae
gcagacacagccgucagggcag

SEQ ID NO: 1241780 - RNA, 16 nt, Mycobacterium leprae
gcagacacgccgcggc

SEQ ID NO: 1241781 - RNA, 20 nt, Mycobacterium leprae
gcagacacgccgcggcuggg

SEQ ID NO: 1241782 - RNA, 16 nt, Mycobacterium leprae
gcagaauuggagugaa

SEQ ID NO: 1241783 - RNA, 20 nt, Mycobacterium leprae
gcagaaauucagcgccagga

SEQ ID NO: 1241784 - RNA, 19 nt, Mycobacterium leprae
gcagacuuuggagcaggag

SEQ ID NO: 1241785 - RNA, 18 nt, Mycobacterium leprae
gcagaccucuuccgccgc

SEQ ID NO: 1241786 - RNA, 18 nt, Mycobacterium leprae
gcagauuauuaagauaaa

SEQ ID NO: 1241787 - RNA, 18 nt, Mycobacterium leprae
gcagaugcaagauuauua

SEQ ID NO: 1241788 - RNA, 19 nt, Mycobacterium leprae
gcagagcucacugggcuuc

SEQ ID NO: 1241789 - RNA, 15 nt, Mycobacterium leprae
gcagaguaaccacuu

SEQ ID NO: 1241790 - RNA, 17 nt, Mycobacterium leprae
gcacuguucacuaacac

SEQ ID NO: 1241791 - RNA, 20 nt, Mycobacterium leprae
gcacuguucacuaacacgau

SEQ ID NO: 1241792 - RNA, 21 nt, Mycobacterium leprae
gcacuguuacuaccguacagg

SEQ ID NO: 1241793 - RNA, 18 nt, Mycobacterium leprae
gcacugcuucggccagcg

SEQ ID NO: 1241794 - RNA, 19 nt, Mycobacterium leprae
gcacuucgcugagcgaagu

SEQ ID NO: 1241795 - RNA, 15 nt, Mycobacterium leprae
gcacguccccgugca

SEQ ID NO: 1241796 - RNA, 19 nt, Mycobacterium leprae
gcacguguguguaucacga

SEQ ID NO: 1241797 - RNA, 20 nt, Mycobacterium leprae
gcacgugggucauugccgau

SEQ ID NO: 1241798 - RNA, 16 nt, Mycobacterium leprae
gcacuagcuugugcuc

SEQ ID NO: 1241799 - RNA, 17 nt, Mycobacterium leprae
gcacuacccgacacaaa

SEQ ID NO: 1241800 - RNA, 16 nt, Mycobacterium leprae
gcacuaaagucuucaa

SEQ ID NO: 1241801 - RNA, 17 nt, Mycobacterium leprae
gcacuccuacgguguau

SEQ ID NO: 1241802 - RNA, 20 nt, Mycobacterium leprae
gcacuccuucaugcuggccu

SEQ ID NO: 1241803 - RNA, 14 nt, Mycobacterium leprae
gcacggcgugcagg

SEQ ID NO: 1241804 - RNA, 21 nt, Mycobacterium leprae
gcacggcacaaucgucgccuu

SEQ ID NO: 1241805 - RNA, 17 nt, Mycobacterium leprae
gcacggagcggccgcga

SEQ ID NO: 1241806 - RNA, 19 nt, Mycobacterium leprae
gcaccuguugcucaacggg

SEQ ID NO: 1241807 - RNA, 21 nt, Mycobacterium leprae
gcaccuuacgauuacgcacgc

SEQ ID NO: 1241808 - RNA, 21 nt, Mycobacterium leprae
gcacgcaaccgccggcaagcc

SEQ ID NO: 1241809 - RNA, 13 nt, Mycobacterium leprae
gcacgccagcugg

SEQ ID NO: 1241810 - RNA, 19 nt, Mycobacterium leprae
gcaccaacucgaugacacg

SEQ ID NO: 1241811 - RNA, 13 nt, Mycobacterium leprae
gcaccacgcacac

SEQ ID NO: 1241812 - RNA, 21 nt, Mycobacterium leprae
gcaccagcucacccgcagcac

SEQ ID NO: 1241813 - RNA, 23 nt, Mycobacterium leprae
gcaccagcucacccgcagcaccu

SEQ ID NO: 1241814 - RNA, 22 nt, Mycobacterium leprae
gcaccaucucgaccgcgcgcuc

SEQ ID NO: 1241815 - RNA, 17 nt, Mycobacterium leprae
gcaccauuucugccgcu

SEQ ID NO: 1241816 - RNA, 18 nt, Mycobacterium leprae
gcacccggcggcaugccu

SEQ ID NO: 1241817 - RNA, 13 nt, Mycobacterium leprae
gcacccgccaggg

SEQ ID NO: 1241818 - RNA, 14 nt, Mycobacterium leprae
gcacccgcaaaaau

SEQ ID NO: 1241819 - RNA, 22 nt, Mycobacterium leprae
gcaccuaaggccgucgcgggcc

SEQ ID NO: 1241820 - RNA, 16 nt, Mycobacterium leprae
gcaccugggcugugcu

SEQ ID NO: 1241821 - RNA, 18 nt, Mycobacterium leprae
gcaccggcauggccgcug

SEQ ID NO: 1241822 - RNA, 15 nt, Mycobacterium leprae
gcaccggcugcaccc

SEQ ID NO: 1241823 - RNA, 14 nt, Mycobacterium leprae
gcaccggcuugaua

SEQ ID NO: 1241824 - RNA, 22 nt, Mycobacterium leprae
gcaccgaauauuuucaagacug

SEQ ID NO: 1241825 - RNA, 16 nt, Mycobacterium leprae
gcaccgauccggcggc

SEQ ID NO: 1241826 - RNA, 19 nt, Mycobacterium leprae
gcaccgauugccugaugcc

SEQ ID NO: 1241827 - RNA, 15 nt, Mycobacterium leprae
gcaccgcgaagcuga

SEQ ID NO: 1241828 - RNA, 21 nt, Mycobacterium leprae
gcaccgcguaacagauuauug

SEQ ID NO: 1241829 - RNA, 13 nt, Mycobacterium leprae
gcaccgcggcggg

SEQ ID NO: 1241830 - RNA, 15 nt, Mycobacterium leprae
gcacaacaagagaag

SEQ ID NO: 1241831 - RNA, 16 nt, Mycobacterium leprae
gcacaacaagagaaga

SEQ ID NO: 1241832 - RNA, 18 nt, Mycobacterium leprae
gcacaacaagagaagagc

SEQ ID NO: 1241833 - RNA, 19 nt, Mycobacterium leprae
gcacaacaagagaagagcu

SEQ ID NO: 1241834 - RNA, 21 nt, Mycobacterium leprae
gcacaacaagagaagagcugg

SEQ ID NO: 1241835 - RNA, 15 nt, Mycobacterium leprae
gcacaucgucgggug

SEQ ID NO: 1241836 - RNA, 19 nt, Mycobacterium leprae
gcacaucaguaucagugcc

SEQ ID NO: 1241837 - RNA, 17 nt, Mycobacterium leprae
gcacagagcccagcacg

SEQ ID NO: 1241838 - RNA, 15 nt, Mycobacterium leprae
gcacagcaccaugga

SEQ ID NO: 1241839 - RNA, 18 nt, Mycobacterium leprae
gcacagugccugaccauc

SEQ ID NO: 1241840 - RNA, 19 nt, Mycobacterium leprae
gcaaucaaugugcgggccg

SEQ ID NO: 1241841 - RNA, 16 nt, Mycobacterium leprae
gcaagcggccgcccag

SEQ ID NO: 1241842 - RNA, 20 nt, Mycobacterium leprae
gcaagcagauucgagcucau

SEQ ID NO: 1241843 - RNA, 19 nt, Mycobacterium leprae
gcaagcgugcaggcugcau

SEQ ID NO: 1241844 - RNA, 20 nt, Mycobacterium leprae
gcaaggucguguugccaccg

SEQ ID NO: 1241845 - RNA, 17 nt, Mycobacterium leprae
gcaaggucacgagacca

SEQ ID NO: 1241846 - RNA, 21 nt, Mycobacterium leprae
gcaaggugagcguugugggca

SEQ ID NO: 1241847 - RNA, 14 nt, Mycobacterium leprae
gcaaggguggggcc

SEQ ID NO: 1241848 - RNA, 15 nt, Mycobacterium leprae
gcaaggcuuggccag

SEQ ID NO: 1241849 - RNA, 18 nt, Mycobacterium leprae
gcaaguuuagcaacaaau

SEQ ID NO: 1241850 - RNA, 14 nt, Mycobacterium leprae
gcaaguuugagaac

SEQ ID NO: 1241851 - RNA, 16 nt, Mycobacterium leprae
gcaagguguugcggug

SEQ ID NO: 1241852 - RNA, 17 nt, Mycobacterium leprae
gcaagucgccuacacca

SEQ ID NO: 1241853 - RNA, 20 nt, Mycobacterium leprae
gcaacgcaccggcguuccgg

SEQ ID NO: 1241854 - RNA, 16 nt, Mycobacterium leprae
gcaacgacgccacagc

SEQ ID NO: 1241855 - RNA, 21 nt, Mycobacterium leprae
gaucacaaauugucagcuaaa

SEQ ID NO: 1241856 - RNA, 14 nt, Mycobacterium leprae
gaucacaguccugc

SEQ ID NO: 1241857 - RNA, 17 nt, Mycobacterium leprae
gaucacaucagugcugu

SEQ ID NO: 1241858 - RNA, 17 nt, Mycobacterium leprae
gcaacgcugcccaccag

SEQ ID NO: 1241859 - RNA, 14 nt, Mycobacterium leprae
gcaacgccuccacu

SEQ ID NO: 1241860 - RNA, 17 nt, Mycobacterium leprae
gcaacggcaccaaaccc

SEQ ID NO: 1241861 - RNA, 21 nt, Mycobacterium leprae
gcaacggcaccaaacccgccg

SEQ ID NO: 1241862 - RNA, 19 nt, Mycobacterium leprae
gcaacgugggcgauucggg

SEQ ID NO: 1241863 - RNA, 17 nt, Mycobacterium leprae
gcaacguguaaggccag

SEQ ID NO: 1241864 - RNA, 19 nt, Mycobacterium leprae
gcaacguguaaggccagcg

SEQ ID NO: 1241865 - RNA, 16 nt, Mycobacterium leprae
gcaacuaugcggcggg

SEQ ID NO: 1241866 - RNA, 13 nt, Mycobacterium leprae
gcaacgugcaguc

SEQ ID NO: 1241867 - RNA, 15 nt, Mycobacterium leprae
gcaacugagaagguc

SEQ ID NO: 1241868 - RNA, 13 nt, Mycobacterium leprae
gcaacugcuggag

SEQ ID NO: 1241869 - RNA, 17 nt, Mycobacterium leprae
guaaagccguuggcuug

SEQ ID NO: 1241870 - RNA, 18 nt, Mycobacterium leprae
guaaagccgcgcccggcc

SEQ ID NO: 1241871 - RNA, 16 nt, Mycobacterium leprae
guaaacaaaaguguaa

SEQ ID NO: 1241872 - RNA, 16 nt, Mycobacterium leprae
guaaccauaagaccuu

SEQ ID NO: 1241873 - RNA, 21 nt, Mycobacterium leprae
guaacuuguccguuuagacuu

SEQ ID NO: 1241874 - RNA, 18 nt, Mycobacterium leprae
guaacuggcucgauucca

SEQ ID NO: 1241875 - RNA, 22 nt, Mycobacterium leprae
guaagagguuuaccgccaucgg

SEQ ID NO: 1241876 - RNA, 20 nt, Mycobacterium leprae
guaacgcugauugccaacuc

SEQ ID NO: 1241877 - RNA, 19 nt, Mycobacterium leprae
guaaccgcucgauggccag

SEQ ID NO: 1241878 - RNA, 15 nt, Mycobacterium leprae
guaacgauuagcaug

SEQ ID NO: 1241879 - RNA, 19 nt, Mycobacterium leprae
guaagguuguugacgauga

SEQ ID NO: 1241880 - RNA, 17 nt, Mycobacterium leprae
guaagcuuggggucgcu

SEQ ID NO: 1241881 - RNA, 16 nt, Mycobacterium leprae
guaagcuugcagucuu

SEQ ID NO: 1241882 - RNA, 16 nt, Mycobacterium leprae
guaagcuggcucgguc

SEQ ID NO: 1241883 - RNA, 16 nt, Mycobacterium leprae
guaauaauauccaaag

SEQ ID NO: 1241884 - RNA, 19 nt, Mycobacterium leprae
guaaugcaagcgcuuuucc

SEQ ID NO: 1241885 - RNA, 17 nt, Mycobacterium leprae
guaaucguaccaacacc

SEQ ID NO: 1241886 - RNA, 20 nt, Mycobacterium leprae
guaccagcggcagcggcggc

SEQ ID NO: 1241887 - RNA, 18 nt, Mycobacterium leprae
guaccgcgaacccugguc

SEQ ID NO: 1241888 - RNA, 18 nt, Mycobacterium leprae
guaccccauucagcggcg

SEQ ID NO: 1241889 - RNA, 15 nt, Mycobacterium leprae
guaccccccaucugc

SEQ ID NO: 1241890 - RNA, 20 nt, Mycobacterium leprae
guacccggccagauccagca

SEQ ID NO: 1241891 - RNA, 23 nt, Mycobacterium leprae
guacgacaaaauuuucaggcugu

SEQ ID NO: 1241892 - RNA, 18 nt, Mycobacterium leprae
guaccuucuguauggcuc

SEQ ID NO: 1241893 - RNA, 13 nt, Mycobacterium leprae
guacggaucgaaa

SEQ ID NO: 1241894 - RNA, 20 nt, Mycobacterium leprae
guacggagauagacaugugu

SEQ ID NO: 1241895 - RNA, 20 nt, Mycobacterium leprae
ggugcugcuuggucuacaug

SEQ ID NO: 1241896 - RNA, 17 nt, Mycobacterium leprae
ggugcugcacggcugcg

SEQ ID NO: 1241897 - RNA, 20 nt, Mycobacterium leprae
ggugcgugagguguugccga

SEQ ID NO: 1241898 - RNA, 17 nt, Mycobacterium leprae
ggugcgucaggucgcaa

SEQ ID NO: 1241899 - RNA, 22 nt, Mycobacterium leprae
ggugcgccaacacuagcggcua

SEQ ID NO: 1241900 - RNA, 22 nt, Mycobacterium leprae
ggugccgaucccggcgcugucc

SEQ ID NO: 1241901 - RNA, 14 nt, Mycobacterium leprae
ggugggcagccugg

SEQ ID NO: 1241902 - RNA, 16 nt, Mycobacterium leprae
gguggggguggggauc

SEQ ID NO: 1241903 - RNA, 19 nt, Mycobacterium leprae
gguggcugucgggcaccug

SEQ ID NO: 1241904 - RNA, 15 nt, Mycobacterium leprae
gguggcgaucggcuc

SEQ ID NO: 1241905 - RNA, 19 nt, Mycobacterium leprae
ggugcuguguugugggugu

SEQ ID NO: 1241906 - RNA, 20 nt, Mycobacterium leprae
gguggacgaaccggacagca

SEQ ID NO: 1241907 - RNA, 21 nt, Mycobacterium leprae
gguggaguaaaggguggcggu

SEQ ID NO: 1241908 - RNA, 17 nt, Mycobacterium leprae
gguggaguucgucugaa

SEQ ID NO: 1241909 - RNA, 19 nt, Mycobacterium leprae
gguggauccaggugcugca

SEQ ID NO: 1241910 - RNA, 16 nt, Mycobacterium leprae
ggugacgguguuggug

SEQ ID NO: 1241911 - RNA, 19 nt, Mycobacterium leprae
ggcucccgggucgagcagc

SEQ ID NO: 1241912 - RNA, 21 nt, Mycobacterium leprae
ggcucccgggucgagcagcca

SEQ ID NO: 1241913 - RNA, 15 nt, Mycobacterium leprae
ggugaucgugguggg

SEQ ID NO: 1241914 - RNA, 19 nt, Mycobacterium leprae
ggugagucgcccagcaggu

SEQ ID NO: 1241915 - RNA, 14 nt, Mycobacterium leprae
ggugcaccagcuca

SEQ ID NO: 1241916 - RNA, 16 nt, Mycobacterium leprae
ggugcagugccgccga

SEQ ID NO: 1241917 - RNA, 20 nt, Mycobacterium leprae
gguugaucugcgcuagaagg

SEQ ID NO: 1241918 - RNA, 19 nt, Mycobacterium leprae
gguugacccgcgguagcgg

SEQ ID NO: 1241919 - RNA, 16 nt, Mycobacterium leprae
gguuguucgacaagcu

SEQ ID NO: 1241920 - RNA, 16 nt, Mycobacterium leprae
gguugguagcuggcuc

SEQ ID NO: 1241921 - RNA, 12 nt, Mycobacterium leprae
gguuggugguga

SEQ ID NO: 1241922 - RNA, 16 nt, Mycobacterium leprae
gguugcguggcugcuu

SEQ ID NO: 1241923 - RNA, 15 nt, Mycobacterium leprae
gguugcuuugggggu

SEQ ID NO: 1241924 - RNA, 18 nt, Mycobacterium leprae
gguugcuuuggggguugc

SEQ ID NO: 1241925 - RNA, 20 nt, Mycobacterium leprae
gguguucgcuccgcccacua

SEQ ID NO: 1241926 - RNA, 16 nt, Mycobacterium leprae
ggugugugaggaucug

SEQ ID NO: 1241927 - RNA, 15 nt, Mycobacterium leprae
gguguggagccugcc

SEQ ID NO: 1241928 - RNA, 19 nt, Mycobacterium leprae
gguguauaauuugaagcug

SEQ ID NO: 1241929 - RNA, 13 nt, Mycobacterium leprae
ggugucggcggcu

SEQ ID NO: 1241930 - RNA, 17 nt, Mycobacterium leprae
ggugucccgaugaucca

SEQ ID NO: 1241931 - RNA, 15 nt, Mycobacterium leprae
gguguccgggccgca

SEQ ID NO: 1241932 - RNA, 12 nt, Mycobacterium leprae
ggugguggguga

SEQ ID NO: 1241933 - RNA, 15 nt, Mycobacterium leprae
gguggugggugcugc

SEQ ID NO: 1241934 - RNA, 15 nt, Mycobacterium leprae
ggugguccggguugc

SEQ ID NO: 1241935 - RNA, 20 nt, Mycobacterium leprae
gguggugaaaucguccaggg

SEQ ID NO: 1241936 - RNA, 12 nt, Mycobacterium leprae
gguggguggcug

SEQ ID NO: 1241937 - RNA, 14 nt, Mycobacterium leprae
gguuaugcagugau

SEQ ID NO: 1241938 - RNA, 14 nt, Mycobacterium leprae
gguuccgcaauuuc

SEQ ID NO: 1241939 - RNA, 13 nt, Mycobacterium leprae
gguucauggcugu

SEQ ID NO: 1241940 - RNA, 14 nt, Mycobacterium leprae
gguucauggcuguu

SEQ ID NO: 1241941 - RNA, 15 nt, Mycobacterium leprae
gguucuaccucggcc

SEQ ID NO: 1241942 - RNA, 14 nt, Mycobacterium leprae
gucgucagcugcug

SEQ ID NO: 1241943 - RNA, 14 nt, Mycobacterium leprae
gucgucggccaggc

SEQ ID NO: 1241944 - RNA, 21 nt, Mycobacterium leprae
gucggcggcgccgaucccauc

SEQ ID NO: 1241945 - RNA, 23 nt, Mycobacterium leprae
gucguacggcgacucaucgccaa

SEQ ID NO: 1241946 - RNA, 12 nt, Mycobacterium leprae
gucggucugccu

SEQ ID NO: 1241947 - RNA, 16 nt, Mycobacterium leprae
gucguacucuggcugg

SEQ ID NO: 1241948 - RNA, 16 nt, Mycobacterium leprae
gucggagucaucgacu

SEQ ID NO: 1241949 - RNA, 12 nt, Mycobacterium leprae
gucggccaggcu

SEQ ID NO: 1241950 - RNA, 19 nt, Mycobacterium leprae
gucggccaguaccuccagc

SEQ ID NO: 1241951 - RNA, 18 nt, Mycobacterium leprae
gucggcccagggaugcug

SEQ ID NO: 1241952 - RNA, 19 nt, Mycobacterium leprae
gucgcucgguaagcuggcu

SEQ ID NO: 1241953 - RNA, 22 nt, Mycobacterium leprae
gucgccaguaugugaugcagcu

SEQ ID NO: 1241954 - RNA, 18 nt, Mycobacterium leprae
guccgguugcguggcugc

SEQ ID NO: 1241955 - RNA, 19 nt, Mycobacterium leprae
guccgguugcguggcugcu

SEQ ID NO: 1241956 - RNA, 13 nt, Mycobacterium leprae
guccgagaaucag

SEQ ID NO: 1241957 - RNA, 23 nt, Mycobacterium leprae
guccgaucgcaccggcugcaccc

SEQ ID NO: 1241958 - RNA, 14 nt, Mycobacterium leprae
guccgcaaaaugcu

SEQ ID NO: 1241959 - RNA, 20 nt, Mycobacterium leprae
guccgcaaaaugcuccccca

SEQ ID NO: 1241960 - RNA, 16 nt, Mycobacterium leprae
guccugggauugggca

SEQ ID NO: 1241961 - RNA, 19 nt, Mycobacterium leprae
guccugguaccccagcaaa

SEQ ID NO: 1241962 - RNA, 22 nt, Mycobacterium leprae
guccugguaccccagcaaaaag

SEQ ID NO: 1241963 - RNA, 12 nt, Mycobacterium leprae
gucgaaacguca

SEQ ID NO: 1241964 - RNA, 15 nt, Mycobacterium leprae
guccuguugauuuuu

SEQ ID NO: 1241965 - RNA, 17 nt, Mycobacterium leprae
gucgaacgcacuggaga

SEQ ID NO: 1241966 - RNA, 14 nt, Mycobacterium leprae
gucgcaggagaucc

SEQ ID NO: 1241967 - RNA, 14 nt, Mycobacterium leprae
gucgauuacucacg

SEQ ID NO: 1241968 - RNA, 18 nt, Mycobacterium leprae
gucgauguugguguggcg

SEQ ID NO: 1241969 - RNA, 20 nt, Mycobacterium leprae
gucgagucauguucccugac

SEQ ID NO: 1241970 - RNA, 14 nt, Mycobacterium leprae
gucgaugaugaaaa

SEQ ID NO: 1241971 - RNA, 17 nt, Mycobacterium leprae
gucgacuucgcagccac

SEQ ID NO: 1241972 - RNA, 12 nt, Mycobacterium leprae
gucgaggccaga

SEQ ID NO: 1241973 - RNA, 16 nt, Mycobacterium leprae
gucgagggcucagugu

SEQ ID NO: 1241974 - RNA, 17 nt, Mycobacterium leprae
gucgaagugcgccagcg

SEQ ID NO: 1241975 - RNA, 14 nt, Mycobacterium leprae
gucccacagccgcg

SEQ ID NO: 1241976 - RNA, 14 nt, Mycobacterium leprae
gucccaagcgcuga

SEQ ID NO: 1241977 - RNA, 18 nt, Mycobacterium leprae
gucccaaggggagcaggu

SEQ ID NO: 1241978 - RNA, 22 nt, Mycobacterium leprae
guccauucgccguccacuggcu

SEQ ID NO: 1241979 - RNA, 17 nt, Mycobacterium leprae
gucccggugcugccugc

SEQ ID NO: 1241980 - RNA, 15 nt, Mycobacterium leprae
gucccuguccuucaa

SEQ ID NO: 1241981 - RNA, 16 nt, Mycobacterium leprae
gucccuggggcugcau

SEQ ID NO: 1241982 - RNA, 21 nt, Mycobacterium leprae
guccacgucggucauuguuag

SEQ ID NO: 1241983 - RNA, 13 nt, Mycobacterium leprae
guccaccugccag

SEQ ID NO: 1241984 - RNA, 12 nt, Mycobacterium leprae
gucaugcagaug

SEQ ID NO: 1241985 - RNA, 15 nt, Mycobacterium leprae
gucaugauccagcug

SEQ ID NO: 1241986 - RNA, 16 nt, Mycobacterium leprae
gucaugauccagcugu

SEQ ID NO: 1241987 - RNA, 18 nt, Mycobacterium leprae
gucagcuggaauccccca

SEQ ID NO: 1241988 - RNA, 14 nt, Mycobacterium leprae
gucaggauaccgaa

SEQ ID NO: 1241989 - RNA, 13 nt, Mycobacterium leprae
gucagaagcuggu

SEQ ID NO: 1241990 - RNA, 20 nt, Mycobacterium leprae
gucagcgugcuccaggguga

SEQ ID NO: 1241991 - RNA, 18 nt, Mycobacterium leprae
gucagcgucguggcugug

SEQ ID NO: 1241992 - RNA, 15 nt, Mycobacterium leprae
gucagcggacugcua

SEQ ID NO: 1241993 - RNA, 17 nt, Mycobacterium leprae
gucagcggacugcuagc

SEQ ID NO: 1241994 - RNA, 12 nt, Mycobacterium leprae
gucagcacaugg

SEQ ID NO: 1241995 - RNA, 23 nt, Mycobacterium leprae
gucacagguaaacaaaaguguaa

SEQ ID NO: 1241996 - RNA, 22 nt, Mycobacterium leprae
gucaacggccucacaguaggcc

SEQ ID NO: 1241997 - RNA, 19 nt, Mycobacterium leprae
gucaacgggacugacggag

SEQ ID NO: 1241998 - RNA, 17 nt, Mycobacterium leprae
gucaccgugcagcguga

SEQ ID NO: 1241999 - RNA, 18 nt, Mycobacterium leprae
gucaaauuacgcgugcca

SEQ ID NO: 1242000 - RNA, 16 nt, Mycobacterium leprae
gucaaauucaaccgga

SEQ ID NO: 1242001 - RNA, 16 nt, Mycobacterium leprae
gucaaagcccuucacu

SEQ ID NO: 1242002 - RNA, 20 nt, Mycobacterium leprae
gucaaagcuagccaccaagu

SEQ ID NO: 1242003 - RNA, 12 nt, Mycobacterium leprae
gucaaaaacuca

SEQ ID NO: 1242004 - RNA, 22 nt, Mycobacterium leprae
guauugcuuagcuaugcaguga

SEQ ID NO: 1242005 - RNA, 11 nt, Mycobacterium leprae
guaugcaugcu

SEQ ID NO: 1242006 - RNA, 17 nt, Mycobacterium leprae
guaugcaccgcggcggg

SEQ ID NO: 1242007 - RNA, 23 nt, Mycobacterium leprae
guaugguguaauuggcaacacag

SEQ ID NO: 1242008 - RNA, 15 nt, Mycobacterium leprae
guaucgccgaucaau

SEQ ID NO: 1242009 - RNA, 16 nt, Mycobacterium leprae
guaucggcauauccgc

SEQ ID NO: 1242010 - RNA, 23 nt, Mycobacterium leprae
guaucucgcauauggccgaaccu

SEQ ID NO: 1242011 - RNA, 13 nt, Mycobacterium leprae
guauccaagguga

SEQ ID NO: 1242012 - RNA, 18 nt, Mycobacterium leprae
guauccggaggcggccac

SEQ ID NO: 1242013 - RNA, 19 nt, Mycobacterium leprae
guaucacgauguagagcug

SEQ ID NO: 1242014 - RNA, 15 nt, Mycobacterium leprae
guaucaaaacuauug

SEQ ID NO: 1242015 - RNA, 16 nt, Mycobacterium leprae
guauagugguucugcu

SEQ ID NO: 1242016 - RNA, 17 nt, Mycobacterium leprae
guaguuuccugagcagc

SEQ ID NO: 1242017 - RNA, 16 nt, Mycobacterium leprae
guauaauuugaagcug

SEQ ID NO: 1242018 - RNA, 13 nt, Mycobacterium leprae
guauaaccugcuu

SEQ ID NO: 1242019 - RNA, 21 nt, Mycobacterium leprae
guagcuaguuuaccgugguug

SEQ ID NO: 1242020 - RNA, 19 nt, Mycobacterium leprae
guagcucaauuggcagagc

SEQ ID NO: 1242021 - RNA, 22 nt, Mycobacterium leprae
guagcggucggcgcacaggugu

SEQ ID NO: 1242022 - RNA, 22 nt, Mycobacterium leprae
guaggcugucugcggauuuugc

SEQ ID NO: 1242023 - RNA, 21 nt, Mycobacterium leprae
guaggggcguuuuagugugca

SEQ ID NO: 1242024 - RNA, 17 nt, Mycobacterium leprae
guaguguagcugcagcg

SEQ ID NO: 1242025 - RNA, 18 nt, Mycobacterium leprae
guaguguagcugcagcga

SEQ ID NO: 1242026 - RNA, 18 nt, Mycobacterium leprae
guagugucaaucuacacu

SEQ ID NO: 1242027 - RNA, 14 nt, Mycobacterium leprae
guacuggugauaaa

SEQ ID NO: 1242028 - RNA, 16 nt, Mycobacterium leprae
guacuggugcuguguu

SEQ ID NO: 1242029 - RNA, 14 nt, Mycobacterium leprae
guacuuugugugca

SEQ ID NO: 1242030 - RNA, 18 nt, Mycobacterium leprae
guagauaucuacugggcc

SEQ ID NO: 1242031 - RNA, 18 nt, Mycobacterium leprae
guagagaagucaggcugu

SEQ ID NO: 1242032 - RNA, 15 nt, Mycobacterium leprae
guagaccucuucaga

SEQ ID NO: 1242033 - RNA, 16 nt, Mycobacterium leprae
guagacgugcacaaga

SEQ ID NO: 1242034 - RNA, 17 nt, Mycobacterium leprae
uaaaaagauauuaaguu

SEQ ID NO: 1242035 - RNA, 17 nt, Mycobacterium leprae
uaaaaaccuguguauca

SEQ ID NO: 1242036 - RNA, 15 nt, Mycobacterium leprae
guuuucucgcagggg

SEQ ID NO: 1242037 - RNA, 14 nt, Mycobacterium leprae
guuuucucuaaaag

SEQ ID NO: 1242038 - RNA, 15 nt, Mycobacterium leprae
guuuuaccagccaga

SEQ ID NO: 1242039 - RNA, 13 nt, Mycobacterium leprae
guuuggcugacac

SEQ ID NO: 1242040 - RNA, 14 nt, Mycobacterium leprae
guuugggugguggu

SEQ ID NO: 1242041 - RNA, 14 nt, Mycobacterium leprae
guuugggugguguu

SEQ ID NO: 1242042 - RNA, 21 nt, Mycobacterium leprae
guuugggugguguuguggugg

SEQ ID NO: 1242043 - RNA, 23 nt, Mycobacterium leprae
uaaaaccgguuugauccagccga

SEQ ID NO: 1242044 - RNA, 19 nt, Mycobacterium leprae
uaaccgcucgauggccagc

SEQ ID NO: 1242045 - RNA, 22 nt, Mycobacterium leprae
uaacauuugauguccauggcuu

SEQ ID NO: 1242046 - RNA, 14 nt, Mycobacterium leprae
uaacagauuauugc

SEQ ID NO: 1242047 - RNA, 22 nt, Mycobacterium leprae
uaaacgaacuucagaagcacga

SEQ ID NO: 1242048 - RNA, 13 nt, Mycobacterium leprae
uaaacacgugcau

SEQ ID NO: 1242049 - RNA, 19 nt, Mycobacterium leprae
uaaacaaaaguguaaccaa

SEQ ID NO: 1242050 - RNA, 17 nt, Mycobacterium leprae
uaaaauuuaaaaauuug

SEQ ID NO: 1242051 - RNA, 22 nt, Mycobacterium leprae
guugggagugcuagcggcgcca

SEQ ID NO: 1242052 - RNA, 16 nt, Mycobacterium leprae
guuguaguagaccuug

SEQ ID NO: 1242053 - RNA, 15 nt, Mycobacterium leprae
guugugccgcugcau

SEQ ID NO: 1242054 - RNA, 24 nt, Mycobacterium leprae
guuggauucgguguugcuggcggu

SEQ ID NO: 1242055 - RNA, 22 nt, Mycobacterium leprae
guugccgaaccucgccaccugg

SEQ ID NO: 1242056 - RNA, 20 nt, Mycobacterium leprae
guugccaucgacgccgccgu

SEQ ID NO: 1242057 - RNA, 17 nt, Mycobacterium leprae
guuuacaucggagggga

SEQ ID NO: 1242058 - RNA, 19 nt, Mycobacterium leprae
guuuaccaagccggugcca

SEQ ID NO: 1242059 - RNA, 17 nt, Mycobacterium leprae
guuuaccgugguugcug

SEQ ID NO: 1242060 - RNA, 19 nt, Mycobacterium leprae
guuguucaacaacaauacu

SEQ ID NO: 1242061 - RNA, 21 nt, Mycobacterium leprae
guugugaaccacugcgcccug

SEQ ID NO: 1242062 - RNA, 13 nt, Mycobacterium leprae
guuguugauggug

SEQ ID NO: 1242063 - RNA, 15 nt, Mycobacterium leprae
guuguuguggugugc

SEQ ID NO: 1242064 - RNA, 19 nt, Mycobacterium leprae
guugcaaaucaccagcgac

SEQ ID NO: 1242065 - RNA, 20 nt, Mycobacterium leprae
guugcaaaucaccagcgacg

SEQ ID NO: 1242066 - RNA, 20 nt, Mycobacterium leprae
guugaucauucgauccaaug

SEQ ID NO: 1242067 - RNA, 16 nt, Mycobacterium leprae
guugauagcgcuggug

SEQ ID NO: 1242068 - RNA, 16 nt, Mycobacterium leprae
guugacguggugauca

SEQ ID NO: 1242069 - RNA, 23 nt, Mycobacterium leprae
guugaccggcccucagccagcaa

SEQ ID NO: 1242070 - RNA, 16 nt, Mycobacterium leprae
guugacugcgaaaaau

SEQ ID NO: 1242071 - RNA, 17 nt, Mycobacterium leprae
guugaaaacgguuaguc

SEQ ID NO: 1242072 - RNA, 20 nt, Mycobacterium leprae
guucuugaucgacguccaca

SEQ ID NO: 1242073 - RNA, 22 nt, Mycobacterium leprae
guucuugaccgucaugcugcuc

SEQ ID NO: 1242074 - RNA, 23 nt, Mycobacterium leprae
guucuggcacccacgcugcgcgg

SEQ ID NO: 1242075 - RNA, 14 nt, Mycobacterium leprae
guucugcgcuggcc

SEQ ID NO: 1242076 - RNA, 14 nt, Mycobacterium leprae
guucuguccgcaca

SEQ ID NO: 1242077 - RNA, 16 nt, Mycobacterium leprae
guucuguccgcacaaa

SEQ ID NO: 1242078 - RNA, 18 nt, Mycobacterium leprae
guucuuacccgagcugac

SEQ ID NO: 1242079 - RNA, 17 nt, Mycobacterium leprae
guucaacgggugucuga

SEQ ID NO: 1242080 - RNA, 16 nt, Mycobacterium leprae
guucauuaugggggug

SEQ ID NO: 1242081 - RNA, 14 nt, Mycobacterium leprae
guuccguugauggu

SEQ ID NO: 1242082 - RNA, 12 nt, Mycobacterium leprae
guucccggcggc

SEQ ID NO: 1242083 - RNA, 21 nt, Mycobacterium leprae
guucgcuuguguacuccacca

SEQ ID NO: 1242084 - RNA, 18 nt, Mycobacterium leprae
guucgacaagcccccgcg

SEQ ID NO: 1242085 - RNA, 19 nt, Mycobacterium leprae
guuaucggaagcguuguaa

SEQ ID NO: 1242086 - RNA, 18 nt, Mycobacterium leprae
guuaucuaaaucauucaa

SEQ ID NO: 1242087 - RNA, 13 nt, Mycobacterium leprae
guuauccacagca

SEQ ID NO: 1242088 - RNA, 18 nt, Mycobacterium leprae
guuauucucuguugcugu

SEQ ID NO: 1242089 - RNA, 19 nt, Mycobacterium leprae
guuagccguuauggcgcug

SEQ ID NO: 1242090 - RNA, 13 nt, Mycobacterium leprae
guuauaaguuaua

SEQ ID NO: 1242091 - RNA, 21 nt, Mycobacterium leprae
guuagaggguccggaccugga

SEQ ID NO: 1242092 - RNA, 13 nt, Mycobacterium leprae
guguuuaggaaac

SEQ ID NO: 1242093 - RNA, 13 nt, Mycobacterium leprae
guguugugguggg

SEQ ID NO: 1242094 - RNA, 20 nt, Mycobacterium leprae
gugucgaugaugcgcuguug

SEQ ID NO: 1242095 - RNA, 17 nt, Mycobacterium leprae
guguuuugucgguggug

SEQ ID NO: 1242096 - RNA, 19 nt, Mycobacterium leprae
guguuuugucggugguggg

SEQ ID NO: 1242097 - RNA, 14 nt, Mycobacterium leprae
guguuuugcugugu

SEQ ID NO: 1242098 - RNA, 22 nt, Mycobacterium leprae
guguuuguuauaguccgcagaa

SEQ ID NO: 1242099 - RNA, 17 nt, Mycobacterium leprae
guuaauauauuccaggu

SEQ ID NO: 1242100 - RNA, 15 nt, Mycobacterium leprae
guuacaucacaggau

SEQ ID NO: 1242101 - RNA, 15 nt, Mycobacterium leprae
guguccgggccgcaa

SEQ ID NO: 1242102 - RNA, 20 nt, Mycobacterium leprae
guguccgcaaaaugcucccc

SEQ ID NO: 1242103 - RNA, 15 nt, Mycobacterium leprae
gugguggaugcugcu

SEQ ID NO: 1242104 - RNA, 19 nt, Mycobacterium leprae
guggucaagugucgggugg

SEQ ID NO: 1242105 - RNA, 14 nt, Mycobacterium leprae
gugguagggccaca

SEQ ID NO: 1242106 - RNA, 21 nt, Mycobacterium leprae
gugguagggcguugucuugug

SEQ ID NO: 1242107 - RNA, 15 nt, Mycobacterium leprae
guggucaccgcugug

SEQ ID NO: 1242108 - RNA, 18 nt, Mycobacterium leprae
guggucaccgcuguggca

SEQ ID NO: 1242109 - RNA, 15 nt, Mycobacterium leprae
gugguaucugcaccu

SEQ ID NO: 1242110 - RNA, 18 nt, Mycobacterium leprae
gugguccuuccggccucc

SEQ ID NO: 1242111 - RNA, 17 nt, Mycobacterium leprae
guggucugaaguggggu

SEQ ID NO: 1242112 - RNA, 17 nt, Mycobacterium leprae
gugggugguugaucugc

SEQ ID NO: 1242113 - RNA, 17 nt, Mycobacterium leprae
gugggcucguguuguuc

SEQ ID NO: 1242114 - RNA, 22 nt, Mycobacterium leprae
gugggcugguggggugugggug

SEQ ID NO: 1242115 - RNA, 12 nt, Mycobacterium leprae
gugggcggcggc

SEQ ID NO: 1242116 - RNA, 22 nt, Mycobacterium leprae
gugggcgaucaggaggugguca

SEQ ID NO: 1242117 - RNA, 16 nt, Mycobacterium leprae
guggcuugaguuuuga

SEQ ID NO: 1242118 - RNA, 17 nt, Mycobacterium leprae
guggcuuugggaucuuu

SEQ ID NO: 1242119 - RNA, 23 nt, Mycobacterium leprae
guggcugaugucuuggcugacgg

SEQ ID NO: 1242120 - RNA, 17 nt, Mycobacterium leprae
guggcugcaaucaauca

SEQ ID NO: 1242121 - RNA, 19 nt, Mycobacterium leprae
guggccgaggucgaggaua

SEQ ID NO: 1242122 - RNA, 19 nt, Mycobacterium leprae
guggacucagcaaugcucu

SEQ ID NO: 1242123 - RNA, 13 nt, Mycobacterium leprae
gugcugcuguggu

SEQ ID NO: 1242124 - RNA, 15 nt, Mycobacterium leprae
gugcugccagggcuc

SEQ ID NO: 1242125 - RNA, 17 nt, Mycobacterium leprae
gugcugcugcuggugga

SEQ ID NO: 1242126 - RNA, 16 nt, Mycobacterium leprae
gugcugaguccgauga

SEQ ID NO: 1242127 - RNA, 21 nt, Mycobacterium leprae
gugcugcaagcaguucggcug

SEQ ID NO: 1242128 - RNA, 15 nt, Mycobacterium leprae
gugcugauggccggc

SEQ ID NO: 1242129 - RNA, 16 nt, Mycobacterium leprae
gugcugaucaccggcc

SEQ ID NO: 1242130 - RNA, 18 nt, Mycobacterium leprae
gugcugaucaccggccag

SEQ ID NO: 1242131 - RNA, 18 nt, Mycobacterium leprae
guggaaucggguuuuaga

SEQ ID NO: 1242132 - RNA, 18 nt, Mycobacterium leprae
guggaauccgcugcacga

SEQ ID NO: 1242133 - RNA, 20 nt, Mycobacterium leprae
gugcuccugacucgccggug

SEQ ID NO: 1242134 - RNA, 24 nt, Mycobacterium leprae
gugcuaauucccgaugaccuugaa

SEQ ID NO: 1242135 - RNA, 14 nt, Mycobacterium leprae
gugcgugccacauu

SEQ ID NO: 1242136 - RNA, 15 nt, Mycobacterium leprae
gugcggcagcugcca

SEQ ID NO: 1242137 - RNA, 20 nt, Mycobacterium leprae
gucuauuuugucagaucuca

SEQ ID NO: 1242138 - RNA, 20 nt, Mycobacterium leprae
gugaucacaucagugcugug

SEQ ID NO: 1242139 - RNA, 14 nt, Mycobacterium leprae
gucuaggauagacu

SEQ ID NO: 1242140 - RNA, 15 nt, Mycobacterium leprae
gucuaggauagacuc

SEQ ID NO: 1242141 - RNA, 12 nt, Mycobacterium leprae
gugcagccucau

SEQ ID NO: 1242142 - RNA, 16 nt, Mycobacterium leprae
gugcaccaucugcucu

SEQ ID NO: 1242143 - RNA, 14 nt, Mycobacterium leprae
gugcaccagcucac

SEQ ID NO: 1242144 - RNA, 15 nt, Mycobacterium leprae
gugcaaauggcacug

SEQ ID NO: 1242145 - RNA, 15 nt, Mycobacterium leprae
gugcaguccucugga

SEQ ID NO: 1242146 - RNA, 12 nt, Mycobacterium leprae
aaauauacuuua

SEQ ID NO: 1242147 - RNA, 17 nt, Mycobacterium leprae
gugcauccgccacaugu

SEQ ID NO: 1242148 - RNA, 22 nt, Mycobacterium leprae
gugcauguucuguugugggggu

SEQ ID NO: 1242149 - RNA, 14 nt, Mycobacterium leprae
gugccgaggcucug

SEQ ID NO: 1242150 - RNA, 13 nt, Mycobacterium leprae
gugccgcaggcac

SEQ ID NO: 1242151 - RNA, 20 nt, Mycobacterium leprae
gugccgcaggcacccguuga

SEQ ID NO: 1242152 - RNA, 15 nt, Mycobacterium leprae
gugccgagcuggccg

SEQ ID NO: 1242153 - RNA, 16 nt, Mycobacterium leprae
gugccaguucccuaca

SEQ ID NO: 1242154 - RNA, 23 nt, Mycobacterium leprae
gugccaacgcgcaccugguggug

SEQ ID NO: 1242155 - RNA, 19 nt, Mycobacterium leprae
gugccaacucggccgccag

SEQ ID NO: 1242156 - RNA, 15 nt, Mycobacterium leprae
gugccuugacuucuu

SEQ ID NO: 1242157 - RNA, 14 nt, Mycobacterium leprae
gugcgaaaacacuu

SEQ ID NO: 1242158 - RNA, 23 nt, Mycobacterium leprae
gugccuucugcacccgccagggc

SEQ ID NO: 1242159 - RNA, 19 nt, Mycobacterium leprae
gugccguuggcccaccgcc

SEQ ID NO: 1242160 - RNA, 18 nt, Mycobacterium leprae
uacaccaacauagucaga

SEQ ID NO: 1242161 - RNA, 22 nt, Mycobacterium leprae
uacaccaacauagucagaucaa

SEQ ID NO: 1242162 - RNA, 18 nt, Mycobacterium leprae
uacaaugugucaaaaggc

SEQ ID NO: 1242163 - RNA, 16 nt, Mycobacterium leprae
uacacgguauaaaggc

SEQ ID NO: 1242164 - RNA, 21 nt, Mycobacterium leprae
uaccaagccggugccaggcag

SEQ ID NO: 1242165 - RNA, 14 nt, Mycobacterium leprae
uacaugcuggcagu

SEQ ID NO: 1242166 - RNA, 19 nt, Mycobacterium leprae
uacauagguagauaaacau

SEQ ID NO: 1242167 - RNA, 14 nt, Mycobacterium leprae
uacauaguccaguc

SEQ ID NO: 1242168 - RNA, 12 nt, Mycobacterium leprae
uacagccgaggg

SEQ ID NO: 1242169 - RNA, 15 nt, Mycobacterium leprae
uacagcgauucugug

SEQ ID NO: 1242170 - RNA, 15 nt, Mycobacterium leprae
uacaggcgugugcua

SEQ ID NO: 1242171 - RNA, 18 nt, Mycobacterium leprae
uaauggcgggcuggagga

SEQ ID NO: 1242172 - RNA, 16 nt, Mycobacterium leprae
uaauucuucucuaaaa

SEQ ID NO: 1242173 - RNA, 19 nt, Mycobacterium leprae
uaauucuucucuaaaaaga

SEQ ID NO: 1242174 - RNA, 16 nt, Mycobacterium leprae
uaacgauuagcaugac

SEQ ID NO: 1242175 - RNA, 18 nt, Mycobacterium leprae
uaaucgcgggcaagcccu

SEQ ID NO: 1242176 - RNA, 16 nt, Mycobacterium leprae
uaaucguguccacugc

SEQ ID NO: 1242177 - RNA, 14 nt, Mycobacterium leprae
uaaucguaccaaca

SEQ ID NO: 1242178 - RNA, 22 nt, Mycobacterium leprae
uaaucucgucgauggccgccuu

SEQ ID NO: 1242179 - RNA, 18 nt, Mycobacterium leprae
uacucccggcuucgccuu

SEQ ID NO: 1242180 - RNA, 13 nt, Mycobacterium leprae
uacuggugcugug

SEQ ID NO: 1242181 - RNA, 14 nt, Mycobacterium leprae
uacuggugcugugu

SEQ ID NO: 1242182 - RNA, 19 nt, Mycobacterium leprae
uacuuggcagugugcaugu

SEQ ID NO: 1242183 - RNA, 13 nt, Mycobacterium leprae
uagaccagaagcu

SEQ ID NO: 1242184 - RNA, 22 nt, Mycobacterium leprae
uagaccaagcagcauccaccac

SEQ ID NO: 1242185 - RNA, 19 nt, Mycobacterium leprae
uagaccgaaucguccugca

SEQ ID NO: 1242186 - RNA, 19 nt, Mycobacterium leprae
uagaacgguuugccaugca

SEQ ID NO: 1242187 - RNA, 18 nt, Mycobacterium leprae
uagaacacguucuugcca

SEQ ID NO: 1242188 - RNA, 19 nt, Mycobacterium leprae
uagaacaaaucagcagcau

SEQ ID NO: 1242189 - RNA, 13 nt, Mycobacterium leprae
uacuccagcagcg

SEQ ID NO: 1242190 - RNA, 13 nt, Mycobacterium leprae
uacuaucacgaau

SEQ ID NO: 1242191 - RNA, 20 nt, Mycobacterium leprae
uacuaucugcgugccgagcc

SEQ ID NO: 1242192 - RNA, 14 nt, Mycobacterium leprae
uacgugguggcugc

SEQ ID NO: 1242193 - RNA, 18 nt, Mycobacterium leprae
uacggucaaaggcaucca

SEQ ID NO: 1242194 - RNA, 22 nt, Mycobacterium leprae
uacggcaaccuucuagcgcaga

SEQ ID NO: 1242195 - RNA, 19 nt, Mycobacterium leprae
uacgcugauaaggucuggc

SEQ ID NO: 1242196 - RNA, 22 nt, Mycobacterium leprae
uacgaaggggucgaugaggcuc

SEQ ID NO: 1242197 - RNA, 15 nt, Mycobacterium leprae
uacgaaagaugcugc

SEQ ID NO: 1242198 - RNA, 22 nt, Mycobacterium leprae
uaccuucuguauggcuccaagu

SEQ ID NO: 1242199 - RNA, 18 nt, Mycobacterium leprae
uaccugcguggccuccga

SEQ ID NO: 1242200 - RNA, 17 nt, Mycobacterium leprae
uaccugaccgaaccgau

SEQ ID NO: 1242201 - RNA, 16 nt, Mycobacterium leprae
uaccggccaaccacag

SEQ ID NO: 1242202 - RNA, 18 nt, Mycobacterium leprae
uaccggcugaaaggaacg

SEQ ID NO: 1242203 - RNA, 19 nt, Mycobacterium leprae
uaccgcccaguaaugugcu

SEQ ID NO: 1242204 - RNA, 17 nt, Mycobacterium leprae
uagauggagccaccaca

SEQ ID NO: 1242205 - RNA, 18 nt, Mycobacterium leprae
uagaucuugaguguagca

SEQ ID NO: 1242206 - RNA, 17 nt, Mycobacterium leprae
uagcaauaaccagggcc

SEQ ID NO: 1242207 - RNA, 14 nt, Mycobacterium leprae
uagauuuagcacuu

SEQ ID NO: 1242208 - RNA, 14 nt, Mycobacterium leprae
uagcagcaucgcgu

SEQ ID NO: 1242209 - RNA, 19 nt, Mycobacterium leprae
uagcaggacgcacccugca

SEQ ID NO: 1242210 - RNA, 22 nt, Mycobacterium leprae
uagcagaguaaccacuugcagu

SEQ ID NO: 1242211 - RNA, 20 nt, Mycobacterium leprae
uagcaugacgucuucuauac

SEQ ID NO: 1242212 - RNA, 14 nt, Mycobacterium leprae
uagcaugagcugcu

SEQ ID NO: 1242213 - RNA, 20 nt, Mycobacterium leprae
uagcauuccucgugugugua

SEQ ID NO: 1242214 - RNA, 12 nt, Mycobacterium leprae
uaggacaacaga

SEQ ID NO: 1242215 - RNA, 20 nt, Mycobacterium leprae
uaggaaacauuguucugcca

SEQ ID NO: 1242216 - RNA, 17 nt, Mycobacterium leprae
uaggaacgcaacgaggu

SEQ ID NO: 1242217 - RNA, 20 nt, Mycobacterium leprae
uaggaacgcaacgagguaag

SEQ ID NO: 1242218 - RNA, 15 nt, Mycobacterium leprae
uagcgugagccuggc

SEQ ID NO: 1242219 - RNA, 21 nt, Mycobacterium leprae
uagcugccagcuucgcagaca

SEQ ID NO: 1242220 - RNA, 17 nt, Mycobacterium leprae
uagcuuauacugcugcg

SEQ ID NO: 1242221 - RNA, 19 nt, Mycobacterium leprae
uagcuggcagucggcaaga

SEQ ID NO: 1242222 - RNA, 16 nt, Mycobacterium leprae
uagccacucgccacua

SEQ ID NO: 1242223 - RNA, 15 nt, Mycobacterium leprae
uagccgguggccacc

SEQ ID NO: 1242224 - RNA, 20 nt, Mycobacterium leprae
uagccggcuuuggcggacug

SEQ ID NO: 1242225 - RNA, 19 nt, Mycobacterium leprae
uagccgauuagacacacuu

SEQ ID NO: 1242226 - RNA, 19 nt, Mycobacterium leprae
uagcgggcucuuaggugcc

SEQ ID NO: 1242227 - RNA, 14 nt, Mycobacterium leprae
uagcggcgccaggc

SEQ ID NO: 1242228 - RNA, 17 nt, Mycobacterium leprae
uagcgcagcugaauacu

SEQ ID NO: 1242229 - RNA, 13 nt, Mycobacterium leprae
uagcgaaaauaac

SEQ ID NO: 1242230 - RNA, 15 nt, Mycobacterium leprae
uagcgaacacacagg

SEQ ID NO: 1242231 - RNA, 22 nt, Mycobacterium leprae
uauagcgcucaacguggagaug

SEQ ID NO: 1242232 - RNA, 21 nt, Mycobacterium leprae
uauagugacuacgguuaauau

SEQ ID NO: 1242233 - RNA, 14 nt, Mycobacterium leprae
uauaacggcuucau

SEQ ID NO: 1242234 - RNA, 16 nt, Mycobacterium leprae
uauccaaagaaguuug

SEQ ID NO: 1242235 - RNA, 22 nt, Mycobacterium leprae
uaucaauccauccgguuguguu

SEQ ID NO: 1242236 - RNA, 23 nt, Mycobacterium leprae
uaucaaaccaguaccuuggucac

SEQ ID NO: 1242237 - RNA, 15 nt, Mycobacterium leprae
uagugcugcagguau

SEQ ID NO: 1242238 - RNA, 16 nt, Mycobacterium leprae
uagugcugcagguaua

SEQ ID NO: 1242239 - RNA, 16 nt, Mycobacterium leprae
uagugucaaucuacac

SEQ ID NO: 1242240 - RNA, 22 nt, Mycobacterium leprae
uagugauggcggaaguucucuu

SEQ ID NO: 1242241 - RNA, 13 nt, Mycobacterium leprae
uagugcacacggc

SEQ ID NO: 1242242 - RNA, 14 nt, Mycobacterium leprae
uaguccggaaagau

SEQ ID NO: 1242243 - RNA, 20 nt, Mycobacterium leprae
uaguccgcagaaugugcucu

SEQ ID NO: 1242244 - RNA, 15 nt, Mycobacterium leprae
uaguccgaccagucg

SEQ ID NO: 1242245 - RNA, 14 nt, Mycobacterium leprae
uaguguguuugguu

SEQ ID NO: 1242246 - RNA, 10 nt, Mycobacterium leprae
uagugugaca

SEQ ID NO: 1242247 - RNA, 22 nt, Mycobacterium leprae
uaguuuagagugcagcacaaga

SEQ ID NO: 1242248 - RNA, 13 nt, Mycobacterium leprae
uaguuuuuggauc

SEQ ID NO: 1242249 - RNA, 16 nt, Mycobacterium leprae
uaggcuguugucaccc

SEQ ID NO: 1242250 - RNA, 16 nt, Mycobacterium leprae
uagggagaaugccaca

SEQ ID NO: 1242251 - RNA, 22 nt, Mycobacterium leprae
uaggcaccacgcacacgacagc

SEQ ID NO: 1242252 - RNA, 11 nt, Mycobacterium leprae
uaggcacagcc

SEQ ID NO: 1242253 - RNA, 21 nt, Mycobacterium leprae
uaggcacagcccaguaggcac

SEQ ID NO: 1242254 - RNA, 17 nt, Mycobacterium leprae
uaggcgaagagcggcac

SEQ ID NO: 1242255 - RNA, 18 nt, Mycobacterium leprae
ucacuuauguguacuguu

SEQ ID NO: 1242256 - RNA, 22 nt, Mycobacterium leprae
ucagcgaagaguuucugcugcc

SEQ ID NO: 1242257 - RNA, 12 nt, Mycobacterium leprae
ucagggcagcag

SEQ ID NO: 1242258 - RNA, 13 nt, Mycobacterium leprae
ucaggaucgcaaa

SEQ ID NO: 1242259 - RNA, 18 nt, Mycobacterium leprae
ucauaacuauucaugaaa

SEQ ID NO: 1242260 - RNA, 15 nt, Mycobacterium leprae
ucagucaagcuagcu

SEQ ID NO: 1242261 - RNA, 16 nt, Mycobacterium leprae
ucaucaucuaaauccu

SEQ ID NO: 1242262 - RNA, 22 nt, Mycobacterium leprae
ucaucaguguguccacaaccuc

SEQ ID NO: 1242263 - RNA, 23 nt, Mycobacterium leprae
ucauccgaaaggauaggcgccgu

SEQ ID NO: 1242264 - RNA, 21 nt, Mycobacterium leprae
ucauccgacggcuucaucagu

SEQ ID NO: 1242265 - RNA, 15 nt, Mycobacterium leprae
ucauccccaucgcuu

SEQ ID NO: 1242266 - RNA, 16 nt, Mycobacterium leprae
ucaucgggccugguuu

SEQ ID NO: 1242267 - RNA, 23 nt, Mycobacterium leprae
ucaucgcugccaucgacgccguc

SEQ ID NO: 1242268 - RNA, 17 nt, Mycobacterium leprae
ucaucgacgaugccaua

SEQ ID NO: 1242269 - RNA, 17 nt, Mycobacterium leprae
ucauagggagaaugcca

SEQ ID NO: 1242270 - RNA, 21 nt, Mycobacterium leprae
ucauagggagaaugccacagg

SEQ ID NO: 1242271 - RNA, 21 nt, Mycobacterium leprae
ucaucuguagcuucgucgcau

SEQ ID NO: 1242272 - RNA, 17 nt, Mycobacterium leprae
ucaucugccaggcgcga

SEQ ID NO: 1242273 - RNA, 14 nt, Mycobacterium leprae
ucaucuugggcauc

SEQ ID NO: 1242274 - RNA, 22 nt, Mycobacterium leprae
ucaugagcgucgcuccuucuua

SEQ ID NO: 1242275 - RNA, 18 nt, Mycobacterium leprae
ucaugacguuuacaacgu

SEQ ID NO: 1242276 - RNA, 19 nt, Mycobacterium leprae
ucaugccgcagcaucaggg

SEQ ID NO: 1242277 - RNA, 18 nt, Mycobacterium leprae
ucaugcuccgacacugga

SEQ ID NO: 1242278 - RNA, 16 nt, Mycobacterium leprae
ucauggccgcagugau

SEQ ID NO: 1242279 - RNA, 14 nt, Mycobacterium leprae
ucauggcaguccac

SEQ ID NO: 1242280 - RNA, 22 nt, Mycobacterium leprae
ucauggccuugaggugucggcg

SEQ ID NO: 1242281 - RNA, 18 nt, Mycobacterium leprae
ucauguagcuacugucaa

SEQ ID NO: 1242282 - RNA, 21 nt, Mycobacterium leprae
uccaccgagacguugcuggga

SEQ ID NO: 1242283 - RNA, 19 nt, Mycobacterium leprae
uccaccgccaggcuuaucc

SEQ ID NO: 1242284 - RNA, 19 nt, Mycobacterium leprae
uccacaacgucagaagcug

SEQ ID NO: 1242285 - RNA, 20 nt, Mycobacterium leprae
uccaaagggucguaauaaua

SEQ ID NO: 1242286 - RNA, 19 nt, Mycobacterium leprae
uccacugcggcaaagcaca

SEQ ID NO: 1242287 - RNA, 22 nt, Mycobacterium leprae
uccaccggaaguuagcgcagcu

SEQ ID NO: 1242288 - RNA, 18 nt, Mycobacterium leprae
uccagacaccacugccag

SEQ ID NO: 1242289 - RNA, 22 nt, Mycobacterium leprae
uccagagccgcgcgcaagucug

SEQ ID NO: 1242290 - RNA, 19 nt, Mycobacterium leprae
uccagcugucagugucgca

SEQ ID NO: 1242291 - RNA, 16 nt, Mycobacterium leprae
uccagcaaacuccuga

SEQ ID NO: 1242292 - RNA, 12 nt, Mycobacterium leprae
ucacuacguugg

SEQ ID NO: 1242293 - RNA, 20 nt, Mycobacterium leprae
ucacuacguuggccagcacg

SEQ ID NO: 1242294 - RNA, 15 nt, Mycobacterium leprae
ucacuacguccacua

SEQ ID NO: 1242295 - RNA, 21 nt, Mycobacterium leprae
ucacuacguccacuagccagu

SEQ ID NO: 1242296 - RNA, 22 nt, Mycobacterium leprae
ucacgggucggcggggugucug

SEQ ID NO: 1242297 - RNA, 10 nt, Mycobacterium leprae
ucaccugaaa

SEQ ID NO: 1242298 - RNA, 16 nt, Mycobacterium leprae
ucaccccgggcacagc

SEQ ID NO: 1242299 - RNA, 17 nt, Mycobacterium leprae
ucaccgcagccggaggg

SEQ ID NO: 1242300 - RNA, 22 nt, Mycobacterium leprae
ucaccgacggaugcccagccag

SEQ ID NO: 1242301 - RNA, 14 nt, Mycobacterium leprae
ucaccgacugagac

SEQ ID NO: 1242302 - RNA, 13 nt, Mycobacterium leprae
ucaccgugcagcg

SEQ ID NO: 1242303 - RNA, 18 nt, Mycobacterium leprae
ucaccggccaccggcgcu

SEQ ID NO: 1242304 - RNA, 21 nt, Mycobacterium leprae
ucaccggaaagcugaaagcuu

SEQ ID NO: 1242305 - RNA, 22 nt, Mycobacterium leprae
ucaccagauuggaaaucgcucg

SEQ ID NO: 1242306 - RNA, 21 nt, Mycobacterium leprae
ucaccaagcgcagaugauccg

SEQ ID NO: 1242307 - RNA, 15 nt, Mycobacterium leprae
ucaccaauccagcca

SEQ ID NO: 1242308 - RNA, 23 nt, Mycobacterium leprae
ucaccaaaucgacuacauccagg

SEQ ID NO: 1242309 - RNA, 19 nt, Mycobacterium leprae
ucaccaacagucccuucgc

SEQ ID NO: 1242310 - RNA, 19 nt, Mycobacterium leprae
ucaccaaacuggacuucua

SEQ ID NO: 1242311 - RNA, 20 nt, Mycobacterium leprae
ucacaccuggugugcgcgcc

SEQ ID NO: 1242312 - RNA, 22 nt, Mycobacterium leprae
ucaauccguacugguucgcgau

SEQ ID NO: 1242313 - RNA, 21 nt, Mycobacterium leprae
ucaaucccgaaaaccccacac

SEQ ID NO: 1242314 - RNA, 18 nt, Mycobacterium leprae
ucaaucccguguucugcg

SEQ ID NO: 1242315 - RNA, 21 nt, Mycobacterium leprae
ucaagcaauagagauagcgcc

SEQ ID NO: 1242316 - RNA, 18 nt, Mycobacterium leprae
ucaagcacugcaguaacc

SEQ ID NO: 1242317 - RNA, 13 nt, Mycobacterium leprae
ucaagccacacgg

SEQ ID NO: 1242318 - RNA, 19 nt, Mycobacterium leprae
ucaaggccaaugcucgcag

SEQ ID NO: 1242319 - RNA, 21 nt, Mycobacterium leprae
ucaagcugggcuugaaacccg

SEQ ID NO: 1242320 - RNA, 19 nt, Mycobacterium leprae
ucaagggauuccacugcca

SEQ ID NO: 1242321 - RNA, 17 nt, Mycobacterium leprae
ucaacggcuacaacaaa

SEQ ID NO: 1242322 - RNA, 16 nt, Mycobacterium leprae
ucaagagcgagcucga

SEQ ID NO: 1242323 - RNA, 14 nt, Mycobacterium leprae
uauuccucuuccug

SEQ ID NO: 1242324 - RNA, 14 nt, Mycobacterium leprae
uauucagaauucua

SEQ ID NO: 1242325 - RNA, 23 nt, Mycobacterium leprae
uauuuauagaugccaguuuuggu

SEQ ID NO: 1242326 - RNA, 17 nt, Mycobacterium leprae
uauucugcgguaucauc

SEQ ID NO: 1242327 - RNA, 17 nt, Mycobacterium leprae
ucaaagguuaucgaucu

SEQ ID NO: 1242328 - RNA, 22 nt, Mycobacterium leprae
ucuacccuuuuugucacugagu

SEQ ID NO: 1242329 - RNA, 18 nt, Mycobacterium leprae
ucuaccuguugaauauac

SEQ ID NO: 1242330 - RNA, 13 nt, Mycobacterium leprae
ucuaccugggcac

SEQ ID NO: 1242331 - RNA, 15 nt, Mycobacterium leprae
aaaugaauuggguaa

SEQ ID NO: 1242332 - RNA, 18 nt, Mycobacterium leprae
ucguuuggguuggguggg

SEQ ID NO: 1242333 - RNA, 23 nt, Mycobacterium leprae
ucuauuugguacacuaagccccg

SEQ ID NO: 1242334 - RNA, 18 nt, Mycobacterium leprae
ucucaucgcggcugccac

SEQ ID NO: 1242335 - RNA, 16 nt, Mycobacterium leprae
ucucacgcugggguug

SEQ ID NO: 1242336 - RNA, 22 nt, Mycobacterium leprae
ucuauaguugaucauucgaucc

SEQ ID NO: 1242337 - RNA, 16 nt, Mycobacterium leprae
ucuagccucggucaua

SEQ ID NO: 1242338 - RNA, 14 nt, Mycobacterium leprae
ucuagcauuccucg

SEQ ID NO: 1242339 - RNA, 15 nt, Mycobacterium leprae
ucuagccaagcuccc

SEQ ID NO: 1242340 - RNA, 16 nt, Mycobacterium leprae
ucuagagaaacaccuu

SEQ ID NO: 1242341 - RNA, 13 nt, Mycobacterium leprae
ucuagauaacuau

SEQ ID NO: 1242342 - RNA, 20 nt, Mycobacterium leprae
ucuagauaagauaaauagua

SEQ ID NO: 1242343 - RNA, 21 nt, Mycobacterium leprae
ucuagcuggucccacagccgc

SEQ ID NO: 1242344 - RNA, 17 nt, Mycobacterium leprae
ucugcuuguggcggagc

SEQ ID NO: 1242345 - RNA, 23 nt, Mycobacterium leprae
ucuggauuucagggcacacagca

SEQ ID NO: 1242346 - RNA, 22 nt, Mycobacterium leprae
ucugguggauccaggugcugca

SEQ ID NO: 1242347 - RNA, 18 nt, Mycobacterium leprae
ucuggcugggacacggcg

SEQ ID NO: 1242348 - RNA, 13 nt, Mycobacterium leprae
ucuguaggcacaa

SEQ ID NO: 1242349 - RNA, 23 nt, Mycobacterium leprae
ucuguauggcuccaaguggcugc

SEQ ID NO: 1242350 - RNA, 23 nt, Mycobacterium leprae
ucuuccuacggcuuccaaguuga

SEQ ID NO: 1242351 - RNA, 14 nt, Mycobacterium leprae
ucuucgccuuguca

SEQ ID NO: 1242352 - RNA, 16 nt, Mycobacterium leprae
ucuucaauuuuccagu

SEQ ID NO: 1242353 - RNA, 19 nt, Mycobacterium leprae
ucuguuguggggguggagu

SEQ ID NO: 1242354 - RNA, 11 nt, Mycobacterium leprae
ucucucaggcc

SEQ ID NO: 1242355 - RNA, 15 nt, Mycobacterium leprae
ucucggauaggugca

SEQ ID NO: 1242356 - RNA, 14 nt, Mycobacterium leprae
ucucgugguggcug

SEQ ID NO: 1242357 - RNA, 13 nt, Mycobacterium leprae
ucuccuggucucc

SEQ ID NO: 1242358 - RNA, 20 nt, Mycobacterium leprae
ucuccgugaugaacuucgga

SEQ ID NO: 1242359 - RNA, 22 nt, Mycobacterium leprae
ucucgcauauucagaauucuau

SEQ ID NO: 1242360 - RNA, 16 nt, Mycobacterium leprae
ucucgccgccuucucc

SEQ ID NO: 1242361 - RNA, 19 nt, Mycobacterium leprae
ucucgccuucgauacggca

SEQ ID NO: 1242362 - RNA, 22 nt, Mycobacterium leprae
ucucccgccacucggcagagcg

SEQ ID NO: 1242363 - RNA, 14 nt, Mycobacterium leprae
ucucauuguggcug

SEQ ID NO: 1242364 - RNA, 19 nt, Mycobacterium leprae
ucguugcggcgcguuugca

SEQ ID NO: 1242365 - RNA, 20 nt, Mycobacterium leprae
ucguucaguuugguccaggc

SEQ ID NO: 1242366 - RNA, 19 nt, Mycobacterium leprae
ucgugcgugagaucaccag

SEQ ID NO: 1242367 - RNA, 19 nt, Mycobacterium leprae
ucgugacgggucaauccgu

SEQ ID NO: 1242368 - RNA, 14 nt, Mycobacterium leprae
ucgugguggcuggc

SEQ ID NO: 1242369 - RNA, 15 nt, Mycobacterium leprae
ucguggugugcaucc

SEQ ID NO: 1242370 - RNA, 19 nt, Mycobacterium leprae
ucgugcugaucaccggcca

SEQ ID NO: 1242371 - RNA, 14 nt, Mycobacterium leprae
ucgugcugcgugcc

SEQ ID NO: 1242372 - RNA, 17 nt, Mycobacterium leprae
ucguggcagaggcugca

SEQ ID NO: 1242373 - RNA, 15 nt, Mycobacterium leprae
ucgucgugcugauca

SEQ ID NO: 1242374 - RNA, 13 nt, Mycobacterium leprae
ucguagcucucca

SEQ ID NO: 1242375 - RNA, 15 nt, Mycobacterium leprae
ucguagcucuccauu

SEQ ID NO: 1242376 - RNA, 23 nt, Mycobacterium leprae
ucgucaagugcgcaccggcugag

SEQ ID NO: 1242377 - RNA, 15 nt, Mycobacterium leprae
ucguacccaauagag

SEQ ID NO: 1242378 - RNA, 21 nt, Mycobacterium leprae
ucgucagauccggccguugag

SEQ ID NO: 1242379 - RNA, 20 nt, Mycobacterium leprae
ucguccagggugaauugcac

SEQ ID NO: 1242380 - RNA, 21 nt, Mycobacterium leprae
ucguccgcaaccgauacgcca

SEQ ID NO: 1242381 - RNA, 16 nt, Mycobacterium leprae
ucgucggccagcacuu

SEQ ID NO: 1242382 - RNA, 19 nt, Mycobacterium leprae
ucggcuagccgugcagccu

SEQ ID NO: 1242383 - RNA, 15 nt, Mycobacterium leprae
ucggcuccuccagca

SEQ ID NO: 1242384 - RNA, 18 nt, Mycobacterium leprae
ucggcuccuccagcaucg

SEQ ID NO: 1242385 - RNA, 23 nt, Mycobacterium leprae
ucggcggcacauacggcaaccuu

SEQ ID NO: 1242386 - RNA, 19 nt, Mycobacterium leprae
ucggcgcgacugcaguguc

SEQ ID NO: 1242387 - RNA, 15 nt, Mycobacterium leprae
ucggcgacacagagc

SEQ ID NO: 1242388 - RNA, 23 nt, Mycobacterium leprae
ucggcgacacagagcgcucggcg

SEQ ID NO: 1242389 - RNA, 19 nt, Mycobacterium leprae
ucggccaguaccuccagcc

SEQ ID NO: 1242390 - RNA, 12 nt, Mycobacterium leprae
ucggucuugucc

SEQ ID NO: 1242391 - RNA, 19 nt, Mycobacterium leprae
ucggucggcaugugcaucc

SEQ ID NO: 1242392 - RNA, 18 nt, Mycobacterium leprae
ucggucgcauugccaacg

SEQ ID NO: 1242393 - RNA, 16 nt, Mycobacterium leprae
ucggugauaucgacug

SEQ ID NO: 1242394 - RNA, 14 nt, Mycobacterium leprae
ucgguucuggcccc

SEQ ID NO: 1242395 - RNA, 16 nt, Mycobacterium leprae
ucgguaacgcugacca

SEQ ID NO: 1242396 - RNA, 19 nt, Mycobacterium leprae
ucgguaacgcugaccagca

SEQ ID NO: 1242397 - RNA, 19 nt, Mycobacterium leprae
ucgguacauuugcggauga

SEQ ID NO: 1242398 - RNA, 18 nt, Mycobacterium leprae
ucgguaucgucaaauuuu

SEQ ID NO: 1242399 - RNA, 18 nt, Mycobacterium leprae
ucgggccguuauccacag

SEQ ID NO: 1242400 - RNA, 20 nt, Mycobacterium leprae
ucgggccguuauccacagca

SEQ ID NO: 1242401 - RNA, 21 nt, Mycobacterium leprae
ucgggaugccgaaacgcugag

SEQ ID NO: 1242402 - RNA, 18 nt, Mycobacterium leprae
ucggauuggaaaagauuu

SEQ ID NO: 1242403 - RNA, 18 nt, Mycobacterium leprae
ucggcaggccggccugga

SEQ ID NO: 1242404 - RNA, 14 nt, Mycobacterium leprae
ucggcagccacggu

SEQ ID NO: 1242405 - RNA, 15 nt, Mycobacterium leprae
ucggcacagugccug

SEQ ID NO: 1242406 - RNA, 21 nt, Mycobacterium leprae
ucggcacgacagaguugggag

SEQ ID NO: 1242407 - RNA, 14 nt, Mycobacterium leprae
ucggcaucugcuac

SEQ ID NO: 1242408 - RNA, 14 nt, Mycobacterium leprae
ucggccaccggccg

SEQ ID NO: 1242409 - RNA, 20 nt, Mycobacterium leprae
ucggcauugccggggcugcg

SEQ ID NO: 1242410 - RNA, 19 nt, Mycobacterium leprae
ucggacugucaaccauggu

SEQ ID NO: 1242411 - RNA, 20 nt, Mycobacterium leprae
ucggaguucuucacacgagc

SEQ ID NO: 1242412 - RNA, 16 nt, Mycobacterium leprae
ucggaaccgcagcugc

SEQ ID NO: 1242413 - RNA, 19 nt, Mycobacterium leprae
ucggaaccgcagcugcucg

SEQ ID NO: 1242414 - RNA, 19 nt, Mycobacterium leprae
ucggacacgagcggccuca

SEQ ID NO: 1242415 - RNA, 20 nt, Mycobacterium leprae
ucggaaucuuugaucugcug

SEQ ID NO: 1242416 - RNA, 19 nt, Mycobacterium leprae
ucggaaaaacggcuggcug

SEQ ID NO: 1242417 - RNA, 23 nt, Mycobacterium leprae
ucgcuucgugguuaggucagcug

SEQ ID NO: 1242418 - RNA, 18 nt, Mycobacterium leprae
ucgcgcuacgauuuugca

SEQ ID NO: 1242419 - RNA, 14 nt, Mycobacterium leprae
ucgcgcgugccacc

SEQ ID NO: 1242420 - RNA, 23 nt, Mycobacterium leprae
ucgcgggacaacaccacuucuug

SEQ ID NO: 1242421 - RNA, 14 nt, Mycobacterium leprae
ucgcgggacgugca

SEQ ID NO: 1242422 - RNA, 18 nt, Mycobacterium leprae
ucgcggggaugcugaggu

SEQ ID NO: 1242423 - RNA, 17 nt, Mycobacterium leprae
ucgcguugaccaaaccg

SEQ ID NO: 1242424 - RNA, 17 nt, Mycobacterium leprae
ucgcugcagcauaaccc

SEQ ID NO: 1242425 - RNA, 13 nt, Mycobacterium leprae
ucgcugaccggug

SEQ ID NO: 1242426 - RNA, 15 nt, Mycobacterium leprae
ucgcuggcccugccu

SEQ ID NO: 1242427 - RNA, 14 nt, Mycobacterium leprae
ucgcugcuuccuga

SEQ ID NO: 1242428 - RNA, 18 nt, Mycobacterium leprae
ucgccaacgguaucuccc

SEQ ID NO: 1242429 - RNA, 14 nt, Mycobacterium leprae
ucgccgagcugauc

SEQ ID NO: 1242430 - RNA, 20 nt, Mycobacterium leprae
ucgccgaugcgcuguugggu

SEQ ID NO: 1242431 - RNA, 17 nt, Mycobacterium leprae
ucgccgacgucuucaau

SEQ ID NO: 1242432 - RNA, 22 nt, Mycobacterium leprae
ucgcccaccgcaaucgaaaaau

SEQ ID NO: 1242433 - RNA, 14 nt, Mycobacterium leprae
ucgcccaggugcug

SEQ ID NO: 1242434 - RNA, 20 nt, Mycobacterium leprae
ucgcccggacgugcacaucg

SEQ ID NO: 1242435 - RNA, 19 nt, Mycobacterium leprae
ucgcccggugacaucaccg

SEQ ID NO: 1242436 - RNA, 19 nt, Mycobacterium leprae
ucgccgcgggacacauccg

SEQ ID NO: 1242437 - RNA, 16 nt, Mycobacterium leprae
ucgccgcgcaucaucg

SEQ ID NO: 1242438 - RNA, 21 nt, Mycobacterium leprae
ucgccgcgaauggugcucgga

SEQ ID NO: 1242439 - RNA, 18 nt, Mycobacterium leprae
ucgccuggucauggcuuc

SEQ ID NO: 1242440 - RNA, 21 nt, Mycobacterium leprae
ucgccugugucgagcuggcug

SEQ ID NO: 1242441 - RNA, 17 nt, Mycobacterium leprae
ucgcgagugcuggucaa

SEQ ID NO: 1242442 - RNA, 23 nt, Mycobacterium leprae
ugaauagucggcaaugcucucac

SEQ ID NO: 1242443 - RNA, 15 nt, Mycobacterium leprae
ugaacgagaagcagc

SEQ ID NO: 1242444 - RNA, 19 nt, Mycobacterium leprae
ugaagauccuauccggaaa

SEQ ID NO: 1242445 - RNA, 15 nt, Mycobacterium leprae
ugaagauaggucgcc

SEQ ID NO: 1242446 - RNA, 15 nt, Mycobacterium leprae
ugaacacgcugaucg

SEQ ID NO: 1242447 - RNA, 13 nt, Mycobacterium leprae
ucuucgugcagca

SEQ ID NO: 1242448 - RNA, 17 nt, Mycobacterium leprae
ugaaaguaggcacagcc

SEQ ID NO: 1242449 - RNA, 14 nt, Mycobacterium leprae
ugaccagccgcagc

SEQ ID NO: 1242450 - RNA, 21 nt, Mycobacterium leprae
ugaccugccgucccucggcca

SEQ ID NO: 1242451 - RNA, 22 nt, Mycobacterium leprae
ugaccucgaacuuguucuuugc

SEQ ID NO: 1242452 - RNA, 15 nt, Mycobacterium leprae
ugaccucgccgucgc

SEQ ID NO: 1242453 - RNA, 20 nt, Mycobacterium leprae
ugaccggacgauuugcgauc

SEQ ID NO: 1242454 - RNA, 15 nt, Mycobacterium leprae
ugaccgcggugcagu

SEQ ID NO: 1242455 - RNA, 14 nt, Mycobacterium leprae
ugaccgcaucaccg

SEQ ID NO: 1242456 - RNA, 13 nt, Mycobacterium leprae
ugacccaagcgcc

SEQ ID NO: 1242457 - RNA, 19 nt, Mycobacterium leprae
ugacccaauccaagaccac

SEQ ID NO: 1242458 - RNA, 19 nt, Mycobacterium leprae
ugacaagagugaaaguagg

SEQ ID NO: 1242459 - RNA, 17 nt, Mycobacterium leprae
ugacaaucgacucacca

SEQ ID NO: 1242460 - RNA, 14 nt, Mycobacterium leprae
ugacaaaagugcag

SEQ ID NO: 1242461 - RNA, 15 nt, Mycobacterium leprae
ugacaaaagugcagu

SEQ ID NO: 1242462 - RNA, 20 nt, Mycobacterium leprae
ugacaaagcccacgccuagc

SEQ ID NO: 1242463 - RNA, 23 nt, Mycobacterium leprae
ugacagcaacggcuacggggugg

SEQ ID NO: 1242464 - RNA, 16 nt, Mycobacterium leprae
ugacagcgcgaacgua

SEQ ID NO: 1242465 - RNA, 16 nt, Mycobacterium leprae
ugaauccgcugcaauu

SEQ ID NO: 1242466 - RNA, 15 nt, Mycobacterium leprae
ugaauccgcugcccu

SEQ ID NO: 1242467 - RNA, 18 nt, Mycobacterium leprae
ugaugguguagcugagcc

SEQ ID NO: 1242468 - RNA, 16 nt, Mycobacterium leprae
ugauguuaucccuugc

SEQ ID NO: 1242469 - RNA, 17 nt, Mycobacterium leprae
ugauugcugcaucugaa

SEQ ID NO: 1242470 - RNA, 21 nt, Mycobacterium leprae
ugaugccgaagcagacugagu

SEQ ID NO: 1242471 - RNA, 15 nt, Mycobacterium leprae
ugaugcacgcgcgcc

SEQ ID NO: 1242472 - RNA, 20 nt, Mycobacterium leprae
ugaugcacgcgcgccugggu

SEQ ID NO: 1242473 - RNA, 15 nt, Mycobacterium leprae
ugauggcauccaaca

SEQ ID NO: 1242474 - RNA, 16 nt, Mycobacterium leprae
ugauggccgccagguc

SEQ ID NO: 1242475 - RNA, 16 nt, Mycobacterium leprae
ugaucacaaauuguca

SEQ ID NO: 1242476 - RNA, 23 nt, Mycobacterium leprae
ugauauuaauggagaugccaacg

SEQ ID NO: 1242477 - RNA, 16 nt, Mycobacterium leprae
ugauauucaagucaca

SEQ ID NO: 1242478 - RNA, 17 nt, Mycobacterium leprae
ugaucaccggccagccu

SEQ ID NO: 1242479 - RNA, 17 nt, Mycobacterium leprae
ugaucagcaaggaacaa

SEQ ID NO: 1242480 - RNA, 13 nt, Mycobacterium leprae
ugaucggcuugcc

SEQ ID NO: 1242481 - RNA, 20 nt, Mycobacterium leprae
ugaguccgaugaugguuggu

SEQ ID NO: 1242482 - RNA, 13 nt, Mycobacterium leprae
ugagucgugucga

SEQ ID NO: 1242483 - RNA, 16 nt, Mycobacterium leprae
ugagucagacacuuga

SEQ ID NO: 1242484 - RNA, 18 nt, Mycobacterium leprae
ugaguaucugugggcagu

SEQ ID NO: 1242485 - RNA, 15 nt, Mycobacterium leprae
ugaguugaugugauc

SEQ ID NO: 1242486 - RNA, 22 nt, Mycobacterium leprae
ugauaauuuggcgccagaccaa

SEQ ID NO: 1242487 - RNA, 19 nt, Mycobacterium leprae
ugaggaucugcugauggua

SEQ ID NO: 1242488 - RNA, 20 nt, Mycobacterium leprae
ugaggaacgacuugaccagc

SEQ ID NO: 1242489 - RNA, 23 nt, Mycobacterium leprae
ugagcgcgaacagaucuucccua

SEQ ID NO: 1242490 - RNA, 13 nt, Mycobacterium leprae
ugagccuggcacc

SEQ ID NO: 1242491 - RNA, 15 nt, Mycobacterium leprae
ugagcgacagcucag

SEQ ID NO: 1242492 - RNA, 15 nt, Mycobacterium leprae
ugagccgacugacaa

SEQ ID NO: 1242493 - RNA, 17 nt, Mycobacterium leprae
ugagccggucggaguuc

SEQ ID NO: 1242494 - RNA, 15 nt, Mycobacterium leprae
ugagcacacgcugcg

SEQ ID NO: 1242495 - RNA, 13 nt, Mycobacterium leprae
ugagaugccagcc

SEQ ID NO: 1242496 - RNA, 15 nt, Mycobacterium leprae
ugagaugccagccaa

SEQ ID NO: 1242497 - RNA, 22 nt, Mycobacterium leprae
ugagcacccgcccaagcgaagc

SEQ ID NO: 1242498 - RNA, 21 nt, Mycobacterium leprae
ugagcagcacgggguguuggc

SEQ ID NO: 1242499 - RNA, 15 nt, Mycobacterium leprae
ugacugcguuucaug

SEQ ID NO: 1242500 - RNA, 13 nt, Mycobacterium leprae
ugacuguuuccgc

SEQ ID NO: 1242501 - RNA, 22 nt, Mycobacterium leprae
ugacugggaacauagccagcau

SEQ ID NO: 1242502 - RNA, 12 nt, Mycobacterium leprae
ugcgcgccgccc

SEQ ID NO: 1242503 - RNA, 16 nt, Mycobacterium leprae
ugcgcggcugccgcac

SEQ ID NO: 1242504 - RNA, 14 nt, Mycobacterium leprae
ugcgcucacccaag

SEQ ID NO: 1242505 - RNA, 23 nt, Mycobacterium leprae
ugcgcugcagcaacagccacacc

SEQ ID NO: 1242506 - RNA, 21 nt, Mycobacterium leprae
ugcggaucgagggauccaaga

SEQ ID NO: 1242507 - RNA, 18 nt, Mycobacterium leprae
ugcggaucggugcaugca

SEQ ID NO: 1242508 - RNA, 18 nt, Mycobacterium leprae
ugcggaugguuggcagaa

SEQ ID NO: 1242509 - RNA, 23 nt, Mycobacterium leprae
ugcguaaucgccgguggcaaccg

SEQ ID NO: 1242510 - RNA, 15 nt, Mycobacterium leprae
ugcgguauccauccg

SEQ ID NO: 1242511 - RNA, 16 nt, Mycobacterium leprae
ugcgguaaacacuucu

SEQ ID NO: 1242512 - RNA, 20 nt, Mycobacterium leprae
ugcgguaaacacuucuugua

SEQ ID NO: 1242513 - RNA, 16 nt, Mycobacterium leprae
ugcgcgcacccaagcc

SEQ ID NO: 1242514 - RNA, 13 nt, Mycobacterium leprae
aaauggcuguuuu

SEQ ID NO: 1242515 - RNA, 18 nt, Mycobacterium leprae
aaauggcuguuuuugcgu

SEQ ID NO: 1242516 - RNA, 22 nt, Mycobacterium leprae
aaauggcacugauacugaugug

SEQ ID NO: 1242517 - RNA, 17 nt, Mycobacterium leprae
ugcgagaguacggagcc

SEQ ID NO: 1242518 - RNA, 19 nt, Mycobacterium leprae
ugcgagauccgugcgccuu

SEQ ID NO: 1242519 - RNA, 22 nt, Mycobacterium leprae
ugcgcagcaauugacgccgacc

SEQ ID NO: 1242520 - RNA, 14 nt, Mycobacterium leprae
ugcgacgucccaag

SEQ ID NO: 1242521 - RNA, 21 nt, Mycobacterium leprae
ugcgacuaucgugugcugauc

SEQ ID NO: 1242522 - RNA, 20 nt, Mycobacterium leprae
ugccgagcaaguuugagaac

SEQ ID NO: 1242523 - RNA, 22 nt, Mycobacterium leprae
ugccgaccgccucgaugugcuu

SEQ ID NO: 1242524 - RNA, 12 nt, Mycobacterium leprae
ugccgaaguccc

SEQ ID NO: 1242525 - RNA, 16 nt, Mycobacterium leprae
ugccgaaagccugcuu

SEQ ID NO: 1242526 - RNA, 14 nt, Mycobacterium leprae
ugcccugggccagc

SEQ ID NO: 1242527 - RNA, 14 nt, Mycobacterium leprae
ugcccucgcugccg

SEQ ID NO: 1242528 - RNA, 17 nt, Mycobacterium leprae
ugccgcaccgcuucaga

SEQ ID NO: 1242529 - RNA, 16 nt, Mycobacterium leprae
ugccgaucccggcgcu

SEQ ID NO: 1242530 - RNA, 19 nt, Mycobacterium leprae
ugccgaucucguguuacau

SEQ ID NO: 1242531 - RNA, 18 nt, Mycobacterium leprae
ugccgaucagccgcaaca

SEQ ID NO: 1242532 - RNA, 16 nt, Mycobacterium leprae
ugccgcccagugcacu

SEQ ID NO: 1242533 - RNA, 15 nt, Mycobacterium leprae
ugccgccgacggccg

SEQ ID NO: 1242534 - RNA, 22 nt, Mycobacterium leprae
ugccgugguagucagcacaauc

SEQ ID NO: 1242535 - RNA, 18 nt, Mycobacterium leprae
ugccgcuccgcgcacagu

SEQ ID NO: 1242536 - RNA, 22 nt, Mycobacterium leprae
ugccgcggucuaguuguugaca

SEQ ID NO: 1242537 - RNA, 17 nt, Mycobacterium leprae
ugccgcugucgauggac

SEQ ID NO: 1242538 - RNA, 13 nt, Mycobacterium leprae
ugccgccgggacg

SEQ ID NO: 1242539 - RNA, 19 nt, Mycobacterium leprae
ugccccagucgccagagcc

SEQ ID NO: 1242540 - RNA, 21 nt, Mycobacterium leprae
ugccccggguacacucucaga

SEQ ID NO: 1242541 - RNA, 13 nt, Mycobacterium leprae
ugccccgcgcucu

SEQ ID NO: 1242542 - RNA, 16 nt, Mycobacterium leprae
ugccccggccgccguc

SEQ ID NO: 1242543 - RNA, 19 nt, Mycobacterium leprae
ugcccagaccgaaaaccac

SEQ ID NO: 1242544 - RNA, 13 nt, Mycobacterium leprae
ugcccaccauguu

SEQ ID NO: 1242545 - RNA, 17 nt, Mycobacterium leprae
ugcccagccccuggcau

SEQ ID NO: 1242546 - RNA, 23 nt, Mycobacterium leprae
ugcccagcauuauccgggcugga

SEQ ID NO: 1242547 - RNA, 12 nt, Mycobacterium leprae
ugcccgggugaa

SEQ ID NO: 1242548 - RNA, 18 nt, Mycobacterium leprae
ugcccggauugauggaug

SEQ ID NO: 1242549 - RNA, 17 nt, Mycobacterium leprae
ugccaucgacgccgccg

SEQ ID NO: 1242550 - RNA, 18 nt, Mycobacterium leprae
ugccaucgacgccgucuc

SEQ ID NO: 1242551 - RNA, 17 nt, Mycobacterium leprae
ugccauacauccgucgc

SEQ ID NO: 1242552 - RNA, 18 nt, Mycobacterium leprae
ugccauuggccgcuggua

SEQ ID NO: 1242553 - RNA, 17 nt, Mycobacterium leprae
ugcccaaugcagcaacg

SEQ ID NO: 1242554 - RNA, 16 nt, Mycobacterium leprae
ugccacggugcaguca

SEQ ID NO: 1242555 - RNA, 13 nt, Mycobacterium leprae
ugccaaaguccau

SEQ ID NO: 1242556 - RNA, 18 nt, Mycobacterium leprae
ugccaaaguccaugugcu

SEQ ID NO: 1242557 - RNA, 23 nt, Mycobacterium leprae
ugccaaaguuagcggagaccccc

SEQ ID NO: 1242558 - RNA, 15 nt, Mycobacterium leprae
ugccaacgcuauugc

SEQ ID NO: 1242559 - RNA, 16 nt, Mycobacterium leprae
ugcaucccuuuuugcu

SEQ ID NO: 1242560 - RNA, 19 nt, Mycobacterium leprae
ugcaucccuuuuugcuaga

SEQ ID NO: 1242561 - RNA, 13 nt, Mycobacterium leprae
ugcauccgacaaa

SEQ ID NO: 1242562 - RNA, 14 nt, Mycobacterium leprae
ugcagcgacuggau

SEQ ID NO: 1242563 - RNA, 19 nt, Mycobacterium leprae
ugcagcgaggccguggccg

SEQ ID NO: 1242564 - RNA, 16 nt, Mycobacterium leprae
ugcagcaugugugaac

SEQ ID NO: 1242565 - RNA, 13 nt, Mycobacterium leprae
ugcagcagccagu

SEQ ID NO: 1242566 - RNA, 12 nt, Mycobacterium leprae
ugcagcagcucg

SEQ ID NO: 1242567 - RNA, 15 nt, Mycobacterium leprae
ugcagaccggauaca

SEQ ID NO: 1242568 - RNA, 19 nt, Mycobacterium leprae
ugcagacuuuggagcagga

SEQ ID NO: 1242569 - RNA, 17 nt, Mycobacterium leprae
ugcaggcagucuuucag

SEQ ID NO: 1242570 - RNA, 23 nt, Mycobacterium leprae
ugcaggauucacccgacgaguuc

SEQ ID NO: 1242571 - RNA, 14 nt, Mycobacterium leprae
ugcaggaccgugcu

SEQ ID NO: 1242572 - RNA, 18 nt, Mycobacterium leprae
ugcacggcgugcaggcag

SEQ ID NO: 1242573 - RNA, 15 nt, Mycobacterium leprae
ugcacggggucagcg

SEQ ID NO: 1242574 - RNA, 16 nt, Mycobacterium leprae
ugcacggggucagcgg

SEQ ID NO: 1242575 - RNA, 19 nt, Mycobacterium leprae
ugcagaaauucagcgccag

SEQ ID NO: 1242576 - RNA, 18 nt, Mycobacterium leprae
ugcacgcgcgccugggug

SEQ ID NO: 1242577 - RNA, 19 nt, Mycobacterium leprae
ugcacgcgcgccuggguga

SEQ ID NO: 1242578 - RNA, 23 nt, Mycobacterium leprae
ugcacgcgcgccugggugaaucg

SEQ ID NO: 1242579 - RNA, 19 nt, Mycobacterium leprae
ugauuugcacaacauccaa

SEQ ID NO: 1242580 - RNA, 20 nt, Mycobacterium leprae
ugcaccauuucugccgcugg

SEQ ID NO: 1242581 - RNA, 23 nt, Mycobacterium leprae
ugcacccggcggcaugccugcuu

SEQ ID NO: 1242582 - RNA, 12 nt, Mycobacterium leprae
ugcacccgucgc

SEQ ID NO: 1242583 - RNA, 16 nt, Mycobacterium leprae
ugcacccggccgucgc

SEQ ID NO: 1242584 - RNA, 23 nt, Mycobacterium leprae
uguuggcuuucaguuuccgccgu

SEQ ID NO: 1242585 - RNA, 18 nt, Mycobacterium leprae
uguuggcuuccagucugg

SEQ ID NO: 1242586 - RNA, 22 nt, Mycobacterium leprae
uguuggacaacacguuucugca

SEQ ID NO: 1242587 - RNA, 16 nt, Mycobacterium leprae
uguuggcgccugccac

SEQ ID NO: 1242588 - RNA, 17 nt, Mycobacterium leprae
uguuguaagaauaaggu

SEQ ID NO: 1242589 - RNA, 14 nt, Mycobacterium leprae
uguuguaagcacug

SEQ ID NO: 1242590 - RNA, 12 nt, Mycobacterium leprae
uguuuaggaaac

SEQ ID NO: 1242591 - RNA, 20 nt, Mycobacterium leprae
uguuuaggaaacauuguucu

SEQ ID NO: 1242592 - RNA, 21 nt, Mycobacterium leprae
uguugccaucgacgccgccgu

SEQ ID NO: 1242593 - RNA, 17 nt, Mycobacterium leprae
uguugcgggguuuuugu

SEQ ID NO: 1242594 - RNA, 21 nt, Mycobacterium leprae
uguugcucaacgggccgcucg

SEQ ID NO: 1242595 - RNA, 23 nt, Mycobacterium leprae
uguugacgaugaucuuggcccgg

SEQ ID NO: 1242596 - RNA, 14 nt, Mycobacterium leprae
uguugaacauucuc

SEQ ID NO: 1242597 - RNA, 22 nt, Mycobacterium leprae
uguugaccggcccucagccagc

SEQ ID NO: 1242598 - RNA, 20 nt, Mycobacterium leprae
uguucuggcacccacgcugc

SEQ ID NO: 1242599 - RNA, 18 nt, Mycobacterium leprae
uguucggcacccauccaa

SEQ ID NO: 1242600 - RNA, 21 nt, Mycobacterium leprae
uguucggcaggccggccugga

SEQ ID NO: 1242601 - RNA, 16 nt, Mycobacterium leprae
uguucgcuccgcccac

SEQ ID NO: 1242602 - RNA, 16 nt, Mycobacterium leprae
uguucgaccaggaugu

SEQ ID NO: 1242603 - RNA, 14 nt, Mycobacterium leprae
uguucugccaugcc

SEQ ID NO: 1242604 - RNA, 22 nt, Mycobacterium leprae
uguucauaucgcgcaacgacug

SEQ ID NO: 1242605 - RNA, 13 nt, Mycobacterium leprae
uguuauaguccgc

SEQ ID NO: 1242606 - RNA, 16 nt, Mycobacterium leprae
uguucaaaagccacac

SEQ ID NO: 1242607 - RNA, 22 nt, Mycobacterium leprae
uguucaccucguucaagauacu

SEQ ID NO: 1242608 - RNA, 19 nt, Mycobacterium leprae
uguucacgcagucauccac

SEQ ID NO: 1242609 - RNA, 23 nt, Mycobacterium leprae
uguucacgcagucauccacugcg

SEQ ID NO: 1242610 - RNA, 16 nt, Mycobacterium leprae
uguuucgauguggcuu

SEQ ID NO: 1242611 - RNA, 13 nt, Mycobacterium leprae
uguuuugucggug

SEQ ID NO: 1242612 - RNA, 18 nt, Mycobacterium leprae
uguuuuguugaacauucu

SEQ ID NO: 1242613 - RNA, 14 nt, Mycobacterium leprae
uguuuuccugugca

SEQ ID NO: 1242614 - RNA, 21 nt, Mycobacterium leprae
uguuuuaagcgaaaaugaaaa

SEQ ID NO: 1242615 - RNA, 15 nt, Mycobacterium leprae
uuaaaaauuuguucu

SEQ ID NO: 1242616 - RNA, 21 nt, Mycobacterium leprae
uguuuuuuggugccacugaac

SEQ ID NO: 1242617 - RNA, 12 nt, Mycobacterium leprae
uuaacacaugca

SEQ ID NO: 1242618 - RNA, 20 nt, Mycobacterium leprae
uuaacaacuugacgaugcug

SEQ ID NO: 1242619 - RNA, 16 nt, Mycobacterium leprae
uuaaguagaccagaag

SEQ ID NO: 1242620 - RNA, 19 nt, Mycobacterium leprae
uuaauauauuccaggucaa

SEQ ID NO: 1242621 - RNA, 20 nt, Mycobacterium leprae
uuacuucggucaggucaugc

SEQ ID NO: 1242622 - RNA, 22 nt, Mycobacterium leprae
uuacgcacgccuugcagcuuca

SEQ ID NO: 1242623 - RNA, 19 nt, Mycobacterium leprae
uuacugaaucauguauucg

SEQ ID NO: 1242624 - RNA, 18 nt, Mycobacterium leprae
uuacauagguagauaaac

SEQ ID NO: 1242625 - RNA, 22 nt, Mycobacterium leprae
uuaccgcggcggccaacuguug

SEQ ID NO: 1242626 - RNA, 11 nt, Mycobacterium leprae
uuaccggcguu

SEQ ID NO: 1242627 - RNA, 20 nt, Mycobacterium leprae
uuaccggcugcgccguucgu

SEQ ID NO: 1242628 - RNA, 16 nt, Mycobacterium leprae
uuaccucagugucagc

SEQ ID NO: 1242629 - RNA, 14 nt, Mycobacterium leprae
uuacacgugccgug

SEQ ID NO: 1242630 - RNA, 13 nt, Mycobacterium leprae
uguguguuuugua

SEQ ID NO: 1242631 - RNA, 13 nt, Mycobacterium leprae
uguguugccaucg

SEQ ID NO: 1242632 - RNA, 22 nt, Mycobacterium leprae
uguguucuacccaggccuguug

SEQ ID NO: 1242633 - RNA, 21 nt, Mycobacterium leprae
uguguccacaaccucggccga

SEQ ID NO: 1242634 - RNA, 15 nt, Mycobacterium leprae
uguguuugguuuugu

SEQ ID NO: 1242635 - RNA, 15 nt, Mycobacterium leprae
ugugcuaaccgggcc

SEQ ID NO: 1242636 - RNA, 21 nt, Mycobacterium leprae
ugugcuagcugauuuggccgc

SEQ ID NO: 1242637 - RNA, 13 nt, Mycobacterium leprae
ugugcugagagca

SEQ ID NO: 1242638 - RNA, 20 nt, Mycobacterium leprae
uguggcgauacgcgcuugcc

SEQ ID NO: 1242639 - RNA, 20 nt, Mycobacterium leprae
ugugggcaaccaccaaaaac

SEQ ID NO: 1242640 - RNA, 22 nt, Mycobacterium leprae
uguggccaaugcgcguugugcc

SEQ ID NO: 1242641 - RNA, 20 nt, Mycobacterium leprae
uguggccgcaccugaacagg

SEQ ID NO: 1242642 - RNA, 22 nt, Mycobacterium leprae
uguggccgcaccugaacaggca

SEQ ID NO: 1242643 - RNA, 15 nt, Mycobacterium leprae
uguggucucaaugac

SEQ ID NO: 1242644 - RNA, 15 nt, Mycobacterium leprae
ugugaccagccaucc

SEQ ID NO: 1242645 - RNA, 22 nt, Mycobacterium leprae
ugugacguucgaugccccaucu

SEQ ID NO: 1242646 - RNA, 17 nt, Mycobacterium leprae
ugucugcggauuuugcc

SEQ ID NO: 1242647 - RNA, 12 nt, Mycobacterium leprae
ugucugugagga

SEQ ID NO: 1242648 - RNA, 15 nt, Mycobacterium leprae
ugucugugaggaauu

SEQ ID NO: 1242649 - RNA, 16 nt, Mycobacterium leprae
ugugccugucacauau

SEQ ID NO: 1242650 - RNA, 13 nt, Mycobacterium leprae
ugugcgagaguac

SEQ ID NO: 1242651 - RNA, 14 nt, Mycobacterium leprae
ugugcgcgccgccc

SEQ ID NO: 1242652 - RNA, 16 nt, Mycobacterium leprae
ugugcgcgccgcccag

SEQ ID NO: 1242653 - RNA, 17 nt, Mycobacterium leprae
ugugcauccgccacaug

SEQ ID NO: 1242654 - RNA, 21 nt, Mycobacterium leprae
ugugcagcugaaaugcucuaa

SEQ ID NO: 1242655 - RNA, 16 nt, Mycobacterium leprae
ugugcagcuuguuggc

SEQ ID NO: 1242656 - RNA, 18 nt, Mycobacterium leprae
uguccacuuaccgcggcg

SEQ ID NO: 1242657 - RNA, 16 nt, Mycobacterium leprae
ugucggguggucagca

SEQ ID NO: 1242658 - RNA, 20 nt, Mycobacterium leprae
ugucuaaucauucuguugca

SEQ ID NO: 1242659 - RNA, 15 nt, Mycobacterium leprae
ugucuaccagcaccc

SEQ ID NO: 1242660 - RNA, 14 nt, Mycobacterium leprae
ugucaagcacugca

SEQ ID NO: 1242661 - RNA, 16 nt, Mycobacterium leprae
ugucaagcacugcagu

SEQ ID NO: 1242662 - RNA, 20 nt, Mycobacterium leprae
uguauggcuccaaguggcug

SEQ ID NO: 1242663 - RNA, 18 nt, Mycobacterium leprae
ugucacuucccaccgugg

SEQ ID NO: 1242664 - RNA, 14 nt, Mycobacterium leprae
uguagggaaucggc

SEQ ID NO: 1242665 - RNA, 20 nt, Mycobacterium leprae
uguagugcacagaauuugcc

SEQ ID NO: 1242666 - RNA, 16 nt, Mycobacterium leprae
uguaaugcugcugcca

SEQ ID NO: 1242667 - RNA, 18 nt, Mycobacterium leprae
uguacuuugugugcaugu

SEQ ID NO: 1242668 - RNA, 17 nt, Mycobacterium leprae
uggcaaccgacacaccc

SEQ ID NO: 1242669 - RNA, 18 nt, Mycobacterium leprae
uggcaaccgacacaccca

SEQ ID NO: 1242670 - RNA, 21 nt, Mycobacterium leprae
uggcaccagugugccagcgcu

SEQ ID NO: 1242671 - RNA, 14 nt, Mycobacterium leprae
uggccagccguccc

SEQ ID NO: 1242672 - RNA, 14 nt, Mycobacterium leprae
uggccagcacggcg

SEQ ID NO: 1242673 - RNA, 16 nt, Mycobacterium leprae
uggccgcaccugaaca

SEQ ID NO: 1242674 - RNA, 22 nt, Mycobacterium leprae
uggccgcaccugaacaggcacg

SEQ ID NO: 1242675 - RNA, 21 nt, Mycobacterium leprae
uggccgcaaguuuagcaacaa

SEQ ID NO: 1242676 - RNA, 11 nt, Mycobacterium leprae
uggccgaggag

SEQ ID NO: 1242677 - RNA, 15 nt, Mycobacterium leprae
uggccgugcuagucg

SEQ ID NO: 1242678 - RNA, 16 nt, Mycobacterium leprae
uggccguguugcugcu

SEQ ID NO: 1242679 - RNA, 18 nt, Mycobacterium leprae
uggccggugagggacgca

SEQ ID NO: 1242680 - RNA, 17 nt, Mycobacterium leprae
uggccggcaugggccgg

SEQ ID NO: 1242681 - RNA, 17 nt, Mycobacterium leprae
uggccggaacagcaucc

SEQ ID NO: 1242682 - RNA, 14 nt, Mycobacterium leprae
uggccgcuggggca

SEQ ID NO: 1242683 - RNA, 17 nt, Mycobacterium leprae
uggccgcagugaucaca

SEQ ID NO: 1242684 - RNA, 19 nt, Mycobacterium leprae
uggcggagcgcggagcugg

SEQ ID NO: 1242685 - RNA, 14 nt, Mycobacterium leprae
uggcggaggcuggg

SEQ ID NO: 1242686 - RNA, 19 nt, Mycobacterium leprae
uggcgguggucuccaaggu

SEQ ID NO: 1242687 - RNA, 13 nt, Mycobacterium leprae
uggcgaucugcau

SEQ ID NO: 1242688 - RNA, 20 nt, Mycobacterium leprae
uggcgaucggcucgauggga

SEQ ID NO: 1242689 - RNA, 13 nt, Mycobacterium leprae
uggcgaguggagu

SEQ ID NO: 1242690 - RNA, 17 nt, Mycobacterium leprae
ugguacaaucccaccac

SEQ ID NO: 1242691 - RNA, 13 nt, Mycobacterium leprae
uggguuggguggg

SEQ ID NO: 1242692 - RNA, 18 nt, Mycobacterium leprae
uggguuugcugucaaggc

SEQ ID NO: 1242693 - RNA, 17 nt, Mycobacterium leprae
ugguccuggcugcgaug

SEQ ID NO: 1242694 - RNA, 16 nt, Mycobacterium leprae
uggucgagcagcucca

SEQ ID NO: 1242695 - RNA, 21 nt, Mycobacterium leprae
uggucgagcagcuccagcucg

SEQ ID NO: 1242696 - RNA, 17 nt, Mycobacterium leprae
uggucgcuggcccugcc

SEQ ID NO: 1242697 - RNA, 18 nt, Mycobacterium leprae
uggucaagugucgggugg

SEQ ID NO: 1242698 - RNA, 15 nt, Mycobacterium leprae
uggucacacuggugg

SEQ ID NO: 1242699 - RNA, 21 nt, Mycobacterium leprae
uggucagcauggcgaugcgca

SEQ ID NO: 1242700 - RNA, 17 nt, Mycobacterium leprae
uggucauggcgagcauc

SEQ ID NO: 1242701 - RNA, 15 nt, Mycobacterium leprae
uggcuugucccaacc

SEQ ID NO: 1242702 - RNA, 18 nt, Mycobacterium leprae
ugggaucuuuugaccagc

SEQ ID NO: 1242703 - RNA, 22 nt, Mycobacterium leprae
ugggaucgacaccucaccaucu

SEQ ID NO: 1242704 - RNA, 18 nt, Mycobacterium leprae
ugggcacaauggguguga

SEQ ID NO: 1242705 - RNA, 14 nt, Mycobacterium leprae
ugggauugggcauc

SEQ ID NO: 1242706 - RNA, 23 nt, Mycobacterium leprae
uggcuuccgauuguccaugccac

SEQ ID NO: 1242707 - RNA, 18 nt, Mycobacterium leprae
uggcuugaguuuugaacu

SEQ ID NO: 1242708 - RNA, 14 nt, Mycobacterium leprae
uggcggugugugca

SEQ ID NO: 1242709 - RNA, 17 nt, Mycobacterium leprae
ugggggugggaaaagca

SEQ ID NO: 1242710 - RNA, 18 nt, Mycobacterium leprae
ugggugugucaucaucac

SEQ ID NO: 1242711 - RNA, 12 nt, Mycobacterium leprae
ugggugugagga

SEQ ID NO: 1242712 - RNA, 13 nt, Mycobacterium leprae
ugggcggcuaguc

SEQ ID NO: 1242713 - RNA, 17 nt, Mycobacterium leprae
ugggcgcagacguuuug

SEQ ID NO: 1242714 - RNA, 21 nt, Mycobacterium leprae
ugggcacggagcggccgcgag

SEQ ID NO: 1242715 - RNA, 14 nt, Mycobacterium leprae
ugggcagccgaggu

SEQ ID NO: 1242716 - RNA, 13 nt, Mycobacterium leprae
ugggcagccugga

SEQ ID NO: 1242717 - RNA, 12 nt, Mycobacterium leprae
uucacuggcccg

SEQ ID NO: 1242718 - RNA, 18 nt, Mycobacterium leprae
uucagagcugcaggucag

SEQ ID NO: 1242719 - RNA, 22 nt, Mycobacterium leprae
uucagaucgacuccgcaagaug

SEQ ID NO: 1242720 - RNA, 20 nt, Mycobacterium leprae
uucaaggaauugaucacaaa

SEQ ID NO: 1242721 - RNA, 20 nt, Mycobacterium leprae
uucaccaaacuggacuucua

SEQ ID NO: 1242722 - RNA, 18 nt, Mycobacterium leprae
uucaauuaguuacugaau

SEQ ID NO: 1242723 - RNA, 16 nt, Mycobacterium leprae
uucaacaccaugguga

SEQ ID NO: 1242724 - RNA, 13 nt, Mycobacterium leprae
uucaacaaaacca

SEQ ID NO: 1242725 - RNA, 18 nt, Mycobacterium leprae
uucaaauaccaagacuuu

SEQ ID NO: 1242726 - RNA, 23 nt, Mycobacterium leprae
uuauuucgucgucagcugcugaa

SEQ ID NO: 1242727 - RNA, 22 nt, Mycobacterium leprae
uuauuccaauccugucaccugg

SEQ ID NO: 1242728 - RNA, 15 nt, Mycobacterium leprae
uuauuccuaaugaau

SEQ ID NO: 1242729 - RNA, 22 nt, Mycobacterium leprae
uuauucgggagcgucucgcgca

SEQ ID NO: 1242730 - RNA, 21 nt, Mycobacterium leprae
uuauugauggaguuuuuguuu

SEQ ID NO: 1242731 - RNA, 12 nt, Mycobacterium leprae
uuauugcugugu

SEQ ID NO: 1242732 - RNA, 21 nt, Mycobacterium leprae
uucaggugugcugcagcauug

SEQ ID NO: 1242733 - RNA, 18 nt, Mycobacterium leprae
uucauccagcuguugacu

SEQ ID NO: 1242734 - RNA, 22 nt, Mycobacterium leprae
uucauagggagaaugccacagg

SEQ ID NO: 1242735 - RNA, 16 nt, Mycobacterium leprae
uucauagguggugggu

SEQ ID NO: 1242736 - RNA, 15 nt, Mycobacterium leprae
uucaugguguguuca

SEQ ID NO: 1242737 - RNA, 18 nt, Mycobacterium leprae
uucugguggggauacagc

SEQ ID NO: 1242738 - RNA, 22 nt, Mycobacterium leprae
uucguuuggguugggugggggu

SEQ ID NO: 1242739 - RNA, 16 nt, Mycobacterium leprae
uucucauuguggcugg

SEQ ID NO: 1242740 - RNA, 18 nt, Mycobacterium leprae
uucugcugccgcguucgu

SEQ ID NO: 1242741 - RNA, 19 nt, Mycobacterium leprae
uucuccagucgcauccucg

SEQ ID NO: 1242742 - RNA, 23 nt, Mycobacterium leprae
uucucccgccacucggcagagcg

SEQ ID NO: 1242743 - RNA, 16 nt, Mycobacterium leprae
uucggcacagugccug

SEQ ID NO: 1242744 - RNA, 15 nt, Mycobacterium leprae
uucggcacccaucca

SEQ ID NO: 1242745 - RNA, 12 nt, Mycobacterium leprae
uucggccagcgc

SEQ ID NO: 1242746 - RNA, 20 nt, Mycobacterium leprae
uucgugagccuaugcggcca

SEQ ID NO: 1242747 - RNA, 21 nt, Mycobacterium leprae
uucggucaggucaugccaggg

SEQ ID NO: 1242748 - RNA, 22 nt, Mycobacterium leprae
uucgagaaaaauuggcaacuuc

SEQ ID NO: 1242749 - RNA, 14 nt, Mycobacterium leprae
uucgacuucugguu

SEQ ID NO: 1242750 - RNA, 14 nt, Mycobacterium leprae
uucgauucugcccg

SEQ ID NO: 1242751 - RNA, 18 nt, Mycobacterium leprae
uucgccauagccgaucuc

SEQ ID NO: 1242752 - RNA, 23 nt, Mycobacterium leprae
uucgcgaccuugcggcgccccuc

SEQ ID NO: 1242753 - RNA, 17 nt, Mycobacterium leprae
uucgcgaucuggauggc

SEQ ID NO: 1242754 - RNA, 14 nt, Mycobacterium leprae
uucgacccaguacu

SEQ ID NO: 1242755 - RNA, 23 nt, Mycobacterium leprae
uuccugacaaccguucgagcccc

SEQ ID NO: 1242756 - RNA, 11 nt, Mycobacterium leprae
uuccuaaaauu

SEQ ID NO: 1242757 - RNA, 20 nt, Mycobacterium leprae
uugucagguaucucuagaaa

SEQ ID NO: 1242758 - RNA, 21 nt, Mycobacterium leprae
uugucagguaucucuagaaau

SEQ ID NO: 1242759 - RNA, 21 nt, Mycobacterium leprae
uugucgccaguaugugaugca

SEQ ID NO: 1242760 - RNA, 20 nt, Mycobacterium leprae
uugucgcgucggguuaugca

SEQ ID NO: 1242761 - RNA, 20 nt, Mycobacterium leprae
uuguagaccaugagcacacg

SEQ ID NO: 1242762 - RNA, 22 nt, Mycobacterium leprae
uuguucggcaggccggccugga

SEQ ID NO: 1242763 - RNA, 18 nt, Mycobacterium leprae
uuguugacguguuuugcu

SEQ ID NO: 1242764 - RNA, 17 nt, Mycobacterium leprae
uuguggggguggaguaa

SEQ ID NO: 1242765 - RNA, 16 nt, Mycobacterium leprae
uuguggcggccgacca

SEQ ID NO: 1242766 - RNA, 17 nt, Mycobacterium leprae
uuguggcgcgagcguuu

SEQ ID NO: 1242767 - RNA, 15 nt, Mycobacterium leprae
uugugggcaggucag

SEQ ID NO: 1242768 - RNA, 15 nt, Mycobacterium leprae
uugucguuccagcuu

SEQ ID NO: 1242769 - RNA, 23 nt, Mycobacterium leprae
uugucguucgucugaaccagggg

SEQ ID NO: 1242770 - RNA, 19 nt, Mycobacterium leprae
uugucguguucguuguucu

SEQ ID NO: 1242771 - RNA, 12 nt, Mycobacterium leprae
uugucguuaugc

SEQ ID NO: 1242772 - RNA, 17 nt, Mycobacterium leprae
uugucuauuuugucaga

SEQ ID NO: 1242773 - RNA, 22 nt, Mycobacterium leprae
uugugccgcugcauccgcagca

SEQ ID NO: 1242774 - RNA, 14 nt, Mycobacterium leprae
uuuaugacuggccg

SEQ ID NO: 1242775 - RNA, 22 nt, Mycobacterium leprae
uuuagagaaaacuuaauaucuu

SEQ ID NO: 1242776 - RNA, 17 nt, Mycobacterium leprae
uuuagagaagaauuaau

SEQ ID NO: 1242777 - RNA, 12 nt, Mycobacterium leprae
uuuagagugcag

SEQ ID NO: 1242778 - RNA, 19 nt, Mycobacterium leprae
uuuagagugcagcacaaga

SEQ ID NO: 1242779 - RNA, 20 nt, Mycobacterium leprae
uuuacauaucgcgaacagcu

SEQ ID NO: 1242780 - RNA, 15 nt, Mycobacterium leprae
uuuaaggucaucuac

SEQ ID NO: 1242781 - RNA, 16 nt, Mycobacterium leprae
uuuaagcaggcucagc

SEQ ID NO: 1242782 - RNA, 14 nt, Mycobacterium leprae
uuggguuauaccgc

SEQ ID NO: 1242783 - RNA, 17 nt, Mycobacterium leprae
uuggguuuggucaaugc

SEQ ID NO: 1242784 - RNA, 22 nt, Mycobacterium leprae
uugguacuugugauucagcgcu

SEQ ID NO: 1242785 - RNA, 15 nt, Mycobacterium leprae
uugggcugcccuccu

SEQ ID NO: 1242786 - RNA, 18 nt, Mycobacterium leprae
uuggucguggcagaggcu

SEQ ID NO: 1242787 - RNA, 21 nt, Mycobacterium leprae
uuggucacgggugguuagaau

SEQ ID NO: 1242788 - RNA, 15 nt, Mycobacterium leprae
uugguucauggcagu

SEQ ID NO: 1242789 - RNA, 13 nt, Mycobacterium leprae
uuggugucuuguc

SEQ ID NO: 1242790 - RNA, 17 nt, Mycobacterium leprae
uuggugccguccucguc

SEQ ID NO: 1242791 - RNA, 16 nt, Mycobacterium leprae
uuggccuacuugggcc

SEQ ID NO: 1242792 - RNA, 13 nt, Mycobacterium leprae
uuggccgccaucu

SEQ ID NO: 1242793 - RNA, 22 nt, Mycobacterium leprae
uuggccggauguuuggcuguug

SEQ ID NO: 1242794 - RNA, 14 nt, Mycobacterium leprae
uuggcucgcucgac

SEQ ID NO: 1242795 - RNA, 16 nt, Mycobacterium leprae
uuggcggacugaaaac

SEQ ID NO: 1242796 - RNA, 17 nt, Mycobacterium leprae
uuggcgucgaucagggc

SEQ ID NO: 1242797 - RNA, 21 nt, Mycobacterium leprae
uugggcagcuaagaagcugcc

SEQ ID NO: 1242798 - RNA, 18 nt, Mycobacterium leprae
uugggaucuuuugaccag

SEQ ID NO: 1242799 - RNA, 14 nt, Mycobacterium leprae
uugggacguccauu

SEQ ID NO: 1242800 - RNA, 15 nt, Mycobacterium leprae
uuggcuugagugcug

SEQ ID NO: 1242801 - RNA, 13 nt, Mycobacterium leprae
uugcuaacgcuua

SEQ ID NO: 1242802 - RNA, 15 nt, Mycobacterium leprae
uugcuggucagcguc

SEQ ID NO: 1242803 - RNA, 18 nt, Mycobacterium leprae
uugcugguggaaggccua

SEQ ID NO: 1242804 - RNA, 14 nt, Mycobacterium leprae
uuggcagugugcau

SEQ ID NO: 1242805 - RNA, 19 nt, Mycobacterium leprae
uuggcacaacaagagaaga

SEQ ID NO: 1242806 - RNA, 17 nt, Mycobacterium leprae
uuggauucgguguugcu

SEQ ID NO: 1242807 - RNA, 13 nt, Mycobacterium leprae
uuggaugguuagc

SEQ ID NO: 1242808 - RNA, 13 nt, Mycobacterium leprae
uuggagcaggagc

SEQ ID NO: 1242809 - RNA, 14 nt, Mycobacterium leprae
uuggaccccaacca

SEQ ID NO: 1242810 - RNA, 16 nt, Mycobacterium leprae
uuggaccccaaccaga

SEQ ID NO: 1242811 - RNA, 21 nt, Mycobacterium leprae
uuggaaccaucaacggcuaca

SEQ ID NO: 1242812 - RNA, 19 nt, Mycobacterium leprae
uugccguagagguccugca

SEQ ID NO: 1242813 - RNA, 20 nt, Mycobacterium leprae
uugcggacaauucaacgaau

SEQ ID NO: 1242814 - RNA, 20 nt, Mycobacterium leprae
uugccacuuacuaucacgaa

SEQ ID NO: 1242815 - RNA, 14 nt, Mycobacterium leprae
uugcaugagcacug

SEQ ID NO: 1242816 - RNA, 19 nt, Mycobacterium leprae
uugcaugagcacuguuacu

SEQ ID NO: 1242817 - RNA, 16 nt, Mycobacterium leprae
uugcagacuuuggagc

SEQ ID NO: 1242818 - RNA, 18 nt, Mycobacterium leprae
uugcagauguugcagcag

SEQ ID NO: 1242819 - RNA, 23 nt, Mycobacterium leprae
uugauguauccaggauugaugcc

SEQ ID NO: 1242820 - RNA, 20 nt, Mycobacterium leprae
uugauuaccugcgaccuggu

SEQ ID NO: 1242821 - RNA, 16 nt, Mycobacterium leprae
uugaggucgcacagca

SEQ ID NO: 1242822 - RNA, 20 nt, Mycobacterium leprae
uugaggaacgacuugaccag

SEQ ID NO: 1242823 - RNA, 17 nt, Mycobacterium leprae
uugagugcgaccugaac

SEQ ID NO: 1242824 - RNA, 15 nt, Mycobacterium leprae
uucuugugaguuguc

SEQ ID NO: 1242825 - RNA, 18 nt, Mycobacterium leprae
aagcucacugugucuuua

SEQ ID NO: 1242826 - RNA, 14 nt, Mycobacterium leprae
aagcgcccgcgcau

SEQ ID NO: 1242827 - RNA, 19 nt, Mycobacterium leprae
aagcugagccgacaaucuc

SEQ ID NO: 1242828 - RNA, 18 nt, Mycobacterium leprae
aagcugaugacaguaagu

SEQ ID NO: 1242829 - RNA, 18 nt, Mycobacterium leprae
aagcuugaaguguuguuu

SEQ ID NO: 1242830 - RNA, 18 nt, Mycobacterium leprae
aaggaacaaaaucucacg

SEQ ID NO: 1242831 - RNA, 17 nt, Mycobacterium leprae
aagccgccgaacaagcc

SEQ ID NO: 1242832 - RNA, 12 nt, Mycobacterium leprae
aagccgccgaca

SEQ ID NO: 1242833 - RNA, 12 nt, Mycobacterium leprae
aagccgggaccu

SEQ ID NO: 1242834 - RNA, 14 nt, Mycobacterium leprae
aagccugagaccau

SEQ ID NO: 1242835 - RNA, 12 nt, Mycobacterium leprae
aagccgugacuc

SEQ ID NO: 1242836 - RNA, 13 nt, Mycobacterium leprae
aaggucaaggcug

SEQ ID NO: 1242837 - RNA, 18 nt, Mycobacterium leprae
aaggaucgagcggagcug

SEQ ID NO: 1242838 - RNA, 19 nt, Mycobacterium leprae
aagggcugguggccgaggu

SEQ ID NO: 1242839 - RNA, 23 nt, Mycobacterium leprae
aagucaugcagaugcaagauuau

SEQ ID NO: 1242840 - RNA, 24 nt, Mycobacterium leprae
aagucaugcagaugcaagauuauu

SEQ ID NO: 1242841 - RNA, 18 nt, Mycobacterium leprae
aagugacugcguuucaug

SEQ ID NO: 1242842 - RNA, 13 nt, Mycobacterium leprae
aagugcgccagcg

SEQ ID NO: 1242843 - RNA, 17 nt, Mycobacterium leprae
aagugugguuucgauca

SEQ ID NO: 1242844 - RNA, 18 nt, Mycobacterium leprae
aauauccaaagaaguuug

SEQ ID NO: 1242845 - RNA, 15 nt, Mycobacterium leprae
aauauacgaaucccg

SEQ ID NO: 1242846 - RNA, 15 nt, Mycobacterium leprae
aauacgggcucacgg

SEQ ID NO: 1242847 - RNA, 20 nt, Mycobacterium leprae
aauacggcacgccgaacagc

SEQ ID NO: 1242848 - RNA, 19 nt, Mycobacterium leprae
aauaaauauccgaauguga

SEQ ID NO: 1242849 - RNA, 15 nt, Mycobacterium leprae
aauucgcucgccggg

SEQ ID NO: 1242850 - RNA, 16 nt, Mycobacterium leprae
aauuccuacccucuca

SEQ ID NO: 1242851 - RNA, 13 nt, Mycobacterium leprae
aauuauuccaauc

SEQ ID NO: 1242852 - RNA, 14 nt, Mycobacterium leprae
aauuauuccaaucc

SEQ ID NO: 1242853 - RNA, 21 nt, Mycobacterium leprae
aauucuucucuaaaaagauau

SEQ ID NO: 1242854 - RNA, 13 nt, Mycobacterium leprae
aauugaucacaaa

SEQ ID NO: 1242855 - RNA, 13 nt, Mycobacterium leprae
aauuggcagagca

SEQ ID NO: 1242856 - RNA, 22 nt, Mycobacterium leprae
aauuggcuccccgaaugcaaug

SEQ ID NO: 1242857 - RNA, 14 nt, Mycobacterium leprae
aauugggaucgaca

SEQ ID NO: 1242858 - RNA, 17 nt, Mycobacterium leprae
aauuuaguuaacgugcc

SEQ ID NO: 1242859 - RNA, 17 nt, Mycobacterium leprae
aauuggguaaagugaac

SEQ ID NO: 1242860 - RNA, 18 nt, Mycobacterium leprae
aauugucguuaugcggug

SEQ ID NO: 1242861 - RNA, 14 nt, Mycobacterium leprae
aauggacagaacac

SEQ ID NO: 1242862 - RNA, 18 nt, Mycobacterium leprae
aaugcgucccgagccugu

SEQ ID NO: 1242863 - RNA, 12 nt, Mycobacterium leprae
aaugccggaacc

SEQ ID NO: 1242864 - RNA, 17 nt, Mycobacterium leprae
aaugccgacagugccac

SEQ ID NO: 1242865 - RNA, 13 nt, Mycobacterium leprae
aaugcaggugacc

SEQ ID NO: 1242866 - RNA, 13 nt, Mycobacterium leprae
aaugcagcggcag

SEQ ID NO: 1242867 - RNA, 19 nt, Mycobacterium leprae
aaugaucgcguugaccaaa

SEQ ID NO: 1242868 - RNA, 15 nt, Mycobacterium leprae
aaugaauguguucaa

SEQ ID NO: 1242869 - RNA, 15 nt, Mycobacterium leprae
aaucugguuagcaac

SEQ ID NO: 1242870 - RNA, 16 nt, Mycobacterium leprae
aaucuaucaagccaca

SEQ ID NO: 1242871 - RNA, 18 nt, Mycobacterium leprae
aaucgcccgcaacaccgu

SEQ ID NO: 1242872 - RNA, 23 nt, Mycobacterium leprae
aaucgcccugcuuaugcgugcug

SEQ ID NO: 1242873 - RNA, 16 nt, Mycobacterium leprae
aauccuucauguccua

SEQ ID NO: 1242874 - RNA, 21 nt, Mycobacterium leprae
aauccuucauguccuacacaa

SEQ ID NO: 1242875 - RNA, 14 nt, Mycobacterium leprae
aaucguccagggug

SEQ ID NO: 1242876 - RNA, 18 nt, Mycobacterium leprae
aaucccagcguucuccac

SEQ ID NO: 1242877 - RNA, 11 nt, Mycobacterium leprae
aaucccgaaaa

SEQ ID NO: 1242878 - RNA, 22 nt, Mycobacterium leprae
aaucccgcuaugugcaaucgau

SEQ ID NO: 1242879 - RNA, 22 nt, Mycobacterium leprae
aauccugcguagcaagguguug

SEQ ID NO: 1242880 - RNA, 14 nt, Mycobacterium leprae
aauccucagcgucc

SEQ ID NO: 1242881 - RNA, 18 nt, Mycobacterium leprae
aauccucagcgucccaac

SEQ ID NO: 1242882 - RNA, 14 nt, Mycobacterium leprae
aauccguauugguu

SEQ ID NO: 1242883 - RNA, 14 nt, Mycobacterium leprae
aauccgcugcccug

SEQ ID NO: 1242884 - RNA, 13 nt, Mycobacterium leprae
aauccagccgagg

SEQ ID NO: 1242885 - RNA, 14 nt, Mycobacterium leprae
aagaaaaggaccca

SEQ ID NO: 1242886 - RNA, 22 nt, Mycobacterium leprae
aagaacguuucgucaguaguuu

SEQ ID NO: 1242887 - RNA, 21 nt, Mycobacterium leprae
aacuucagaagcacgacacua

SEQ ID NO: 1242888 - RNA, 22 nt, Mycobacterium leprae
aacuucccgacggugaaucagu

SEQ ID NO: 1242889 - RNA, 12 nt, Mycobacterium leprae
aacuugcacuga

SEQ ID NO: 1242890 - RNA, 14 nt, Mycobacterium leprae
aacuuggcacaaca

SEQ ID NO: 1242891 - RNA, 14 nt, Mycobacterium leprae
aacuugauuucaag

SEQ ID NO: 1242892 - RNA, 18 nt, Mycobacterium leprae
aacuugauuucaaggaau

SEQ ID NO: 1242893 - RNA, 17 nt, Mycobacterium leprae
aacugccggcaaccagc

SEQ ID NO: 1242894 - RNA, 15 nt, Mycobacterium leprae
aacugcggguagauc

SEQ ID NO: 1242895 - RNA, 21 nt, Mycobacterium leprae
aacugacuucagucagcaugg

SEQ ID NO: 1242896 - RNA, 18 nt, Mycobacterium leprae
aacugagcgcguuaggca

SEQ ID NO: 1242897 - RNA, 18 nt, Mycobacterium leprae
aacuggaguacuggcggc

SEQ ID NO: 1242898 - RNA, 14 nt, Mycobacterium leprae
aacugguggcagcc

SEQ ID NO: 1242899 - RNA, 17 nt, Mycobacterium leprae
aacugucgguaaugcaa

SEQ ID NO: 1242900 - RNA, 18 nt, Mycobacterium leprae
aacugucgguaaugcaag

SEQ ID NO: 1242901 - RNA, 17 nt, Mycobacterium leprae
aacuauccucacacuca

SEQ ID NO: 1242902 - RNA, 13 nt, Mycobacterium leprae
aacguggcaccaa

SEQ ID NO: 1242903 - RNA, 14 nt, Mycobacterium leprae
aacguuucgccgca

SEQ ID NO: 1242904 - RNA, 20 nt, Mycobacterium leprae
aacguuuauuccuaaugaau

SEQ ID NO: 1242905 - RNA, 15 nt, Mycobacterium leprae
aacguugcugcuggu

SEQ ID NO: 1242906 - RNA, 17 nt, Mycobacterium leprae
aacguugacugggaaca

SEQ ID NO: 1242907 - RNA, 20 nt, Mycobacterium leprae
aacuacuggauuaauauuua

SEQ ID NO: 1242908 - RNA, 14 nt, Mycobacterium leprae
aacuagcgggcucu

SEQ ID NO: 1242909 - RNA, 22 nt, Mycobacterium leprae
aacggccuguucgggcgcccgg

SEQ ID NO: 1242910 - RNA, 20 nt, Mycobacterium leprae
aacggggucgucggccaggc

SEQ ID NO: 1242911 - RNA, 13 nt, Mycobacterium leprae
aacgggacaaguc

SEQ ID NO: 1242912 - RNA, 16 nt, Mycobacterium leprae
aacggaaaggucucua

SEQ ID NO: 1242913 - RNA, 15 nt, Mycobacterium leprae
aacggcaccaaaccc

SEQ ID NO: 1242914 - RNA, 16 nt, Mycobacterium leprae
aacggcaccaaacccg

SEQ ID NO: 1242915 - RNA, 13 nt, Mycobacterium leprae
aacgcugaccagc

SEQ ID NO: 1242916 - RNA, 14 nt, Mycobacterium leprae
aacgcugaccagca

SEQ ID NO: 1242917 - RNA, 16 nt, Mycobacterium leprae
aacgcgcaccuggugg

SEQ ID NO: 1242918 - RNA, 18 nt, Mycobacterium leprae
aacgacuugaccagccgc

SEQ ID NO: 1242919 - RNA, 23 nt, Mycobacterium leprae
aacgaccuggugacgucguaaac

SEQ ID NO: 1242920 - RNA, 18 nt, Mycobacterium leprae
aacgcagcgcgaacaaga

SEQ ID NO: 1242921 - RNA, 23 nt, Mycobacterium leprae
aaccgucggaaacacagcaagca

SEQ ID NO: 1242922 - RNA, 16 nt, Mycobacterium leprae
aaccuaauuagucuag

SEQ ID NO: 1242923 - RNA, 21 nt, Mycobacterium leprae
aaccugcugaucgaauugacc

SEQ ID NO: 1242924 - RNA, 20 nt, Mycobacterium leprae
aaccucguuacgauccaugc

SEQ ID NO: 1242925 - RNA, 19 nt, Mycobacterium leprae
aacgacaugacauauugua

SEQ ID NO: 1242926 - RNA, 19 nt, Mycobacterium leprae
aacgaagggaaugcgucag

SEQ ID NO: 1242927 - RNA, 16 nt, Mycobacterium leprae
aaccgggccaacuccu

SEQ ID NO: 1242928 - RNA, 18 nt, Mycobacterium leprae
aaccggucaaucagguug

SEQ ID NO: 1242929 - RNA, 20 nt, Mycobacterium leprae
aaccgcaguacuggugcugu

SEQ ID NO: 1242930 - RNA, 15 nt, Mycobacterium leprae
aaccgcugugacagc

SEQ ID NO: 1242931 - RNA, 15 nt, Mycobacterium leprae
aaccgccuuugacga

SEQ ID NO: 1242932 - RNA, 17 nt, Mycobacterium leprae
aaccccacgucgccggu

SEQ ID NO: 1242933 - RNA, 23 nt, Mycobacterium leprae
aaccccacacugagaaaggcaga

SEQ ID NO: 1242934 - RNA, 14 nt, Mycobacterium leprae
aaccccgcggaagc

SEQ ID NO: 1242935 - RNA, 20 nt, Mycobacterium leprae
aacccguugucaagcacugc

SEQ ID NO: 1242936 - RNA, 17 nt, Mycobacterium leprae
aaccaucccaaaaccac

SEQ ID NO: 1242937 - RNA, 12 nt, Mycobacterium leprae
aaccaucaacgg

SEQ ID NO: 1242938 - RNA, 19 nt, Mycobacterium leprae
aaccaucaacggcuacaac

SEQ ID NO: 1242939 - RNA, 17 nt, Mycobacterium leprae
aaccaucagaaaaccgu

SEQ ID NO: 1242940 - RNA, 22 nt, Mycobacterium leprae
aacccauauucgucaaaaaacu

SEQ ID NO: 1242941 - RNA, 22 nt, Mycobacterium leprae
aaccacuugcaguacaaugucu

SEQ ID NO: 1242942 - RNA, 15 nt, Mycobacterium leprae
aaccacuuagcguga

SEQ ID NO: 1242943 - RNA, 16 nt, Mycobacterium leprae
aaccacugcgcccuga

SEQ ID NO: 1242944 - RNA, 13 nt, Mycobacterium leprae
aaccacacccugg

SEQ ID NO: 1242945 - RNA, 22 nt, Mycobacterium leprae
aaccagacccacagcugcgcau

SEQ ID NO: 1242946 - RNA, 13 nt, Mycobacterium leprae
aaccagcgugcaa

SEQ ID NO: 1242947 - RNA, 18 nt, Mycobacterium leprae
aaccaagauguaaagcag

SEQ ID NO: 1242948 - RNA, 17 nt, Mycobacterium leprae
aaccaacuaggcgccag

SEQ ID NO: 1242949 - RNA, 16 nt, Mycobacterium leprae
aacauuguucugccau

SEQ ID NO: 1242950 - RNA, 17 nt, Mycobacterium leprae
aacauucaggaugcugu

SEQ ID NO: 1242951 - RNA, 18 nt, Mycobacterium leprae
aacauucaggaugcuguc

SEQ ID NO: 1242952 - RNA, 21 nt, Mycobacterium leprae
aacaugaucaauaccacaauu

SEQ ID NO: 1242953 - RNA, 17 nt, Mycobacterium leprae
aacaugaacgucacugg

SEQ ID NO: 1242954 - RNA, 13 nt, Mycobacterium leprae
aacauagccagca

SEQ ID NO: 1242955 - RNA, 17 nt, Mycobacterium leprae
aacauagccagcaucaa

SEQ ID NO: 1242956 - RNA, 16 nt, Mycobacterium leprae
aacauagucagaucaa

SEQ ID NO: 1242957 - RNA, 17 nt, Mycobacterium leprae
aacauagucagaucaac

SEQ ID NO: 1242958 - RNA, 22 nt, Mycobacterium leprae
aacaguuaaagguaaagaauuc

SEQ ID NO: 1242959 - RNA, 13 nt, Mycobacterium leprae
aacauaaccacau

SEQ ID NO: 1242960 - RNA, 18 nt, Mycobacterium leprae
aacagggccgaagcagcc

SEQ ID NO: 1242961 - RNA, 12 nt, Mycobacterium leprae
aacaggcgccug

SEQ ID NO: 1242962 - RNA, 21 nt, Mycobacterium leprae
aacaggcgguuuaaaagugac

SEQ ID NO: 1242963 - RNA, 20 nt, Mycobacterium leprae
aacagccuaaccucacgccu

SEQ ID NO: 1242964 - RNA, 11 nt, Mycobacterium leprae
aacagccaaug

SEQ ID NO: 1242965 - RNA, 11 nt, Mycobacterium leprae
aacagauuauu

SEQ ID NO: 1242966 - RNA, 14 nt, Mycobacterium leprae
aacacguuucugca

SEQ ID NO: 1242967 - RNA, 21 nt, Mycobacterium leprae
aacacugaguagaugcaacug

SEQ ID NO: 1242968 - RNA, 15 nt, Mycobacterium leprae
aacacuuacaccaac

SEQ ID NO: 1242969 - RNA, 21 nt, Mycobacterium leprae
aacaauccuguagcuguucgg

SEQ ID NO: 1242970 - RNA, 14 nt, Mycobacterium leprae
aacaacaaaaauag

SEQ ID NO: 1242971 - RNA, 21 nt, Mycobacterium leprae
aacaaaucauagugaccaaaa

SEQ ID NO: 1242972 - RNA, 14 nt, Mycobacterium leprae
aacaagagaagagc

SEQ ID NO: 1242973 - RNA, 16 nt, Mycobacterium leprae
aacaacgaccagcgcu

SEQ ID NO: 1242974 - RNA, 21 nt, Mycobacterium leprae
aacaacuauccucacacucac

SEQ ID NO: 1242975 - RNA, 22 nt, Mycobacterium leprae
aaauuugaggucgacacagaac

SEQ ID NO: 1242976 - RNA, 16 nt, Mycobacterium leprae
aaauuuuaucgcagga

SEQ ID NO: 1242977 - RNA, 20 nt, Mycobacterium leprae
aaauuuguuuaucagccugu

SEQ ID NO: 1242978 - RNA, 19 nt, Mycobacterium leprae
acagguaaacgagaccagg

SEQ ID NO: 1242979 - RNA, 16 nt, Mycobacterium leprae
acagguggcaucagau

SEQ ID NO: 1242980 - RNA, 18 nt, Mycobacterium leprae
acaguaucgaccagccac

SEQ ID NO: 1242981 - RNA, 16 nt, Mycobacterium leprae
acagugcaucgaugau

SEQ ID NO: 1242982 - RNA, 17 nt, Mycobacterium leprae
acaguggugauugcugg

SEQ ID NO: 1242983 - RNA, 20 nt, Mycobacterium leprae
acagugcgguuguacagcuc

SEQ ID NO: 1242984 - RNA, 15 nt, Mycobacterium leprae
acauaaccacauugu

SEQ ID NO: 1242985 - RNA, 21 nt, Mycobacterium leprae
acaugaucaauaccacaauuu

SEQ ID NO: 1242986 - RNA, 13 nt, Mycobacterium leprae
acaucacugggug

SEQ ID NO: 1242987 - RNA, 12 nt, Mycobacterium leprae
acacugugccug

SEQ ID NO: 1242988 - RNA, 21 nt, Mycobacterium leprae
acacucccgacgcggaaagcu

SEQ ID NO: 1242989 - RNA, 22 nt, Mycobacterium leprae
acacuugccgcguucgucggaa

SEQ ID NO: 1242990 - RNA, 15 nt, Mycobacterium leprae
acagaugagcucagu

SEQ ID NO: 1242991 - RNA, 20 nt, Mycobacterium leprae
acagagucaaauucaaccgg

SEQ ID NO: 1242992 - RNA, 23 nt, Mycobacterium leprae
acagagcugugucaaugacaagc

SEQ ID NO: 1242993 - RNA, 14 nt, Mycobacterium leprae
acagcucgacagca

SEQ ID NO: 1242994 - RNA, 22 nt, Mycobacterium leprae
acagcuacaccuuggccgccgg

SEQ ID NO: 1242995 - RNA, 18 nt, Mycobacterium leprae
acagcuugacaucaguca

SEQ ID NO: 1242996 - RNA, 17 nt, Mycobacterium leprae
acagcgugaaccaaagc

SEQ ID NO: 1242997 - RNA, 19 nt, Mycobacterium leprae
acagcggggucgacuuaau

SEQ ID NO: 1242998 - RNA, 23 nt, Mycobacterium leprae
acagcgaugacauggaagccgcc

SEQ ID NO: 1242999 - RNA, 20 nt, Mycobacterium leprae
acagccugccgauauaccug

SEQ ID NO: 1243000 - RNA, 18 nt, Mycobacterium leprae
acagccguugcugcugcc

SEQ ID NO: 1243001 - RNA, 22 nt, Mycobacterium leprae
acagcccaggugcccagccccu

SEQ ID NO: 1243002 - RNA, 15 nt, Mycobacterium leprae
acagccgucagggca

SEQ ID NO: 1243003 - RNA, 16 nt, Mycobacterium leprae
acagccgucagggcag

SEQ ID NO: 1243004 - RNA, 14 nt, Mycobacterium leprae
accauuggcgacaa

SEQ ID NO: 1243005 - RNA, 15 nt, Mycobacterium leprae
accauugggucaucg

SEQ ID NO: 1243006 - RNA, 16 nt, Mycobacterium leprae
acccaagcgccagcuc

SEQ ID NO: 1243007 - RNA, 15 nt, Mycobacterium leprae
acccaauagagcagu

SEQ ID NO: 1243008 - RNA, 21 nt, Mycobacterium leprae
acccaauagagcagugcugac

SEQ ID NO: 1243009 - RNA, 21 nt, Mycobacterium leprae
acccaagugacugcguuucau

SEQ ID NO: 1243010 - RNA, 15 nt, Mycobacterium leprae
accccagucgagcca

SEQ ID NO: 1243011 - RNA, 21 nt, Mycobacterium leprae
accccagucgagccaccucug

SEQ ID NO: 1243012 - RNA, 19 nt, Mycobacterium leprae
acccagacgcgaccgccac

SEQ ID NO: 1243013 - RNA, 20 nt, Mycobacterium leprae
acccagacgcgaccgccacc

SEQ ID NO: 1243014 - RNA, 14 nt, Mycobacterium leprae
accauaaccgcaua

SEQ ID NO: 1243015 - RNA, 18 nt, Mycobacterium leprae
accaguugcuugucuucu

SEQ ID NO: 1243016 - RNA, 23 nt, Mycobacterium leprae
accagcgaucgacccaagcaucc

SEQ ID NO: 1243017 - RNA, 14 nt, Mycobacterium leprae
accagguuguggca

SEQ ID NO: 1243018 - RNA, 17 nt, Mycobacterium leprae
accagguuguggcacca

SEQ ID NO: 1243019 - RNA, 23 nt, Mycobacterium leprae
accaggucgacuaacgcuucugc

SEQ ID NO: 1243020 - RNA, 22 nt, Mycobacterium leprae
accagggaagugacgccacagu

SEQ ID NO: 1243021 - RNA, 15 nt, Mycobacterium leprae
accacugaaccugcc

SEQ ID NO: 1243022 - RNA, 14 nt, Mycobacterium leprae
accaccaccccuac

SEQ ID NO: 1243023 - RNA, 16 nt, Mycobacterium leprae
accagccaagccgcca

SEQ ID NO: 1243024 - RNA, 13 nt, Mycobacterium leprae
accagcagugguc

SEQ ID NO: 1243025 - RNA, 15 nt, Mycobacterium leprae
accagaaguggucga

SEQ ID NO: 1243026 - RNA, 18 nt, Mycobacterium leprae
accaaggcucccaaggac

SEQ ID NO: 1243027 - RNA, 14 nt, Mycobacterium leprae
accaaccuguagac

SEQ ID NO: 1243028 - RNA, 12 nt, Mycobacterium leprae
acaugugugcug

SEQ ID NO: 1243029 - RNA, 20 nt, Mycobacterium leprae
acauguacggaauaugcuug

SEQ ID NO: 1243030 - RNA, 22 nt, Mycobacterium leprae
acgagggugacgguggcgcaca

SEQ ID NO: 1243031 - RNA, 22 nt, Mycobacterium leprae
acgaugaucuuggcccggcucc

SEQ ID NO: 1243032 - RNA, 15 nt, Mycobacterium leprae
acgcaaaguugaacg

SEQ ID NO: 1243033 - RNA, 14 nt, Mycobacterium leprae
acgauuagcaugac

SEQ ID NO: 1243034 - RNA, 16 nt, Mycobacterium leprae
acgauuagcaugacgu

SEQ ID NO: 1243035 - RNA, 13 nt, Mycobacterium leprae
acgaacuucagaa

SEQ ID NO: 1243036 - RNA, 23 nt, Mycobacterium leprae
acgaagccucaucgaaagcaggc

SEQ ID NO: 1243037 - RNA, 20 nt, Mycobacterium leprae
acgaaucccgcuaagacgag

SEQ ID NO: 1243038 - RNA, 23 nt, Mycobacterium leprae
acgacguuaucuugaugcugugu

SEQ ID NO: 1243039 - RNA, 13 nt, Mycobacterium leprae
acgacgccacagc

SEQ ID NO: 1243040 - RNA, 16 nt, Mycobacterium leprae
acgacggugcggcugg

SEQ ID NO: 1243041 - RNA, 22 nt, Mycobacterium leprae
acgacguagaacaagugcaaug

SEQ ID NO: 1243042 - RNA, 13 nt, Mycobacterium leprae
acgacguagccca

SEQ ID NO: 1243043 - RNA, 13 nt, Mycobacterium leprae
acgagaccagggg

SEQ ID NO: 1243044 - RNA, 13 nt, Mycobacterium leprae
acgaccaaaccuc

SEQ ID NO: 1243045 - RNA, 18 nt, Mycobacterium leprae
acgacgaguagugauuau

SEQ ID NO: 1243046 - RNA, 12 nt, Mycobacterium leprae
acgaacaacaga

SEQ ID NO: 1243047 - RNA, 16 nt, Mycobacterium leprae
acgaaaauguuuuguu

SEQ ID NO: 1243048 - RNA, 15 nt, Mycobacterium leprae
accuuugcccugcgc

SEQ ID NO: 1243049 - RNA, 11 nt, Mycobacterium leprae
accuuuggccg

SEQ ID NO: 1243050 - RNA, 21 nt, Mycobacterium leprae
accuugaaagcgcgagauuag

SEQ ID NO: 1243051 - RNA, 14 nt, Mycobacterium leprae
accuuggccgccgg

SEQ ID NO: 1243052 - RNA, 20 nt, Mycobacterium leprae
accuuguugcagccuggugu

SEQ ID NO: 1243053 - RNA, 20 nt, Mycobacterium leprae
accuuccgcaaaguuaugca

SEQ ID NO: 1243054 - RNA, 14 nt, Mycobacterium leprae
accugcauggacga

SEQ ID NO: 1243055 - RNA, 13 nt, Mycobacterium leprae
accugccgcagcg

SEQ ID NO: 1243056 - RNA, 15 nt, Mycobacterium leprae
accugccuagcaacg

SEQ ID NO: 1243057 - RNA, 16 nt, Mycobacterium leprae
accugcgacgucccaa

SEQ ID NO: 1243058 - RNA, 17 nt, Mycobacterium leprae
accuggaggccaacccu

SEQ ID NO: 1243059 - RNA, 23 nt, Mycobacterium leprae
accuguuucagcguggcuaggcc

SEQ ID NO: 1243060 - RNA, 22 nt, Mycobacterium leprae
accuggucaccaaccggccggc

SEQ ID NO: 1243061 - RNA, 22 nt, Mycobacterium leprae
accuuaaguccgguagucgcua

SEQ ID NO: 1243062 - RNA, 15 nt, Mycobacterium leprae
accuuacagucacua

SEQ ID NO: 1243063 - RNA, 15 nt, Mycobacterium leprae
accuuaccguccacc

SEQ ID NO: 1243064 - RNA, 17 nt, Mycobacterium leprae
accuccuugaccaccac

SEQ ID NO: 1243065 - RNA, 18 nt, Mycobacterium leprae
accucgaacuuguucuuu

SEQ ID NO: 1243066 - RNA, 14 nt, Mycobacterium leprae
accuccagccgcgg

SEQ ID NO: 1243067 - RNA, 22 nt, Mycobacterium leprae
accuauucaaccgguuuccuca

SEQ ID NO: 1243068 - RNA, 15 nt, Mycobacterium leprae
accucacccaguccu

SEQ ID NO: 1243069 - RNA, 22 nt, Mycobacterium leprae
accucauauuuagcgaccggcc

SEQ ID NO: 1243070 - RNA, 18 nt, Mycobacterium leprae
accucacgauuucggcuc

SEQ ID NO: 1243071 - RNA, 21 nt, Mycobacterium leprae
accuacaacuucaaccaagcc

SEQ ID NO: 1243072 - RNA, 15 nt, Mycobacterium leprae
accuaucgacauccu

SEQ ID NO: 1243073 - RNA, 23 nt, Mycobacterium leprae
accuaguugguugccaagauacu

SEQ ID NO: 1243074 - RNA, 16 nt, Mycobacterium leprae
accuaggccugcugaa

SEQ ID NO: 1243075 - RNA, 12 nt, Mycobacterium leprae
accguuaauaua

SEQ ID NO: 1243076 - RNA, 19 nt, Mycobacterium leprae
accguagucacuauauaua

SEQ ID NO: 1243077 - RNA, 22 nt, Mycobacterium leprae
accguaguguuuuaccagccag

SEQ ID NO: 1243078 - RNA, 13 nt, Mycobacterium leprae
accguauauuaac

SEQ ID NO: 1243079 - RNA, 20 nt, Mycobacterium leprae
accguauccuggucaucugu

SEQ ID NO: 1243080 - RNA, 14 nt, Mycobacterium leprae
accgucaugcugcu

SEQ ID NO: 1243081 - RNA, 14 nt, Mycobacterium leprae
accguguagugcac

SEQ ID NO: 1243082 - RNA, 13 nt, Mycobacterium leprae
accgugcugaugc

SEQ ID NO: 1243083 - RNA, 22 nt, Mycobacterium leprae
accgugcacggggacgugccug

SEQ ID NO: 1243084 - RNA, 13 nt, Mycobacterium leprae
accgugcagcugc

SEQ ID NO: 1243085 - RNA, 20 nt, Mycobacterium leprae
accgugcagcugccaaccgg

SEQ ID NO: 1243086 - RNA, 15 nt, Mycobacterium leprae
accgucuuugcuaac

SEQ ID NO: 1243087 - RNA, 18 nt, Mycobacterium leprae
accggugaugucggcguc

SEQ ID NO: 1243088 - RNA, 17 nt, Mycobacterium leprae
accggugcugcagccac

SEQ ID NO: 1243089 - RNA, 13 nt, Mycobacterium leprae
accgguccggaua

SEQ ID NO: 1243090 - RNA, 19 nt, Mycobacterium leprae
accgggguacaauaaacug

SEQ ID NO: 1243091 - RNA, 21 nt, Mycobacterium leprae
accggcggugucggcuaccaa

SEQ ID NO: 1243092 - RNA, 20 nt, Mycobacterium leprae
accggcgcuuguaaggccag

SEQ ID NO: 1243093 - RNA, 15 nt, Mycobacterium leprae
accggccagugcaac

SEQ ID NO: 1243094 - RNA, 16 nt, Mycobacterium leprae
accggcccgaauucau

SEQ ID NO: 1243095 - RNA, 16 nt, Mycobacterium leprae
accgcuucagagugca

SEQ ID NO: 1243096 - RNA, 15 nt, Mycobacterium leprae
accggccaaaauggc

SEQ ID NO: 1243097 - RNA, 16 nt, Mycobacterium leprae
accggccaaccacagc

SEQ ID NO: 1243098 - RNA, 19 nt, Mycobacterium leprae
accggccaaaagccuugcg

SEQ ID NO: 1243099 - RNA, 20 nt, Mycobacterium leprae
accgauccgguguggaguga

SEQ ID NO: 1243100 - RNA, 22 nt, Mycobacterium leprae
accccuacccaaaucagcacca

SEQ ID NO: 1243101 - RNA, 16 nt, Mycobacterium leprae
accccgauuccaccug

SEQ ID NO: 1243102 - RNA, 23 nt, Mycobacterium leprae
accgcucgauggccagccguccc

SEQ ID NO: 1243103 - RNA, 16 nt, Mycobacterium leprae
accgcugacacuguca

SEQ ID NO: 1243104 - RNA, 22 nt, Mycobacterium leprae
accgcugggugugucaucauca

SEQ ID NO: 1243105 - RNA, 13 nt, Mycobacterium leprae
accgcuguggcag

SEQ ID NO: 1243106 - RNA, 15 nt, Mycobacterium leprae
accgccggucgggga

SEQ ID NO: 1243107 - RNA, 13 nt, Mycobacterium leprae
agaaaaaugcugc

SEQ ID NO: 1243108 - RNA, 16 nt, Mycobacterium leprae
acuucgacgagacacu

SEQ ID NO: 1243109 - RNA, 12 nt, Mycobacterium leprae
acuuuuuguggg

SEQ ID NO: 1243110 - RNA, 22 nt, Mycobacterium leprae
agaacaccccgcggaguuggcc

SEQ ID NO: 1243111 - RNA, 18 nt, Mycobacterium leprae
agaaccaguucuugguaa

SEQ ID NO: 1243112 - RNA, 14 nt, Mycobacterium leprae
agaauuuaccggcg

SEQ ID NO: 1243113 - RNA, 21 nt, Mycobacterium leprae
agaccaccguaagucagaugg

SEQ ID NO: 1243114 - RNA, 22 nt, Mycobacterium leprae
agaccaccguaagucagaugga

SEQ ID NO: 1243115 - RNA, 21 nt, Mycobacterium leprae
agacgguguugcugaguguug

SEQ ID NO: 1243116 - RNA, 12 nt, Mycobacterium leprae
agacgugcacaa

SEQ ID NO: 1243117 - RNA, 21 nt, Mycobacterium leprae
agacgcauaacgaucuaucug

SEQ ID NO: 1243118 - RNA, 15 nt, Mycobacterium leprae
agacgagaucagugc

SEQ ID NO: 1243119 - RNA, 20 nt, Mycobacterium leprae
agaccagggguguugcacca

SEQ ID NO: 1243120 - RNA, 23 nt, Mycobacterium leprae
agaccaguugcacaucagcaaag

SEQ ID NO: 1243121 - RNA, 15 nt, Mycobacterium leprae
agaccaucacgaucc

SEQ ID NO: 1243122 - RNA, 21 nt, Mycobacterium leprae
agacccacagcugcgcauacu

SEQ ID NO: 1243123 - RNA, 18 nt, Mycobacterium leprae
agaccucccugacgcaca

SEQ ID NO: 1243124 - RNA, 16 nt, Mycobacterium leprae
agaaucacaaucacaa

SEQ ID NO: 1243125 - RNA, 14 nt, Mycobacterium leprae
agaaucgaucccac

SEQ ID NO: 1243126 - RNA, 17 nt, Mycobacterium leprae
agaaucgccuggucaug

SEQ ID NO: 1243127 - RNA, 19 nt, Mycobacterium leprae
agaauauugcgacauccaa

SEQ ID NO: 1243128 - RNA, 20 nt, Mycobacterium leprae
agaauucgccauugcucugg

SEQ ID NO: 1243129 - RNA, 17 nt, Mycobacterium leprae
agaagaauuaauauaua

SEQ ID NO: 1243130 - RNA, 23 nt, Mycobacterium leprae
agaacuucaagcucauccugggc

SEQ ID NO: 1243131 - RNA, 13 nt, Mycobacterium leprae
agaagucaggcug

SEQ ID NO: 1243132 - RNA, 13 nt, Mycobacterium leprae
agauguaaagcag

SEQ ID NO: 1243133 - RNA, 23 nt, Mycobacterium leprae
agauggugcacuugcacuauguc

SEQ ID NO: 1243134 - RNA, 15 nt, Mycobacterium leprae
agaugucgcagcggc

SEQ ID NO: 1243135 - RNA, 20 nt, Mycobacterium leprae
agaugcugcguucagcgaag

SEQ ID NO: 1243136 - RNA, 13 nt, Mycobacterium leprae
agauggaaggcgg

SEQ ID NO: 1243137 - RNA, 19 nt, Mycobacterium leprae
agauggaaggcggagaugu

SEQ ID NO: 1243138 - RNA, 22 nt, Mycobacterium leprae
agauugacaaaagugcagugau

SEQ ID NO: 1243139 - RNA, 19 nt, Mycobacterium leprae
agauugacaccgccggcgu

SEQ ID NO: 1243140 - RNA, 22 nt, Mycobacterium leprae
agauuccaaugucccaccgagu

SEQ ID NO: 1243141 - RNA, 17 nt, Mycobacterium leprae
agauuauuaagauaaag

SEQ ID NO: 1243142 - RNA, 20 nt, Mycobacterium leprae
agaucucacccucgccgcga

SEQ ID NO: 1243143 - RNA, 18 nt, Mycobacterium leprae
agaucgacgcugcgccgu

SEQ ID NO: 1243144 - RNA, 20 nt, Mycobacterium leprae
agaucgccugguucacuaag

SEQ ID NO: 1243145 - RNA, 16 nt, Mycobacterium leprae
agaucugauucagauu

SEQ ID NO: 1243146 - RNA, 22 nt, Mycobacterium leprae
agaucuugccaucgaacgcucu

SEQ ID NO: 1243147 - RNA, 18 nt, Mycobacterium leprae
agaucuggguaucaguau

SEQ ID NO: 1243148 - RNA, 17 nt, Mycobacterium leprae
agaucuuaaucgagcca

SEQ ID NO: 1243149 - RNA, 13 nt, Mycobacterium leprae
agaucuuucuggu

SEQ ID NO: 1243150 - RNA, 22 nt, Mycobacterium leprae
agaugaguugugcagcugaaau

SEQ ID NO: 1243151 - RNA, 14 nt, Mycobacterium leprae
agaucaaacaugga

SEQ ID NO: 1243152 - RNA, 16 nt, Mycobacterium leprae
agaucacaguccugcc

SEQ ID NO: 1243153 - RNA, 13 nt, Mycobacterium leprae
agauauuaaguuu

SEQ ID NO: 1243154 - RNA, 22 nt, Mycobacterium leprae
agauaggugaagguuucugagu

SEQ ID NO: 1243155 - RNA, 16 nt, Mycobacterium leprae
agauaguauaaggugc

SEQ ID NO: 1243156 - RNA, 19 nt, Mycobacterium leprae
agauagacaugugugcugg

SEQ ID NO: 1243157 - RNA, 22 nt, Mycobacterium leprae
agauagacaugugugcuggcca

SEQ ID NO: 1243158 - RNA, 21 nt, Mycobacterium leprae
agagcugugccgacaccaucc

SEQ ID NO: 1243159 - RNA, 17 nt, Mycobacterium leprae
agagcugugucaaugac

SEQ ID NO: 1243160 - RNA, 14 nt, Mycobacterium leprae
agagcugcaccuga

SEQ ID NO: 1243161 - RNA, 13 nt, Mycobacterium leprae
agagcugcagcua

SEQ ID NO: 1243162 - RNA, 15 nt, Mycobacterium leprae
agagcugcaggucag

SEQ ID NO: 1243163 - RNA, 18 nt, Mycobacterium leprae
agagcaagccgcacaugg

SEQ ID NO: 1243164 - RNA, 15 nt, Mycobacterium leprae
agagcacaugaaaac

SEQ ID NO: 1243165 - RNA, 17 nt, Mycobacterium leprae
agagguccugcagucuu

SEQ ID NO: 1243166 - RNA, 17 nt, Mycobacterium leprae
agaguaucacaacgccg

SEQ ID NO: 1243167 - RNA, 17 nt, Mycobacterium leprae
agagucccucagcggca

SEQ ID NO: 1243168 - RNA, 22 nt, Mycobacterium leprae
agagucgaccgccgaagcagcc

SEQ ID NO: 1243169 - RNA, 21 nt, Mycobacterium leprae
agagucguuucgaggucuugg

SEQ ID NO: 1243170 - RNA, 23 nt, Mycobacterium leprae
agagauuucgcaggcuguugugg

SEQ ID NO: 1243171 - RNA, 18 nt, Mycobacterium leprae
agagagguuuuccacugc

SEQ ID NO: 1243172 - RNA, 18 nt, Mycobacterium leprae
acuucaccaauccagcca

SEQ ID NO: 1243173 - RNA, 18 nt, Mycobacterium leprae
acuuauagucauguuguu

SEQ ID NO: 1243174 - RNA, 16 nt, Mycobacterium leprae
acuuaguuuagagugc

SEQ ID NO: 1243175 - RNA, 19 nt, Mycobacterium leprae
acuuaguuuagagugcagc

SEQ ID NO: 1243176 - RNA, 17 nt, Mycobacterium leprae
acuuccggcuucuccag

SEQ ID NO: 1243177 - RNA, 15 nt, Mycobacterium leprae
acuucccaccguggu

SEQ ID NO: 1243178 - RNA, 18 nt, Mycobacterium leprae
acugucuaccguugacgu

SEQ ID NO: 1243179 - RNA, 16 nt, Mycobacterium leprae
acuggaucacacucug

SEQ ID NO: 1243180 - RNA, 21 nt, Mycobacterium leprae
acugcggcucaccgacugaga

SEQ ID NO: 1243181 - RNA, 14 nt, Mycobacterium leprae
acugcguuucauga

SEQ ID NO: 1243182 - RNA, 20 nt, Mycobacterium leprae
acugcucaaccaggucgguc

SEQ ID NO: 1243183 - RNA, 22 nt, Mycobacterium leprae
acugcugcgcaagguuguuugu

SEQ ID NO: 1243184 - RNA, 16 nt, Mycobacterium leprae
acuggcgaguggagug

SEQ ID NO: 1243185 - RNA, 14 nt, Mycobacterium leprae
acuggcuaaaucgu

SEQ ID NO: 1243186 - RNA, 22 nt, Mycobacterium leprae
acuggcuacgacaggagcuuca

SEQ ID NO: 1243187 - RNA, 21 nt, Mycobacterium leprae
acuggcaugagccgacugaca

SEQ ID NO: 1243188 - RNA, 15 nt, Mycobacterium leprae
acuggcuguagugau

SEQ ID NO: 1243189 - RNA, 22 nt, Mycobacterium leprae
acugggucguuggcaacguggc

SEQ ID NO: 1243190 - RNA, 16 nt, Mycobacterium leprae
acugggcugagccgcc

SEQ ID NO: 1243191 - RNA, 18 nt, Mycobacterium leprae
acugggcugagccgccgu

SEQ ID NO: 1243192 - RNA, 12 nt, Mycobacterium leprae
acuggugguggc

SEQ ID NO: 1243193 - RNA, 17 nt, Mycobacterium leprae
acugggugaccacccac

SEQ ID NO: 1243194 - RNA, 16 nt, Mycobacterium leprae
acugcaggagguagca

SEQ ID NO: 1243195 - RNA, 18 nt, Mycobacterium leprae
acugcagggcgagcugcg

SEQ ID NO: 1243196 - RNA, 17 nt, Mycobacterium leprae
acugcgaagcgcagcga

SEQ ID NO: 1243197 - RNA, 13 nt, Mycobacterium leprae
acugcgaaaaauc

SEQ ID NO: 1243198 - RNA, 16 nt, Mycobacterium leprae
acugagaguacugacc

SEQ ID NO: 1243199 - RNA, 23 nt, Mycobacterium leprae
acugagugaaccuauugucaggu

SEQ ID NO: 1243200 - RNA, 19 nt, Mycobacterium leprae
acugaugugcugagagcag

SEQ ID NO: 1243201 - RNA, 22 nt, Mycobacterium leprae
acugaugugcugagagcagaug

SEQ ID NO: 1243202 - RNA, 20 nt, Mycobacterium leprae
acugcaauccguggagagca

SEQ ID NO: 1243203 - RNA, 22 nt, Mycobacterium leprae
acugcaauccguggagagcaug

SEQ ID NO: 1243204 - RNA, 22 nt, Mycobacterium leprae
acucggaauggcggcagcgcca

SEQ ID NO: 1243205 - RNA, 13 nt, Mycobacterium leprae
acucgaugacacg

SEQ ID NO: 1243206 - RNA, 12 nt, Mycobacterium leprae
acucuagauaac

SEQ ID NO: 1243207 - RNA, 13 nt, Mycobacterium leprae
acucuggcuagcc

SEQ ID NO: 1243208 - RNA, 12 nt, Mycobacterium leprae
acucugaaaaua

SEQ ID NO: 1243209 - RNA, 16 nt, Mycobacterium leprae
acucaaugcuguucgg

SEQ ID NO: 1243210 - RNA, 21 nt, Mycobacterium leprae
acuccgugacgcauuaccugg

SEQ ID NO: 1243211 - RNA, 22 nt, Mycobacterium leprae
acuccuaggaucagaaccgcgg

SEQ ID NO: 1243212 - RNA, 18 nt, Mycobacterium leprae
acucgagcaaugcugagc

SEQ ID NO: 1243213 - RNA, 23 nt, Mycobacterium leprae
acucgaccuugccgaagcucugg

SEQ ID NO: 1243214 - RNA, 23 nt, Mycobacterium leprae
acuacggcgacguuuugucuucu

SEQ ID NO: 1243215 - RNA, 17 nt, Mycobacterium leprae
acuacccgacacaaagc

SEQ ID NO: 1243216 - RNA, 13 nt, Mycobacterium leprae
acuaauuagaggc

SEQ ID NO: 1243217 - RNA, 14 nt, Mycobacterium leprae
acuaaagucaugca

SEQ ID NO: 1243218 - RNA, 13 nt, Mycobacterium leprae
acuaaagucuuca

SEQ ID NO: 1243219 - RNA, 22 nt, Mycobacterium leprae
acguuguccgcguggaugccca

SEQ ID NO: 1243220 - RNA, 16 nt, Mycobacterium leprae
acguuggcuugagugc

SEQ ID NO: 1243221 - RNA, 17 nt, Mycobacterium leprae
acguugugacaguucag

SEQ ID NO: 1243222 - RNA, 19 nt, Mycobacterium leprae
acguugcugggacauccgc

SEQ ID NO: 1243223 - RNA, 17 nt, Mycobacterium leprae
acguuagucuggcuggc

SEQ ID NO: 1243224 - RNA, 17 nt, Mycobacterium leprae
acguuaucuugaugcug

SEQ ID NO: 1243225 - RNA, 14 nt, Mycobacterium leprae
acguuuuguugcua

SEQ ID NO: 1243226 - RNA, 22 nt, Mycobacterium leprae
acgucgggcagcaaccgcacag

SEQ ID NO: 1243227 - RNA, 22 nt, Mycobacterium leprae
acgucggccgaucauggcugga

SEQ ID NO: 1243228 - RNA, 21 nt, Mycobacterium leprae
acgugccggccucgugcugcg

SEQ ID NO: 1243229 - RNA, 23 nt, Mycobacterium leprae
acgucucgcggugauuggcugag

SEQ ID NO: 1243230 - RNA, 12 nt, Mycobacterium leprae
acguaccggauc

SEQ ID NO: 1243231 - RNA, 18 nt, Mycobacterium leprae
acguccgcggcagcugcu

SEQ ID NO: 1243232 - RNA, 21 nt, Mycobacterium leprae
acgucgccgguagcagcggua

SEQ ID NO: 1243233 - RNA, 23 nt, Mycobacterium leprae
acgucgaucagcggccccgcauc

SEQ ID NO: 1243234 - RNA, 19 nt, Mycobacterium leprae
acggugcaggugccaguga

SEQ ID NO: 1243235 - RNA, 17 nt, Mycobacterium leprae
acggucaacggccucac

SEQ ID NO: 1243236 - RNA, 15 nt, Mycobacterium leprae
acggucgcugcuacc

SEQ ID NO: 1243237 - RNA, 18 nt, Mycobacterium leprae
acgguucuuugcacgggg

SEQ ID NO: 1243238 - RNA, 18 nt, Mycobacterium leprae
acgguguugcugaguguu

SEQ ID NO: 1243239 - RNA, 21 nt, Mycobacterium leprae
acgguguauaauuugaagcug

SEQ ID NO: 1243240 - RNA, 20 nt, Mycobacterium leprae
acgguaaguuuucagccaca

SEQ ID NO: 1243241 - RNA, 19 nt, Mycobacterium leprae
acggggucgucggccaggc

SEQ ID NO: 1243242 - RNA, 12 nt, Mycobacterium leprae
acggggugggca

SEQ ID NO: 1243243 - RNA, 19 nt, Mycobacterium leprae
acgggcucacggggcuggg

SEQ ID NO: 1243244 - RNA, 14 nt, Mycobacterium leprae
acgggcggccaggc

SEQ ID NO: 1243245 - RNA, 16 nt, Mycobacterium leprae
acgcaacugcuggagg

SEQ ID NO: 1243246 - RNA, 22 nt, Mycobacterium leprae
acggauuucucgugguggcugg

SEQ ID NO: 1243247 - RNA, 22 nt, Mycobacterium leprae
acggcaacgguuacugccacaa

SEQ ID NO: 1243248 - RNA, 19 nt, Mycobacterium leprae
acggauguggucaacaucg

SEQ ID NO: 1243249 - RNA, 21 nt, Mycobacterium leprae
acggccggaucaucgaugcac

SEQ ID NO: 1243250 - RNA, 11 nt, Mycobacterium leprae
acggccgggca

SEQ ID NO: 1243251 - RNA, 15 nt, Mycobacterium leprae
acggcccagcaccac

SEQ ID NO: 1243252 - RNA, 15 nt, Mycobacterium leprae
aggacaacagagcac

SEQ ID NO: 1243253 - RNA, 20 nt, Mycobacterium leprae
aggaaaagauaaucgcccug

SEQ ID NO: 1243254 - RNA, 14 nt, Mycobacterium leprae
aggaggugcuggau

SEQ ID NO: 1243255 - RNA, 20 nt, Mycobacterium leprae
aggagcggugguacaauccc

SEQ ID NO: 1243256 - RNA, 22 nt, Mycobacterium leprae
aggagcggugguacaaucccac

SEQ ID NO: 1243257 - RNA, 13 nt, Mycobacterium leprae
aggauauggcaga

SEQ ID NO: 1243258 - RNA, 14 nt, Mycobacterium leprae
aggaucagcgcugc

SEQ ID NO: 1243259 - RNA, 19 nt, Mycobacterium leprae
aggauaggcgccguuucuu

SEQ ID NO: 1243260 - RNA, 15 nt, Mycobacterium leprae
aggacucgguuggcu

SEQ ID NO: 1243261 - RNA, 20 nt, Mycobacterium leprae
aggaccaaccgcgcagcaca

SEQ ID NO: 1243262 - RNA, 15 nt, Mycobacterium leprae
aggaccggugcugca

SEQ ID NO: 1243263 - RNA, 18 nt, Mycobacterium leprae
aggacgauuugcgggccc

SEQ ID NO: 1243264 - RNA, 12 nt, Mycobacterium leprae
aggacgcacccu

SEQ ID NO: 1243265 - RNA, 22 nt, Mycobacterium leprae
aggaccgugcuauccgcugaua

SEQ ID NO: 1243266 - RNA, 14 nt, Mycobacterium leprae
aggcaugaaccuca

SEQ ID NO: 1243267 - RNA, 14 nt, Mycobacterium leprae
aggcauuaagaugu

SEQ ID NO: 1243268 - RNA, 17 nt, Mycobacterium leprae
aggcagcccgcgccgcc

SEQ ID NO: 1243269 - RNA, 15 nt, Mycobacterium leprae
aggcagggcugggga

SEQ ID NO: 1243270 - RNA, 16 nt, Mycobacterium leprae
aggcagcgacgugccg

SEQ ID NO: 1243271 - RNA, 20 nt, Mycobacterium leprae
aggcaggacugauggccguc

SEQ ID NO: 1243272 - RNA, 19 nt, Mycobacterium leprae
aggccaccguuggacacca

SEQ ID NO: 1243273 - RNA, 15 nt, Mycobacterium leprae
aggccaggcagcgcc

SEQ ID NO: 1243274 - RNA, 12 nt, Mycobacterium leprae
aggcaccuggaa

SEQ ID NO: 1243275 - RNA, 19 nt, Mycobacterium leprae
aggaucgagcggagcuggg

SEQ ID NO: 1243276 - RNA, 14 nt, Mycobacterium leprae
agcuugugcuccug

SEQ ID NO: 1243277 - RNA, 20 nt, Mycobacterium leprae
agcuugggaaacugggucua

SEQ ID NO: 1243278 - RNA, 23 nt, Mycobacterium leprae
agcuugggaaacugggucuaaua

SEQ ID NO: 1243279 - RNA, 14 nt, Mycobacterium leprae
agcuuagaaagcug

SEQ ID NO: 1243280 - RNA, 18 nt, Mycobacterium leprae
agcuucaaaccggccacc

SEQ ID NO: 1243281 - RNA, 16 nt, Mycobacterium leprae
agcuuccugcgguggu

SEQ ID NO: 1243282 - RNA, 19 nt, Mycobacterium leprae
agcuuccugcggugguggc

SEQ ID NO: 1243283 - RNA, 11 nt, Mycobacterium leprae
agcuucugguc

SEQ ID NO: 1243284 - RNA, 15 nt, Mycobacterium leprae
agcuguugcuuguug

SEQ ID NO: 1243285 - RNA, 16 nt, Mycobacterium leprae
agcuguugugaagcug

SEQ ID NO: 1243286 - RNA, 15 nt, Mycobacterium leprae
agcuguuucuguauu

SEQ ID NO: 1243287 - RNA, 13 nt, Mycobacterium leprae
agcugugucgguc

SEQ ID NO: 1243288 - RNA, 22 nt, Mycobacterium leprae
agcugugggguauugugcggac

SEQ ID NO: 1243289 - RNA, 22 nt, Mycobacterium leprae
agcugugcacgugcaaacugcu

SEQ ID NO: 1243290 - RNA, 19 nt, Mycobacterium leprae
agcuguccaaugucagguc

SEQ ID NO: 1243291 - RNA, 14 nt, Mycobacterium leprae
agcuguauaacaaa

SEQ ID NO: 1243292 - RNA, 20 nt, Mycobacterium leprae
agcuggucuucuuggcgcug

SEQ ID NO: 1243293 - RNA, 13 nt, Mycobacterium leprae
agcuggaaucccc

SEQ ID NO: 1243294 - RNA, 15 nt, Mycobacterium leprae
agcuggaauccccca

SEQ ID NO: 1243295 - RNA, 16 nt, Mycobacterium leprae
agcuggggcggccgcc

SEQ ID NO: 1243296 - RNA, 21 nt, Mycobacterium leprae
agcuggguaccgaugugcugg

SEQ ID NO: 1243297 - RNA, 22 nt, Mycobacterium leprae
agcuggguaccgaugugcugga

SEQ ID NO: 1243298 - RNA, 15 nt, Mycobacterium leprae
agcugaaaugcucua

SEQ ID NO: 1243299 - RNA, 20 nt, Mycobacterium leprae
agcugaaaugcucuaauuuu

SEQ ID NO: 1243300 - RNA, 20 nt, Mycobacterium leprae
agcugccauuggccgcuggu

SEQ ID NO: 1243301 - RNA, 20 nt, Mycobacterium leprae
agcugcaggccaccguugga

SEQ ID NO: 1243302 - RNA, 14 nt, Mycobacterium leprae
agcugcaucggcag

SEQ ID NO: 1243303 - RNA, 16 nt, Mycobacterium leprae
agcugcaucggcaggc

SEQ ID NO: 1243304 - RNA, 21 nt, Mycobacterium leprae
agcucaucggcgacugggaua

SEQ ID NO: 1243305 - RNA, 21 nt, Mycobacterium leprae
agcucuccggcuaucaggauc

SEQ ID NO: 1243306 - RNA, 18 nt, Mycobacterium leprae
agcucagcaacuuuccug

SEQ ID NO: 1243307 - RNA, 21 nt, Mycobacterium leprae
agcucaggauagcgacuguug

SEQ ID NO: 1243308 - RNA, 21 nt, Mycobacterium leprae
agcgcucgcuaucgccacacu

SEQ ID NO: 1243309 - RNA, 11 nt, Mycobacterium leprae
agcgcugaucc

SEQ ID NO: 1243310 - RNA, 15 nt, Mycobacterium leprae
agcgcgauguuggaa

SEQ ID NO: 1243311 - RNA, 21 nt, Mycobacterium leprae
agcggccuaggacgccgcccu

SEQ ID NO: 1243312 - RNA, 21 nt, Mycobacterium leprae
agcggcgcaugccaaccugug

SEQ ID NO: 1243313 - RNA, 13 nt, Mycobacterium leprae
agcggcccaaccc

SEQ ID NO: 1243314 - RNA, 14 nt, Mycobacterium leprae
agcggcggcggcca

SEQ ID NO: 1243315 - RNA, 16 nt, Mycobacterium leprae
agcggcggcggccagc

SEQ ID NO: 1243316 - RNA, 13 nt, Mycobacterium leprae
agcgggcggggcg

SEQ ID NO: 1243317 - RNA, 12 nt, Mycobacterium leprae
agcggucaguuu

SEQ ID NO: 1243318 - RNA, 19 nt, Mycobacterium leprae
agcggugguacaaucccac

SEQ ID NO: 1243319 - RNA, 22 nt, Mycobacterium leprae
agcggugguacaaucccaccac

SEQ ID NO: 1243320 - RNA, 19 nt, Mycobacterium leprae
agcgucugcuggaucgucu

SEQ ID NO: 1243321 - RNA, 22 nt, Mycobacterium leprae
agcguggucaccgcuguggcag

SEQ ID NO: 1243322 - RNA, 22 nt, Mycobacterium leprae
agcguaguagcuuucccugcga

SEQ ID NO: 1243323 - RNA, 18 nt, Mycobacterium leprae
agcucacccgcagcaccu

SEQ ID NO: 1243324 - RNA, 20 nt, Mycobacterium leprae
agcucacaauugacaacacg

SEQ ID NO: 1243325 - RNA, 18 nt, Mycobacterium leprae
agcucaauuggcagagca

SEQ ID NO: 1243326 - RNA, 13 nt, Mycobacterium leprae
agcuaaucccaug

SEQ ID NO: 1243327 - RNA, 16 nt, Mycobacterium leprae
agcuaaucccauggga

SEQ ID NO: 1243328 - RNA, 19 nt, Mycobacterium leprae
agggagaaugccacaggcg

SEQ ID NO: 1243329 - RNA, 15 nt, Mycobacterium leprae
agggauuccuguucu

SEQ ID NO: 1243330 - RNA, 21 nt, Mycobacterium leprae
agggauccaagacaggcgcgg

SEQ ID NO: 1243331 - RNA, 22 nt, Mycobacterium leprae
aggcuguuguuaccggcgaaga

SEQ ID NO: 1243332 - RNA, 17 nt, Mycobacterium leprae
aggcugcauccugcagc

SEQ ID NO: 1243333 - RNA, 15 nt, Mycobacterium leprae
aggcugggcaccacc

SEQ ID NO: 1243334 - RNA, 18 nt, Mycobacterium leprae
aggggagucgggcuuggc

SEQ ID NO: 1243335 - RNA, 15 nt, Mycobacterium leprae
agggcggggaaguca

SEQ ID NO: 1243336 - RNA, 16 nt, Mycobacterium leprae
agggcguugucuugug

SEQ ID NO: 1243337 - RNA, 18 nt, Mycobacterium leprae
agggguucgccgccggcg

SEQ ID NO: 1243338 - RNA, 17 nt, Mycobacterium leprae
aggggucgaugaggcuc

SEQ ID NO: 1243339 - RNA, 19 nt, Mycobacterium leprae
aggguacgagugguugagu

SEQ ID NO: 1243340 - RNA, 23 nt, Mycobacterium leprae
aggguacgccagguagugaguac

SEQ ID NO: 1243341 - RNA, 21 nt, Mycobacterium leprae
aggggguuaccugggccaggg

SEQ ID NO: 1243342 - RNA, 17 nt, Mycobacterium leprae
aggggcugggcaccugg

SEQ ID NO: 1243343 - RNA, 23 nt, Mycobacterium leprae
agggccggucaacaagccgccga

SEQ ID NO: 1243344 - RNA, 19 nt, Mycobacterium leprae
agggcacgugcggcggccu

SEQ ID NO: 1243345 - RNA, 15 nt, Mycobacterium leprae
agggcaauacgcugc

SEQ ID NO: 1243346 - RNA, 14 nt, Mycobacterium leprae
aggcgaagagcggc

SEQ ID NO: 1243347 - RNA, 16 nt, Mycobacterium leprae
aggcgaagagcggcac

SEQ ID NO: 1243348 - RNA, 13 nt, Mycobacterium leprae
aggcgaauugcua

SEQ ID NO: 1243349 - RNA, 15 nt, Mycobacterium leprae
aggccuuaagcugca

SEQ ID NO: 1243350 - RNA, 16 nt, Mycobacterium leprae
aggccuuaagcugcau

SEQ ID NO: 1243351 - RNA, 17 nt, Mycobacterium leprae
aggccuugggugguggu

SEQ ID NO: 1243352 - RNA, 16 nt, Mycobacterium leprae
aggccugguucuggau

SEQ ID NO: 1243353 - RNA, 23 nt, Mycobacterium leprae
aggcgauaucgaugcaggcguga

SEQ ID NO: 1243354 - RNA, 21 nt, Mycobacterium leprae
aggccggugcuuaccgagauu

SEQ ID NO: 1243355 - RNA, 15 nt, Mycobacterium leprae
aggccuagcuggcag

SEQ ID NO: 1243356 - RNA, 22 nt, Mycobacterium leprae
aggccggcagggugcgugacaa

SEQ ID NO: 1243357 - RNA, 13 nt, Mycobacterium leprae
aggccggccugga

SEQ ID NO: 1243358 - RNA, 22 nt, Mycobacterium leprae
aggccgacuucggcaacggcgu

SEQ ID NO: 1243359 - RNA, 14 nt, Mycobacterium leprae
aggccgagugcagg

SEQ ID NO: 1243360 - RNA, 22 nt, Mycobacterium leprae
aggccgauuccggagacggcag

SEQ ID NO: 1243361 - RNA, 20 nt, Mycobacterium leprae
aggcgccugaaguugaguag

SEQ ID NO: 1243362 - RNA, 13 nt, Mycobacterium leprae
aggcggugaucaa

SEQ ID NO: 1243363 - RNA, 22 nt, Mycobacterium leprae
aggcgguugcguaauggccggc

SEQ ID NO: 1243364 - RNA, 21 nt, Mycobacterium leprae
aggcggccacgugcacaucag

SEQ ID NO: 1243365 - RNA, 20 nt, Mycobacterium leprae
aggcucacccaccgugcauc

SEQ ID NO: 1243366 - RNA, 18 nt, Mycobacterium leprae
aguaaugcaggugaccgg

SEQ ID NO: 1243367 - RNA, 19 nt, Mycobacterium leprae
aguaaucgcauuuaccgag

SEQ ID NO: 1243368 - RNA, 14 nt, Mycobacterium leprae
aguacaaugucuuc

SEQ ID NO: 1243369 - RNA, 15 nt, Mycobacterium leprae
aguacagaccgaagc

SEQ ID NO: 1243370 - RNA, 22 nt, Mycobacterium leprae
agguugacaaucgacucaccac

SEQ ID NO: 1243371 - RNA, 23 nt, Mycobacterium leprae
agguuggcuuuaagcaaucccac

SEQ ID NO: 1243372 - RNA, 21 nt, Mycobacterium leprae
agguugccguaugugccgccg

SEQ ID NO: 1243373 - RNA, 22 nt, Mycobacterium leprae
agguugccguaugugccgccga

SEQ ID NO: 1243374 - RNA, 15 nt, Mycobacterium leprae
aggugugcugcagca

SEQ ID NO: 1243375 - RNA, 14 nt, Mycobacterium leprae
agguguugcgguga

SEQ ID NO: 1243376 - RNA, 18 nt, Mycobacterium leprae
aggugucggcguggucaa

SEQ ID NO: 1243377 - RNA, 22 nt, Mycobacterium leprae
aggugucggcguggucaaugug

SEQ ID NO: 1243378 - RNA, 16 nt, Mycobacterium leprae
agguuucugagucgga

SEQ ID NO: 1243379 - RNA, 21 nt, Mycobacterium leprae
agguuguuuguucagugccgu

SEQ ID NO: 1243380 - RNA, 23 nt, Mycobacterium leprae
aguaaaggguggugggucagugu

SEQ ID NO: 1243381 - RNA, 15 nt, Mycobacterium leprae
agguaagcuugcagu

SEQ ID NO: 1243382 - RNA, 11 nt, Mycobacterium leprae
agggugguggg

SEQ ID NO: 1243383 - RNA, 16 nt, Mycobacterium leprae
aggguguugugggugu

SEQ ID NO: 1243384 - RNA, 23 nt, Mycobacterium leprae
aggguggcgguguguugcagugu

SEQ ID NO: 1243385 - RNA, 19 nt, Mycobacterium leprae
agggugauagauggagcca

SEQ ID NO: 1243386 - RNA, 14 nt, Mycobacterium leprae
aggucaacguuugu

SEQ ID NO: 1243387 - RNA, 18 nt, Mycobacterium leprae
agguaaugcugccugcgu

SEQ ID NO: 1243388 - RNA, 16 nt, Mycobacterium leprae
agguagugaguacacc

SEQ ID NO: 1243389 - RNA, 20 nt, Mycobacterium leprae
agguagcuacguggucugaa

SEQ ID NO: 1243390 - RNA, 21 nt, Mycobacterium leprae
agguacuagcacgcugucuua

SEQ ID NO: 1243391 - RNA, 18 nt, Mycobacterium leprae
aggucuuuuagguguggu

SEQ ID NO: 1243392 - RNA, 15 nt, Mycobacterium leprae
aggucuccuggucuc

SEQ ID NO: 1243393 - RNA, 18 nt, Mycobacterium leprae
aggucucacacccgcaca

SEQ ID NO: 1243394 - RNA, 14 nt, Mycobacterium leprae
aggucugaccuauc

SEQ ID NO: 1243395 - RNA, 22 nt, Mycobacterium leprae
aggucagcggucacauuguaac

SEQ ID NO: 1243396 - RNA, 18 nt, Mycobacterium leprae
aggucaguacgcuagagu

SEQ ID NO: 1243397 - RNA, 17 nt, Mycobacterium leprae
aggucaugccagggcau

SEQ ID NO: 1243398 - RNA, 22 nt, Mycobacterium leprae
aggucgccgaaagacauugucc

SEQ ID NO: 1243399 - RNA, 14 nt, Mycobacterium leprae
aggucgcaaagguc

SEQ ID NO: 1243400 - RNA, 20 nt, Mycobacterium leprae
aggucgaaacuaagccgagu

SEQ ID NO: 1243401 - RNA, 15 nt, Mycobacterium leprae
aggugaugauggcau

SEQ ID NO: 1243402 - RNA, 18 nt, Mycobacterium leprae
aggugagcguugugggca

SEQ ID NO: 1243403 - RNA, 20 nt, Mycobacterium leprae
aggugaauaguuaccggugu

SEQ ID NO: 1243404 - RNA, 18 nt, Mycobacterium leprae
aggugcuggaugccggga

SEQ ID NO: 1243405 - RNA, 18 nt, Mycobacterium leprae
aggugcguugugcgguga

SEQ ID NO: 1243406 - RNA, 15 nt, Mycobacterium leprae
agguggcauugucca

SEQ ID NO: 1243407 - RNA, 20 nt, Mycobacterium leprae
agguggcggcgacacggcug

SEQ ID NO: 1243408 - RNA, 19 nt, Mycobacterium leprae
aucagacacggaagcccuc

SEQ ID NO: 1243409 - RNA, 13 nt, Mycobacterium leprae
aucacuugguguc

SEQ ID NO: 1243410 - RNA, 15 nt, Mycobacterium leprae
aucagcaucgacagc

SEQ ID NO: 1243411 - RNA, 19 nt, Mycobacterium leprae
aucacugagugaaccuauu

SEQ ID NO: 1243412 - RNA, 15 nt, Mycobacterium leprae
aucacugaucccaga

SEQ ID NO: 1243413 - RNA, 15 nt, Mycobacterium leprae
aucacgcccagcgca

SEQ ID NO: 1243414 - RNA, 21 nt, Mycobacterium leprae
aucaccggacagcggcccaac

SEQ ID NO: 1243415 - RNA, 17 nt, Mycobacterium leprae
aucaccguggccggccc

SEQ ID NO: 1243416 - RNA, 15 nt, Mycobacterium leprae
aucaccacuuuggca

SEQ ID NO: 1243417 - RNA, 23 nt, Mycobacterium leprae
aucaauucgcuguauugaucaac

SEQ ID NO: 1243418 - RNA, 13 nt, Mycobacterium leprae
aucaacgccagca

SEQ ID NO: 1243419 - RNA, 15 nt, Mycobacterium leprae
aucaaccaggcaacc

SEQ ID NO: 1243420 - RNA, 23 nt, Mycobacterium leprae
aucaacauguagaccaagcagca

SEQ ID NO: 1243421 - RNA, 19 nt, Mycobacterium leprae
auauuuucaagacugcacc

SEQ ID NO: 1243422 - RNA, 17 nt, Mycobacterium leprae
auauugcgacauccaaa

SEQ ID NO: 1243423 - RNA, 18 nt, Mycobacterium leprae
auagguguagcagcugca

SEQ ID NO: 1243424 - RNA, 11 nt, Mycobacterium leprae
auagguggcau

SEQ ID NO: 1243425 - RNA, 15 nt, Mycobacterium leprae
auauaacggcuucau

SEQ ID NO: 1243426 - RNA, 15 nt, Mycobacterium leprae
auaguggcugauguc

SEQ ID NO: 1243427 - RNA, 16 nt, Mycobacterium leprae
auaguggcugaugucu

SEQ ID NO: 1243428 - RNA, 17 nt, Mycobacterium leprae
auaguuguuagcgccgc

SEQ ID NO: 1243429 - RNA, 17 nt, Mycobacterium leprae
auaguguguuugguuuu

SEQ ID NO: 1243430 - RNA, 23 nt, Mycobacterium leprae
auaucaacggcugcgugucgacc

SEQ ID NO: 1243431 - RNA, 20 nt, Mycobacterium leprae
auauauguuccuauguuggu

SEQ ID NO: 1243432 - RNA, 15 nt, Mycobacterium leprae
auauagacuaugaag

SEQ ID NO: 1243433 - RNA, 14 nt, Mycobacterium leprae
auauauuccagguc

SEQ ID NO: 1243434 - RNA, 18 nt, Mycobacterium leprae
auaucuuuuuagagaaga

SEQ ID NO: 1243435 - RNA, 15 nt, Mycobacterium leprae
auaucgaugcaggcg

SEQ ID NO: 1243436 - RNA, 22 nt, Mycobacterium leprae
auaucuaauugggaucgacacc

SEQ ID NO: 1243437 - RNA, 13 nt, Mycobacterium leprae
auauccaccauac

SEQ ID NO: 1243438 - RNA, 13 nt, Mycobacterium leprae
auagcuugcaguu

SEQ ID NO: 1243439 - RNA, 14 nt, Mycobacterium leprae
auagcugugcagga

SEQ ID NO: 1243440 - RNA, 16 nt, Mycobacterium leprae
auagcuaaagugcugc

SEQ ID NO: 1243441 - RNA, 15 nt, Mycobacterium leprae
auagauggagccacc

SEQ ID NO: 1243442 - RNA, 22 nt, Mycobacterium leprae
auacguguuuguuauaguccgc

SEQ ID NO: 1243443 - RNA, 17 nt, Mycobacterium leprae
auacugaugugcugaga

SEQ ID NO: 1243444 - RNA, 21 nt, Mycobacterium leprae
auacugaugugcugagagcag

SEQ ID NO: 1243445 - RNA, 17 nt, Mycobacterium leprae
auacgccagucagucac

SEQ ID NO: 1243446 - RNA, 14 nt, Mycobacterium leprae
aguuuccgccucag

SEQ ID NO: 1243447 - RNA, 14 nt, Mycobacterium leprae
aguuuucucuaaaa

SEQ ID NO: 1243448 - RNA, 14 nt, Mycobacterium leprae
aguuguugcacaag

SEQ ID NO: 1243449 - RNA, 23 nt, Mycobacterium leprae
agugugcugcauccgacaaagca

SEQ ID NO: 1243450 - RNA, 14 nt, Mycobacterium leprae
aguguuccgggcug

SEQ ID NO: 1243451 - RNA, 22 nt, Mycobacterium leprae
aguguucgcauuccggcccucg

SEQ ID NO: 1243452 - RNA, 12 nt, Mycobacterium leprae
aguguucggaac

SEQ ID NO: 1243453 - RNA, 20 nt, Mycobacterium leprae
aguguucggcacccauccaa

SEQ ID NO: 1243454 - RNA, 17 nt, Mycobacterium leprae
aguguucaggccaucag

SEQ ID NO: 1243455 - RNA, 23 nt, Mycobacterium leprae
aguguuggcuuucaguuuccgcc

SEQ ID NO: 1243456 - RNA, 19 nt, Mycobacterium leprae
aguuagcaugagcugcugg

SEQ ID NO: 1243457 - RNA, 12 nt, Mycobacterium leprae
aguuccuucaga

SEQ ID NO: 1243458 - RNA, 17 nt, Mycobacterium leprae
aguuccuguguugccau

SEQ ID NO: 1243459 - RNA, 18 nt, Mycobacterium leprae
aguuccuguguugccauc

SEQ ID NO: 1243460 - RNA, 23 nt, Mycobacterium leprae
aguucgggugcguaaucgccggu

SEQ ID NO: 1243461 - RNA, 18 nt, Mycobacterium leprae
aguucguuccuggcuggc

SEQ ID NO: 1243462 - RNA, 15 nt, Mycobacterium leprae
aguucaacaaaacca

SEQ ID NO: 1243463 - RNA, 16 nt, Mycobacterium leprae
aguucaacaaaaccau

SEQ ID NO: 1243464 - RNA, 16 nt, Mycobacterium leprae
agugguucgauucugc

SEQ ID NO: 1243465 - RNA, 18 nt, Mycobacterium leprae
aguggucacacugguggu

SEQ ID NO: 1243466 - RNA, 17 nt, Mycobacterium leprae
agugguaauauccuccg

SEQ ID NO: 1243467 - RNA, 19 nt, Mycobacterium leprae
agugggugaaacccuucac

SEQ ID NO: 1243468 - RNA, 21 nt, Mycobacterium leprae
agugggggugcggcagcugcc

SEQ ID NO: 1243469 - RNA, 13 nt, Mycobacterium leprae
aguggcuuuaaag

SEQ ID NO: 1243470 - RNA, 17 nt, Mycobacterium leprae
agugucugggccgggcu

SEQ ID NO: 1243471 - RNA, 14 nt, Mycobacterium leprae
agugucccuguccu

SEQ ID NO: 1243472 - RNA, 13 nt, Mycobacterium leprae
agugucagcagca

SEQ ID NO: 1243473 - RNA, 15 nt, Mycobacterium leprae
agugucaaucuacac

SEQ ID NO: 1243474 - RNA, 13 nt, Mycobacterium leprae
agugcgaccugaa

SEQ ID NO: 1243475 - RNA, 22 nt, Mycobacterium leprae
agugcugacgccgggcacuugg

SEQ ID NO: 1243476 - RNA, 18 nt, Mycobacterium leprae
aguggaucuccuaagagg

SEQ ID NO: 1243477 - RNA, 21 nt, Mycobacterium leprae
agugcaguuccuucagacgcc

SEQ ID NO: 1243478 - RNA, 12 nt, Mycobacterium leprae
agugcagagagu

SEQ ID NO: 1243479 - RNA, 14 nt, Mycobacterium leprae
aguaccggcucaca

SEQ ID NO: 1243480 - RNA, 22 nt, Mycobacterium leprae
aguaccgaaaacacgggcacca

SEQ ID NO: 1243481 - RNA, 20 nt, Mycobacterium leprae
agucgaccgccgaagcagcc

SEQ ID NO: 1243482 - RNA, 15 nt, Mycobacterium leprae
aguccuuuccagcca

SEQ ID NO: 1243483 - RNA, 20 nt, Mycobacterium leprae
agucgcgggcuugcuccgag

SEQ ID NO: 1243484 - RNA, 17 nt, Mycobacterium leprae
agucuucggaucugguu

SEQ ID NO: 1243485 - RNA, 17 nt, Mycobacterium leprae
agucuugaugccaaccu

SEQ ID NO: 1243486 - RNA, 15 nt, Mycobacterium leprae
agugaccaaaauuua

SEQ ID NO: 1243487 - RNA, 16 nt, Mycobacterium leprae
auaaauuauaaaguua

SEQ ID NO: 1243488 - RNA, 14 nt, Mycobacterium leprae
auaaagcuuagaaa

SEQ ID NO: 1243489 - RNA, 17 nt, Mycobacterium leprae
auaaagcuuagaaagcu

SEQ ID NO: 1243490 - RNA, 13 nt, Mycobacterium leprae
auaagcagcagcg

SEQ ID NO: 1243491 - RNA, 16 nt, Mycobacterium leprae
auaagaaguuguagcu

SEQ ID NO: 1243492 - RNA, 13 nt, Mycobacterium leprae
auaauauccaaag

SEQ ID NO: 1243493 - RNA, 18 nt, Mycobacterium leprae
auaaugccgguggccagc

SEQ ID NO: 1243494 - RNA, 17 nt, Mycobacterium leprae
aucgcauucgugagccu

SEQ ID NO: 1243495 - RNA, 19 nt, Mycobacterium leprae
aucgcaggcaccacaaaca

SEQ ID NO: 1243496 - RNA, 13 nt, Mycobacterium leprae
aucgcccaccgca

SEQ ID NO: 1243497 - RNA, 14 nt, Mycobacterium leprae
aucgcccaggugcu

SEQ ID NO: 1243498 - RNA, 16 nt, Mycobacterium leprae
aucgauaagcagcagc

SEQ ID NO: 1243499 - RNA, 18 nt, Mycobacterium leprae
aucgaguccaagcucaac

SEQ ID NO: 1243500 - RNA, 18 nt, Mycobacterium leprae
aucgaaaggcguuaucgg

SEQ ID NO: 1243501 - RNA, 22 nt, Mycobacterium leprae
aucuacacuagggaggucacca

SEQ ID NO: 1243502 - RNA, 20 nt, Mycobacterium leprae
aucguuaaaaugcuggagcg

SEQ ID NO: 1243503 - RNA, 23 nt, Mycobacterium leprae
aucguccucaugcccaugccagc

SEQ ID NO: 1243504 - RNA, 18 nt, Mycobacterium leprae
aucgguggauuaggcgug

SEQ ID NO: 1243505 - RNA, 19 nt, Mycobacterium leprae
aucgcguugacagccgucc

SEQ ID NO: 1243506 - RNA, 15 nt, Mycobacterium leprae
aucgggcccagcacc

SEQ ID NO: 1243507 - RNA, 23 nt, Mycobacterium leprae
aucggggcgauguuauguagcug

SEQ ID NO: 1243508 - RNA, 15 nt, Mycobacterium leprae
aucggguugacgcug

SEQ ID NO: 1243509 - RNA, 11 nt, Mycobacterium leprae
aucggccucac

SEQ ID NO: 1243510 - RNA, 15 nt, Mycobacterium leprae
aucugccgugcagcg

SEQ ID NO: 1243511 - RNA, 16 nt, Mycobacterium leprae
aucugauucagauuac

SEQ ID NO: 1243512 - RNA, 11 nt, Mycobacterium leprae
aucugcacaac

SEQ ID NO: 1243513 - RNA, 17 nt, Mycobacterium leprae
aucucuuccgagccgac

SEQ ID NO: 1243514 - RNA, 13 nt, Mycobacterium leprae
aucucugugcgaa

SEQ ID NO: 1243515 - RNA, 20 nt, Mycobacterium leprae
aucucuaugucacuucccac

SEQ ID NO: 1243516 - RNA, 20 nt, Mycobacterium leprae
aucucgcuugguugcgggua

SEQ ID NO: 1243517 - RNA, 13 nt, Mycobacterium leprae
aucuaugguuuug

SEQ ID NO: 1243518 - RNA, 17 nt, Mycobacterium leprae
aucuaucaagccacacg

SEQ ID NO: 1243519 - RNA, 16 nt, Mycobacterium leprae
aucuauaguugaucau

SEQ ID NO: 1243520 - RNA, 20 nt, Mycobacterium leprae
aucuagccggggaaaggcau

SEQ ID NO: 1243521 - RNA, 22 nt, Mycobacterium leprae
aucuaguggucgauuacucacg

SEQ ID NO: 1243522 - RNA, 21 nt, Mycobacterium leprae
aucuacccuuuuugucacuga

SEQ ID NO: 1243523 - RNA, 13 nt, Mycobacterium leprae
aucuacuggaugc

SEQ ID NO: 1243524 - RNA, 15 nt, Mycobacterium leprae
aucuccccagguuga

SEQ ID NO: 1243525 - RNA, 14 nt, Mycobacterium leprae
aucuccgacuggcu

SEQ ID NO: 1243526 - RNA, 21 nt, Mycobacterium leprae
aucucgaugucggacaaugag

SEQ ID NO: 1243527 - RNA, 17 nt, Mycobacterium leprae
augccaucagaagacca

SEQ ID NO: 1243528 - RNA, 18 nt, Mycobacterium leprae
augccaguuuuggugucu

SEQ ID NO: 1243529 - RNA, 19 nt, Mycobacterium leprae
augccaguuuuggugucuu

SEQ ID NO: 1243530 - RNA, 24 nt, Mycobacterium leprae
augcccgaaaaguucggccauggc

SEQ ID NO: 1243531 - RNA, 20 nt, Mycobacterium leprae
augcccaggggguaguucuu

SEQ ID NO: 1243532 - RNA, 14 nt, Mycobacterium leprae
augcccagccagga

SEQ ID NO: 1243533 - RNA, 17 nt, Mycobacterium leprae
augcccagcagauggcc

SEQ ID NO: 1243534 - RNA, 19 nt, Mycobacterium leprae
augccgagguggcagcugg

SEQ ID NO: 1243535 - RNA, 10 nt, Mycobacterium leprae
augccgccga

SEQ ID NO: 1243536 - RNA, 18 nt, Mycobacterium leprae
augccuugaccuucucga

SEQ ID NO: 1243537 - RNA, 10 nt, Mycobacterium leprae
augccgccgg

SEQ ID NO: 1243538 - RNA, 22 nt, Mycobacterium leprae
augccgcgcacccgagcggcac

SEQ ID NO: 1243539 - RNA, 15 nt, Mycobacterium leprae
augccgguggccagc

SEQ ID NO: 1243540 - RNA, 18 nt, Mycobacterium leprae
augccgguggccagcgca

SEQ ID NO: 1243541 - RNA, 17 nt, Mycobacterium leprae
augccgggcugcaccga

SEQ ID NO: 1243542 - RNA, 13 nt, Mycobacterium leprae
augccguggugau

SEQ ID NO: 1243543 - RNA, 16 nt, Mycobacterium leprae
augcagggccagcccg

SEQ ID NO: 1243544 - RNA, 19 nt, Mycobacterium leprae
augcagguggucugcauuc

SEQ ID NO: 1243545 - RNA, 18 nt, Mycobacterium leprae
augcagcuggugguccug

SEQ ID NO: 1243546 - RNA, 22 nt, Mycobacterium leprae
augccaggggcugggcaccugg

SEQ ID NO: 1243547 - RNA, 17 nt, Mycobacterium leprae
augccagccaacggcua

SEQ ID NO: 1243548 - RNA, 22 nt, Mycobacterium leprae
augccagccaacggcuagccag

SEQ ID NO: 1243549 - RNA, 13 nt, Mycobacterium leprae
augcaguggguga

SEQ ID NO: 1243550 - RNA, 12 nt, Mycobacterium leprae
augccaaccugu

SEQ ID NO: 1243551 - RNA, 19 nt, Mycobacterium leprae
augcaacuaugcggcggga

SEQ ID NO: 1243552 - RNA, 19 nt, Mycobacterium leprae
augauuuauguguaagaua

SEQ ID NO: 1243553 - RNA, 22 nt, Mycobacterium leprae
augaugguuuggcugccagaau

SEQ ID NO: 1243554 - RNA, 17 nt, Mycobacterium leprae
augacaugcacacuaaa

SEQ ID NO: 1243555 - RNA, 23 nt, Mycobacterium leprae
augaauucuugauccgagaaaac

SEQ ID NO: 1243556 - RNA, 18 nt, Mycobacterium leprae
augagacgaaugcugacc

SEQ ID NO: 1243557 - RNA, 22 nt, Mycobacterium leprae
augacgacuugacacaaagaag

SEQ ID NO: 1243558 - RNA, 15 nt, Mycobacterium leprae
augaccagggaagug

SEQ ID NO: 1243559 - RNA, 22 nt, Mycobacterium leprae
augacuuauagucauguuguug

SEQ ID NO: 1243560 - RNA, 19 nt, Mycobacterium leprae
augaacugacuucagucag

SEQ ID NO: 1243561 - RNA, 13 nt, Mycobacterium leprae
aucuuuugaccag

SEQ ID NO: 1243562 - RNA, 17 nt, Mycobacterium leprae
aucuuuugaccagcacu

SEQ ID NO: 1243563 - RNA, 20 nt, Mycobacterium leprae
aucugcgugccgagccugga

SEQ ID NO: 1243564 - RNA, 14 nt, Mycobacterium leprae
auguggcuuuggga

SEQ ID NO: 1243565 - RNA, 14 nt, Mycobacterium leprae
augugggucuguua

SEQ ID NO: 1243566 - RNA, 16 nt, Mycobacterium leprae
augugcagugcgguga

SEQ ID NO: 1243567 - RNA, 16 nt, Mycobacterium leprae
auguuaaacaguuaaa

SEQ ID NO: 1243568 - RNA, 19 nt, Mycobacterium leprae
augucuucgucgacuauau

SEQ ID NO: 1243569 - RNA, 14 nt, Mycobacterium leprae
augucgaucggcag

SEQ ID NO: 1243570 - RNA, 17 nt, Mycobacterium leprae
augucccggugcugccu

SEQ ID NO: 1243571 - RNA, 16 nt, Mycobacterium leprae
augugaacuucuggau

SEQ ID NO: 1243572 - RNA, 13 nt, Mycobacterium leprae
auguccgcccuga

SEQ ID NO: 1243573 - RNA, 18 nt, Mycobacterium leprae
augucauggccuugaggu

SEQ ID NO: 1243574 - RNA, 15 nt, Mycobacterium leprae
auguauuacugacuu

SEQ ID NO: 1243575 - RNA, 16 nt, Mycobacterium leprae
augguuuggcugccag

SEQ ID NO: 1243576 - RNA, 16 nt, Mycobacterium leprae
auggcacggcgacaag

SEQ ID NO: 1243577 - RNA, 20 nt, Mycobacterium leprae
auggcacuacccgacacaaa

SEQ ID NO: 1243578 - RNA, 16 nt, Mycobacterium leprae
auggcuaagcuaggcg

SEQ ID NO: 1243579 - RNA, 23 nt, Mycobacterium leprae
augguaagaauaccggugauguc

SEQ ID NO: 1243580 - RNA, 20 nt, Mycobacterium leprae
augguagugcacacggccgu

SEQ ID NO: 1243581 - RNA, 15 nt, Mycobacterium leprae
augguccuggcugcg

SEQ ID NO: 1243582 - RNA, 16 nt, Mycobacterium leprae
augguguaaggccagg

SEQ ID NO: 1243583 - RNA, 13 nt, Mycobacterium leprae
auuaauauauaua

SEQ ID NO: 1243584 - RNA, 21 nt, Mycobacterium leprae
auguuucggaugaauuuuucg

SEQ ID NO: 1243585 - RNA, 17 nt, Mycobacterium leprae
auguuuggcuguuggga

SEQ ID NO: 1243586 - RNA, 19 nt, Mycobacterium leprae
auguuauuuauagaugcca

SEQ ID NO: 1243587 - RNA, 21 nt, Mycobacterium leprae
auguuguuagcucugcugcau

SEQ ID NO: 1243588 - RNA, 20 nt, Mycobacterium leprae
auguuguugguaugagcauu

SEQ ID NO: 1243589 - RNA, 14 nt, Mycobacterium leprae
auguuggccagcag

SEQ ID NO: 1243590 - RNA, 22 nt, Mycobacterium leprae
auuacuacgcuagcaagucgcu

SEQ ID NO: 1243591 - RNA, 23 nt, Mycobacterium leprae
auuaccgggcucaccgagacggg

SEQ ID NO: 1243592 - RNA, 13 nt, Mycobacterium leprae
auuaguguggagu

SEQ ID NO: 1243593 - RNA, 16 nt, Mycobacterium leprae
auuagucuagauaaga

SEQ ID NO: 1243594 - RNA, 14 nt, Mycobacterium leprae
auuagcucuucucg

SEQ ID NO: 1243595 - RNA, 15 nt, Mycobacterium leprae
auuacugacuuggcc

SEQ ID NO: 1243596 - RNA, 23 nt, Mycobacterium leprae
auuaucguuaccggaauuuuuga

SEQ ID NO: 1243597 - RNA, 20 nt, Mycobacterium leprae
auuauuaccgauaaucaaag

SEQ ID NO: 1243598 - RNA, 14 nt, Mycobacterium leprae
auucaaccagccaa

SEQ ID NO: 1243599 - RNA, 15 nt, Mycobacterium leprae
auucacgaacaacag

SEQ ID NO: 1243600 - RNA, 18 nt, Mycobacterium leprae
auuuauuugucgcuggau

SEQ ID NO: 1243601 - RNA, 18 nt, Mycobacterium leprae
auuguucugccaugccag

SEQ ID NO: 1243602 - RNA, 22 nt, Mycobacterium leprae
auuguccgagcuuuuccagcgg

SEQ ID NO: 1243603 - RNA, 20 nt, Mycobacterium leprae
auugucgugggucagucgga

SEQ ID NO: 1243604 - RNA, 23 nt, Mycobacterium leprae
auugguugccgagcuguuccucu

SEQ ID NO: 1243605 - RNA, 14 nt, Mycobacterium leprae
auugcuccgcagca

SEQ ID NO: 1243606 - RNA, 16 nt, Mycobacterium leprae
auugcuucgaggcauu

SEQ ID NO: 1243607 - RNA, 22 nt, Mycobacterium leprae
auuggauguaaucguaccaaca

SEQ ID NO: 1243608 - RNA, 13 nt, Mycobacterium leprae
auuggcugaucaa

SEQ ID NO: 1243609 - RNA, 14 nt, Mycobacterium leprae
auuggcugaucaaa

SEQ ID NO: 1243610 - RNA, 14 nt, Mycobacterium leprae
auugccugaugcca

SEQ ID NO: 1243611 - RNA, 16 nt, Mycobacterium leprae
auugccugaugccauc

SEQ ID NO: 1243612 - RNA, 20 nt, Mycobacterium leprae
auugaaaauuucgucuaguu

SEQ ID NO: 1243613 - RNA, 14 nt, Mycobacterium leprae
auugacgugguggu

SEQ ID NO: 1243614 - RNA, 17 nt, Mycobacterium leprae
auugaauccgcugcccu

SEQ ID NO: 1243615 - RNA, 19 nt, Mycobacterium leprae
auucucgagcggcgcaugc

SEQ ID NO: 1243616 - RNA, 20 nt, Mycobacterium leprae
auucuagguucgaguccugg

SEQ ID NO: 1243617 - RNA, 14 nt, Mycobacterium leprae
auucaggaugcugu

SEQ ID NO: 1243618 - RNA, 15 nt, Mycobacterium leprae
auucaggaaaauacu

SEQ ID NO: 1243619 - RNA, 21 nt, Mycobacterium leprae
auuuucucggcagcaguuuuc

SEQ ID NO: 1243620 - RNA, 19 nt, Mycobacterium leprae
auuuucucggugucaucua

SEQ ID NO: 1243621 - RNA, 13 nt, Mycobacterium leprae
auuuggcugauaa

SEQ ID NO: 1243622 - RNA, 17 nt, Mycobacterium leprae
auuugguacacuaagcc

SEQ ID NO: 1243623 - RNA, 22 nt, Mycobacterium leprae
auuugcggcuuguggcuaccau

SEQ ID NO: 1243624 - RNA, 14 nt, Mycobacterium leprae
auuugcgaucaacu

SEQ ID NO: 1243625 - RNA, 22 nt, Mycobacterium leprae
auuugcucagugacguguuggu

SEQ ID NO: 1243626 - RNA, 15 nt, Mycobacterium leprae
auuucucgugguggc

SEQ ID NO: 1243627 - RNA, 18 nt, Mycobacterium leprae
auuucucgugguggcugg

SEQ ID NO: 1243628 - RNA, 22 nt, Mycobacterium leprae
auuucucgugguggcuggcuac

SEQ ID NO: 1243629 - RNA, 16 nt, Mycobacterium leprae
auuuuuggcauacucu

SEQ ID NO: 1243630 - RNA, 23 nt, Mycobacterium leprae
auuuuuguucuguccgcacaaac

SEQ ID NO: 1243631 - RNA, 23 nt, Mycobacterium leprae
auuuuucuugaaaaauaaggaua

SEQ ID NO: 1243632 - RNA, 12 nt, Mycobacterium leprae
caaaaaaaggga

SEQ ID NO: 1243633 - RNA, 16 nt, Mycobacterium leprae
caaaacuuacuucugu

SEQ ID NO: 1243634 - RNA, 20 nt, Mycobacterium leprae
caaaacgucgaucuggggaa

SEQ ID NO: 1243635 - RNA, 16 nt, Mycobacterium leprae
caaggucguguugcca

SEQ ID NO: 1243636 - RNA, 18 nt, Mycobacterium leprae
caaggucggugggcaauu

SEQ ID NO: 1243637 - RNA, 23 nt, Mycobacterium leprae
caaggucgagugcgagccacucc

SEQ ID NO: 1243638 - RNA, 15 nt, Mycobacterium leprae
caaggaacaaaaucu

SEQ ID NO: 1243639 - RNA, 17 nt, Mycobacterium leprae
caagcacacugcggcug

SEQ ID NO: 1243640 - RNA, 14 nt, Mycobacterium leprae
caagcagcaccaca

SEQ ID NO: 1243641 - RNA, 17 nt, Mycobacterium leprae
caagcagcauccaccac

SEQ ID NO: 1243642 - RNA, 18 nt, Mycobacterium leprae
caagccggugccaggcag

SEQ ID NO: 1243643 - RNA, 17 nt, Mycobacterium leprae
caagccgccagugcgca

SEQ ID NO: 1243644 - RNA, 17 nt, Mycobacterium leprae
caaguagcaguguggca

SEQ ID NO: 1243645 - RNA, 17 nt, Mycobacterium leprae
caagucacaccacuacc

SEQ ID NO: 1243646 - RNA, 14 nt, Mycobacterium leprae
caagucaaaaccag

SEQ ID NO: 1243647 - RNA, 18 nt, Mycobacterium leprae
caaguuuagcaacaaauu

SEQ ID NO: 1243648 - RNA, 17 nt, Mycobacterium leprae
caauaguaaguggccaa

SEQ ID NO: 1243649 - RNA, 17 nt, Mycobacterium leprae
caaugcucugcugauca

SEQ ID NO: 1243650 - RNA, 18 nt, Mycobacterium leprae
caaugcugcagcugggau

SEQ ID NO: 1243651 - RNA, 15 nt, Mycobacterium leprae
caaugcucucacccu

SEQ ID NO: 1243652 - RNA, 18 nt, Mycobacterium leprae
caaugcaguagaauuuau

SEQ ID NO: 1243653 - RNA, 16 nt, Mycobacterium leprae
caaucuuugaccagac

SEQ ID NO: 1243654 - RNA, 19 nt, Mycobacterium leprae
caaugcacgugauggcgcg

SEQ ID NO: 1243655 - RNA, 17 nt, Mycobacterium leprae
caauccagccaacauag

SEQ ID NO: 1243656 - RNA, 21 nt, Mycobacterium leprae
caaucccgaaaaccccacacu

SEQ ID NO: 1243657 - RNA, 16 nt, Mycobacterium leprae
caaucccaccacccug

SEQ ID NO: 1243658 - RNA, 24 nt, Mycobacterium leprae
caauccuggaugugugcacucgca

SEQ ID NO: 1243659 - RNA, 17 nt, Mycobacterium leprae
caauccuguagcuguuc

SEQ ID NO: 1243660 - RNA, 15 nt, Mycobacterium leprae
caaucgccugugucg

SEQ ID NO: 1243661 - RNA, 17 nt, Mycobacterium leprae
caaucuaauugcgaugc

SEQ ID NO: 1243662 - RNA, 20 nt, Mycobacterium leprae
caaucuccgguggauacaua

SEQ ID NO: 1243663 - RNA, 12 nt, Mycobacterium leprae
caaucgucgccu

SEQ ID NO: 1243664 - RNA, 20 nt, Mycobacterium leprae
caaccuauaaagcgucugcu

SEQ ID NO: 1243665 - RNA, 23 nt, Mycobacterium leprae
caacgccgagccuguuguugugc

SEQ ID NO: 1243666 - RNA, 16 nt, Mycobacterium leprae
caacggcaccaaaccc

SEQ ID NO: 1243667 - RNA, 14 nt, Mycobacterium leprae
caacgugcaguccu

SEQ ID NO: 1243668 - RNA, 18 nt, Mycobacterium leprae
caacgugauggacgaccu

SEQ ID NO: 1243669 - RNA, 16 nt, Mycobacterium leprae
caacuggaaguacugu

SEQ ID NO: 1243670 - RNA, 14 nt, Mycobacterium leprae
caacugcuggaggg

SEQ ID NO: 1243671 - RNA, 14 nt, Mycobacterium leprae
caaccaacaugugc

SEQ ID NO: 1243672 - RNA, 19 nt, Mycobacterium leprae
caaccagccccucgacaac

SEQ ID NO: 1243673 - RNA, 12 nt, Mycobacterium leprae
caacauucaccc

SEQ ID NO: 1243674 - RNA, 21 nt, Mycobacterium leprae
caacccguugucaagcacugc

SEQ ID NO: 1243675 - RNA, 19 nt, Mycobacterium leprae
caaccccgugccgucccua

SEQ ID NO: 1243676 - RNA, 15 nt, Mycobacterium leprae
caacccgacggcaca

SEQ ID NO: 1243677 - RNA, 17 nt, Mycobacterium leprae
caaccgaugcagggcca

SEQ ID NO: 1243678 - RNA, 16 nt, Mycobacterium leprae
caaccgcacagagccc

SEQ ID NO: 1243679 - RNA, 14 nt, Mycobacterium leprae
caacccgggucaua

SEQ ID NO: 1243680 - RNA, 14 nt, Mycobacterium leprae
caacaccaugguga

SEQ ID NO: 1243681 - RNA, 20 nt, Mycobacterium leprae
caacacgaucgcagcccaga

SEQ ID NO: 1243682 - RNA, 16 nt, Mycobacterium leprae
caacaccagcgacugg

SEQ ID NO: 1243683 - RNA, 23 nt, Mycobacterium leprae
caacacguuucugcaugcauaua

SEQ ID NO: 1243684 - RNA, 14 nt, Mycobacterium leprae
caaauugugggggu

SEQ ID NO: 1243685 - RNA, 18 nt, Mycobacterium leprae
caaauuaaggcugagcca

SEQ ID NO: 1243686 - RNA, 13 nt, Mycobacterium leprae
caaaucaccagcg

SEQ ID NO: 1243687 - RNA, 23 nt, Mycobacterium leprae
caaaucgauguuguagguugaug

SEQ ID NO: 1243688 - RNA, 18 nt, Mycobacterium leprae
caaaguuaugcaacgcac

SEQ ID NO: 1243689 - RNA, 18 nt, Mycobacterium leprae
caaaggugcccaccaugu

SEQ ID NO: 1243690 - RNA, 22 nt, Mycobacterium leprae
cagcaaccgcacagagcccagc

SEQ ID NO: 1243691 - RNA, 22 nt, Mycobacterium leprae
cagcaacauucaccccccagga

SEQ ID NO: 1243692 - RNA, 19 nt, Mycobacterium leprae
cagcaauugacgccgaccg

SEQ ID NO: 1243693 - RNA, 18 nt, Mycobacterium leprae
cagcaaugcucugcugau

SEQ ID NO: 1243694 - RNA, 12 nt, Mycobacterium leprae
cagauuggaaau

SEQ ID NO: 1243695 - RNA, 14 nt, Mycobacterium leprae
cagauguccuucaa

SEQ ID NO: 1243696 - RNA, 17 nt, Mycobacterium leprae
cagauugcaguccacca

SEQ ID NO: 1243697 - RNA, 18 nt, Mycobacterium leprae
cagauugcaguccaccag

SEQ ID NO: 1243698 - RNA, 19 nt, Mycobacterium leprae
cagaugcgaucgcagucau

SEQ ID NO: 1243699 - RNA, 12 nt, Mycobacterium leprae
cagaucaaccaa

SEQ ID NO: 1243700 - RNA, 23 nt, Mycobacterium leprae
cagauaccgggcucggugaaaau

SEQ ID NO: 1243701 - RNA, 18 nt, Mycobacterium leprae
cagagguucuagguagaa

SEQ ID NO: 1243702 - RNA, 14 nt, Mycobacterium leprae
cagagcugauggcc

SEQ ID NO: 1243703 - RNA, 18 nt, Mycobacterium leprae
cagagcugauggccgcca

SEQ ID NO: 1243704 - RNA, 16 nt, Mycobacterium leprae
cagagcugcaggucag

SEQ ID NO: 1243705 - RNA, 21 nt, Mycobacterium leprae
cagagcugcgacggacaggcc

SEQ ID NO: 1243706 - RNA, 14 nt, Mycobacterium leprae
cagagcgcugugau

SEQ ID NO: 1243707 - RNA, 19 nt, Mycobacterium leprae
cagagcgcugugauuggcu

SEQ ID NO: 1243708 - RNA, 17 nt, Mycobacterium leprae
cagagcucacugggcuu

SEQ ID NO: 1243709 - RNA, 15 nt, Mycobacterium leprae
cagagcaagccgcac

SEQ ID NO: 1243710 - RNA, 20 nt, Mycobacterium leprae
cagagccgcgcgcaagucug

SEQ ID NO: 1243711 - RNA, 16 nt, Mycobacterium leprae
cagacuucagcgagcg

SEQ ID NO: 1243712 - RNA, 15 nt, Mycobacterium leprae
cagacucagaaaucg

SEQ ID NO: 1243713 - RNA, 22 nt, Mycobacterium leprae
cagacgcgaccgccaccagauc

SEQ ID NO: 1243714 - RNA, 14 nt, Mycobacterium leprae
cagacgauccacug

SEQ ID NO: 1243715 - RNA, 23 nt, Mycobacterium leprae
cagaauauugcgacauccaaagg

SEQ ID NO: 1243716 - RNA, 17 nt, Mycobacterium leprae
cagaauucuauaucuau

SEQ ID NO: 1243717 - RNA, 13 nt, Mycobacterium leprae
cagaccaacauga

SEQ ID NO: 1243718 - RNA, 17 nt, Mycobacterium leprae
cagacagcaagacgggg

SEQ ID NO: 1243719 - RNA, 22 nt, Mycobacterium leprae
cagacacgccgcggcugggcag

SEQ ID NO: 1243720 - RNA, 17 nt, Mycobacterium leprae
cagacaccacugccagc

SEQ ID NO: 1243721 - RNA, 17 nt, Mycobacterium leprae
cagacauggcuguaucu

SEQ ID NO: 1243722 - RNA, 14 nt, Mycobacterium leprae
cagacccagcuaga

SEQ ID NO: 1243723 - RNA, 22 nt, Mycobacterium leprae
cagaccucccugacgcacaccg

SEQ ID NO: 1243724 - RNA, 21 nt, Mycobacterium leprae
cagaccgaaaaccacaagcag

SEQ ID NO: 1243725 - RNA, 16 nt, Mycobacterium leprae
cagaagcuguugugaa

SEQ ID NO: 1243726 - RNA, 13 nt, Mycobacterium leprae
cagaaaguugaag

SEQ ID NO: 1243727 - RNA, 22 nt, Mycobacterium leprae
cacuugggcaacaccucaagca

SEQ ID NO: 1243728 - RNA, 22 nt, Mycobacterium leprae
cacuuaugagcaaaaauccgcu

SEQ ID NO: 1243729 - RNA, 11 nt, Mycobacterium leprae
cacuucaacau

SEQ ID NO: 1243730 - RNA, 23 nt, Mycobacterium leprae
cacuugacuauauaguccgacca

SEQ ID NO: 1243731 - RNA, 16 nt, Mycobacterium leprae
cacugcgucaaagcua

SEQ ID NO: 1243732 - RNA, 13 nt, Mycobacterium leprae
cacuggcggccgc

SEQ ID NO: 1243733 - RNA, 13 nt, Mycobacterium leprae
cacuggguggcac

SEQ ID NO: 1243734 - RNA, 15 nt, Mycobacterium leprae
cacugugucaccuga

SEQ ID NO: 1243735 - RNA, 16 nt, Mycobacterium leprae
cacugugucaccugaa

SEQ ID NO: 1243736 - RNA, 17 nt, Mycobacterium leprae
cacuuaaguggcuggcu

SEQ ID NO: 1243737 - RNA, 16 nt, Mycobacterium leprae
cacuguuuuaagcgaa

SEQ ID NO: 1243738 - RNA, 19 nt, Mycobacterium leprae
caauguggccgcaccugaa

SEQ ID NO: 1243739 - RNA, 23 nt, Mycobacterium leprae
caauguggccgcaccugaacagg

SEQ ID NO: 1243740 - RNA, 21 nt, Mycobacterium leprae
caauguugagugcgaccugaa

SEQ ID NO: 1243741 - RNA, 22 nt, Mycobacterium leprae
cacugccagagaugcguagcca

SEQ ID NO: 1243742 - RNA, 22 nt, Mycobacterium leprae
cacugcacgaccacacugugcc

SEQ ID NO: 1243743 - RNA, 14 nt, Mycobacterium leprae
cagccaacgggaac

SEQ ID NO: 1243744 - RNA, 13 nt, Mycobacterium leprae
cagccaaugcugc

SEQ ID NO: 1243745 - RNA, 15 nt, Mycobacterium leprae
cagccaccaucugga

SEQ ID NO: 1243746 - RNA, 17 nt, Mycobacterium leprae
cagccaccgacgagcaa

SEQ ID NO: 1243747 - RNA, 14 nt, Mycobacterium leprae
cagccaagccgcca

SEQ ID NO: 1243748 - RNA, 19 nt, Mycobacterium leprae
cagccaacaccaccagugg

SEQ ID NO: 1243749 - RNA, 22 nt, Mycobacterium leprae
cagccaacaccaccaguggcuc

SEQ ID NO: 1243750 - RNA, 21 nt, Mycobacterium leprae
cagccaacauagucauugccu

SEQ ID NO: 1243751 - RNA, 16 nt, Mycobacterium leprae
cagcauuggcuccugg

SEQ ID NO: 1243752 - RNA, 22 nt, Mycobacterium leprae
cagcauggcgaugcgcagccgc

SEQ ID NO: 1243753 - RNA, 18 nt, Mycobacterium leprae
cagcaucgacagcaccca

SEQ ID NO: 1243754 - RNA, 18 nt, Mycobacterium leprae
cagcauccucggcacagu

SEQ ID NO: 1243755 - RNA, 22 nt, Mycobacterium leprae
cagcauccucggcacagugacg

SEQ ID NO: 1243756 - RNA, 20 nt, Mycobacterium leprae
cagcauccgccgacgaugcg

SEQ ID NO: 1243757 - RNA, 21 nt, Mycobacterium leprae
cagcauggacgaauccugaga

SEQ ID NO: 1243758 - RNA, 13 nt, Mycobacterium leprae
cagcaugcccaga

SEQ ID NO: 1243759 - RNA, 15 nt, Mycobacterium leprae
cagcauauggaaagu

SEQ ID NO: 1243760 - RNA, 19 nt, Mycobacterium leprae
cagcauaacccgaucaccu

SEQ ID NO: 1243761 - RNA, 15 nt, Mycobacterium leprae
cagcaucagacagag

SEQ ID NO: 1243762 - RNA, 18 nt, Mycobacterium leprae
cagcaucagacagagccg

SEQ ID NO: 1243763 - RNA, 17 nt, Mycobacterium leprae
cagcaucaacgccagca

SEQ ID NO: 1243764 - RNA, 12 nt, Mycobacterium leprae
cagccaucacug

SEQ ID NO: 1243765 - RNA, 16 nt, Mycobacterium leprae
cagccaucacugaucc

SEQ ID NO: 1243766 - RNA, 18 nt, Mycobacterium leprae
cagcccaggugcccagcc

SEQ ID NO: 1243767 - RNA, 21 nt, Mycobacterium leprae
cagcccaggugcccagccccu

SEQ ID NO: 1243768 - RNA, 14 nt, Mycobacterium leprae
cagccccuggcauc

SEQ ID NO: 1243769 - RNA, 19 nt, Mycobacterium leprae
cagccagcaagcaggcaug

SEQ ID NO: 1243770 - RNA, 20 nt, Mycobacterium leprae
cagccacugagauuaucccg

SEQ ID NO: 1243771 - RNA, 16 nt, Mycobacterium leprae
cagcaguguucaggcc

SEQ ID NO: 1243772 - RNA, 12 nt, Mycobacterium leprae
cagcagcauugc

SEQ ID NO: 1243773 - RNA, 15 nt, Mycobacterium leprae
cagcagccacugaga

SEQ ID NO: 1243774 - RNA, 14 nt, Mycobacterium leprae
cagcacguaaccca

SEQ ID NO: 1243775 - RNA, 10 nt, Mycobacterium leprae
cagcacccgc

SEQ ID NO: 1243776 - RNA, 18 nt, Mycobacterium leprae
cagcacccgcuugucuuu

SEQ ID NO: 1243777 - RNA, 16 nt, Mycobacterium leprae
cagcaccauucugguc

SEQ ID NO: 1243778 - RNA, 14 nt, Mycobacterium leprae
cagcaccuugggcg

SEQ ID NO: 1243779 - RNA, 17 nt, Mycobacterium leprae
cagcaccuugggcgccu

SEQ ID NO: 1243780 - RNA, 13 nt, Mycobacterium leprae
cagccgaccgccc

SEQ ID NO: 1243781 - RNA, 13 nt, Mycobacterium leprae
cagccgaggggcc

SEQ ID NO: 1243782 - RNA, 14 nt, Mycobacterium leprae
cagcccgauuugaa

SEQ ID NO: 1243783 - RNA, 22 nt, Mycobacterium leprae
cagcccgaggcuaaccucgcua

SEQ ID NO: 1243784 - RNA, 19 nt, Mycobacterium leprae
cagcccgcuagcaucgacc

SEQ ID NO: 1243785 - RNA, 20 nt, Mycobacterium leprae
cagcccgcuagcaucgacca

SEQ ID NO: 1243786 - RNA, 21 nt, Mycobacterium leprae
cagccgcgaauggacagaaca

SEQ ID NO: 1243787 - RNA, 21 nt, Mycobacterium leprae
cagccgcguccagacaccacu

SEQ ID NO: 1243788 - RNA, 13 nt, Mycobacterium leprae
cagccgaugucca

SEQ ID NO: 1243789 - RNA, 18 nt, Mycobacterium leprae
cagccgauguccaugcag

SEQ ID NO: 1243790 - RNA, 14 nt, Mycobacterium leprae
cagccgcaaucgcc

SEQ ID NO: 1243791 - RNA, 18 nt, Mycobacterium leprae
cagcgacaggcagcugca

SEQ ID NO: 1243792 - RNA, 19 nt, Mycobacterium leprae
cagcgaagaguuucugcug

SEQ ID NO: 1243793 - RNA, 20 nt, Mycobacterium leprae
cagcgacggcaagcugauca

SEQ ID NO: 1243794 - RNA, 23 nt, Mycobacterium leprae
cagccugcgacacuugccgcguu

SEQ ID NO: 1243795 - RNA, 19 nt, Mycobacterium leprae
cagccguucggguugcggu

SEQ ID NO: 1243796 - RNA, 13 nt, Mycobacterium leprae
cagccgugccucg

SEQ ID NO: 1243797 - RNA, 17 nt, Mycobacterium leprae
cagccgucagggcagca

SEQ ID NO: 1243798 - RNA, 14 nt, Mycobacterium leprae
cagcgauugggauc

SEQ ID NO: 1243799 - RNA, 14 nt, Mycobacterium leprae
cagcgcagcccgcu

SEQ ID NO: 1243800 - RNA, 15 nt, Mycobacterium leprae
cagcgcagcccgcua

SEQ ID NO: 1243801 - RNA, 16 nt, Mycobacterium leprae
cagcgcacgguaagac

SEQ ID NO: 1243802 - RNA, 14 nt, Mycobacterium leprae
cagcgcaucagcca

SEQ ID NO: 1243803 - RNA, 18 nt, Mycobacterium leprae
cagcgcggacucucccca

SEQ ID NO: 1243804 - RNA, 20 nt, Mycobacterium leprae
cagcggacugcuagccggcu

SEQ ID NO: 1243805 - RNA, 15 nt, Mycobacterium leprae
cagcgcucgcuggaa

SEQ ID NO: 1243806 - RNA, 20 nt, Mycobacterium leprae
cauugugcugcccaucaccg

SEQ ID NO: 1243807 - RNA, 19 nt, Mycobacterium leprae
cauuaucgcaugugauacu

SEQ ID NO: 1243808 - RNA, 14 nt, Mycobacterium leprae
cauucuccugucac

SEQ ID NO: 1243809 - RNA, 14 nt, Mycobacterium leprae
cauuuuaucacugu

SEQ ID NO: 1243810 - RNA, 15 nt, Mycobacterium leprae
cauuuuucuugaaaa

SEQ ID NO: 1243811 - RNA, 17 nt, Mycobacterium leprae
cauguucuguugugggg

SEQ ID NO: 1243812 - RNA, 16 nt, Mycobacterium leprae
caugugcgcacugggu

SEQ ID NO: 1243813 - RNA, 19 nt, Mycobacterium leprae
caugugcgcacugggugga

SEQ ID NO: 1243814 - RNA, 19 nt, Mycobacterium leprae
caugugaccgcggugcagu

SEQ ID NO: 1243815 - RNA, 17 nt, Mycobacterium leprae
cauggugcggcgccgcc

SEQ ID NO: 1243816 - RNA, 17 nt, Mycobacterium leprae
caugguuaacgaagagu

SEQ ID NO: 1243817 - RNA, 16 nt, Mycobacterium leprae
cauggucgucgcugcu

SEQ ID NO: 1243818 - RNA, 16 nt, Mycobacterium leprae
caugcaagaucaagac

SEQ ID NO: 1243819 - RNA, 19 nt, Mycobacterium leprae
caugcaaccacacccuggc

SEQ ID NO: 1243820 - RNA, 13 nt, Mycobacterium leprae
caucuuuucucaa

SEQ ID NO: 1243821 - RNA, 20 nt, Mycobacterium leprae
caugcccgggauggcugggc

SEQ ID NO: 1243822 - RNA, 13 nt, Mycobacterium leprae
cauggaagccgcc

SEQ ID NO: 1243823 - RNA, 16 nt, Mycobacterium leprae
cauggaagccgccgug

SEQ ID NO: 1243824 - RNA, 18 nt, Mycobacterium leprae
cauggagguucuggguag

SEQ ID NO: 1243825 - RNA, 13 nt, Mycobacterium leprae
cauggcacugccg

SEQ ID NO: 1243826 - RNA, 15 nt, Mycobacterium leprae
cauggcacugccgau

SEQ ID NO: 1243827 - RNA, 13 nt, Mycobacterium leprae
cauggcagccgau

SEQ ID NO: 1243828 - RNA, 16 nt, Mycobacterium leprae
cauggcaguccacagg

SEQ ID NO: 1243829 - RNA, 22 nt, Mycobacterium leprae
cauggcaguccacaggacuuca

SEQ ID NO: 1243830 - RNA, 21 nt, Mycobacterium leprae
caucuugaccagugugccugu

SEQ ID NO: 1243831 - RNA, 22 nt, Mycobacterium leprae
caucuugaccagugugccuguc

SEQ ID NO: 1243832 - RNA, 15 nt, Mycobacterium leprae
caucuucgcccagca

SEQ ID NO: 1243833 - RNA, 20 nt, Mycobacterium leprae
caucuggcgacucggcgcca

SEQ ID NO: 1243834 - RNA, 16 nt, Mycobacterium leprae
caucugcucucagcac

SEQ ID NO: 1243835 - RNA, 18 nt, Mycobacterium leprae
caucugccgugcagcgac

SEQ ID NO: 1243836 - RNA, 14 nt, Mycobacterium leprae
caucgguugugggc

SEQ ID NO: 1243837 - RNA, 16 nt, Mycobacterium leprae
caucuagagaaacacc

SEQ ID NO: 1243838 - RNA, 17 nt, Mycobacterium leprae
caucggggcuacaaagc

SEQ ID NO: 1243839 - RNA, 15 nt, Mycobacterium leprae
caucgaacaagucga

SEQ ID NO: 1243840 - RNA, 17 nt, Mycobacterium leprae
caucgaacaagucgaac

SEQ ID NO: 1243841 - RNA, 16 nt, Mycobacterium leprae
cauccucgaugguguc

SEQ ID NO: 1243842 - RNA, 18 nt, Mycobacterium leprae
cauccucggacugccccg

SEQ ID NO: 1243843 - RNA, 19 nt, Mycobacterium leprae
cauccucacgaccguugca

SEQ ID NO: 1243844 - RNA, 23 nt, Mycobacterium leprae
cauccgccacucgucacauuccu

SEQ ID NO: 1243845 - RNA, 22 nt, Mycobacterium leprae
cauccguggcgagacacccggc

SEQ ID NO: 1243846 - RNA, 16 nt, Mycobacterium leprae
caucgcccaccgcaac

SEQ ID NO: 1243847 - RNA, 14 nt, Mycobacterium leprae
caucgacuugcugc

SEQ ID NO: 1243848 - RNA, 16 nt, Mycobacterium leprae
caucgacgaggucgcc

SEQ ID NO: 1243849 - RNA, 19 nt, Mycobacterium leprae
caucgacaucccagcaacg

SEQ ID NO: 1243850 - RNA, 12 nt, Mycobacterium leprae
caucgacgccgc

SEQ ID NO: 1243851 - RNA, 19 nt, Mycobacterium leprae
caucgcggcugccacugug

SEQ ID NO: 1243852 - RNA, 22 nt, Mycobacterium leprae
caucgcggucugggcgugugca

SEQ ID NO: 1243853 - RNA, 19 nt, Mycobacterium leprae
caucggcgacugggauaga

SEQ ID NO: 1243854 - RNA, 20 nt, Mycobacterium leprae
caucggcucccaucggcggc

SEQ ID NO: 1243855 - RNA, 23 nt, Mycobacterium leprae
caucggcucccaucggcggccag

SEQ ID NO: 1243856 - RNA, 17 nt, Mycobacterium leprae
caucggcgucgguggca

SEQ ID NO: 1243857 - RNA, 19 nt, Mycobacterium leprae
caucggcgugccuggccca

SEQ ID NO: 1243858 - RNA, 22 nt, Mycobacterium leprae
caucggcggccagcucagcaac

SEQ ID NO: 1243859 - RNA, 19 nt, Mycobacterium leprae
caucaccguggccggcccc

SEQ ID NO: 1243860 - RNA, 21 nt, Mycobacterium leprae
caucaucgaucagacccuugg

SEQ ID NO: 1243861 - RNA, 22 nt, Mycobacterium leprae
caucaucgcccaccgcaacgcc

SEQ ID NO: 1243862 - RNA, 20 nt, Mycobacterium leprae
caucaucgcuaagacucacc

SEQ ID NO: 1243863 - RNA, 20 nt, Mycobacterium leprae
caucaucaacauguagacca

SEQ ID NO: 1243864 - RNA, 14 nt, Mycobacterium leprae
caucaucaccguug

SEQ ID NO: 1243865 - RNA, 17 nt, Mycobacterium leprae
caucaagccuccagaau

SEQ ID NO: 1243866 - RNA, 17 nt, Mycobacterium leprae
cauaucuaauugggauc

SEQ ID NO: 1243867 - RNA, 17 nt, Mycobacterium leprae
cauaugagcaucgagga

SEQ ID NO: 1243868 - RNA, 18 nt, Mycobacterium leprae
cauauggaaagucagcau

SEQ ID NO: 1243869 - RNA, 14 nt, Mycobacterium leprae
cauaugccgccaug

SEQ ID NO: 1243870 - RNA, 17 nt, Mycobacterium leprae
cauacucgacgaaccaa

SEQ ID NO: 1243871 - RNA, 17 nt, Mycobacterium leprae
cauacagugcaccggug

SEQ ID NO: 1243872 - RNA, 10 nt, Mycobacterium leprae
caguguggcc

SEQ ID NO: 1243873 - RNA, 19 nt, Mycobacterium leprae
caguguucaggccaucaga

SEQ ID NO: 1243874 - RNA, 19 nt, Mycobacterium leprae
cagugugccagcgcucgcu

SEQ ID NO: 1243875 - RNA, 16 nt, Mycobacterium leprae
caguugcuugucuucu

SEQ ID NO: 1243876 - RNA, 18 nt, Mycobacterium leprae
caguugcuugucuucugu

SEQ ID NO: 1243877 - RNA, 19 nt, Mycobacterium leprae
cauaacacccgguuggcca

SEQ ID NO: 1243878 - RNA, 22 nt, Mycobacterium leprae
caggugcggccacauugaccac

SEQ ID NO: 1243879 - RNA, 20 nt, Mycobacterium leprae
caggugugccuggaugggca

SEQ ID NO: 1243880 - RNA, 18 nt, Mycobacterium leprae
caggugguaucugcaccu

SEQ ID NO: 1243881 - RNA, 16 nt, Mycobacterium leprae
caguaucagugccauu

SEQ ID NO: 1243882 - RNA, 22 nt, Mycobacterium leprae
caguaguuaccguauauuaacg

SEQ ID NO: 1243883 - RNA, 21 nt, Mycobacterium leprae
caguacccgugcccaagacuc

SEQ ID NO: 1243884 - RNA, 14 nt, Mycobacterium leprae
caguaccgagggcc

SEQ ID NO: 1243885 - RNA, 13 nt, Mycobacterium leprae
cagugaagaccau

SEQ ID NO: 1243886 - RNA, 14 nt, Mycobacterium leprae
cagugaacacgcug

SEQ ID NO: 1243887 - RNA, 19 nt, Mycobacterium leprae
cagugaucacaucagugcu

SEQ ID NO: 1243888 - RNA, 16 nt, Mycobacterium leprae
cagugcaguucaccac

SEQ ID NO: 1243889 - RNA, 21 nt, Mycobacterium leprae
cagugcaucgaugauccggcc

SEQ ID NO: 1243890 - RNA, 23 nt, Mycobacterium leprae
cagugcacgagcggguguuuccg

SEQ ID NO: 1243891 - RNA, 13 nt, Mycobacterium leprae
cagugcacucuuc

SEQ ID NO: 1243892 - RNA, 17 nt, Mycobacterium leprae
cagucagcgugccugag

SEQ ID NO: 1243893 - RNA, 15 nt, Mycobacterium leprae
cagucauccacugcg

SEQ ID NO: 1243894 - RNA, 14 nt, Mycobacterium leprae
caguccugcccgga

SEQ ID NO: 1243895 - RNA, 20 nt, Mycobacterium leprae
cagucgagauaguccgacca

SEQ ID NO: 1243896 - RNA, 14 nt, Mycobacterium leprae
cagucgagccaccu

SEQ ID NO: 1243897 - RNA, 20 nt, Mycobacterium leprae
cagucggaaccgcagcugcu

SEQ ID NO: 1243898 - RNA, 16 nt, Mycobacterium leprae
cagucggcucaaccac

SEQ ID NO: 1243899 - RNA, 23 nt, Mycobacterium leprae
cagucuggcggcccacaagucca

SEQ ID NO: 1243900 - RNA, 16 nt, Mycobacterium leprae
caggcacguugaugaa

SEQ ID NO: 1243901 - RNA, 13 nt, Mycobacterium leprae
caggacuucaaau

SEQ ID NO: 1243902 - RNA, 15 nt, Mycobacterium leprae
caggagauacucuga

SEQ ID NO: 1243903 - RNA, 21 nt, Mycobacterium leprae
cagcuugacaucagucagcau

SEQ ID NO: 1243904 - RNA, 22 nt, Mycobacterium leprae
cagcuugaacgccgcgagcaaa

SEQ ID NO: 1243905 - RNA, 19 nt, Mycobacterium leprae
caggaagugcucaauuuag

SEQ ID NO: 1243906 - RNA, 23 nt, Mycobacterium leprae
caggaauugguggucgcgggcua

SEQ ID NO: 1243907 - RNA, 22 nt, Mycobacterium leprae
caggacauauuaagacgcugau

SEQ ID NO: 1243908 - RNA, 17 nt, Mycobacterium leprae
caggacaaagucagcuu

SEQ ID NO: 1243909 - RNA, 19 nt, Mycobacterium leprae
caggacgcacccugcaaug

SEQ ID NO: 1243910 - RNA, 18 nt, Mycobacterium leprae
cagcuguauaacaaauca

SEQ ID NO: 1243911 - RNA, 23 nt, Mycobacterium leprae
cagcuguauaacaaaucauagug

SEQ ID NO: 1243912 - RNA, 11 nt, Mycobacterium leprae
cagcuggaaag

SEQ ID NO: 1243913 - RNA, 18 nt, Mycobacterium leprae
cagcuccagaacggucug

SEQ ID NO: 1243914 - RNA, 15 nt, Mycobacterium leprae
cagggccagcccgcu

SEQ ID NO: 1243915 - RNA, 15 nt, Mycobacterium leprae
cagggccgaagcagc

SEQ ID NO: 1243916 - RNA, 16 nt, Mycobacterium leprae
cagggccgaagcagcc

SEQ ID NO: 1243917 - RNA, 20 nt, Mycobacterium leprae
cagggaagugacgccacagu

SEQ ID NO: 1243918 - RNA, 16 nt, Mycobacterium leprae
cagggcacacagcaau

SEQ ID NO: 1243919 - RNA, 14 nt, Mycobacterium leprae
cagggcagccuaga

SEQ ID NO: 1243920 - RNA, 22 nt, Mycobacterium leprae
cagggcagccuagacugaccca

SEQ ID NO: 1243921 - RNA, 17 nt, Mycobacterium leprae
caggggcugggcaccug

SEQ ID NO: 1243922 - RNA, 22 nt, Mycobacterium leprae
caggggcugggcaccugggcug

SEQ ID NO: 1243923 - RNA, 15 nt, Mycobacterium leprae
caggggguaguucuu

SEQ ID NO: 1243924 - RNA, 15 nt, Mycobacterium leprae
caggggaaccaucgc

SEQ ID NO: 1243925 - RNA, 17 nt, Mycobacterium leprae
cagggcguugccguccc

SEQ ID NO: 1243926 - RNA, 20 nt, Mycobacterium leprae
cagggcguugccguccccuc

SEQ ID NO: 1243927 - RNA, 21 nt, Mycobacterium leprae
cagggcuguuaaaguaaagca

SEQ ID NO: 1243928 - RNA, 16 nt, Mycobacterium leprae
caggguacucagcugg

SEQ ID NO: 1243929 - RNA, 13 nt, Mycobacterium leprae
caggcgugggugu

SEQ ID NO: 1243930 - RNA, 17 nt, Mycobacterium leprae
caggcgugggugugagg

SEQ ID NO: 1243931 - RNA, 18 nt, Mycobacterium leprae
caggcgugagugugagga

SEQ ID NO: 1243932 - RNA, 15 nt, Mycobacterium leprae
caggccguggacgaa

SEQ ID NO: 1243933 - RNA, 14 nt, Mycobacterium leprae
caggccggccugga

SEQ ID NO: 1243934 - RNA, 15 nt, Mycobacterium leprae
caggccgagugcagg

SEQ ID NO: 1243935 - RNA, 17 nt, Mycobacterium leprae
caggcagcgccugcccc

SEQ ID NO: 1243936 - RNA, 16 nt, Mycobacterium leprae
caggcagcugugcacg

SEQ ID NO: 1243937 - RNA, 15 nt, Mycobacterium leprae
caggcagagccaaac

SEQ ID NO: 1243938 - RNA, 22 nt, Mycobacterium leprae
ccuucaaaaagguguucaacga

SEQ ID NO: 1243939 - RNA, 21 nt, Mycobacterium leprae
ccuuacaaugugucaaaaggc

SEQ ID NO: 1243940 - RNA, 15 nt, Mycobacterium leprae
ccuguucauggugug

SEQ ID NO: 1243941 - RNA, 14 nt, Mycobacterium leprae
ccugucuaucacau

SEQ ID NO: 1243942 - RNA, 22 nt, Mycobacterium leprae
ccugucuaucacauccgauuug

SEQ ID NO: 1243943 - RNA, 22 nt, Mycobacterium leprae
ccugcuguaauauauguuccua

SEQ ID NO: 1243944 - RNA, 18 nt, Mycobacterium leprae
ccugcucauggcaccggc

SEQ ID NO: 1243945 - RNA, 22 nt, Mycobacterium leprae
ccuggcgauuuucuugccgucg

SEQ ID NO: 1243946 - RNA, 19 nt, Mycobacterium leprae
ccuggugcccgacagccac

SEQ ID NO: 1243947 - RNA, 15 nt, Mycobacterium leprae
ccuggucuccucgcu

SEQ ID NO: 1243948 - RNA, 13 nt, Mycobacterium leprae
ccuggugacgucg

SEQ ID NO: 1243949 - RNA, 17 nt, Mycobacterium leprae
ccuggucgagcagcucc

SEQ ID NO: 1243950 - RNA, 15 nt, Mycobacterium leprae
ccuggucauggcuuc

SEQ ID NO: 1243951 - RNA, 14 nt, Mycobacterium leprae
ccugggaacccauu

SEQ ID NO: 1243952 - RNA, 13 nt, Mycobacterium leprae
ccucgagcuugcc

SEQ ID NO: 1243953 - RNA, 15 nt, Mycobacterium leprae
ccucagugucagcag

SEQ ID NO: 1243954 - RNA, 21 nt, Mycobacterium leprae
ccucgauuugcucagugacgu

SEQ ID NO: 1243955 - RNA, 18 nt, Mycobacterium leprae
ccucugccagggguucca

SEQ ID NO: 1243956 - RNA, 14 nt, Mycobacterium leprae
ccucggccaucucg

SEQ ID NO: 1243957 - RNA, 22 nt, Mycobacterium leprae
ccugcaaagccgaagccgccag

SEQ ID NO: 1243958 - RNA, 21 nt, Mycobacterium leprae
ccugauccagcaaacuccuga

SEQ ID NO: 1243959 - RNA, 21 nt, Mycobacterium leprae
ccugagacaucgccaccgacc

SEQ ID NO: 1243960 - RNA, 20 nt, Mycobacterium leprae
ccugagcaaauuugugcccg

SEQ ID NO: 1243961 - RNA, 18 nt, Mycobacterium leprae
ccucuucgacaccgagca

SEQ ID NO: 1243962 - RNA, 15 nt, Mycobacterium leprae
ccucuuccgccgcua

SEQ ID NO: 1243963 - RNA, 16 nt, Mycobacterium leprae
ccugaccgccugugcu

SEQ ID NO: 1243964 - RNA, 13 nt, Mycobacterium leprae
ccguauugguugc

SEQ ID NO: 1243965 - RNA, 19 nt, Mycobacterium leprae
ccguaugugccgccgacgg

SEQ ID NO: 1243966 - RNA, 12 nt, Mycobacterium leprae
ccguauauuaac

SEQ ID NO: 1243967 - RNA, 22 nt, Mycobacterium leprae
ccguauauuaacgguauauuaa

SEQ ID NO: 1243968 - RNA, 21 nt, Mycobacterium leprae
ccguacaugcuggcaguggca

SEQ ID NO: 1243969 - RNA, 16 nt, Mycobacterium leprae
ccgguguggucagcau

SEQ ID NO: 1243970 - RNA, 14 nt, Mycobacterium leprae
ccgguuacccgcuu

SEQ ID NO: 1243971 - RNA, 14 nt, Mycobacterium leprae
ccgguggccaccgc

SEQ ID NO: 1243972 - RNA, 19 nt, Mycobacterium leprae
ccgguggcuauacccccug

SEQ ID NO: 1243973 - RNA, 19 nt, Mycobacterium leprae
ccggucugcgucgacugac

SEQ ID NO: 1243974 - RNA, 18 nt, Mycobacterium leprae
ccgguagcggucuggcgc

SEQ ID NO: 1243975 - RNA, 13 nt, Mycobacterium leprae
ccgguagccugga

SEQ ID NO: 1243976 - RNA, 15 nt, Mycobacterium leprae
ccgggaucggcggca

SEQ ID NO: 1243977 - RNA, 15 nt, Mycobacterium leprae
ccgggcagucucguu

SEQ ID NO: 1243978 - RNA, 12 nt, Mycobacterium leprae
ccgggcgcgcgc

SEQ ID NO: 1243979 - RNA, 22 nt, Mycobacterium leprae
ccgggcgagcuggggcggccgc

SEQ ID NO: 1243980 - RNA, 16 nt, Mycobacterium leprae
ccgggccggccgcgga

SEQ ID NO: 1243981 - RNA, 17 nt, Mycobacterium leprae
ccuagagucgaccgccg

SEQ ID NO: 1243982 - RNA, 19 nt, Mycobacterium leprae
ccuagauuaggugugcuag

SEQ ID NO: 1243983 - RNA, 21 nt, Mycobacterium leprae
ccuagagaauaaugguggugc

SEQ ID NO: 1243984 - RNA, 15 nt, Mycobacterium leprae
ccuagaaagaccccc

SEQ ID NO: 1243985 - RNA, 17 nt, Mycobacterium leprae
ccuaggccacccgccag

SEQ ID NO: 1243986 - RNA, 15 nt, Mycobacterium leprae
ccuauaucgcggcgc

SEQ ID NO: 1243987 - RNA, 16 nt, Mycobacterium leprae
ccuaucgcuguggcca

SEQ ID NO: 1243988 - RNA, 17 nt, Mycobacterium leprae
ccuagguccacuugacu

SEQ ID NO: 1243989 - RNA, 20 nt, Mycobacterium leprae
ccuauugguuggggaaauga

SEQ ID NO: 1243990 - RNA, 22 nt, Mycobacterium leprae
ccucacuuauguguacuguuug

SEQ ID NO: 1243991 - RNA, 22 nt, Mycobacterium leprae
ccucacucaugaucgcaggcac

SEQ ID NO: 1243992 - RNA, 20 nt, Mycobacterium leprae
ccucacgaauccuacaucca

SEQ ID NO: 1243993 - RNA, 20 nt, Mycobacterium leprae
ccucaaggccaugacaugca

SEQ ID NO: 1243994 - RNA, 21 nt, Mycobacterium leprae
ccgugaggucgaagcugcccu

SEQ ID NO: 1243995 - RNA, 13 nt, Mycobacterium leprae
ccguuagguuguc

SEQ ID NO: 1243996 - RNA, 14 nt, Mycobacterium leprae
ccguucucccgcca

SEQ ID NO: 1243997 - RNA, 23 nt, Mycobacterium leprae
ccguucuaggguguugugggugu

SEQ ID NO: 1243998 - RNA, 17 nt, Mycobacterium leprae
ccuacaacuucaaccaa

SEQ ID NO: 1243999 - RNA, 18 nt, Mycobacterium leprae
ccguugucccgcccggcc

SEQ ID NO: 1244000 - RNA, 13 nt, Mycobacterium leprae
ccguugggcugcc

SEQ ID NO: 1244001 - RNA, 13 nt, Mycobacterium leprae
ccggacccgagcc

SEQ ID NO: 1244002 - RNA, 21 nt, Mycobacterium leprae
ccggaccaucgucagucggcc

SEQ ID NO: 1244003 - RNA, 11 nt, Mycobacterium leprae
ccggaccugga

SEQ ID NO: 1244004 - RNA, 18 nt, Mycobacterium leprae
ccggauuccgaacgaccu

SEQ ID NO: 1244005 - RNA, 13 nt, Mycobacterium leprae
ccggaguuuucaa

SEQ ID NO: 1244006 - RNA, 19 nt, Mycobacterium leprae
ccggaucgacggcagcgcu

SEQ ID NO: 1244007 - RNA, 21 nt, Mycobacterium leprae
ccggcaccaauguugcccgca

SEQ ID NO: 1244008 - RNA, 11 nt, Mycobacterium leprae
ccggcaccaau

SEQ ID NO: 1244009 - RNA, 19 nt, Mycobacterium leprae
ccggcgauugccaccacca

SEQ ID NO: 1244010 - RNA, 14 nt, Mycobacterium leprae
ccggccgucggcgg

SEQ ID NO: 1244011 - RNA, 16 nt, Mycobacterium leprae
ccggccggccccugag

SEQ ID NO: 1244012 - RNA, 21 nt, Mycobacterium leprae
ccggccgaucgugugcacugc

SEQ ID NO: 1244013 - RNA, 17 nt, Mycobacterium leprae
ccggcgaccagcgagca

SEQ ID NO: 1244014 - RNA, 17 nt, Mycobacterium leprae
ccggccuucgucagcug

SEQ ID NO: 1244015 - RNA, 23 nt, Mycobacterium leprae
ccggcgaacucggagcaaggugg

SEQ ID NO: 1244016 - RNA, 13 nt, Mycobacterium leprae
ccgcgacaguccg

SEQ ID NO: 1244017 - RNA, 11 nt, Mycobacterium leprae
ccgcugugaca

SEQ ID NO: 1244018 - RNA, 22 nt, Mycobacterium leprae
ccgcugauacgugccggccucg

SEQ ID NO: 1244019 - RNA, 21 nt, Mycobacterium leprae
ccgcuacauugcuccgcagca

SEQ ID NO: 1244020 - RNA, 18 nt, Mycobacterium leprae
ccgcggucgugcugcugg

SEQ ID NO: 1244021 - RNA, 20 nt, Mycobacterium leprae
ccgcggugagcggucgcagc

SEQ ID NO: 1244022 - RNA, 15 nt, Mycobacterium leprae
ccgcgguggcgugcu

SEQ ID NO: 1244023 - RNA, 15 nt, Mycobacterium leprae
ccgcggcgaugaccg

SEQ ID NO: 1244024 - RNA, 16 nt, Mycobacterium leprae
ccgaucccaaguggaa

SEQ ID NO: 1244025 - RNA, 12 nt, Mycobacterium leprae
ccgaucccagga

SEQ ID NO: 1244026 - RNA, 19 nt, Mycobacterium leprae
ccgaucccaucggcugcac

SEQ ID NO: 1244027 - RNA, 18 nt, Mycobacterium leprae
ccgauccagacagcaaga

SEQ ID NO: 1244028 - RNA, 15 nt, Mycobacterium leprae
ccgauaucgaccagc

SEQ ID NO: 1244029 - RNA, 19 nt, Mycobacterium leprae
ccgaucgcaccggcugcac

SEQ ID NO: 1244030 - RNA, 14 nt, Mycobacterium leprae
ccgaucgcccgccc

SEQ ID NO: 1244031 - RNA, 14 nt, Mycobacterium leprae
ccgaucgacauagu

SEQ ID NO: 1244032 - RNA, 17 nt, Mycobacterium leprae
ccgaugcucgcccucgg

SEQ ID NO: 1244033 - RNA, 14 nt, Mycobacterium leprae
ccgaggugggcccc

SEQ ID NO: 1244034 - RNA, 17 nt, Mycobacterium leprae
ccgagcguaccaggucg

SEQ ID NO: 1244035 - RNA, 16 nt, Mycobacterium leprae
ccgagcguacugguga

SEQ ID NO: 1244036 - RNA, 17 nt, Mycobacterium leprae
ccgaccucggcgcuggg

SEQ ID NO: 1244037 - RNA, 19 nt, Mycobacterium leprae
ccgacggcgcggcugcuug

SEQ ID NO: 1244038 - RNA, 15 nt, Mycobacterium leprae
ccgacggcgccgcac

SEQ ID NO: 1244039 - RNA, 12 nt, Mycobacterium leprae
ccgaagcgaaga

SEQ ID NO: 1244040 - RNA, 13 nt, Mycobacterium leprae
ccgaagccgcgca

SEQ ID NO: 1244041 - RNA, 15 nt, Mycobacterium leprae
ccgaagccgggcgag

SEQ ID NO: 1244042 - RNA, 17 nt, Mycobacterium leprae
ccgaagccgggcgagcu

SEQ ID NO: 1244043 - RNA, 21 nt, Mycobacterium leprae
ccgaagcgggggaaguaagcu

SEQ ID NO: 1244044 - RNA, 18 nt, Mycobacterium leprae
ccgacaguuuaccgugcc

SEQ ID NO: 1244045 - RNA, 15 nt, Mycobacterium leprae
ccgacauuugggauu

SEQ ID NO: 1244046 - RNA, 21 nt, Mycobacterium leprae
ccgaaccugugcguaaggaag

SEQ ID NO: 1244047 - RNA, 16 nt, Mycobacterium leprae
ccgaaccucgccaccu

SEQ ID NO: 1244048 - RNA, 16 nt, Mycobacterium leprae
ccgaacaacgaacagc

SEQ ID NO: 1244049 - RNA, 14 nt, Mycobacterium leprae
cccucgccggcggu

SEQ ID NO: 1244050 - RNA, 16 nt, Mycobacterium leprae
cccucggccaucucga

SEQ ID NO: 1244051 - RNA, 18 nt, Mycobacterium leprae
ccgcaucgauaagcagca

SEQ ID NO: 1244052 - RNA, 13 nt, Mycobacterium leprae
ccgcaucggcccg

SEQ ID NO: 1244053 - RNA, 23 nt, Mycobacterium leprae
ccgcaucguugucggcuccucca

SEQ ID NO: 1244054 - RNA, 17 nt, Mycobacterium leprae
ccgcaugagccggucgg

SEQ ID NO: 1244055 - RNA, 15 nt, Mycobacterium leprae
ccgccaccagaucca

SEQ ID NO: 1244056 - RNA, 21 nt, Mycobacterium leprae
ccgccacaugugcgccagggg

SEQ ID NO: 1244057 - RNA, 22 nt, Mycobacterium leprae
ccgcagaggacgggcggccagg

SEQ ID NO: 1244058 - RNA, 13 nt, Mycobacterium leprae
ccgcacccggcag

SEQ ID NO: 1244059 - RNA, 14 nt, Mycobacterium leprae
ccgcacccggcagc

SEQ ID NO: 1244060 - RNA, 19 nt, Mycobacterium leprae
ccgcaccugaacaggcacg

SEQ ID NO: 1244061 - RNA, 15 nt, Mycobacterium leprae
ccgccgagcgcacca

SEQ ID NO: 1244062 - RNA, 14 nt, Mycobacterium leprae
ccgcccgcuggauc

SEQ ID NO: 1244063 - RNA, 13 nt, Mycobacterium leprae
ccgcccaagcgaa

SEQ ID NO: 1244064 - RNA, 16 nt, Mycobacterium leprae
ccgccacucgucacau

SEQ ID NO: 1244065 - RNA, 22 nt, Mycobacterium leprae
ccgccagcgacaccaccacggu

SEQ ID NO: 1244066 - RNA, 20 nt, Mycobacterium leprae
cccucaaugcacgugauggc

SEQ ID NO: 1244067 - RNA, 16 nt, Mycobacterium leprae
cccuccuuuucgccgg

SEQ ID NO: 1244068 - RNA, 22 nt, Mycobacterium leprae
cccguaugaucuaauagccgaa

SEQ ID NO: 1244069 - RNA, 23 nt, Mycobacterium leprae
cccgguuacguccgcggcagcug

SEQ ID NO: 1244070 - RNA, 14 nt, Mycobacterium leprae
cccggugucacccg

SEQ ID NO: 1244071 - RNA, 21 nt, Mycobacterium leprae
cccggugugcccucgcugccg

SEQ ID NO: 1244072 - RNA, 13 nt, Mycobacterium leprae
cccgguaucccaa

SEQ ID NO: 1244073 - RNA, 13 nt, Mycobacterium leprae
cccgguagcgccg

SEQ ID NO: 1244074 - RNA, 18 nt, Mycobacterium leprae
cccggugguguuccagug

SEQ ID NO: 1244075 - RNA, 17 nt, Mycobacterium leprae
cccgggggccagcguug

SEQ ID NO: 1244076 - RNA, 23 nt, Mycobacterium leprae
cccggcgugcaggauucacccga

SEQ ID NO: 1244077 - RNA, 16 nt, Mycobacterium leprae
cccggcgauugccacc

SEQ ID NO: 1244078 - RNA, 18 nt, Mycobacterium leprae
cccggcgauugccaccac

SEQ ID NO: 1244079 - RNA, 17 nt, Mycobacterium leprae
cccggacggcccagcac

SEQ ID NO: 1244080 - RNA, 18 nt, Mycobacterium leprae
cccggacggcccagcacc

SEQ ID NO: 1244081 - RNA, 18 nt, Mycobacterium leprae
cccggacaguccaccgcc

SEQ ID NO: 1244082 - RNA, 23 nt, Mycobacterium leprae
cccgcuugucuuugauccgcugg

SEQ ID NO: 1244083 - RNA, 11 nt, Mycobacterium leprae
cccggccaggu

SEQ ID NO: 1244084 - RNA, 24 nt, Mycobacterium leprae
cccggcaccgacguauccaaggug

SEQ ID NO: 1244085 - RNA, 18 nt, Mycobacterium leprae
cccggcagcauccgccga

SEQ ID NO: 1244086 - RNA, 12 nt, Mycobacterium leprae
cccgcugcugcg

SEQ ID NO: 1244087 - RNA, 21 nt, Mycobacterium leprae
cccgcuguaucguccucaaga

SEQ ID NO: 1244088 - RNA, 16 nt, Mycobacterium leprae
cccgccagaucacauu

SEQ ID NO: 1244089 - RNA, 17 nt, Mycobacterium leprae
cccgccagaucacauug

SEQ ID NO: 1244090 - RNA, 18 nt, Mycobacterium leprae
cccgccacucauauccga

SEQ ID NO: 1244091 - RNA, 18 nt, Mycobacterium leprae
cccgcaugcccugggcca

SEQ ID NO: 1244092 - RNA, 18 nt, Mycobacterium leprae
cccgcaucguugucggcu

SEQ ID NO: 1244093 - RNA, 22 nt, Mycobacterium leprae
cccgcaucguugucggcuccuc

SEQ ID NO: 1244094 - RNA, 14 nt, Mycobacterium leprae
cccgcgccgccguu

SEQ ID NO: 1244095 - RNA, 12 nt, Mycobacterium leprae
cccgcgccgccg

SEQ ID NO: 1244096 - RNA, 13 nt, Mycobacterium leprae
ccauugaccucuu

SEQ ID NO: 1244097 - RNA, 15 nt, Mycobacterium leprae
ccauugaccucuuca

SEQ ID NO: 1244098 - RNA, 12 nt, Mycobacterium leprae
cccacaagucca

SEQ ID NO: 1244099 - RNA, 17 nt, Mycobacterium leprae
cccacaaguuguccgcc

SEQ ID NO: 1244100 - RNA, 20 nt, Mycobacterium leprae
cccacaaguuguccgccccg

SEQ ID NO: 1244101 - RNA, 14 nt, Mycobacterium leprae
cccagcagauggcc

SEQ ID NO: 1244102 - RNA, 22 nt, Mycobacterium leprae
cccagcacgcaaccgccggcaa

SEQ ID NO: 1244103 - RNA, 17 nt, Mycobacterium leprae
cccagcaccacugcggu

SEQ ID NO: 1244104 - RNA, 11 nt, Mycobacterium leprae
cccagcaccac

SEQ ID NO: 1244105 - RNA, 17 nt, Mycobacterium leprae
cccagcgauaucaagcu

SEQ ID NO: 1244106 - RNA, 14 nt, Mycobacterium leprae
cccagcguucucca

SEQ ID NO: 1244107 - RNA, 12 nt, Mycobacterium leprae
ccccagacguca

SEQ ID NO: 1244108 - RNA, 15 nt, Mycobacterium leprae
ccccacccgucccgc

SEQ ID NO: 1244109 - RNA, 21 nt, Mycobacterium leprae
ccccacacugagaaaggcaga

SEQ ID NO: 1244110 - RNA, 14 nt, Mycobacterium leprae
ccccaauggcggag

SEQ ID NO: 1244111 - RNA, 16 nt, Mycobacterium leprae
cccgcacagcaccaug

SEQ ID NO: 1244112 - RNA, 20 nt, Mycobacterium leprae
cccgcaaaccaaacaacaac

SEQ ID NO: 1244113 - RNA, 15 nt, Mycobacterium leprae
cccgaaaaccccaca

SEQ ID NO: 1244114 - RNA, 20 nt, Mycobacterium leprae
cccgacggcacaccgugucc

SEQ ID NO: 1244115 - RNA, 22 nt, Mycobacterium leprae
cccgacucagggcccagaucca

SEQ ID NO: 1244116 - RNA, 20 nt, Mycobacterium leprae
ccccgcuucaacguugaagc

SEQ ID NO: 1244117 - RNA, 21 nt, Mycobacterium leprae
ccagcgucgcucacggccacc

SEQ ID NO: 1244118 - RNA, 22 nt, Mycobacterium leprae
ccagcgucgcucacggccacca

SEQ ID NO: 1244119 - RNA, 16 nt, Mycobacterium leprae
ccagcgguaacuggcu

SEQ ID NO: 1244120 - RNA, 14 nt, Mycobacterium leprae
ccagcucggcaucg

SEQ ID NO: 1244121 - RNA, 23 nt, Mycobacterium leprae
ccagcucggcaucggccucaccu

SEQ ID NO: 1244122 - RNA, 21 nt, Mycobacterium leprae
ccaggcgguaggaaucaccgg

SEQ ID NO: 1244123 - RNA, 19 nt, Mycobacterium leprae
ccaggcuacugugaucgca

SEQ ID NO: 1244124 - RNA, 23 nt, Mycobacterium leprae
ccaggucgacuaacgcuucugcc

SEQ ID NO: 1244125 - RNA, 12 nt, Mycobacterium leprae
ccaggguagcug

SEQ ID NO: 1244126 - RNA, 17 nt, Mycobacterium leprae
ccagggucggccgggcu

SEQ ID NO: 1244127 - RNA, 21 nt, Mycobacterium leprae
ccagucagccgucgagccgau

SEQ ID NO: 1244128 - RNA, 13 nt, Mycobacterium leprae
ccaguaggcacca

SEQ ID NO: 1244129 - RNA, 15 nt, Mycobacterium leprae
ccaggucggcuagcc

SEQ ID NO: 1244130 - RNA, 13 nt, Mycobacterium leprae
ccagucgagccac

SEQ ID NO: 1244131 - RNA, 14 nt, Mycobacterium leprae
ccagucgcagggcg

SEQ ID NO: 1244132 - RNA, 13 nt, Mycobacterium leprae
ccagugcacugag

SEQ ID NO: 1244133 - RNA, 19 nt, Mycobacterium leprae
ccagugccuugggcacgga

SEQ ID NO: 1244134 - RNA, 20 nt, Mycobacterium leprae
ccagugcgcaacuucaacuu

SEQ ID NO: 1244135 - RNA, 14 nt, Mycobacterium leprae
ccaucggcugcacc

SEQ ID NO: 1244136 - RNA, 15 nt, Mycobacterium leprae
ccaucggcugcaccg

SEQ ID NO: 1244137 - RNA, 18 nt, Mycobacterium leprae
ccaucaacggcuacaaca

SEQ ID NO: 1244138 - RNA, 19 nt, Mycobacterium leprae
ccagcgauaucaagcugcg

SEQ ID NO: 1244139 - RNA, 20 nt, Mycobacterium leprae
ccagcgauaucaagcugcgc

SEQ ID NO: 1244140 - RNA, 15 nt, Mycobacterium leprae
ccagcaccaaccugu

SEQ ID NO: 1244141 - RNA, 19 nt, Mycobacterium leprae
ccagauagcccgauuugga

SEQ ID NO: 1244142 - RNA, 20 nt, Mycobacterium leprae
ccagauagucgagggcucag

SEQ ID NO: 1244143 - RNA, 15 nt, Mycobacterium leprae
ccagcaaacuccuga

SEQ ID NO: 1244144 - RNA, 13 nt, Mycobacterium leprae
ccacgacaucuug

SEQ ID NO: 1244145 - RNA, 14 nt, Mycobacterium leprae
ccacgaccaaaccu

SEQ ID NO: 1244146 - RNA, 14 nt, Mycobacterium leprae
ccaccuggucacca

SEQ ID NO: 1244147 - RNA, 16 nt, Mycobacterium leprae
ccaccuggucaccaac

SEQ ID NO: 1244148 - RNA, 21 nt, Mycobacterium leprae
ccacgccgauaucgaccagcc

SEQ ID NO: 1244149 - RNA, 19 nt, Mycobacterium leprae
ccacgagacccagccgugg

SEQ ID NO: 1244150 - RNA, 22 nt, Mycobacterium leprae
ccacgauucugcuggagaucga

SEQ ID NO: 1244151 - RNA, 23 nt, Mycobacterium leprae
ccacgcaaacgaauaacugccaa

SEQ ID NO: 1244152 - RNA, 12 nt, Mycobacterium leprae
ccacucggacac

SEQ ID NO: 1244153 - RNA, 21 nt, Mycobacterium leprae
ccacuugacggucgagcugga

SEQ ID NO: 1244154 - RNA, 21 nt, Mycobacterium leprae
ccagaaaguacugaccggcua

SEQ ID NO: 1244155 - RNA, 17 nt, Mycobacterium leprae
ccacuggugguggccuc

SEQ ID NO: 1244156 - RNA, 19 nt, Mycobacterium leprae
ccacugggcugagccgccg

SEQ ID NO: 1244157 - RNA, 13 nt, Mycobacterium leprae
ccacugccagaga

SEQ ID NO: 1244158 - RNA, 14 nt, Mycobacterium leprae
ccacugcacgacca

SEQ ID NO: 1244159 - RNA, 19 nt, Mycobacterium leprae
ccacugcaggagguagcaa

SEQ ID NO: 1244160 - RNA, 23 nt, Mycobacterium leprae
ccacugcuccugagacaucgcca

SEQ ID NO: 1244161 - RNA, 19 nt, Mycobacterium leprae
cggaacugcaagguccccc

SEQ ID NO: 1244162 - RNA, 20 nt, Mycobacterium leprae
cggaaauacggcagugagcu

SEQ ID NO: 1244163 - RNA, 17 nt, Mycobacterium leprae
cggcaaaaacggaggcc

SEQ ID NO: 1244164 - RNA, 19 nt, Mycobacterium leprae
cggauugauggaugcacac

SEQ ID NO: 1244165 - RNA, 12 nt, Mycobacterium leprae
cggaugcccagc

SEQ ID NO: 1244166 - RNA, 17 nt, Mycobacterium leprae
cggaugaauaucaucgc

SEQ ID NO: 1244167 - RNA, 14 nt, Mycobacterium leprae
cggaugagcuccau

SEQ ID NO: 1244168 - RNA, 20 nt, Mycobacterium leprae
cggcaccuuaccguccaccg

SEQ ID NO: 1244169 - RNA, 16 nt, Mycobacterium leprae
cggcaccuccccgccc

SEQ ID NO: 1244170 - RNA, 20 nt, Mycobacterium leprae
cggcagaaauaacagggaug

SEQ ID NO: 1244171 - RNA, 20 nt, Mycobacterium leprae
cggcagguggaucgucggcc

SEQ ID NO: 1244172 - RNA, 20 nt, Mycobacterium leprae
cggcagugagcucaccggcg

SEQ ID NO: 1244173 - RNA, 14 nt, Mycobacterium leprae
cggcaggcuguaca

SEQ ID NO: 1244174 - RNA, 14 nt, Mycobacterium leprae
cggcaggccggccu

SEQ ID NO: 1244175 - RNA, 16 nt, Mycobacterium leprae
cggcaggccggccugg

SEQ ID NO: 1244176 - RNA, 13 nt, Mycobacterium leprae
cggcagcgcuguc

SEQ ID NO: 1244177 - RNA, 20 nt, Mycobacterium leprae
cggccucacaguaggccagc

SEQ ID NO: 1244178 - RNA, 15 nt, Mycobacterium leprae
cggccgucggcggca

SEQ ID NO: 1244179 - RNA, 21 nt, Mycobacterium leprae
cggccgucgcgggugggucga

SEQ ID NO: 1244180 - RNA, 16 nt, Mycobacterium leprae
cggccggugaugacga

SEQ ID NO: 1244181 - RNA, 23 nt, Mycobacterium leprae
cggccucgugcugcgugccuggu

SEQ ID NO: 1244182 - RNA, 19 nt, Mycobacterium leprae
cggccuggaaacgggugga

SEQ ID NO: 1244183 - RNA, 14 nt, Mycobacterium leprae
cggccggcaagcug

SEQ ID NO: 1244184 - RNA, 14 nt, Mycobacterium leprae
cggccggcacugag

SEQ ID NO: 1244185 - RNA, 19 nt, Mycobacterium leprae
cggccgggcaaaccacuua

SEQ ID NO: 1244186 - RNA, 23 nt, Mycobacterium leprae
cggccgcgguggcgugcucuucc

SEQ ID NO: 1244187 - RNA, 19 nt, Mycobacterium leprae
cggccgccacgccgugcuu

SEQ ID NO: 1244188 - RNA, 14 nt, Mycobacterium leprae
cggccgcacccggc

SEQ ID NO: 1244189 - RNA, 17 nt, Mycobacterium leprae
cggccgcacagccagca

SEQ ID NO: 1244190 - RNA, 23 nt, Mycobacterium leprae
cggccgaucgugugcacugcuuc

SEQ ID NO: 1244191 - RNA, 21 nt, Mycobacterium leprae
cggccccuuucacgucggcgu

SEQ ID NO: 1244192 - RNA, 13 nt, Mycobacterium leprae
cggcccagcacca

SEQ ID NO: 1244193 - RNA, 18 nt, Mycobacterium leprae
cggccaggugugccugga

SEQ ID NO: 1244194 - RNA, 14 nt, Mycobacterium leprae
cggccagcgcauca

SEQ ID NO: 1244195 - RNA, 23 nt, Mycobacterium leprae
cggccagcgcaucagccaacacc

SEQ ID NO: 1244196 - RNA, 20 nt, Mycobacterium leprae
cgcgguagauaucuacuggg

SEQ ID NO: 1244197 - RNA, 19 nt, Mycobacterium leprae
cgcgguguucgucgcggag

SEQ ID NO: 1244198 - RNA, 20 nt, Mycobacterium leprae
cgcgucgcaucgguggcacg

SEQ ID NO: 1244199 - RNA, 14 nt, Mycobacterium leprae
cgcuacccuugagc

SEQ ID NO: 1244200 - RNA, 14 nt, Mycobacterium leprae
cgcgugaucuccgc

SEQ ID NO: 1244201 - RNA, 17 nt, Mycobacterium leprae
cgcuagaaacaggcaua

SEQ ID NO: 1244202 - RNA, 21 nt, Mycobacterium leprae
cgcuaugcggacggacacugu

SEQ ID NO: 1244203 - RNA, 19 nt, Mycobacterium leprae
cgcuauggauacucaauug

SEQ ID NO: 1244204 - RNA, 15 nt, Mycobacterium leprae
cgcucagcauugcuc

SEQ ID NO: 1244205 - RNA, 16 nt, Mycobacterium leprae
cgcggcaucgucggca

SEQ ID NO: 1244206 - RNA, 19 nt, Mycobacterium leprae
cgcggcgaugaccggacga

SEQ ID NO: 1244207 - RNA, 14 nt, Mycobacterium leprae
cgcggcugccacug

SEQ ID NO: 1244208 - RNA, 21 nt, Mycobacterium leprae
cgcggguaccccauucagcgg

SEQ ID NO: 1244209 - RNA, 17 nt, Mycobacterium leprae
cgcggggggaucggggc

SEQ ID NO: 1244210 - RNA, 18 nt, Mycobacterium leprae
cgcggggcgaugucgacc

SEQ ID NO: 1244211 - RNA, 20 nt, Mycobacterium leprae
cgcuguuccauaacguugca

SEQ ID NO: 1244212 - RNA, 20 nt, Mycobacterium leprae
cgcuguguguuuggggguua

SEQ ID NO: 1244213 - RNA, 23 nt, Mycobacterium leprae
cgcugguaucggugucggcggcu

SEQ ID NO: 1244214 - RNA, 17 nt, Mycobacterium leprae
cgcugggugagcugugc

SEQ ID NO: 1244215 - RNA, 15 nt, Mycobacterium leprae
cgcuggcggugugug

SEQ ID NO: 1244216 - RNA, 15 nt, Mycobacterium leprae
cggaaacacagcaag

SEQ ID NO: 1244217 - RNA, 18 nt, Mycobacterium leprae
cggaaaagucguggagca

SEQ ID NO: 1244218 - RNA, 19 nt, Mycobacterium leprae
cgcuuuccgcgccccuucc

SEQ ID NO: 1244219 - RNA, 13 nt, Mycobacterium leprae
cgcuggagcaccu

SEQ ID NO: 1244220 - RNA, 15 nt, Mycobacterium leprae
cgcuggcccugccug

SEQ ID NO: 1244221 - RNA, 17 nt, Mycobacterium leprae
cgcuggcccugccuguu

SEQ ID NO: 1244222 - RNA, 14 nt, Mycobacterium leprae
cgcugcgugaagca

SEQ ID NO: 1244223 - RNA, 15 nt, Mycobacterium leprae
cgcugcgcggcugcg

SEQ ID NO: 1244224 - RNA, 18 nt, Mycobacterium leprae
cgcucaggcuaccgagcu

SEQ ID NO: 1244225 - RNA, 16 nt, Mycobacterium leprae
cgcugaggcagcagcu

SEQ ID NO: 1244226 - RNA, 17 nt, Mycobacterium leprae
cgggcgcucagcggcca

SEQ ID NO: 1244227 - RNA, 18 nt, Mycobacterium leprae
cgggcgcucagugaucag

SEQ ID NO: 1244228 - RNA, 13 nt, Mycobacterium leprae
cgggcggcaccug

SEQ ID NO: 1244229 - RNA, 22 nt, Mycobacterium leprae
cgggcuagaaucuucacgcgga

SEQ ID NO: 1244230 - RNA, 22 nt, Mycobacterium leprae
cgggcucacggggcuggguccc

SEQ ID NO: 1244231 - RNA, 14 nt, Mycobacterium leprae
cgggcuuccugcug

SEQ ID NO: 1244232 - RNA, 15 nt, Mycobacterium leprae
cgggcuugaccugga

SEQ ID NO: 1244233 - RNA, 14 nt, Mycobacterium leprae
cggggcggcaccuu

SEQ ID NO: 1244234 - RNA, 16 nt, Mycobacterium leprae
cggggcgguggcagcg

SEQ ID NO: 1244235 - RNA, 13 nt, Mycobacterium leprae
cggggcgucgcug

SEQ ID NO: 1244236 - RNA, 16 nt, Mycobacterium leprae
cggggugggcagccug

SEQ ID NO: 1244237 - RNA, 16 nt, Mycobacterium leprae
cggguacggucuggcc

SEQ ID NO: 1244238 - RNA, 20 nt, Mycobacterium leprae
cgggguacaauaaacuggcg

SEQ ID NO: 1244239 - RNA, 16 nt, Mycobacterium leprae
cgggcccggacggccc

SEQ ID NO: 1244240 - RNA, 20 nt, Mycobacterium leprae
cgggcccggacggcccagca

SEQ ID NO: 1244241 - RNA, 14 nt, Mycobacterium leprae
cgggcagcugcaac

SEQ ID NO: 1244242 - RNA, 21 nt, Mycobacterium leprae
cgggcacacagauccugggcg

SEQ ID NO: 1244243 - RNA, 18 nt, Mycobacterium leprae
cgggcaccagauggcucc

SEQ ID NO: 1244244 - RNA, 23 nt, Mycobacterium leprae
cgggccgcuaugaguuucggcgc

SEQ ID NO: 1244245 - RNA, 21 nt, Mycobacterium leprae
cgggccguuauccacagcauc

SEQ ID NO: 1244246 - RNA, 19 nt, Mycobacterium leprae
cggcuucaucagugugucc

SEQ ID NO: 1244247 - RNA, 16 nt, Mycobacterium leprae
cggcuuuggcggacug

SEQ ID NO: 1244248 - RNA, 13 nt, Mycobacterium leprae
cggcugccgcgca

SEQ ID NO: 1244249 - RNA, 11 nt, Mycobacterium leprae
cggcugcaccc

SEQ ID NO: 1244250 - RNA, 22 nt, Mycobacterium leprae
cggcugccacugugucacgcga

SEQ ID NO: 1244251 - RNA, 22 nt, Mycobacterium leprae
cggcugucagagugcagaucac

SEQ ID NO: 1244252 - RNA, 19 nt, Mycobacterium leprae
cggcuggcuaauggcgggc

SEQ ID NO: 1244253 - RNA, 13 nt, Mycobacterium leprae
cggcgugccuggc

SEQ ID NO: 1244254 - RNA, 22 nt, Mycobacterium leprae
cggcguguggggguccgcgcac

SEQ ID NO: 1244255 - RNA, 15 nt, Mycobacterium leprae
cggcguucaauaaga

SEQ ID NO: 1244256 - RNA, 22 nt, Mycobacterium leprae
cggcuacacgguauaaaggcgc

SEQ ID NO: 1244257 - RNA, 22 nt, Mycobacterium leprae
cggcucagcaccauucuggucg

SEQ ID NO: 1244258 - RNA, 20 nt, Mycobacterium leprae
cggcggcuuguugaccggcc

SEQ ID NO: 1244259 - RNA, 15 nt, Mycobacterium leprae
cggcgcucuguucug

SEQ ID NO: 1244260 - RNA, 20 nt, Mycobacterium leprae
cggcggccaauucgccgacc

SEQ ID NO: 1244261 - RNA, 13 nt, Mycobacterium leprae
cggcggccaccgc

SEQ ID NO: 1244262 - RNA, 12 nt, Mycobacterium leprae
cggcggccagcu

SEQ ID NO: 1244263 - RNA, 21 nt, Mycobacterium leprae
cggcggccgccacgccgugcu

SEQ ID NO: 1244264 - RNA, 17 nt, Mycobacterium leprae
cggccuugccgcuccgc

SEQ ID NO: 1244265 - RNA, 20 nt, Mycobacterium leprae
cggccuuaucgucuugcagc

SEQ ID NO: 1244266 - RNA, 21 nt, Mycobacterium leprae
cgucacccggucaagagccgc

SEQ ID NO: 1244267 - RNA, 20 nt, Mycobacterium leprae
cgucaagugcgcaccggcug

SEQ ID NO: 1244268 - RNA, 18 nt, Mycobacterium leprae
cgucauggcacugggcug

SEQ ID NO: 1244269 - RNA, 11 nt, Mycobacterium leprae
cgucagcugcu

SEQ ID NO: 1244270 - RNA, 15 nt, Mycobacterium leprae
cgucagcuggaaucc

SEQ ID NO: 1244271 - RNA, 13 nt, Mycobacterium leprae
cguaucaaaacua

SEQ ID NO: 1244272 - RNA, 18 nt, Mycobacterium leprae
cguaguguagcugcagcg

SEQ ID NO: 1244273 - RNA, 19 nt, Mycobacterium leprae
cguaguguagcugcagcga

SEQ ID NO: 1244274 - RNA, 16 nt, Mycobacterium leprae
cguagcggucggcgca

SEQ ID NO: 1244275 - RNA, 18 nt, Mycobacterium leprae
cggucgcucggacugggc

SEQ ID NO: 1244276 - RNA, 14 nt, Mycobacterium leprae
cggucggaguucuu

SEQ ID NO: 1244277 - RNA, 17 nt, Mycobacterium leprae
cggucgggaccuaccgc

SEQ ID NO: 1244278 - RNA, 20 nt, Mycobacterium leprae
cggugacuucggccggaguu

SEQ ID NO: 1244279 - RNA, 18 nt, Mycobacterium leprae
cggugacuaguccggaaa

SEQ ID NO: 1244280 - RNA, 16 nt, Mycobacterium leprae
cggugauuggcugaga

SEQ ID NO: 1244281 - RNA, 18 nt, Mycobacterium leprae
cggucuagcaaguagacg

SEQ ID NO: 1244282 - RNA, 18 nt, Mycobacterium leprae
cggucguagaccucuuca

SEQ ID NO: 1244283 - RNA, 13 nt, Mycobacterium leprae
cggucgugcugcu

SEQ ID NO: 1244284 - RNA, 12 nt, Mycobacterium leprae
cggucacuccac

SEQ ID NO: 1244285 - RNA, 17 nt, Mycobacterium leprae
cgggucgagcagccacc

SEQ ID NO: 1244286 - RNA, 14 nt, Mycobacterium leprae
cggucccaucgcug

SEQ ID NO: 1244287 - RNA, 17 nt, Mycobacterium leprae
cggucccaucgcugacc

SEQ ID NO: 1244288 - RNA, 17 nt, Mycobacterium leprae
cgguccugguggcaacg

SEQ ID NO: 1244289 - RNA, 15 nt, Mycobacterium leprae
cgguccuguccaggu

SEQ ID NO: 1244290 - RNA, 15 nt, Mycobacterium leprae
cgguggccaccgcca

SEQ ID NO: 1244291 - RNA, 14 nt, Mycobacterium leprae
cgguggauuaggcg

SEQ ID NO: 1244292 - RNA, 12 nt, Mycobacterium leprae
cggugcauggau

SEQ ID NO: 1244293 - RNA, 22 nt, Mycobacterium leprae
cggugcaccagcucacccgcag

SEQ ID NO: 1244294 - RNA, 23 nt, Mycobacterium leprae
cggugcaccagcucacccgcagc

SEQ ID NO: 1244295 - RNA, 20 nt, Mycobacterium leprae
cgguuacaucgucaacgacc

SEQ ID NO: 1244296 - RNA, 17 nt, Mycobacterium leprae
cggugucggauccccuc

SEQ ID NO: 1244297 - RNA, 23 nt, Mycobacterium leprae
cggugucaucuaucuccaccagc

SEQ ID NO: 1244298 - RNA, 17 nt, Mycobacterium leprae
cggugggcuuccagcag

SEQ ID NO: 1244299 - RNA, 15 nt, Mycobacterium leprae
cgguuugggccaggu

SEQ ID NO: 1244300 - RNA, 11 nt, Mycobacterium leprae
cgguuucacag

SEQ ID NO: 1244301 - RNA, 20 nt, Mycobacterium leprae
cgguuucgggaaagcugaga

SEQ ID NO: 1244302 - RNA, 22 nt, Mycobacterium leprae
cgguugucgacgcgugcgucau

SEQ ID NO: 1244303 - RNA, 15 nt, Mycobacterium leprae
cgcgcccgagccguu

SEQ ID NO: 1244304 - RNA, 15 nt, Mycobacterium leprae
cgcgccgcccagcag

SEQ ID NO: 1244305 - RNA, 16 nt, Mycobacterium leprae
cgcgccgccugcugca

SEQ ID NO: 1244306 - RNA, 17 nt, Mycobacterium leprae
cgcgcauacacggcagc

SEQ ID NO: 1244307 - RNA, 16 nt, Mycobacterium leprae
cgcgcaucaucgccca

SEQ ID NO: 1244308 - RNA, 19 nt, Mycobacterium leprae
cgcgacaguaucgaccagc

SEQ ID NO: 1244309 - RNA, 16 nt, Mycobacterium leprae
cgcgaccgccaccaga

SEQ ID NO: 1244310 - RNA, 18 nt, Mycobacterium leprae
cgcgaccuugcggcgccc

SEQ ID NO: 1244311 - RNA, 15 nt, Mycobacterium leprae
cgcgacgccaggcgg

SEQ ID NO: 1244312 - RNA, 17 nt, Mycobacterium leprae
cgcgagcacugacaugc

SEQ ID NO: 1244313 - RNA, 20 nt, Mycobacterium leprae
cgcgagaauuuugugcugcg

SEQ ID NO: 1244314 - RNA, 19 nt, Mycobacterium leprae
cgcgagaaaaucagaugua

SEQ ID NO: 1244315 - RNA, 23 nt, Mycobacterium leprae
cgcgaucuggauggccgccagca

SEQ ID NO: 1244316 - RNA, 14 nt, Mycobacterium leprae
cgcgauccaucagc

SEQ ID NO: 1244317 - RNA, 13 nt, Mycobacterium leprae
cgcgagugcuggu

SEQ ID NO: 1244318 - RNA, 19 nt, Mycobacterium leprae
cgcgauagcuugcaguuau

SEQ ID NO: 1244319 - RNA, 18 nt, Mycobacterium leprae
cgcgauggggggcagcag

SEQ ID NO: 1244320 - RNA, 19 nt, Mycobacterium leprae
cgccguuaguuucgggccu

SEQ ID NO: 1244321 - RNA, 23 nt, Mycobacterium leprae
cgccugaacuggaucggucagcc

SEQ ID NO: 1244322 - RNA, 14 nt, Mycobacterium leprae
cgccucgucggcca

SEQ ID NO: 1244323 - RNA, 22 nt, Mycobacterium leprae
cgccugcuugaggucgcacagc

SEQ ID NO: 1244324 - RNA, 17 nt, Mycobacterium leprae
cgccuugcugccggcga

SEQ ID NO: 1244325 - RNA, 14 nt, Mycobacterium leprae
cgccuugcagcuuc

SEQ ID NO: 1244326 - RNA, 17 nt, Mycobacterium leprae
cgccggucgugcaugcg

SEQ ID NO: 1244327 - RNA, 18 nt, Mycobacterium leprae
cgccggggauuucaggug

SEQ ID NO: 1244328 - RNA, 23 nt, Mycobacterium leprae
cgccggcgucggccaguaccucc

SEQ ID NO: 1244329 - RNA, 22 nt, Mycobacterium leprae
cgccggcgucaaagucgcgggc

SEQ ID NO: 1244330 - RNA, 18 nt, Mycobacterium leprae
cgccggcgcgcaggcugc

SEQ ID NO: 1244331 - RNA, 20 nt, Mycobacterium leprae
cgccggccgcacccggcagc

SEQ ID NO: 1244332 - RNA, 21 nt, Mycobacterium leprae
cgccggccgcacccggcagca

SEQ ID NO: 1244333 - RNA, 14 nt, Mycobacterium leprae
cgccggcaagcccg

SEQ ID NO: 1244334 - RNA, 20 nt, Mycobacterium leprae
cgccggagcgaagcacccgg

SEQ ID NO: 1244335 - RNA, 14 nt, Mycobacterium leprae
cgccgcggcugccg

SEQ ID NO: 1244336 - RNA, 12 nt, Mycobacterium leprae
cgccgcggcggg

SEQ ID NO: 1244337 - RNA, 23 nt, Mycobacterium leprae
cgccgcgcaucaucgcccaccgc

SEQ ID NO: 1244338 - RNA, 23 nt, Mycobacterium leprae
cgccgccuuuacgaagccgccac

SEQ ID NO: 1244339 - RNA, 23 nt, Mycobacterium leprae
cgcccuguguucggucugcggug

SEQ ID NO: 1244340 - RNA, 16 nt, Mycobacterium leprae
cgcccuggaccgcagc

SEQ ID NO: 1244341 - RNA, 16 nt, Mycobacterium leprae
cgcccucggacguggu

SEQ ID NO: 1244342 - RNA, 16 nt, Mycobacterium leprae
cgccgaagccgcgcau

SEQ ID NO: 1244343 - RNA, 16 nt, Mycobacterium leprae
cgccgaccucggcgcu

SEQ ID NO: 1244344 - RNA, 21 nt, Mycobacterium leprae
cgccgaccucggcgcuggggc

SEQ ID NO: 1244345 - RNA, 17 nt, Mycobacterium leprae
cgccgauaucgaccagc

SEQ ID NO: 1244346 - RNA, 22 nt, Mycobacterium leprae
cgccgauaucgaccagccaagc

SEQ ID NO: 1244347 - RNA, 16 nt, Mycobacterium leprae
cgccgaggugggcccc

SEQ ID NO: 1244348 - RNA, 19 nt, Mycobacterium leprae
cgccagccuuucacgccag

SEQ ID NO: 1244349 - RNA, 22 nt, Mycobacterium leprae
cgccagcgacacagccggccgg

SEQ ID NO: 1244350 - RNA, 22 nt, Mycobacterium leprae
cgccaguguagagggccacuaa

SEQ ID NO: 1244351 - RNA, 17 nt, Mycobacterium leprae
cgccauagccgaucucc

SEQ ID NO: 1244352 - RNA, 22 nt, Mycobacterium leprae
cgccauauacaaaccccagacc

SEQ ID NO: 1244353 - RNA, 17 nt, Mycobacterium leprae
cgccaggguacccgugc

SEQ ID NO: 1244354 - RNA, 12 nt, Mycobacterium leprae
cgccagggcggc

SEQ ID NO: 1244355 - RNA, 15 nt, Mycobacterium leprae
cgccacucgucacau

SEQ ID NO: 1244356 - RNA, 16 nt, Mycobacterium leprae
cgccccaccauaaccg

SEQ ID NO: 1244357 - RNA, 12 nt, Mycobacterium leprae
cgcccggccugc

SEQ ID NO: 1244358 - RNA, 15 nt, Mycobacterium leprae
cgcccgcgcauguaa

SEQ ID NO: 1244359 - RNA, 13 nt, Mycobacterium leprae
ccuucauguccua

SEQ ID NO: 1244360 - RNA, 20 nt, Mycobacterium leprae
cgaucgagguuuaacgaucc

SEQ ID NO: 1244361 - RNA, 14 nt, Mycobacterium leprae
cgaucgcagcccag

SEQ ID NO: 1244362 - RNA, 16 nt, Mycobacterium leprae
cgaucgcaaauauaau

SEQ ID NO: 1244363 - RNA, 21 nt, Mycobacterium leprae
cgauccucgacgggucacagg

SEQ ID NO: 1244364 - RNA, 11 nt, Mycobacterium leprae
cgaucccaagu

SEQ ID NO: 1244365 - RNA, 21 nt, Mycobacterium leprae
cgaucccgguuacguccgcgg

SEQ ID NO: 1244366 - RNA, 13 nt, Mycobacterium leprae
cgaucagggcgcc

SEQ ID NO: 1244367 - RNA, 18 nt, Mycobacterium leprae
cgaucauggugguguuca

SEQ ID NO: 1244368 - RNA, 15 nt, Mycobacterium leprae
cgaucauggcuggac

SEQ ID NO: 1244369 - RNA, 14 nt, Mycobacterium leprae
cgauccacuugacg

SEQ ID NO: 1244370 - RNA, 15 nt, Mycobacterium leprae
cgauaucaagcugcg

SEQ ID NO: 1244371 - RNA, 16 nt, Mycobacterium leprae
cgauaucgaugcaggc

SEQ ID NO: 1244372 - RNA, 19 nt, Mycobacterium leprae
cgaugaggcucgugcacug

SEQ ID NO: 1244373 - RNA, 22 nt, Mycobacterium leprae
cgaugcacuguucacuaacacg

SEQ ID NO: 1244374 - RNA, 18 nt, Mycobacterium leprae
cgaugcagggccagcccg

SEQ ID NO: 1244375 - RNA, 22 nt, Mycobacterium leprae
cgaugccauagacuucuggauc

SEQ ID NO: 1244376 - RNA, 20 nt, Mycobacterium leprae
cgaugccccaucucaucuug

SEQ ID NO: 1244377 - RNA, 22 nt, Mycobacterium leprae
cgauguacuccgaaugugggau

SEQ ID NO: 1244378 - RNA, 15 nt, Mycobacterium leprae
cgauggugugcagua

SEQ ID NO: 1244379 - RNA, 23 nt, Mycobacterium leprae
cgaugcuaccgaacuugccacuu

SEQ ID NO: 1244380 - RNA, 17 nt, Mycobacterium leprae
cgaugcgugccccggcc

SEQ ID NO: 1244381 - RNA, 17 nt, Mycobacterium leprae
cgauggccagccguccc

SEQ ID NO: 1244382 - RNA, 15 nt, Mycobacterium leprae
cgaucggcagccacg

SEQ ID NO: 1244383 - RNA, 13 nt, Mycobacterium leprae
cgaucugcccagc

SEQ ID NO: 1244384 - RNA, 20 nt, Mycobacterium leprae
cgaucucggcgcgcucucug

SEQ ID NO: 1244385 - RNA, 19 nt, Mycobacterium leprae
cgaucuaucugacgacuuc

SEQ ID NO: 1244386 - RNA, 21 nt, Mycobacterium leprae
cgaucucagccaggagaagcg

SEQ ID NO: 1244387 - RNA, 21 nt, Mycobacterium leprae
cgaucugugacacuucuccaa

SEQ ID NO: 1244388 - RNA, 14 nt, Mycobacterium leprae
cgaucuggauggcc

SEQ ID NO: 1244389 - RNA, 20 nt, Mycobacterium leprae
cgaucuggauggccgccagc

SEQ ID NO: 1244390 - RNA, 14 nt, Mycobacterium leprae
cgaucuuccaccau

SEQ ID NO: 1244391 - RNA, 17 nt, Mycobacterium leprae
cgcaacgccuccacugc

SEQ ID NO: 1244392 - RNA, 16 nt, Mycobacterium leprae
cgcaagugcggcgccc

SEQ ID NO: 1244393 - RNA, 17 nt, Mycobacterium leprae
cgcaagugcggcgccca

SEQ ID NO: 1244394 - RNA, 20 nt, Mycobacterium leprae
cgcaagugcggcgcccagca

SEQ ID NO: 1244395 - RNA, 17 nt, Mycobacterium leprae
cgcaacugguugacccc

SEQ ID NO: 1244396 - RNA, 19 nt, Mycobacterium leprae
cgcacccugccgccacagc

SEQ ID NO: 1244397 - RNA, 24 nt, Mycobacterium leprae
cgcacccugccgccacagcaaguc

SEQ ID NO: 1244398 - RNA, 17 nt, Mycobacterium leprae
cgcaccugaucggucag

SEQ ID NO: 1244399 - RNA, 20 nt, Mycobacterium leprae
cgcacacgacagccgcaauc

SEQ ID NO: 1244400 - RNA, 15 nt, Mycobacterium leprae
cgcacagagcccagc

SEQ ID NO: 1244401 - RNA, 16 nt, Mycobacterium leprae
cgcacaguuccagugc

SEQ ID NO: 1244402 - RNA, 18 nt, Mycobacterium leprae
cgcacaguuccagugccu

SEQ ID NO: 1244403 - RNA, 15 nt, Mycobacterium leprae
cgcagcaucagggcu

SEQ ID NO: 1244404 - RNA, 20 nt, Mycobacterium leprae
cgcagcaugguggccacgau

SEQ ID NO: 1244405 - RNA, 13 nt, Mycobacterium leprae
cgcagccaccacu

SEQ ID NO: 1244406 - RNA, 14 nt, Mycobacterium leprae
cgcagccaccacuc

SEQ ID NO: 1244407 - RNA, 14 nt, Mycobacterium leprae
cgcagccggagggu

SEQ ID NO: 1244408 - RNA, 23 nt, Mycobacterium leprae
cgcagccggaggguugccgacgg

SEQ ID NO: 1244409 - RNA, 15 nt, Mycobacterium leprae
cgcaguuggccacug

SEQ ID NO: 1244410 - RNA, 16 nt, Mycobacterium leprae
cgcaguuggccacugu

SEQ ID NO: 1244411 - RNA, 16 nt, Mycobacterium leprae
cgcaggagauccacgu

SEQ ID NO: 1244412 - RNA, 19 nt, Mycobacterium leprae
cgcaggaguaauaacugug

SEQ ID NO: 1244413 - RNA, 15 nt, Mycobacterium leprae
cgcagcugcucggcc

SEQ ID NO: 1244414 - RNA, 15 nt, Mycobacterium leprae
cgcagcuggccaagc

SEQ ID NO: 1244415 - RNA, 16 nt, Mycobacterium leprae
cgcagcgcgaacaaga

SEQ ID NO: 1244416 - RNA, 22 nt, Mycobacterium leprae
cuucagaagcacgacacuagcu

SEQ ID NO: 1244417 - RNA, 18 nt, Mycobacterium leprae
cuucagaaaguugaagua

SEQ ID NO: 1244418 - RNA, 18 nt, Mycobacterium leprae
cuucacuuagccaugucu

SEQ ID NO: 1244419 - RNA, 18 nt, Mycobacterium leprae
cuuccaccauuuccggaa

SEQ ID NO: 1244420 - RNA, 17 nt, Mycobacterium leprae
cuuccugcuggcccugu

SEQ ID NO: 1244421 - RNA, 18 nt, Mycobacterium leprae
cuucccgacggugaauca

SEQ ID NO: 1244422 - RNA, 14 nt, Mycobacterium leprae
cuucuauacuuuaa

SEQ ID NO: 1244423 - RNA, 12 nt, Mycobacterium leprae
cuucgacggugu

SEQ ID NO: 1244424 - RNA, 21 nt, Mycobacterium leprae
cuucgacgguguaaugcugcu

SEQ ID NO: 1244425 - RNA, 18 nt, Mycobacterium leprae
cuucgggcaagugguugg

SEQ ID NO: 1244426 - RNA, 19 nt, Mycobacterium leprae
cuucggucaggucaugcca

SEQ ID NO: 1244427 - RNA, 15 nt, Mycobacterium leprae
cuucgguaacgcuga

SEQ ID NO: 1244428 - RNA, 18 nt, Mycobacterium leprae
cuuauuuauauucaauuu

SEQ ID NO: 1244429 - RNA, 23 nt, Mycobacterium leprae
cuuaguuuagagugcagcacaag

SEQ ID NO: 1244430 - RNA, 16 nt, Mycobacterium leprae
cuuaugcgugcugagu

SEQ ID NO: 1244431 - RNA, 18 nt, Mycobacterium leprae
cuucacgaaugccaucgg

SEQ ID NO: 1244432 - RNA, 14 nt, Mycobacterium leprae
cuucaaccaagccg

SEQ ID NO: 1244433 - RNA, 20 nt, Mycobacterium leprae
cuucaacguugaagcggggg

SEQ ID NO: 1244434 - RNA, 17 nt, Mycobacterium leprae
cuuaaggcagaacugga

SEQ ID NO: 1244435 - RNA, 22 nt, Mycobacterium leprae
cuuaaucgccggcguugauuga

SEQ ID NO: 1244436 - RNA, 18 nt, Mycobacterium leprae
cuuaacgccaguugcauu

SEQ ID NO: 1244437 - RNA, 12 nt, Mycobacterium leprae
cuguuccucuug

SEQ ID NO: 1244438 - RNA, 21 nt, Mycobacterium leprae
cuuaaugaucgcguugaccaa

SEQ ID NO: 1244439 - RNA, 23 nt, Mycobacterium leprae
cuuaaugaucgcguugaccaaac

SEQ ID NO: 1244440 - RNA, 23 nt, Mycobacterium leprae
cuuaaugcaggaggugcagacuu

SEQ ID NO: 1244441 - RNA, 19 nt, Mycobacterium leprae
cuuagcgugagccuggcac

SEQ ID NO: 1244442 - RNA, 21 nt, Mycobacterium leprae
cuuagcgauguggcucaucuc

SEQ ID NO: 1244443 - RNA, 15 nt, Mycobacterium leprae
cuuagggcgauucga

SEQ ID NO: 1244444 - RNA, 14 nt, Mycobacterium leprae
cuuugcuggucagc

SEQ ID NO: 1244445 - RNA, 13 nt, Mycobacterium leprae
cuuugcuggcaag

SEQ ID NO: 1244446 - RNA, 15 nt, Mycobacterium leprae
cuuugcgguguggga

SEQ ID NO: 1244447 - RNA, 21 nt, Mycobacterium leprae
cuuuggagcaggagcuguugg

SEQ ID NO: 1244448 - RNA, 16 nt, Mycobacterium leprae
cuuugccgaauauggc

SEQ ID NO: 1244449 - RNA, 20 nt, Mycobacterium leprae
cuuugauccgcuggagcacc

SEQ ID NO: 1244450 - RNA, 15 nt, Mycobacterium leprae
cuuugaucagcaagg

SEQ ID NO: 1244451 - RNA, 16 nt, Mycobacterium leprae
cuugucgggcauugcc

SEQ ID NO: 1244452 - RNA, 22 nt, Mycobacterium leprae
cuuuagcuugguugacagcaga

SEQ ID NO: 1244453 - RNA, 21 nt, Mycobacterium leprae
cuuuacguauagcgaaaauaa

SEQ ID NO: 1244454 - RNA, 15 nt, Mycobacterium leprae
cuuuauucuuuuaga

SEQ ID NO: 1244455 - RNA, 19 nt, Mycobacterium leprae
cuuucacugcgucaaagcu

SEQ ID NO: 1244456 - RNA, 18 nt, Mycobacterium leprae
cuugcugucguaacacca

SEQ ID NO: 1244457 - RNA, 19 nt, Mycobacterium leprae
cuuggcacaacaagagaag

SEQ ID NO: 1244458 - RNA, 18 nt, Mycobacterium leprae
cuuggcgcugagcagucc

SEQ ID NO: 1244459 - RNA, 15 nt, Mycobacterium leprae
cuuggcgcauugguc

SEQ ID NO: 1244460 - RNA, 15 nt, Mycobacterium leprae
cuugguuuguaggcc

SEQ ID NO: 1244461 - RNA, 21 nt, Mycobacterium leprae
cuuggucaaggugaaacuccc

SEQ ID NO: 1244462 - RNA, 13 nt, Mycobacterium leprae
cuuggcuugcugu

SEQ ID NO: 1244463 - RNA, 18 nt, Mycobacterium leprae
cuugggcacaaugggugu

SEQ ID NO: 1244464 - RNA, 18 nt, Mycobacterium leprae
cuugccaaggucguuagc

SEQ ID NO: 1244465 - RNA, 18 nt, Mycobacterium leprae
cuugccgaagccgggacc

SEQ ID NO: 1244466 - RNA, 17 nt, Mycobacterium leprae
cuugccgaagcucuggc

SEQ ID NO: 1244467 - RNA, 19 nt, Mycobacterium leprae
cuugcaaaacgucgaucuc

SEQ ID NO: 1244468 - RNA, 18 nt, Mycobacterium leprae
cuugacggucgagcugga

SEQ ID NO: 1244469 - RNA, 22 nt, Mycobacterium leprae
cuucuuuucgagggcagcgcuc

SEQ ID NO: 1244470 - RNA, 15 nt, Mycobacterium leprae
cuugaccaccaccgc

SEQ ID NO: 1244471 - RNA, 22 nt, Mycobacterium leprae
cuugaccaccgaaccgggcagc

SEQ ID NO: 1244472 - RNA, 13 nt, Mycobacterium leprae
cuugaaguguugu

SEQ ID NO: 1244473 - RNA, 16 nt, Mycobacterium leprae
cuugaccagugugccu

SEQ ID NO: 1244474 - RNA, 16 nt, Mycobacterium leprae
cuugaccgucaugcug

SEQ ID NO: 1244475 - RNA, 19 nt, Mycobacterium leprae
cuguguugcgggguuuuug

SEQ ID NO: 1244476 - RNA, 14 nt, Mycobacterium leprae
cuguguuguuggga

SEQ ID NO: 1244477 - RNA, 15 nt, Mycobacterium leprae
cugugggcagugccu

SEQ ID NO: 1244478 - RNA, 19 nt, Mycobacterium leprae
cugugggguauugugcgga

SEQ ID NO: 1244479 - RNA, 22 nt, Mycobacterium leprae
cugugggucgacccgguggugu

SEQ ID NO: 1244480 - RNA, 16 nt, Mycobacterium leprae
cuguggcagagacggu

SEQ ID NO: 1244481 - RNA, 15 nt, Mycobacterium leprae
cuguguacgaagccu

SEQ ID NO: 1244482 - RNA, 21 nt, Mycobacterium leprae
cuguguacgaagccugagacc

SEQ ID NO: 1244483 - RNA, 21 nt, Mycobacterium leprae
cugugcgagaguacggagcca

SEQ ID NO: 1244484 - RNA, 17 nt, Mycobacterium leprae
cugugcuaaccgggcca

SEQ ID NO: 1244485 - RNA, 19 nt, Mycobacterium leprae
cugugccugcauucuccug

SEQ ID NO: 1244486 - RNA, 24 nt, Mycobacterium leprae
cugugcgaaaacacuuacaccaac

SEQ ID NO: 1244487 - RNA, 19 nt, Mycobacterium leprae
cugugcaaauacgcgcgcu

SEQ ID NO: 1244488 - RNA, 12 nt, Mycobacterium leprae
cugugcacgugc

SEQ ID NO: 1244489 - RNA, 13 nt, Mycobacterium leprae
cugugccagcucg

SEQ ID NO: 1244490 - RNA, 13 nt, Mycobacterium leprae
cugucgaaaaccu

SEQ ID NO: 1244491 - RNA, 21 nt, Mycobacterium leprae
cuguccgucagcgugcuccag

SEQ ID NO: 1244492 - RNA, 22 nt, Mycobacterium leprae
cuguauggcuccaaguggcugc

SEQ ID NO: 1244493 - RNA, 17 nt, Mycobacterium leprae
cuguaucuugguagacg

SEQ ID NO: 1244494 - RNA, 16 nt, Mycobacterium leprae
cuguagggaaucggca

SEQ ID NO: 1244495 - RNA, 15 nt, Mycobacterium leprae
cugguguggacagcg

SEQ ID NO: 1244496 - RNA, 20 nt, Mycobacterium leprae
cuggugugcgcgccgcccag

SEQ ID NO: 1244497 - RNA, 22 nt, Mycobacterium leprae
cugguguuuugacgccucagcc

SEQ ID NO: 1244498 - RNA, 20 nt, Mycobacterium leprae
cugguucagccauucuaggu

SEQ ID NO: 1244499 - RNA, 16 nt, Mycobacterium leprae
cugguucagccauucu

SEQ ID NO: 1244500 - RNA, 20 nt, Mycobacterium leprae
cugguuguccacggcagcua

SEQ ID NO: 1244501 - RNA, 23 nt, Mycobacterium leprae
cugguuuggguuugggugguggu

SEQ ID NO: 1244502 - RNA, 17 nt, Mycobacterium leprae
cuggguagcaggacgca

SEQ ID NO: 1244503 - RNA, 21 nt, Mycobacterium leprae
cugguggauccaggugcugca

SEQ ID NO: 1244504 - RNA, 16 nt, Mycobacterium leprae
cugguggcaacgcugc

SEQ ID NO: 1244505 - RNA, 12 nt, Mycobacterium leprae
cugguggcaagu

SEQ ID NO: 1244506 - RNA, 22 nt, Mycobacterium leprae
cugguggcagccacagcgacgg

SEQ ID NO: 1244507 - RNA, 15 nt, Mycobacterium leprae
cugguggccgagguc

SEQ ID NO: 1244508 - RNA, 22 nt, Mycobacterium leprae
cugguggggugugggugguuga

SEQ ID NO: 1244509 - RNA, 15 nt, Mycobacterium leprae
cuggugucgcagcgu

SEQ ID NO: 1244510 - RNA, 16 nt, Mycobacterium leprae
cuggugguggccucgu

SEQ ID NO: 1244511 - RNA, 15 nt, Mycobacterium leprae
cugggauagaccgcc

SEQ ID NO: 1244512 - RNA, 22 nt, Mycobacterium leprae
cugggauagcugugcaggagag

SEQ ID NO: 1244513 - RNA, 22 nt, Mycobacterium leprae
cugggcagccgagguucccggc

SEQ ID NO: 1244514 - RNA, 15 nt, Mycobacterium leprae
cugggcucauagcua

SEQ ID NO: 1244515 - RNA, 15 nt, Mycobacterium leprae
cugggccgggcugcu

SEQ ID NO: 1244516 - RNA, 22 nt, Mycobacterium leprae
cugggcggcuagucggccggcu

SEQ ID NO: 1244517 - RNA, 15 nt, Mycobacterium leprae
cuggcgugcaucccu

SEQ ID NO: 1244518 - RNA, 14 nt, Mycobacterium leprae
cuggcugcugcaga

SEQ ID NO: 1244519 - RNA, 14 nt, Mycobacterium leprae
cuggcugcgccggc

SEQ ID NO: 1244520 - RNA, 14 nt, Mycobacterium leprae
cuggcugccgccac

SEQ ID NO: 1244521 - RNA, 15 nt, Mycobacterium leprae
cuggcuucucuaucu

SEQ ID NO: 1244522 - RNA, 19 nt, Mycobacterium leprae
cuggcuucucuaucuugag

SEQ ID NO: 1244523 - RNA, 13 nt, Mycobacterium leprae
cuggcuuccucuc

SEQ ID NO: 1244524 - RNA, 16 nt, Mycobacterium leprae
cuggaucagcgcgcca

SEQ ID NO: 1244525 - RNA, 15 nt, Mycobacterium leprae
cugcuucggccagcg

SEQ ID NO: 1244526 - RNA, 15 nt, Mycobacterium leprae
cugcuuacucgcgcc

SEQ ID NO: 1244527 - RNA, 23 nt, Mycobacterium leprae
cuggauuucagggcacacagcaa

SEQ ID NO: 1244528 - RNA, 15 nt, Mycobacterium leprae
cuggauuaauauuua

SEQ ID NO: 1244529 - RNA, 12 nt, Mycobacterium leprae
cuggauggcgcu

SEQ ID NO: 1244530 - RNA, 15 nt, Mycobacterium leprae
cuggaucuguauuaa

SEQ ID NO: 1244531 - RNA, 13 nt, Mycobacterium leprae
cuggcgaacaaca

SEQ ID NO: 1244532 - RNA, 20 nt, Mycobacterium leprae
cuggccgggaucggcggcac

SEQ ID NO: 1244533 - RNA, 16 nt, Mycobacterium leprae
cuggccggggccaagc

SEQ ID NO: 1244534 - RNA, 14 nt, Mycobacterium leprae
cuggccgccgggcg

SEQ ID NO: 1244535 - RNA, 13 nt, Mycobacterium leprae
cuggcacgccagc

SEQ ID NO: 1244536 - RNA, 15 nt, Mycobacterium leprae
cugcucggccagagc

SEQ ID NO: 1244537 - RNA, 23 nt, Mycobacterium leprae
cugcugaccgggguucaaucucu

SEQ ID NO: 1244538 - RNA, 14 nt, Mycobacterium leprae
cugcuccugagaca

SEQ ID NO: 1244539 - RNA, 16 nt, Mycobacterium leprae
cugcugcgcaagguug

SEQ ID NO: 1244540 - RNA, 18 nt, Mycobacterium leprae
cugcugagcguggcugcu

SEQ ID NO: 1244541 - RNA, 15 nt, Mycobacterium leprae
cugcugcacccggcg

SEQ ID NO: 1244542 - RNA, 14 nt, Mycobacterium leprae
cugcugcuggugga

SEQ ID NO: 1244543 - RNA, 13 nt, Mycobacterium leprae
cugcugguucuug

SEQ ID NO: 1244544 - RNA, 15 nt, Mycobacterium leprae
cugcugguucuuggc

SEQ ID NO: 1244545 - RNA, 14 nt, Mycobacterium leprae
cugcuguucaugcc

SEQ ID NO: 1244546 - RNA, 17 nt, Mycobacterium leprae
cugcuguguuugcuggu

SEQ ID NO: 1244547 - RNA, 23 nt, Mycobacterium leprae
cugccuugaugagaucacugagu

SEQ ID NO: 1244548 - RNA, 22 nt, Mycobacterium leprae
cugccgccacagcaagucgccu

SEQ ID NO: 1244549 - RNA, 15 nt, Mycobacterium leprae
cugcgacgucccaag

SEQ ID NO: 1244550 - RNA, 15 nt, Mycobacterium leprae
cugcgauccggcaca

SEQ ID NO: 1244551 - RNA, 20 nt, Mycobacterium leprae
cugcgcaauacggugcacca

SEQ ID NO: 1244552 - RNA, 19 nt, Mycobacterium leprae
cugcgcaccugccacggcc

SEQ ID NO: 1244553 - RNA, 18 nt, Mycobacterium leprae
cugcgccggggauuucag

SEQ ID NO: 1244554 - RNA, 17 nt, Mycobacterium leprae
cugcggcugcugugcga

SEQ ID NO: 1244555 - RNA, 20 nt, Mycobacterium leprae
cugcguauagugguucugcu

SEQ ID NO: 1244556 - RNA, 20 nt, Mycobacterium leprae
cugaugcugccuagaugaug

SEQ ID NO: 1244557 - RNA, 16 nt, Mycobacterium leprae
cugaugcuguguggcu

SEQ ID NO: 1244558 - RNA, 14 nt, Mycobacterium leprae
cugauggccgccag

SEQ ID NO: 1244559 - RNA, 18 nt, Mycobacterium leprae
cugaugcggucaugcguc

SEQ ID NO: 1244560 - RNA, 17 nt, Mycobacterium leprae
cugauggggggugugau

SEQ ID NO: 1244561 - RNA, 17 nt, Mycobacterium leprae
cugcacacugacuugca

SEQ ID NO: 1244562 - RNA, 17 nt, Mycobacterium leprae
cugcaacgacuggauga

SEQ ID NO: 1244563 - RNA, 18 nt, Mycobacterium leprae
cugcagcauaacccgauc

SEQ ID NO: 1244564 - RNA, 18 nt, Mycobacterium leprae
cugcagcaacagccacac

SEQ ID NO: 1244565 - RNA, 17 nt, Mycobacterium leprae
cugcaccuguugcucaa

SEQ ID NO: 1244566 - RNA, 16 nt, Mycobacterium leprae
cugcaccgagcgaccu

SEQ ID NO: 1244567 - RNA, 13 nt, Mycobacterium leprae
cugcacccggcgg

SEQ ID NO: 1244568 - RNA, 18 nt, Mycobacterium leprae
cugcacccggcggcaugc

SEQ ID NO: 1244569 - RNA, 16 nt, Mycobacterium leprae
cugcacccgucgcuga

SEQ ID NO: 1244570 - RNA, 15 nt, Mycobacterium leprae
cugccaaaguccaug

SEQ ID NO: 1244571 - RNA, 16 nt, Mycobacterium leprae
cugccaaucagcacuc

SEQ ID NO: 1244572 - RNA, 13 nt, Mycobacterium leprae
cugcauucugcug

SEQ ID NO: 1244573 - RNA, 22 nt, Mycobacterium leprae
cugcagccgaucggcugccgcg

SEQ ID NO: 1244574 - RNA, 22 nt, Mycobacterium leprae
cugcagcauuggcuccugggaa

SEQ ID NO: 1244575 - RNA, 17 nt, Mycobacterium leprae
cugcagcuaaucccaug

SEQ ID NO: 1244576 - RNA, 21 nt, Mycobacterium leprae
cugccagcuauccccgaucgc

SEQ ID NO: 1244577 - RNA, 20 nt, Mycobacterium leprae
cugccacauguuuccggcaa

SEQ ID NO: 1244578 - RNA, 18 nt, Mycobacterium leprae
cugagagcagauggugca

SEQ ID NO: 1244579 - RNA, 17 nt, Mycobacterium leprae
cugagacaucgccaccg

SEQ ID NO: 1244580 - RNA, 15 nt, Mycobacterium leprae
cugagcaauuucuuc

SEQ ID NO: 1244581 - RNA, 15 nt, Mycobacterium leprae
cugagcgcgaacaga

SEQ ID NO: 1244582 - RNA, 12 nt, Mycobacterium leprae
cugagcgggcca

SEQ ID NO: 1244583 - RNA, 22 nt, Mycobacterium leprae
cugagcgggccagcaccaaccu

SEQ ID NO: 1244584 - RNA, 23 nt, Mycobacterium leprae
cugacucgacauagaacauccgc

SEQ ID NO: 1244585 - RNA, 20 nt, Mycobacterium leprae
cugacgccgauuguuacuga

SEQ ID NO: 1244586 - RNA, 22 nt, Mycobacterium leprae
cugaauggucauuggaagcuga

SEQ ID NO: 1244587 - RNA, 20 nt, Mycobacterium leprae
cugaauucagccgugcccaa

SEQ ID NO: 1244588 - RNA, 15 nt, Mycobacterium leprae
cugacaucaagccuc

SEQ ID NO: 1244589 - RNA, 22 nt, Mycobacterium leprae
cugacaucaagccuccagaauc

SEQ ID NO: 1244590 - RNA, 19 nt, Mycobacterium leprae
cugacaccgcaguugaucc

SEQ ID NO: 1244591 - RNA, 16 nt, Mycobacterium leprae
cugacagacauggcug

SEQ ID NO: 1244592 - RNA, 18 nt, Mycobacterium leprae
cugacagacauggcugua

SEQ ID NO: 1244593 - RNA, 22 nt, Mycobacterium leprae
cugaacuggaucggucagccac

SEQ ID NO: 1244594 - RNA, 16 nt, Mycobacterium leprae
cugaacaggcgccuga

SEQ ID NO: 1244595 - RNA, 17 nt, Mycobacterium leprae
cugaacgagaagcagcu

SEQ ID NO: 1244596 - RNA, 15 nt, Mycobacterium leprae
cugaaaacagcgccu

SEQ ID NO: 1244597 - RNA, 22 nt, Mycobacterium leprae
cucugucgacgggaaguggugg

SEQ ID NO: 1244598 - RNA, 13 nt, Mycobacterium leprae
cucuguucaggcc

SEQ ID NO: 1244599 - RNA, 15 nt, Mycobacterium leprae
cucuuaacaacuuga

SEQ ID NO: 1244600 - RNA, 14 nt, Mycobacterium leprae
cucuuccgagccga

SEQ ID NO: 1244601 - RNA, 23 nt, Mycobacterium leprae
cucugaggucaccggccaccggc

SEQ ID NO: 1244602 - RNA, 22 nt, Mycobacterium leprae
cucugguaacggaccuggcaaa

SEQ ID NO: 1244603 - RNA, 15 nt, Mycobacterium leprae
cucugcuggaucugu

SEQ ID NO: 1244604 - RNA, 20 nt, Mycobacterium leprae
cucuagcuggucccacagcc

SEQ ID NO: 1244605 - RNA, 15 nt, Mycobacterium leprae
cucuagauaacuauu

SEQ ID NO: 1244606 - RNA, 22 nt, Mycobacterium leprae
cucguggguuaaagucaugccc

SEQ ID NO: 1244607 - RNA, 13 nt, Mycobacterium leprae
cucggugcgagga

SEQ ID NO: 1244608 - RNA, 15 nt, Mycobacterium leprae
cucgucggccagcac

SEQ ID NO: 1244609 - RNA, 22 nt, Mycobacterium leprae
cucgguaucgucaaauuuuccg

SEQ ID NO: 1244610 - RNA, 22 nt, Mycobacterium leprae
cucggucaccccgagcucggcc

SEQ ID NO: 1244611 - RNA, 17 nt, Mycobacterium leprae
cucggcgguaccgucua

SEQ ID NO: 1244612 - RNA, 18 nt, Mycobacterium leprae
cucggcgguaccgucuag

SEQ ID NO: 1244613 - RNA, 21 nt, Mycobacterium leprae
cucgacgacguuaucuugaug

SEQ ID NO: 1244614 - RNA, 15 nt, Mycobacterium leprae
cucgaaccgauccag

SEQ ID NO: 1244615 - RNA, 17 nt, Mycobacterium leprae
cucgaaacgcgaagcac

SEQ ID NO: 1244616 - RNA, 16 nt, Mycobacterium leprae
cuccuuuucgccggcg

SEQ ID NO: 1244617 - RNA, 18 nt, Mycobacterium leprae
cuccuguuucaauucacc

SEQ ID NO: 1244618 - RNA, 15 nt, Mycobacterium leprae
cuccuucaugcuggc

SEQ ID NO: 1244619 - RNA, 21 nt, Mycobacterium leprae
cuccuucaugcuggccuccag

SEQ ID NO: 1244620 - RNA, 14 nt, Mycobacterium leprae
cuccuggcgagugg

SEQ ID NO: 1244621 - RNA, 12 nt, Mycobacterium leprae
cucgaugacacg

SEQ ID NO: 1244622 - RNA, 13 nt, Mycobacterium leprae
cucgagcggcgca

SEQ ID NO: 1244623 - RNA, 13 nt, Mycobacterium leprae
cucgagcuugccc

SEQ ID NO: 1244624 - RNA, 22 nt, Mycobacterium leprae
cucgaggaagcgcagcucgcca

SEQ ID NO: 1244625 - RNA, 17 nt, Mycobacterium leprae
cuccgcuauaagugugg

SEQ ID NO: 1244626 - RNA, 19 nt, Mycobacterium leprae
cuccgugaugaacuucgga

SEQ ID NO: 1244627 - RNA, 19 nt, Mycobacterium leprae
cuccucaacucuucugcug

SEQ ID NO: 1244628 - RNA, 19 nt, Mycobacterium leprae
cuccguggcccaaaccguu

SEQ ID NO: 1244629 - RNA, 18 nt, Mycobacterium leprae
cuccgccguuuuaccccg

SEQ ID NO: 1244630 - RNA, 19 nt, Mycobacterium leprae
cuccgcgcacaguguggcc

SEQ ID NO: 1244631 - RNA, 18 nt, Mycobacterium leprae
cuccgaagcagccaaugc

SEQ ID NO: 1244632 - RNA, 15 nt, Mycobacterium leprae
cuccccgcccaaggc

SEQ ID NO: 1244633 - RNA, 15 nt, Mycobacterium leprae
cucaguuaucccacg

SEQ ID NO: 1244634 - RNA, 22 nt, Mycobacterium leprae
cucaguuaucccacgcugacgu

SEQ ID NO: 1244635 - RNA, 14 nt, Mycobacterium leprae
cucagugaucaggu

SEQ ID NO: 1244636 - RNA, 15 nt, Mycobacterium leprae
cucauucucugccuu

SEQ ID NO: 1244637 - RNA, 15 nt, Mycobacterium leprae
cucauugagccacgu

SEQ ID NO: 1244638 - RNA, 15 nt, Mycobacterium leprae
cucauuguggcuggc

SEQ ID NO: 1244639 - RNA, 11 nt, Mycobacterium leprae
cuccaagguua

SEQ ID NO: 1244640 - RNA, 17 nt, Mycobacterium leprae
cucaugacuuauaguca

SEQ ID NO: 1244641 - RNA, 17 nt, Mycobacterium leprae
cuauugacgguaacuga

SEQ ID NO: 1244642 - RNA, 15 nt, Mycobacterium leprae
cucacggccaccaua

SEQ ID NO: 1244643 - RNA, 19 nt, Mycobacterium leprae
cucacccgcgccgccugcu

SEQ ID NO: 1244644 - RNA, 22 nt, Mycobacterium leprae
cucacccgcgccgccugcugca

SEQ ID NO: 1244645 - RNA, 16 nt, Mycobacterium leprae
cucacccgcagcaccu

SEQ ID NO: 1244646 - RNA, 15 nt, Mycobacterium leprae
cucacaauugacaac

SEQ ID NO: 1244647 - RNA, 14 nt, Mycobacterium leprae
cucacacucacgcc

SEQ ID NO: 1244648 - RNA, 17 nt, Mycobacterium leprae
cucacacucacgccugc

SEQ ID NO: 1244649 - RNA, 22 nt, Mycobacterium leprae
cucacccaugccucuagcaagg

SEQ ID NO: 1244650 - RNA, 23 nt, Mycobacterium leprae
cuauagcgucgaagaaucuugaa

SEQ ID NO: 1244651 - RNA, 13 nt, Mycobacterium leprae
cuaucauagccac

SEQ ID NO: 1244652 - RNA, 14 nt, Mycobacterium leprae
cuaucaagccacac

SEQ ID NO: 1244653 - RNA, 15 nt, Mycobacterium leprae
cuaucacgaauucca

SEQ ID NO: 1244654 - RNA, 23 nt, Mycobacterium leprae
cuaugauuucaucugccaggcgc

SEQ ID NO: 1244655 - RNA, 16 nt, Mycobacterium leprae
cuauguccaacaaggu

SEQ ID NO: 1244656 - RNA, 16 nt, Mycobacterium leprae
cuaugcagugagcagu

SEQ ID NO: 1244657 - RNA, 17 nt, Mycobacterium leprae
cuauguuggccagcagc

SEQ ID NO: 1244658 - RNA, 22 nt, Mycobacterium leprae
cuaggucgguaaaugccucgcu

SEQ ID NO: 1244659 - RNA, 15 nt, Mycobacterium leprae
cuaggguuggauggu

SEQ ID NO: 1244660 - RNA, 17 nt, Mycobacterium leprae
cuagguaccccagucga

SEQ ID NO: 1244661 - RNA, 17 nt, Mycobacterium leprae
cuagggaugugaccauu

SEQ ID NO: 1244662 - RNA, 20 nt, Mycobacterium leprae
cuaguggucgauuacucacg

SEQ ID NO: 1244663 - RNA, 14 nt, Mycobacterium leprae
cuagauugguccaa

SEQ ID NO: 1244664 - RNA, 23 nt, Mycobacterium leprae
cuagaugggcgacaaugugucag

SEQ ID NO: 1244665 - RNA, 23 nt, Mycobacterium leprae
cuaggcgccaguucggcaguccu

SEQ ID NO: 1244666 - RNA, 16 nt, Mycobacterium leprae
cuagcuguccaauguc

SEQ ID NO: 1244667 - RNA, 22 nt, Mycobacterium leprae
cuagcguaaggaccaaccgcgc

SEQ ID NO: 1244668 - RNA, 13 nt, Mycobacterium leprae
cuagacuuuugcu

SEQ ID NO: 1244669 - RNA, 12 nt, Mycobacterium leprae
cuacuugcgcuc

SEQ ID NO: 1244670 - RNA, 22 nt, Mycobacterium leprae
cuacugcgacagcagccacuga

SEQ ID NO: 1244671 - RNA, 16 nt, Mycobacterium leprae
cuaccgagcucugguc

SEQ ID NO: 1244672 - RNA, 20 nt, Mycobacterium leprae
cuaccccgcggcgcuaacaa

SEQ ID NO: 1244673 - RNA, 22 nt, Mycobacterium leprae
cuacccacuggugguggccucg

SEQ ID NO: 1244674 - RNA, 16 nt, Mycobacterium leprae
cuaaaucuggccaacg

SEQ ID NO: 1244675 - RNA, 12 nt, Mycobacterium leprae
cuaaauauuaau

SEQ ID NO: 1244676 - RNA, 21 nt, Mycobacterium leprae
cuaauaaaguguuaugagaua

SEQ ID NO: 1244677 - RNA, 19 nt, Mycobacterium leprae
cuaauggcgggcuggagga

SEQ ID NO: 1244678 - RNA, 21 nt, Mycobacterium leprae
cuaauauagacuaugaagacc

SEQ ID NO: 1244679 - RNA, 19 nt, Mycobacterium leprae
cuaaucgcgggcaagcccu

SEQ ID NO: 1244680 - RNA, 18 nt, Mycobacterium leprae
cuaauugcgaugcacuga

SEQ ID NO: 1244681 - RNA, 13 nt, Mycobacterium leprae
cuacauguugaug

SEQ ID NO: 1244682 - RNA, 23 nt, Mycobacterium leprae
cuaccagggucggccgggcuacc

SEQ ID NO: 1244683 - RNA, 16 nt, Mycobacterium leprae
cuaccauuauuucguc

SEQ ID NO: 1244684 - RNA, 14 nt, Mycobacterium leprae
cuaaagugcugcug

SEQ ID NO: 1244685 - RNA, 21 nt, Mycobacterium leprae
cguuucucauucucugccuug

SEQ ID NO: 1244686 - RNA, 20 nt, Mycobacterium leprae
cguuuuggcguaccuggguu

SEQ ID NO: 1244687 - RNA, 16 nt, Mycobacterium leprae
cguugcuaaaaccacc

SEQ ID NO: 1244688 - RNA, 23 nt, Mycobacterium leprae
cguugucgaaaugcauuggauga

SEQ ID NO: 1244689 - RNA, 22 nt, Mycobacterium leprae
cguugucggcuccuccagcauc

SEQ ID NO: 1244690 - RNA, 16 nt, Mycobacterium leprae
cguugugccauuggcu

SEQ ID NO: 1244691 - RNA, 13 nt, Mycobacterium leprae
cguugugcgguga

SEQ ID NO: 1244692 - RNA, 23 nt, Mycobacterium leprae
cguugugcggugagagcuuccaa

SEQ ID NO: 1244693 - RNA, 12 nt, Mycobacterium leprae
cguuccugagug

SEQ ID NO: 1244694 - RNA, 22 nt, Mycobacterium leprae
cguuccugagugugaugccgaa

SEQ ID NO: 1244695 - RNA, 14 nt, Mycobacterium leprae
cguuccuggcuggc

SEQ ID NO: 1244696 - RNA, 19 nt, Mycobacterium leprae
cguucggggugucaacagc

SEQ ID NO: 1244697 - RNA, 22 nt, Mycobacterium leprae
cguucggcuacugcgacagcag

SEQ ID NO: 1244698 - RNA, 15 nt, Mycobacterium leprae
cguugagcugcaugu

SEQ ID NO: 1244699 - RNA, 16 nt, Mycobacterium leprae
cguugagcgcagccac

SEQ ID NO: 1244700 - RNA, 21 nt, Mycobacterium leprae
cguugaugaauuugccgcgag

SEQ ID NO: 1244701 - RNA, 18 nt, Mycobacterium leprae
cguugauuuccgcggcga

SEQ ID NO: 1244702 - RNA, 21 nt, Mycobacterium leprae
cguugauguuugcaucagcac

SEQ ID NO: 1244703 - RNA, 18 nt, Mycobacterium leprae
cguugcaaaucaccagcg

SEQ ID NO: 1244704 - RNA, 20 nt, Mycobacterium leprae
cguugcauucgacggagcgc

SEQ ID NO: 1244705 - RNA, 15 nt, Mycobacterium leprae
cguugccguccccuc

SEQ ID NO: 1244706 - RNA, 17 nt, Mycobacterium leprae
aaaaaaaugaauguguu

SEQ ID NO: 1244707 - RNA, 20 nt, Mycobacterium leprae
aaaaacagcgugaauuacuc

SEQ ID NO: 1244708 - RNA, 19 nt, Mycobacterium leprae
aaaaauccgcgcaacaccc

SEQ ID NO: 1244709 - RNA, 13 nt, Mycobacterium leprae
aaaacguccagua

SEQ ID NO: 1244710 - RNA, 15 nt, Mycobacterium leprae
aaaacucaugcaaga

SEQ ID NO: 1244711 - RNA, 12 nt, Mycobacterium leprae
aaaauccuccca

SEQ ID NO: 1244712 - RNA, 19 nt, Mycobacterium leprae
aaaauagcugccaagcuga

SEQ ID NO: 1244713 - RNA, 21 nt, Mycobacterium leprae
aaaauuuucuugugaguuguc

SEQ ID NO: 1244714 - RNA, 12 nt, Mycobacterium leprae
aaaauucaugcc

SEQ ID NO: 1244715 - RNA, 20 nt, Mycobacterium leprae
aaaauuccuacccucucagc

SEQ ID NO: 1244716 - RNA, 14 nt, Mycobacterium leprae
aaaauccuucaugu

SEQ ID NO: 1244717 - RNA, 23 nt, Mycobacterium leprae
aaaaucguccgcguaaccaacua

SEQ ID NO: 1244718 - RNA, 14 nt, Mycobacterium leprae
aaaaugcugcacug

SEQ ID NO: 1244719 - RNA, 23 nt, Mycobacterium leprae
aaaugccuacccuagagucgacc

SEQ ID NO: 1244720 - RNA, 17 nt, Mycobacterium leprae
aaaucuucaauuuucca

SEQ ID NO: 1244721 - RNA, 17 nt, Mycobacterium leprae
aaaucaucgcugccauc

SEQ ID NO: 1244722 - RNA, 19 nt, Mycobacterium leprae
aaaucguucgaccagauga

SEQ ID NO: 1244723 - RNA, 13 nt, Mycobacterium leprae
aaauguucaacau

SEQ ID NO: 1244724 - RNA, 21 nt, Mycobacterium leprae
aaauuacguuuaccgauucgg

SEQ ID NO: 1244725 - RNA, 16 nt, Mycobacterium leprae
aaauuccuacccucuc

SEQ ID NO: 1244726 - RNA, 22 nt, Mycobacterium leprae
aaauucgcgcuacgauuuugca

SEQ ID NO: 1244727 - RNA, 16 nt, Mycobacterium leprae
aaauagcugccaagcu

SEQ ID NO: 1244728 - RNA, 17 nt, Mycobacterium leprae
aaagucgcgggcuugcu

SEQ ID NO: 1244729 - RNA, 13 nt, Mycobacterium leprae
aaauaguggcuga

SEQ ID NO: 1244730 - RNA, 12 nt, Mycobacterium leprae
aaaucagacugc

SEQ ID NO: 1244731 - RNA, 15 nt, Mycobacterium leprae
aaagucaccugucau

SEQ ID NO: 1244732 - RNA, 20 nt, Mycobacterium leprae
aaagggaccgggcucuuucu

SEQ ID NO: 1244733 - RNA, 23 nt, Mycobacterium leprae
aaaggaacgacggauaaguccac

SEQ ID NO: 1244734 - RNA, 18 nt, Mycobacterium leprae
aaagcuggcgaacaacaa

SEQ ID NO: 1244735 - RNA, 19 nt, Mycobacterium leprae
aaagcuggcgaacaacaaa

SEQ ID NO: 1244736 - RNA, 18 nt, Mycobacterium leprae
aaacugccgguagccugg

SEQ ID NO: 1244737 - RNA, 14 nt, Mycobacterium leprae
aaacuuaauaucuu

SEQ ID NO: 1244738 - RNA, 18 nt, Mycobacterium leprae
aaacuacuguugucagug

SEQ ID NO: 1244739 - RNA, 21 nt, Mycobacterium leprae
aaaccuuacagucacuauaau

SEQ ID NO: 1244740 - RNA, 13 nt, Mycobacterium leprae
aaacgagauugcc

SEQ ID NO: 1244741 - RNA, 21 nt, Mycobacterium leprae
aaggagcggugguacaauccc

SEQ ID NO: 1244742 - RNA, 22 nt, Mycobacterium leprae
aagcugcgcaccugccacggcc

SEQ ID NO: 1244743 - RNA, 19 nt, Mycobacterium leprae
aagcuguagcccggagugc

SEQ ID NO: 1244744 - RNA, 23 nt, Mycobacterium leprae
aagcuuacuuggucaaggugaaa

SEQ ID NO: 1244745 - RNA, 17 nt, Mycobacterium leprae
aagcugaugacaguaag

SEQ ID NO: 1244746 - RNA, 20 nt, Mycobacterium leprae
aagcugaugacaguaaguag

SEQ ID NO: 1244747 - RNA, 14 nt, Mycobacterium leprae
aagcgugagggcgg

SEQ ID NO: 1244748 - RNA, 13 nt, Mycobacterium leprae
aagcugaaagcuu

SEQ ID NO: 1244749 - RNA, 15 nt, Mycobacterium leprae
aagcgcuaugccauc

SEQ ID NO: 1244750 - RNA, 21 nt, Mycobacterium leprae
aaggcgccaaacuugcacuga

SEQ ID NO: 1244751 - RNA, 21 nt, Mycobacterium leprae
aaggcgcgguaucucaauccg

SEQ ID NO: 1244752 - RNA, 16 nt, Mycobacterium leprae
aaggcggagaugugga

SEQ ID NO: 1244753 - RNA, 16 nt, Mycobacterium leprae
aaggcgucaagcagca

SEQ ID NO: 1244754 - RNA, 19 nt, Mycobacterium leprae
aagggacgacgugccgcag

SEQ ID NO: 1244755 - RNA, 18 nt, Mycobacterium leprae
aagggauuccacugccag

SEQ ID NO: 1244756 - RNA, 20 nt, Mycobacterium leprae
aaggguggugggucagugua

SEQ ID NO: 1244757 - RNA, 15 nt, Mycobacterium leprae
aaggucgcgcugccg

SEQ ID NO: 1244758 - RNA, 13 nt, Mycobacterium leprae
aaggucaucuacc

SEQ ID NO: 1244759 - RNA, 13 nt, Mycobacterium leprae
aaggugacaagua

SEQ ID NO: 1244760 - RNA, 14 nt, Mycobacterium leprae
aagguaagcuugca

SEQ ID NO: 1244761 - RNA, 15 nt, Mycobacterium leprae
aagguguugcgguga

SEQ ID NO: 1244762 - RNA, 16 nt, Mycobacterium leprae
aagguggugagcaccu

SEQ ID NO: 1244763 - RNA, 14 nt, Mycobacterium leprae
aaggugaaacuccc

SEQ ID NO: 1244764 - RNA, 14 nt, Mycobacterium leprae
aaggugaugacccg

SEQ ID NO: 1244765 - RNA, 15 nt, Mycobacterium leprae
aagguuguugacgau

SEQ ID NO: 1244766 - RNA, 20 nt, Mycobacterium leprae
aagcccacgccuagcuagcc

SEQ ID NO: 1244767 - RNA, 19 nt, Mycobacterium leprae
aagcaucuuaacgccaguu

SEQ ID NO: 1244768 - RNA, 22 nt, Mycobacterium leprae
aagcaguuccuguguugccauc

SEQ ID NO: 1244769 - RNA, 21 nt, Mycobacterium leprae
aagcagccaaugcugcagcug

SEQ ID NO: 1244770 - RNA, 21 nt, Mycobacterium leprae
aagcagcaccacagcgccaac

SEQ ID NO: 1244771 - RNA, 23 nt, Mycobacterium leprae
aagcacacgaagccucaucgaaa

SEQ ID NO: 1244772 - RNA, 18 nt, Mycobacterium leprae
aagcaaaaaauagcugcc

SEQ ID NO: 1244773 - RNA, 22 nt, Mycobacterium leprae
aagaugcagguguccuauaaaa

SEQ ID NO: 1244774 - RNA, 21 nt, Mycobacterium leprae
aagaugcugcguucagcgaag

SEQ ID NO: 1244775 - RNA, 12 nt, Mycobacterium leprae
aagauuccaaug

SEQ ID NO: 1244776 - RNA, 21 nt, Mycobacterium leprae
aauaaucacagccuccgaaaa

SEQ ID NO: 1244777 - RNA, 17 nt, Mycobacterium leprae
aauaacguuugcugcaa

SEQ ID NO: 1244778 - RNA, 22 nt, Mycobacterium leprae
aauaaccuucugcgaacacuga

SEQ ID NO: 1244779 - RNA, 12 nt, Mycobacterium leprae
aauaacuauaau

SEQ ID NO: 1244780 - RNA, 15 nt, Mycobacterium leprae
aauaauauccaaaga

SEQ ID NO: 1244781 - RNA, 16 nt, Mycobacterium leprae
aauaauauccaaagaa

SEQ ID NO: 1244782 - RNA, 19 nt, Mycobacterium leprae
aauacagguggcaucagau

SEQ ID NO: 1244783 - RNA, 19 nt, Mycobacterium leprae
aagugcaccaucugcucuc

SEQ ID NO: 1244784 - RNA, 24 nt, Mycobacterium leprae
aagucuugugcguagucgaccgga

SEQ ID NO: 1244785 - RNA, 17 nt, Mycobacterium leprae
aaguuugagaacagccu

SEQ ID NO: 1244786 - RNA, 19 nt, Mycobacterium leprae
aaguguagucuugaacuca

SEQ ID NO: 1244787 - RNA, 19 nt, Mycobacterium leprae
aaguucggccauggcagcc

SEQ ID NO: 1244788 - RNA, 15 nt, Mycobacterium leprae
aaguuuucucuaaaa

SEQ ID NO: 1244789 - RNA, 21 nt, Mycobacterium leprae
aaguuuucucuaaaagaauaa

SEQ ID NO: 1244790 - RNA, 16 nt, Mycobacterium leprae
aagaaguaaagcccug

SEQ ID NO: 1244791 - RNA, 22 nt, Mycobacterium leprae
aacuuggcacaacaagagaaga

SEQ ID NO: 1244792 - RNA, 14 nt, Mycobacterium leprae
aacugggugaccac

SEQ ID NO: 1244793 - RNA, 14 nt, Mycobacterium leprae
aacugguugaagcg

SEQ ID NO: 1244794 - RNA, 19 nt, Mycobacterium leprae
aacuuaguuuagagugcag

SEQ ID NO: 1244795 - RNA, 17 nt, Mycobacterium leprae
aacuugacgaugcugug

SEQ ID NO: 1244796 - RNA, 15 nt, Mycobacterium leprae
aacuucaaccaagcc

SEQ ID NO: 1244797 - RNA, 14 nt, Mycobacterium leprae
aacugcacuauaag

SEQ ID NO: 1244798 - RNA, 11 nt, Mycobacterium leprae
aacugcagguu

SEQ ID NO: 1244799 - RNA, 21 nt, Mycobacterium leprae
aacguuugcugcaaugccgga

SEQ ID NO: 1244800 - RNA, 17 nt, Mycobacterium leprae
aacguguuuaggaaaca

SEQ ID NO: 1244801 - RNA, 12 nt, Mycobacterium leprae
aacgugcugcug

SEQ ID NO: 1244802 - RNA, 15 nt, Mycobacterium leprae
aacguguaaggccag

SEQ ID NO: 1244803 - RNA, 22 nt, Mycobacterium leprae
aacuaagccgaguugaagugcu

SEQ ID NO: 1244804 - RNA, 22 nt, Mycobacterium leprae
aacuagucgcccggaauuuacc

SEQ ID NO: 1244805 - RNA, 17 nt, Mycobacterium leprae
aacuauugugccacaac

SEQ ID NO: 1244806 - RNA, 17 nt, Mycobacterium leprae
aacuacuggauuaauau

SEQ ID NO: 1244807 - RNA, 21 nt, Mycobacterium leprae
aacuacuggauuaauauuuag

SEQ ID NO: 1244808 - RNA, 17 nt, Mycobacterium leprae
aacuacgugugcucgcu

SEQ ID NO: 1244809 - RNA, 21 nt, Mycobacterium leprae
aacggggucgucggccaggcu

SEQ ID NO: 1244810 - RNA, 15 nt, Mycobacterium leprae
aacgguguugccauu

SEQ ID NO: 1244811 - RNA, 21 nt, Mycobacterium leprae
aacgguaucuccccagguuga

SEQ ID NO: 1244812 - RNA, 17 nt, Mycobacterium leprae
aacgcugauugccaacu

SEQ ID NO: 1244813 - RNA, 14 nt, Mycobacterium leprae
aacgcuucugccuc

SEQ ID NO: 1244814 - RNA, 13 nt, Mycobacterium leprae
aacgcugcccacc

SEQ ID NO: 1244815 - RNA, 19 nt, Mycobacterium leprae
aacgauaugagcuccacug

SEQ ID NO: 1244816 - RNA, 11 nt, Mycobacterium leprae
aacgccaggcg

SEQ ID NO: 1244817 - RNA, 17 nt, Mycobacterium leprae
aaccauccggcaaaaau

SEQ ID NO: 1244818 - RNA, 14 nt, Mycobacterium leprae
aaccauccagccua

SEQ ID NO: 1244819 - RNA, 22 nt, Mycobacterium leprae
aacccacuucggcacagugccu

SEQ ID NO: 1244820 - RNA, 23 nt, Mycobacterium leprae
aacccgugucgaccgacugcaga

SEQ ID NO: 1244821 - RNA, 19 nt, Mycobacterium leprae
aaccgauacgccagucagu

SEQ ID NO: 1244822 - RNA, 18 nt, Mycobacterium leprae
aaccgcgugugcacuccu

SEQ ID NO: 1244823 - RNA, 20 nt, Mycobacterium leprae
aaccgcucgauggccagccg

SEQ ID NO: 1244824 - RNA, 12 nt, Mycobacterium leprae
aaccgaagauca

SEQ ID NO: 1244825 - RNA, 17 nt, Mycobacterium leprae
aaccaagcuguuucugu

SEQ ID NO: 1244826 - RNA, 12 nt, Mycobacterium leprae
aaccaacuaggc

SEQ ID NO: 1244827 - RNA, 23 nt, Mycobacterium leprae
aaccaaaugcuaugauaauuugg

SEQ ID NO: 1244828 - RNA, 17 nt, Mycobacterium leprae
aacauguagaccaagca

SEQ ID NO: 1244829 - RNA, 20 nt, Mycobacterium leprae
aacagccgagcuugcugcuu

SEQ ID NO: 1244830 - RNA, 12 nt, Mycobacterium leprae
aacagcgcagug

SEQ ID NO: 1244831 - RNA, 22 nt, Mycobacterium leprae
aacagagcugauggccgccagg

SEQ ID NO: 1244832 - RNA, 17 nt, Mycobacterium leprae
aacagagucaaauucaa

SEQ ID NO: 1244833 - RNA, 16 nt, Mycobacterium leprae
aacagaaccuauucaa

SEQ ID NO: 1244834 - RNA, 21 nt, Mycobacterium leprae
aacagcauccucggcacagug

SEQ ID NO: 1244835 - RNA, 14 nt, Mycobacterium leprae
aacacgaucgcagc

SEQ ID NO: 1244836 - RNA, 22 nt, Mycobacterium leprae
aacacgucuagcgaacacacag

SEQ ID NO: 1244837 - RNA, 14 nt, Mycobacterium leprae
aacacuuacaccaa

SEQ ID NO: 1244838 - RNA, 15 nt, Mycobacterium leprae
aacacguuucugcau

SEQ ID NO: 1244839 - RNA, 17 nt, Mycobacterium leprae
aacacucauuggaccca

SEQ ID NO: 1244840 - RNA, 22 nt, Mycobacterium leprae
aacaccuuuuccaauucguaau

SEQ ID NO: 1244841 - RNA, 16 nt, Mycobacterium leprae
aacaccucaagcaaua

SEQ ID NO: 1244842 - RNA, 13 nt, Mycobacterium leprae
aacaccccacccg

SEQ ID NO: 1244843 - RNA, 17 nt, Mycobacterium leprae
aacaauaaucccgcucu

SEQ ID NO: 1244844 - RNA, 20 nt, Mycobacterium leprae
aaauucucgcgccaccgccg

SEQ ID NO: 1244845 - RNA, 14 nt, Mycobacterium leprae
aacaccagaucagc

SEQ ID NO: 1244846 - RNA, 18 nt, Mycobacterium leprae
aaucgagaauuuaccggc

SEQ ID NO: 1244847 - RNA, 15 nt, Mycobacterium leprae
aaucgagcacggcac

SEQ ID NO: 1244848 - RNA, 13 nt, Mycobacterium leprae
aaucgauccggcg

SEQ ID NO: 1244849 - RNA, 12 nt, Mycobacterium leprae
aaucgaguucug

SEQ ID NO: 1244850 - RNA, 22 nt, Mycobacterium leprae
aauccuucauguccuacacaaa

SEQ ID NO: 1244851 - RNA, 19 nt, Mycobacterium leprae
aauccuagaaaauccaagu

SEQ ID NO: 1244852 - RNA, 23 nt, Mycobacterium leprae
aauccgcugcacgaaaagaaacg

SEQ ID NO: 1244853 - RNA, 18 nt, Mycobacterium leprae
aauccgggcgcucagcgg

SEQ ID NO: 1244854 - RNA, 20 nt, Mycobacterium leprae
aaucgcaacccuuuugccca

SEQ ID NO: 1244855 - RNA, 15 nt, Mycobacterium leprae
aaucguccaggguga

SEQ ID NO: 1244856 - RNA, 23 nt, Mycobacterium leprae
aaucgucggcuaacucgaacauc

SEQ ID NO: 1244857 - RNA, 13 nt, Mycobacterium leprae
aaaaauugcgaua

SEQ ID NO: 1244858 - RNA, 14 nt, Mycobacterium leprae
aaucuucaauuuuc

SEQ ID NO: 1244859 - RNA, 18 nt, Mycobacterium leprae
aaucugcccugcacuuca

SEQ ID NO: 1244860 - RNA, 11 nt, Mycobacterium leprae
aaucaaugugc

SEQ ID NO: 1244861 - RNA, 16 nt, Mycobacterium leprae
aaucacgcccagcgca

SEQ ID NO: 1244862 - RNA, 19 nt, Mycobacterium leprae
aaucacgcccagcgcagcc

SEQ ID NO: 1244863 - RNA, 15 nt, Mycobacterium leprae
aaucagacugcccag

SEQ ID NO: 1244864 - RNA, 19 nt, Mycobacterium leprae
aauaugcccagcagauggc

SEQ ID NO: 1244865 - RNA, 24 nt, Mycobacterium leprae
aauucacgaacaacagagcaagcc

SEQ ID NO: 1244866 - RNA, 21 nt, Mycobacterium leprae
aauucuagagagguuuuccac

SEQ ID NO: 1244867 - RNA, 20 nt, Mycobacterium leprae
aauuccauuccguugaacuu

SEQ ID NO: 1244868 - RNA, 20 nt, Mycobacterium leprae
aaugucucggugucggacuu

SEQ ID NO: 1244869 - RNA, 22 nt, Mycobacterium leprae
aauguggccgcaccugaacagg

SEQ ID NO: 1244870 - RNA, 17 nt, Mycobacterium leprae
aauguuguuagugcugc

SEQ ID NO: 1244871 - RNA, 22 nt, Mycobacterium leprae
aauguugagugcgaccugaaca

SEQ ID NO: 1244872 - RNA, 18 nt, Mycobacterium leprae
aaugcaggaggugcagac

SEQ ID NO: 1244873 - RNA, 16 nt, Mycobacterium leprae
aauggccggcgccugg

SEQ ID NO: 1244874 - RNA, 19 nt, Mycobacterium leprae
acaaaaccgcggagcuuga

SEQ ID NO: 1244875 - RNA, 10 nt, Mycobacterium leprae
acaaagcuca

SEQ ID NO: 1244876 - RNA, 18 nt, Mycobacterium leprae
acaaagcuggcgaacaac

SEQ ID NO: 1244877 - RNA, 21 nt, Mycobacterium leprae
acaaagcuggcgaacaacaaa

SEQ ID NO: 1244878 - RNA, 13 nt, Mycobacterium leprae
acaaagucagcuu

SEQ ID NO: 1244879 - RNA, 18 nt, Mycobacterium leprae
acaaaucagcagcauugc

SEQ ID NO: 1244880 - RNA, 19 nt, Mycobacterium leprae
acaaaucauagugaccaaa

SEQ ID NO: 1244881 - RNA, 21 nt, Mycobacterium leprae
acaaauccguauaaccugcuu

SEQ ID NO: 1244882 - RNA, 21 nt, Mycobacterium leprae
acaacauccaaccaauugcca

SEQ ID NO: 1244883 - RNA, 17 nt, Mycobacterium leprae
acaaccucuagccaagc

SEQ ID NO: 1244884 - RNA, 13 nt, Mycobacterium leprae
acaacaccacuuc

SEQ ID NO: 1244885 - RNA, 18 nt, Mycobacterium leprae
acaacaagagaagagcug

SEQ ID NO: 1244886 - RNA, 20 nt, Mycobacterium leprae
acacccaauugccuggcgag

SEQ ID NO: 1244887 - RNA, 23 nt, Mycobacterium leprae
acaccgcagggcuguuuggccuc

SEQ ID NO: 1244888 - RNA, 20 nt, Mycobacterium leprae
acaccgccggcgucaggcca

SEQ ID NO: 1244889 - RNA, 23 nt, Mycobacterium leprae
acaccgccggcgucaggccaggc

SEQ ID NO: 1244890 - RNA, 22 nt, Mycobacterium leprae
acacaaagcuggcgaacaacaa

SEQ ID NO: 1244891 - RNA, 19 nt, Mycobacterium leprae
acacgccgcggcugggcag

SEQ ID NO: 1244892 - RNA, 17 nt, Mycobacterium leprae
acaccuguugcaauccg

SEQ ID NO: 1244893 - RNA, 21 nt, Mycobacterium leprae
acaccucaaggccaugacaug

SEQ ID NO: 1244894 - RNA, 18 nt, Mycobacterium leprae
acaaggguuagcagaaac

SEQ ID NO: 1244895 - RNA, 18 nt, Mycobacterium leprae
acaacgcaguuggccacu

SEQ ID NO: 1244896 - RNA, 13 nt, Mycobacterium leprae
acaaccuuccgca

SEQ ID NO: 1244897 - RNA, 17 nt, Mycobacterium leprae
acaaguguuuccacacc

SEQ ID NO: 1244898 - RNA, 20 nt, Mycobacterium leprae
acaaucagucgggccaggcc

SEQ ID NO: 1244899 - RNA, 13 nt, Mycobacterium leprae
acaauucaacgaa

SEQ ID NO: 1244900 - RNA, 19 nt, Mycobacterium leprae
acacggcguggauggcuuc

SEQ ID NO: 1244901 - RNA, 20 nt, Mycobacterium leprae
acagccagugcguaccccua

SEQ ID NO: 1244902 - RNA, 20 nt, Mycobacterium leprae
acagccuccgaaaagcugag

SEQ ID NO: 1244903 - RNA, 19 nt, Mycobacterium leprae
acagccucucgacaaagaa

SEQ ID NO: 1244904 - RNA, 12 nt, Mycobacterium leprae
acagcaguguuc

SEQ ID NO: 1244905 - RNA, 17 nt, Mycobacterium leprae
acagcaggcgaguggcg

SEQ ID NO: 1244906 - RNA, 21 nt, Mycobacterium leprae
acagcuucggucuggcggagu

SEQ ID NO: 1244907 - RNA, 14 nt, Mycobacterium leprae
acagcucagcggcu

SEQ ID NO: 1244908 - RNA, 16 nt, Mycobacterium leprae
acagcuaaccuccacg

SEQ ID NO: 1244909 - RNA, 17 nt, Mycobacterium leprae
acagcgcagugugcuuu

SEQ ID NO: 1244910 - RNA, 18 nt, Mycobacterium leprae
acaguguguuuuucugca

SEQ ID NO: 1244911 - RNA, 22 nt, Mycobacterium leprae
acagugccacgguggccuuaau

SEQ ID NO: 1244912 - RNA, 22 nt, Mycobacterium leprae
acagugcgguuguacagcucuu

SEQ ID NO: 1244913 - RNA, 23 nt, Mycobacterium leprae
acagugggggugcggcagcugcc

SEQ ID NO: 1244914 - RNA, 23 nt, Mycobacterium leprae
acaguuaccacgacguagcccac

SEQ ID NO: 1244915 - RNA, 13 nt, Mycobacterium leprae
acaguuguuggcc

SEQ ID NO: 1244916 - RNA, 16 nt, Mycobacterium leprae
acaguuuaaguagacc

SEQ ID NO: 1244917 - RNA, 22 nt, Mycobacterium leprae
acagucggcgcaguuaguuuaa

SEQ ID NO: 1244918 - RNA, 15 nt, Mycobacterium leprae
acagucccuucgccg

SEQ ID NO: 1244919 - RNA, 17 nt, Mycobacterium leprae
acaguaucgaccagcca

SEQ ID NO: 1244920 - RNA, 13 nt, Mycobacterium leprae
acaguaauggcau

SEQ ID NO: 1244921 - RNA, 17 nt, Mycobacterium leprae
acagguaguagccgcuu

SEQ ID NO: 1244922 - RNA, 19 nt, Mycobacterium leprae
acagguugaaaaagaaagc

SEQ ID NO: 1244923 - RNA, 16 nt, Mycobacterium leprae
acauguagaccaagca

SEQ ID NO: 1244924 - RNA, 18 nt, Mycobacterium leprae
acaugucccggugcugcc

SEQ ID NO: 1244925 - RNA, 20 nt, Mycobacterium leprae
acaugucccggugcugccug

SEQ ID NO: 1244926 - RNA, 15 nt, Mycobacterium leprae
acaugaacgucacug

SEQ ID NO: 1244927 - RNA, 17 nt, Mycobacterium leprae
acaucguggaccaagca

SEQ ID NO: 1244928 - RNA, 13 nt, Mycobacterium leprae
accaaaugcuaug

SEQ ID NO: 1244929 - RNA, 16 nt, Mycobacterium leprae
accaaaugugcugugg

SEQ ID NO: 1244930 - RNA, 14 nt, Mycobacterium leprae
accaaaccucugca

SEQ ID NO: 1244931 - RNA, 23 nt, Mycobacterium leprae
accaaaccgaagaucaccgccac

SEQ ID NO: 1244932 - RNA, 21 nt, Mycobacterium leprae
acauuguucugccaugccagu

SEQ ID NO: 1244933 - RNA, 14 nt, Mycobacterium leprae
acuuggcugguuaa

SEQ ID NO: 1244934 - RNA, 18 nt, Mycobacterium leprae
acuugugauucagcgcug

SEQ ID NO: 1244935 - RNA, 20 nt, Mycobacterium leprae
acuuguggucucaaugaccg

SEQ ID NO: 1244936 - RNA, 18 nt, Mycobacterium leprae
acuuguaucgugccuccg

SEQ ID NO: 1244937 - RNA, 18 nt, Mycobacterium leprae
acuugcgcucacccaagg

SEQ ID NO: 1244938 - RNA, 16 nt, Mycobacterium leprae
acuugcgauagcggug

SEQ ID NO: 1244939 - RNA, 17 nt, Mycobacterium leprae
acuuuacgugcguaagg

SEQ ID NO: 1244940 - RNA, 20 nt, Mycobacterium leprae
agaauauugcgacauccaaa

SEQ ID NO: 1244941 - RNA, 21 nt, Mycobacterium leprae
agaaucgguguuguccgucag

SEQ ID NO: 1244942 - RNA, 15 nt, Mycobacterium leprae
agaagccggcucgcg

SEQ ID NO: 1244943 - RNA, 20 nt, Mycobacterium leprae
agaagugcgacgauuuugcu

SEQ ID NO: 1244944 - RNA, 20 nt, Mycobacterium leprae
aaaacacuuacaccaacaua

SEQ ID NO: 1244945 - RNA, 18 nt, Mycobacterium leprae
aaaacacgggcaccagau

SEQ ID NO: 1244946 - RNA, 23 nt, Mycobacterium leprae
agaacgcagucugaucgcucacc

SEQ ID NO: 1244947 - RNA, 18 nt, Mycobacterium leprae
agaaccuucaucggaggc

SEQ ID NO: 1244948 - RNA, 20 nt, Mycobacterium leprae
agaacaaaucagcagcauug

SEQ ID NO: 1244949 - RNA, 14 nt, Mycobacterium leprae
agaucaacagcgca

SEQ ID NO: 1244950 - RNA, 23 nt, Mycobacterium leprae
agauagucgagggcucaguguau

SEQ ID NO: 1244951 - RNA, 21 nt, Mycobacterium leprae
agagugaaaguaggcacagcc

SEQ ID NO: 1244952 - RNA, 10 nt, Mycobacterium leprae
agagugcagc

SEQ ID NO: 1244953 - RNA, 22 nt, Mycobacterium leprae
agagugcagaucaccaacaguc

SEQ ID NO: 1244954 - RNA, 19 nt, Mycobacterium leprae
agaucuuuucggcugcacu

SEQ ID NO: 1244955 - RNA, 17 nt, Mycobacterium leprae
agaugcaagauuauuac

SEQ ID NO: 1244956 - RNA, 13 nt, Mycobacterium leprae
agaucgaucucga

SEQ ID NO: 1244957 - RNA, 22 nt, Mycobacterium leprae
agaucgcccaccgcaaucgaaa

SEQ ID NO: 1244958 - RNA, 20 nt, Mycobacterium leprae
agaucuggguaucaguaugu

SEQ ID NO: 1244959 - RNA, 14 nt, Mycobacterium leprae
agagaagagcuggu

SEQ ID NO: 1244960 - RNA, 21 nt, Mycobacterium leprae
agagaaguagagaaaaaugcu

SEQ ID NO: 1244961 - RNA, 14 nt, Mycobacterium leprae
agacuuuggagcag

SEQ ID NO: 1244962 - RNA, 17 nt, Mycobacterium leprae
agagcauggacccacug

SEQ ID NO: 1244963 - RNA, 18 nt, Mycobacterium leprae
agagccgcggguuucccg

SEQ ID NO: 1244964 - RNA, 16 nt, Mycobacterium leprae
agagagucgaacacgc

SEQ ID NO: 1244965 - RNA, 19 nt, Mycobacterium leprae
agacugagucugcgguuca

SEQ ID NO: 1244966 - RNA, 22 nt, Mycobacterium leprae
agacugcguguucaucaucuaa

SEQ ID NO: 1244967 - RNA, 11 nt, Mycobacterium leprae
agacugcaccc

SEQ ID NO: 1244968 - RNA, 19 nt, Mycobacterium leprae
agacggcaugucaauaccc

SEQ ID NO: 1244969 - RNA, 16 nt, Mycobacterium leprae
agacggccugcucugu

SEQ ID NO: 1244970 - RNA, 23 nt, Mycobacterium leprae
agacuaccggagguucucggcgu

SEQ ID NO: 1244971 - RNA, 20 nt, Mycobacterium leprae
agacucaccaagauugcgga

SEQ ID NO: 1244972 - RNA, 13 nt, Mycobacterium leprae
agaccgaaaucaa

SEQ ID NO: 1244973 - RNA, 22 nt, Mycobacterium leprae
agaccccuuacgaucucagcca

SEQ ID NO: 1244974 - RNA, 18 nt, Mycobacterium leprae
agcgaccggaugaacacg

SEQ ID NO: 1244975 - RNA, 14 nt, Mycobacterium leprae
agcgaccggccagu

SEQ ID NO: 1244976 - RNA, 13 nt, Mycobacterium leprae
agcgcagccacca

SEQ ID NO: 1244977 - RNA, 21 nt, Mycobacterium leprae
agcgcccaguaguucgagcac

SEQ ID NO: 1244978 - RNA, 22 nt, Mycobacterium leprae
agcgcccgcacagcaccaugga

SEQ ID NO: 1244979 - RNA, 15 nt, Mycobacterium leprae
agcgcgguucgccac

SEQ ID NO: 1244980 - RNA, 16 nt, Mycobacterium leprae
agcggaauaucggaga

SEQ ID NO: 1244981 - RNA, 14 nt, Mycobacterium leprae
agcggagcugggcg

SEQ ID NO: 1244982 - RNA, 20 nt, Mycobacterium leprae
agcggacguacaguggugau

SEQ ID NO: 1244983 - RNA, 15 nt, Mycobacterium leprae
agcggcagagcccgg

SEQ ID NO: 1244984 - RNA, 17 nt, Mycobacterium leprae
agcggucuggcgcucca

SEQ ID NO: 1244985 - RNA, 13 nt, Mycobacterium leprae
agcgguccgguuu

SEQ ID NO: 1244986 - RNA, 13 nt, Mycobacterium leprae
agcgguccaggcc

SEQ ID NO: 1244987 - RNA, 18 nt, Mycobacterium leprae
agcgguauuuguggaugu

SEQ ID NO: 1244988 - RNA, 23 nt, Mycobacterium leprae
agcggcgcaugccaaccugugca

SEQ ID NO: 1244989 - RNA, 13 nt, Mycobacterium leprae
agccuacucccgg

SEQ ID NO: 1244990 - RNA, 14 nt, Mycobacterium leprae
agccuacucccgga

SEQ ID NO: 1244991 - RNA, 14 nt, Mycobacterium leprae
agccguugcugcug

SEQ ID NO: 1244992 - RNA, 18 nt, Mycobacterium leprae
agccguugggcugcccuc

SEQ ID NO: 1244993 - RNA, 13 nt, Mycobacterium leprae
agccgugcagccu

SEQ ID NO: 1244994 - RNA, 15 nt, Mycobacterium leprae
agccgugcagccuca

SEQ ID NO: 1244995 - RNA, 22 nt, Mycobacterium leprae
agccgucacugugugcagcuug

SEQ ID NO: 1244996 - RNA, 23 nt, Mycobacterium leprae
agccgucgcugugccaaguugua

SEQ ID NO: 1244997 - RNA, 16 nt, Mycobacterium leprae
agccgucgaagcccug

SEQ ID NO: 1244998 - RNA, 19 nt, Mycobacterium leprae
agccgucgagccgauuacc

SEQ ID NO: 1244999 - RNA, 20 nt, Mycobacterium leprae
agccgguggccaccgccacc

SEQ ID NO: 1245000 - RNA, 19 nt, Mycobacterium leprae
agccggucgggaccuaccg

SEQ ID NO: 1245001 - RNA, 15 nt, Mycobacterium leprae
agccgggcgagcugg

SEQ ID NO: 1245002 - RNA, 18 nt, Mycobacterium leprae
agccggcuuuggcggacu

SEQ ID NO: 1245003 - RNA, 18 nt, Mycobacterium leprae
agccggcucgcggggaug

SEQ ID NO: 1245004 - RNA, 22 nt, Mycobacterium leprae
agccggcucgcggggaugcuga

SEQ ID NO: 1245005 - RNA, 16 nt, Mycobacterium leprae
agcgaaguccuugcug

SEQ ID NO: 1245006 - RNA, 13 nt, Mycobacterium leprae
agcgacagcucag

SEQ ID NO: 1245007 - RNA, 22 nt, Mycobacterium leprae
agccucggcgcuagugaauuca

SEQ ID NO: 1245008 - RNA, 13 nt, Mycobacterium leprae
agccuaugcggcc

SEQ ID NO: 1245009 - RNA, 17 nt, Mycobacterium leprae
agccgcgggcgaugcca

SEQ ID NO: 1245010 - RNA, 15 nt, Mycobacterium leprae
agccgauuagacaca

SEQ ID NO: 1245011 - RNA, 20 nt, Mycobacterium leprae
agccgaucggcugccgcgau

SEQ ID NO: 1245012 - RNA, 16 nt, Mycobacterium leprae
agcaugucggccacug

SEQ ID NO: 1245013 - RNA, 17 nt, Mycobacterium leprae
agcaugucgguggugga

SEQ ID NO: 1245014 - RNA, 17 nt, Mycobacterium leprae
agcaugucggugguggg

SEQ ID NO: 1245015 - RNA, 20 nt, Mycobacterium leprae
agcaugucgguggugggugc

SEQ ID NO: 1245016 - RNA, 22 nt, Mycobacterium leprae
agccacacucgaccuccgcuau

SEQ ID NO: 1245017 - RNA, 14 nt, Mycobacterium leprae
agccacaaguaggu

SEQ ID NO: 1245018 - RNA, 17 nt, Mycobacterium leprae
agccaaugcugcagcug

SEQ ID NO: 1245019 - RNA, 19 nt, Mycobacterium leprae
agcaucgacagcacccagc

SEQ ID NO: 1245020 - RNA, 17 nt, Mycobacterium leprae
agcaucaacgccagcaa

SEQ ID NO: 1245021 - RNA, 19 nt, Mycobacterium leprae
agcaggucgccgaggcgac

SEQ ID NO: 1245022 - RNA, 21 nt, Mycobacterium leprae
agcaggucuuuuagguguggu

SEQ ID NO: 1245023 - RNA, 12 nt, Mycobacterium leprae
agcagguugagg

SEQ ID NO: 1245024 - RNA, 18 nt, Mycobacterium leprae
agcagacugagucugcgg

SEQ ID NO: 1245025 - RNA, 21 nt, Mycobacterium leprae
aaaaccguguagugcacagaa

SEQ ID NO: 1245026 - RNA, 14 nt, Mycobacterium leprae
aaaaccggguucau

SEQ ID NO: 1245027 - RNA, 19 nt, Mycobacterium leprae
agcacuucgguaacgcuga

SEQ ID NO: 1245028 - RNA, 15 nt, Mycobacterium leprae
agcagaauauugcga

SEQ ID NO: 1245029 - RNA, 19 nt, Mycobacterium leprae
agcagaauuggagugaagu

SEQ ID NO: 1245030 - RNA, 16 nt, Mycobacterium leprae
agcacgggguguuggc

SEQ ID NO: 1245031 - RNA, 19 nt, Mycobacterium leprae
agcacgggguguuggcgcu

SEQ ID NO: 1245032 - RNA, 17 nt, Mycobacterium leprae
agcacuuacgcgauuca

SEQ ID NO: 1245033 - RNA, 14 nt, Mycobacterium leprae
agcacuucgcccug

SEQ ID NO: 1245034 - RNA, 23 nt, Mycobacterium leprae
agcacuucgcgagugcuggucaa

SEQ ID NO: 1245035 - RNA, 20 nt, Mycobacterium leprae
agcacgaugacaagagugaa

SEQ ID NO: 1245036 - RNA, 22 nt, Mycobacterium leprae
agcacaucaguaucagugccau

SEQ ID NO: 1245037 - RNA, 17 nt, Mycobacterium leprae
agcacccgcuugucuuu

SEQ ID NO: 1245038 - RNA, 15 nt, Mycobacterium leprae
agcaaugccaaacuu

SEQ ID NO: 1245039 - RNA, 17 nt, Mycobacterium leprae
agcaaugcucugcugau

SEQ ID NO: 1245040 - RNA, 15 nt, Mycobacterium leprae
agcaauuuuucggua

SEQ ID NO: 1245041 - RNA, 17 nt, Mycobacterium leprae
agcaagcgcuaugccau

SEQ ID NO: 1245042 - RNA, 19 nt, Mycobacterium leprae
agcaagucgccuacaccag

SEQ ID NO: 1245043 - RNA, 14 nt, Mycobacterium leprae
agcaagucgcugau

SEQ ID NO: 1245044 - RNA, 15 nt, Mycobacterium leprae
agcaagguguugcgg

SEQ ID NO: 1245045 - RNA, 20 nt, Mycobacterium leprae
agcaaggcuuggccagcaag

SEQ ID NO: 1245046 - RNA, 21 nt, Mycobacterium leprae
agcaaggcgcgguaucucaau

SEQ ID NO: 1245047 - RNA, 17 nt, Mycobacterium leprae
agcaacguacugcaaug

SEQ ID NO: 1245048 - RNA, 18 nt, Mycobacterium leprae
agcaacguguaaggccag

SEQ ID NO: 1245049 - RNA, 13 nt, Mycobacterium leprae
acuuaauaucuuu

SEQ ID NO: 1245050 - RNA, 19 nt, Mycobacterium leprae
acugugcggagcaugacag

SEQ ID NO: 1245051 - RNA, 16 nt, Mycobacterium leprae
acugugucaccugaaa

SEQ ID NO: 1245052 - RNA, 14 nt, Mycobacterium leprae
acuguauaaaccgg

SEQ ID NO: 1245053 - RNA, 19 nt, Mycobacterium leprae
acuguagagacguaccacu

SEQ ID NO: 1245054 - RNA, 23 nt, Mycobacterium leprae
acuguagagacguaccacucaca

SEQ ID NO: 1245055 - RNA, 13 nt, Mycobacterium leprae
acuggugauaaau

SEQ ID NO: 1245056 - RNA, 20 nt, Mycobacterium leprae
acuggggcguccagugauga

SEQ ID NO: 1245057 - RNA, 22 nt, Mycobacterium leprae
acuggggcguccagugaugacc

SEQ ID NO: 1245058 - RNA, 16 nt, Mycobacterium leprae
acugggaccaccugag

SEQ ID NO: 1245059 - RNA, 13 nt, Mycobacterium leprae
acuggguggaugu

SEQ ID NO: 1245060 - RNA, 18 nt, Mycobacterium leprae
acuggcauuaggcgacaa

SEQ ID NO: 1245061 - RNA, 18 nt, Mycobacterium leprae
acugcuucggccagcgca

SEQ ID NO: 1245062 - RNA, 21 nt, Mycobacterium leprae
acuggcggccggugaugacga

SEQ ID NO: 1245063 - RNA, 15 nt, Mycobacterium leprae
acugagaccaugguc

SEQ ID NO: 1245064 - RNA, 18 nt, Mycobacterium leprae
acugacguuggcgcucug

SEQ ID NO: 1245065 - RNA, 21 nt, Mycobacterium leprae
acugacggguggucuugauuc

SEQ ID NO: 1245066 - RNA, 17 nt, Mycobacterium leprae
acugaaugcgaugcugg

SEQ ID NO: 1245067 - RNA, 13 nt, Mycobacterium leprae
acugcacccggcc

SEQ ID NO: 1245068 - RNA, 15 nt, Mycobacterium leprae
acugaugggcagcac

SEQ ID NO: 1245069 - RNA, 14 nt, Mycobacterium leprae
acugcccagacuca

SEQ ID NO: 1245070 - RNA, 18 nt, Mycobacterium leprae
acugccagcuauccccga

SEQ ID NO: 1245071 - RNA, 19 nt, Mycobacterium leprae
acugcacggcgugcaggca

SEQ ID NO: 1245072 - RNA, 20 nt, Mycobacterium leprae
acugcagaaauucagcgcca

SEQ ID NO: 1245073 - RNA, 17 nt, Mycobacterium leprae
acugcagcuaaucccau

SEQ ID NO: 1245074 - RNA, 23 nt, Mycobacterium leprae
acugcccgggugaacgccaggcg

SEQ ID NO: 1245075 - RNA, 20 nt, Mycobacterium leprae
acugcuaucgcccaggugcu

SEQ ID NO: 1245076 - RNA, 21 nt, Mycobacterium leprae
acucgggguuugacaccgcag

SEQ ID NO: 1245077 - RNA, 16 nt, Mycobacterium leprae
acucgaucguucuuac

SEQ ID NO: 1245078 - RNA, 14 nt, Mycobacterium leprae
acuccgaugugggu

SEQ ID NO: 1245079 - RNA, 11 nt, Mycobacterium leprae
acuccagcagc

SEQ ID NO: 1245080 - RNA, 12 nt, Mycobacterium leprae
acuccagcagcg

SEQ ID NO: 1245081 - RNA, 15 nt, Mycobacterium leprae
acucauguucucaag

SEQ ID NO: 1245082 - RNA, 21 nt, Mycobacterium leprae
acucauagcggcgacugugcu

SEQ ID NO: 1245083 - RNA, 23 nt, Mycobacterium leprae
acuaugcuggcuaagacgcucaa

SEQ ID NO: 1245084 - RNA, 11 nt, Mycobacterium leprae
acuauggcucu

SEQ ID NO: 1245085 - RNA, 22 nt, Mycobacterium leprae
acucaccgguacacaccgcaca

SEQ ID NO: 1245086 - RNA, 17 nt, Mycobacterium leprae
acuacuguugucagugg

SEQ ID NO: 1245087 - RNA, 12 nt, Mycobacterium leprae
acuacggggcua

SEQ ID NO: 1245088 - RNA, 18 nt, Mycobacterium leprae
acuacguuggccagcacg

SEQ ID NO: 1245089 - RNA, 20 nt, Mycobacterium leprae
acguucggugacgaacaugc

SEQ ID NO: 1245090 - RNA, 15 nt, Mycobacterium leprae
acggucgcacgaccu

SEQ ID NO: 1245091 - RNA, 22 nt, Mycobacterium leprae
acggucgcucggacugggcuca

SEQ ID NO: 1245092 - RNA, 17 nt, Mycobacterium leprae
acggucaaaggcaucca

SEQ ID NO: 1245093 - RNA, 13 nt, Mycobacterium leprae
acgguauauuaac

SEQ ID NO: 1245094 - RNA, 23 nt, Mycobacterium leprae
acgguauuugcugucguggcugc

SEQ ID NO: 1245095 - RNA, 13 nt, Mycobacterium leprae
acggggcuggguc

SEQ ID NO: 1245096 - RNA, 20 nt, Mycobacterium leprae
acggggucgucggccaggcu

SEQ ID NO: 1245097 - RNA, 21 nt, Mycobacterium leprae
acggggucgucggccaggcuc

SEQ ID NO: 1245098 - RNA, 12 nt, Mycobacterium leprae
acgggcaccuuu

SEQ ID NO: 1245099 - RNA, 22 nt, Mycobacterium leprae
acgggcaccagauggcuccccg

SEQ ID NO: 1245100 - RNA, 15 nt, Mycobacterium leprae
acggccggaucaucg

SEQ ID NO: 1245101 - RNA, 16 nt, Mycobacterium leprae
acggcccagcaccacu

SEQ ID NO: 1245102 - RNA, 17 nt, Mycobacterium leprae
acgucacacuaaacugc

SEQ ID NO: 1245103 - RNA, 12 nt, Mycobacterium leprae
acgucacgcugc

SEQ ID NO: 1245104 - RNA, 15 nt, Mycobacterium leprae
acgucacgcugcucg

SEQ ID NO: 1245105 - RNA, 22 nt, Mycobacterium leprae
acguccaguaugucgucaaugg

SEQ ID NO: 1245106 - RNA, 13 nt, Mycobacterium leprae
acgugguggcugc

SEQ ID NO: 1245107 - RNA, 18 nt, Mycobacterium leprae
acguguuuugcuguguug

SEQ ID NO: 1245108 - RNA, 21 nt, Mycobacterium leprae
acgugaugcagcaugugugaa

SEQ ID NO: 1245109 - RNA, 14 nt, Mycobacterium leprae
acgugaugcuaucg

SEQ ID NO: 1245110 - RNA, 13 nt, Mycobacterium leprae
acgcgaccgccac

SEQ ID NO: 1245111 - RNA, 17 nt, Mycobacterium leprae
acgcgaccgccaccaga

SEQ ID NO: 1245112 - RNA, 18 nt, Mycobacterium leprae
acgcgacagcugcgguuc

SEQ ID NO: 1245113 - RNA, 16 nt, Mycobacterium leprae
acgcgcaccugguggu

SEQ ID NO: 1245114 - RNA, 19 nt, Mycobacterium leprae
acgcgcaccugguggugcg

SEQ ID NO: 1245115 - RNA, 19 nt, Mycobacterium leprae
acgcggaaagcuucugguc

SEQ ID NO: 1245116 - RNA, 17 nt, Mycobacterium leprae
acgcguacuccagcagc

SEQ ID NO: 1245117 - RNA, 13 nt, Mycobacterium leprae
acgcuaaaacgaa

SEQ ID NO: 1245118 - RNA, 14 nt, Mycobacterium leprae
acgcuggccgccgg

SEQ ID NO: 1245119 - RNA, 16 nt, Mycobacterium leprae
acgcucggccaaggau

SEQ ID NO: 1245120 - RNA, 17 nt, Mycobacterium leprae
acgccuccacugcuccu

SEQ ID NO: 1245121 - RNA, 16 nt, Mycobacterium leprae
acgccgguauguggga

SEQ ID NO: 1245122 - RNA, 21 nt, Mycobacterium leprae
acgacaaaauuuucaggcugu

SEQ ID NO: 1245123 - RNA, 14 nt, Mycobacterium leprae
acgaaugcugacca

SEQ ID NO: 1245124 - RNA, 18 nt, Mycobacterium leprae
acgacaggagcuucaaca

SEQ ID NO: 1245125 - RNA, 16 nt, Mycobacterium leprae
acgacaucuugaccug

SEQ ID NO: 1245126 - RNA, 20 nt, Mycobacterium leprae
acgaauaugcccagcagaug

SEQ ID NO: 1245127 - RNA, 16 nt, Mycobacterium leprae
acgaccggcugcaccu

SEQ ID NO: 1245128 - RNA, 19 nt, Mycobacterium leprae
acgacgugaaacaagccga

SEQ ID NO: 1245129 - RNA, 14 nt, Mycobacterium leprae
acgagugguugagu

SEQ ID NO: 1245130 - RNA, 19 nt, Mycobacterium leprae
acgauaucgcuaaggcugc

SEQ ID NO: 1245131 - RNA, 21 nt, Mycobacterium leprae
acgagcguuuagucaccgccg

SEQ ID NO: 1245132 - RNA, 15 nt, Mycobacterium leprae
accuuguugcagccu

SEQ ID NO: 1245133 - RNA, 16 nt, Mycobacterium leprae
accuuguugcagccug

SEQ ID NO: 1245134 - RNA, 16 nt, Mycobacterium leprae
accuucuagcgcagau

SEQ ID NO: 1245135 - RNA, 19 nt, Mycobacterium leprae
accugguucuuuugauugg

SEQ ID NO: 1245136 - RNA, 18 nt, Mycobacterium leprae
accugugcguaaggaaga

SEQ ID NO: 1245137 - RNA, 16 nt, Mycobacterium leprae
accuccacggucaugg

SEQ ID NO: 1245138 - RNA, 16 nt, Mycobacterium leprae
accugcaacgcugcaa

SEQ ID NO: 1245139 - RNA, 22 nt, Mycobacterium leprae
accugcgacagccgugccucgc

SEQ ID NO: 1245140 - RNA, 12 nt, Mycobacterium leprae
accuaccgcauc

SEQ ID NO: 1245141 - RNA, 12 nt, Mycobacterium leprae
accuacaugucg

SEQ ID NO: 1245142 - RNA, 14 nt, Mycobacterium leprae
accucaucccacag

SEQ ID NO: 1245143 - RNA, 22 nt, Mycobacterium leprae
accguccucggcggcaccuccc

SEQ ID NO: 1245144 - RNA, 14 nt, Mycobacterium leprae
accgugcagcugcc

SEQ ID NO: 1245145 - RNA, 15 nt, Mycobacterium leprae
accguucguuugggu

SEQ ID NO: 1245146 - RNA, 16 nt, Mycobacterium leprae
accguuaacacggugc

SEQ ID NO: 1245147 - RNA, 15 nt, Mycobacterium leprae
accgugguugcugag

SEQ ID NO: 1245148 - RNA, 22 nt, Mycobacterium leprae
accguauauuaacgguauauua

SEQ ID NO: 1245149 - RNA, 23 nt, Mycobacterium leprae
accguaguguuuuaccagccaga

SEQ ID NO: 1245150 - RNA, 23 nt, Mycobacterium leprae
accguacugaacgagaagcagcu

SEQ ID NO: 1245151 - RNA, 17 nt, Mycobacterium leprae
accgggaaauacggcac

SEQ ID NO: 1245152 - RNA, 15 nt, Mycobacterium leprae
accggccaaccacag

SEQ ID NO: 1245153 - RNA, 17 nt, Mycobacterium leprae
accggccaaccacagca

SEQ ID NO: 1245154 - RNA, 19 nt, Mycobacterium leprae
accggccaaccacagcaau

SEQ ID NO: 1245155 - RNA, 16 nt, Mycobacterium leprae
acccaggguagcugac

SEQ ID NO: 1245156 - RNA, 21 nt, Mycobacterium leprae
acccagcgauaucaagcugcg

SEQ ID NO: 1245157 - RNA, 23 nt, Mycobacterium leprae
acccagcucacaauugacaacac

SEQ ID NO: 1245158 - RNA, 22 nt, Mycobacterium leprae
accaucuaacccgcaaaccaaa

SEQ ID NO: 1245159 - RNA, 16 nt, Mycobacterium leprae
accaucugcucucagc

SEQ ID NO: 1245160 - RNA, 19 nt, Mycobacterium leprae
acccacugggcaagcagug

SEQ ID NO: 1245161 - RNA, 22 nt, Mycobacterium leprae
acccacuucggcacagugccug

SEQ ID NO: 1245162 - RNA, 16 nt, Mycobacterium leprae
accccguagaacacgu

SEQ ID NO: 1245163 - RNA, 16 nt, Mycobacterium leprae
accccaaccagaccca

SEQ ID NO: 1245164 - RNA, 20 nt, Mycobacterium leprae
acccgcaaaccaaacaacaa

SEQ ID NO: 1245165 - RNA, 21 nt, Mycobacterium leprae
acccgcaaaccaaacaacaac

SEQ ID NO: 1245166 - RNA, 21 nt, Mycobacterium leprae
accccguucuguuaagcaucg

SEQ ID NO: 1245167 - RNA, 18 nt, Mycobacterium leprae
accccgugccgucccuau

SEQ ID NO: 1245168 - RNA, 20 nt, Mycobacterium leprae
accccuagaaagacccccgg

SEQ ID NO: 1245169 - RNA, 23 nt, Mycobacterium leprae
accgaguuuggcugacacuucuu

SEQ ID NO: 1245170 - RNA, 20 nt, Mycobacterium leprae
accgacggaugcccagccag

SEQ ID NO: 1245171 - RNA, 21 nt, Mycobacterium leprae
accgacggaugcccagccagg

SEQ ID NO: 1245172 - RNA, 15 nt, Mycobacterium leprae
accgacggcgccgca

SEQ ID NO: 1245173 - RNA, 13 nt, Mycobacterium leprae
accgaccaaccgu

SEQ ID NO: 1245174 - RNA, 14 nt, Mycobacterium leprae
accgaaagccgcac

SEQ ID NO: 1245175 - RNA, 19 nt, Mycobacterium leprae
accgaaucguuccacccga

SEQ ID NO: 1245176 - RNA, 17 nt, Mycobacterium leprae
accgacacacccaucaa

SEQ ID NO: 1245177 - RNA, 18 nt, Mycobacterium leprae
acccuggcugggcugcug

SEQ ID NO: 1245178 - RNA, 14 nt, Mycobacterium leprae
acccuagagucgac

SEQ ID NO: 1245179 - RNA, 20 nt, Mycobacterium leprae
accaucgaaacugccaaagu

SEQ ID NO: 1245180 - RNA, 17 nt, Mycobacterium leprae
accauaaacacgugcau

SEQ ID NO: 1245181 - RNA, 17 nt, Mycobacterium leprae
accagcucacccgcagc

SEQ ID NO: 1245182 - RNA, 21 nt, Mycobacterium leprae
accagcucacccgcagcaccu

SEQ ID NO: 1245183 - RNA, 15 nt, Mycobacterium leprae
accagggguguugca

SEQ ID NO: 1245184 - RNA, 18 nt, Mycobacterium leprae
accagggguguugcacca

SEQ ID NO: 1245185 - RNA, 23 nt, Mycobacterium leprae
accaagauugcggacaauucaac

SEQ ID NO: 1245186 - RNA, 19 nt, Mycobacterium leprae
accagaucagcagaaauuu

SEQ ID NO: 1245187 - RNA, 16 nt, Mycobacterium leprae
accagauggcuccccg

SEQ ID NO: 1245188 - RNA, 17 nt, Mycobacterium leprae
accagauggcuccccga

SEQ ID NO: 1245189 - RNA, 16 nt, Mycobacterium leprae
accagccgcaggcacc

SEQ ID NO: 1245190 - RNA, 17 nt, Mycobacterium leprae
accagccaagccgccag

SEQ ID NO: 1245191 - RNA, 11 nt, Mycobacterium leprae
accagccagac

SEQ ID NO: 1245192 - RNA, 19 nt, Mycobacterium leprae
accagccagaccaacauga

SEQ ID NO: 1245193 - RNA, 23 nt, Mycobacterium leprae
accagcgacuggcuguagugaua

SEQ ID NO: 1245194 - RNA, 18 nt, Mycobacterium leprae
aguacaccacccaagaua

SEQ ID NO: 1245195 - RNA, 16 nt, Mycobacterium leprae
aguacaauauugacca

SEQ ID NO: 1245196 - RNA, 14 nt, Mycobacterium leprae
aguaaugcagguga

SEQ ID NO: 1245197 - RNA, 20 nt, Mycobacterium leprae
aguaauggcauuuucguugu

SEQ ID NO: 1245198 - RNA, 19 nt, Mycobacterium leprae
aguacggagccaguggcgu

SEQ ID NO: 1245199 - RNA, 20 nt, Mycobacterium leprae
aguacgcuagagucaucccg

SEQ ID NO: 1245200 - RNA, 14 nt, Mycobacterium leprae
aguacguguggugu

SEQ ID NO: 1245201 - RNA, 18 nt, Mycobacterium leprae
aguaccgcgaacccuggu

SEQ ID NO: 1245202 - RNA, 19 nt, Mycobacterium leprae
agguucggggcuaaugucc

SEQ ID NO: 1245203 - RNA, 21 nt, Mycobacterium leprae
aguaaaucuugauugggcuuu

SEQ ID NO: 1245204 - RNA, 14 nt, Mycobacterium leprae
aggucucuaaaaaa

SEQ ID NO: 1245205 - RNA, 19 nt, Mycobacterium leprae
aggugugccuggaugggca

SEQ ID NO: 1245206 - RNA, 23 nt, Mycobacterium leprae
aggugucgacggugaaugucugg

SEQ ID NO: 1245207 - RNA, 20 nt, Mycobacterium leprae
agguggucaagugucgggug

SEQ ID NO: 1245208 - RNA, 20 nt, Mycobacterium leprae
agguggcuagcuguaaggac

SEQ ID NO: 1245209 - RNA, 22 nt, Mycobacterium leprae
aggugacgccaguguagagggc

SEQ ID NO: 1245210 - RNA, 15 nt, Mycobacterium leprae
aggugcccagccccu

SEQ ID NO: 1245211 - RNA, 23 nt, Mycobacterium leprae
aggugccagugaucgccgaugcu

SEQ ID NO: 1245212 - RNA, 16 nt, Mycobacterium leprae
agggauuccacugcca

SEQ ID NO: 1245213 - RNA, 19 nt, Mycobacterium leprae
agggcaucgccgugguggc

SEQ ID NO: 1245214 - RNA, 14 nt, Mycobacterium leprae
agggcgagcugcgc

SEQ ID NO: 1245215 - RNA, 15 nt, Mycobacterium leprae
agggcgauucgagcc

SEQ ID NO: 1245216 - RNA, 17 nt, Mycobacterium leprae
aggcuucgucacauaau

SEQ ID NO: 1245217 - RNA, 22 nt, Mycobacterium leprae
agggguccugaccgccugugcu

SEQ ID NO: 1245218 - RNA, 16 nt, Mycobacterium leprae
aggguccggaccugga

SEQ ID NO: 1245219 - RNA, 20 nt, Mycobacterium leprae
aggguuggaugguuagcaug

SEQ ID NO: 1245220 - RNA, 22 nt, Mycobacterium leprae
aggggagucgggcuuggccucg

SEQ ID NO: 1245221 - RNA, 21 nt, Mycobacterium leprae
aggggaugcagguacuagcac

SEQ ID NO: 1245222 - RNA, 14 nt, Mycobacterium leprae
aggggacuggauau

SEQ ID NO: 1245223 - RNA, 20 nt, Mycobacterium leprae
agggcgccgauuuggggguc

SEQ ID NO: 1245224 - RNA, 17 nt, Mycobacterium leprae
aggcggucauguagcua

SEQ ID NO: 1245225 - RNA, 17 nt, Mycobacterium leprae
aggcggccggcacugag

SEQ ID NO: 1245226 - RNA, 14 nt, Mycobacterium leprae
aggccggccuggaa

SEQ ID NO: 1245227 - RNA, 13 nt, Mycobacterium leprae
aggccggcaaggu

SEQ ID NO: 1245228 - RNA, 18 nt, Mycobacterium leprae
aggcguuaucggaagcgu

SEQ ID NO: 1245229 - RNA, 13 nt, Mycobacterium leprae
aggcgugagugug

SEQ ID NO: 1245230 - RNA, 22 nt, Mycobacterium leprae
aggcugccaacguccagugugu

SEQ ID NO: 1245231 - RNA, 14 nt, Mycobacterium leprae
aggcugagccauuu

SEQ ID NO: 1245232 - RNA, 13 nt, Mycobacterium leprae
aggcagcagcucg

SEQ ID NO: 1245233 - RNA, 16 nt, Mycobacterium leprae
aggcagagccaaacau

SEQ ID NO: 1245234 - RNA, 14 nt, Mycobacterium leprae
aggcaggaucugcu

SEQ ID NO: 1245235 - RNA, 15 nt, Mycobacterium leprae
aggcagcgccugccc

SEQ ID NO: 1245236 - RNA, 18 nt, Mycobacterium leprae
aggccaggauggugccau

SEQ ID NO: 1245237 - RNA, 19 nt, Mycobacterium leprae
aggccaugacaugcacacu

SEQ ID NO: 1245238 - RNA, 14 nt, Mycobacterium leprae
aggcauaugagcau

SEQ ID NO: 1245239 - RNA, 17 nt, Mycobacterium leprae
aggcauaugagcaucga

SEQ ID NO: 1245240 - RNA, 13 nt, Mycobacterium leprae
aggcauaauacaa

SEQ ID NO: 1245241 - RNA, 21 nt, Mycobacterium leprae
aggaucgagcggagcugggcg

SEQ ID NO: 1245242 - RNA, 15 nt, Mycobacterium leprae
aggaugacacugcgg

SEQ ID NO: 1245243 - RNA, 20 nt, Mycobacterium leprae
aggaguaauaacugugcaua

SEQ ID NO: 1245244 - RNA, 20 nt, Mycobacterium leprae
aggacucggauccaucagac

SEQ ID NO: 1245245 - RNA, 23 nt, Mycobacterium leprae
aggaguugacaaagaaaaagagc

SEQ ID NO: 1245246 - RNA, 15 nt, Mycobacterium leprae
aggaguguugcagug

SEQ ID NO: 1245247 - RNA, 18 nt, Mycobacterium leprae
aggaguucaacaaaacca

SEQ ID NO: 1245248 - RNA, 23 nt, Mycobacterium leprae
aggaaaauuagucgaggccagau

SEQ ID NO: 1245249 - RNA, 20 nt, Mycobacterium leprae
aggaaaccuuccggcgguca

SEQ ID NO: 1245250 - RNA, 12 nt, Mycobacterium leprae
aggaaugccugg

SEQ ID NO: 1245251 - RNA, 21 nt, Mycobacterium leprae
aggaaugguuguagcgccuga

SEQ ID NO: 1245252 - RNA, 17 nt, Mycobacterium leprae
aggacgggcggccaggc

SEQ ID NO: 1245253 - RNA, 17 nt, Mycobacterium leprae
agcugcaccugaucuag

SEQ ID NO: 1245254 - RNA, 11 nt, Mycobacterium leprae
agcugaugaca

SEQ ID NO: 1245255 - RNA, 14 nt, Mycobacterium leprae
agcuggagguuguu

SEQ ID NO: 1245256 - RNA, 19 nt, Mycobacterium leprae
agcugcgagucucacccac

SEQ ID NO: 1245257 - RNA, 13 nt, Mycobacterium leprae
agcuguugacugc

SEQ ID NO: 1245258 - RNA, 21 nt, Mycobacterium leprae
agcuguuacgaggacucccuu

SEQ ID NO: 1245259 - RNA, 14 nt, Mycobacterium leprae
agcuggggcggccg

SEQ ID NO: 1245260 - RNA, 18 nt, Mycobacterium leprae
agcugugucaaugacaag

SEQ ID NO: 1245261 - RNA, 19 nt, Mycobacterium leprae
agcugugucaaugacaagc

SEQ ID NO: 1245262 - RNA, 17 nt, Mycobacterium leprae
agcuggcgaacaacaaa

SEQ ID NO: 1245263 - RNA, 14 nt, Mycobacterium leprae
agcuggccggggcc

SEQ ID NO: 1245264 - RNA, 19 nt, Mycobacterium leprae
agcuggccggggccaagcu

SEQ ID NO: 1245265 - RNA, 16 nt, Mycobacterium leprae
agcucucgaggauuau

SEQ ID NO: 1245266 - RNA, 23 nt, Mycobacterium leprae
agcucucgaggauuaucgccggc

SEQ ID NO: 1245267 - RNA, 20 nt, Mycobacterium leprae
agcgucucgcgcauacacgg

SEQ ID NO: 1245268 - RNA, 20 nt, Mycobacterium leprae
agcgucgcucacggccacca

SEQ ID NO: 1245269 - RNA, 15 nt, Mycobacterium leprae
agcuccgaagcacca

SEQ ID NO: 1245270 - RNA, 18 nt, Mycobacterium leprae
agcucgauggugccauug

SEQ ID NO: 1245271 - RNA, 22 nt, Mycobacterium leprae
agcucgauggugccauuggugg

SEQ ID NO: 1245272 - RNA, 15 nt, Mycobacterium leprae
agcucggcaucggcc

SEQ ID NO: 1245273 - RNA, 19 nt, Mycobacterium leprae
agcucgcccggacgugcac

SEQ ID NO: 1245274 - RNA, 16 nt, Mycobacterium leprae
auaagauaaauaguau

SEQ ID NO: 1245275 - RNA, 23 nt, Mycobacterium leprae
auaaggauuugcacgaauaucga

SEQ ID NO: 1245276 - RNA, 22 nt, Mycobacterium leprae
auaagcuugggaaacugggucu

SEQ ID NO: 1245277 - RNA, 23 nt, Mycobacterium leprae
auaaggugcccgggaaacuagcg

SEQ ID NO: 1245278 - RNA, 19 nt, Mycobacterium leprae
auaagcaaaaaauagcugc

SEQ ID NO: 1245279 - RNA, 16 nt, Mycobacterium leprae
aguuuuucucacaccu

SEQ ID NO: 1245280 - RNA, 14 nt, Mycobacterium leprae
aguuuuuguuccua

SEQ ID NO: 1245281 - RNA, 13 nt, Mycobacterium leprae
aguuuucgcggga

SEQ ID NO: 1245282 - RNA, 13 nt, Mycobacterium leprae
auaaaguguuaug

SEQ ID NO: 1245283 - RNA, 15 nt, Mycobacterium leprae
auaaacaucgaguga

SEQ ID NO: 1245284 - RNA, 17 nt, Mycobacterium leprae
aguucagcugcuuuacc

SEQ ID NO: 1245285 - RNA, 21 nt, Mycobacterium leprae
aguuggauucgguguugcugg

SEQ ID NO: 1245286 - RNA, 20 nt, Mycobacterium leprae
aguugaguagcgccggggug

SEQ ID NO: 1245287 - RNA, 19 nt, Mycobacterium leprae
aguugaccaggcaaugugu

SEQ ID NO: 1245288 - RNA, 16 nt, Mycobacterium leprae
aguguuuccacaccga

SEQ ID NO: 1245289 - RNA, 23 nt, Mycobacterium leprae
aguuaagagaaguagagaaaaau

SEQ ID NO: 1245290 - RNA, 23 nt, Mycobacterium leprae
aguguguuugguuuuguuguugu

SEQ ID NO: 1245291 - RNA, 13 nt, Mycobacterium leprae
agugucggguggu

SEQ ID NO: 1245292 - RNA, 19 nt, Mycobacterium leprae
agugugagcccaaucuguu

SEQ ID NO: 1245293 - RNA, 15 nt, Mycobacterium leprae
aguggaauaacagag

SEQ ID NO: 1245294 - RNA, 17 nt, Mycobacterium leprae
aguggacuuuucugcac

SEQ ID NO: 1245295 - RNA, 19 nt, Mycobacterium leprae
aguggacacuacagcguga

SEQ ID NO: 1245296 - RNA, 23 nt, Mycobacterium leprae
agugguucugcuucgauguguug

SEQ ID NO: 1245297 - RNA, 21 nt, Mycobacterium leprae
aguggcuugucacgccggucg

SEQ ID NO: 1245298 - RNA, 19 nt, Mycobacterium leprae
agugaguacaccacccaag

SEQ ID NO: 1245299 - RNA, 20 nt, Mycobacterium leprae
agugcuagcggcgccaggcg

SEQ ID NO: 1245300 - RNA, 17 nt, Mycobacterium leprae
agucguggagcaccuca

SEQ ID NO: 1245301 - RNA, 15 nt, Mycobacterium leprae
agucuaucccggcuc

SEQ ID NO: 1245302 - RNA, 19 nt, Mycobacterium leprae
agucuugaugccaaccugc

SEQ ID NO: 1245303 - RNA, 18 nt, Mycobacterium leprae
agucuucggaucugguuu

SEQ ID NO: 1245304 - RNA, 18 nt, Mycobacterium leprae
agucuucaauccgcgcau

SEQ ID NO: 1245305 - RNA, 19 nt, Mycobacterium leprae
agugaaccuauugucaggu

SEQ ID NO: 1245306 - RNA, 21 nt, Mycobacterium leprae
agugaccgaugcucgcccucg

SEQ ID NO: 1245307 - RNA, 18 nt, Mycobacterium leprae
agugacuacgguuaauau

SEQ ID NO: 1245308 - RNA, 15 nt, Mycobacterium leprae
agucauccacugcga

SEQ ID NO: 1245309 - RNA, 22 nt, Mycobacterium leprae
agucauccccaucgcuugagac

SEQ ID NO: 1245310 - RNA, 19 nt, Mycobacterium leprae
agucaugcagaugcaagau

SEQ ID NO: 1245311 - RNA, 21 nt, Mycobacterium leprae
agucaugcagaugcaagauua

SEQ ID NO: 1245312 - RNA, 19 nt, Mycobacterium leprae
agucaguuuggcgcugcug

SEQ ID NO: 1245313 - RNA, 20 nt, Mycobacterium leprae
agucaguuuggcgcugcugc

SEQ ID NO: 1245314 - RNA, 15 nt, Mycobacterium leprae
aguccaugaauuacu

SEQ ID NO: 1245315 - RNA, 17 nt, Mycobacterium leprae
aguccaugaauuacuac

SEQ ID NO: 1245316 - RNA, 22 nt, Mycobacterium leprae
agucauguucaucacggguggu

SEQ ID NO: 1245317 - RNA, 14 nt, Mycobacterium leprae
agucauguucccug

SEQ ID NO: 1245318 - RNA, 15 nt, Mycobacterium leprae
agucauugccuaguu

SEQ ID NO: 1245319 - RNA, 14 nt, Mycobacterium leprae
agucagacacuuga

SEQ ID NO: 1245320 - RNA, 17 nt, Mycobacterium leprae
agucagaucaaccaaau

SEQ ID NO: 1245321 - RNA, 14 nt, Mycobacterium leprae
agucagcaucagac

SEQ ID NO: 1245322 - RNA, 13 nt, Mycobacterium leprae
agucacuccgacg

SEQ ID NO: 1245323 - RNA, 12 nt, Mycobacterium leprae
aguagagaaguc

SEQ ID NO: 1245324 - RNA, 14 nt, Mycobacterium leprae
auauccguugccau

SEQ ID NO: 1245325 - RNA, 20 nt, Mycobacterium leprae
auauccaccauacagcuaac

SEQ ID NO: 1245326 - RNA, 17 nt, Mycobacterium leprae
auagucagaucaaccaa

SEQ ID NO: 1245327 - RNA, 14 nt, Mycobacterium leprae
auaguauaaggugc

SEQ ID NO: 1245328 - RNA, 14 nt, Mycobacterium leprae
auaguacagaccga

SEQ ID NO: 1245329 - RNA, 18 nt, Mycobacterium leprae
auagcugugcaggagagc

SEQ ID NO: 1245330 - RNA, 17 nt, Mycobacterium leprae
auagccgcgacaguccg

SEQ ID NO: 1245331 - RNA, 16 nt, Mycobacterium leprae
auagaagacagucuga

SEQ ID NO: 1245332 - RNA, 19 nt, Mycobacterium leprae
auagaacauccgcagcaug

SEQ ID NO: 1245333 - RNA, 19 nt, Mycobacterium leprae
auagaacaccgaagcugau

SEQ ID NO: 1245334 - RNA, 14 nt, Mycobacterium leprae
auaccguuuacugu

SEQ ID NO: 1245335 - RNA, 16 nt, Mycobacterium leprae
aucacaaggagccaac

SEQ ID NO: 1245336 - RNA, 12 nt, Mycobacterium leprae
aucacaaucaca

SEQ ID NO: 1245337 - RNA, 22 nt, Mycobacterium leprae
aucacagccuccgaaaagcuga

SEQ ID NO: 1245338 - RNA, 14 nt, Mycobacterium leprae
aucacaucagugcu

SEQ ID NO: 1245339 - RNA, 20 nt, Mycobacterium leprae
aaaacgguuagucagaguga

SEQ ID NO: 1245340 - RNA, 18 nt, Mycobacterium leprae
aucaguaaucgacgcagc

SEQ ID NO: 1245341 - RNA, 18 nt, Mycobacterium leprae
aucaggguacucagcugg

SEQ ID NO: 1245342 - RNA, 22 nt, Mycobacterium leprae
aucagaaauguccuugagcuaa

SEQ ID NO: 1245343 - RNA, 14 nt, Mycobacterium leprae
aucagcaccgcgcc

SEQ ID NO: 1245344 - RNA, 21 nt, Mycobacterium leprae
aucagcaggaaucccagcagc

SEQ ID NO: 1245345 - RNA, 13 nt, Mycobacterium leprae
auauggcgaucau

SEQ ID NO: 1245346 - RNA, 19 nt, Mycobacterium leprae
auaugccguuccugagugu

SEQ ID NO: 1245347 - RNA, 22 nt, Mycobacterium leprae
auauuaauucuucucuaaaaag

SEQ ID NO: 1245348 - RNA, 17 nt, Mycobacterium leprae
auauuaacgguauauua

SEQ ID NO: 1245349 - RNA, 16 nt, Mycobacterium leprae
aucaacauuuguugaa

SEQ ID NO: 1245350 - RNA, 13 nt, Mycobacterium leprae
aucaaccaaaugc

SEQ ID NO: 1245351 - RNA, 23 nt, Mycobacterium leprae
aucaacggcuacaacaaaguuau

SEQ ID NO: 1245352 - RNA, 17 nt, Mycobacterium leprae
auauucgcgaucuggau

SEQ ID NO: 1245353 - RNA, 14 nt, Mycobacterium leprae
auauuuuuaagguc

SEQ ID NO: 1245354 - RNA, 22 nt, Mycobacterium leprae
augaccgcggucggcaucugcu

SEQ ID NO: 1245355 - RNA, 23 nt, Mycobacterium leprae
aucuugggcaucggcuugauguc

SEQ ID NO: 1245356 - RNA, 16 nt, Mycobacterium leprae
aucuuugccuucguga

SEQ ID NO: 1245357 - RNA, 13 nt, Mycobacterium leprae
aucuuucugguug

SEQ ID NO: 1245358 - RNA, 13 nt, Mycobacterium leprae
aucuuuuuuagag

SEQ ID NO: 1245359 - RNA, 18 nt, Mycobacterium leprae
aucuucugaaccaucacu

SEQ ID NO: 1245360 - RNA, 18 nt, Mycobacterium leprae
aucuguuccgcgugugcc

SEQ ID NO: 1245361 - RNA, 13 nt, Mycobacterium leprae
aucugugccuggu

SEQ ID NO: 1245362 - RNA, 20 nt, Mycobacterium leprae
aucuugcggauuugcagagc

SEQ ID NO: 1245363 - RNA, 16 nt, Mycobacterium leprae
aucuugaguguagcag

SEQ ID NO: 1245364 - RNA, 17 nt, Mycobacterium leprae
aucuugaguguagcagg

SEQ ID NO: 1245365 - RNA, 18 nt, Mycobacterium leprae
aucuugaaauucaauacu

SEQ ID NO: 1245366 - RNA, 23 nt, Mycobacterium leprae
aucugcaacucaucggcucccau

SEQ ID NO: 1245367 - RNA, 19 nt, Mycobacterium leprae
aucugauugaucggugacu

SEQ ID NO: 1245368 - RNA, 15 nt, Mycobacterium leprae
aucuggugaaacugc

SEQ ID NO: 1245369 - RNA, 15 nt, Mycobacterium leprae
aucugguagccguuc

SEQ ID NO: 1245370 - RNA, 15 nt, Mycobacterium leprae
aucugcuuguggcgg

SEQ ID NO: 1245371 - RNA, 13 nt, Mycobacterium leprae
aucuggacaaagu

SEQ ID NO: 1245372 - RNA, 19 nt, Mycobacterium leprae
aucucugugcgaaaacacu

SEQ ID NO: 1245373 - RNA, 15 nt, Mycobacterium leprae
aucucuguuaugacu

SEQ ID NO: 1245374 - RNA, 19 nt, Mycobacterium leprae
aucucgggcagcugcaaca

SEQ ID NO: 1245375 - RNA, 13 nt, Mycobacterium leprae
aucucggcgcgcu

SEQ ID NO: 1245376 - RNA, 18 nt, Mycobacterium leprae
aucguugcacggcaaagu

SEQ ID NO: 1245377 - RNA, 15 nt, Mycobacterium leprae
aucguuucaggugag

SEQ ID NO: 1245378 - RNA, 18 nt, Mycobacterium leprae
aucuaauugcgaugcacu

SEQ ID NO: 1245379 - RNA, 18 nt, Mycobacterium leprae
aucuacccuuuuugucac

SEQ ID NO: 1245380 - RNA, 21 nt, Mycobacterium leprae
aucgcuucgguuagcaucgac

SEQ ID NO: 1245381 - RNA, 16 nt, Mycobacterium leprae
aucgcuuagcugagaa

SEQ ID NO: 1245382 - RNA, 18 nt, Mycobacterium leprae
aucgucgguuagcucgaa

SEQ ID NO: 1245383 - RNA, 13 nt, Mycobacterium leprae
aucguccgcaacc

SEQ ID NO: 1245384 - RNA, 15 nt, Mycobacterium leprae
aucguguuccacugu

SEQ ID NO: 1245385 - RNA, 23 nt, Mycobacterium leprae
aucguguccacugcggcaaagca

SEQ ID NO: 1245386 - RNA, 15 nt, Mycobacterium leprae
aucguggugggucac

SEQ ID NO: 1245387 - RNA, 12 nt, Mycobacterium leprae
aucguguggugu

SEQ ID NO: 1245388 - RNA, 14 nt, Mycobacterium leprae
aucgugugguguuu

SEQ ID NO: 1245389 - RNA, 18 nt, Mycobacterium leprae
aucguguuagugaacagu

SEQ ID NO: 1245390 - RNA, 22 nt, Mycobacterium leprae
aucguggcagcuguauaacaaa

SEQ ID NO: 1245391 - RNA, 19 nt, Mycobacterium leprae
aucgcagccgcaaggucac

SEQ ID NO: 1245392 - RNA, 13 nt, Mycobacterium leprae
aucgaggccagcc

SEQ ID NO: 1245393 - RNA, 14 nt, Mycobacterium leprae
aucgagcggagcug

SEQ ID NO: 1245394 - RNA, 14 nt, Mycobacterium leprae
aucgccuucagcac

SEQ ID NO: 1245395 - RNA, 15 nt, Mycobacterium leprae
aucgcugauguccaa

SEQ ID NO: 1245396 - RNA, 21 nt, Mycobacterium leprae
auccucgacgggucacaggua

SEQ ID NO: 1245397 - RNA, 23 nt, Mycobacterium leprae
auccucagcgucccaaccaaucu

SEQ ID NO: 1245398 - RNA, 19 nt, Mycobacterium leprae
auccucgauggcgccgagu

SEQ ID NO: 1245399 - RNA, 18 nt, Mycobacterium leprae
auccugagaugccagcca

SEQ ID NO: 1245400 - RNA, 20 nt, Mycobacterium leprae
auccgguggcgacaguguug

SEQ ID NO: 1245401 - RNA, 20 nt, Mycobacterium leprae
aucccgaagugaucggcgac

SEQ ID NO: 1245402 - RNA, 13 nt, Mycobacterium leprae
aucccgacagcau

SEQ ID NO: 1245403 - RNA, 19 nt, Mycobacterium leprae
aucccgaaaaccccacacu

SEQ ID NO: 1245404 - RNA, 15 nt, Mycobacterium leprae
aucccaaguggaaua

SEQ ID NO: 1245405 - RNA, 16 nt, Mycobacterium leprae
aucccaaaaccacaaa

SEQ ID NO: 1245406 - RNA, 22 nt, Mycobacterium leprae
aucccaugagucuucacucacc

SEQ ID NO: 1245407 - RNA, 21 nt, Mycobacterium leprae
aucccaucggggcuacaaagc

SEQ ID NO: 1245408 - RNA, 22 nt, Mycobacterium leprae
auccaguaguuaccguauauua

SEQ ID NO: 1245409 - RNA, 23 nt, Mycobacterium leprae
auccaaagggucguaauaauauc

SEQ ID NO: 1245410 - RNA, 22 nt, Mycobacterium leprae
auccaacgugaccagcuccgaa

SEQ ID NO: 1245411 - RNA, 14 nt, Mycobacterium leprae
auccacagcaucaa

SEQ ID NO: 1245412 - RNA, 17 nt, Mycobacterium leprae
aucauucgauccaauga

SEQ ID NO: 1245413 - RNA, 15 nt, Mycobacterium leprae
aucaugguuaacgaa

SEQ ID NO: 1245414 - RNA, 16 nt, Mycobacterium leprae
aucaugcauccuccua

SEQ ID NO: 1245415 - RNA, 11 nt, Mycobacterium leprae
caaaaggcagg

SEQ ID NO: 1245416 - RNA, 21 nt, Mycobacterium leprae
caaaacgucgaucuggggaau

SEQ ID NO: 1245417 - RNA, 18 nt, Mycobacterium leprae
caaaaccuaucccgaccg

SEQ ID NO: 1245418 - RNA, 21 nt, Mycobacterium leprae
caaaaccguagaacaacuaac

SEQ ID NO: 1245419 - RNA, 18 nt, Mycobacterium leprae
caaaaacucauguucuca

SEQ ID NO: 1245420 - RNA, 18 nt, Mycobacterium leprae
caaaacucacguuguuau

SEQ ID NO: 1245421 - RNA, 16 nt, Mycobacterium leprae
caaagaaauuuuaucg

SEQ ID NO: 1245422 - RNA, 19 nt, Mycobacterium leprae
caaacuugguuaauaucaa

SEQ ID NO: 1245423 - RNA, 15 nt, Mycobacterium leprae
caaacuuccucugcc

SEQ ID NO: 1245424 - RNA, 21 nt, Mycobacterium leprae
caaacuuccucugccaacaaa

SEQ ID NO: 1245425 - RNA, 14 nt, Mycobacterium leprae
caaacaacaacccg

SEQ ID NO: 1245426 - RNA, 14 nt, Mycobacterium leprae
caaaccaaacaaca

SEQ ID NO: 1245427 - RNA, 15 nt, Mycobacterium leprae
caaaccaaacaacaa

SEQ ID NO: 1245428 - RNA, 21 nt, Mycobacterium leprae
caaaccaguaccuuggucacg

SEQ ID NO: 1245429 - RNA, 14 nt, Mycobacterium leprae
caacagccacaccc

SEQ ID NO: 1245430 - RNA, 15 nt, Mycobacterium leprae
caacagcgcagugug

SEQ ID NO: 1245431 - RNA, 20 nt, Mycobacterium leprae
caacauuguaaucagcccaa

SEQ ID NO: 1245432 - RNA, 21 nt, Mycobacterium leprae
caacauuguaaucagcccaac

SEQ ID NO: 1245433 - RNA, 13 nt, Mycobacterium leprae
caaccagccccuc

SEQ ID NO: 1245434 - RNA, 18 nt, Mycobacterium leprae
caaccaugccgcgcgccu

SEQ ID NO: 1245435 - RNA, 21 nt, Mycobacterium leprae
caacccgggucauacacgugg

SEQ ID NO: 1245436 - RNA, 21 nt, Mycobacterium leprae
caacccgggacuugacuccuc

SEQ ID NO: 1245437 - RNA, 14 nt, Mycobacterium leprae
caaccggccggccc

SEQ ID NO: 1245438 - RNA, 23 nt, Mycobacterium leprae
caaagucgacguugcgcacugcc

SEQ ID NO: 1245439 - RNA, 16 nt, Mycobacterium leprae
caaaguccaugugcug

SEQ ID NO: 1245440 - RNA, 22 nt, Mycobacterium leprae
caaauaucgcguuugcagugac

SEQ ID NO: 1245441 - RNA, 16 nt, Mycobacterium leprae
caaaucagcaccaucc

SEQ ID NO: 1245442 - RNA, 19 nt, Mycobacterium leprae
caaaucauagugaccaaaa

SEQ ID NO: 1245443 - RNA, 12 nt, Mycobacterium leprae
caacgcgcaccu

SEQ ID NO: 1245444 - RNA, 17 nt, Mycobacterium leprae
caaccuagcaaguuguu

SEQ ID NO: 1245445 - RNA, 21 nt, Mycobacterium leprae
caacggcuacaacaaaguuau

SEQ ID NO: 1245446 - RNA, 17 nt, Mycobacterium leprae
caacgggccgcucgacc

SEQ ID NO: 1245447 - RNA, 16 nt, Mycobacterium leprae
caacgggacugacgga

SEQ ID NO: 1245448 - RNA, 17 nt, Mycobacterium leprae
caacgucacgucgacgg

SEQ ID NO: 1245449 - RNA, 16 nt, Mycobacterium leprae
caacguacugcaaugc

SEQ ID NO: 1245450 - RNA, 20 nt, Mycobacterium leprae
caacggucgcucggacuggg

SEQ ID NO: 1245451 - RNA, 23 nt, Mycobacterium leprae
caacggucgcucggacugggcuc

SEQ ID NO: 1245452 - RNA, 15 nt, Mycobacterium leprae
caacuauccucacac

SEQ ID NO: 1245453 - RNA, 13 nt, Mycobacterium leprae
caacguugcugcu

SEQ ID NO: 1245454 - RNA, 14 nt, Mycobacterium leprae
caacuaggagcgca

SEQ ID NO: 1245455 - RNA, 14 nt, Mycobacterium leprae
caacuaugcuggcu

SEQ ID NO: 1245456 - RNA, 16 nt, Mycobacterium leprae
caacguguaaggccag

SEQ ID NO: 1245457 - RNA, 18 nt, Mycobacterium leprae
caacguguaaggccagcg

SEQ ID NO: 1245458 - RNA, 17 nt, Mycobacterium leprae
caagauggcgucaccgu

SEQ ID NO: 1245459 - RNA, 22 nt, Mycobacterium leprae
caagcagugucugggccgggcu

SEQ ID NO: 1245460 - RNA, 16 nt, Mycobacterium leprae
caagcagucccaaggg

SEQ ID NO: 1245461 - RNA, 20 nt, Mycobacterium leprae
caagcucaaccaacaugugc

SEQ ID NO: 1245462 - RNA, 18 nt, Mycobacterium leprae
caagcucccggagagagu

SEQ ID NO: 1245463 - RNA, 21 nt, Mycobacterium leprae
caagcuagcucuccuacaacg

SEQ ID NO: 1245464 - RNA, 21 nt, Mycobacterium leprae
caagaaguacagucccgaaca

SEQ ID NO: 1245465 - RNA, 15 nt, Mycobacterium leprae
caagaucggccagcc

SEQ ID NO: 1245466 - RNA, 21 nt, Mycobacterium leprae
caagaucggccagccguggcu

SEQ ID NO: 1245467 - RNA, 18 nt, Mycobacterium leprae
caagauacuccgcgaaau

SEQ ID NO: 1245468 - RNA, 12 nt, Mycobacterium leprae
caagacugcacc

SEQ ID NO: 1245469 - RNA, 13 nt, Mycobacterium leprae
caagacugcaccc

SEQ ID NO: 1245470 - RNA, 15 nt, Mycobacterium leprae
caagacugcacccgg

SEQ ID NO: 1245471 - RNA, 16 nt, Mycobacterium leprae
caauacggugcaccag

SEQ ID NO: 1245472 - RNA, 18 nt, Mycobacterium leprae
caaucaccacuuuggcaa

SEQ ID NO: 1245473 - RNA, 12 nt, Mycobacterium leprae
caaucacaagga

SEQ ID NO: 1245474 - RNA, 14 nt, Mycobacterium leprae
caaucaacgagauc

SEQ ID NO: 1245475 - RNA, 19 nt, Mycobacterium leprae
caaucuaucaagccacacg

SEQ ID NO: 1245476 - RNA, 20 nt, Mycobacterium leprae
caaucagacacggaagcccu

SEQ ID NO: 1245477 - RNA, 13 nt, Mycobacterium leprae
caauccaccgugc

SEQ ID NO: 1245478 - RNA, 14 nt, Mycobacterium leprae
caaguggcugcuau

SEQ ID NO: 1245479 - RNA, 13 nt, Mycobacterium leprae
caaguggucccgc

SEQ ID NO: 1245480 - RNA, 18 nt, Mycobacterium leprae
caagugcggcgcccagca

SEQ ID NO: 1245481 - RNA, 19 nt, Mycobacterium leprae
caagugcggcgcccagcac

SEQ ID NO: 1245482 - RNA, 19 nt, Mycobacterium leprae
caagugccgcgggugcagu

SEQ ID NO: 1245483 - RNA, 23 nt, Mycobacterium leprae
caagugccgcgggugcaguugua

SEQ ID NO: 1245484 - RNA, 14 nt, Mycobacterium leprae
caaguccagcacga

SEQ ID NO: 1245485 - RNA, 18 nt, Mycobacterium leprae
caagucuucgaugcucug

SEQ ID NO: 1245486 - RNA, 13 nt, Mycobacterium leprae
caagcugcccggc

SEQ ID NO: 1245487 - RNA, 14 nt, Mycobacterium leprae
caaguaggucgauu

SEQ ID NO: 1245488 - RNA, 13 nt, Mycobacterium leprae
caagucaaaacca

SEQ ID NO: 1245489 - RNA, 16 nt, Mycobacterium leprae
cacgaacaacagagca

SEQ ID NO: 1245490 - RNA, 14 nt, Mycobacterium leprae
cacgagaccaugac

SEQ ID NO: 1245491 - RNA, 17 nt, Mycobacterium leprae
cacgacucaaagacgac

SEQ ID NO: 1245492 - RNA, 14 nt, Mycobacterium leprae
cacgagcggccuca

SEQ ID NO: 1245493 - RNA, 12 nt, Mycobacterium leprae
caccuguugcaa

SEQ ID NO: 1245494 - RNA, 16 nt, Mycobacterium leprae
caccugggcugugcug

SEQ ID NO: 1245495 - RNA, 19 nt, Mycobacterium leprae
cacgccgaacagccgcgcc

SEQ ID NO: 1245496 - RNA, 14 nt, Mycobacterium leprae
cacgauugcucuga

SEQ ID NO: 1245497 - RNA, 17 nt, Mycobacterium leprae
cacgccgauaucgacca

SEQ ID NO: 1245498 - RNA, 16 nt, Mycobacterium leprae
cacgcgacgccgccau

SEQ ID NO: 1245499 - RNA, 14 nt, Mycobacterium leprae
cacgcgcgccuggg

SEQ ID NO: 1245500 - RNA, 12 nt, Mycobacterium leprae
cacggguggugc

SEQ ID NO: 1245501 - RNA, 19 nt, Mycobacterium leprae
cacgggauggccaagccgc

SEQ ID NO: 1245502 - RNA, 19 nt, Mycobacterium leprae
cacggcggcaucucaacuu

SEQ ID NO: 1245503 - RNA, 20 nt, Mycobacterium leprae
cacgggauaggucaguucuc

SEQ ID NO: 1245504 - RNA, 16 nt, Mycobacterium leprae
caccucagcaacuucu

SEQ ID NO: 1245505 - RNA, 15 nt, Mycobacterium leprae
caccuacaacuucaa

SEQ ID NO: 1245506 - RNA, 18 nt, Mycobacterium leprae
caccguuguggaucgacc

SEQ ID NO: 1245507 - RNA, 18 nt, Mycobacterium leprae
caccggcgggccgaugcg

SEQ ID NO: 1245508 - RNA, 21 nt, Mycobacterium leprae
caccggcgcuuguaaggccag

SEQ ID NO: 1245509 - RNA, 17 nt, Mycobacterium leprae
caccggcuuagcccgcu

SEQ ID NO: 1245510 - RNA, 16 nt, Mycobacterium leprae
caccggcauggccgcu

SEQ ID NO: 1245511 - RNA, 19 nt, Mycobacterium leprae
caccggccaaaagccuugc

SEQ ID NO: 1245512 - RNA, 20 nt, Mycobacterium leprae
caccggcaucggacaggauc

SEQ ID NO: 1245513 - RNA, 13 nt, Mycobacterium leprae
caccggccaccgg

SEQ ID NO: 1245514 - RNA, 18 nt, Mycobacterium leprae
caccgcgaacgccucggc

SEQ ID NO: 1245515 - RNA, 17 nt, Mycobacterium leprae
caccgcuucagagugca

SEQ ID NO: 1245516 - RNA, 15 nt, Mycobacterium leprae
caccggaaagcugaa

SEQ ID NO: 1245517 - RNA, 15 nt, Mycobacterium leprae
cacccauaacgugcu

SEQ ID NO: 1245518 - RNA, 18 nt, Mycobacterium leprae
cacccgcgauagcuugca

SEQ ID NO: 1245519 - RNA, 14 nt, Mycobacterium leprae
cacccgcgccgccu

SEQ ID NO: 1245520 - RNA, 16 nt, Mycobacterium leprae
cacccgcgccgccugc

SEQ ID NO: 1245521 - RNA, 22 nt, Mycobacterium leprae
caccgagaucuuaaucgagcca

SEQ ID NO: 1245522 - RNA, 13 nt, Mycobacterium leprae
caccgaccgccuu

SEQ ID NO: 1245523 - RNA, 18 nt, Mycobacterium leprae
cacccugccgccacagca

SEQ ID NO: 1245524 - RNA, 16 nt, Mycobacterium leprae
caccagagacaccugu

SEQ ID NO: 1245525 - RNA, 20 nt, Mycobacterium leprae
caccagauggcuccccgagc

SEQ ID NO: 1245526 - RNA, 12 nt, Mycobacterium leprae
caccaaaggcgc

SEQ ID NO: 1245527 - RNA, 13 nt, Mycobacterium leprae
cacauccgauuug

SEQ ID NO: 1245528 - RNA, 20 nt, Mycobacterium leprae
cacauaucuaauugggaucg

SEQ ID NO: 1245529 - RNA, 15 nt, Mycobacterium leprae
cacauacgcucugau

SEQ ID NO: 1245530 - RNA, 12 nt, Mycobacterium leprae
cacauacggcaa

SEQ ID NO: 1245531 - RNA, 22 nt, Mycobacterium leprae
cacaucaucgaucagacccuug

SEQ ID NO: 1245532 - RNA, 23 nt, Mycobacterium leprae
cacauaugccgccauguuaaaca

SEQ ID NO: 1245533 - RNA, 19 nt, Mycobacterium leprae
cacaagauugcagcccuga

SEQ ID NO: 1245534 - RNA, 14 nt, Mycobacterium leprae
cacaaggaauugcu

SEQ ID NO: 1245535 - RNA, 22 nt, Mycobacterium leprae
cacacaggucauccuugcgcug

SEQ ID NO: 1245536 - RNA, 22 nt, Mycobacterium leprae
cacacagcaaugugcgcugcuc

SEQ ID NO: 1245537 - RNA, 14 nt, Mycobacterium leprae
cacacggccgugca

SEQ ID NO: 1245538 - RNA, 13 nt, Mycobacterium leprae
caaugcucugcug

SEQ ID NO: 1245539 - RNA, 19 nt, Mycobacterium leprae
caaugcugagcgaagaauu

SEQ ID NO: 1245540 - RNA, 14 nt, Mycobacterium leprae
caaugacuacgaca

SEQ ID NO: 1245541 - RNA, 14 nt, Mycobacterium leprae
caaugcucucaccc

SEQ ID NO: 1245542 - RNA, 21 nt, Mycobacterium leprae
caauggcaguagcaucgaaca

SEQ ID NO: 1245543 - RNA, 17 nt, Mycobacterium leprae
caaugggugugacacca

SEQ ID NO: 1245544 - RNA, 17 nt, Mycobacterium leprae
caaugugcgcugcuccg

SEQ ID NO: 1245545 - RNA, 17 nt, Mycobacterium leprae
auuuuucuugaaaaaua

SEQ ID NO: 1245546 - RNA, 11 nt, Mycobacterium leprae
caaaaaaaggg

SEQ ID NO: 1245547 - RNA, 22 nt, Mycobacterium leprae
auuuucgauccgcucaaagccu

SEQ ID NO: 1245548 - RNA, 20 nt, Mycobacterium leprae
auuuucauagggagaaugcc

SEQ ID NO: 1245549 - RNA, 19 nt, Mycobacterium leprae
auuugaggucgacacagaa

SEQ ID NO: 1245550 - RNA, 17 nt, Mycobacterium leprae
auuuguuuuccugugca

SEQ ID NO: 1245551 - RNA, 15 nt, Mycobacterium leprae
auuugaacugggacc

SEQ ID NO: 1245552 - RNA, 22 nt, Mycobacterium leprae
auuucggcgucgugaucggcau

SEQ ID NO: 1245553 - RNA, 22 nt, Mycobacterium leprae
auuuccggaacaacagacacau

SEQ ID NO: 1245554 - RNA, 15 nt, Mycobacterium leprae
auuggcugaucaaaa

SEQ ID NO: 1245555 - RNA, 20 nt, Mycobacterium leprae
auugggcagcuaagaagcug

SEQ ID NO: 1245556 - RNA, 22 nt, Mycobacterium leprae
aaaagggaccgggcucuuucuu

SEQ ID NO: 1245557 - RNA, 18 nt, Mycobacterium leprae
auugguugccgagcuguu

SEQ ID NO: 1245558 - RNA, 13 nt, Mycobacterium leprae
auuguacugacug

SEQ ID NO: 1245559 - RNA, 16 nt, Mycobacterium leprae
auuguacugacugggg

SEQ ID NO: 1245560 - RNA, 19 nt, Mycobacterium leprae
auuguacuuugugugcaug

SEQ ID NO: 1245561 - RNA, 11 nt, Mycobacterium leprae
auuguggcugg

SEQ ID NO: 1245562 - RNA, 20 nt, Mycobacterium leprae
auuguguaacgauuagcaug

SEQ ID NO: 1245563 - RNA, 16 nt, Mycobacterium leprae
auuuaaauuucaagac

SEQ ID NO: 1245564 - RNA, 19 nt, Mycobacterium leprae
auuuaaauuucaagacaga

SEQ ID NO: 1245565 - RNA, 23 nt, Mycobacterium leprae
auugccucggcuucccgauccca

SEQ ID NO: 1245566 - RNA, 15 nt, Mycobacterium leprae
auugccugaugccau

SEQ ID NO: 1245567 - RNA, 15 nt, Mycobacterium leprae
auugcgacauccaaa

SEQ ID NO: 1245568 - RNA, 20 nt, Mycobacterium leprae
auugcggacaauucaacgaa

SEQ ID NO: 1245569 - RNA, 19 nt, Mycobacterium leprae
auugaucgggcccagcacc

SEQ ID NO: 1245570 - RNA, 18 nt, Mycobacterium leprae
auugaaaauuucgucuag

SEQ ID NO: 1245571 - RNA, 17 nt, Mycobacterium leprae
auugcagcccugagcac

SEQ ID NO: 1245572 - RNA, 18 nt, Mycobacterium leprae
auugcagcccugagcacc

SEQ ID NO: 1245573 - RNA, 13 nt, Mycobacterium leprae
auucuucucuaaa

SEQ ID NO: 1245574 - RNA, 14 nt, Mycobacterium leprae
auucucuguugcug

SEQ ID NO: 1245575 - RNA, 18 nt, Mycobacterium leprae
auucugcacgcccaacac

SEQ ID NO: 1245576 - RNA, 16 nt, Mycobacterium leprae
auucucgcgccaccgc

SEQ ID NO: 1245577 - RNA, 13 nt, Mycobacterium leprae
auucguacaacgu

SEQ ID NO: 1245578 - RNA, 12 nt, Mycobacterium leprae
auuccacugcca

SEQ ID NO: 1245579 - RNA, 14 nt, Mycobacterium leprae
auucauuguacuga

SEQ ID NO: 1245580 - RNA, 17 nt, Mycobacterium leprae
auuacugacuuggccuu

SEQ ID NO: 1245581 - RNA, 23 nt, Mycobacterium leprae
auuaucgccggcuugaaauuacu

SEQ ID NO: 1245582 - RNA, 22 nt, Mycobacterium leprae
auguucuguuguggggguggag

SEQ ID NO: 1245583 - RNA, 21 nt, Mycobacterium leprae
auguuccuauguuggucugcu

SEQ ID NO: 1245584 - RNA, 14 nt, Mycobacterium leprae
auguuauguagcug

SEQ ID NO: 1245585 - RNA, 17 nt, Mycobacterium leprae
auguggccgcaccugaa

SEQ ID NO: 1245586 - RNA, 20 nt, Mycobacterium leprae
augugguugucggaccacuc

SEQ ID NO: 1245587 - RNA, 15 nt, Mycobacterium leprae
augugggcuuuccuu

SEQ ID NO: 1245588 - RNA, 16 nt, Mycobacterium leprae
augucggccacugcac

SEQ ID NO: 1245589 - RNA, 14 nt, Mycobacterium leprae
augucgugcugacc

SEQ ID NO: 1245590 - RNA, 16 nt, Mycobacterium leprae
augucggacaaugagu

SEQ ID NO: 1245591 - RNA, 14 nt, Mycobacterium leprae
augucggugguggg

SEQ ID NO: 1245592 - RNA, 20 nt, Mycobacterium leprae
augucgccgggugcgcugcu

SEQ ID NO: 1245593 - RNA, 22 nt, Mycobacterium leprae
auguacaacaccagaucagcag

SEQ ID NO: 1245594 - RNA, 23 nt, Mycobacterium leprae
auguacaacgggaucgacaaaau

SEQ ID NO: 1245595 - RNA, 14 nt, Mycobacterium leprae
augguuagcaugag

SEQ ID NO: 1245596 - RNA, 19 nt, Mycobacterium leprae
auggugcaagggauaacau

SEQ ID NO: 1245597 - RNA, 18 nt, Mycobacterium leprae
auggugccauugguggga

SEQ ID NO: 1245598 - RNA, 19 nt, Mycobacterium leprae
auggugccauuggugggau

SEQ ID NO: 1245599 - RNA, 21 nt, Mycobacterium leprae
auggugccauuggugggauga

SEQ ID NO: 1245600 - RNA, 16 nt, Mycobacterium leprae
auggguuuggugggca

SEQ ID NO: 1245601 - RNA, 23 nt, Mycobacterium leprae
auggcugcaacgacuggaugacc

SEQ ID NO: 1245602 - RNA, 18 nt, Mycobacterium leprae
auggcuccaaguggcugc

SEQ ID NO: 1245603 - RNA, 20 nt, Mycobacterium leprae
auggcuccauagaacaccga

SEQ ID NO: 1245604 - RNA, 17 nt, Mycobacterium leprae
auggcaguccacaggac

SEQ ID NO: 1245605 - RNA, 22 nt, Mycobacterium leprae
auggacaaccugggcggcauga

SEQ ID NO: 1245606 - RNA, 16 nt, Mycobacterium leprae
auggagccaccacaaa

SEQ ID NO: 1245607 - RNA, 17 nt, Mycobacterium leprae
auggaaggcggagaugu

SEQ ID NO: 1245608 - RNA, 19 nt, Mycobacterium leprae
augcugccugcgucaguaa

SEQ ID NO: 1245609 - RNA, 15 nt, Mycobacterium leprae
augcacacuaaaacg

SEQ ID NO: 1245610 - RNA, 15 nt, Mycobacterium leprae
augcagaugcaagau

SEQ ID NO: 1245611 - RNA, 13 nt, Mycobacterium leprae
augccgacagugc

SEQ ID NO: 1245612 - RNA, 15 nt, Mycobacterium leprae
augccgaagcagacu

SEQ ID NO: 1245613 - RNA, 21 nt, Mycobacterium leprae
augccgaucugggggugcacc

SEQ ID NO: 1245614 - RNA, 16 nt, Mycobacterium leprae
augccacgagcucgaa

SEQ ID NO: 1245615 - RNA, 23 nt, Mycobacterium leprae
augcgccugaagguuaucgacac

SEQ ID NO: 1245616 - RNA, 19 nt, Mycobacterium leprae
augccgcgcgccugcgcuu

SEQ ID NO: 1245617 - RNA, 20 nt, Mycobacterium leprae
augccuacccuagagucgac

SEQ ID NO: 1245618 - RNA, 17 nt, Mycobacterium leprae
augccugcuugcuggcu

SEQ ID NO: 1245619 - RNA, 17 nt, Mycobacterium leprae
augagcaguagaccaag

SEQ ID NO: 1245620 - RNA, 13 nt, Mycobacterium leprae
augagcaacacgu

SEQ ID NO: 1245621 - RNA, 18 nt, Mycobacterium leprae
augaugccaggggcuggg

SEQ ID NO: 1245622 - RNA, 21 nt, Mycobacterium leprae
augaugguuuggcugccagaa

SEQ ID NO: 1245623 - RNA, 13 nt, Mycobacterium leprae
augcaagauuauu

SEQ ID NO: 1245624 - RNA, 23 nt, Mycobacterium leprae
augcaaccacacccuggcugggc

SEQ ID NO: 1245625 - RNA, 10 nt, Mycobacterium leprae
aaaauucucg

SEQ ID NO: 1245626 - RNA, 21 nt, Mycobacterium leprae
aaaauuagucgaggccagaug

SEQ ID NO: 1245627 - RNA, 14 nt, Mycobacterium leprae
cagcggcccaaccc

SEQ ID NO: 1245628 - RNA, 17 nt, Mycobacterium leprae
cagcggcccaacccggc

SEQ ID NO: 1245629 - RNA, 20 nt, Mycobacterium leprae
cagcggcggccgugauuuuc

SEQ ID NO: 1245630 - RNA, 15 nt, Mycobacterium leprae
aaaauguuuuguuua

SEQ ID NO: 1245631 - RNA, 21 nt, Mycobacterium leprae
aaaauguuuuguuuauguucg

SEQ ID NO: 1245632 - RNA, 14 nt, Mycobacterium leprae
cagcgccugccccg

SEQ ID NO: 1245633 - RNA, 15 nt, Mycobacterium leprae
cagcgccugccccgc

SEQ ID NO: 1245634 - RNA, 16 nt, Mycobacterium leprae
cagcgccugccccgcu

SEQ ID NO: 1245635 - RNA, 14 nt, Mycobacterium leprae
cagcgcagugugcu

SEQ ID NO: 1245636 - RNA, 14 nt, Mycobacterium leprae
cagcccgcgccgcc

SEQ ID NO: 1245637 - RNA, 20 nt, Mycobacterium leprae
cagccaacggcuagccagag

SEQ ID NO: 1245638 - RNA, 21 nt, Mycobacterium leprae
cagccaacggcuagccagaga

SEQ ID NO: 1245639 - RNA, 15 nt, Mycobacterium leprae
cagccaacaccacca

SEQ ID NO: 1245640 - RNA, 22 nt, Mycobacterium leprae
cagccaaucuuuacgcgcgccu

SEQ ID NO: 1245641 - RNA, 11 nt, Mycobacterium leprae
cagcagccacu

SEQ ID NO: 1245642 - RNA, 15 nt, Mycobacterium leprae
cagccagaccaacau

SEQ ID NO: 1245643 - RNA, 16 nt, Mycobacterium leprae
cagccagcaagcaggc

SEQ ID NO: 1245644 - RNA, 16 nt, Mycobacterium leprae
cagccagcaaggcaac

SEQ ID NO: 1245645 - RNA, 19 nt, Mycobacterium leprae
cagcgauaccagcgucgcu

SEQ ID NO: 1245646 - RNA, 19 nt, Mycobacterium leprae
cagccuuucaggugugcug

SEQ ID NO: 1245647 - RNA, 16 nt, Mycobacterium leprae
cagcgacgcggaacgc

SEQ ID NO: 1245648 - RNA, 14 nt, Mycobacterium leprae
cagccuagacugac

SEQ ID NO: 1245649 - RNA, 13 nt, Mycobacterium leprae
cagccuaggugau

SEQ ID NO: 1245650 - RNA, 17 nt, Mycobacterium leprae
cagccguugcugcugcc

SEQ ID NO: 1245651 - RNA, 18 nt, Mycobacterium leprae
cagccgucgaagcccugc

SEQ ID NO: 1245652 - RNA, 14 nt, Mycobacterium leprae
cagccgggugaucc

SEQ ID NO: 1245653 - RNA, 19 nt, Mycobacterium leprae
cagccgggcuaaggugcgu

SEQ ID NO: 1245654 - RNA, 22 nt, Mycobacterium leprae
cagccgcguccagacaccacug

SEQ ID NO: 1245655 - RNA, 18 nt, Mycobacterium leprae
cagggugcgugacaaugu

SEQ ID NO: 1245656 - RNA, 16 nt, Mycobacterium leprae
cagguaauugacaccg

SEQ ID NO: 1245657 - RNA, 16 nt, Mycobacterium leprae
cagggcgagcugcgcc

SEQ ID NO: 1245658 - RNA, 20 nt, Mycobacterium leprae
caggguacucagcuggugcu

SEQ ID NO: 1245659 - RNA, 21 nt, Mycobacterium leprae
caggguacucagcuggugcug

SEQ ID NO: 1245660 - RNA, 17 nt, Mycobacterium leprae
caggcgacgucacgcug

SEQ ID NO: 1245661 - RNA, 18 nt, Mycobacterium leprae
caggcgacacgcgcgaca

SEQ ID NO: 1245662 - RNA, 20 nt, Mycobacterium leprae
caggcagucuuucagugccg

SEQ ID NO: 1245663 - RNA, 23 nt, Mycobacterium leprae
caggauuuuuacgacguagaaca

SEQ ID NO: 1245664 - RNA, 21 nt, Mycobacterium leprae
caggauugcguugaccgccgc

SEQ ID NO: 1245665 - RNA, 15 nt, Mycobacterium leprae
caggcaacacgugcu

SEQ ID NO: 1245666 - RNA, 15 nt, Mycobacterium leprae
caggcaaccgcccgc

SEQ ID NO: 1245667 - RNA, 14 nt, Mycobacterium leprae
caggaguaauaacu

SEQ ID NO: 1245668 - RNA, 21 nt, Mycobacterium leprae
caggagcuucaacaccauggu

SEQ ID NO: 1245669 - RNA, 14 nt, Mycobacterium leprae
caggaccgugcuau

SEQ ID NO: 1245670 - RNA, 17 nt, Mycobacterium leprae
caggaauuuagaggcug

SEQ ID NO: 1245671 - RNA, 20 nt, Mycobacterium leprae
caggaauuuagaggcugcac

SEQ ID NO: 1245672 - RNA, 22 nt, Mycobacterium leprae
caggaauuuagaggcugcaccg

SEQ ID NO: 1245673 - RNA, 22 nt, Mycobacterium leprae
caggaauuccgcuacaguaaug

SEQ ID NO: 1245674 - RNA, 17 nt, Mycobacterium leprae
caggaucacguguggcc

SEQ ID NO: 1245675 - RNA, 24 nt, Mycobacterium leprae
caggaucgcaaaacaacguaccua

SEQ ID NO: 1245676 - RNA, 16 nt, Mycobacterium leprae
caggaucccugauccu

SEQ ID NO: 1245677 - RNA, 17 nt, Mycobacterium leprae
caggaugcgugcccaua

SEQ ID NO: 1245678 - RNA, 19 nt, Mycobacterium leprae
caggaugcgugcccauauc

SEQ ID NO: 1245679 - RNA, 18 nt, Mycobacterium leprae
cagcuucgcagacacagc

SEQ ID NO: 1245680 - RNA, 15 nt, Mycobacterium leprae
cagcuggugaccuga

SEQ ID NO: 1245681 - RNA, 14 nt, Mycobacterium leprae
cagcuggccaagcg

SEQ ID NO: 1245682 - RNA, 21 nt, Mycobacterium leprae
cagcuggccgggaucggcggc

SEQ ID NO: 1245683 - RNA, 18 nt, Mycobacterium leprae
cagcuggcggaugcgggc

SEQ ID NO: 1245684 - RNA, 13 nt, Mycobacterium leprae
cagcuuguuggcc

SEQ ID NO: 1245685 - RNA, 17 nt, Mycobacterium leprae
cagcuuguuggccaucg

SEQ ID NO: 1245686 - RNA, 15 nt, Mycobacterium leprae
cagcuucggucuggc

SEQ ID NO: 1245687 - RNA, 23 nt, Mycobacterium leprae
caggaacgcgucggugacucuga

SEQ ID NO: 1245688 - RNA, 20 nt, Mycobacterium leprae
cagcugcaacaccuccucug

SEQ ID NO: 1245689 - RNA, 21 nt, Mycobacterium leprae
cagcugcagucgauuagccgg

SEQ ID NO: 1245690 - RNA, 15 nt, Mycobacterium leprae
cagcugccauuggcc

SEQ ID NO: 1245691 - RNA, 23 nt, Mycobacterium leprae
cagcugcuuuaccuucaggucua

SEQ ID NO: 1245692 - RNA, 16 nt, Mycobacterium leprae
cagcucuuuucgucug

SEQ ID NO: 1245693 - RNA, 14 nt, Mycobacterium leprae
cagcaacagccaca

SEQ ID NO: 1245694 - RNA, 18 nt, Mycobacterium leprae
aaaaugcucccccaaugc

SEQ ID NO: 1245695 - RNA, 19 nt, Mycobacterium leprae
cagcaagugaccaccaggg

SEQ ID NO: 1245696 - RNA, 13 nt, Mycobacterium leprae
cagauccugggcg

SEQ ID NO: 1245697 - RNA, 17 nt, Mycobacterium leprae
aaaaucggcgucacggu

SEQ ID NO: 1245698 - RNA, 23 nt, Mycobacterium leprae
cagauucccgcugagcaauuucu

SEQ ID NO: 1245699 - RNA, 14 nt, Mycobacterium leprae
cagauugcagucca

SEQ ID NO: 1245700 - RNA, 21 nt, Mycobacterium leprae
aaaaucuggcgccauauccuc

SEQ ID NO: 1245701 - RNA, 19 nt, Mycobacterium leprae
aaaaucugguuagcaacug

SEQ ID NO: 1245702 - RNA, 18 nt, Mycobacterium leprae
cagcacuaaagucuucaa

SEQ ID NO: 1245703 - RNA, 13 nt, Mycobacterium leprae
cagcaccaaccug

SEQ ID NO: 1245704 - RNA, 15 nt, Mycobacterium leprae
cagcaccacagcgcc

SEQ ID NO: 1245705 - RNA, 14 nt, Mycobacterium leprae
cagcaaucaaugug

SEQ ID NO: 1245706 - RNA, 11 nt, Mycobacterium leprae
cagcaccacug

SEQ ID NO: 1245707 - RNA, 15 nt, Mycobacterium leprae
cagcaccauggaaca

SEQ ID NO: 1245708 - RNA, 11 nt, Mycobacterium leprae
cagcaccaucc

SEQ ID NO: 1245709 - RNA, 20 nt, Mycobacterium leprae
cagcaccucgaaucagcauc

SEQ ID NO: 1245710 - RNA, 16 nt, Mycobacterium leprae
aaaauccucccaguga

SEQ ID NO: 1245711 - RNA, 22 nt, Mycobacterium leprae
cagauaucgcacacagcggcca

SEQ ID NO: 1245712 - RNA, 14 nt, Mycobacterium leprae
cagaucacauuggu

SEQ ID NO: 1245713 - RNA, 13 nt, Mycobacterium leprae
cagauaccauuac

SEQ ID NO: 1245714 - RNA, 19 nt, Mycobacterium leprae
cagauaccauuacgcacua

SEQ ID NO: 1245715 - RNA, 14 nt, Mycobacterium leprae
cagagccgcgcgca

SEQ ID NO: 1245716 - RNA, 18 nt, Mycobacterium leprae
aaaaucagacugcccaga

SEQ ID NO: 1245717 - RNA, 22 nt, Mycobacterium leprae
cagagcgcucggcgugcggaua

SEQ ID NO: 1245718 - RNA, 14 nt, Mycobacterium leprae
cagaggcugcaguc

SEQ ID NO: 1245719 - RNA, 17 nt, Mycobacterium leprae
cagagguaaaucuggca

SEQ ID NO: 1245720 - RNA, 19 nt, Mycobacterium leprae
cagagguaaaucuggcaag

SEQ ID NO: 1245721 - RNA, 18 nt, Mycobacterium leprae
cagaggcgcgccgugcca

SEQ ID NO: 1245722 - RNA, 21 nt, Mycobacterium leprae
cagaaucgucggcuaacucga

SEQ ID NO: 1245723 - RNA, 22 nt, Mycobacterium leprae
cagaauauugcgacauccaaag

SEQ ID NO: 1245724 - RNA, 15 nt, Mycobacterium leprae
cagacucgagucccg

SEQ ID NO: 1245725 - RNA, 20 nt, Mycobacterium leprae
cagacgagcucucagucgaa

SEQ ID NO: 1245726 - RNA, 18 nt, Mycobacterium leprae
cagaccgaaaucaaagcc

SEQ ID NO: 1245727 - RNA, 17 nt, Mycobacterium leprae
cagacccgggacuuuag

SEQ ID NO: 1245728 - RNA, 22 nt, Mycobacterium leprae
cagaccgcuaugcggacggaca

SEQ ID NO: 1245729 - RNA, 17 nt, Mycobacterium leprae
cagaccucuuccgccgc

SEQ ID NO: 1245730 - RNA, 17 nt, Mycobacterium leprae
cagaaaauucagggaau

SEQ ID NO: 1245731 - RNA, 14 nt, Mycobacterium leprae
cagaaccaucccaa

SEQ ID NO: 1245732 - RNA, 17 nt, Mycobacterium leprae
cagaaggggcugcggcu

SEQ ID NO: 1245733 - RNA, 19 nt, Mycobacterium leprae
cagaaguggucgauuugca

SEQ ID NO: 1245734 - RNA, 20 nt, Mycobacterium leprae
cagaagcuguugugaagcug

SEQ ID NO: 1245735 - RNA, 22 nt, Mycobacterium leprae
cagaagcuguugugaagcugag

SEQ ID NO: 1245736 - RNA, 14 nt, Mycobacterium leprae
cagaagaccgugcu

SEQ ID NO: 1245737 - RNA, 23 nt, Mycobacterium leprae
cacuucagcgacaggcagcugca

SEQ ID NO: 1245738 - RNA, 17 nt, Mycobacterium leprae
cacuuccggcuucucca

SEQ ID NO: 1245739 - RNA, 22 nt, Mycobacterium leprae
cacuugcgauaauuaugagugg

SEQ ID NO: 1245740 - RNA, 17 nt, Mycobacterium leprae
cacuguuuuaagcgaaa

SEQ ID NO: 1245741 - RNA, 19 nt, Mycobacterium leprae
cacuuacaccaacauaguc

SEQ ID NO: 1245742 - RNA, 18 nt, Mycobacterium leprae
cacuuagcgugagccugg

SEQ ID NO: 1245743 - RNA, 13 nt, Mycobacterium leprae
cacuggugguggc

SEQ ID NO: 1245744 - RNA, 18 nt, Mycobacterium leprae
cacuauauauauauuaau

SEQ ID NO: 1245745 - RNA, 19 nt, Mycobacterium leprae
cacuacuccugcugacggu

SEQ ID NO: 1245746 - RNA, 16 nt, Mycobacterium leprae
cacucacccggucguc

SEQ ID NO: 1245747 - RNA, 22 nt, Mycobacterium leprae
cacucauugcuguuagacugca

SEQ ID NO: 1245748 - RNA, 14 nt, Mycobacterium leprae
cacucagugguggg

SEQ ID NO: 1245749 - RNA, 19 nt, Mycobacterium leprae
cacguucuugccauccgcu

SEQ ID NO: 1245750 - RNA, 19 nt, Mycobacterium leprae
cacguucgaucggcagcca

SEQ ID NO: 1245751 - RNA, 18 nt, Mycobacterium leprae
cacguucggaucauugcu

SEQ ID NO: 1245752 - RNA, 18 nt, Mycobacterium leprae
cacgugcaaacugcugcg

SEQ ID NO: 1245753 - RNA, 22 nt, Mycobacterium leprae
cacgugcaucgagaacugcacu

SEQ ID NO: 1245754 - RNA, 18 nt, Mycobacterium leprae
cacuaccaucuauaguac

SEQ ID NO: 1245755 - RNA, 15 nt, Mycobacterium leprae
cacuacccgacacaa

SEQ ID NO: 1245756 - RNA, 21 nt, Mycobacterium leprae
cacuaauaagcucgugggcgg

SEQ ID NO: 1245757 - RNA, 15 nt, Mycobacterium leprae
cacuaacaccgugcc

SEQ ID NO: 1245758 - RNA, 15 nt, Mycobacterium leprae
cacuaaaacgccccu

SEQ ID NO: 1245759 - RNA, 12 nt, Mycobacterium leprae
cacuaaaugcca

SEQ ID NO: 1245760 - RNA, 22 nt, Mycobacterium leprae
cacuaaaugccauaucguuccc

SEQ ID NO: 1245761 - RNA, 16 nt, Mycobacterium leprae
cacuccacgcacccug

SEQ ID NO: 1245762 - RNA, 13 nt, Mycobacterium leprae
cacugaucccaga

SEQ ID NO: 1245763 - RNA, 11 nt, Mycobacterium leprae
cacugccagag

SEQ ID NO: 1245764 - RNA, 19 nt, Mycobacterium leprae
cacugcacgaccacacugu

SEQ ID NO: 1245765 - RNA, 16 nt, Mycobacterium leprae
caucuuaacgccaguu

SEQ ID NO: 1245766 - RNA, 15 nt, Mycobacterium leprae
caucucgacaaccuc

SEQ ID NO: 1245767 - RNA, 16 nt, Mycobacterium leprae
caucuaaacugacgcu

SEQ ID NO: 1245768 - RNA, 22 nt, Mycobacterium leprae
caucuaaacugacgcugcgcug

SEQ ID NO: 1245769 - RNA, 23 nt, Mycobacterium leprae
caucgucaacgaccugcaacgcu

SEQ ID NO: 1245770 - RNA, 16 nt, Mycobacterium leprae
caucgcggcugccacu

SEQ ID NO: 1245771 - RNA, 18 nt, Mycobacterium leprae
caucuaugcuggccuugc

SEQ ID NO: 1245772 - RNA, 15 nt, Mycobacterium leprae
caucuagcauuccuc

SEQ ID NO: 1245773 - RNA, 13 nt, Mycobacterium leprae
caucuaucuccac

SEQ ID NO: 1245774 - RNA, 12 nt, Mycobacterium leprae
caucuauaguac

SEQ ID NO: 1245775 - RNA, 22 nt, Mycobacterium leprae
cauccucgguaucgucaaauuu

SEQ ID NO: 1245776 - RNA, 22 nt, Mycobacterium leprae
cauccguuccucuuaacaacuu

SEQ ID NO: 1245777 - RNA, 17 nt, Mycobacterium leprae
cauccgaaucaccgcug

SEQ ID NO: 1245778 - RNA, 23 nt, Mycobacterium leprae
cauccgaaacccgaaaccaagcc

SEQ ID NO: 1245779 - RNA, 17 nt, Mycobacterium leprae
caucgcagagcucacug

SEQ ID NO: 1245780 - RNA, 13 nt, Mycobacterium leprae
caucgccuuccaa

SEQ ID NO: 1245781 - RNA, 13 nt, Mycobacterium leprae
cauccugcagcau

SEQ ID NO: 1245782 - RNA, 12 nt, Mycobacterium leprae
cauccugcugua

SEQ ID NO: 1245783 - RNA, 19 nt, Mycobacterium leprae
caucgacagcacccagcuc

SEQ ID NO: 1245784 - RNA, 13 nt, Mycobacterium leprae
caucgauacacuu

SEQ ID NO: 1245785 - RNA, 14 nt, Mycobacterium leprae
caucgaugcacugu

SEQ ID NO: 1245786 - RNA, 17 nt, Mycobacterium leprae
caucaguaucagugcca

SEQ ID NO: 1245787 - RNA, 22 nt, Mycobacterium leprae
caucaucgcuaagacucaccaa

SEQ ID NO: 1245788 - RNA, 16 nt, Mycobacterium leprae
caucagaaauguccuu

SEQ ID NO: 1245789 - RNA, 23 nt, Mycobacterium leprae
caucaggagauacucugaaaaua

SEQ ID NO: 1245790 - RNA, 17 nt, Mycobacterium leprae
caucaacggcuacaaca

SEQ ID NO: 1245791 - RNA, 21 nt, Mycobacterium leprae
caucaaccggugauugccgcg

SEQ ID NO: 1245792 - RNA, 12 nt, Mycobacterium leprae
caucaagccucc

SEQ ID NO: 1245793 - RNA, 18 nt, Mycobacterium leprae
cauaugugcuauagcaca

SEQ ID NO: 1245794 - RNA, 20 nt, Mycobacterium leprae
cauaugugcuauagcacacc

SEQ ID NO: 1245795 - RNA, 16 nt, Mycobacterium leprae
cauagugcaagugcac

SEQ ID NO: 1245796 - RNA, 17 nt, Mycobacterium leprae
cauaguggaucuccuaa

SEQ ID NO: 1245797 - RNA, 18 nt, Mycobacterium leprae
cauauacaaaccccagac

SEQ ID NO: 1245798 - RNA, 24 nt, Mycobacterium leprae
cauacgguuauugacgugaucgca

SEQ ID NO: 1245799 - RNA, 20 nt, Mycobacterium leprae
cauagucagaucaaccaaau

SEQ ID NO: 1245800 - RNA, 19 nt, Mycobacterium leprae
cauaaccacauugugugac

SEQ ID NO: 1245801 - RNA, 18 nt, Mycobacterium leprae
cauaaccgcauaaacuca

SEQ ID NO: 1245802 - RNA, 17 nt, Mycobacterium leprae
cauaaaauauaacgcga

SEQ ID NO: 1245803 - RNA, 17 nt, Mycobacterium leprae
cauacagcuaaccucca

SEQ ID NO: 1245804 - RNA, 14 nt, Mycobacterium leprae
cauacagugcaccg

SEQ ID NO: 1245805 - RNA, 18 nt, Mycobacterium leprae
cauaccgaacucgaugcc

SEQ ID NO: 1245806 - RNA, 19 nt, Mycobacterium leprae
caguuggguuugcugucaa

SEQ ID NO: 1245807 - RNA, 21 nt, Mycobacterium leprae
caguuuaccgugccuugcggc

SEQ ID NO: 1245808 - RNA, 20 nt, Mycobacterium leprae
caguuuuucucacaccugcg

SEQ ID NO: 1245809 - RNA, 18 nt, Mycobacterium leprae
caguugcgggacagaagc

SEQ ID NO: 1245810 - RNA, 14 nt, Mycobacterium leprae
caguucaccacauc

SEQ ID NO: 1245811 - RNA, 15 nt, Mycobacterium leprae
caguucacgcuggcc

SEQ ID NO: 1245812 - RNA, 18 nt, Mycobacterium leprae
caguuaucuagcccagaa

SEQ ID NO: 1245813 - RNA, 24 nt, Mycobacterium leprae
caguuauuguuuccgauguagcac

SEQ ID NO: 1245814 - RNA, 13 nt, Mycobacterium leprae
caguuaaagguaa

SEQ ID NO: 1245815 - RNA, 12 nt, Mycobacterium leprae
cagguagugagu

SEQ ID NO: 1245816 - RNA, 23 nt, Mycobacterium leprae
cagguagugaguacaccacccaa

SEQ ID NO: 1245817 - RNA, 19 nt, Mycobacterium leprae
cagugccuugggcacggag

SEQ ID NO: 1245818 - RNA, 14 nt, Mycobacterium leprae
cagugccguaaauc

SEQ ID NO: 1245819 - RNA, 20 nt, Mycobacterium leprae
cagugccugaccaucgggca

SEQ ID NO: 1245820 - RNA, 14 nt, Mycobacterium leprae
cagugcuucccuug

SEQ ID NO: 1245821 - RNA, 17 nt, Mycobacterium leprae
cagugggccaguggcuu

SEQ ID NO: 1245822 - RNA, 14 nt, Mycobacterium leprae
caguggcugcaccg

SEQ ID NO: 1245823 - RNA, 21 nt, Mycobacterium leprae
caguggcgggcuugaccugga

SEQ ID NO: 1245824 - RNA, 15 nt, Mycobacterium leprae
caguguagagggcca

SEQ ID NO: 1245825 - RNA, 21 nt, Mycobacterium leprae
caguguagugucaaucuacac

SEQ ID NO: 1245826 - RNA, 12 nt, Mycobacterium leprae
ccacggcagcua

SEQ ID NO: 1245827 - RNA, 18 nt, Mycobacterium leprae
ccacgccgauaucgacca

SEQ ID NO: 1245828 - RNA, 17 nt, Mycobacterium leprae
ccacuauuucaaagcgc

SEQ ID NO: 1245829 - RNA, 11 nt, Mycobacterium leprae
ccacuaacaca

SEQ ID NO: 1245830 - RNA, 20 nt, Mycobacterium leprae
ccacgucgggcagcaaccgc

SEQ ID NO: 1245831 - RNA, 13 nt, Mycobacterium leprae
ccacgguggccuu

SEQ ID NO: 1245832 - RNA, 20 nt, Mycobacterium leprae
ccacaggcagagccaaacau

SEQ ID NO: 1245833 - RNA, 21 nt, Mycobacterium leprae
ccacaggcgauucauggcuug

SEQ ID NO: 1245834 - RNA, 22 nt, Mycobacterium leprae
ccaccauauaagcgaaguccuu

SEQ ID NO: 1245835 - RNA, 21 nt, Mycobacterium leprae
ccaccagggaagaucucagcc

SEQ ID NO: 1245836 - RNA, 16 nt, Mycobacterium leprae
ccacccgucccgcagc

SEQ ID NO: 1245837 - RNA, 20 nt, Mycobacterium leprae
ccacgaggggguuaccuggg

SEQ ID NO: 1245838 - RNA, 16 nt, Mycobacterium leprae
ccacgauucugcugga

SEQ ID NO: 1245839 - RNA, 19 nt, Mycobacterium leprae
ccacgauucugcuggagau

SEQ ID NO: 1245840 - RNA, 16 nt, Mycobacterium leprae
ccaccgccaccuaggc

SEQ ID NO: 1245841 - RNA, 12 nt, Mycobacterium leprae
ccaccgccaccg

SEQ ID NO: 1245842 - RNA, 21 nt, Mycobacterium leprae
ccaccgccaccgaacccagac

SEQ ID NO: 1245843 - RNA, 16 nt, Mycobacterium leprae
ccacacccuggcuggg

SEQ ID NO: 1245844 - RNA, 16 nt, Mycobacterium leprae
ccaauccagccgaggg

SEQ ID NO: 1245845 - RNA, 17 nt, Mycobacterium leprae
ccaauccgauuuguaca

SEQ ID NO: 1245846 - RNA, 16 nt, Mycobacterium leprae
ccaagugaugucuuug

SEQ ID NO: 1245847 - RNA, 13 nt, Mycobacterium leprae
ccaacguccagug

SEQ ID NO: 1245848 - RNA, 12 nt, Mycobacterium leprae
ccaacgcgcacc

SEQ ID NO: 1245849 - RNA, 15 nt, Mycobacterium leprae
ccaacgggaacagcg

SEQ ID NO: 1245850 - RNA, 17 nt, Mycobacterium leprae
ccaacgguaucucccca

SEQ ID NO: 1245851 - RNA, 14 nt, Mycobacterium leprae
ccaacaacggccug

SEQ ID NO: 1245852 - RNA, 15 nt, Mycobacterium leprae
ccaacagccaauguc

SEQ ID NO: 1245853 - RNA, 19 nt, Mycobacterium leprae
ccaacauagucagaucaac

SEQ ID NO: 1245854 - RNA, 18 nt, Mycobacterium leprae
ccaacauagucauugccu

SEQ ID NO: 1245855 - RNA, 20 nt, Mycobacterium leprae
cauuucaccucuguugugau

SEQ ID NO: 1245856 - RNA, 22 nt, Mycobacterium leprae
cauuuacgugccgagguguucu

SEQ ID NO: 1245857 - RNA, 21 nt, Mycobacterium leprae
cauuuccggaacaacagacac

SEQ ID NO: 1245858 - RNA, 23 nt, Mycobacterium leprae
cauuucugccgcugguaucggug

SEQ ID NO: 1245859 - RNA, 18 nt, Mycobacterium leprae
cauuugauguccauggcu

SEQ ID NO: 1245860 - RNA, 22 nt, Mycobacterium leprae
cauuuuagcuuauacugcugcg

SEQ ID NO: 1245861 - RNA, 22 nt, Mycobacterium leprae
cauuguccagcgguaacuggcu

SEQ ID NO: 1245862 - RNA, 15 nt, Mycobacterium leprae
cauuguagaaacggc

SEQ ID NO: 1245863 - RNA, 15 nt, Mycobacterium leprae
cauuggcucgacauu

SEQ ID NO: 1245864 - RNA, 15 nt, Mycobacterium leprae
cauugucgguguuga

SEQ ID NO: 1245865 - RNA, 16 nt, Mycobacterium leprae
cauugucuaccacaua

SEQ ID NO: 1245866 - RNA, 18 nt, Mycobacterium leprae
cauugccaacguguguga

SEQ ID NO: 1245867 - RNA, 19 nt, Mycobacterium leprae
cauugcaagggacauccgc

SEQ ID NO: 1245868 - RNA, 20 nt, Mycobacterium leprae
cauugcccgcguucauggca

SEQ ID NO: 1245869 - RNA, 16 nt, Mycobacterium leprae
cauugcuucgaggcau

SEQ ID NO: 1245870 - RNA, 19 nt, Mycobacterium leprae
cauugccuaguuucuccac

SEQ ID NO: 1245871 - RNA, 18 nt, Mycobacterium leprae
cauucaggaaaauacuac

SEQ ID NO: 1245872 - RNA, 15 nt, Mycobacterium leprae
cauucaggaugcugu

SEQ ID NO: 1245873 - RNA, 19 nt, Mycobacterium leprae
cauucgccguccacuggcu

SEQ ID NO: 1245874 - RNA, 14 nt, Mycobacterium leprae
cauuccgugugacg

SEQ ID NO: 1245875 - RNA, 14 nt, Mycobacterium leprae
caugugcgcacugg

SEQ ID NO: 1245876 - RNA, 14 nt, Mycobacterium leprae
caugugugcuggcc

SEQ ID NO: 1245877 - RNA, 21 nt, Mycobacterium leprae
caugugaccgcggugcagugc

SEQ ID NO: 1245878 - RNA, 22 nt, Mycobacterium leprae
caugugaccgcggugcagugcc

SEQ ID NO: 1245879 - RNA, 12 nt, Mycobacterium leprae
caugugagguca

SEQ ID NO: 1245880 - RNA, 14 nt, Mycobacterium leprae
caugcugccgucga

SEQ ID NO: 1245881 - RNA, 18 nt, Mycobacterium leprae
caugcuugucaugcggaa

SEQ ID NO: 1245882 - RNA, 14 nt, Mycobacterium leprae
cauggcagucuugg

SEQ ID NO: 1245883 - RNA, 16 nt, Mycobacterium leprae
cauggagguucugggu

SEQ ID NO: 1245884 - RNA, 22 nt, Mycobacterium leprae
cauggagguucuggguagcagg

SEQ ID NO: 1245885 - RNA, 14 nt, Mycobacterium leprae
cauggcuucgucac

SEQ ID NO: 1245886 - RNA, 21 nt, Mycobacterium leprae
cauggcuguaucucgggguag

SEQ ID NO: 1245887 - RNA, 16 nt, Mycobacterium leprae
caugucauauguagcg

SEQ ID NO: 1245888 - RNA, 17 nt, Mycobacterium leprae
caugucauauguagcga

SEQ ID NO: 1245889 - RNA, 18 nt, Mycobacterium leprae
cauguagaccaagcagca

SEQ ID NO: 1245890 - RNA, 16 nt, Mycobacterium leprae
caugucggccacugca

SEQ ID NO: 1245891 - RNA, 15 nt, Mycobacterium leprae
caugucgguggugga

SEQ ID NO: 1245892 - RNA, 23 nt, Mycobacterium leprae
caugucggugguggaugcugcuu

SEQ ID NO: 1245893 - RNA, 24 nt, Mycobacterium leprae
caugucggugguggaugcugcuug

SEQ ID NO: 1245894 - RNA, 24 nt, Mycobacterium leprae
caugucgguggugggugcugcuug

SEQ ID NO: 1245895 - RNA, 13 nt, Mycobacterium leprae
cgaagacauggcg

SEQ ID NO: 1245896 - RNA, 20 nt, Mycobacterium leprae
cgaagcgauugggugggcuu

SEQ ID NO: 1245897 - RNA, 13 nt, Mycobacterium leprae
cgaacaacaaaaa

SEQ ID NO: 1245898 - RNA, 19 nt, Mycobacterium leprae
cgaacccagacgcgaccgc

SEQ ID NO: 1245899 - RNA, 17 nt, Mycobacterium leprae
cgaaccgauccagcauu

SEQ ID NO: 1245900 - RNA, 23 nt, Mycobacterium leprae
cgaacaguucgcacgaaauggcg

SEQ ID NO: 1245901 - RNA, 16 nt, Mycobacterium leprae
cgaaaggauggggcca

SEQ ID NO: 1245902 - RNA, 14 nt, Mycobacterium leprae
cgaaaugaacguca

SEQ ID NO: 1245903 - RNA, 21 nt, Mycobacterium leprae
cgaaaugcauuggaugagaua

SEQ ID NO: 1245904 - RNA, 12 nt, Mycobacterium leprae
cgaaauggcgcc

SEQ ID NO: 1245905 - RNA, 14 nt, Mycobacterium leprae
cgaaacgcgaagca

SEQ ID NO: 1245906 - RNA, 16 nt, Mycobacterium leprae
cgaaacgucaucgaca

SEQ ID NO: 1245907 - RNA, 21 nt, Mycobacterium leprae
cgaaacguucauagaaccugc

SEQ ID NO: 1245908 - RNA, 16 nt, Mycobacterium leprae
cgaaacccgaaaccaa

SEQ ID NO: 1245909 - RNA, 13 nt, Mycobacterium leprae
cgaaaauaacuau

SEQ ID NO: 1245910 - RNA, 16 nt, Mycobacterium leprae
cgaaaacacuuacacc

SEQ ID NO: 1245911 - RNA, 18 nt, Mycobacterium leprae
cgaaaacauucaggaugc

SEQ ID NO: 1245912 - RNA, 13 nt, Mycobacterium leprae
cgaaaaaugaguu

SEQ ID NO: 1245913 - RNA, 14 nt, Mycobacterium leprae
ccuuuucgaccaca

SEQ ID NO: 1245914 - RNA, 18 nt, Mycobacterium leprae
ccuuggugcgggcacaca

SEQ ID NO: 1245915 - RNA, 21 nt, Mycobacterium leprae
ccuuggugcuuaacgccgccu

SEQ ID NO: 1245916 - RNA, 22 nt, Mycobacterium leprae
ccuucaugcuggccuccaguuu

SEQ ID NO: 1245917 - RNA, 12 nt, Mycobacterium leprae
ccuucgucagcu

SEQ ID NO: 1245918 - RNA, 13 nt, Mycobacterium leprae
ccuucgucagcug

SEQ ID NO: 1245919 - RNA, 19 nt, Mycobacterium leprae
ccuuccaacgcggccgcaa

SEQ ID NO: 1245920 - RNA, 18 nt, Mycobacterium leprae
ccuugaugagaucacuga

SEQ ID NO: 1245921 - RNA, 15 nt, Mycobacterium leprae
ccuguuuuuggaccc

SEQ ID NO: 1245922 - RNA, 21 nt, Mycobacterium leprae
ccuguuuuuggaccccaacca

SEQ ID NO: 1245923 - RNA, 10 nt, Mycobacterium leprae
ccuguuggac

SEQ ID NO: 1245924 - RNA, 13 nt, Mycobacterium leprae
ccuguugauuuuu

SEQ ID NO: 1245925 - RNA, 17 nt, Mycobacterium leprae
ccugugcguaaggaaga

SEQ ID NO: 1245926 - RNA, 15 nt, Mycobacterium leprae
ccugcgucaguaagu

SEQ ID NO: 1245927 - RNA, 22 nt, Mycobacterium leprae
ccugucacuacguccacuagcc

SEQ ID NO: 1245928 - RNA, 20 nt, Mycobacterium leprae
ccugauuaauaacgccggcc

SEQ ID NO: 1245929 - RNA, 15 nt, Mycobacterium leprae
ccugauccuucuuuu

SEQ ID NO: 1245930 - RNA, 14 nt, Mycobacterium leprae
ccugccgccacagc

SEQ ID NO: 1245931 - RNA, 18 nt, Mycobacterium leprae
ccugcauugcuucgaggc

SEQ ID NO: 1245932 - RNA, 15 nt, Mycobacterium leprae
ccugcgcgaagugag

SEQ ID NO: 1245933 - RNA, 13 nt, Mycobacterium leprae
ccugcgguggugg

SEQ ID NO: 1245934 - RNA, 14 nt, Mycobacterium leprae
ccugaacugguggc

SEQ ID NO: 1245935 - RNA, 14 nt, Mycobacterium leprae
ccucuguugugauc

SEQ ID NO: 1245936 - RNA, 14 nt, Mycobacterium leprae
ccugagcaccaucu

SEQ ID NO: 1245937 - RNA, 16 nt, Mycobacterium leprae
ccugagacaucgccac

SEQ ID NO: 1245938 - RNA, 18 nt, Mycobacterium leprae
ccugagaccauaacacua

SEQ ID NO: 1245939 - RNA, 18 nt, Mycobacterium leprae
ccugauaagggucaucca

SEQ ID NO: 1245940 - RNA, 20 nt, Mycobacterium leprae
ccugaggguguuggucuguu

SEQ ID NO: 1245941 - RNA, 17 nt, Mycobacterium leprae
ccugacaucaagccucc

SEQ ID NO: 1245942 - RNA, 22 nt, Mycobacterium leprae
ccugacaucaagccuccagaau

SEQ ID NO: 1245943 - RNA, 19 nt, Mycobacterium leprae
ccucugacguuguuuuugu

SEQ ID NO: 1245944 - RNA, 16 nt, Mycobacterium leprae
ccucgugcugcgugcc

SEQ ID NO: 1245945 - RNA, 20 nt, Mycobacterium leprae
ccucguggguacgugccaac

SEQ ID NO: 1245946 - RNA, 17 nt, Mycobacterium leprae
ccucgucggccagcacu

SEQ ID NO: 1245947 - RNA, 17 nt, Mycobacterium leprae
ccuccuaggccacccgc

SEQ ID NO: 1245948 - RNA, 17 nt, Mycobacterium leprae
ccucgccaccuggucac

SEQ ID NO: 1245949 - RNA, 16 nt, Mycobacterium leprae
ccucagugucagcagc

SEQ ID NO: 1245950 - RNA, 22 nt, Mycobacterium leprae
ccuccgagcgcccgcacagcac

SEQ ID NO: 1245951 - RNA, 21 nt, Mycobacterium leprae
ccucccagugagugcauucug

SEQ ID NO: 1245952 - RNA, 16 nt, Mycobacterium leprae
ccuccagccgcgggcg

SEQ ID NO: 1245953 - RNA, 17 nt, Mycobacterium leprae
ccgugccuugcggcagg

SEQ ID NO: 1245954 - RNA, 17 nt, Mycobacterium leprae
ccgugauuuucauuggc

SEQ ID NO: 1245955 - RNA, 19 nt, Mycobacterium leprae
ccgugaggucgaagcugcc

SEQ ID NO: 1245956 - RNA, 15 nt, Mycobacterium leprae
ccucacgaauccuac

SEQ ID NO: 1245957 - RNA, 20 nt, Mycobacterium leprae
ccucaccugcgacagccgug

SEQ ID NO: 1245958 - RNA, 13 nt, Mycobacterium leprae
ccgugacucaaca

SEQ ID NO: 1245959 - RNA, 15 nt, Mycobacterium leprae
ccgugaccgacagcu

SEQ ID NO: 1245960 - RNA, 16 nt, Mycobacterium leprae
ccguccugccggugcg

SEQ ID NO: 1245961 - RNA, 14 nt, Mycobacterium leprae
ccgucccucggcca

SEQ ID NO: 1245962 - RNA, 18 nt, Mycobacterium leprae
ccgucacugugugcagcu

SEQ ID NO: 1245963 - RNA, 14 nt, Mycobacterium leprae
ccgucagggcagca

SEQ ID NO: 1245964 - RNA, 19 nt, Mycobacterium leprae
ccgucagcgugcuccaggg

SEQ ID NO: 1245965 - RNA, 19 nt, Mycobacterium leprae
ccguacaccaaucaggcca

SEQ ID NO: 1245966 - RNA, 19 nt, Mycobacterium leprae
ccguaaucaagaucggcca

SEQ ID NO: 1245967 - RNA, 16 nt, Mycobacterium leprae
ccguaagucagaugga

SEQ ID NO: 1245968 - RNA, 14 nt, Mycobacterium leprae
ccguagaguucuau

SEQ ID NO: 1245969 - RNA, 13 nt, Mycobacterium leprae
ccguaagacacuu

SEQ ID NO: 1245970 - RNA, 16 nt, Mycobacterium leprae
ccguaagacacuuccu

SEQ ID NO: 1245971 - RNA, 21 nt, Mycobacterium leprae
ccguaugaucuaauagccgaa

SEQ ID NO: 1245972 - RNA, 15 nt, Mycobacterium leprae
ccguauugaccugac

SEQ ID NO: 1245973 - RNA, 22 nt, Mycobacterium leprae
ccguauugguugccgagcuguu

SEQ ID NO: 1245974 - RNA, 22 nt, Mycobacterium leprae
ccgucaaagucagccaaaacuc

SEQ ID NO: 1245975 - RNA, 15 nt, Mycobacterium leprae
ccggguacggacauc

SEQ ID NO: 1245976 - RNA, 23 nt, Mycobacterium leprae
ccggggguaguaguucacgguca

SEQ ID NO: 1245977 - RNA, 20 nt, Mycobacterium leprae
ccgguggcgguaaccugcug

SEQ ID NO: 1245978 - RNA, 20 nt, Mycobacterium leprae
ccgguguacacgugcugccc

SEQ ID NO: 1245979 - RNA, 14 nt, Mycobacterium leprae
ccggucuuuucgcg

SEQ ID NO: 1245980 - RNA, 17 nt, Mycobacterium leprae
ccggugccuauuucacu

SEQ ID NO: 1245981 - RNA, 14 nt, Mycobacterium leprae
ccggcggccaccgc

SEQ ID NO: 1245982 - RNA, 23 nt, Mycobacterium leprae
ccggcugaggcggccggcacuga

SEQ ID NO: 1245983 - RNA, 18 nt, Mycobacterium leprae
ccggcuuuggcggacugc

SEQ ID NO: 1245984 - RNA, 19 nt, Mycobacterium leprae
aaaccuguguaucagugcu

SEQ ID NO: 1245985 - RNA, 19 nt, Mycobacterium leprae
aaaccucgagcuugcccuc

SEQ ID NO: 1245986 - RNA, 21 nt, Mycobacterium leprae
ccgggcugcuguguuugcugg

SEQ ID NO: 1245987 - RNA, 15 nt, Mycobacterium leprae
ccgggcgcucagcgg

SEQ ID NO: 1245988 - RNA, 20 nt, Mycobacterium leprae
ccggcgcuuguaaggccagc

SEQ ID NO: 1245989 - RNA, 18 nt, Mycobacterium leprae
ccggcgaccaguuuacau

SEQ ID NO: 1245990 - RNA, 16 nt, Mycobacterium leprae
ccggccgcggacaaga

SEQ ID NO: 1245991 - RNA, 16 nt, Mycobacterium leprae
ccggccuccggugccc

SEQ ID NO: 1245992 - RNA, 16 nt, Mycobacterium leprae
ccggccucgugcugcg

SEQ ID NO: 1245993 - RNA, 12 nt, Mycobacterium leprae
ccggccaccacg

SEQ ID NO: 1245994 - RNA, 19 nt, Mycobacterium leprae
ccgcugcccugggugacca

SEQ ID NO: 1245995 - RNA, 18 nt, Mycobacterium leprae
ccgcugcauccgcagcac

SEQ ID NO: 1245996 - RNA, 20 nt, Mycobacterium leprae
ccgcugagcaauuucuucuc

SEQ ID NO: 1245997 - RNA, 20 nt, Mycobacterium leprae
ccggaauuuuugaggugcag

SEQ ID NO: 1245998 - RNA, 17 nt, Mycobacterium leprae
ccggaauguccaccagc

SEQ ID NO: 1245999 - RNA, 18 nt, Mycobacterium leprae
ccggaauuccgacgaagg

SEQ ID NO: 1246000 - RNA, 22 nt, Mycobacterium leprae
ccgcugguaucggugucggcgg

SEQ ID NO: 1246001 - RNA, 20 nt, Mycobacterium leprae
ccggaaagaucgcccaccgc

SEQ ID NO: 1246002 - RNA, 17 nt, Mycobacterium leprae
ccggaaagcugaaagcu

SEQ ID NO: 1246003 - RNA, 19 nt, Mycobacterium leprae
ccgcuaugcggacggacac

SEQ ID NO: 1246004 - RNA, 17 nt, Mycobacterium leprae
ccgcuccgcgcacagug

SEQ ID NO: 1246005 - RNA, 14 nt, Mycobacterium leprae
ccgcuaaggcagcc

SEQ ID NO: 1246006 - RNA, 17 nt, Mycobacterium leprae
ccgcuaaggcagcccgc

SEQ ID NO: 1246007 - RNA, 14 nt, Mycobacterium leprae
ccgcguugcggcgc

SEQ ID NO: 1246008 - RNA, 22 nt, Mycobacterium leprae
ccgcuacauugcuccgcagcac

SEQ ID NO: 1246009 - RNA, 11 nt, Mycobacterium leprae
ccgcggcggcc

SEQ ID NO: 1246010 - RNA, 12 nt, Mycobacterium leprae
ccgcgucggcgu

SEQ ID NO: 1246011 - RNA, 15 nt, Mycobacterium leprae
ccgcgcucuggcauc

SEQ ID NO: 1246012 - RNA, 20 nt, Mycobacterium leprae
ccgcgcugugcgcaugcacg

SEQ ID NO: 1246013 - RNA, 14 nt, Mycobacterium leprae
ccgcggaguuggcc

SEQ ID NO: 1246014 - RNA, 14 nt, Mycobacterium leprae
ccgcggcaacaacg

SEQ ID NO: 1246015 - RNA, 21 nt, Mycobacterium leprae
ccgcgcuagcgauguagccaa

SEQ ID NO: 1246016 - RNA, 13 nt, Mycobacterium leprae
ccgcgcgugcaca

SEQ ID NO: 1246017 - RNA, 20 nt, Mycobacterium leprae
ccgcgcgcaagucuggaguc

SEQ ID NO: 1246018 - RNA, 17 nt, Mycobacterium leprae
ccgcgccgccugcugca

SEQ ID NO: 1246019 - RNA, 17 nt, Mycobacterium leprae
ccgcgaagauugacaaa

SEQ ID NO: 1246020 - RNA, 22 nt, Mycobacterium leprae
ccgcagcaugguaagaauaccg

SEQ ID NO: 1246021 - RNA, 14 nt, Mycobacterium leprae
ccgcagcaucggca

SEQ ID NO: 1246022 - RNA, 17 nt, Mycobacterium leprae
ccgcgcaucaucgccca

SEQ ID NO: 1246023 - RNA, 21 nt, Mycobacterium leprae
ccgcgauuuagguucggggcu

SEQ ID NO: 1246024 - RNA, 17 nt, Mycobacterium leprae
ccgacaccgauaccagc

SEQ ID NO: 1246025 - RNA, 23 nt, Mycobacterium leprae
ccgacaccgauaccagcggcaga

SEQ ID NO: 1246026 - RNA, 14 nt, Mycobacterium leprae
aaaccaaacaacaa

SEQ ID NO: 1246027 - RNA, 15 nt, Mycobacterium leprae
aaaccaaacaacaac

SEQ ID NO: 1246028 - RNA, 20 nt, Mycobacterium leprae
ccgaauuaccauuggcgaca

SEQ ID NO: 1246029 - RNA, 11 nt, Mycobacterium leprae
ccgaacuuggg

SEQ ID NO: 1246030 - RNA, 17 nt, Mycobacterium leprae
aaacagugccacaguca

SEQ ID NO: 1246031 - RNA, 20 nt, Mycobacterium leprae
ccgaaagugccguuggccca

SEQ ID NO: 1246032 - RNA, 13 nt, Mycobacterium leprae
aaacagagcugau

SEQ ID NO: 1246033 - RNA, 14 nt, Mycobacterium leprae
cccuucuccaccac

SEQ ID NO: 1246034 - RNA, 20 nt, Mycobacterium leprae
cccugcaauggguagucagc

SEQ ID NO: 1246035 - RNA, 16 nt, Mycobacterium leprae
cccugcgaacugcgca

SEQ ID NO: 1246036 - RNA, 16 nt, Mycobacterium leprae
cccuggaccgcagcac

SEQ ID NO: 1246037 - RNA, 17 nt, Mycobacterium leprae
ccgacggcacaccgugu

SEQ ID NO: 1246038 - RNA, 21 nt, Mycobacterium leprae
ccgacuaauuguggcuucccc

SEQ ID NO: 1246039 - RNA, 14 nt, Mycobacterium leprae
ccgacgucuucaau

SEQ ID NO: 1246040 - RNA, 15 nt, Mycobacterium leprae
ccgacuggugggcgc

SEQ ID NO: 1246041 - RNA, 19 nt, Mycobacterium leprae
ccgacucgcgaucccacgc

SEQ ID NO: 1246042 - RNA, 14 nt, Mycobacterium leprae
ccgagcgcaccaac

SEQ ID NO: 1246043 - RNA, 14 nt, Mycobacterium leprae
ccgagauggcgucu

SEQ ID NO: 1246044 - RNA, 15 nt, Mycobacterium leprae
ccgaguuuuuguucc

SEQ ID NO: 1246045 - RNA, 19 nt, Mycobacterium leprae
ccgagucucuggugcgcca

SEQ ID NO: 1246046 - RNA, 14 nt, Mycobacterium leprae
ccgagcuuuuccag

SEQ ID NO: 1246047 - RNA, 18 nt, Mycobacterium leprae
ccgagcuuuuccagcggg

SEQ ID NO: 1246048 - RNA, 14 nt, Mycobacterium leprae
ccgaggagaggcag

SEQ ID NO: 1246049 - RNA, 18 nt, Mycobacterium leprae
ccgaggagaggcagggcu

SEQ ID NO: 1246050 - RNA, 20 nt, Mycobacterium leprae
ccgcaagugcguuggauccc

SEQ ID NO: 1246051 - RNA, 17 nt, Mycobacterium leprae
ccgcaccugaacaggca

SEQ ID NO: 1246052 - RNA, 19 nt, Mycobacterium leprae
ccgaucugggggugcaccu

SEQ ID NO: 1246053 - RNA, 17 nt, Mycobacterium leprae
ccgaugcagggccagcc

SEQ ID NO: 1246054 - RNA, 21 nt, Mycobacterium leprae
ccgaugauccacucgccgcgg

SEQ ID NO: 1246055 - RNA, 13 nt, Mycobacterium leprae
ccgaucccgaaag

SEQ ID NO: 1246056 - RNA, 11 nt, Mycobacterium leprae
ccgaucccauc

SEQ ID NO: 1246057 - RNA, 21 nt, Mycobacterium leprae
cccgcguuagucgucgugaau

SEQ ID NO: 1246058 - RNA, 17 nt, Mycobacterium leprae
cccgcgccgccugcugc

SEQ ID NO: 1246059 - RNA, 16 nt, Mycobacterium leprae
cccgcgacggccggcg

SEQ ID NO: 1246060 - RNA, 20 nt, Mycobacterium leprae
cccgcuagcaucgaccacgu

SEQ ID NO: 1246061 - RNA, 18 nt, Mycobacterium leprae
cccggauugauggaugca

SEQ ID NO: 1246062 - RNA, 15 nt, Mycobacterium leprae
cccggacaagucagc

SEQ ID NO: 1246063 - RNA, 17 nt, Mycobacterium leprae
cccggacaagucagccu

SEQ ID NO: 1246064 - RNA, 19 nt, Mycobacterium leprae
cccggacggcccagcacca

SEQ ID NO: 1246065 - RNA, 21 nt, Mycobacterium leprae
cccggacggcccagcaccacu

SEQ ID NO: 1246066 - RNA, 14 nt, Mycobacterium leprae
cccgggucgagcag

SEQ ID NO: 1246067 - RNA, 19 nt, Mycobacterium leprae
cccgggggcgguggaagga

SEQ ID NO: 1246068 - RNA, 18 nt, Mycobacterium leprae
cccggcggcacgguguug

SEQ ID NO: 1246069 - RNA, 17 nt, Mycobacterium leprae
cccggcggcaugccugc

SEQ ID NO: 1246070 - RNA, 21 nt, Mycobacterium leprae
cccggcggcaugccugcuugc

SEQ ID NO: 1246071 - RNA, 13 nt, Mycobacterium leprae
ccccgaacccggc

SEQ ID NO: 1246072 - RNA, 23 nt, Mycobacterium leprae
cccccggacaguccaccgccagg

SEQ ID NO: 1246073 - RNA, 15 nt, Mycobacterium leprae
ccccgaaugcaaugc

SEQ ID NO: 1246074 - RNA, 13 nt, Mycobacterium leprae
ccccagucgccag

SEQ ID NO: 1246075 - RNA, 13 nt, Mycobacterium leprae
ccccacguugcgg

SEQ ID NO: 1246076 - RNA, 21 nt, Mycobacterium leprae
cccgaauucaucgaauaccuu

SEQ ID NO: 1246077 - RNA, 13 nt, Mycobacterium leprae
ccauuggcucgac

SEQ ID NO: 1246078 - RNA, 19 nt, Mycobacterium leprae
ccauuguugugcugggcgg

SEQ ID NO: 1246079 - RNA, 17 nt, Mycobacterium leprae
cccaaaucagcaccauc

SEQ ID NO: 1246080 - RNA, 17 nt, Mycobacterium leprae
ccauuuauuccagagca

SEQ ID NO: 1246081 - RNA, 21 nt, Mycobacterium leprae
cccacucuugacuaaagucau

SEQ ID NO: 1246082 - RNA, 15 nt, Mycobacterium leprae
cccacugggcaagca

SEQ ID NO: 1246083 - RNA, 19 nt, Mycobacterium leprae
cccacugggcaagcagugc

SEQ ID NO: 1246084 - RNA, 13 nt, Mycobacterium leprae
cccagcagguuga

SEQ ID NO: 1246085 - RNA, 16 nt, Mycobacterium leprae
cccagacgcgaccgcc

SEQ ID NO: 1246086 - RNA, 15 nt, Mycobacterium leprae
cccacuugggcaaca

SEQ ID NO: 1246087 - RNA, 23 nt, Mycobacterium leprae
cccaccggcggcuggugcggcgg

SEQ ID NO: 1246088 - RNA, 14 nt, Mycobacterium leprae
cccaccgcaaucga

SEQ ID NO: 1246089 - RNA, 21 nt, Mycobacterium leprae
cccacgagaaugucgcacccu

SEQ ID NO: 1246090 - RNA, 21 nt, Mycobacterium leprae
ccaucagauccgguggcgaca

SEQ ID NO: 1246091 - RNA, 20 nt, Mycobacterium leprae
ccauccgaucaauggcagcc

SEQ ID NO: 1246092 - RNA, 21 nt, Mycobacterium leprae
ccauccgaucaauggcagcca

SEQ ID NO: 1246093 - RNA, 15 nt, Mycobacterium leprae
ccaucgacgccgccg

SEQ ID NO: 1246094 - RNA, 13 nt, Mycobacterium leprae
ccaucgacgccgc

SEQ ID NO: 1246095 - RNA, 23 nt, Mycobacterium leprae
ccaucgugaggugugaccgugca

SEQ ID NO: 1246096 - RNA, 22 nt, Mycobacterium leprae
ccagugugccagcgcucgcugg

SEQ ID NO: 1246097 - RNA, 14 nt, Mycobacterium leprae
ccaguggcuuuaaa

SEQ ID NO: 1246098 - RNA, 13 nt, Mycobacterium leprae
ccaggugaagccg

SEQ ID NO: 1246099 - RNA, 17 nt, Mycobacterium leprae
ccauauagcgucccagc

SEQ ID NO: 1246100 - RNA, 20 nt, Mycobacterium leprae
ccaucaacggcuacaacaaa

SEQ ID NO: 1246101 - RNA, 16 nt, Mycobacterium leprae
ccagcgugugaugugu

SEQ ID NO: 1246102 - RNA, 18 nt, Mycobacterium leprae
ccagcgugugauguguau

SEQ ID NO: 1246103 - RNA, 14 nt, Mycobacterium leprae
ccagcucacccgca

SEQ ID NO: 1246104 - RNA, 13 nt, Mycobacterium leprae
ccagcuagggaug

SEQ ID NO: 1246105 - RNA, 18 nt, Mycobacterium leprae
ccacuccgguugcggcga

SEQ ID NO: 1246106 - RNA, 18 nt, Mycobacterium leprae
ccagcgacacagccggcc

SEQ ID NO: 1246107 - RNA, 20 nt, Mycobacterium leprae
ccagcgcaucagccaacacc

SEQ ID NO: 1246108 - RNA, 21 nt, Mycobacterium leprae
ccagcgaucuaccucgccaac

SEQ ID NO: 1246109 - RNA, 13 nt, Mycobacterium leprae
ccagcgacuggcu

SEQ ID NO: 1246110 - RNA, 14 nt, Mycobacterium leprae
ccagcgacuggcug

SEQ ID NO: 1246111 - RNA, 14 nt, Mycobacterium leprae
ccagcgccagaccu

SEQ ID NO: 1246112 - RNA, 21 nt, Mycobacterium leprae
ccaggauggugccauccggug

SEQ ID NO: 1246113 - RNA, 13 nt, Mycobacterium leprae
ccaggcagcgccu

SEQ ID NO: 1246114 - RNA, 23 nt, Mycobacterium leprae
ccaggcagcgccugccccgcugg

SEQ ID NO: 1246115 - RNA, 19 nt, Mycobacterium leprae
ccaggcagcugugcacgug

SEQ ID NO: 1246116 - RNA, 14 nt, Mycobacterium leprae
ccaggacuacgcca

SEQ ID NO: 1246117 - RNA, 16 nt, Mycobacterium leprae
ccaggaguaccgugcc

SEQ ID NO: 1246118 - RNA, 15 nt, Mycobacterium leprae
ccaggaucccugauc

SEQ ID NO: 1246119 - RNA, 23 nt, Mycobacterium leprae
ccagcuuggcacgccgguaugug

SEQ ID NO: 1246120 - RNA, 17 nt, Mycobacterium leprae
ccagggcguggucgagg

SEQ ID NO: 1246121 - RNA, 23 nt, Mycobacterium leprae
ccaggucaucuaaacugacgcug

SEQ ID NO: 1246122 - RNA, 20 nt, Mycobacterium leprae
ccagggaugaguaucugugg

SEQ ID NO: 1246123 - RNA, 21 nt, Mycobacterium leprae
ccagggaagugacgccacagu

SEQ ID NO: 1246124 - RNA, 15 nt, Mycobacterium leprae
cgauaacagaccucc

SEQ ID NO: 1246125 - RNA, 15 nt, Mycobacterium leprae
cgaguucugcaccga

SEQ ID NO: 1246126 - RNA, 13 nt, Mycobacterium leprae
cgaguuggccucc

SEQ ID NO: 1246127 - RNA, 18 nt, Mycobacterium leprae
cgauaauuaugaguggua

SEQ ID NO: 1246128 - RNA, 17 nt, Mycobacterium leprae
cgauacagucauugucc

SEQ ID NO: 1246129 - RNA, 23 nt, Mycobacterium leprae
cgauaucgcuaaggcugcugacu

SEQ ID NO: 1246130 - RNA, 14 nt, Mycobacterium leprae
cgauagcugccagc

SEQ ID NO: 1246131 - RNA, 18 nt, Mycobacterium leprae
cgauagaccgcuacaacc

SEQ ID NO: 1246132 - RNA, 18 nt, Mycobacterium leprae
cgagugguacaacaguug

SEQ ID NO: 1246133 - RNA, 17 nt, Mycobacterium leprae
cgagugugaaaaagcac

SEQ ID NO: 1246134 - RNA, 14 nt, Mycobacterium leprae
cgagucucacccac

SEQ ID NO: 1246135 - RNA, 16 nt, Mycobacterium leprae
cgaggggccgucggca

SEQ ID NO: 1246136 - RNA, 16 nt, Mycobacterium leprae
cgagguaaccaaaacc

SEQ ID NO: 1246137 - RNA, 17 nt, Mycobacterium leprae
cgagguggcagcugggu

SEQ ID NO: 1246138 - RNA, 17 nt, Mycobacterium leprae
cgagguucccggcggcc

SEQ ID NO: 1246139 - RNA, 18 nt, Mycobacterium leprae
cgagcggccucagcagca

SEQ ID NO: 1246140 - RNA, 19 nt, Mycobacterium leprae
cgagcggccucagcagcag

SEQ ID NO: 1246141 - RNA, 18 nt, Mycobacterium leprae
cgagcggaccauggcgcu

SEQ ID NO: 1246142 - RNA, 16 nt, Mycobacterium leprae
cgagcugaacaggcgc

SEQ ID NO: 1246143 - RNA, 23 nt, Mycobacterium leprae
cgagcucugagagugcagagagu

SEQ ID NO: 1246144 - RNA, 22 nt, Mycobacterium leprae
cgaggacacccggguggcguca

SEQ ID NO: 1246145 - RNA, 15 nt, Mycobacterium leprae
cgaggagaggcaggg

SEQ ID NO: 1246146 - RNA, 18 nt, Mycobacterium leprae
cgaggagaggcagggcug

SEQ ID NO: 1246147 - RNA, 19 nt, Mycobacterium leprae
cgaggagcacggcucgucc

SEQ ID NO: 1246148 - RNA, 22 nt, Mycobacterium leprae
cgaggaagcgcagcucgccaag

SEQ ID NO: 1246149 - RNA, 16 nt, Mycobacterium leprae
cgaggaucgucucggg

SEQ ID NO: 1246150 - RNA, 13 nt, Mycobacterium leprae
cgaggcucugcuc

SEQ ID NO: 1246151 - RNA, 18 nt, Mycobacterium leprae
cgagggcggugccccggg

SEQ ID NO: 1246152 - RNA, 20 nt, Mycobacterium leprae
cgaggcgcuaggacaacaga

SEQ ID NO: 1246153 - RNA, 16 nt, Mycobacterium leprae
cgacgugaaacaagcc

SEQ ID NO: 1246154 - RNA, 21 nt, Mycobacterium leprae
cgaauagccgguggccaccgc

SEQ ID NO: 1246155 - RNA, 13 nt, Mycobacterium leprae
cgacgucuucaau

SEQ ID NO: 1246156 - RNA, 18 nt, Mycobacterium leprae
cgacucgcgaucccacgc

SEQ ID NO: 1246157 - RNA, 15 nt, Mycobacterium leprae
cgacucgagcaaugc

SEQ ID NO: 1246158 - RNA, 12 nt, Mycobacterium leprae
cgacuugaccag

SEQ ID NO: 1246159 - RNA, 17 nt, Mycobacterium leprae
cgacuuccggcccaacg

SEQ ID NO: 1246160 - RNA, 20 nt, Mycobacterium leprae
cgacuucgcagccaccgacg

SEQ ID NO: 1246161 - RNA, 18 nt, Mycobacterium leprae
cgagaaugucgcacccug

SEQ ID NO: 1246162 - RNA, 18 nt, Mycobacterium leprae
cgagaagggagugcagug

SEQ ID NO: 1246163 - RNA, 20 nt, Mycobacterium leprae
cgagaagggagugcagugcc

SEQ ID NO: 1246164 - RNA, 14 nt, Mycobacterium leprae
cgagacacccggcu

SEQ ID NO: 1246165 - RNA, 15 nt, Mycobacterium leprae
cgagaucagugcaau

SEQ ID NO: 1246166 - RNA, 15 nt, Mycobacterium leprae
cgagaucgccacucg

SEQ ID NO: 1246167 - RNA, 21 nt, Mycobacterium leprae
cgagaguuagaugucgcagcg

SEQ ID NO: 1246168 - RNA, 20 nt, Mycobacterium leprae
cgagauugacgucggugugg

SEQ ID NO: 1246169 - RNA, 12 nt, Mycobacterium leprae
cgagcagcucca

SEQ ID NO: 1246170 - RNA, 15 nt, Mycobacterium leprae
cgagcagccgaccgc

SEQ ID NO: 1246171 - RNA, 22 nt, Mycobacterium leprae
cgagcacuagcuugugcuccug

SEQ ID NO: 1246172 - RNA, 16 nt, Mycobacterium leprae
cgagcccagugugucg

SEQ ID NO: 1246173 - RNA, 13 nt, Mycobacterium leprae
cgagcgccccguu

SEQ ID NO: 1246174 - RNA, 15 nt, Mycobacterium leprae
cgagcgcccgcacag

SEQ ID NO: 1246175 - RNA, 12 nt, Mycobacterium leprae
cgccaccgccgg

SEQ ID NO: 1246176 - RNA, 22 nt, Mycobacterium leprae
cgccaacgguaucuccccaggu

SEQ ID NO: 1246177 - RNA, 23 nt, Mycobacterium leprae
cgcauguaacacucauuggaccc

SEQ ID NO: 1246178 - RNA, 15 nt, Mycobacterium leprae
cgcaugcccugggcc

SEQ ID NO: 1246179 - RNA, 15 nt, Mycobacterium leprae
cgcaucaacaccaaa

SEQ ID NO: 1246180 - RNA, 23 nt, Mycobacterium leprae
cgcauagcagcuucucggggcga

SEQ ID NO: 1246181 - RNA, 22 nt, Mycobacterium leprae
aaacggccgggcaaaccacuua

SEQ ID NO: 1246182 - RNA, 17 nt, Mycobacterium leprae
cgcaucugccauaucaa

SEQ ID NO: 1246183 - RNA, 17 nt, Mycobacterium leprae
cgcaucagccaacacca

SEQ ID NO: 1246184 - RNA, 22 nt, Mycobacterium leprae
cgcaucagccaacaccaccagu

SEQ ID NO: 1246185 - RNA, 16 nt, Mycobacterium leprae
cgcaggacaaagucag

SEQ ID NO: 1246186 - RNA, 16 nt, Mycobacterium leprae
cgcaggaucggguagc

SEQ ID NO: 1246187 - RNA, 14 nt, Mycobacterium leprae
cgcagagguaaauc

SEQ ID NO: 1246188 - RNA, 18 nt, Mycobacterium leprae
cgcagaagccggcucgcg

SEQ ID NO: 1246189 - RNA, 15 nt, Mycobacterium leprae
cgcagauaucgcaca

SEQ ID NO: 1246190 - RNA, 17 nt, Mycobacterium leprae
cgcagcgguacccgcca

SEQ ID NO: 1246191 - RNA, 12 nt, Mycobacterium leprae
cgcacagcucuc

SEQ ID NO: 1246192 - RNA, 17 nt, Mycobacterium leprae
cgcaccaauccaccgug

SEQ ID NO: 1246193 - RNA, 22 nt, Mycobacterium leprae
cgcacgaaauggcgccaccgug

SEQ ID NO: 1246194 - RNA, 14 nt, Mycobacterium leprae
cgauggcgguguua

SEQ ID NO: 1246195 - RNA, 20 nt, Mycobacterium leprae
cgaugcgcagccgcgguaac

SEQ ID NO: 1246196 - RNA, 18 nt, Mycobacterium leprae
cgaugauccggccgucgg

SEQ ID NO: 1246197 - RNA, 22 nt, Mycobacterium leprae
cgaugcgcaccucgcugcagca

SEQ ID NO: 1246198 - RNA, 14 nt, Mycobacterium leprae
cgcaaaccaaacaa

SEQ ID NO: 1246199 - RNA, 19 nt, Mycobacterium leprae
cgcaaaacgauucugcgga

SEQ ID NO: 1246200 - RNA, 15 nt, Mycobacterium leprae
cgauugccaccacca

SEQ ID NO: 1246201 - RNA, 11 nt, Mycobacterium leprae
cgaugugcuua

SEQ ID NO: 1246202 - RNA, 19 nt, Mycobacterium leprae
cgauguggcuuugggaucu

SEQ ID NO: 1246203 - RNA, 23 nt, Mycobacterium leprae
cgaugucggggaugguuuccagg

SEQ ID NO: 1246204 - RNA, 19 nt, Mycobacterium leprae
aaacguugacugggaacau

SEQ ID NO: 1246205 - RNA, 15 nt, Mycobacterium leprae
aaacgucgaucucga

SEQ ID NO: 1246206 - RNA, 19 nt, Mycobacterium leprae
cgccgcgaacacggcaacg

SEQ ID NO: 1246207 - RNA, 22 nt, Mycobacterium leprae
cgccgccuuuacgaagccgcca

SEQ ID NO: 1246208 - RNA, 21 nt, Mycobacterium leprae
cgccggagcgaagcacccgga

SEQ ID NO: 1246209 - RNA, 22 nt, Mycobacterium leprae
cgccgacgaugcgugccccggc

SEQ ID NO: 1246210 - RNA, 21 nt, Mycobacterium leprae
cgccgaguucacugaggaucc

SEQ ID NO: 1246211 - RNA, 20 nt, Mycobacterium leprae
cgcccaccgcaacgccucca

SEQ ID NO: 1246212 - RNA, 21 nt, Mycobacterium leprae
cgcggagucaugauccagcug

SEQ ID NO: 1246213 - RNA, 21 nt, Mycobacterium leprae
cgcgggcggucgcaugaguga

SEQ ID NO: 1246214 - RNA, 17 nt, Mycobacterium leprae
cgcgggcuugcuccgag

SEQ ID NO: 1246215 - RNA, 14 nt, Mycobacterium leprae
cgcggggaugcuga

SEQ ID NO: 1246216 - RNA, 17 nt, Mycobacterium leprae
cgcgggagcggugccgc

SEQ ID NO: 1246217 - RNA, 15 nt, Mycobacterium leprae
cgcggcugccacugu

SEQ ID NO: 1246218 - RNA, 16 nt, Mycobacterium leprae
cgcguacuccagcagc

SEQ ID NO: 1246219 - RNA, 23 nt, Mycobacterium leprae
cgcguggguccguucgugucgga

SEQ ID NO: 1246220 - RNA, 18 nt, Mycobacterium leprae
cgcguuaggucuccuggu

SEQ ID NO: 1246221 - RNA, 14 nt, Mycobacterium leprae
cgcgucgacaagca

SEQ ID NO: 1246222 - RNA, 19 nt, Mycobacterium leprae
cgcgguaguuuccugagca

SEQ ID NO: 1246223 - RNA, 22 nt, Mycobacterium leprae
cgcgguaggaguuuuucagcgg

SEQ ID NO: 1246224 - RNA, 16 nt, Mycobacterium leprae
cgcgguccuguccagg

SEQ ID NO: 1246225 - RNA, 19 nt, Mycobacterium leprae
cgcggucgugcugcugguu

SEQ ID NO: 1246226 - RNA, 17 nt, Mycobacterium leprae
cgcggucgucaagugcg

SEQ ID NO: 1246227 - RNA, 14 nt, Mycobacterium leprae
cgcggucugggcgu

SEQ ID NO: 1246228 - RNA, 18 nt, Mycobacterium leprae
cgcggugugucccgucug

SEQ ID NO: 1246229 - RNA, 20 nt, Mycobacterium leprae
cgcggugggcuuccagcaga

SEQ ID NO: 1246230 - RNA, 20 nt, Mycobacterium leprae
cgcgaucuggauggccgcca

SEQ ID NO: 1246231 - RNA, 22 nt, Mycobacterium leprae
cgcgaucuggauggccgccagc

SEQ ID NO: 1246232 - RNA, 13 nt, Mycobacterium leprae
cgcgcauuggcca

SEQ ID NO: 1246233 - RNA, 19 nt, Mycobacterium leprae
cgcgccaaacacggccagc

SEQ ID NO: 1246234 - RNA, 18 nt, Mycobacterium leprae
cgcgccgcgugggggucc

SEQ ID NO: 1246235 - RNA, 21 nt, Mycobacterium leprae
cgccugcuugaggucgcacag

SEQ ID NO: 1246236 - RNA, 14 nt, Mycobacterium leprae
cgccgucuccgccg

SEQ ID NO: 1246237 - RNA, 14 nt, Mycobacterium leprae
cgcgaccgccacca

SEQ ID NO: 1246238 - RNA, 15 nt, Mycobacterium leprae
cgcgaauauguugcu

SEQ ID NO: 1246239 - RNA, 16 nt, Mycobacterium leprae
cgcgaccuugcggcgc

SEQ ID NO: 1246240 - RNA, 23 nt, Mycobacterium leprae
cgcgagcaaauugccgagcuggu

SEQ ID NO: 1246241 - RNA, 21 nt, Mycobacterium leprae
cggauuuaauuacaucggccc

SEQ ID NO: 1246242 - RNA, 17 nt, Mycobacterium leprae
cggauuuacccccagaa

SEQ ID NO: 1246243 - RNA, 22 nt, Mycobacterium leprae
cggcaagcgguuguccggcgcg

SEQ ID NO: 1246244 - RNA, 16 nt, Mycobacterium leprae
cggcaacggcgucuuc

SEQ ID NO: 1246245 - RNA, 18 nt, Mycobacterium leprae
cggcacaucgaaccgacg

SEQ ID NO: 1246246 - RNA, 22 nt, Mycobacterium leprae
cggcacacccaauugccuggcg

SEQ ID NO: 1246247 - RNA, 20 nt, Mycobacterium leprae
cggcacaccguguccgaacg

SEQ ID NO: 1246248 - RNA, 22 nt, Mycobacterium leprae
cggcacguucgaucggcagcca

SEQ ID NO: 1246249 - RNA, 18 nt, Mycobacterium leprae
cggaggcugggcaccacc

SEQ ID NO: 1246250 - RNA, 12 nt, Mycobacterium leprae
cggaggcggcca

SEQ ID NO: 1246251 - RNA, 20 nt, Mycobacterium leprae
cggaggcggccacgugcaca

SEQ ID NO: 1246252 - RNA, 17 nt, Mycobacterium leprae
cggauccuguugacugg

SEQ ID NO: 1246253 - RNA, 15 nt, Mycobacterium leprae
cggaugcccagccag

SEQ ID NO: 1246254 - RNA, 17 nt, Mycobacterium leprae
cggaugugucagcaccg

SEQ ID NO: 1246255 - RNA, 13 nt, Mycobacterium leprae
cggaccacuauuu

SEQ ID NO: 1246256 - RNA, 21 nt, Mycobacterium leprae
cggacccguugagcugcaugu

SEQ ID NO: 1246257 - RNA, 18 nt, Mycobacterium leprae
cggacagcggcccaaccc

SEQ ID NO: 1246258 - RNA, 15 nt, Mycobacterium leprae
cggacaagcaguguc

SEQ ID NO: 1246259 - RNA, 21 nt, Mycobacterium leprae
cggacaagcagugucugggcc

SEQ ID NO: 1246260 - RNA, 19 nt, Mycobacterium leprae
cggacaagccguuccauuc

SEQ ID NO: 1246261 - RNA, 17 nt, Mycobacterium leprae
cggaauguccaccagcc

SEQ ID NO: 1246262 - RNA, 15 nt, Mycobacterium leprae
cggaauugcauugca

SEQ ID NO: 1246263 - RNA, 21 nt, Mycobacterium leprae
cggaaucgccgcgacgaaccc

SEQ ID NO: 1246264 - RNA, 15 nt, Mycobacterium leprae
cggacugcuugggcg

SEQ ID NO: 1246265 - RNA, 14 nt, Mycobacterium leprae
cggagacggcagcg

SEQ ID NO: 1246266 - RNA, 18 nt, Mycobacterium leprae
cggagaauauagccuugg

SEQ ID NO: 1246267 - RNA, 13 nt, Mycobacterium leprae
cggacgcugaaac

SEQ ID NO: 1246268 - RNA, 16 nt, Mycobacterium leprae
cggagaucggcgugca

SEQ ID NO: 1246269 - RNA, 17 nt, Mycobacterium leprae
cggagcgcggagcuggu

SEQ ID NO: 1246270 - RNA, 20 nt, Mycobacterium leprae
cggaaauaacgggcaugcag

SEQ ID NO: 1246271 - RNA, 12 nt, Mycobacterium leprae
cggaacagcauc

SEQ ID NO: 1246272 - RNA, 19 nt, Mycobacterium leprae
cggaaguaacgucgaaccc

SEQ ID NO: 1246273 - RNA, 19 nt, Mycobacterium leprae
cggaauaaucacagccucc

SEQ ID NO: 1246274 - RNA, 16 nt, Mycobacterium leprae
cggaagcccucccagc

SEQ ID NO: 1246275 - RNA, 17 nt, Mycobacterium leprae
cgcuuuuugugaacaua

SEQ ID NO: 1246276 - RNA, 14 nt, Mycobacterium leprae
cgcuuguaaggcca

SEQ ID NO: 1246277 - RNA, 18 nt, Mycobacterium leprae
cgcuuguaaggccagcag

SEQ ID NO: 1246278 - RNA, 19 nt, Mycobacterium leprae
cgcuacauugcuccgcagc

SEQ ID NO: 1246279 - RNA, 15 nt, Mycobacterium leprae
cggccuccggugccc

SEQ ID NO: 1246280 - RNA, 22 nt, Mycobacterium leprae
cggccucacaguaggccagccc

SEQ ID NO: 1246281 - RNA, 19 nt, Mycobacterium leprae
cggcgaccuggucgagcag

SEQ ID NO: 1246282 - RNA, 20 nt, Mycobacterium leprae
cggcgaccuggucgagcagc

SEQ ID NO: 1246283 - RNA, 22 nt, Mycobacterium leprae
cggcgaccuggucgagcagcuc

SEQ ID NO: 1246284 - RNA, 17 nt, Mycobacterium leprae
cggcccucgcgcggggc

SEQ ID NO: 1246285 - RNA, 15 nt, Mycobacterium leprae
cggccggccccugag

SEQ ID NO: 1246286 - RNA, 20 nt, Mycobacterium leprae
cggccgcggcgaccuggucg

SEQ ID NO: 1246287 - RNA, 22 nt, Mycobacterium leprae
cggccccgcaucuucgcccagc

SEQ ID NO: 1246288 - RNA, 18 nt, Mycobacterium leprae
cggcccaacccggccgau

SEQ ID NO: 1246289 - RNA, 13 nt, Mycobacterium leprae
cggccagcgcauc

SEQ ID NO: 1246290 - RNA, 20 nt, Mycobacterium leprae
cggccagcgcaucagccaac

SEQ ID NO: 1246291 - RNA, 15 nt, Mycobacterium leprae
cggccacgugcacau

SEQ ID NO: 1246292 - RNA, 21 nt, Mycobacterium leprae
cggccacucguagggaccgcu

SEQ ID NO: 1246293 - RNA, 17 nt, Mycobacterium leprae
cggccacaacgcggccu

SEQ ID NO: 1246294 - RNA, 18 nt, Mycobacterium leprae
cggccacauugaccacgc

SEQ ID NO: 1246295 - RNA, 14 nt, Mycobacterium leprae
cggccaccggcgcu

SEQ ID NO: 1246296 - RNA, 15 nt, Mycobacterium leprae
cggccaccggcgcuu

SEQ ID NO: 1246297 - RNA, 22 nt, Mycobacterium leprae
cggccaccgcgaacgccucggc

SEQ ID NO: 1246298 - RNA, 16 nt, Mycobacterium leprae
cggcauucccaaccgc

SEQ ID NO: 1246299 - RNA, 16 nt, Mycobacterium leprae
cggcauugccggggcu

SEQ ID NO: 1246300 - RNA, 15 nt, Human
uuaccugggaaaggg

SEQ ID NO: 1246301 - RNA, 18 nt, Human
uguuuccuagcgcagcca

SEQ ID NO: 1246302 - RNA, 19 nt, Human
uuaaaaaaaaaccugagcc

SEQ ID NO: 1246303 - RNA, 21 nt, Human
uuaauggaaauguuuacagau

SEQ ID NO: 1246304 - RNA, 19 nt, Human
ugaggacuugggcgggaca

SEQ ID NO: 1246305 - RNA, 17 nt, Human
ugacuauggcuaccaaa

SEQ ID NO: 1246306 - RNA, 11 nt, Human
ugagcccaugg

SEQ ID NO: 1246307 - RNA, 15 nt, Human
ugcccucuccugggc

SEQ ID NO: 1246308 - RNA, 13 nt, Human
ugcauaguaccaa

SEQ ID NO: 1246309 - RNA, 19 nt, Human
ugcuugccaucccucccuc

SEQ ID NO: 1246310 - RNA, 15 nt, Human
uggcgcgcgccacca

SEQ ID NO: 1246311 - RNA, 16 nt, Human
uggcgcgcgccaccac

SEQ ID NO: 1246312 - RNA, 12 nt, Human
uggagacaccac

SEQ ID NO: 1246313 - RNA, 23 nt, Human
ugggacaguuccugagaccagcc

SEQ ID NO: 1246314 - RNA, 24 nt, Human
ugggacaguuccugagaccagcca

SEQ ID NO: 1246315 - RNA, 14 nt, Human
gccgggcgcggugg

SEQ ID NO: 1246316 - RNA, 13 nt, Human
gccuccauccuga

SEQ ID NO: 1246317 - RNA, 15 nt, Human
gccucuuagaugcag

SEQ ID NO: 1246318 - RNA, 15 nt, Human
gcgcgcaccuguaau

SEQ ID NO: 1246319 - RNA, 13 nt, Human
gcgugagccacca

SEQ ID NO: 1246320 - RNA, 15 nt, Human
gccuuccugccgcaa

SEQ ID NO: 1246321 - RNA, 20 nt, Human
gcuaucgccaucacagcuga

SEQ ID NO: 1246322 - RNA, 15 nt, Human
guucagagcugcccu

SEQ ID NO: 1246323 - RNA, 18 nt, Human
gcugcccucuccugggca

SEQ ID NO: 1246324 - RNA, 16 nt, Human
uagauaaacucagaaa

SEQ ID NO: 1246325 - RNA, 16 nt, Human
uaguaauuggaaaggc

SEQ ID NO: 1246326 - RNA, 14 nt, Human
uagggaccugcugu

SEQ ID NO: 1246327 - RNA, 22 nt, Human
uauccuaauaaaaaggugacca

SEQ ID NO: 1246328 - RNA, 18 nt, Human
uaucgccaucacagcuga

SEQ ID NO: 1246329 - RNA, 12 nt, Human
cccuguacucca

SEQ ID NO: 1246330 - RNA, 20 nt, Human
ccgucucccaaagugcuggg

SEQ ID NO: 1246331 - RNA, 11 nt, Human
ccucaagccag

SEQ ID NO: 1246332 - RNA, 18 nt, Human
ccucccuccaccucccug

SEQ ID NO: 1246333 - RNA, 22 nt, Human
ccucagucucccucccuugggg

SEQ ID NO: 1246334 - RNA, 18 nt, Human
cccuguacuccagccugg

SEQ ID NO: 1246335 - RNA, 21 nt, Human
cccugcugagucccaggcuga

SEQ ID NO: 1246336 - RNA, 18 nt, Human
cccugcacuccagccuga

SEQ ID NO: 1246337 - RNA, 23 nt, Human
ccgggaguggcgcgcgccaccac

SEQ ID NO: 1246338 - RNA, 22 nt, Human
ccgggaguggcgcgcgccacca

SEQ ID NO: 1246339 - RNA, 14 nt, Human
ccugggcagcugcc

SEQ ID NO: 1246340 - RNA, 16 nt, Human
ccugggcagcugccuc

SEQ ID NO: 1246341 - RNA, 15 nt, Human
ccugccccugagccc

SEQ ID NO: 1246342 - RNA, 12 nt, Human
ccugcaggcgug

SEQ ID NO: 1246343 - RNA, 19 nt, Human
ccucugcuugccaucccuc

SEQ ID NO: 1246344 - RNA, 15 nt, Human
ccuuccucugagccu

SEQ ID NO: 1246345 - RNA, 20 nt, Human
cgaaguauccuucagccuga

SEQ ID NO: 1246346 - RNA, 22 nt, Human
cgaacugcuggauucaagugau

SEQ ID NO: 1246347 - RNA, 14 nt, Human
uugcuugaacccag

SEQ ID NO: 1246348 - RNA, 11 nt, Human
uugggaaagga

SEQ ID NO: 1246349 - RNA, 13 nt, Human
cccucccuccacc

SEQ ID NO: 1246350 - RNA, 17 nt, Human
cgccaccacgcccagcu

SEQ ID NO: 1246351 - RNA, 15 nt, Human
cgggauuaguacaca

SEQ ID NO: 1246352 - RNA, 23 nt, Human
cgucuugacuuuggcaaaugagc

SEQ ID NO: 1246353 - RNA, 13 nt, Human
cgugacuggccug

SEQ ID NO: 1246354 - RNA, 21 nt, Human
cgggaguggcgcgcgccacca

SEQ ID NO: 1246355 - RNA, 19 nt, Human
cugaugagaacucugagca

SEQ ID NO: 1246356 - RNA, 13 nt, Human
cugagccuuggga

SEQ ID NO: 1246357 - RNA, 13 nt, Human
cugagaccagcca

SEQ ID NO: 1246358 - RNA, 23 nt, Human
cucucuggccuucggccuccauc

SEQ ID NO: 1246359 - RNA, 14 nt, Human
cucuggccuucggc

SEQ ID NO: 1246360 - RNA, 12 nt, Human
cuaggccgggcg

SEQ ID NO: 1246361 - RNA, 20 nt, Human
cucauggaauuggagcucgu

SEQ ID NO: 1246362 - RNA, 15 nt, Human
cucccuccaccuccc

SEQ ID NO: 1246363 - RNA, 14 nt, Human
cuccagccugagcg

SEQ ID NO: 1246364 - RNA, 18 nt, Human
gcaguucagagcugcccu

SEQ ID NO: 1246365 - RNA, 13 nt, Human
gcauauguuucgc

SEQ ID NO: 1246366 - RNA, 18 nt, Human
gccaucccucccuccacc

SEQ ID NO: 1246367 - RNA, 19 nt, Human
gccagcaguucagagcugc

SEQ ID NO: 1246368 - RNA, 15 nt, Human
gccaaccugggggcu

SEQ ID NO: 1246369 - RNA, 14 nt, Human
gcccaagggugggu

SEQ ID NO: 1246370 - RNA, 21 nt, Human
gcccaagggugggugggguga

SEQ ID NO: 1246371 - RNA, 16 nt, Human
gcccugcugaguccca

SEQ ID NO: 1246372 - RNA, 18 nt, Human
gaggaauauuugcaagac

SEQ ID NO: 1246373 - RNA, 15 nt, Human
gaggcggguggauca

SEQ ID NO: 1246374 - RNA, 12 nt, Human
gagcugcccucu

SEQ ID NO: 1246375 - RNA, 15 nt, Human
gagcugcccucuccu

SEQ ID NO: 1246376 - RNA, 12 nt, Human
gagacaccacca

SEQ ID NO: 1246377 - RNA, 18 nt, Human
gagaccagccaaccuggg

SEQ ID NO: 1246378 - RNA, 16 nt, Human
gagacucugucucagu

SEQ ID NO: 1246379 - RNA, 22 nt, Human
gagaccagccaaccugggggcu

SEQ ID NO: 1246380 - RNA, 13 nt, Human
gaugauguuucgu

SEQ ID NO: 1246381 - RNA, 18 nt, Human
gagggcuugaggacuugg

SEQ ID NO: 1246382 - RNA, 16 nt, Human
gaguucugucuggacu

SEQ ID NO: 1246383 - RNA, 14 nt, Human
gauccuggaaauca

SEQ ID NO: 1246384 - RNA, 16 nt, Human
cuggcugggaguggca

SEQ ID NO: 1246385 - RNA, 13 nt, Human
cuggccuucggcc

SEQ ID NO: 1246386 - RNA, 19 nt, Human
cuggccuucggccuccauc

SEQ ID NO: 1246387 - RNA, 15 nt, Human
cugggcagcugccuc

SEQ ID NO: 1246388 - RNA, 18 nt, Human
cugccuaagugcagcccc

SEQ ID NO: 1246389 - RNA, 18 nt, Human
cuggagugcaguggcgca

SEQ ID NO: 1246390 - RNA, 19 nt, Human
cuggagugcaguggcgcaa

SEQ ID NO: 1246391 - RNA, 22 nt, Human
cugcugagucccaggcugagcc

SEQ ID NO: 1246392 - RNA, 20 nt, Human
cuuagacccucaugcugcca

SEQ ID NO: 1246393 - RNA, 20 nt, Human
cuuggcccaggaguuuggcc

SEQ ID NO: 1246394 - RNA, 13 nt, Human
cuugccaucccuc

SEQ ID NO: 1246395 - RNA, 17 nt, Human
cuuccuggcaauaguca

SEQ ID NO: 1246396 - RNA, 18 nt, Human
gacauguuuacaaaccuc

SEQ ID NO: 1246397 - RNA, 15 nt, Human
gaauuggagcucgug

SEQ ID NO: 1246398 - RNA, 17 nt, Human
gacaagcucacagaccu

SEQ ID NO: 1246399 - RNA, 23 nt, Human
gacacaggcuccaaacuggagcu

SEQ ID NO: 1246400 - RNA, 21 nt, Human
gacgguuuaaugggcacaggg

SEQ ID NO: 1246401 - RNA, 15 nt, Human
gacccucaugcugcc

SEQ ID NO: 1246402 - RNA, 16 nt, Human
gacccucaugcugcca

SEQ ID NO: 1246403 - RNA, 22 nt, Human
gaauuacaggcgugagccacca

SEQ ID NO: 1246404 - RNA, 18 nt, Human
gaacagugauuaccaggg

SEQ ID NO: 1246405 - RNA, 20 nt, Human
gaaaagacauaagcaaagac

SEQ ID NO: 1246406 - RNA, 15 nt, Human
aaauggguuuuacug

SEQ ID NO: 1246407 - RNA, 15 nt, Human
aaauuuuauaguguc

SEQ ID NO: 1246408 - RNA, 12 nt, Human
aaggcuggagug

SEQ ID NO: 1246409 - RNA, 14 nt, Human
aaaguucugcagau

SEQ ID NO: 1246410 - RNA, 19 nt, Human
aacucccugccccccagcc

SEQ ID NO: 1246411 - RNA, 21 nt, Human
aagcacuuucccucuuggugc

SEQ ID NO: 1246412 - RNA, 13 nt, Human
aaaaaggugacca

SEQ ID NO: 1246413 - RNA, 15 nt, Human
acccucugggucuca

SEQ ID NO: 1246414 - RNA, 13 nt, Human
acaaccuguccca

SEQ ID NO: 1246415 - RNA, 18 nt, Human
acugggguggguggggca

SEQ ID NO: 1246416 - RNA, 17 nt, Human
acugccgguuugaaaau

SEQ ID NO: 1246417 - RNA, 18 nt, Human
acucauugcaaccuccac

SEQ ID NO: 1246418 - RNA, 14 nt, Human
accuucuggguuca

SEQ ID NO: 1246419 - RNA, 13 nt, Human
aauuagccgggca

SEQ ID NO: 1246420 - RNA, 15 nt, Human
aagagauggguuuga

SEQ ID NO: 1246421 - RNA, 14 nt, Human
aagaguggguuuca

SEQ ID NO: 1246422 - RNA, 22 nt, Human
aacuaaauaaagcuugcaacaa

SEQ ID NO: 1246423 - RNA, 14 nt, Human
aacuucagcgguuu

SEQ ID NO: 1246424 - RNA, 18 nt, Human
aacacaugauccugcaau

SEQ ID NO: 1246425 - RNA, 11 nt, Human
augauuccacc

SEQ ID NO: 1246426 - RNA, 19 nt, Human
augccuggugcuuccaaau

SEQ ID NO: 1246427 - RNA, 12 nt, Human
auaugugaaaua

SEQ ID NO: 1246428 - RNA, 18 nt, Human
agucauuugcugagcaug

SEQ ID NO: 1246429 - RNA, 17 nt, Human
aggucacacaaccuguc

SEQ ID NO: 1246430 - RNA, 22 nt, Human
aggcuuagacccucaugcugcc

SEQ ID NO: 1246431 - RNA, 13 nt, Human
aggcuggucucga

SEQ ID NO: 1246432 - RNA, 22 nt, Human
agcagagacgggguuugccaug

SEQ ID NO: 1246433 - RNA, 14 nt, Human
acuucuuaggguua

SEQ ID NO: 1246434 - RNA, 20 nt, Human
acuuuccacauucagagcuu

SEQ ID NO: 1246435 - RNA, 12 nt, Human
agacaccaccac

SEQ ID NO: 1246436 - RNA, 22 nt, Human
agacaccaccacccuugccaug

SEQ ID NO: 1246437 - RNA, 19 nt, Human
agacagggaaagggucucc

SEQ ID NO: 1246438 - RNA, 22 nt, Human
agaagucaaggcuuagacccuc

SEQ ID NO: 1246439 - RNA, 18 nt, Human
cccugcaauaaaaugggu

SEQ ID NO: 1246440 - RNA, 23 nt, Human
cccgggaguggcgcgcgccacca

SEQ ID NO: 1246441 - RNA, 19 nt, Human
ccccucuggcuccagcugg

SEQ ID NO: 1246442 - RNA, 14 nt, Human
cccaagccuggcaa

SEQ ID NO: 1246443 - RNA, 16 nt, Human
ccaggaguuuggccag

SEQ ID NO: 1246444 - RNA, 14 nt, Human
ccucaugcugccaa

SEQ ID NO: 1246445 - RNA, 11 nt, Human
ccgggcgcggu

SEQ ID NO: 1246446 - RNA, 12 nt, Human
ccucuccugggc

SEQ ID NO: 1246447 - RNA, 13 nt, Human
ccugaggcuccac

SEQ ID NO: 1246448 - RNA, 16 nt, Human
cgagcguugcuggggg

SEQ ID NO: 1246449 - RNA, 13 nt, Human
ccuuugggaaagg

SEQ ID NO: 1246450 - RNA, 20 nt, Human
ccugggcagcugccuccccu

SEQ ID NO: 1246451 - RNA, 23 nt, Human
cauccugaggcuccacuuggucu

SEQ ID NO: 1246452 - RNA, 16 nt, Human
caucccucccuccacc

SEQ ID NO: 1246453 - RNA, 13 nt, Human
cagcuacuuggga

SEQ ID NO: 1246454 - RNA, 15 nt, Human
cagcucuaaauguca

SEQ ID NO: 1246455 - RNA, 16 nt, Human
cauugcaaccuccacc

SEQ ID NO: 1246456 - RNA, 15 nt, Human
cauuauuuauauggg

SEQ ID NO: 1246457 - RNA, 21 nt, Human
ccaaacauccuacaagacaca

SEQ ID NO: 1246458 - RNA, 15 nt, Human
caugcugucuacacu

SEQ ID NO: 1246459 - RNA, 15 nt, Human
cagcccuggugggca

SEQ ID NO: 1246460 - RNA, 21 nt, Human
cagcaguucagagcugcccuc

SEQ ID NO: 1246461 - RNA, 16 nt, Human
cagcaguucagagcug

SEQ ID NO: 1246462 - RNA, 19 nt, Human
cagagaaaauaaaagcacu

SEQ ID NO: 1246463 - RNA, 16 nt, Human
cagagaaaauaaaagc

SEQ ID NO: 1246464 - RNA, 22 nt, Human
cagagcugcccucuccugggca

SEQ ID NO: 1246465 - RNA, 18 nt, Human
caaggcuuagacccucau

SEQ ID NO: 1246466 - RNA, 19 nt, Human
caagugauccgcccaucuc

SEQ ID NO: 1246467 - RNA, 15 nt, Human
caaggcuggagugca

SEQ ID NO: 1246468 - RNA, 16 nt, Human
caaggcuuagacccuc

SEQ ID NO: 1246469 - RNA, 19 nt, Human
cacaagaaaugaaagcagg

SEQ ID NO: 1246470 - RNA, 16 nt, Human
auuacaggcgugagcc

SEQ ID NO: 1246471 - RNA, 22 nt, Human
caagcacuuucccucuuggugc

SEQ ID NO: 1246472 - RNA, 17 nt, Human
cuggacuuuccagagac

SEQ ID NO: 1246473 - RNA, 21 nt, Human
cuggguuccuuccucugagcc

SEQ ID NO: 1246474 - RNA, 22 nt, Human
cuguccccgaaacuaccagccc

SEQ ID NO: 1246475 - RNA, 15 nt, Human
cuggccugcuggaug

SEQ ID NO: 1246476 - RNA, 16 nt, Human
cuggccuucggccucc

SEQ ID NO: 1246477 - RNA, 16 nt, Human
cuggcacuugggacaa

SEQ ID NO: 1246478 - RNA, 19 nt, Human
cugggguggguggggcagu

SEQ ID NO: 1246479 - RNA, 22 nt, Human
gaauugaauucccugccuggau

SEQ ID NO: 1246480 - RNA, 17 nt, Human
cuugggaccccugagcu

SEQ ID NO: 1246481 - RNA, 17 nt, Human
cuucaacucccugcccc

SEQ ID NO: 1246482 - RNA, 18 nt, Human
cuuccuggcaauagucaa

SEQ ID NO: 1246483 - RNA, 13 nt, Human
cuucggccuccau

SEQ ID NO: 1246484 - RNA, 17 nt, Human
cuucggccuccauccug

SEQ ID NO: 1246485 - RNA, 21 nt, Human
cuaagccuuccugccgcaaca

SEQ ID NO: 1246486 - RNA, 16 nt, Human
cuaccaaaaaucucaa

SEQ ID NO: 1246487 - RNA, 12 nt, Human
cgugagccacca

SEQ ID NO: 1246488 - RNA, 16 nt, Human
cgugggacagucaccu

SEQ ID NO: 1246489 - RNA, 18 nt, Human
cugcuguuuccuagcgca

SEQ ID NO: 1246490 - RNA, 23 nt, Human
cugcugagucccaggcugagccu

SEQ ID NO: 1246491 - RNA, 24 nt, Human
cugcugagucccaggcugagccuc

SEQ ID NO: 1246492 - RNA, 17 nt, Human
cugcccucuccugggca

SEQ ID NO: 1246493 - RNA, 13 nt, Human
cugccccugagcc

SEQ ID NO: 1246494 - RNA, 21 nt, Human
cgggguuugccaugcuggcca

SEQ ID NO: 1246495 - RNA, 19 nt, Human
cgucucccaaagugcuggg

SEQ ID NO: 1246496 - RNA, 22 nt, Human
cggccuccauccugaggcucca

SEQ ID NO: 1246497 - RNA, 14 nt, Human
cgcgcgccaccacg

SEQ ID NO: 1246498 - RNA, 14 nt, Human
gccgagccucaaga

SEQ ID NO: 1246499 - RNA, 18 nt, Human
gccgggcgcgguggcuca

SEQ ID NO: 1246500 - RNA, 15 nt, Human
gccuccauccugagg

SEQ ID NO: 1246501 - RNA, 17 nt, Human
gccuaugcagaggucca

SEQ ID NO: 1246502 - RNA, 13 nt, Human
gcugaugaacucu

SEQ ID NO: 1246503 - RNA, 12 nt, Human
gcugaggcgggu

SEQ ID NO: 1246504 - RNA, 13 nt, Human
gcugaggcgggug

SEQ ID NO: 1246505 - RNA, 22 nt, Human
gcugcccucuccugggcagcug

SEQ ID NO: 1246506 - RNA, 20 nt, Human
gcugccuccccuccucugcu

SEQ ID NO: 1246507 - RNA, 13 nt, Human
gcucuggaaacca

SEQ ID NO: 1246508 - RNA, 18 nt, Human
gccugcaggcaugaguca

SEQ ID NO: 1246509 - RNA, 17 nt, Human
gcucuaucaccaaggag

SEQ ID NO: 1246510 - RNA, 13 nt, Human
gcucucuggccuu

SEQ ID NO: 1246511 - RNA, 19 nt, Human
gcuguaugauucccagcca

SEQ ID NO: 1246512 - RNA, 16 nt, Human
gcuuuuucucucccac

SEQ ID NO: 1246513 - RNA, 22 nt, Human
ggacagcccuucuuuccacaga

SEQ ID NO: 1246514 - RNA, 15 nt, Human
ggaauugaggacacu

SEQ ID NO: 1246515 - RNA, 18 nt, Human
gccaugcuggccaggcug

SEQ ID NO: 1246516 - RNA, 15 nt, Human
gccccccagcccucc

SEQ ID NO: 1246517 - RNA, 16 nt, Human
gaucugcuuggucuug

SEQ ID NO: 1246518 - RNA, 14 nt, Human
gaauuggagcucgu

SEQ ID NO: 1246519 - RNA, 11 nt, Human
gacaccaccac

SEQ ID NO: 1246520 - RNA, 17 nt, Human
gacaccaccacccuugc

SEQ ID NO: 1246521 - RNA, 14 nt, Human
gacagggaggacgc

SEQ ID NO: 1246522 - RNA, 22 nt, Human
gacagcuucucauccugcaggc

SEQ ID NO: 1246523 - RNA, 13 nt, Human
gacagaaagcaga

SEQ ID NO: 1246524 - RNA, 21 nt, Human
gaggacgcucucuggccuucg

SEQ ID NO: 1246525 - RNA, 18 nt, Human
uguuaaaacugggacagg

SEQ ID NO: 1246526 - RNA, 14 nt, Human
uguugccaaggcug

SEQ ID NO: 1246527 - RNA, 15 nt, Human
uggagacaccaccac

SEQ ID NO: 1246528 - RNA, 18 nt, Human
uggcgcgcgccaccacgc

SEQ ID NO: 1246529 - RNA, 12 nt, Human
uggcgcgcgcca

SEQ ID NO: 1246530 - RNA, 15 nt, Human
uggccgggagccuga

SEQ ID NO: 1246531 - RNA, 14 nt, Human
uggagacaccacca

SEQ ID NO: 1246532 - RNA, 15 nt, Human
ugggguggguggggc

SEQ ID NO: 1246533 - RNA, 17 nt, Human
ugggacagggaggacgc

SEQ ID NO: 1246534 - RNA, 17 nt, Human
ucgagcguugcuggggg

SEQ ID NO: 1246535 - RNA, 18 nt, Human
uccugggcagcugccucc

SEQ ID NO: 1246536 - RNA, 13 nt, Human
uccugagaccagc

SEQ ID NO: 1246537 - RNA, 13 nt, Human
ucccuccaccucc

SEQ ID NO: 1246538 - RNA, 21 nt, Human
uaguaagagauuccugagcca

SEQ ID NO: 1246539 - RNA, 13 nt, Human
uaaaguacaagag

SEQ ID NO: 1246540 - RNA, 24 nt, Human
uaugucauuugcuggagcucugcc

SEQ ID NO: 1246541 - RNA, 13 nt, Human
ggagacaccacca

SEQ ID NO: 1246542 - RNA, 17 nt, Human
ggacgcucucuggccuu

SEQ ID NO: 1246543 - RNA, 14 nt, Human
ggaguuuggccaga

SEQ ID NO: 1246544 - RNA, 22 nt, Human
guaucuuguuuuuccacuacug

SEQ ID NO: 1246545 - RNA, 23 nt, Human
gucacacaaccugucccagcgag

SEQ ID NO: 1246546 - RNA, 20 nt, Human
guuuagaaagcuugcccugg

SEQ ID NO: 1246547 - RNA, 21 nt, Human
ggcgcgcgccaccacgcccag

SEQ ID NO: 1246548 - RNA, 17 nt, Human
ggcgcgcgccaccacgc

SEQ ID NO: 1246549 - RNA, 14 nt, Human
ggcgcgcgccacca

SEQ ID NO: 1246550 - RNA, 22 nt, Human
ggcccaggaguuuggccagaag

SEQ ID NO: 1246551 - RNA, 19 nt, Human
ggcuccacuuggucuguga

SEQ ID NO: 1246552 - RNA, 15 nt, Human
ggcugaggcgggugg

SEQ ID NO: 1246553 - RNA, 14 nt, Human
gguggggcagugcu

SEQ ID NO: 1246554 - RNA, 14 nt, Human
ggugggcagagagg

SEQ ID NO: 1246555 - RNA, 19 nt, Human
gguucuucuuggucucagu

SEQ ID NO: 1246556 - RNA, 15 nt, Human
guaacugacaacuug

SEQ ID NO: 1246557 - RNA, 22 nt, Human
gggcagcugccuccccuccucu

SEQ ID NO: 1246558 - RNA, 22 nt, Human
ggugacccugaugaaaacauag

SEQ ID NO: 1246559 - RNA, 22 nt, Human
ccccugcaaagcccagcuugaa

SEQ ID NO: 1246560 - RNA, 17 nt, Human
gcuucaccuguccccga

SEQ ID NO: 1246561 - RNA, 21 nt, Human
gcuuagacccucaugcugcca

SEQ ID NO: 1246562 - RNA, 22 nt, Human
gcuuagacccucaugcugccaa

SEQ ID NO: 1246563 - RNA, 19 nt, Human
gcuuggcccaggaguuugg

SEQ ID NO: 1246564 - RNA, 13 nt, Human
gcuugccaucccu

SEQ ID NO: 1246565 - RNA, 16 nt, Human
gcuugccugcaggcau

SEQ ID NO: 1246566 - RNA, 22 nt, Human
gcuugaggacuugggcgggaca

SEQ ID NO: 1246567 - RNA, 19 nt, Human
gcuuuugcuaggucacaga

SEQ ID NO: 1246568 - RNA, 19 nt, Human
gcuggauucaagugauccg

SEQ ID NO: 1246569 - RNA, 20 nt, Human
ccccugcacuccagccugag

SEQ ID NO: 1246570 - RNA, 15 nt, Human
ggacauuugcucaug

SEQ ID NO: 1246571 - RNA, 17 nt, Human
ggacagucaccucaugg

SEQ ID NO: 1246572 - RNA, 17 nt, Human
ggagcucgugggacagu

SEQ ID NO: 1246573 - RNA, 18 nt, Human
ggacauuugcucauggaa

SEQ ID NO: 1246574 - RNA, 20 nt, Human
ggaggacgcucucuggccuu

SEQ ID NO: 1246575 - RNA, 19 nt, Human
ggcagugcuuggcccagga

SEQ ID NO: 1246576 - RNA, 11 nt, Human
uccuacaagac

SEQ ID NO: 1246577 - RNA, 23 nt, Human
ucaauauuuauuauuuucaccug

SEQ ID NO: 1246578 - RNA, 19 nt, Human
ucaaggcuuagacccucau

SEQ ID NO: 1246579 - RNA, 16 nt, Human
guggcauuuucacuuu

SEQ ID NO: 1246580 - RNA, 13 nt, Human
gugggugggguga

SEQ ID NO: 1246581 - RNA, 14 nt, Human
guucagagcugccc

SEQ ID NO: 1246582 - RNA, 13 nt, Human
guauggcagcuuu

SEQ ID NO: 1246583 - RNA, 21 nt, Human
gugcugggaauuacaggcgug

SEQ ID NO: 1246584 - RNA, 18 nt, Human
gucucgaacugcuggauu

SEQ ID NO: 1246585 - RNA, 16 nt, Human
gugaaaugcagaguca

SEQ ID NO: 1246586 - RNA, 16 nt, Human
gugacaagcucacaga

SEQ ID NO: 1246587 - RNA, 16 nt, Human
uucacaggggacagga

SEQ ID NO: 1246588 - RNA, 21 nt, Human
uuuaaaaaaaaaccugagccc

SEQ ID NO: 1246589 - RNA, 20 nt, Human
uugguucuaauagaacucag

SEQ ID NO: 1246590 - RNA, 12 nt, Human
uugccaucccuc

SEQ ID NO: 1246591 - RNA, 23 nt, Human
uugcaugguuuagaaagcuugcc

SEQ ID NO: 1246592 - RNA, 17 nt, Human
ugggauagcugacccag

SEQ ID NO: 1246593 - RNA, 17 nt, Human
uggggcagugcuuggcc

SEQ ID NO: 1246594 - RNA, 18 nt, Human
uggugcuuccaaauauug

SEQ ID NO: 1246595 - RNA, 13 nt, Human
ucuaacucagaaa

SEQ ID NO: 1246596 - RNA, 20 nt, Human
ucggccuccauccugaggcu

SEQ ID NO: 1246597 - RNA, 12 nt, Human
uccugggcagcu

SEQ ID NO: 1246598 - RNA, 13 nt, Human
ucuggccuucggc

SEQ ID NO: 1246599 - RNA, 16 nt, Human
ucugggucucaguguc

SEQ ID NO: 1246600 - RNA, 17 nt, Human
ucuccugggcagcugcc

SEQ ID NO: 1246601 - RNA, 21 nt, Human
uuuacagauccccaagccugg

SEQ ID NO: 1246602 - RNA, 13 nt, Human
aaauaaugaaaua

SEQ ID NO: 1246603 - RNA, 14 nt, Human
aaaggccugucccu

SEQ ID NO: 1246604 - RNA, 21 nt, Human
acagauuugagcucagcccug

SEQ ID NO: 1246605 - RNA, 15 nt, Human
acagggaggacgcuc

SEQ ID NO: 1246606 - RNA, 21 nt, Human
acaccaggcuugccugcaggc

SEQ ID NO: 1246607 - RNA, 16 nt, Human
acauuauuaucaacaa

SEQ ID NO: 1246608 - RNA, 15 nt, Human
acaugagagacagca

SEQ ID NO: 1246609 - RNA, 22 nt, Human
acagggaggacgcucucuggcc

SEQ ID NO: 1246610 - RNA, 23 nt, Human
acaagguucuucccuuuuacaua

SEQ ID NO: 1246611 - RNA, 13 nt, Human
acccucugggucu

SEQ ID NO: 1246612 - RNA, 15 nt, Human
accuguccccgaaac

SEQ ID NO: 1246613 - RNA, 22 nt, Human
acccacaguggaaagacagcuu

SEQ ID NO: 1246614 - RNA, 11 nt, Human
accagccuggu

SEQ ID NO: 1246615 - RNA, 20 nt, Human
accccugagcuugcagagau

SEQ ID NO: 1246616 - RNA, 14 nt, Human
acccucaugcugcc

SEQ ID NO: 1246617 - RNA, 13 nt, Human
acccggccugauu

SEQ ID NO: 1246618 - RNA, 14 nt, Human
acccgggaggcaga

SEQ ID NO: 1246619 - RNA, 13 nt, Human
acuccagccuggg

SEQ ID NO: 1246620 - RNA, 22 nt, Human
acgcucucuggccuucggccuc

SEQ ID NO: 1246621 - RNA, 21 nt, Human
acugggguggguggggcagug

SEQ ID NO: 1246622 - RNA, 14 nt, Human
acuugggaggcuga

SEQ ID NO: 1246623 - RNA, 16 nt, Human
agccugaucaccugcc

SEQ ID NO: 1246624 - RNA, 15 nt, Human
agcgagggacaccga

SEQ ID NO: 1246625 - RNA, 21 nt, Human
agcuaaaauuagaugaacuca

SEQ ID NO: 1246626 - RNA, 21 nt, Human
agcccagcuugaaaccuucac

SEQ ID NO: 1246627 - RNA, 16 nt, Human
agccuaguugaucagc

SEQ ID NO: 1246628 - RNA, 20 nt, Human
agccagcaguucagagcugc

SEQ ID NO: 1246629 - RNA, 21 nt, Human
acccccugcaaagcccagcuu

SEQ ID NO: 1246630 - RNA, 13 nt, Human
acagaggaucugc

SEQ ID NO: 1246631 - RNA, 12 nt, Human
accacugcagaa

SEQ ID NO: 1246632 - RNA, 13 nt, Human
auuagccgggcgu

SEQ ID NO: 1246633 - RNA, 21 nt, Human
augacgugacuggccugcugg

SEQ ID NO: 1246634 - RNA, 14 nt, Human
auugugggcucugg

SEQ ID NO: 1246635 - RNA, 15 nt, Human
auccuucagccugaa

SEQ ID NO: 1246636 - RNA, 22 nt, Human
auccgcccaucuccgucuccca

SEQ ID NO: 1246637 - RNA, 18 nt, Human
auacuguauuuuuaccuu

SEQ ID NO: 1246638 - RNA, 23 nt, Human
cacauggcuucaccuguccccga

SEQ ID NO: 1246639 - RNA, 19 nt, Human
caccagggccuggcuggga

SEQ ID NO: 1246640 - RNA, 23 nt, Human
cacagcugaacuuguugagaucc

SEQ ID NO: 1246641 - RNA, 21 nt, Human
caccuucuggguucaagcgau

SEQ ID NO: 1246642 - RNA, 19 nt, Human
cacuagacccacuggacuc

SEQ ID NO: 1246643 - RNA, 21 nt, Human
ucuccugggcagcugccuccc

SEQ ID NO: 1246644 - RNA, 17 nt, Human
ucggccuccauccugag

SEQ ID NO: 1246645 - RNA, 20 nt, Human
ugaggcuccacuuggucugu

SEQ ID NO: 1246646 - RNA, 19 nt, Human
ucacuugugcaguguugac

SEQ ID NO: 1246647 - RNA, 18 nt, Human
ucaacaauagugauugau

SEQ ID NO: 1246648 - RNA, 16 nt, Human
guucagagcugcccuc

SEQ ID NO: 1246649 - RNA, 22 nt, Human
guuccugagaccagccaaccug

SEQ ID NO: 1246650 - RNA, 20 nt, Human
guuccuuccucugagccuug

SEQ ID NO: 1246651 - RNA, 13 nt, Human
gggcagcugccuc

SEQ ID NO: 1246652 - RNA, 17 nt, Human
gggaguggcgcgcgcca

SEQ ID NO: 1246653 - RNA, 21 nt, Human
ggggcagugcuuggcccagga

SEQ ID NO: 1246654 - RNA, 15 nt, Human
gggccuaugcagagg

SEQ ID NO: 1246655 - RNA, 15 nt, Human
gggacagggaggacg

SEQ ID NO: 1246656 - RNA, 13 nt, Human
ggcuuacacccac

SEQ ID NO: 1246657 - RNA, 17 nt, Human
ggcuggagugcaguggc

SEQ ID NO: 1246658 - RNA, 12 nt, Human
ggguuucacaag

SEQ ID NO: 1246659 - RNA, 17 nt, Human
ggucgucgucuugacuu

SEQ ID NO: 1246660 - RNA, 22 nt, Human
gguucuaggccgggcgcggugg

SEQ ID NO: 1246661 - RNA, 12 nt, Human
gugagccaccaa

SEQ ID NO: 1246662 - RNA, 22 nt, Human
gugggacagucaccucauggaa

SEQ ID NO: 1246663 - RNA, 20 nt, Human
guuauuuagggaacugcuug

SEQ ID NO: 1246664 - RNA, 17 nt, Human
ggcaggucacacaaccu

SEQ ID NO: 1246665 - RNA, 15 nt, Human
gcucacgccuguaau

SEQ ID NO: 1246666 - RNA, 15 nt, Human
gcuccacuuggucug

SEQ ID NO: 1246667 - RNA, 14 nt, Human
ggcuccacuugguc

SEQ ID NO: 1246668 - RNA, 14 nt, Human
ggcgugagccacca

SEQ ID NO: 1246669 - RNA, 15 nt, Human
ggcgugagccaccaa

SEQ ID NO: 1246670 - RNA, 13 nt, Human
ggcuauucacaac

SEQ ID NO: 1246671 - RNA, 19 nt, Human
ggcgugaccugacagccca

SEQ ID NO: 1246672 - RNA, 21 nt, Human
ggcgugaccugacagcccaag

SEQ ID NO: 1246673 - RNA, 12 nt, Human
ggccuggcuggg

SEQ ID NO: 1246674 - RNA, 15 nt, Human
ggccaugggacaggg

SEQ ID NO: 1246675 - RNA, 21 nt, Human
gcgacaguuuuccuucucauc

SEQ ID NO: 1246676 - RNA, 13 nt, Human
gccuucggccucc

SEQ ID NO: 1246677 - RNA, 13 nt, Human
gccacuucacuuu

SEQ ID NO: 1246678 - RNA, 15 nt, Human
gccagaagucaaggc

SEQ ID NO: 1246679 - RNA, 21 nt, Human
gcuacucuguuccuucacauc

SEQ ID NO: 1246680 - RNA, 18 nt, Human
gccuuggggcugaugcag

SEQ ID NO: 1246681 - RNA, 12 nt, Human
gcgcgcgccacc

SEQ ID NO: 1246682 - RNA, 13 nt, Human
gcgcgcgccacca

SEQ ID NO: 1246683 - RNA, 14 nt, Human
gcgcgcgccaccac

SEQ ID NO: 1246684 - RNA, 16 nt, Human
caggcgugagccacca

SEQ ID NO: 1246685 - RNA, 21 nt, Human
caggcuccaaacuggagcuug

SEQ ID NO: 1246686 - RNA, 20 nt, Human
cacuugggacaaaaacaaac

SEQ ID NO: 1246687 - RNA, 17 nt, Human
cacuugaacccgggagg

SEQ ID NO: 1246688 - RNA, 14 nt, Human
cagucagaagaccu

SEQ ID NO: 1246689 - RNA, 20 nt, Human
caggcgugaccugacagccc

SEQ ID NO: 1246690 - RNA, 23 nt, Human
cagggaggacgcucucuggccuu

SEQ ID NO: 1246691 - RNA, 11 nt, Human
caggucuacca

SEQ ID NO: 1246692 - RNA, 19 nt, Human
cagugucuggcacuuggga

SEQ ID NO: 1246693 - RNA, 18 nt, Human
cuaucuuugagcgcccac

SEQ ID NO: 1246694 - RNA, 14 nt, Human
cuaucgccaucaca

SEQ ID NO: 1246695 - RNA, 16 nt, Human
cucauccugcaggcag

SEQ ID NO: 1246696 - RNA, 19 nt, Human
cucauggaauuggagcucg

SEQ ID NO: 1246697 - RNA, 13 nt, Human
cugcaauuccacu

SEQ ID NO: 1246698 - RNA, 14 nt, Human
cugcagacaugaga

SEQ ID NO: 1246699 - RNA, 20 nt, Human
agcagucagaagaccugguc

SEQ ID NO: 1246700 - RNA, 21 nt, Human
agcaccugcaggcgugaccug

SEQ ID NO: 1246701 - RNA, 16 nt, Human
cuccugggcagcugcc

SEQ ID NO: 1246702 - RNA, 14 nt, Human
cuccccuccucugc

SEQ ID NO: 1246703 - RNA, 13 nt, Human
cucgugggacagu

SEQ ID NO: 1246704 - RNA, 15 nt, Human
cugacccagccccuu

SEQ ID NO: 1246705 - RNA, 21 nt, Human
cugaagaagaugguaccacca

SEQ ID NO: 1246706 - RNA, 16 nt, Human
cucuggccuucggccu

SEQ ID NO: 1246707 - RNA, 12 nt, Human
cucugcuugcca

SEQ ID NO: 1246708 - RNA, 16 nt, Human
cucugcuugccauccc

SEQ ID NO: 1246709 - RNA, 16 nt, Human
cucuuuauucagcccc

SEQ ID NO: 1246710 - RNA, 14 nt, Human
gaacugcuggauuc

SEQ ID NO: 1246711 - RNA, 12 nt, Human
gagaagaaugac

SEQ ID NO: 1246712 - RNA, 19 nt, Human
gaccagccaaccugggggc

SEQ ID NO: 1246713 - RNA, 17 nt, Human
cuuucacaggggacagg

SEQ ID NO: 1246714 - RNA, 21 nt, Human
cuuugaugauuaauucaccuu

SEQ ID NO: 1246715 - RNA, 16 nt, Human
gcaccugcaggcguga

SEQ ID NO: 1246716 - RNA, 17 nt, Human
gcacacagcacgggggc

SEQ ID NO: 1246717 - RNA, 17 nt, Human
gcacgggggccaaggau

SEQ ID NO: 1246718 - RNA, 15 nt, Human
gcaggcgugaccuga

SEQ ID NO: 1246719 - RNA, 15 nt, Human
gcauguaugacguga

SEQ ID NO: 1246720 - RNA, 15 nt, Human
gccaccaaacccggc

SEQ ID NO: 1246721 - RNA, 21 nt, Human
gcaugaauuuuuuucaucuuc

SEQ ID NO: 1246722 - RNA, 18 nt, Human
gcaggauagagugggaca

SEQ ID NO: 1246723 - RNA, 13 nt, Human
gcaggcgugaccu

SEQ ID NO: 1246724 - RNA, 14 nt, Human
gcagugcuuggccc

SEQ ID NO: 1246725 - RNA, 19 nt, Human
gcagugcuuggcccaggag

SEQ ID NO: 1246726 - RNA, 20 nt, Human
gagcaccugcaggcgugacc

SEQ ID NO: 1246727 - RNA, 21 nt, Human
gcaaauugucacaggacagcc

SEQ ID NO: 1246728 - RNA, 22 nt, Human
gauggaaguugcagugagcuga

SEQ ID NO: 1246729 - RNA, 14 nt, Human
agcuguugagcugu

SEQ ID NO: 1246730 - RNA, 19 nt, Human
agccuugcuccuggcuggg

SEQ ID NO: 1246731 - RNA, 14 nt, Human
agcugccuccccuc

SEQ ID NO: 1246732 - RNA, 18 nt, Human
agucaaggcuuagacccu

SEQ ID NO: 1246733 - RNA, 16 nt, Human
aggcuccacuuggucu

SEQ ID NO: 1246734 - RNA, 12 nt, Human
aguaaugauaac

SEQ ID NO: 1246735 - RNA, 14 nt, Human
auggagacaccacc

SEQ ID NO: 1246736 - RNA, 17 nt, Human
auggagacaccaccacc

SEQ ID NO: 1246737 - RNA, 18 nt, Human
auuauggcugguaacaua

SEQ ID NO: 1246738 - RNA, 21 nt, Human
auuacuguaagaaaauaucac

SEQ ID NO: 1246739 - RNA, 14 nt, Human
aucucaauauuuca

SEQ ID NO: 1246740 - RNA, 23 nt, Human
aucacagcuacuugggaggcuga

SEQ ID NO: 1246741 - RNA, 19 nt, Human
auauguaccauguacauga

SEQ ID NO: 1246742 - RNA, 13 nt, Human
auaacucaucaua

SEQ ID NO: 1246743 - RNA, 16 nt, Human
aguggcgcgcgccacc

SEQ ID NO: 1246744 - RNA, 16 nt, Human
aguugcagugagcuga

SEQ ID NO: 1246745 - RNA, 17 nt, Human
aguucauauguaccaug

SEQ ID NO: 1246746 - RNA, 15 nt, Human
auaccacaggaacca

SEQ ID NO: 1246747 - RNA, 23 nt, Human
cagagacgggguuugccaugcug

SEQ ID NO: 1246748 - RNA, 22 nt, Human
cagccagcaguucagagcugcc

SEQ ID NO: 1246749 - RNA, 16 nt, Human
cagcauuuuacuacuu

SEQ ID NO: 1246750 - RNA, 14 nt, Human
cagccaaccugggg

SEQ ID NO: 1246751 - RNA, 15 nt, Human
cagccagcacagccu

SEQ ID NO: 1246752 - RNA, 14 nt, Human
caccucccugcaau

SEQ ID NO: 1246753 - RNA, 13 nt, Human
caccuguaauccc

SEQ ID NO: 1246754 - RNA, 15 nt, Human
cacuugaacccggga

SEQ ID NO: 1246755 - RNA, 16 nt, Human
cacagcacgggggcca

SEQ ID NO: 1246756 - RNA, 14 nt, Human
cacaacacacagau

SEQ ID NO: 1246757 - RNA, 19 nt, Human
caauauucauagcagcuua

SEQ ID NO: 1246758 - RNA, 22 nt, Human
caacugggguggguggggcagu

SEQ ID NO: 1246759 - RNA, 13 nt, Human
caaagugcuggga

SEQ ID NO: 1246760 - RNA, 15 nt, Human
caaaauugggaaagg

SEQ ID NO: 1246761 - RNA, 12 nt, Human
auuccacagcug

SEQ ID NO: 1246762 - RNA, 13 nt, Human
auugguuuaccug

SEQ ID NO: 1246763 - RNA, 20 nt, Human
auuugcugagcauguacuga

SEQ ID NO: 1246764 - RNA, 20 nt, Human
ccagcuggccgggagccuga

SEQ ID NO: 1246765 - RNA, 23 nt, Human
ccaggaguuuggccagaagucaa

SEQ ID NO: 1246766 - RNA, 16 nt, Human
ccaccuucuggguuca

SEQ ID NO: 1246767 - RNA, 16 nt, Human
ccacuagacccacugg

SEQ ID NO: 1246768 - RNA, 12 nt, Human
ccaugggacagg

SEQ ID NO: 1246769 - RNA, 18 nt, Human
ccaggaguuuggccagaa

SEQ ID NO: 1246770 - RNA, 15 nt, Human
ccaugggacagggag

SEQ ID NO: 1246771 - RNA, 19 nt, Human
ccacaaaauugggaaagga

SEQ ID NO: 1246772 - RNA, 13 nt, Human
ccaaauucacaag

SEQ ID NO: 1246773 - RNA, 19 nt, Human
caugcugccaauauccuaa

SEQ ID NO: 1246774 - RNA, 13 nt, Human
caugcugccaaua

SEQ ID NO: 1246775 - RNA, 21 nt, Human
caugcuggccaggcuggucuc

SEQ ID NO: 1246776 - RNA, 22 nt, Human
cauggaucugguagggggaaaa

SEQ ID NO: 1246777 - RNA, 19 nt, Human
cagcuggccgggagccuga

SEQ ID NO: 1246778 - RNA, 13 nt, Human
cagggagccccuu

SEQ ID NO: 1246779 - RNA, 22 nt, Human
caggaguuccuaaccagccugg

SEQ ID NO: 1246780 - RNA, 14 nt, Human
caggcagcaggaua

SEQ ID NO: 1246781 - RNA, 19 nt, Human
caggcgugagccaccaaac

SEQ ID NO: 1246782 - RNA, 15 nt, Human
caggcgugagccacc

SEQ ID NO: 1246783 - RNA, 18 nt, Human
cagugucaaugcagcccc

SEQ ID NO: 1246784 - RNA, 20 nt, Human
cagugcuuggcccaggaguu

SEQ ID NO: 1246785 - RNA, 15 nt, Human
cagugcuuuaauggc

SEQ ID NO: 1246786 - RNA, 16 nt, Human
cagugcuuggcccagg

SEQ ID NO: 1246787 - RNA, 16 nt, Human
cagugauuaccaggga

SEQ ID NO: 1246788 - RNA, 23 nt, Human
cauacuaauuauacccccugcaa

SEQ ID NO: 1246789 - RNA, 14 nt, Human
cauagaauaguguu

SEQ ID NO: 1246790 - RNA, 18 nt, Human
gagucccaggcugagccu

SEQ ID NO: 1246791 - RNA, 20 nt, Human
cuuuuuuuuuuuuuuaaaca

SEQ ID NO: 1246792 - RNA, 22 nt, Human
cagaguacuggcugauggagua

SEQ ID NO: 1246793 - RNA, 20 nt, Human
uuugcaagccagauuuuccu

SEQ ID NO: 1246794 - RNA, 16 nt, Human
cuuaaagaauuuucaa

SEQ ID NO: 1246795 - RNA, 14 nt, Human
aaaauacaaaaaaa

SEQ ID NO: 1246796 - RNA, 13 nt, Human
aauuuuuauauuu

SEQ ID NO: 1246797 - RNA, 16 nt, Human
ugagcucagcccuggu

SEQ ID NO: 1246798 - RNA, 13 nt, Human
acaagaaaugaaa

SEQ ID NO: 1246799 - RNA, 14 nt, Human
uaaacaaaggaauu

SEQ ID NO: 1246800 - RNA, 21 nt, Human
ugcccauccugccccugagcc

SEQ ID NO: 1246801 - RNA, 14 nt, Human
aaauaaaagcacuu

SEQ ID NO: 1246802 - RNA, 15 nt, Human
cccucccuccaccuc

SEQ ID NO: 1246803 - RNA, 14 nt, Human
uuuucaaaauggag

SEQ ID NO: 1246804 - RNA, 21 nt, Human
ccagcaguucagagcugcccu

SEQ ID NO: 1246805 - RNA, 18 nt, Human
ccuguaaucccagcuacu

SEQ ID NO: 1246806 - RNA, 21 nt, Human
uacauaagggaggaaaaaaaa

SEQ ID NO: 1246807 - RNA, 19 nt, Human
ucaucaaucaaauaaguau

SEQ ID NO: 1246808 - RNA, 14 nt, Human
auuuuaaguaauuu

SEQ ID NO: 1246809 - RNA, 18 nt, Human
uaagaaaacuaagaaaua

SEQ ID NO: 1246810 - RNA, 20 nt, Human
gcuacucuguuccuucacau

SEQ ID NO: 1246811 - RNA, 20 nt, Human
ucucuccuguacuuuuucca

SEQ ID NO: 1246812 - RNA, 14 nt, Human
ugagcaaaaguuga

SEQ ID NO: 1246813 - RNA, 15 nt, Human
cucgaacugcuggau

SEQ ID NO: 1246814 - RNA, 16 nt, Human
aauaucuauuaauaua

SEQ ID NO: 1246815 - RNA, 14 nt, Human
ugagaccagccaac

SEQ ID NO: 1246816 - RNA, 21 nt, Human
auugcuuguuagcaaaaugga

SEQ ID NO: 1246817 - RNA, 23 nt, Human
ggucucagugucaaugcagcccc

SEQ ID NO: 1246818 - RNA, 19 nt, Human
uagcaagugaauuuuucuc

SEQ ID NO: 1246819 - RNA, 14 nt, Human
uugcagugagcuga

SEQ ID NO: 1246820 - RNA, 14 nt, Human
uaagcuguuuuuau

SEQ ID NO: 1246821 - RNA, 15 nt, Human
acacuaacauauaau

SEQ ID NO: 1246822 - RNA, 14 nt, Human
gccagcaguucaga

SEQ ID NO: 1246823 - RNA, 14 nt, Human
aacauuauuuauau

SEQ ID NO: 1246824 - RNA, 15 nt, Human
ucuuuucucugccuu

SEQ ID NO: 1246825 - RNA, 23 nt, Human
uuuaguaagagauuccugagcca

SEQ ID NO: 1246826 - RNA, 17 nt, Human
ggaaaaaaaggaagaaa

SEQ ID NO: 1246827 - RNA, 16 nt, Human
uauguaccauguacau

SEQ ID NO: 1246828 - RNA, 22 nt, Human
agacucgggauuaguacacacu

SEQ ID NO: 1246829 - RNA, 17 nt, Human
auauauguauuuauaaa

SEQ ID NO: 1246830 - RNA, 18 nt, Human
agugucuuacagagaaaa

SEQ ID NO: 1246831 - RNA, 14 nt, Human
uccagauccuggaa

SEQ ID NO: 1246832 - RNA, 19 nt, Human
auuguauuuuaguaagaga

SEQ ID NO: 1246833 - RNA, 19 nt, Human
gugucuggcacuugggaca

SEQ ID NO: 1246834 - RNA, 22 nt, Human
uucaauaucuuuuuuuuaauaa

SEQ ID NO: 1246835 - RNA, 12 nt, Human
ccuggcugggag

SEQ ID NO: 1246836 - RNA, 15 nt, Human
uggcucacgccugua

SEQ ID NO: 1246837 - RNA, 14 nt, Human
ugaucaccugcccu

SEQ ID NO: 1246838 - RNA, 14 nt, Human
cagcugccuccccu

SEQ ID NO: 1246839 - RNA, 17 nt, Human
aagaagccacagaccua

SEQ ID NO: 1246840 - RNA, 18 nt, Human
caaauauuguugacaacu

SEQ ID NO: 1246841 - RNA, 22 nt, Human
cuggagcuugaaauagugucug

SEQ ID NO: 1246842 - RNA, 14 nt, Human
ugaaacaagaagcc

SEQ ID NO: 1246843 - RNA, 21 nt, Human
cuguuuguuauggcuuaauga

SEQ ID NO: 1246844 - RNA, 22 nt, Human
caguguccucaucuguaaaaug

SEQ ID NO: 1246845 - RNA, 21 nt, Human
uacauuauuaucaacaauagu

SEQ ID NO: 1246846 - RNA, 20 nt, Human
uugcaaccuccaccuucugg

SEQ ID NO: 1246847 - RNA, 15 nt, Human
aagaagugaaaaucu

SEQ ID NO: 1246848 - RNA, 15 nt, Human
gccuguaaucccagc

SEQ ID NO: 1246849 - RNA, 15 nt, Human
uaaaucuaaaucuau

SEQ ID NO: 1246850 - RNA, 22 nt, Human
agcacagccucuuagaugcagu

SEQ ID NO: 1246851 - RNA, 14 nt, Human
caugagucagucug

SEQ ID NO: 1246852 - RNA, 13 nt, Human
aauuagaugaacu

SEQ ID NO: 1246853 - RNA, 14 nt, Human
cucuggcuccagcu

SEQ ID NO: 1246854 - RNA, 17 nt, Human
cugcacuccagccugag

SEQ ID NO: 1246855 - RNA, 13 nt, Human
uaccuuuuuccuu

SEQ ID NO: 1246856 - RNA, 16 nt, Human
uuuauauuugaaauau

SEQ ID NO: 1246857 - RNA, 13 nt, Human
cugccuccccucc

SEQ ID NO: 1246858 - RNA, 17 nt, Human
cccagccagcaguucag

SEQ ID NO: 1246859 - RNA, 22 nt, Human
cucugagccuugggaccccuga

SEQ ID NO: 1246860 - RNA, 14 nt, Human
uauuugaaauauug

SEQ ID NO: 1246861 - RNA, 22 nt, Human
cuuacuauuuauugcugaauga

SEQ ID NO: 1246862 - RNA, 19 nt, Human
ugaguuuuugauagcuuua

SEQ ID NO: 1246863 - RNA, 17 nt, Human
gcaagcucuaucaccaa

SEQ ID NO: 1246864 - RNA, 23 nt, Human
uacugccuaucagcauuuuacua

SEQ ID NO: 1246865 - RNA, 18 nt, Human
gccaucccucccuccacc

SEQ ID NO: 1246866 - RNA, 16 nt, Human
auaugugaaauaaaag

SEQ ID NO: 1246867 - RNA, 19 nt, Human
caacucccugccccccagc

SEQ ID NO: 1246868 - RNA, 22 nt, Human
gaugcaguuguugcccacagcu

SEQ ID NO: 1246869 - RNA, 17 nt, Human
augcacacagugcuuuc

SEQ ID NO: 1246870 - RNA, 20 nt, Human
acaagacccaaaaggcagaa

SEQ ID NO: 1246871 - RNA, 15 nt, Human
acuucauuuaaaaua

SEQ ID NO: 1246872 - RNA, 19 nt, Human
uaagcaacaucuagcaaau

SEQ ID NO: 1246873 - RNA, 21 nt, Human
cuggccuucggccuccauccu

SEQ ID NO: 1246874 - RNA, 22 nt, Human
uguuugccuucuacuuuuaagu

SEQ ID NO: 1246875 - RNA, 20 nt, Human
ucuucuggguuccuuccucu

SEQ ID NO: 1246876 - RNA, 14 nt, Human
uguuauuuuuuaau

SEQ ID NO: 1246877 - RNA, 13 nt, Human
aaaugacuaaaaa

SEQ ID NO: 1246878 - RNA, 16 nt, Human
gccaugugcuaguaau

SEQ ID NO: 1246879 - RNA, 15 nt, Human
ccacuucacuuuuuu

SEQ ID NO: 1246880 - RNA, 13 nt, Human
uuuuuuuuuuucu

SEQ ID NO: 1246881 - RNA, 16 nt, Human
acccagccccuugaga

SEQ ID NO: 1246882 - RNA, 20 nt, Human
agcagagacgggguuugcca

SEQ ID NO: 1246883 - RNA, 18 nt, Human
aagacaacauuaaaacaa

SEQ ID NO: 1246884 - RNA, 18 nt, Human
auagaauuaacacaugau

SEQ ID NO: 1246885 - RNA, 13 nt, Human
aauaaaaauaaaa

SEQ ID NO: 1246886 - RNA, 20 nt, Human
aaucauauaauaaauguaca

SEQ ID NO: 1246887 - RNA, 16 nt, Human
uauguucuaagaagug

SEQ ID NO: 1246888 - RNA, 18 nt, Human
gagaccacuguuaucaaa

SEQ ID NO: 1246889 - RNA, 15 nt, Human
uaaaaucuaauucaa

SEQ ID NO: 1246890 - RNA, 16 nt, Human
gaguggguuucacaag

SEQ ID NO: 1246891 - RNA, 18 nt, Human
agacuuugugaaaaaaaa

SEQ ID NO: 1246892 - RNA, 18 nt, Human
uuaacuagaauuuauuca

SEQ ID NO: 1246893 - RNA, 18 nt, Human
ccuaacugcuacaaauac

SEQ ID NO: 1246894 - RNA, 14 nt, Human
gcugggaauuacag

SEQ ID NO: 1246895 - RNA, 19 nt, Human
gucaaucagccuaguugau

SEQ ID NO: 1246896 - RNA, 16 nt, Human
ccacuuggucugugag

SEQ ID NO: 1246897 - RNA, 19 nt, Human
gcuugccaucccucccucc

SEQ ID NO: 1246898 - RNA, 15 nt, Human
gccccauucaacauc

SEQ ID NO: 1246899 - RNA, 20 nt, Human
ugcuugccaucccucccucc

SEQ ID NO: 1246900 - RNA, 13 nt, Human
cuccaccucccug

SEQ ID NO: 1246901 - RNA, 18 nt, Human
cgccuguaaucccagcac

SEQ ID NO: 1246902 - RNA, 15 nt, Human
agaagagaauauuag

SEQ ID NO: 1246903 - RNA, 17 nt, Human
ccucaguuuuaucauuu

SEQ ID NO: 1246904 - RNA, 14 nt, Human
uuuuaauuauuauu

SEQ ID NO: 1246905 - RNA, 18 nt, Human
cacuccagugagacagcu

SEQ ID NO: 1246906 - RNA, 19 nt, Human
acucugucucaguccauga

SEQ ID NO: 1246907 - RNA, 15 nt, Human
accuguaaucccagc

SEQ ID NO: 1246908 - RNA, 13 nt, Human
ccccagcccuccu

SEQ ID NO: 1246909 - RNA, 19 nt, Human
cccugcaaagcccagcuug

SEQ ID NO: 1246910 - RNA, 19 nt, Human
cugcccucuccugggcagc

SEQ ID NO: 1246911 - RNA, 17 nt, Human
uauaauuuuuuucaaua

SEQ ID NO: 1246912 - RNA, 14 nt, Human
cuuuauauuauuuu

SEQ ID NO: 1246913 - RNA, 12 nt, Human
uuauuauuuaua

SEQ ID NO: 1246914 - RNA, 18 nt, Human
gaccccugagcuugcaga

SEQ ID NO: 1246915 - RNA, 23 nt, Human
ggggagccaacagaagcuuccau

SEQ ID NO: 1246916 - RNA, 16 nt, Human
ucaaauaaguauuuau

SEQ ID NO: 1246917 - RNA, 23 nt, Human
agauuaugaucucagaaauugua

SEQ ID NO: 1246918 - RNA, 14 nt, Human
uauauuauuuugaa

SEQ ID NO: 1246919 - RNA, 16 nt, Human
ccuccuuaucaaagga

SEQ ID NO: 1246920 - RNA, 15 nt, Human
auuucauucaauauc

SEQ ID NO: 1246921 - RNA, 18 nt, Human
uaauucaaacuaauagaa

SEQ ID NO: 1246922 - RNA, 14 nt, Human
ucucaaaaaauaaa

SEQ ID NO: 1246923 - RNA, 21 nt, Human
ucagaucauuucaaaacucau

SEQ ID NO: 1246924 - RNA, 18 nt, Human
acauuugcucauggaauu

SEQ ID NO: 1246925 - RNA, 22 nt, Human
gcccaucuccgucucccaaagu

SEQ ID NO: 1246926 - RNA, 13 nt, Human
gaauguaaucaau

SEQ ID NO: 1246927 - RNA, 13 nt, Human
cuugccugcaggc

SEQ ID NO: 1246928 - RNA, 17 nt, Human
augauuaaguaaugaua

SEQ ID NO: 1246929 - RNA, 17 nt, Human
ucucuggccuucggccu

SEQ ID NO: 1246930 - RNA, 15 nt, Human
caucauaaaauaaag

SEQ ID NO: 1246931 - RNA, 16 nt, Human
gauguggagggggcgc

SEQ ID NO: 1246932 - RNA, 22 nt, Human
caaggaugccccgucccccucu

SEQ ID NO: 1246933 - RNA, 17 nt, Human
ccugcaauaaaaugggu

SEQ ID NO: 1246934 - RNA, 16 nt, Human
cugagccucagucucc

SEQ ID NO: 1246935 - RNA, 21 nt, Human
uguauaaaauaauuuuuauau

SEQ ID NO: 1246936 - RNA, 18 nt, Human
aaccuuauuguaccucuc

SEQ ID NO: 1246937 - RNA, 14 nt, Human
uuucugcuuuaauu

SEQ ID NO: 1246938 - RNA, 11 nt, Human
uuauauuuauu

SEQ ID NO: 1246939 - RNA, 17 nt, Human
uaugcuaagugaaauaa

SEQ ID NO: 1246940 - RNA, 11 nt, Human
ugcagugagcc

SEQ ID NO: 1246941 - RNA, 14 nt, Human
uuguaauucuaaau

SEQ ID NO: 1246942 - RNA, 17 nt, Human
aguaauuucagaagaaa

SEQ ID NO: 1246943 - RNA, 16 nt, Human
cuuuaugcuaagugaa

SEQ ID NO: 1246944 - RNA, 23 nt, Human
aguaauuggaaaggcagcucuaa

SEQ ID NO: 1246945 - RNA, 20 nt, Human
accaaucauuuuaauuauua

SEQ ID NO: 1246946 - RNA, 23 nt, Human
agaguuuagcuggaaaaguaugu

SEQ ID NO: 1246947 - RNA, 18 nt, Human
uccuaauuccacagcugc

SEQ ID NO: 1246948 - RNA, 13 nt, Human
accgaguggcccu

SEQ ID NO: 1246949 - RNA, 18 nt, Human
cccaagccuggcaaggga

SEQ ID NO: 1246950 - RNA, 18 nt, Human
auauaauguuguuauuua

SEQ ID NO: 1246951 - RNA, 13 nt, Human
accucaguuuuau

SEQ ID NO: 1246952 - RNA, 15 nt, Human
aucaauuuaaaaaaa

SEQ ID NO: 1246953 - RNA, 12 nt, Human
gguuuauauaag

SEQ ID NO: 1246954 - RNA, 12 nt, Human
gucccaggcuga

SEQ ID NO: 1246955 - RNA, 18 nt, Human
ccugcaaagcccagcuug

SEQ ID NO: 1246956 - RNA, 21 nt, Human
ugcucaauaaaguacaagagc

SEQ ID NO: 1246957 - RNA, 22 nt, Human
gugccucaccccuugccauaau

SEQ ID NO: 1246958 - RNA, 16 nt, Human
ugguacuagauacuga

SEQ ID NO: 1246959 - RNA, 16 nt, Human
cuggccuucggccucc

SEQ ID NO: 1246960 - RNA, 22 nt, Human
uuaccucugccucagaaaacaa

SEQ ID NO: 1246961 - RNA, 14 nt, Human
ugaggucaggaguu

SEQ ID NO: 1246962 - RNA, 22 nt, Human
gagacgggguuugccaugcugg

SEQ ID NO: 1246963 - RNA, 23 nt, Human
ugagucagucugaugagaacucu

SEQ ID NO: 1246964 - RNA, 18 nt, Human
cagccucuuagaugcagu

SEQ ID NO: 1246965 - RNA, 11 nt, Human
uuguuuuucca

SEQ ID NO: 1246966 - RNA, 21 nt, Human
cuauuuauuuauuuauuugag

SEQ ID NO: 1246967 - RNA, 18 nt, Human
uaacuagaauuuauucaa

SEQ ID NO: 1246968 - RNA, 14 nt, Human
aauaaaauggguuu

SEQ ID NO: 1246969 - RNA, 19 nt, Human
ucacgccuguaaucccagc

SEQ ID NO: 1246970 - RNA, 21 nt, Human
ccuggaucucacaagcacuuu

SEQ ID NO: 1246971 - RNA, 18 nt, Human
caguauucccuuuugcug

SEQ ID NO: 1246972 - RNA, 17 nt, Human
cuuaaagaauuuucaaa

SEQ ID NO: 1246973 - RNA, 14 nt, Human
caguaacggaacag

SEQ ID NO: 1246974 - RNA, 20 nt, Human
ccugggcagcugccuccccu

SEQ ID NO: 1246975 - RNA, 18 nt, Human
uucagagcugcccucucc

SEQ ID NO: 1246976 - RNA, 13 nt, Human
gagacagcucugc

SEQ ID NO: 1246977 - RNA, 15 nt, Human
ccacaggaaccacaa

SEQ ID NO: 1246978 - RNA, 19 nt, Human
uagagauuuuuaaauaaag

SEQ ID NO: 1246979 - RNA, 16 nt, Human
uuacauguuuucuuug

SEQ ID NO: 1246980 - RNA, 21 nt, Human
ucuuugccuuuauaaucuuuu

SEQ ID NO: 1246981 - RNA, 16 nt, Human
cacuaguauuucuaug

SEQ ID NO: 1246982 - RNA, 18 nt, Human
gagugacauguuuacaaa

SEQ ID NO: 1246983 - RNA, 23 nt, Human
gcaauaugugauguggcaaaucu

SEQ ID NO: 1246984 - RNA, 19 nt, Human
cucaccucccccaucucuu

SEQ ID NO: 1246985 - RNA, 20 nt, Human
gccgggcgugguggugagug

SEQ ID NO: 1246986 - RNA, 18 nt, Human
acagugucuuacagagaa

SEQ ID NO: 1246987 - RNA, 15 nt, Human
aucaaaggacaccau

SEQ ID NO: 1246988 - RNA, 20 nt, Human
acuuugugaaaaaaaauuuu

SEQ ID NO: 1246989 - RNA, 17 nt, Human
cugcaggcgugaccuga

SEQ ID NO: 1246990 - RNA, 17 nt, Human
gcaaauugucacaggac

SEQ ID NO: 1246991 - RNA, 20 nt, Human
agaaugggaugaucauguau

SEQ ID NO: 1246992 - RNA, 16 nt, Human
cuuugaugauuaauuc

SEQ ID NO: 1246993 - RNA, 15 nt, Human
uguaccauguacaug

SEQ ID NO: 1246994 - RNA, 16 nt, Human
gcuguuuuuauauaug

SEQ ID NO: 1246995 - RNA, 19 nt, Human
uuacugccgguuugaaaau

SEQ ID NO: 1246996 - RNA, 22 nt, Human
cugcuugccaucccucccucca

SEQ ID NO: 1246997 - RNA, 17 nt, Human
cugcauauguuucgcug

SEQ ID NO: 1246998 - RNA, 16 nt, Human
uggucugugagaugcu

SEQ ID NO: 1246999 - RNA, 14 nt, Human
gcauucucugaaga

SEQ ID NO: 1247000 - RNA, 13 nt, Human
cucgaacugcugg

SEQ ID NO: 1247001 - RNA, 15 nt, Human
ccugccccccagccc

SEQ ID NO: 1247002 - RNA, 17 nt, Human
cugccucagaaaacaag

SEQ ID NO: 1247003 - RNA, 17 nt, Human
cguaaucguguccccua

SEQ ID NO: 1247004 - RNA, 17 nt, Human
agagcugcccucuccug

SEQ ID NO: 1247005 - RNA, 19 nt, Human
gcuuguauuccuuuuucuc

SEQ ID NO: 1247006 - RNA, 17 nt, Human
caagaaugagaagaaug

SEQ ID NO: 1247007 - RNA, 20 nt, Human
cccgggaguggcgcgcgcca

SEQ ID NO: 1247008 - RNA, 23 nt, Human
auguuaaaacugggacaggggag

SEQ ID NO: 1247009 - RNA, 20 nt, Human
caugagagacagcaggucuc

SEQ ID NO: 1247010 - RNA, 21 nt, Human
auccccaagccuggcaaggga

SEQ ID NO: 1247011 - RNA, 18 nt, Human
uacauacugcugucuaug

SEQ ID NO: 1247012 - RNA, 19 nt, Human
cugucucaaaaaauaaaaa

SEQ ID NO: 1247013 - RNA, 13 nt, Human
uaucuauuaauau

SEQ ID NO: 1247014 - RNA, 14 nt, Human
ggcaauagucaaau

SEQ ID NO: 1247015 - RNA, 13 nt, Human
auuacccucuggg

SEQ ID NO: 1247016 - RNA, 15 nt, Human
ccgucccccucuggc

SEQ ID NO: 1247017 - RNA, 21 nt, Human
gaaaaguauguuagugcaaau

SEQ ID NO: 1247018 - RNA, 18 nt, Human
uggucaauuuuguuaugu

SEQ ID NO: 1247019 - RNA, 12 nt, Human
ucaacaugguga

SEQ ID NO: 1247020 - RNA, 23 nt, Human
gccccugcacuccagccugagcg

SEQ ID NO: 1247021 - RNA, 17 nt, Human
uuucaaaacucauuucc

SEQ ID NO: 1247022 - RNA, 19 nt, Human
gauugauagaguguuauca

SEQ ID NO: 1247023 - RNA, 21 nt, Human
accaaucauuuuaauuauuau

SEQ ID NO: 1247024 - RNA, 18 nt, Human
gaaacguguauauuuuuu

SEQ ID NO: 1247025 - RNA, 24 nt, Human
uuuucgaugguacauauuucuuug

SEQ ID NO: 1247026 - RNA, 13 nt, Human
cuucucaacucca

SEQ ID NO: 1247027 - RNA, 17 nt, Human
caguucagagcugcccu

SEQ ID NO: 1247028 - RNA, 21 nt, Human
ccucccuuggggccuaugcag

SEQ ID NO: 1247029 - RNA, 19 nt, Human
uuuaaaaaaaaaaaaaaag

SEQ ID NO: 1247030 - RNA, 14 nt, Human
gagaagagaauauu

SEQ ID NO: 1247031 - RNA, 22 nt, Human
guacacugccuucucaacucca

SEQ ID NO: 1247032 - RNA, 17 nt, Human
ugaaaaaaaauuuuaua

SEQ ID NO: 1247033 - RNA, 23 nt, Human
aauguauuuguuuguauuuugug

SEQ ID NO: 1247034 - RNA, 23 nt, Human
agcuuuuuuuuuuuuucuuaaag

SEQ ID NO: 1247035 - RNA, 17 nt, Human
uacuauuuauugcugaa

SEQ ID NO: 1247036 - RNA, 20 nt, Human
uaugugaaauaaaaguagaa

SEQ ID NO: 1247037 - RNA, 23 nt, Human
uaggauggcuaguaucaaaagaa

SEQ ID NO: 1247038 - RNA, 21 nt, Human
auuuauauggggaauauauuu

SEQ ID NO: 1247039 - RNA, 19 nt, Human
cugacagcccaaggguggg

SEQ ID NO: 1247040 - RNA, 12 nt, Human
auuuucaaaaug

SEQ ID NO: 1247041 - RNA, 12 nt, Human
cacacagugcuu

SEQ ID NO: 1247042 - RNA, 15 nt, Human
aagauuucuugaguu

SEQ ID NO: 1247043 - RNA, 16 nt, Human
cugagcuugcagagau

SEQ ID NO: 1247044 - RNA, 16 nt, Human
ucaggugacccugaug

SEQ ID NO: 1247045 - RNA, 19 nt, Human
guacaagagcuuaacagug

SEQ ID NO: 1247046 - RNA, 13 nt, Human
auaacuggaaacu

SEQ ID NO: 1247047 - RNA, 15 nt, Human
ugccugcaggcauga

SEQ ID NO: 1247048 - RNA, 14 nt, Human
uacuguauuuuuac

SEQ ID NO: 1247049 - RNA, 22 nt, Human
ucccagccagcaguucagagcu

SEQ ID NO: 1247050 - RNA, 17 nt, Human
cugauuaaaguuaaaua

SEQ ID NO: 1247051 - RNA, 20 nt, Human
gccaaggcuggagugcagug

SEQ ID NO: 1247052 - RNA, 22 nt, Human
agaaugagagacacacugaaga

SEQ ID NO: 1247053 - RNA, 15 nt, Human
uuugaaaauaugccu

SEQ ID NO: 1247054 - RNA, 16 nt, Human
acaaggaugaauuaag

SEQ ID NO: 1247055 - RNA, 22 nt, Human
cuuguaaaguacagacuuuuuu

SEQ ID NO: 1247056 - RNA, 13 nt, Human
gaggcaagagaau

SEQ ID NO: 1247057 - RNA, 16 nt, Human
cuuagacccucaugcu

SEQ ID NO: 1247058 - RNA, 20 nt, Human
aaaugaauaucuauuaauau

SEQ ID NO: 1247059 - RNA, 20 nt, Human
uuaaguaauuucagaagaaa

SEQ ID NO: 1247060 - RNA, 16 nt, Human
ugacacuuaaaaaugg

SEQ ID NO: 1247061 - RNA, 10 nt, Human
caacucccug

SEQ ID NO: 1247062 - RNA, 15 nt, Human
cagacaguguuuucu

SEQ ID NO: 1247063 - RNA, 16 nt, Human
uuaaacuggaaauaaa

SEQ ID NO: 1247064 - RNA, 14 nt, Human
caaucaaauaagua

SEQ ID NO: 1247065 - RNA, 19 nt, Human
uccucugcuugccaucccu

SEQ ID NO: 1247066 - RNA, 17 nt, Human
acuugaaugugucaggu

SEQ ID NO: 1247067 - RNA, 14 nt, Human
aacagaagcuucca

SEQ ID NO: 1247068 - RNA, 14 nt, Human
auuccaccugcaau

SEQ ID NO: 1247069 - RNA, 12 nt, Human
gcugaugcaguu

SEQ ID NO: 1247070 - RNA, 17 nt, Human
ccucugggucucagugu

SEQ ID NO: 1247071 - RNA, 13 nt, Human
auguggcuguauc

SEQ ID NO: 1247072 - RNA, 23 nt, Human
gccaucccucccuccaccucccu

SEQ ID NO: 1247073 - RNA, 17 nt, Human
cuuuacuguuagucauu

SEQ ID NO: 1247074 - RNA, 16 nt, Human
aaguugcagugagcug

SEQ ID NO: 1247075 - RNA, 15 nt, Human
uauaauauacuauau

SEQ ID NO: 1247076 - RNA, 17 nt, Human
acacuaagagagaauga

SEQ ID NO: 1247077 - RNA, 17 nt, Human
ucagucauaacuaaaua

SEQ ID NO: 1247078 - RNA, 19 nt, Human
cacuuuauauuauuuugaa

SEQ ID NO: 1247079 - RNA, 17 nt, Human
auguacaugaagaagcu

SEQ ID NO: 1247080 - RNA, 13 nt, Human
cagcugccucccc

SEQ ID NO: 1247081 - RNA, 13 nt, Human
ugggacaguuccu

SEQ ID NO: 1247082 - RNA, 13 nt, Human
uucuaggccgggc

SEQ ID NO: 1247083 - RNA, 23 nt, Human
caccaaggagccaaacauccuac

SEQ ID NO: 1247084 - RNA, 18 nt, Human
auuuguauaaaauaauuu

SEQ ID NO: 1247085 - RNA, 21 nt, Human
uaaaauaaaguauauauagaa

SEQ ID NO: 1247086 - RNA, 15 nt, Human
augaggaauauuugc

SEQ ID NO: 1247087 - RNA, 13 nt, Human
agcuguugagcug

SEQ ID NO: 1247088 - RNA, 17 nt, Human
gaaugagagacacacug

SEQ ID NO: 1247089 - RNA, 19 nt, Human
agaccuguaaucauauaau

SEQ ID NO: 1247090 - RNA, 11 nt, Human
augugcaauaa

SEQ ID NO: 1247091 - RNA, 21 nt, Human
uagcaucucaggagauuucau

SEQ ID NO: 1247092 - RNA, 20 nt, Human
gcugauauauguguuuuuca

SEQ ID NO: 1247093 - RNA, 14 nt, Human
cguguccccuaucc

SEQ ID NO: 1247094 - RNA, 20 nt, Human
gcacuugggacaaaaacaaa

SEQ ID NO: 1247095 - RNA, 11 nt, Human
cuguuuuauaa

SEQ ID NO: 1247096 - RNA, 22 nt, Human
agcauuuuacuacuuuaaaaaa

SEQ ID NO: 1247097 - RNA, 13 nt, Human
agcaguucagagc

SEQ ID NO: 1247098 - RNA, 15 nt, Human
cccccagcccuccuu

SEQ ID NO: 1247099 - RNA, 19 nt, Human
aucccucccuccaccuccc

SEQ ID NO: 1247100 - RNA, 11 nt, Human
gcaugguuuag

SEQ ID NO: 1247101 - RNA, 15 nt, Human
ggacaguuccugaga

SEQ ID NO: 1247102 - RNA, 21 nt, Human
uaaacuuaccugggcauucuu

SEQ ID NO: 1247103 - RNA, 14 nt, Human
auauuuaagauaau

SEQ ID NO: 1247104 - RNA, 14 nt, Human
aaugauuaugaauu

SEQ ID NO: 1247105 - RNA, 14 nt, Human
gugagccaccaaac

SEQ ID NO: 1247106 - RNA, 21 nt, Human
gcugagucccaggcugagccu

SEQ ID NO: 1247107 - RNA, 19 nt, Human
ggcaaggguucaccugggc

SEQ ID NO: 1247108 - RNA, 23 nt, Human
aaaugaauaucuauuaauauaug

SEQ ID NO: 1247109 - RNA, 18 nt, Human
gaaaugaaagcagggacu

SEQ ID NO: 1247110 - RNA, 13 nt, Human
uuuauauuauuuu

SEQ ID NO: 1247111 - RNA, 13 nt, Human
uauuuauuaauau

SEQ ID NO: 1247112 - RNA, 19 nt, Human
uaaauuuucccaaaacuga

SEQ ID NO: 1247113 - RNA, 15 nt, Human
uccagauccuggaaa

SEQ ID NO: 1247114 - RNA, 19 nt, Human
auaauguuacauuauuauc

SEQ ID NO: 1247115 - RNA, 15 nt, Human
uuacaucuuucacau

SEQ ID NO: 1247116 - RNA, 11 nt, Human
accauuuuuac

SEQ ID NO: 1247117 - RNA, 19 nt, Human
uugggaaaggaguagaaaa

SEQ ID NO: 1247118 - RNA, 19 nt, Human
cuaauuuguguauuuucag

SEQ ID NO: 1247119 - RNA, 19 nt, Human
uaaagaacacccuauauuu

SEQ ID NO: 1247120 - RNA, 14 nt, Human
aaauaaguauuuau

SEQ ID NO: 1247121 - RNA, 13 nt, Human
cugcaauaaaaug

SEQ ID NO: 1247122 - RNA, 14 nt, Human
ccucagucucccuc

SEQ ID NO: 1247123 - RNA, 16 nt, Human
uggggauagugaggca

SEQ ID NO: 1247124 - RNA, 23 nt, Human
aucagcauuuuacuacuuuaaaa

SEQ ID NO: 1247125 - RNA, 17 nt, Human
cuccugggcagcugccu

SEQ ID NO: 1247126 - RNA, 17 nt, Human
cugugacugucucacuu

SEQ ID NO: 1247127 - RNA, 21 nt, Human
uucacaagugaaaaacaucca

SEQ ID NO: 1247128 - RNA, 16 nt, Human
ucacuuaauccuuugu

SEQ ID NO: 1247129 - RNA, 21 nt, Human
cagagucaaugaacuuuccac

SEQ ID NO: 1247130 - RNA, 15 nt, Human
ucucagaaauuguau

SEQ ID NO: 1247131 - RNA, 17 nt, Human
gaacuuuccacauucag

SEQ ID NO: 1247132 - RNA, 15 nt, Human
cugcccucuccuggg

SEQ ID NO: 1247133 - RNA, 23 nt, Human
ucaugcauuugcacuauuggaag

SEQ ID NO: 1247134 - RNA, 15 nt, Human
agccgggcauggugg

SEQ ID NO: 1247135 - RNA, 18 nt, Human
cauaagggaggaaaaaaa

SEQ ID NO: 1247136 - RNA, 13 nt, Human
agaaaugaaagca

SEQ ID NO: 1247137 - RNA, 12 nt, Human
uaagaagacugc

SEQ ID NO: 1247138 - RNA, 22 nt, Human
acagagaaaauaaaagcacuua

SEQ ID NO: 1247139 - RNA, 12 nt, Human
aaacaaaaaaag

SEQ ID NO: 1247140 - RNA, 23 nt, Human
auuaauggaauauguaaauagaa

SEQ ID NO: 1247141 - RNA, 14 nt, Human
ugcuguauuuuaaa

SEQ ID NO: 1247142 - RNA, 23 nt, Human
uacauuguuugucugucuucaua

SEQ ID NO: 1247143 - RNA, 20 nt, Human
ggcuggagugcaguggcgca

SEQ ID NO: 1247144 - RNA, 17 nt, Human
cuccaccucccugcaau

SEQ ID NO: 1247145 - RNA, 20 nt, Human
gggaggcagagguugcagug

SEQ ID NO: 1247146 - RNA, 19 nt, Human
aagacucuacccauauuac

SEQ ID NO: 1247147 - RNA, 15 nt, Human
acucuuuugccauua

SEQ ID NO: 1247148 - RNA, 17 nt, Human
ccuacuuccccuuccua

SEQ ID NO: 1247149 - RNA, 16 nt, Human
ucaucaaucaaauaag

SEQ ID NO: 1247150 - RNA, 20 nt, Human
ugaggcuccacuuggucugu

SEQ ID NO: 1247151 - RNA, 13 nt, Human
cagcaguucagag

SEQ ID NO: 1247152 - RNA, 18 nt, Human
gaagaugcuuguauuuua

SEQ ID NO: 1247153 - RNA, 15 nt, Human
uuauacagugucuua

SEQ ID NO: 1247154 - RNA, 15 nt, Human
cagacagaacuugaa

SEQ ID NO: 1247155 - RNA, 22 nt, Human
aaugaaagaaaggccagcaaau

SEQ ID NO: 1247156 - RNA, 16 nt, Human
ugaaguccaagcauuu

SEQ ID NO: 1247157 - RNA, 18 nt, Human
caccuguccccgaaacua

SEQ ID NO: 1247158 - RNA, 14 nt, Human
agcuuuucaaaauu

SEQ ID NO: 1247159 - RNA, 15 nt, Human
cagugucaggaggaa

SEQ ID NO: 1247160 - RNA, 21 nt, Human
auauuucuuugccuuuauaau

SEQ ID NO: 1247161 - RNA, 16 nt, Human
cagcuuuccucaaaac

SEQ ID NO: 1247162 - RNA, 14 nt, Human
caacacuaacauau

SEQ ID NO: 1247163 - RNA, 19 nt, Human
cauggaauuggagcucgug

SEQ ID NO: 1247164 - RNA, 17 nt, Human
uaaaucuauuuauuaau

SEQ ID NO: 1247165 - RNA, 20 nt, Human
acuaauagaauuaauggaau

SEQ ID NO: 1247166 - RNA, 23 nt, Human
aaacucagggagcauuuauaaau

SEQ ID NO: 1247167 - RNA, 21 nt, Human
auuuuuucucuaggaaauauu

SEQ ID NO: 1247168 - RNA, 22 nt, Human
cuggguuccuuccucugagccu

SEQ ID NO: 1247169 - RNA, 22 nt, Human
aauguuauuuuuuaauuauuau

SEQ ID NO: 1247170 - RNA, 23 nt, Human
ugaauuacauuuguauaaaauaa

SEQ ID NO: 1247171 - RNA, 17 nt, Human
agaaacaucaguuacuc

SEQ ID NO: 1247172 - RNA, 15 nt, Human
cuacaagcuaaaauu

SEQ ID NO: 1247173 - RNA, 19 nt, Human
cgcccacuagacccacugg

SEQ ID NO: 1247174 - RNA, 10 nt, Human
accugagccc

SEQ ID NO: 1247175 - RNA, 23 nt, Human
cuucaacucccugccccccagcc

SEQ ID NO: 1247176 - RNA, 15 nt, Human
uagauaggccauggg

SEQ ID NO: 1247177 - RNA, 21 nt, Human
aaugaauggcuaagcaaaaug

SEQ ID NO: 1247178 - RNA, 21 nt, Human
ucuauuaggaaauauucugua

SEQ ID NO: 1247179 - RNA, 18 nt, Human
acugacucuuaagaagac

SEQ ID NO: 1247180 - RNA, 22 nt, Human
gaaaauguguauuuuauuacau

SEQ ID NO: 1247181 - RNA, 14 nt, Human
ugcuuguuagcaaa

SEQ ID NO: 1247182 - RNA, 13 nt, Human
uuuuuuacuuccu

SEQ ID NO: 1247183 - RNA, 15 nt, Human
gaccagagcuacuga

SEQ ID NO: 1247184 - RNA, 21 nt, Human
aauuuacagagacagaaagca

SEQ ID NO: 1247185 - RNA, 19 nt, Human
gugcaauaaaauguauuug

SEQ ID NO: 1247186 - RNA, 17 nt, Human
ucugucucaaaaaauaa

SEQ ID NO: 1247187 - RNA, 14 nt, Human
ggcugggaguggca

SEQ ID NO: 1247188 - RNA, 13 nt, Human
aagugcagccccg

SEQ ID NO: 1247189 - RNA, 15 nt, Human
aaauacaaaaauuag

SEQ ID NO: 1247190 - RNA, 23 nt, Human
caauauuugaauuuuaaaucuaa

SEQ ID NO: 1247191 - RNA, 16 nt, Human
guaauucuaaaugaau

SEQ ID NO: 1247192 - RNA, 17 nt, Human
cacuagacaaguccagc

SEQ ID NO: 1247193 - RNA, 21 nt, Human
cucuccugggcagcugccucc

SEQ ID NO: 1247194 - RNA, 17 nt, Human
gccaucccucccuccac

SEQ ID NO: 1247195 - RNA, 12 nt, Human
cuuccucacacc

SEQ ID NO: 1247196 - RNA, 16 nt, Human
ucaucuuggucacaua

SEQ ID NO: 1247197 - RNA, 20 nt, Human
ugagaacugcauauguuucg

SEQ ID NO: 1247198 - RNA, 22 nt, Human
cucugcuugccaucccucccuc

SEQ ID NO: 1247199 - RNA, 14 nt, Human
caaacgaaaaacau

SEQ ID NO: 1247200 - RNA, 22 nt, Human
ccccuuccuaauuccacagcug

SEQ ID NO: 1247201 - RNA, 15 nt, Human
gaccacugcagaaga

SEQ ID NO: 1247202 - RNA, 23 nt, Human
ugagcaccugcaggcgugaccug

SEQ ID NO: 1247203 - RNA, 18 nt, Human
uuuggcuuguaaaguaca

SEQ ID NO: 1247204 - RNA, 23 nt, Human
gcuuuggucuaucuuugagcgcc

SEQ ID NO: 1247205 - RNA, 22 nt, Human
gaaauaagccagacaucaacag

SEQ ID NO: 1247206 - RNA, 22 nt, Human
auuuuuuaaguauuuauauauu

SEQ ID NO: 1247207 - RNA, 15 nt, Human
gccuaagugcagccc

SEQ ID NO: 1247208 - RNA, 21 nt, Human
uuucaaaacucauuuccuaug

SEQ ID NO: 1247209 - RNA, 16 nt, Human
ugguagggggaaaaug

SEQ ID NO: 1247210 - RNA, 16 nt, Human
gccucagucucccucc

SEQ ID NO: 1247211 - RNA, 15 nt, Human
aggcuggagugcagu

SEQ ID NO: 1247212 - RNA, 22 nt, Human
aaguaacucauuuguuaaaauu

SEQ ID NO: 1247213 - RNA, 14 nt, Human
uuauauauguauuu

SEQ ID NO: 1247214 - RNA, 18 nt, Human
cuuuacuguuagucauuu

SEQ ID NO: 1247215 - RNA, 16 nt, Human
auugucuagugaaacu

SEQ ID NO: 1247216 - RNA, 13 nt, Human
acauuaaaacaau

SEQ ID NO: 1247217 - RNA, 14 nt, Human
aagaaugacuaugc

SEQ ID NO: 1247218 - RNA, 16 nt, Human
aaugaaagcagggacu

SEQ ID NO: 1247219 - RNA, 20 nt, Human
aauaucuuuuuuuuaauaaa

SEQ ID NO: 1247220 - RNA, 20 nt, Human
auaacucaucauaaaauaaa

SEQ ID NO: 1247221 - RNA, 11 nt, Human
aaccugagccc

SEQ ID NO: 1247222 - RNA, 19 nt, Human
gcaccugcaggcgugaccu

SEQ ID NO: 1247223 - RNA, 15 nt, Human
cauuccaagccucau

SEQ ID NO: 1247224 - RNA, 15 nt, Human
ucuaaaucuauuuau

SEQ ID NO: 1247225 - RNA, 18 nt, Human
augguauuugaguguuuu

SEQ ID NO: 1247226 - RNA, 16 nt, Human
aagacugcacaucaaa

SEQ ID NO: 1247227 - RNA, 14 nt, Human
aaguagaauaaaca

SEQ ID NO: 1247228 - RNA, 15 nt, Human
gacccugaugaaaac

SEQ ID NO: 1247229 - RNA, 14 nt, Human
acuggacucaccuc

SEQ ID NO: 1247230 - RNA, 14 nt, Human
ucucuacuaaaaau

SEQ ID NO: 1247231 - RNA, 22 nt, Human
gaauaauacuagucuuauaaua

SEQ ID NO: 1247232 - RNA, 14 nt, Human
auacaaaaaaaaaa

SEQ ID NO: 1247233 - RNA, 17 nt, Human
uaaagaauuuucaaaau

SEQ ID NO: 1247234 - RNA, 22 nt, Human
agacucuacccauauuacagau

SEQ ID NO: 1247235 - RNA, 14 nt, Human
aaaaacauuucaaa

SEQ ID NO: 1247236 - RNA, 12 nt, Human
ucuccugggcag

SEQ ID NO: 1247237 - RNA, 23 nt, Human
ucaauaucuaauauauaugaaua

SEQ ID NO: 1247238 - RNA, 15 nt, Human
acuggccugcuggau

SEQ ID NO: 1247239 - RNA, 21 nt, Human
aaacaaaaaaagcauuguaac

SEQ ID NO: 1247240 - RNA, 18 nt, Human
ucuccuguacuuuuucca

SEQ ID NO: 1247241 - RNA, 15 nt, Human
uccccuccucugcuu

SEQ ID NO: 1247242 - RNA, 21 nt, Human
gaagugaaaaucuacacucca

SEQ ID NO: 1247243 - RNA, 19 nt, Human
cuaaaauuagaugaacuca

SEQ ID NO: 1247244 - RNA, 23 nt, Human
uccaacuaucucauuuccaagca

SEQ ID NO: 1247245 - RNA, 18 nt, Human
aaagcacuuauuuauugu

SEQ ID NO: 1247246 - RNA, 14 nt, Human
gaaugauuaugaau

SEQ ID NO: 1247247 - RNA, 14 nt, Human
ggcgggacacaggc

SEQ ID NO: 1247248 - RNA, 20 nt, Human
cugagccucagucucccucc

SEQ ID NO: 1247249 - RNA, 15 nt, Human
ucaaaggacaccauu

SEQ ID NO: 1247250 - RNA, 16 nt, Human
ccaggcugagccucag

SEQ ID NO: 1247251 - RNA, 18 nt, Human
uggaauauguaaauagaa

SEQ ID NO: 1247252 - RNA, 11 nt, Human
cccucccucca

SEQ ID NO: 1247253 - RNA, 21 nt, Human
uuuucgaugguacauauuucu

SEQ ID NO: 1247254 - RNA, 21 nt, Human
ucaugccccuguacuccagcc

SEQ ID NO: 1247255 - RNA, 13 nt, Human
aucaggcuggcca

SEQ ID NO: 1247256 - RNA, 12 nt, Human
uuuuuguaaguu

SEQ ID NO: 1247257 - RNA, 15 nt, Human
ucuggcuccagcugg

SEQ ID NO: 1247258 - RNA, 16 nt, Human
aucauauaauaaaugu

SEQ ID NO: 1247259 - RNA, 19 nt, Human
agucaaugaacuuuccaca

SEQ ID NO: 1247260 - RNA, 20 nt, Human
uuguagguaauauugcaagg

SEQ ID NO: 1247261 - RNA, 14 nt, Human
uacaguaauuuuaa

SEQ ID NO: 1247262 - RNA, 15 nt, Human
ggauuccccuaaccu

SEQ ID NO: 1247263 - RNA, 18 nt, Human
acagcuucucauccugca

SEQ ID NO: 1247264 - RNA, 16 nt, Human
ccugagcgacagugag

SEQ ID NO: 1247265 - RNA, 19 nt, Human
ugcuuguuagcaaaaugga

SEQ ID NO: 1247266 - RNA, 12 nt, Human
cucccugccccc

SEQ ID NO: 1247267 - RNA, 12 nt, Human
ucuuaagaagac

SEQ ID NO: 1247268 - RNA, 16 nt, Human
aguaagagauuccuga

SEQ ID NO: 1247269 - RNA, 22 nt, Human
aacuuucuuuucuggaauguaa

SEQ ID NO: 1247270 - RNA, 20 nt, Human
ucuugggaauuuucuuccaa

SEQ ID NO: 1247271 - RNA, 21 nt, Human
ugaacaaauuuacagagacag

SEQ ID NO: 1247272 - RNA, 14 nt, Human
gacuggccugcugg

SEQ ID NO: 1247273 - RNA, 23 nt, Human
aaauuaaggcuucucuuaaacac

SEQ ID NO: 1247274 - RNA, 20 nt, Human
gaaacauuugguaaggggaa

SEQ ID NO: 1247275 - RNA, 21 nt, Human
uuuauaauagcaacuuuugug

SEQ ID NO: 1247276 - RNA, 13 nt, Human
aacucuuaaucaa

SEQ ID NO: 1247277 - RNA, 15 nt, Human
cugcacuccagccug

SEQ ID NO: 1247278 - RNA, 23 nt, Human
caagagaauugcuugaacccagg

SEQ ID NO: 1247279 - RNA, 17 nt, Human
uuaaggcuucucuuaaa

SEQ ID NO: 1247280 - RNA, 12 nt, Human
uuuacuuuucca

SEQ ID NO: 1247281 - RNA, 21 nt, Human
auuccuauauccugugacugu

SEQ ID NO: 1247282 - RNA, 22 nt, Human
uaaacuggaaauaaaagauugu

SEQ ID NO: 1247283 - RNA, 16 nt, Human
cuuguaauucuaaaug

SEQ ID NO: 1247284 - RNA, 21 nt, Human
ucuccugggcagcugccuccc

SEQ ID NO: 1247285 - RNA, 16 nt, Human
agggaggacgcucucu

SEQ ID NO: 1247286 - RNA, 21 nt, Human
agauacugaauguaaacaaag

SEQ ID NO: 1247287 - RNA, 16 nt, Human
gaacucaaggaaaucu

SEQ ID NO: 1247288 - RNA, 20 nt, Human
acagcccuucuuuccacaga

SEQ ID NO: 1247289 - RNA, 19 nt, Human
uuuccugaaaacccuugcc

SEQ ID NO: 1247290 - RNA, 15 nt, Human
uaaguauuuauauau

SEQ ID NO: 1247291 - RNA, 15 nt, Human
ucugcagauaaacag

SEQ ID NO: 1247292 - RNA, 17 nt, Human
agaaacguguauauuuu

SEQ ID NO: 1247293 - RNA, 13 nt, Human
gauuguaaaaugg

SEQ ID NO: 1247294 - RNA, 17 nt, Human
aaggaaaucugugucag

SEQ ID NO: 1247295 - RNA, 14 nt, Human
agcgcagccaugug

SEQ ID NO: 1247296 - RNA, 22 nt, Human
caucucuucuggguuccuuccu

SEQ ID NO: 1247297 - RNA, 16 nt, Human
auaauguuacauuauu

SEQ ID NO: 1247298 - RNA, 22 nt, Human
gaugcaguucugaagaagaugg

SEQ ID NO: 1247299 - RNA, 14 nt, Human
agccagcaguucag

SEQ ID NO: 1247300 - RNA, 17 nt, Human
aaucuuucacaggggac

SEQ ID NO: 1247301 - RNA, 21 nt, Human
uuacauuuguauaaaauaauu

SEQ ID NO: 1247302 - RNA, 16 nt, Human
cugcugagucccaggc

SEQ ID NO: 1247303 - RNA, 15 nt, Human
uuuuacaauugaaau

SEQ ID NO: 1247304 - RNA, 21 nt, Human
gaaacagagaaaauaaaagca

SEQ ID NO: 1247305 - RNA, 18 nt, Human
aauucacaaguuguguuu

SEQ ID NO: 1247306 - RNA, 21 nt, Human
uuuuauggcacuaguauuucu

SEQ ID NO: 1247307 - RNA, 20 nt, Human
uccaagccucauguccacug

SEQ ID NO: 1247308 - RNA, 18 nt, Human
aaucauauaauaaaugua

SEQ ID NO: 1247309 - RNA, 14 nt, Human
cauguaauugcuug

SEQ ID NO: 1247310 - RNA, 19 nt, Human
cuucuggguuccuuccucu

SEQ ID NO: 1247311 - RNA, 20 nt, Human
acggacgaaccuugaaaacu

SEQ ID NO: 1247312 - RNA, 18 nt, Human
ucaaggguacacugccuu

SEQ ID NO: 1247313 - RNA, 14 nt, Human
ugagcuugcagaga

SEQ ID NO: 1247314 - RNA, 20 nt, Human
ugcaauaaaauguauuuguu

SEQ ID NO: 1247315 - RNA, 18 nt, Human
cugaugaauguuaaauua

SEQ ID NO: 1247316 - RNA, 15 nt, Human
uuugguaaaauacuu

SEQ ID NO: 1247317 - RNA, 13 nt, Human
ugauagcuuuauu

SEQ ID NO: 1247318 - RNA, 17 nt, Human
aaauuccaggaaaaucu

SEQ ID NO: 1247319 - RNA, 23 nt, Human
caguucauauguaccauguacau

SEQ ID NO: 1247320 - RNA, 21 nt, Human
cucaaaacuucagacauagaa

SEQ ID NO: 1247321 - RNA, 13 nt, Human
uuugguucuaaua

SEQ ID NO: 1247322 - RNA, 15 nt, Human
cugcuggauguggag

SEQ ID NO: 1247323 - RNA, 18 nt, Human
uuuccuauguaacugcau

SEQ ID NO: 1247324 - RNA, 16 nt, Human
uugggcugagcaguca

SEQ ID NO: 1247325 - RNA, 15 nt, Human
auuucuaugaaauau

SEQ ID NO: 1247326 - RNA, 16 nt, Human
uaugugcaauaaaaug

SEQ ID NO: 1247327 - RNA, 15 nt, Human
ucacaggacagcccu

SEQ ID NO: 1247328 - RNA, 23 nt, Human
uguaaucccagcuacuugggagg

SEQ ID NO: 1247329 - RNA, 14 nt, Human
aauguaucuuauuc

SEQ ID NO: 1247330 - RNA, 22 nt, Human
gcgacucuauagacucuaggac

SEQ ID NO: 1247331 - RNA, 16 nt, Human
cuccucugcuugccau

SEQ ID NO: 1247332 - RNA, 22 nt, Human
ccgggagccugaucaccugccc

SEQ ID NO: 1247333 - RNA, 16 nt, Human
ucaaagccaaguuuau

SEQ ID NO: 1247334 - RNA, 18 nt, Human
gcuugaggacuugggcgg

SEQ ID NO: 1247335 - RNA, 20 nt, Human
aaauguuauuuuuuaauuau

SEQ ID NO: 1247336 - RNA, 22 nt, Human
aucaccaaggcugauuaaacca

SEQ ID NO: 1247337 - RNA, 20 nt, Human
uaagugaaauaagccagaca

SEQ ID NO: 1247338 - RNA, 14 nt, Human
cacaagaaaugaaa

SEQ ID NO: 1247339 - RNA, 23 nt, Human
accuguaaucauauaauaaaugu

SEQ ID NO: 1247340 - RNA, 11 nt, Human
uauuauuuaua

SEQ ID NO: 1247341 - RNA, 14 nt, Human
agguugcagugagc

SEQ ID NO: 1247342 - RNA, 16 nt, Human
gaaggcuuacacccac

SEQ ID NO: 1247343 - RNA, 18 nt, Human
acuuuaugcuaagugaaa

SEQ ID NO: 1247344 - RNA, 19 nt, Human
cccacuggacucaccuccc

SEQ ID NO: 1247345 - RNA, 15 nt, Human
aaguauuuauauauu

SEQ ID NO: 1247346 - RNA, 18 nt, Human
ucuccgucucccaaagug

SEQ ID NO: 1247347 - RNA, 11 nt, Human
aauauuauaau

SEQ ID NO: 1247348 - RNA, 22 nt, Human
augaauuuuuuucaucuucucu

SEQ ID NO: 1247349 - RNA, 15 nt, Human
agucaccucauggaa

SEQ ID NO: 1247350 - RNA, 18 nt, Human
cuccagccugagcgacag

SEQ ID NO: 1247351 - RNA, 17 nt, Human
auaguguuggaaaaugu

SEQ ID NO: 1247352 - RNA, 14 nt, Human
uugccaugugcuag

SEQ ID NO: 1247353 - RNA, 20 nt, Human
ugagucccaggcugagccuc

SEQ ID NO: 1247354 - RNA, 16 nt, Human
auuuuaaguaauuuca

SEQ ID NO: 1247355 - RNA, 14 nt, Human
uucuaugaaauauu

SEQ ID NO: 1247356 - RNA, 16 nt, Human
caguguccucaucugu

SEQ ID NO: 1247357 - RNA, 23 nt, Human
uaaauauacuccuaguaauuuaa

SEQ ID NO: 1247358 - RNA, 17 nt, Human
ucaacccccauuucuau

SEQ ID NO: 1247359 - RNA, 22 nt, Human
uacucugaagggcaucaugcau

SEQ ID NO: 1247360 - RNA, 18 nt, Human
auguuaaaacugggacag

SEQ ID NO: 1247361 - RNA, 18 nt, Human
agagaaugagagacacac

SEQ ID NO: 1247362 - RNA, 15 nt, Human
auaucuauuaauaua

SEQ ID NO: 1247363 - RNA, 21 nt, Human
auaauuuuuuucaauauuuau

SEQ ID NO: 1247364 - RNA, 17 nt, Human
cccccugcaaagcccag

SEQ ID NO: 1247365 - RNA, 10 nt, Human
auagugucuu

SEQ ID NO: 1247366 - RNA, 15 nt, Human
aaugaauggcuaagc

SEQ ID NO: 1247367 - RNA, 14 nt, Human
uugaggacuugggc

SEQ ID NO: 1247368 - RNA, 17 nt, Human
aaaugcuguauucuucu

SEQ ID NO: 1247369 - RNA, 14 nt, Human
ugacagcccaaggg

SEQ ID NO: 1247370 - RNA, 22 nt, Human
auacugaauguaaacaaaggaa

SEQ ID NO: 1247371 - RNA, 15 nt, Human
gacaguauggcagcu

SEQ ID NO: 1247372 - RNA, 16 nt, Human
uuacagagaaaagaca

SEQ ID NO: 1247373 - RNA, 17 nt, Human
uccuacaagacacagug

SEQ ID NO: 1247374 - RNA, 19 nt, Human
accccuucauccucugagu

SEQ ID NO: 1247375 - RNA, 18 nt, Human
uaaaauggagacaccacc

SEQ ID NO: 1247376 - RNA, 21 nt, Human
cucagugucaaugcagccccc

SEQ ID NO: 1247377 - RNA, 18 nt, Human
uuauuuagggaacugcuu

SEQ ID NO: 1247378 - RNA, 14 nt, Human
uaucuuguuuuucc

SEQ ID NO: 1247379 - RNA, 22 nt, Human
gacucugucucaaaaaauaaaa

SEQ ID NO: 1247380 - RNA, 17 nt, Human
uuauuacuguaagaaaa

SEQ ID NO: 1247381 - RNA, 22 nt, Human
gucacaggaaguagaggaggcc

SEQ ID NO: 1247382 - RNA, 15 nt, Human
aaacauccagauaca

SEQ ID NO: 1247383 - RNA, 21 nt, Human
uaguauuucuaugaaauauua

SEQ ID NO: 1247384 - RNA, 16 nt, Human
acuuaaaaucuaauuc

SEQ ID NO: 1247385 - RNA, 22 nt, Human
aggaugccccgucccccucugg

SEQ ID NO: 1247386 - RNA, 13 nt, Human
accuagaauaaua

SEQ ID NO: 1247387 - RNA, 21 nt, Human
aauggaauauguaaauagaaa

SEQ ID NO: 1247388 - RNA, 16 nt, Human
uuuaauuucaugaaaa

SEQ ID NO: 1247389 - RNA, 12 nt, Human
uuauuuuuuaau

SEQ ID NO: 1247390 - RNA, 17 nt, Human
ugagaagagaauauuag

SEQ ID NO: 1247391 - RNA, 16 nt, Human
cacgggggccaaggau

SEQ ID NO: 1247392 - RNA, 14 nt, Human
uugacccacaagaa

SEQ ID NO: 1247393 - RNA, 13 nt, Human
acaacauuaaaac

SEQ ID NO: 1247394 - RNA, 13 nt, Human
uuuauagugucuu

SEQ ID NO: 1247395 - RNA, 15 nt, Human
caacuuuuguguaau

SEQ ID NO: 1247396 - RNA, 14 nt, Human
aucaccaaggcuga

SEQ ID NO: 1247397 - RNA, 21 nt, Human
auaagcaaagacuaugaggaa

SEQ ID NO: 1247398 - RNA, 15 nt, Human
acgaaauguuauuuu

SEQ ID NO: 1247399 - RNA, 13 nt, Human
ccaccugccuaua

SEQ ID NO: 1247400 - RNA, 22 nt, Human
ugauaguuguaccgcaauguga

SEQ ID NO: 1247401 - RNA, 14 nt, Human
agaaauaaugaaau

SEQ ID NO: 1247402 - RNA, 23 nt, Human
gggcagcugccuccccuccucug

SEQ ID NO: 1247403 - RNA, 20 nt, Human
auugguuuaccugugaaaua

SEQ ID NO: 1247404 - RNA, 14 nt, Human
cagugucaggagga

SEQ ID NO: 1247405 - RNA, 13 nt, Human
cacaacuauauug

SEQ ID NO: 1247406 - RNA, 10 nt, Human
uguguauuuu

SEQ ID NO: 1247407 - RNA, 18 nt, Human
ggggcgcgugcaggcagc

SEQ ID NO: 1247408 - RNA, 22 nt, Human
aauuuuuucucuaggaaauauu

SEQ ID NO: 1247409 - RNA, 22 nt, Human
aaaucaggguuaguauugucca

SEQ ID NO: 1247410 - RNA, 18 nt, Human
aacaaugcuguauuuuaa

SEQ ID NO: 1247411 - RNA, 14 nt, Human
agucucccucccuu

SEQ ID NO: 1247412 - RNA, 20 nt, Human
gugagccaccaaacccggcc

SEQ ID NO: 1247413 - RNA, 17 nt, Human
augcacuuuauauuauu

SEQ ID NO: 1247414 - RNA, 14 nt, Human
uaaauaguuuauga

SEQ ID NO: 1247415 - RNA, 15 nt, Human
auguauuuauaaaua

SEQ ID NO: 1247416 - RNA, 22 nt, Human
acaugagguacugagagugaac

SEQ ID NO: 1247417 - RNA, 14 nt, Human
gcugauuaaaccaa

SEQ ID NO: 1247418 - RNA, 12 nt, Human
uucucuaggaaa

SEQ ID NO: 1247419 - RNA, 22 nt, Human
cuaauugaaucccuuaaacuca

SEQ ID NO: 1247420 - RNA, 19 nt, Human
caaaugcuuaugaaacuaa

SEQ ID NO: 1247421 - RNA, 12 nt, Human
gggcgcgguggc

SEQ ID NO: 1247422 - RNA, 14 nt, Human
gccugucccugcag

SEQ ID NO: 1247423 - RNA, 16 nt, Human
ucaaaagguauuuauu

SEQ ID NO: 1247424 - RNA, 19 nt, Human
gccugaucaccugcccugc

SEQ ID NO: 1247425 - RNA, 17 nt, Human
ucagaccauaauguuac

SEQ ID NO: 1247426 - RNA, 14 nt, Human
uauguauauuuuau

SEQ ID NO: 1247427 - RNA, 17 nt, Human
uccugccccugagccca

SEQ ID NO: 1247428 - RNA, 16 nt, Human
agaaauaaugaaauaa

SEQ ID NO: 1247429 - RNA, 14 nt, Human
uauuugaauuuuaa

SEQ ID NO: 1247430 - RNA, 20 nt, Human
ucaucugugauucccuccug

SEQ ID NO: 1247431 - RNA, 13 nt, Human
acggggugaaacc

SEQ ID NO: 1247432 - RNA, 22 nt, Human
ugauuuuacggagauaucccag

SEQ ID NO: 1247433 - RNA, 17 nt, Human
agugauuaccagggacu

SEQ ID NO: 1247434 - RNA, 14 nt, Human
agaccagccaaccu

SEQ ID NO: 1247435 - RNA, 14 nt, Human
uuucuaugaaauau

SEQ ID NO: 1247436 - RNA, 14 nt, Human
aaauuggacuuaaa

SEQ ID NO: 1247437 - RNA, 15 nt, Human
uagggugauauuaac

SEQ ID NO: 1247438 - RNA, 20 nt, Human
aggagauggaaguugcagug

SEQ ID NO: 1247439 - RNA, 15 nt, Human
uguaacuuaugaacc

SEQ ID NO: 1247440 - RNA, 13 nt, Human
cuauggaaaaaaa

SEQ ID NO: 1247441 - RNA, 15 nt, Human
ccagcacagccucuu

SEQ ID NO: 1247442 - RNA, 20 nt, Human
auuauaauuuuuuucaauau

SEQ ID NO: 1247443 - RNA, 18 nt, Human
uucuagcuguugagcugu

SEQ ID NO: 1247444 - RNA, 15 nt, Human
auauugacuuuuuau

SEQ ID NO: 1247445 - RNA, 21 nt, Human
cuaagauuuguaauauuucuc

SEQ ID NO: 1247446 - RNA, 19 nt, Human
ccuccauccugaggcucca

SEQ ID NO: 1247447 - RNA, 23 nt, Human
uagacacacaugaaguccaagca

SEQ ID NO: 1247448 - RNA, 23 nt, Human
cuagacccacuggacucaccucc

SEQ ID NO: 1247449 - RNA, 19 nt, Human
aaauuggacuuaaaaucua

SEQ ID NO: 1247450 - RNA, 16 nt, Human
cccucccuccaccucc

SEQ ID NO: 1247451 - RNA, 15 nt, Human
caucaguuacucuga

SEQ ID NO: 1247452 - RNA, 12 nt, Human
cuucaacucccu

SEQ ID NO: 1247453 - RNA, 19 nt, Human
aacuagaauuuauucaauu

SEQ ID NO: 1247454 - RNA, 18 nt, Human
ugccuccccuccucugcu

SEQ ID NO: 1247455 - RNA, 20 nt, Human
auuuauauggggaauauauu

SEQ ID NO: 1247456 - RNA, 16 nt, Human
cagauccccaagccug

SEQ ID NO: 1247457 - RNA, 14 nt, Human
accuucuggguuca

SEQ ID NO: 1247458 - RNA, 17 nt, Human
uuuacuacuuuaaaaaa

SEQ ID NO: 1247459 - RNA, 16 nt, Human
aguccucuuucaaagg

SEQ ID NO: 1247460 - RNA, 17 nt, Human
aauuucaugaaaagauu

SEQ ID NO: 1247461 - RNA, 14 nt, Human
agggcuugaggacu

SEQ ID NO: 1247462 - RNA, 19 nt, Human
gguauuuauugagcaccug

SEQ ID NO: 1247463 - RNA, 15 nt, Human
cagccagcacagccu

SEQ ID NO: 1247464 - RNA, 16 nt, Human
ugcaaauugucacagg

SEQ ID NO: 1247465 - RNA, 14 nt, Human
aaaagaaagaaaau

SEQ ID NO: 1247466 - RNA, 19 nt, Human
cauauguuuuuguaaguuu

SEQ ID NO: 1247467 - RNA, 13 nt, Human
ccucuggcuccag

SEQ ID NO: 1247468 - RNA, 16 nt, Human
cucuaggacauaaauu

SEQ ID NO: 1247469 - RNA, 19 nt, Human
uccccuauccuacuucccc

SEQ ID NO: 1247470 - RNA, 21 nt, Human
gcuaaaguaucuguauugcau

SEQ ID NO: 1247471 - RNA, 18 nt, Human
gagcgacagugagacucu

SEQ ID NO: 1247472 - RNA, 14 nt, Human
acccaaaaggcaga

SEQ ID NO: 1247473 - RNA, 18 nt, Human
gccugagcgacagugaga

SEQ ID NO: 1247474 - RNA, 18 nt, Human
uuggggccuaugcagagg

SEQ ID NO: 1247475 - RNA, 21 nt, Human
cauauguuuuuguaaguuuau

SEQ ID NO: 1247476 - RNA, 18 nt, Human
caguuagagauuuuuaaa

SEQ ID NO: 1247477 - RNA, 21 nt, Human
ucuuaggguuaugauuaagua

SEQ ID NO: 1247478 - RNA, 21 nt, Human
accugacagcccaaggguggg

SEQ ID NO: 1247479 - RNA, 18 nt, Human
auaauguuguuauuuaaa

SEQ ID NO: 1247480 - RNA, 12 nt, Human
auagaauauuua

SEQ ID NO: 1247481 - RNA, 17 nt, Human
ucgggauuaguacacac

SEQ ID NO: 1247482 - RNA, 19 nt, Human
uucagagcugcccucuccu

SEQ ID NO: 1247483 - RNA, 13 nt, Human
aauccagaaauaa

SEQ ID NO: 1247484 - RNA, 20 nt, Human
caccagagauaauaugagaa

SEQ ID NO: 1247485 - RNA, 21 nt, Human
aaauccuuuacuguuagucau

SEQ ID NO: 1247486 - RNA, 11 nt, Human
ugggcagcugc

SEQ ID NO: 1247487 - RNA, 15 nt, Human
cugaaagaggaauga

SEQ ID NO: 1247488 - RNA, 13 nt, Human
gaaugagaagaau

SEQ ID NO: 1247489 - RNA, 17 nt, Human
uaaacaaaaaaagcauu

SEQ ID NO: 1247490 - RNA, 23 nt, Human
cauucucucuccuguacuuuuuc

SEQ ID NO: 1247491 - RNA, 16 nt, Human
uauauuuuuuaugaaa

SEQ ID NO: 1247492 - RNA, 18 nt, Human
acuuuuguguaaugaaaa

SEQ ID NO: 1247493 - RNA, 15 nt, Human
auuuuuuaaguauuu

SEQ ID NO: 1247494 - RNA, 19 nt, Human
uugugccccugcacuccag

SEQ ID NO: 1247495 - RNA, 14 nt, Human
ucuauuaggaaaua

SEQ ID NO: 1247496 - RNA, 14 nt, Human
ccuccaccucccug

SEQ ID NO: 1247497 - RNA, 17 nt, Human
uauuucuuugccuuuau

SEQ ID NO: 1247498 - RNA, 21 nt, Human
uagaaagaagcccaauauuau

SEQ ID NO: 1247499 - RNA, 18 nt, Human
cugagucccaggcugagc

SEQ ID NO: 1247500 - RNA, 15 nt, Human
gcagagguugcagug

SEQ ID NO: 1247501 - RNA, 18 nt, Human
ccuguaaucauauaauaa

SEQ ID NO: 1247502 - RNA, 16 nt, Human
uguagauaaacucaga

SEQ ID NO: 1247503 - RNA, 19 nt, Human
cauuguuugucugucuuca

SEQ ID NO: 1247504 - RNA, 13 nt, Human
agccuugcuccug

SEQ ID NO: 1247505 - RNA, 20 nt, Human
auauguaccauguacaugaa

SEQ ID NO: 1247506 - RNA, 18 nt, Human
cgcgccaccacgcccagc

SEQ ID NO: 1247507 - RNA, 19 nt, Human
agacucgggauuaguacac

SEQ ID NO: 1247508 - RNA, 17 nt, Human
uggcuaagcaaaaugug

SEQ ID NO: 1247509 - RNA, 15 nt, Human
ucugcccugcuuuug

SEQ ID NO: 1247510 - RNA, 15 nt, Human
gccuccccuccucug

SEQ ID NO: 1247511 - RNA, 19 nt, Human
auuuugugaagcaaaauuu

SEQ ID NO: 1247512 - RNA, 21 nt, Human
aggcaugagucagucugauga

SEQ ID NO: 1247513 - RNA, 16 nt, Human
acgggguuugccaugc

SEQ ID NO: 1247514 - RNA, 16 nt, Human
aucaaauaaguauuua

SEQ ID NO: 1247515 - RNA, 14 nt, Human
aacugcuggauuca

SEQ ID NO: 1247516 - RNA, 20 nt, Human
cucccuccaccucccugcaa

SEQ ID NO: 1247517 - RNA, 19 nt, Human
caaacagaacuauggaaaa

SEQ ID NO: 1247518 - RNA, 21 nt, Human
uuaacuagaauuuauucaauu

SEQ ID NO: 1247519 - RNA, 21 nt, Human
cuucuaaccugaacugauggg

SEQ ID NO: 1247520 - RNA, 19 nt, Human
uuuccuaaaucaauucuau

SEQ ID NO: 1247521 - RNA, 16 nt, Human
agcuugaaaccuucac

SEQ ID NO: 1247522 - RNA, 14 nt, Human
aagcaacccaaaug

SEQ ID NO: 1247523 - RNA, 11 nt, Human
caacucccugc

SEQ ID NO: 1247524 - RNA, 14 nt, Human
agaaugagaagaau

SEQ ID NO: 1247525 - RNA, 18 nt, Human
acucuaggacauaaauua

SEQ ID NO: 1247526 - RNA, 19 nt, Human
cagagaugaggccgccaug

SEQ ID NO: 1247527 - RNA, 16 nt, Human
uuauagaauauuuauu

SEQ ID NO: 1247528 - RNA, 22 nt, Human
uugaauaauacaccagagauaa

SEQ ID NO: 1247529 - RNA, 19 nt, Human
uagcuuuauuuuuuaagua

SEQ ID NO: 1247530 - RNA, 16 nt, Human
aaaaugugauauguac

SEQ ID NO: 1247531 - RNA, 14 nt, Human
uaacaauuuuagga

SEQ ID NO: 1247532 - RNA, 14 nt, Human
uauauuuauaacuc

SEQ ID NO: 1247533 - RNA, 21 nt, Human
uuuucaggcuagauguaugua

SEQ ID NO: 1247534 - RNA, 16 nt, Human
uguacaugaagaagcu

SEQ ID NO: 1247535 - RNA, 19 nt, Human
gaacacccuauauuuugca

SEQ ID NO: 1247536 - RNA, 15 nt, Human
cuaugaggaauauuu

SEQ ID NO: 1247537 - RNA, 14 nt, Human
uuaaguguaacugg

SEQ ID NO: 1247538 - RNA, 21 nt, Human
cggccugauuaaaguuaaaua

SEQ ID NO: 1247539 - RNA, 20 nt, Human
agaagaacugaaaucauacu

SEQ ID NO: 1247540 - RNA, 13 nt, Human
ugugacuuuccua

SEQ ID NO: 1247541 - RNA, 20 nt, Human
ccagauacacccaaaguauc

SEQ ID NO: 1247542 - RNA, 21 nt, Human
ucaauagaaggauguacauuu

SEQ ID NO: 1247543 - RNA, 22 nt, Human
caagacucugucucaaaaaaua

SEQ ID NO: 1247544 - RNA, 16 nt, Human
ggaaagggucucccuc

SEQ ID NO: 1247545 - RNA, 19 nt, Human
cucugucucaaaaaauaaa

SEQ ID NO: 1247546 - RNA, 14 nt, Human
aaaaauaaaaauaa

SEQ ID NO: 1247547 - RNA, 17 nt, Human
uuuuccacuacugcuac

SEQ ID NO: 1247548 - RNA, 18 nt, Human
aaacccggccugauuaaa

SEQ ID NO: 1247549 - RNA, 14 nt, Human
uuuauaauuccuau

SEQ ID NO: 1247550 - RNA, 13 nt, Human
acacuuaaaaaug

SEQ ID NO: 1247551 - RNA, 14 nt, Human
uggacucaccuccc

SEQ ID NO: 1247552 - RNA, 14 nt, Human
agaauauuagcuuu

SEQ ID NO: 1247553 - RNA, 21 nt, Human
ccuuuacauccagauagguua

SEQ ID NO: 1247554 - RNA, 16 nt, Human
caguucagagcugccc

SEQ ID NO: 1247555 - RNA, 17 nt, Human
augaucauguauuuauu

SEQ ID NO: 1247556 - RNA, 22 nt, Human
gagucccaggcugagccucagu

SEQ ID NO: 1247557 - RNA, 23 nt, Human
aguacucauacauguuacaacac

SEQ ID NO: 1247558 - RNA, 14 nt, Human
auaaauauauuuaa

SEQ ID NO: 1247559 - RNA, 12 nt, Human
cagaacagugau

SEQ ID NO: 1247560 - RNA, 14 nt, Human
acucuauagacucu

SEQ ID NO: 1247561 - RNA, 18 nt, Human
ugagcucagcccuggugg

SEQ ID NO: 1247562 - RNA, 17 nt, Human
gccugagcgacagugag

SEQ ID NO: 1247563 - RNA, 13 nt, Human
cacaccaggcuug

SEQ ID NO: 1247564 - RNA, 18 nt, Human
guucaaagccaaguuuau

SEQ ID NO: 1247565 - RNA, 15 nt, Human
ucaaccaaauggagu

SEQ ID NO: 1247566 - RNA, 19 nt, Human
aauaaauguaucuuauuca

SEQ ID NO: 1247567 - RNA, 15 nt, Human
cugaggcaagagaau

SEQ ID NO: 1247568 - RNA, 13 nt, Human
ggucucccucugu

SEQ ID NO: 1247569 - RNA, 14 nt, Human
cucaccccuugcca

SEQ ID NO: 1247570 - RNA, 14 nt, Human
ccugggcagcugcc

SEQ ID NO: 1247571 - RNA, 13 nt, Human
gcugggaguggca

SEQ ID NO: 1247572 - RNA, 21 nt, Human
gccugaucaccugcccugcug

SEQ ID NO: 1247573 - RNA, 21 nt, Human
ucucacaagcacuuucccucu

SEQ ID NO: 1247574 - RNA, 14 nt, Human
ccaugggacaggga

SEQ ID NO: 1247575 - RNA, 17 nt, Human
cuuugaugauuaauuca

SEQ ID NO: 1247576 - RNA, 14 nt, Human
aucuuguuuuucca

SEQ ID NO: 1247577 - RNA, 16 nt, Human
uuaaagaauuuucaaa

SEQ ID NO: 1247578 - RNA, 22 nt, Human
auuucuugaguuuuguuuuaaa

SEQ ID NO: 1247579 - RNA, 17 nt, Human
ggacacaggcuccaaac

SEQ ID NO: 1247580 - RNA, 16 nt, Human
aacucuuaaucaaaua

SEQ ID NO: 1247581 - RNA, 20 nt, Human
ucaggaggaaggcuuacacc

SEQ ID NO: 1247582 - RNA, 20 nt, Human
augguuuagaaagcuugccc

SEQ ID NO: 1247583 - RNA, 13 nt, Human
ccagcccuccuua

SEQ ID NO: 1247584 - RNA, 22 nt, Human
cacuaguauuucuaugaaauau

SEQ ID NO: 1247585 - RNA, 21 nt, Human
uauaauaaauguacauuaauu

SEQ ID NO: 1247586 - RNA, 22 nt, Human
ugucucuacuaaaaauacaaaa

SEQ ID NO: 1247587 - RNA, 17 nt, Human
ccaaggaugccccgucc

SEQ ID NO: 1247588 - RNA, 22 nt, Human
uuugagacagggaaagggucuc

SEQ ID NO: 1247589 - RNA, 19 nt, Human
uugccaucccucccuccac

SEQ ID NO: 1247590 - RNA, 20 nt, Human
agauaucccaggaaaauuaa

SEQ ID NO: 1247591 - RNA, 15 nt, Human
aguacagacuuuuuu

SEQ ID NO: 1247592 - RNA, 24 nt, Human
cucaucuguaaaauggagacacca

SEQ ID NO: 1247593 - RNA, 20 nt, Human
gaccauacuaauuauacccc

SEQ ID NO: 1247594 - RNA, 23 nt, Human
uuuccaucaaggguacacugccu

SEQ ID NO: 1247595 - RNA, 16 nt, Human
aacaguauccaguacu

SEQ ID NO: 1247596 - RNA, 15 nt, Human
auguaaacaaaggaa

SEQ ID NO: 1247597 - RNA, 23 nt, Human
aaaucuauuuauuaauauuuaac

SEQ ID NO: 1247598 - RNA, 13 nt, Human
uuuugcuguggca

SEQ ID NO: 1247599 - RNA, 18 nt, Human
caaagacuaugaggaaua

SEQ ID NO: 1247600 - RNA, 19 nt, Human
uaagauuuuguuuuuaaac

SEQ ID NO: 1247601 - RNA, 23 nt, Human
uucucucuccuguacuuuuucca

SEQ ID NO: 1247602 - RNA, 16 nt, Human
ucuguuccuucacauc

SEQ ID NO: 1247603 - RNA, 15 nt, Human
ggcugggaguggcau

SEQ ID NO: 1247604 - RNA, 17 nt, Human
gaagcaccaaucaugaa

SEQ ID NO: 1247605 - RNA, 13 nt, Human
cucaccuccccca

SEQ ID NO: 1247606 - RNA, 16 nt, Human
uauuugcaagacauag

SEQ ID NO: 1247607 - RNA, 17 nt, Human
uucuaaaugaauguuua

SEQ ID NO: 1247608 - RNA, 20 nt, Human
uauauagauggcgagaaccu

SEQ ID NO: 1247609 - RNA, 15 nt, Human
uucauguacauccau

SEQ ID NO: 1247610 - RNA, 18 nt, Human
gcacuccagccugagcga

SEQ ID NO: 1247611 - RNA, 21 nt, Human
caaucugaggccuccucucuc

SEQ ID NO: 1247612 - RNA, 13 nt, Human
uaauuuuuauauu

SEQ ID NO: 1247613 - RNA, 17 nt, Human
aucccagcacuuuggga

SEQ ID NO: 1247614 - RNA, 19 nt, Human
augcagagguccacaacac

SEQ ID NO: 1247615 - RNA, 17 nt, Human
caaucuuaacucauugc

SEQ ID NO: 1247616 - RNA, 19 nt, Human
uacaaaaaaaaaaaaaaau

SEQ ID NO: 1247617 - RNA, 21 nt, Human
agcccuucuuuccacagaagc

SEQ ID NO: 1247618 - RNA, 11 nt, Human
aauaucuauua

SEQ ID NO: 1247619 - RNA, 19 nt, Human
auauugcaaggcaaagacu

SEQ ID NO: 1247620 - RNA, 19 nt, Human
cuuggggccuaugcagagg

SEQ ID NO: 1247621 - RNA, 17 nt, Human
aggccaugggacaggga

SEQ ID NO: 1247622 - RNA, 19 nt, Human
aauuuucuuccaaacagaa

SEQ ID NO: 1247623 - RNA, 16 nt, Human
ccugccccccagcccu

SEQ ID NO: 1247624 - RNA, 19 nt, Human
aguguuaucagucauaacu

SEQ ID NO: 1247625 - RNA, 16 nt, Human
cauuuguauaaaauaa

SEQ ID NO: 1247626 - RNA, 17 nt, Human
agucugacuguuuccau

SEQ ID NO: 1247627 - RNA, 21 nt, Human
ccugcaauaaaauggguuuua

SEQ ID NO: 1247628 - RNA, 17 nt, Human
gagggggcgcgugcagg

SEQ ID NO: 1247629 - RNA, 14 nt, Human
ugacacuuaaaaau

SEQ ID NO: 1247630 - RNA, 20 nt, Human
acugucucacuuaauccuuu

SEQ ID NO: 1247631 - RNA, 21 nt, Human
aauuuuuuucaucuucucugg

SEQ ID NO: 1247632 - RNA, 18 nt, Human
agguauuuauugagcacc

SEQ ID NO: 1247633 - RNA, 11 nt, Human
uaaaaauaaau

SEQ ID NO: 1247634 - RNA, 22 nt, Human
acaagcuuuuuuuuuuuuucuu

SEQ ID NO: 1247635 - RNA, 15 nt, Human
gacaaaugcuuauga

SEQ ID NO: 1247636 - RNA, 12 nt, Human
uaucuaauauau

SEQ ID NO: 1247637 - RNA, 13 nt, Human
uuuaaacaaaaaa

SEQ ID NO: 1247638 - RNA, 13 nt, Human
gccucaguuuccu

SEQ ID NO: 1247639 - RNA, 17 nt, Human
ccaaaaaucucaauauu

SEQ ID NO: 1247640 - RNA, 23 nt, Human
augaauuaaguuuuuuuuuaaaa

SEQ ID NO: 1247641 - RNA, 23 nt, Human
aauauuuauuuuaauaauguuuc

SEQ ID NO: 1247642 - RNA, 20 nt, Human
cagcuggccgggagccugau

SEQ ID NO: 1247643 - RNA, 19 nt, Human
ugugcuggcuuaaaaugua

SEQ ID NO: 1247644 - RNA, 16 nt, Human
auugagcaccugcagg

SEQ ID NO: 1247645 - RNA, 16 nt, Human
auacaguaauuuuaag

SEQ ID NO: 1247646 - RNA, 17 nt, Human
cauucugcuuucaucuu

SEQ ID NO: 1247647 - RNA, 16 nt, Human
ugugauuacccucugg

SEQ ID NO: 1247648 - RNA, 15 nt, Human
uaauauugcaaggca

SEQ ID NO: 1247649 - RNA, 12 nt, Human
gcaguucagagc

SEQ ID NO: 1247650 - RNA, 13 nt, Human
uacagacuuuuuu

SEQ ID NO: 1247651 - RNA, 18 nt, Human
uggccaggcuggucucga

SEQ ID NO: 1247652 - RNA, 22 nt, Human
agaauggaacucaaggaaaucu

SEQ ID NO: 1247653 - RNA, 19 nt, Human
ucaauauuuauuauuuuca

SEQ ID NO: 1247654 - RNA, 21 nt, Human
uauuacuguaagaaaauauca

SEQ ID NO: 1247655 - RNA, 17 nt, Human
auuugcacuauuggaag

SEQ ID NO: 1247656 - RNA, 17 nt, Human
agguccacaacacacag

SEQ ID NO: 1247657 - RNA, 22 nt, Human
aaccagggagccccuuugauga

SEQ ID NO: 1247658 - RNA, 14 nt, Human
aaaguauaaauaaa

SEQ ID NO: 1247659 - RNA, 17 nt, Human
aaaguacaagagcuuaa

SEQ ID NO: 1247660 - RNA, 15 nt, Human
uagaaggauguacau

SEQ ID NO: 1247661 - RNA, 16 nt, Human
cagggccuggcuggga

SEQ ID NO: 1247662 - RNA, 19 nt, Human
ugagucccaggcugagccu

SEQ ID NO: 1247663 - RNA, 22 nt, Human
cauguauuuauuuuuuuacuuc

SEQ ID NO: 1247664 - RNA, 18 nt, Human
ucccuccaccucccugca

SEQ ID NO: 1247665 - RNA, 12 nt, Human
agggauggggcu

SEQ ID NO: 1247666 - RNA, 19 nt, Human
ugugaaaaaaaauuuuaua

SEQ ID NO: 1247667 - RNA, 12 nt, Human
gcucagcccugg

SEQ ID NO: 1247668 - RNA, 15 nt, Human
uuauauuauuuugaa

SEQ ID NO: 1247669 - RNA, 21 nt, Human
cuauguucuaagaagugaaaa

SEQ ID NO: 1247670 - RNA, 21 nt, Human
acucugucucaaaaaauaaaa

SEQ ID NO: 1247671 - RNA, 23 nt, Human
gaagccgagccucaagaugaagg

SEQ ID NO: 1247672 - RNA, 14 nt, Human
cuucucuucacagu

SEQ ID NO: 1247673 - RNA, 23 nt, Human
caucaacagauaaauaguuuaug

SEQ ID NO: 1247674 - RNA, 14 nt, Human
auaucuaauauaua

SEQ ID NO: 1247675 - RNA, 14 nt, Human
agguucuucccuuu

SEQ ID NO: 1247676 - RNA, 16 nt, Human
ccacuguuaucaaaac

SEQ ID NO: 1247677 - RNA, 12 nt, Human
cuucucuuaaac

SEQ ID NO: 1247678 - RNA, 19 nt, Human
uuaauauauguauuauuua

SEQ ID NO: 1247679 - RNA, 24 nt, Human
cugauauauguguuuuucacauuu

SEQ ID NO: 1247680 - RNA, 14 nt, Human
ccugccccccagcc

SEQ ID NO: 1247681 - RNA, 14 nt, Human
cuggaaaucagggu

SEQ ID NO: 1247682 - RNA, 16 nt, Human
gggcuuuagggaccug

SEQ ID NO: 1247683 - RNA, 12 nt, Human
gcuguugagcug

SEQ ID NO: 1247684 - RNA, 22 nt, Human
gaagugauacuauccaguuacu

SEQ ID NO: 1247685 - RNA, 15 nt, Human
accuguaaucauaua

SEQ ID NO: 1247686 - RNA, 21 nt, Human
uguaaaauggugugaccacug

SEQ ID NO: 1247687 - RNA, 15 nt, Human
auggaacucaaggaa

SEQ ID NO: 1247688 - RNA, 20 nt, Human
ugagagugaacaaauuuaca

SEQ ID NO: 1247689 - RNA, 16 nt, Human
aguucagagcugcccu

SEQ ID NO: 1247690 - RNA, 13 nt, Human
uuauagaauauuu

SEQ ID NO: 1247691 - RNA, 17 nt, Human
gcaccuguaaucccagc

SEQ ID NO: 1247692 - RNA, 16 nt, Human
accucugccucagaaa

SEQ ID NO: 1247693 - RNA, 13 nt, Human
cacuuucccucuu

SEQ ID NO: 1247694 - RNA, 15 nt, Human
acugcuggauucaag

SEQ ID NO: 1247695 - RNA, 14 nt, Human
cagucucccucccu

SEQ ID NO: 1247696 - RNA, 13 nt, Human
uguaauucuaaau

SEQ ID NO: 1247697 - RNA, 14 nt, Human
acuaaaaauacaaa

SEQ ID NO: 1247698 - RNA, 23 nt, Human
caaagacuaugaggaauauuugc

SEQ ID NO: 1247699 - RNA, 13 nt, Human
gaaaauaugccug

SEQ ID NO: 1247700 - RNA, 15 nt, Human
uguguuuauuucacu

SEQ ID NO: 1247701 - RNA, 20 nt, Human
aaaagauuaugaucucagaa

SEQ ID NO: 1247702 - RNA, 14 nt, Human
cuccaccuucuggg

SEQ ID NO: 1247703 - RNA, 15 nt, Human
uaaagaauuuucaaa

SEQ ID NO: 1247704 - RNA, 15 nt, Human
agacaccaccacccu

SEQ ID NO: 1247705 - RNA, 17 nt, Human
ugaagguaaaauugaaa

SEQ ID NO: 1247706 - RNA, 15 nt, Human
gccaucccucccucc

SEQ ID NO: 1247707 - RNA, 19 nt, Human
uaaaaauaaaaauaaauuu

SEQ ID NO: 1247708 - RNA, 18 nt, Human
uauuuauuuuuuuacuuc

SEQ ID NO: 1247709 - RNA, 13 nt, Human
auagaguguuauc

SEQ ID NO: 1247710 - RNA, 21 nt, Human
aggcagcuuuuucucucccac

SEQ ID NO: 1247711 - RNA, 17 nt, Human
agaaggauguacauuuc

SEQ ID NO: 1247712 - RNA, 17 nt, Human
ugcaagacauagaauag

SEQ ID NO: 1247713 - RNA, 22 nt, Human
auucuaaaugaauguuuacacu

SEQ ID NO: 1247714 - RNA, 20 nt, Human
auugcuugaacccaggagau

SEQ ID NO: 1247715 - RNA, 16 nt, Human
uaaauggacaaaugcu

SEQ ID NO: 1247716 - RNA, 15 nt, Human
cagucucccucccuu

SEQ ID NO: 1247717 - RNA, 16 nt, Human
acauuugcucauggaa

SEQ ID NO: 1247718 - RNA, 20 nt, Human
cugcacuccagccugagcga

SEQ ID NO: 1247719 - RNA, 16 nt, Human
ugcuccuggcuggggc

SEQ ID NO: 1247720 - RNA, 23 nt, Human
auucucucuccuguacuuuuucc

SEQ ID NO: 1247721 - RNA, 12 nt, Human
ccaggcugagcc

SEQ ID NO: 1247722 - RNA, 23 nt, Human
aauauuuuuaugugcaauaaaau

SEQ ID NO: 1247723 - RNA, 21 nt, Human
caguauucccuuuugcugccu

SEQ ID NO: 1247724 - RNA, 23 nt, Human
cucagucucccucccuuggggcc

SEQ ID NO: 1247725 - RNA, 16 nt, Human
ucugcuuuaauuucau

SEQ ID NO: 1247726 - RNA, 22 nt, Human
aucccagcuacuugggaggcug

SEQ ID NO: 1247727 - RNA, 23 nt, Human
agcucugcccauccugccccuga

SEQ ID NO: 1247728 - RNA, 16 nt, Human
gacaacugugacugua

SEQ ID NO: 1247729 - RNA, 11 nt, Human
uccucuuucaa

SEQ ID NO: 1247730 - RNA, 20 nt, Human
aaucuuucacaggggacagg

SEQ ID NO: 1247731 - RNA, 18 nt, Human
ucuauuaggaaauauucu

SEQ ID NO: 1247732 - RNA, 13 nt, Human
ucucacuuaaucc

SEQ ID NO: 1247733 - RNA, 21 nt, Human
auuugaguguuuuaagauaaa

SEQ ID NO: 1247734 - RNA, 19 nt, Human
auauuuuuuaugaaacauu

SEQ ID NO: 1247735 - RNA, 12 nt, Human
guauaaauaaaa

SEQ ID NO: 1247736 - RNA, 16 nt, Human
gugacuggccugcugg

SEQ ID NO: 1247737 - RNA, 15 nt, Human
ccuggugggcagaga

SEQ ID NO: 1247738 - RNA, 21 nt, Human
acuuuuuuucuuuucucugcc

SEQ ID NO: 1247739 - RNA, 19 nt, Human
auaauuuuuauauuugaaa

SEQ ID NO: 1247740 - RNA, 12 nt, Human
gcuauucacaac

SEQ ID NO: 1247741 - RNA, 13 nt, Human
gcuuuaaguguaa

SEQ ID NO: 1247742 - RNA, 13 nt, Human
ggccuggcuggga

SEQ ID NO: 1247743 - RNA, 15 nt, Human
ugcaauuccacuuau

SEQ ID NO: 1247744 - RNA, 17 nt, Human
aaauguucaucaaugaa

SEQ ID NO: 1247745 - RNA, 18 nt, Human
cugauauauguguuuuuc

SEQ ID NO: 1247746 - RNA, 20 nt, Human
uauaacucaucauaaaauaa

SEQ ID NO: 1247747 - RNA, 19 nt, Human
ucaccaaggcugauuaaac

SEQ ID NO: 1247748 - RNA, 18 nt, Human
aucuacacuccagugaga

SEQ ID NO: 1247749 - RNA, 21 nt, Human
cccuauccuacuuccccuucc

SEQ ID NO: 1247750 - RNA, 23 nt, Human
cugagaccagccaaccugggggc

SEQ ID NO: 1247751 - RNA, 15 nt, Human
caagacucugucuca

SEQ ID NO: 1247752 - RNA, 13 nt, Human
gagcaccugcagg

SEQ ID NO: 1247753 - RNA, 13 nt, Human
uguauugcauuaa

SEQ ID NO: 1247754 - RNA, 16 nt, Human
auuaauucaccuucca

SEQ ID NO: 1247755 - RNA, 11 nt, Human
gugaaaaaaaa

SEQ ID NO: 1247756 - RNA, 18 nt, Human
gccuggucaacaugguga

SEQ ID NO: 1247757 - RNA, 13 nt, Human
guuugauuucauu

SEQ ID NO: 1247758 - RNA, 17 nt, Human
uccauccugaggcucca

SEQ ID NO: 1247759 - RNA, 12 nt, Human
ccccuugccaua

SEQ ID NO: 1247760 - RNA, 16 nt, Human
aggcuugccugcaggc

SEQ ID NO: 1247761 - RNA, 14 nt, Human
agaugaacucaacu

SEQ ID NO: 1247762 - RNA, 20 nt, Human
gcaaaucucuauuaggaaau

SEQ ID NO: 1247763 - RNA, 15 nt, Human
ucagucucccucccu

SEQ ID NO: 1247764 - RNA, 12 nt, Human
aauuauuauuua

SEQ ID NO: 1247765 - RNA, 22 nt, Human
acucauuuccuauguaacugca

SEQ ID NO: 1247766 - RNA, 20 nt, Human
acaguuagagauuuuuaaau

SEQ ID NO: 1247767 - RNA, 15 nt, Human
cuugaaaacuuuaug

SEQ ID NO: 1247768 - RNA, 18 nt, Human
ccuguuuuuaagcuguuu

SEQ ID NO: 1247769 - RNA, 11 nt, Human
ugcuugccauc

SEQ ID NO: 1247770 - RNA, 15 nt, Human
gaaauaguucaaagc

SEQ ID NO: 1247771 - RNA, 15 nt, Human
cacaggcuccaaacu

SEQ ID NO: 1247772 - RNA, 20 nt, Human
gaacguaaucguguccccua

SEQ ID NO: 1247773 - RNA, 24 nt, Human
guccucaucuguaaaauggagaca

SEQ ID NO: 1247774 - RNA, 23 nt, Human
cugggguggguggggcagugcuu

SEQ ID NO: 1247775 - RNA, 19 nt, Human
aucuauuuauuaauauuua

SEQ ID NO: 1247776 - RNA, 22 nt, Human
uguugagcuguuuucccugacc

SEQ ID NO: 1247777 - RNA, 22 nt, Human
cauuaaaacaauauuguuucua

SEQ ID NO: 1247778 - RNA, 13 nt, Human
ugcuugccauccc

SEQ ID NO: 1247779 - RNA, 12 nt, Human
ucaauauuuauu

SEQ ID NO: 1247780 - RNA, 17 nt, Human
ucccugcaauaaaaugg

SEQ ID NO: 1247781 - RNA, 12 nt, Human
aaggccuguccc

SEQ ID NO: 1247782 - RNA, 13 nt, Human
aagaauuuuaaaa

SEQ ID NO: 1247783 - RNA, 16 nt, Human
gaagagaaaccaggga

SEQ ID NO: 1247784 - RNA, 18 nt, Human
gagccaacagaagcuucc

SEQ ID NO: 1247785 - RNA, 13 nt, Human
acuaaaaaacaaa

SEQ ID NO: 1247786 - RNA, 14 nt, Human
cuguaaucacagcu

SEQ ID NO: 1247787 - RNA, 13 nt, Human
auccugaggcucc

SEQ ID NO: 1247788 - RNA, 19 nt, Human
ccaccugccuauauuuuuu

SEQ ID NO: 1247789 - RNA, 17 nt, Human
gaauaucuauuaauaua

SEQ ID NO: 1247790 - RNA, 22 nt, Human
agacuuugugaaaaaaaauuuu

SEQ ID NO: 1247791 - RNA, 22 nt, Human
uauuuauaaauauauuuaagau

SEQ ID NO: 1247792 - RNA, 18 nt, Human
acagaccuaggauuucau

SEQ ID NO: 1247793 - RNA, 22 nt, Human
ggacagcccuucuuuccacaga

SEQ ID NO: 1247794 - RNA, 16 nt, Human
uggaaaaugugcaaua

SEQ ID NO: 1247795 - RNA, 13 nt, Human
agcauuuauaaau

SEQ ID NO: 1247796 - RNA, 17 nt, Human
uucuagguucuaaaaau

SEQ ID NO: 1247797 - RNA, 17 nt, Human
uuuacuuuguuauuuuu

SEQ ID NO: 1247798 - RNA, 15 nt, Human
gucccaggcugagcc

SEQ ID NO: 1247799 - RNA, 16 nt, Human
uccaccucccugcaau

SEQ ID NO: 1247800 - RNA, 21 nt, Human
caguucagagcugcccucucc

SEQ ID NO: 1247801 - RNA, 21 nt, Human
uuccuaauuccacagcugcuc

SEQ ID NO: 1247802 - RNA, 21 nt, Human
uuaucagucauaacuaaauaa

SEQ ID NO: 1247803 - RNA, 15 nt, Human
gccccugcacuccag

SEQ ID NO: 1247804 - RNA, 16 nt, Human
ucuuacugaagguaaa

SEQ ID NO: 1247805 - RNA, 21 nt, Human
gacagucaccucauggaauug

SEQ ID NO: 1247806 - RNA, 21 nt, Human
aauuaaguuuuuuuuuaaaaa

SEQ ID NO: 1247807 - RNA, 14 nt, Human
aaaggccugucccu

SEQ ID NO: 1247808 - RNA, 14 nt, Human
caacaguuuuuuau

SEQ ID NO: 1247809 - RNA, 16 nt, Human
aggguguguaaguaga

SEQ ID NO: 1247810 - RNA, 16 nt, Human
ucuaaaucuauuuauu

SEQ ID NO: 1247811 - RNA, 22 nt, Human
caaaacugauacccuuugaaaa

SEQ ID NO: 1247812 - RNA, 23 nt, Human
gaaugagagacacacugaagaag

SEQ ID NO: 1247813 - RNA, 12 nt, Human
ucccccucuggc

SEQ ID NO: 1247814 - RNA, 23 nt, Human
uaaguaaguuugauuucauuaau

SEQ ID NO: 1247815 - RNA, 23 nt, Human
cagagguugcagugagccgagau

SEQ ID NO: 1247816 - RNA, 15 nt, Human
gagauuucaugccug

SEQ ID NO: 1247817 - RNA, 15 nt, Human
auuuucaaaaucaaa

SEQ ID NO: 1247818 - RNA, 18 nt, Human
uccagauacacccaaagu

SEQ ID NO: 1247819 - RNA, 18 nt, Human
agauccccaagccuggca

SEQ ID NO: 1247820 - RNA, 15 nt, Human
uuuaccuuuuuccuu

SEQ ID NO: 1247821 - RNA, 15 nt, Human
caguuuuaucauuuu

SEQ ID NO: 1247822 - RNA, 18 nt, Human
auugaaaggcauucucug

SEQ ID NO: 1247823 - RNA, 22 nt, Human
acauuacaguuagagauuuuua

SEQ ID NO: 1247824 - RNA, 17 nt, Human
auggcuaguaucaaaag

SEQ ID NO: 1247825 - RNA, 19 nt, Human
ggcagugcuuggcccagga

SEQ ID NO: 1247826 - RNA, 23 nt, Human
aucucuucuggguuccuuccucu

SEQ ID NO: 1247827 - RNA, 14 nt, Human
aauaaaaauaaauu

SEQ ID NO: 1247828 - RNA, 16 nt, Human
cucccaaagugcuggg

SEQ ID NO: 1247829 - RNA, 13 nt, Human
gaucauguauuua

SEQ ID NO: 1247830 - RNA, 23 nt, Human
uuagaugcaguucugaagaagau

SEQ ID NO: 1247831 - RNA, 17 nt, Human
cagugcuuggcccagga

SEQ ID NO: 1247832 - RNA, 15 nt, Human
cccuguacuccagcc

SEQ ID NO: 1247833 - RNA, 11 nt, Human
aacugcuggau

SEQ ID NO: 1247834 - RNA, 21 nt, Human
cgggguuugccaugcuggcca

SEQ ID NO: 1247835 - RNA, 16 nt, Human
augcuaagugaaauaa

SEQ ID NO: 1247836 - RNA, 20 nt, Human
aagggcuguuauaaucuuuc

SEQ ID NO: 1247837 - RNA, 22 nt, Human
aaccaugagaccacuguuauca

SEQ ID NO: 1247838 - RNA, 13 nt, Human
uaagugcagcccc

SEQ ID NO: 1247839 - RNA, 11 nt, Human
augugcaauau

SEQ ID NO: 1247840 - RNA, 17 nt, Human
uuuccguggcacugcau

SEQ ID NO: 1247841 - RNA, 19 nt, Human
aagauuaugaucucagaaa

SEQ ID NO: 1247842 - RNA, 21 nt, Human
agagacuuugugaaaaaaaau

SEQ ID NO: 1247843 - RNA, 16 nt, Human
ugccuccccuccucug

SEQ ID NO: 1247844 - RNA, 16 nt, Human
uauacuguauuuuuac

SEQ ID NO: 1247845 - RNA, 12 nt, Human
cugauuuuccug

SEQ ID NO: 1247846 - RNA, 15 nt, Human
guguacaugaaagcg

SEQ ID NO: 1247847 - RNA, 14 nt, Human
acacuaacauauaa

SEQ ID NO: 1247848 - RNA, 22 nt, Human
uagaauggaacucaaggaaauc

SEQ ID NO: 1247849 - RNA, 20 nt, Human
gagauaucccaggaaaauua

SEQ ID NO: 1247850 - RNA, 13 nt, Human
aauaaaaagguga

SEQ ID NO: 1247851 - RNA, 18 nt, Human
uuuuuagacucaucaauc

SEQ ID NO: 1247852 - RNA, 16 nt, Human
cccccagcccuccuua

SEQ ID NO: 1247853 - RNA, 12 nt, Human
caggucucaugg

SEQ ID NO: 1247854 - RNA, 21 nt, Human
ugaccauacuaauuauacccc

SEQ ID NO: 1247855 - RNA, 12 nt, Human
uucccugaccuc

SEQ ID NO: 1247856 - RNA, 17 nt, Human
agacauagaauaguguu

SEQ ID NO: 1247857 - RNA, 14 nt, Human
guacuccagccugg

SEQ ID NO: 1247858 - RNA, 15 nt, Human
auuugguaaggggaa

SEQ ID NO: 1247859 - RNA, 20 nt, Human
uagagacuuugugaaaaaaa

SEQ ID NO: 1247860 - RNA, 19 nt, Human
gaaaauaaaagcacuuauu

SEQ ID NO: 1247861 - RNA, 16 nt, Human
uauaucaauuuaaaaa

SEQ ID NO: 1247862 - RNA, 18 nt, Human
ccucccuccaccucccug

SEQ ID NO: 1247863 - RNA, 17 nt, Human
ccacugcagaagacagu

SEQ ID NO: 1247864 - RNA, 23 nt, Human
uuguaacuuaugaaccuuuacau

SEQ ID NO: 1247865 - RNA, 18 nt, Human
aaggaugccccguccccc

SEQ ID NO: 1247866 - RNA, 16 nt, Human
guuggaaaaugugcaa

SEQ ID NO: 1247867 - RNA, 15 nt, Human
uuuaaguaauuucag

SEQ ID NO: 1247868 - RNA, 20 nt, Human
aaaaaccugagccccaaaag

SEQ ID NO: 1247869 - RNA, 14 nt, Human
ucaaugcagccccc

SEQ ID NO: 1247870 - RNA, 17 nt, Human
uaaaaaaaaaaaaaaag

SEQ ID NO: 1247871 - RNA, 21 nt, Human
uacuucauuuaaaauauuuuu

SEQ ID NO: 1247872 - RNA, 15 nt, Human
accaaucauuuuaau

SEQ ID NO: 1247873 - RNA, 19 nt, Human
uaucacuugucaauaaaau

SEQ ID NO: 1247874 - RNA, 20 nt, Human
acaucucugauacuuuuuuc

SEQ ID NO: 1247875 - RNA, 21 nt, Human
auuccuuuuucucuccucucc

SEQ ID NO: 1247876 - RNA, 19 nt, Human
accauuuuggcaagcucua

SEQ ID NO: 1247877 - RNA, 14 nt, Human
uccuucacauccug

SEQ ID NO: 1247878 - RNA, 20 nt, Human
auucagccccgggaguggcg

SEQ ID NO: 1247879 - RNA, 13 nt, Human
aguuuuccuucuc

SEQ ID NO: 1247880 - RNA, 19 nt, Human
aagcauuccaacuaucuca

SEQ ID NO: 1247881 - RNA, 15 nt, Human
ggacucaccuccccc

SEQ ID NO: 1247882 - RNA, 12 nt, Human
cauauaauguug

SEQ ID NO: 1247883 - RNA, 18 nt, Human
agguccacaacacacaga

SEQ ID NO: 1247884 - RNA, 19 nt, Human
acuagacaaguccagccug

SEQ ID NO: 1247885 - RNA, 13 nt, Human
uaauuuuuuucaa

SEQ ID NO: 1247886 - RNA, 10 nt, Human
auguuuucag

SEQ ID NO: 1247887 - RNA, 16 nt, Human
aaaggccugucccugc

SEQ ID NO: 1247888 - RNA, 23 nt, Human
auucuuacauguuuucuuugcuu

SEQ ID NO: 1247889 - RNA, 15 nt, Human
accucccccaucucu

SEQ ID NO: 1247890 - RNA, 22 nt, Human
guaaguuuaugcauacaguaau

SEQ ID NO: 1247891 - RNA, 16 nt, Human
aguguuggaaaaugug

SEQ ID NO: 1247892 - RNA, 21 nt, Human
cccacuggacucaccuccccc

SEQ ID NO: 1247893 - RNA, 20 nt, Human
cucuguucugcacacagcac

SEQ ID NO: 1247894 - RNA, 20 nt, Human
caggaguuccuaaccagccu

SEQ ID NO: 1247895 - RNA, 20 nt, Human
augccugcaaucugagccag

SEQ ID NO: 1247896 - RNA, 21 nt, Human
uccugggcagcugccuccccu

SEQ ID NO: 1247897 - RNA, 23 nt, Human
guuucacaagugaaaaacaucca

SEQ ID NO: 1247898 - RNA, 20 nt, Human
cucuccugggcagcugccuc

SEQ ID NO: 1247899 - RNA, 21 nt, Human
uauuuauaacaaccuaaauuu

SEQ ID NO: 1247900 - RNA, 19 nt, Human
uggggcagugcuuggccca

SEQ ID NO: 1247901 - RNA, 22 nt, Human
aagacccaaaaggcagaagcaa

SEQ ID NO: 1247902 - RNA, 18 nt, Human
uucauagcagauuuuaau

SEQ ID NO: 1247903 - RNA, 15 nt, Human
ugugggcuuuuauug

SEQ ID NO: 1247904 - RNA, 16 nt, Human
aagacaaagacaaauu

SEQ ID NO: 1247905 - RNA, 21 nt, Human
agcaguucagagcugcccucu

SEQ ID NO: 1247906 - RNA, 20 nt, Human
cacuggcucccuggaagaga

SEQ ID NO: 1247907 - RNA, 24 nt, Human
aaucugaggccuccucucucaguu

SEQ ID NO: 1247908 - RNA, 16 nt, Human
ucccuccaccucccug

SEQ ID NO: 1247909 - RNA, 12 nt, Human
ucaugcugccaa

SEQ ID NO: 1247910 - RNA, 20 nt, Human
uauuuauuacuguaagaaaa

SEQ ID NO: 1247911 - RNA, 19 nt, Human
cagauccccaagccuggca

SEQ ID NO: 1247912 - RNA, 13 nt, Human
caaaaagaauggg

SEQ ID NO: 1247913 - RNA, 14 nt, Human
uauaaucuuuuaua

SEQ ID NO: 1247914 - RNA, 20 nt, Human
gcagagaugaggccgccaug

SEQ ID NO: 1247915 - RNA, 13 nt, Human
aauucuaaaugaa

SEQ ID NO: 1247916 - RNA, 20 nt, Human
auaaauuuucccaaaacuga

SEQ ID NO: 1247917 - RNA, 16 nt, Human
uauuuuacuuuuccau

SEQ ID NO: 1247918 - RNA, 15 nt, Human
acuuuggcaaaugag

SEQ ID NO: 1247919 - RNA, 16 nt, Human
auauccaaagcugaau

SEQ ID NO: 1247920 - RNA, 16 nt, Human
aaucuaauucaaacua

SEQ ID NO: 1247921 - RNA, 21 nt, Human
cuaccaaaaaucucaauauuu

SEQ ID NO: 1247922 - RNA, 21 nt, Human
cccccucuggcuccagcuggc

SEQ ID NO: 1247923 - RNA, 19 nt, Human
cagcuuuuucucucccacu

SEQ ID NO: 1247924 - RNA, 20 nt, Human
gcagacaguguuuucuggga

SEQ ID NO: 1247925 - RNA, 22 nt, Human
ugaagcaaaauuuuuucucuag

SEQ ID NO: 1247926 - RNA, 16 nt, Human
uucucuaggaaauauu

SEQ ID NO: 1247927 - RNA, 14 nt, Human
ucugcuugccaucc

SEQ ID NO: 1247928 - RNA, 21 nt, Human
agcuaaguugcaccaacuuug

SEQ ID NO: 1247929 - RNA, 20 nt, Human
cuggccuucggccuccaucc

SEQ ID NO: 1247930 - RNA, 15 nt, Human
aaccugggggcuuua

SEQ ID NO: 1247931 - RNA, 21 nt, Human
cuggcuuaaaauguaauuaau

SEQ ID NO: 1247932 - RNA, 15 nt, Human
uuaccuuuuuccuuc

SEQ ID NO: 1247933 - RNA, 17 nt, Human
agauccccguguuacug

SEQ ID NO: 1247934 - RNA, 22 nt, Human
gaauuaauggaauauguaaaua

SEQ ID NO: 1247935 - RNA, 21 nt, Human
cucuucuggguuccuuccucu

SEQ ID NO: 1247936 - RNA, 13 nt, Human
agaauauuuauua

SEQ ID NO: 1247937 - RNA, 22 nt, Human
aguauguuagugcaaauuguca

SEQ ID NO: 1247938 - RNA, 22 nt, Human
ucaguugauuuuacaauugaaa

SEQ ID NO: 1247939 - RNA, 16 nt, Human
uucacauccuguguuu

SEQ ID NO: 1247940 - RNA, 18 nt, Human
aucauuucaaaacucauu

SEQ ID NO: 1247941 - RNA, 16 nt, Human
agucuuauaauagguu

SEQ ID NO: 1247942 - RNA, 22 nt, Human
uguugcccacagcuguaugauu

SEQ ID NO: 1247943 - RNA, 15 nt, Human
agagcugcccucucc

SEQ ID NO: 1247944 - RNA, 23 nt, Human
caaaagguauuuauugagcaccu

SEQ ID NO: 1247945 - RNA, 21 nt, Human
auuuuuaugugcaauaaaaug

SEQ ID NO: 1247946 - RNA, 15 nt, Human
uuugaauaaauaaau

SEQ ID NO: 1247947 - RNA, 19 nt, Human
aauauuauguuaaaacugg

SEQ ID NO: 1247948 - RNA, 13 nt, Human
uaaauaaagaauu

SEQ ID NO: 1247949 - RNA, 17 nt, Human
acuuccagauccuggaa

SEQ ID NO: 1247950 - RNA, 16 nt, Human
caaaaaccaaauuugu

SEQ ID NO: 1247951 - RNA, 16 nt, Human
agauaauuauaauaua

SEQ ID NO: 1247952 - RNA, 20 nt, Human
uacaucccuuaccugggaaa

SEQ ID NO: 1247953 - RNA, 16 nt, Human
gagcucgugggacagu

SEQ ID NO: 1247954 - RNA, 21 nt, Human
uuaucuaucuaucuauuuauu

SEQ ID NO: 1247955 - RNA, 21 nt, Human
agaaauuugccaauuuacuuu

SEQ ID NO: 1247956 - RNA, 20 nt, Human
cugugguccgaagucuucca

SEQ ID NO: 1247957 - RNA, 17 nt, Human
auagaauggaacucaag

SEQ ID NO: 1247958 - RNA, 15 nt, Human
ugagagacagcaggu

SEQ ID NO: 1247959 - RNA, 13 nt, Human
uuccucugagccu

SEQ ID NO: 1247960 - RNA, 13 nt, Human
aacuaauagaauu

SEQ ID NO: 1247961 - RNA, 20 nt, Human
auuauuuugaauccagaaau

SEQ ID NO: 1247962 - RNA, 22 nt, Human
gcaugaauuuuuuucaucuucu

SEQ ID NO: 1247963 - RNA, 13 nt, Human
aaaggaagaaauu

SEQ ID NO: 1247964 - RNA, 16 nt, Human
ccuaugcagaggucca

SEQ ID NO: 1247965 - RNA, 15 nt, Human
augaaccuuuacauc

SEQ ID NO: 1247966 - RNA, 21 nt, Human
uauaacucaucauaaaauaaa

SEQ ID NO: 1247967 - RNA, 14 nt, Human
uccucugcuugcca

SEQ ID NO: 1247968 - RNA, 16 nt, Human
uaagauaaauuauaag

SEQ ID NO: 1247969 - RNA, 23 nt, Human
cucagcccuggugggcagagagg

SEQ ID NO: 1247970 - RNA, 18 nt, Human
auccuucagccugaaaga

SEQ ID NO: 1247971 - RNA, 19 nt, Human
uucuagggaaaugaaagaa

SEQ ID NO: 1247972 - RNA, 20 nt, Human
cuuaaagaauuuucaaaauc

SEQ ID NO: 1247973 - RNA, 23 nt, Human
cuugccaucccucccuccaccuc

SEQ ID NO: 1247974 - RNA, 18 nt, Human
uauuuaagguauauaaau

SEQ ID NO: 1247975 - RNA, 17 nt, Human
cuuuuuuuuuuuuucuu

SEQ ID NO: 1247976 - RNA, 14 nt, Human
ucuacuuuuaaguu

SEQ ID NO: 1247977 - RNA, 14 nt, Human
cacaaaauugggaa

SEQ ID NO: 1247978 - RNA, 20 nt, Human
auaaauggcuuccuggcaau

SEQ ID NO: 1247979 - RNA, 23 nt, Human
gacuuuuuuuuuuuuuuaaacaa

SEQ ID NO: 1247980 - RNA, 18 nt, Human
ucuucuggguuccuuccu

SEQ ID NO: 1247981 - RNA, 14 nt, Human
uuucaauauuuauu

SEQ ID NO: 1247982 - RNA, 14 nt, Human
uuuucaauauuuau

SEQ ID NO: 1247983 - RNA, 17 nt, Human
aaauucugcaagcuuuu

SEQ ID NO: 1247984 - RNA, 19 nt, Human
agaccuaggauuucaugau

SEQ ID NO: 1247985 - RNA, 17 nt, Human
ugugcaauaugugaugu

SEQ ID NO: 1247986 - RNA, 19 nt, Human
gaucauguauuuauuuuuu

SEQ ID NO: 1247987 - RNA, 12 nt, Human
auaacuggaaac

SEQ ID NO: 1247988 - RNA, 23 nt, Human
uuauaaauauauuuaagauaauu

SEQ ID NO: 1247989 - RNA, 18 nt, Human
cucuauguucuaagaagu

SEQ ID NO: 1247990 - RNA, 13 nt, Human
accaaauggagug

SEQ ID NO: 1247991 - RNA, 21 nt, Human
ugggcauucuuguuucaauuc

SEQ ID NO: 1247992 - RNA, 23 nt, Human
ucgcugauauauguguuuuucac

SEQ ID NO: 1247993 - RNA, 22 nt, Human
cucuggccuucggccuccaucc

SEQ ID NO: 1247994 - RNA, 15 nt, Human
aacauagguuuuuag

SEQ ID NO: 1247995 - RNA, 19 nt, Human
uacauucugcuuucaucuu

SEQ ID NO: 1247996 - RNA, 21 nt, Human
acguaggaacgguaaauuucu

SEQ ID NO: 1247997 - RNA, 18 nt, Human
aaaaguucugcagauaaa

SEQ ID NO: 1247998 - RNA, 17 nt, Human
ugaucagaccauaaugu

SEQ ID NO: 1247999 - RNA, 17 nt, Human
aaaccuuauuguaccuc

SEQ ID NO: 1248000 - RNA, 22 nt, Human
caccucccccaucucuucuggg

SEQ ID NO: 1248001 - RNA, 13 nt, Human
gcagaacagugau

SEQ ID NO: 1248002 - RNA, 17 nt, Human
aaaauuggacuuaaaau

SEQ ID NO: 1248003 - RNA, 12 nt, Human
caacccaaaugu

SEQ ID NO: 1248004 - RNA, 19 nt, Human
uccagaaagugacaagcuc

SEQ ID NO: 1248005 - RNA, 20 nt, Human
aucaaguccuacaagcuaaa

SEQ ID NO: 1248006 - RNA, 18 nt, Human
ccugccugcaauauuuga

SEQ ID NO: 1248007 - RNA, 20 nt, Human
caggcugagccucagucucc

SEQ ID NO: 1248008 - RNA, 12 nt, Human
uacaucuuucac

SEQ ID NO: 1248009 - RNA, 20 nt, Human
caaacauccuacaagacaca

SEQ ID NO: 1248010 - RNA, 15 nt, Human
uauuaucaugcaaau

SEQ ID NO: 1248011 - RNA, 16 nt, Human
ucagaccuagaauaau

SEQ ID NO: 1248012 - RNA, 22 nt, Human
guguccccuauccuacuucccc

SEQ ID NO: 1248013 - RNA, 22 nt, Human
gugugaccacugcagaagacag

SEQ ID NO: 1248014 - RNA, 21 nt, Human
gcccugcugagucccaggcug

SEQ ID NO: 1248015 - RNA, 23 nt, Human
gauauuaaccaggggccaugaau

SEQ ID NO: 1248016 - RNA, 18 nt, Human
uaguaucaaaagaaagaa

SEQ ID NO: 1248017 - RNA, 18 nt, Human
aauuccaccugcaaucaa

SEQ ID NO: 1248018 - RNA, 14 nt, Human
accacaagacugca

SEQ ID NO: 1248019 - RNA, 20 nt, Human
aguuuuuuuuuaaaaaagaa

SEQ ID NO: 1248020 - RNA, 22 nt, Human
ugaaaccccgucucuacuaaaa

SEQ ID NO: 1248021 - RNA, 17 nt, Human
uaucuauuaauauaugu

SEQ ID NO: 1248022 - RNA, 13 nt, Human
gcaggcagcagga

SEQ ID NO: 1248023 - RNA, 19 nt, Human
acaaauuuacagagacaga

SEQ ID NO: 1248024 - RNA, 23 nt, Human
auaagcuguuuuuauauauguga

SEQ ID NO: 1248025 - RNA, 18 nt, Human
gaauucuuacauguuuuc

SEQ ID NO: 1248026 - RNA, 16 nt, Human
agagguccacaacaca

SEQ ID NO: 1248027 - RNA, 16 nt, Human
cucagcccuggugggc

SEQ ID NO: 1248028 - RNA, 16 nt, Human
acugauggguuucucc

SEQ ID NO: 1248029 - RNA, 14 nt, Human
cuuguauuuuacuu

SEQ ID NO: 1248030 - RNA, 14 nt, Human
ugagacucugucuc

SEQ ID NO: 1248031 - RNA, 20 nt, Human
cacuagacccacuggacuca

SEQ ID NO: 1248032 - RNA, 22 nt, Human
ucgucgucuugacuuuggcaaa

SEQ ID NO: 1248033 - RNA, 18 nt, Human
caaccuccaccuucuggg

SEQ ID NO: 1248034 - RNA, 19 nt, Human
auuauggcugguaacauag

SEQ ID NO: 1248035 - RNA, 17 nt, Human
ucccaaagugcugggaa

SEQ ID NO: 1248036 - RNA, 14 nt, Human
uaugugaaauaaaa

SEQ ID NO: 1248037 - RNA, 21 nt, Human
caauuuuguuauguauauuuu

SEQ ID NO: 1248038 - RNA, 15 nt, Human
uuuauacagugucuu

SEQ ID NO: 1248039 - RNA, 17 nt, Human
caagaaaugaaagcagg

SEQ ID NO: 1248040 - RNA, 12 nt, Human
cauucucugaag

SEQ ID NO: 1248041 - RNA, 12 nt, Human
cuggccaggcug

SEQ ID NO: 1248042 - RNA, 17 nt, Human
cuauauccugugacugu

SEQ ID NO: 1248043 - RNA, 14 nt, Human
cugggcagcugccu

SEQ ID NO: 1248044 - RNA, 23 nt, Human
acaaauacucuuaggaagagaaa

SEQ ID NO: 1248045 - RNA, 15 nt, Human
uccuacaagacacag

SEQ ID NO: 1248046 - RNA, 17 nt, Human
caaacauauauaacaau

SEQ ID NO: 1248047 - RNA, 22 nt, Human
aggauggcuaguaucaaaagaa

SEQ ID NO: 1248048 - RNA, 15 nt, Human
uggggcuuccuaacu

SEQ ID NO: 1248049 - RNA, 16 nt, Human
gauaauuauaauauac

SEQ ID NO: 1248050 - RNA, 19 nt, Human
uccaaagcugaauacauuc

SEQ ID NO: 1248051 - RNA, 15 nt, Human
aagaauuuuaaaacu

SEQ ID NO: 1248052 - RNA, 16 nt, Human
ucauuuugguaaaaua

SEQ ID NO: 1248053 - RNA, 22 nt, Human
gaauaguguuggaaaaugugca

SEQ ID NO: 1248054 - RNA, 21 nt, Human
aagacucgggauuaguacaca

SEQ ID NO: 1248055 - RNA, 15 nt, Human
auugugaucagacca

SEQ ID NO: 1248056 - RNA, 18 nt, Human
uggagggaagccuugggg

SEQ ID NO: 1248057 - RNA, 19 nt, Human
uuccucccuucucuucaca

SEQ ID NO: 1248058 - RNA, 20 nt, Human
cugaagggcaucaugcaucu

SEQ ID NO: 1248059 - RNA, 13 nt, Human
cuuccaaacagaa

SEQ ID NO: 1248060 - RNA, 21 nt, Human
ucuuuguaagaguggaaccaa

SEQ ID NO: 1248061 - RNA, 16 nt, Human
uacauuuccaaauuca

SEQ ID NO: 1248062 - RNA, 18 nt, Human
ucucuaggaaauauuuau

SEQ ID NO: 1248063 - RNA, 15 nt, Human
caggaggaaggcuua

SEQ ID NO: 1248064 - RNA, 15 nt, Human
aaaucuaaaucuauu

SEQ ID NO: 1248065 - RNA, 18 nt, Human
gagccucagucucccucc

SEQ ID NO: 1248066 - RNA, 20 nt, Human
accucauggaauuggagcuc

SEQ ID NO: 1248067 - RNA, 20 nt, Human
ccuccugccuaagugcagcc

SEQ ID NO: 1248068 - RNA, 17 nt, Human
uugugaaaaaaaauuuu

SEQ ID NO: 1248069 - RNA, 21 nt, Human
cuccagcuggccgggagccug

SEQ ID NO: 1248070 - RNA, 14 nt, Human
auauuuauuaccuc

SEQ ID NO: 1248071 - RNA, 19 nt, Human
auauauuuauaacucauca

SEQ ID NO: 1248072 - RNA, 23 nt, Human
uaucaauagaaggauguacauuu

SEQ ID NO: 1248073 - RNA, 17 nt, Human
uugccaucccucccucc

SEQ ID NO: 1248074 - RNA, 22 nt, Human
gcagccaugugauuacccucug

SEQ ID NO: 1248075 - RNA, 21 nt, Human
cuugccaucccucccuccacc

SEQ ID NO: 1248076 - RNA, 15 nt, Human
auauaugugaaauaa

SEQ ID NO: 1248077 - RNA, 15 nt, Human
cacaagcacuuuccc

SEQ ID NO: 1248078 - RNA, 13 nt, Human
ugagccaccaaac

SEQ ID NO: 1248079 - RNA, 21 nt, Human
uauggaaaaaaaggaagaaau

SEQ ID NO: 1248080 - RNA, 17 nt, Human
uuuucaccuguuuuuaa

SEQ ID NO: 1248081 - RNA, 19 nt, Human
cagcuacuugggaggcuga

SEQ ID NO: 1248082 - RNA, 22 nt, Human
uauuccuuuuucucuccucucc

SEQ ID NO: 1248083 - RNA, 19 nt, Human
uauauuuuuuguuaaauga

SEQ ID NO: 1248084 - RNA, 14 nt, Human
ucagucucccuccc

SEQ ID NO: 1248085 - RNA, 14 nt, Human
agucugacuguuuc

SEQ ID NO: 1248086 - RNA, 17 nt, Human
cuaucagcauuuuacua

SEQ ID NO: 1248087 - RNA, 21 nt, Human
cuggucucgaacugcuggauu

SEQ ID NO: 1248088 - RNA, 15 nt, Human
gaaaugaaagcaggg

SEQ ID NO: 1248089 - RNA, 11 nt, Human
guuuuaucauu

SEQ ID NO: 1248090 - RNA, 19 nt, Human
cuucauuuaaaauauuuuu

SEQ ID NO: 1248091 - RNA, 21 nt, Human
ccugucccugcagacaugaga

SEQ ID NO: 1248092 - RNA, 11 nt, Human
uucccugccug

SEQ ID NO: 1248093 - RNA, 14 nt, Human
ccacuggacucacc

SEQ ID NO: 1248094 - RNA, 18 nt, Human
cuuugaagucugauuuuc

SEQ ID NO: 1248095 - RNA, 21 nt, Human
auguuuacagauccccaagcc

SEQ ID NO: 1248096 - RNA, 15 nt, Human
uguuaaaugauuuca

SEQ ID NO: 1248097 - RNA, 21 nt, Human
uaaaaaggcauguaauugcuu

SEQ ID NO: 1248098 - RNA, 19 nt, Human
ggacucaccucccccaucu

SEQ ID NO: 1248099 - RNA, 15 nt, Human
auaaauauauuuaag

SEQ ID NO: 1248100 - RNA, 14 nt, Human
agacaucaacagau

SEQ ID NO: 1248101 - RNA, 19 nt, Human
cucuccugggcagcugccu

SEQ ID NO: 1248102 - RNA, 13 nt, Human
ccuacaccauucc

SEQ ID NO: 1248103 - RNA, 20 nt, Human
aauuuaugaguuuuugauag

SEQ ID NO: 1248104 - RNA, 20 nt, Human
uucauuuaaaauauuuuuau

SEQ ID NO: 1248105 - RNA, 18 nt, Human
ggccuggcugggaguggc

SEQ ID NO: 1248106 - RNA, 15 nt, Human
uuaauauuuaacauu

SEQ ID NO: 1248107 - RNA, 17 nt, Human
auugagcaccugcaggc

SEQ ID NO: 1248108 - RNA, 16 nt, Human
aacagaagcuuccauu

SEQ ID NO: 1248109 - RNA, 22 nt, Human
aaauccuuuacuguuagucauu

SEQ ID NO: 1248110 - RNA, 21 nt, Human
uucacaaccacucauucaaaa

SEQ ID NO: 1248111 - RNA, 14 nt, Human
uguaaguuuaugca

SEQ ID NO: 1248112 - RNA, 15 nt, Human
uauccuaauaaaaag

SEQ ID NO: 1248113 - RNA, 16 nt, Human
aaauaaugaaauaacu

SEQ ID NO: 1248114 - RNA, 21 nt, Human
ccauccugccccugagcccau

SEQ ID NO: 1248115 - RNA, 18 nt, Human
gguuaagcacuuuaacac

SEQ ID NO: 1248116 - RNA, 19 nt, Human
caccaacuuugaagucuga

SEQ ID NO: 1248117 - RNA, 18 nt, Human
caguucauauguaccaug

SEQ ID NO: 1248118 - RNA, 16 nt, Human
gccuaagugcagcccc

SEQ ID NO: 1248119 - RNA, 12 nt, Human
cagauuuuccug

SEQ ID NO: 1248120 - RNA, 22 nt, Human
agaaagugacaagcucacagac

SEQ ID NO: 1248121 - RNA, 16 nt, Human
ugagaugcuagaacuc

SEQ ID NO: 1248122 - RNA, 22 nt, Human
aauaguguuggaaaaugugcaa

SEQ ID NO: 1248123 - RNA, 19 nt, Human
gucaaauugugugaaaggu

SEQ ID NO: 1248124 - RNA, 19 nt, Human
aggucacacaaccuguccc

SEQ ID NO: 1248125 - RNA, 21 nt, Human
uugccaugcuggccaggcugg

SEQ ID NO: 1248126 - RNA, 19 nt, Human
caccauuccuucugcccug

SEQ ID NO: 1248127 - RNA, 17 nt, Human
auucacaaccacucauu

SEQ ID NO: 1248128 - RNA, 16 nt, Human
caucuagcaaauguua

SEQ ID NO: 1248129 - RNA, 16 nt, Human
ugacuuaaugccacua

SEQ ID NO: 1248130 - RNA, 11 nt, Human
cgaaauguuau

SEQ ID NO: 1248131 - RNA, 22 nt, Human
agccaaacauccuacaagacac

SEQ ID NO: 1248132 - RNA, 22 nt, Human
augagaccacuguuaucaaaac

SEQ ID NO: 1248133 - RNA, 14 nt, Human
ggccaacuaggcag

SEQ ID NO: 1248134 - RNA, 15 nt, Human
caggcagcuuuuucu

SEQ ID NO: 1248135 - RNA, 12 nt, Human
auguauuauuua

SEQ ID NO: 1248136 - RNA, 15 nt, Human
cuuugaugauuaauu

SEQ ID NO: 1248137 - RNA, 13 nt, Human
uuuaaaaaaaaac

SEQ ID NO: 1248138 - RNA, 18 nt, Human
auagucaaauugugugaa

SEQ ID NO: 1248139 - RNA, 20 nt, Human
agacgggguuugccaugcug

SEQ ID NO: 1248140 - RNA, 18 nt, Human
cugcaggcgugaccugac

SEQ ID NO: 1248141 - RNA, 16 nt, Human
aguauucccuuuugcu

SEQ ID NO: 1248142 - RNA, 20 nt, Human
auaacaaugcuguauuuuaa

SEQ ID NO: 1248143 - RNA, 19 nt, Human
acaaucugaggccuccucu

SEQ ID NO: 1248144 - RNA, 22 nt, Human
uucuagcuguugagcuguuuuc

SEQ ID NO: 1248145 - RNA, 13 nt, Human
uuaggcuauucac

SEQ ID NO: 1248146 - RNA, 21 nt, Human
cuguuccuucacauccugugu

SEQ ID NO: 1248147 - RNA, 15 nt, Human
cagaucauuucaaaa

SEQ ID NO: 1248148 - RNA, 15 nt, Human
gcagagacgggguuu

SEQ ID NO: 1248149 - RNA, 14 nt, Human
auauuuauuuuaau

SEQ ID NO: 1248150 - RNA, 16 nt, Human
caaggguggguggggu

SEQ ID NO: 1248151 - RNA, 20 nt, Human
auuaauauauguauuauuua

SEQ ID NO: 1248152 - RNA, 23 nt, Human
cggagauaucccaggaaaauuaa

SEQ ID NO: 1248153 - RNA, 23 nt, Human
cccagcccuccuuaucaaaggac

SEQ ID NO: 1248154 - RNA, 21 nt, Human
guaaucauauaauaaauguac

SEQ ID NO: 1248155 - RNA, 17 nt, Human
cuuuagggaccugcugu

SEQ ID NO: 1248156 - RNA, 20 nt, Human
ccugccuaagugcagccccg

SEQ ID NO: 1248157 - RNA, 15 nt, Human
auauuuauuaccucu

SEQ ID NO: 1248158 - RNA, 12 nt, Human
auauuauaauuu

SEQ ID NO: 1248159 - RNA, 17 nt, Human
ucagacauagaauuaac

SEQ ID NO: 1248160 - RNA, 19 nt, Human
ccucaacccccauuucuau

SEQ ID NO: 1248161 - RNA, 18 nt, Human
uucaauaucuuuuuuuua

SEQ ID NO: 1248162 - RNA, 23 nt, Human
ucaauaucuuuuuuuuaauaaac

SEQ ID NO: 1248163 - RNA, 23 nt, Human
cuggccgggagccugaucaccug

SEQ ID NO: 1248164 - RNA, 14 nt, Human
ggacaguuuucugc

SEQ ID NO: 1248165 - RNA, 15 nt, Human
gaagauguagaggag

SEQ ID NO: 1248166 - RNA, 22 nt, Human
uaugcauacaguaauuuuaagu

SEQ ID NO: 1248167 - RNA, 18 nt, Human
gaugccccgucccccucu

SEQ ID NO: 1248168 - RNA, 21 nt, Human
ugaauuuuucucuaacucaga

SEQ ID NO: 1248169 - RNA, 14 nt, Human
auaaucuuuuauac

SEQ ID NO: 1248170 - RNA, 21 nt, Human
ccugaucaccugcccugcuga

SEQ ID NO: 1248171 - RNA, 21 nt, Human
uccaccucccugcaauaaaau

SEQ ID NO: 1248172 - RNA, 13 nt, Human
auugucuagugaa

SEQ ID NO: 1248173 - RNA, 23 nt, Human
cauagagacuuugugaaaaaaaa

SEQ ID NO: 1248174 - RNA, 16 nt, Human
aucaaaagaaagaaaa

SEQ ID NO: 1248175 - RNA, 21 nt, Human
auucagagcuuacuuaaaauu

SEQ ID NO: 1248176 - RNA, 15 nt, Human
guugccaaggcugga

SEQ ID NO: 1248177 - RNA, 19 nt, Human
uggugagugccuguaauca

SEQ ID NO: 1248178 - RNA, 15 nt, Human
uuuaugcauacagua

SEQ ID NO: 1248179 - RNA, 13 nt, Human
ugcaguggcgcaa

SEQ ID NO: 1248180 - RNA, 17 nt, Human
acaagaaaugaaagcag

SEQ ID NO: 1248181 - RNA, 23 nt, Human
aguucugucuggacuuuccagag

SEQ ID NO: 1248182 - RNA, 15 nt, Human
uuuaccugugaaaua

SEQ ID NO: 1248183 - RNA, 14 nt, Human
cagucugaugagaa

SEQ ID NO: 1248184 - RNA, 15 nt, Human
uguauuuauaaauau

SEQ ID NO: 1248185 - RNA, 21 nt, Human
acuggcucccuggaagagauc

SEQ ID NO: 1248186 - RNA, 18 nt, Human
gaugcaguucugaagaag

SEQ ID NO: 1248187 - RNA, 21 nt, Human
caacuuuuguguaaugaaaau

SEQ ID NO: 1248188 - RNA, 17 nt, Human
acucaccucccccaucu

SEQ ID NO: 1248189 - RNA, 17 nt, Human
gugccuguaaucacagc

SEQ ID NO: 1248190 - RNA, 13 nt, Human
cuaagaaauaugc

SEQ ID NO: 1248191 - RNA, 20 nt, Human
acuaaauaaagcuugcaaca

SEQ ID NO: 1248192 - RNA, 22 nt, Human
caccaaacccggccugauuaaa

SEQ ID NO: 1248193 - RNA, 15 nt, Human
ucugucucaguccau

SEQ ID NO: 1248194 - RNA, 24 nt, Human
ccccugagcuugcagagaugaggc

SEQ ID NO: 1248195 - RNA, 12 nt, Human
gaauaucuauua

SEQ ID NO: 1248196 - RNA, 21 nt, Human
uuccuggacaguuuucugcuu

SEQ ID NO: 1248197 - RNA, 15 nt, Human
gaucauguauuuauu

SEQ ID NO: 1248198 - RNA, 14 nt, Human
uauuuuuuaugaaa

SEQ ID NO: 1248199 - RNA, 18 nt, Human
agaaauaugcacaauagc

SEQ ID NO: 1248200 - RNA, 15 nt, Human
acauuuccaaauuca

SEQ ID NO: 1248201 - RNA, 19 nt, Human
auuucuucaacucccugcc

SEQ ID NO: 1248202 - RNA, 15 nt, Human
ccuuccagugucucg

SEQ ID NO: 1248203 - RNA, 23 nt, Human
uuuguauaaaauaauuuuuauau

SEQ ID NO: 1248204 - RNA, 19 nt, Human
ggaucuggggcucugggau

SEQ ID NO: 1248205 - RNA, 18 nt, Human
caugcccaagaaugagaa

SEQ ID NO: 1248206 - RNA, 18 nt, Human
ccuugggaccccugagcu

SEQ ID NO: 1248207 - RNA, 14 nt, Human
accugcuguuuccu

SEQ ID NO: 1248208 - RNA, 16 nt, Human
auaucuauuaauauau

SEQ ID NO: 1248209 - RNA, 22 nt, Human
uagcagacaguguuuucuggga

SEQ ID NO: 1248210 - RNA, 19 nt, Human
auuugcaagacauagaaua

SEQ ID NO: 1248211 - RNA, 16 nt, Human
aaaguauaaauaaaau

SEQ ID NO: 1248212 - RNA, 19 nt, Human
cagagcugcccucuccugg

SEQ ID NO: 1248213 - RNA, 18 nt, Human
ugguucuaauagaacuca

SEQ ID NO: 1248214 - RNA, 18 nt, Human
gaacgauuuagaaagaag

SEQ ID NO: 1248215 - RNA, 17 nt, Human
uucaguugauuuuacaa

SEQ ID NO: 1248216 - RNA, 20 nt, Human
caaagcacgaaauguuauuu

SEQ ID NO: 1248217 - RNA, 16 nt, Human
uguaugacgugacugg

SEQ ID NO: 1248218 - RNA, 13 nt, Human
uggcaguuuucca

SEQ ID NO: 1248219 - RNA, 15 nt, Human
cugcagauaaacagu

SEQ ID NO: 1248220 - RNA, 19 nt, Human
uaguaccaaucauuuuaau

SEQ ID NO: 1248221 - RNA, 18 nt, Human
uaaaaugagcaaaaguug

SEQ ID NO: 1248222 - RNA, 15 nt, Human
aucuaauauauauga

SEQ ID NO: 1248223 - RNA, 21 nt, Human
ggcaaaucucuauuaggaaau

SEQ ID NO: 1248224 - RNA, 19 nt, Human
auaauacaccagagauaau

SEQ ID NO: 1248225 - RNA, 22 nt, Human
uuaugugcaauaaaauguauuu

SEQ ID NO: 1248226 - RNA, 18 nt, Human
ucaaauuccagaaugauu

SEQ ID NO: 1248227 - RNA, 19 nt, Human
aagcuuguauuccuuuuuc

SEQ ID NO: 1248228 - RNA, 16 nt, Human
gaugaauguuaaauua

SEQ ID NO: 1248229 - RNA, 14 nt, Human
cugagucccaggcu

SEQ ID NO: 1248230 - RNA, 14 nt, Human
ggcacuugggacaa

SEQ ID NO: 1248231 - RNA, 15 nt, Human
aacaucuagcaaaug

SEQ ID NO: 1248232 - RNA, 19 nt, Human
uacuucauuuaaaauauuu

SEQ ID NO: 1248233 - RNA, 16 nt, Human
ugcuggauucaaguga

SEQ ID NO: 1248234 - RNA, 18 nt, Human
guauuuguuuguauuuug

SEQ ID NO: 1248235 - RNA, 14 nt, Human
uugaauaaauaaau

SEQ ID NO: 1248236 - RNA, 22 nt, Human
caccagucugacuguuuccauc

SEQ ID NO: 1248237 - RNA, 21 nt, Human
gaccuggucgucgucuugacu

SEQ ID NO: 1248238 - RNA, 14 nt, Human
ccacccuugccaug

SEQ ID NO: 1248239 - RNA, 16 nt, Human
uuaauauauguauuau

SEQ ID NO: 1248240 - RNA, 22 nt, Human
caguauggcagcuuuccucaaa

SEQ ID NO: 1248241 - RNA, 18 nt, Human
guaaauagaaacguguau

SEQ ID NO: 1248242 - RNA, 22 nt, Human
gggcagugcuuggcccaggagu

SEQ ID NO: 1248243 - RNA, 21 nt, Human
uccguggcacugcauacaauc

SEQ ID NO: 1248244 - RNA, 20 nt, Human
augaaguuguagguaauauu

SEQ ID NO: 1248245 - RNA, 18 nt, Human
accaccugccuauauuuu

SEQ ID NO: 1248246 - RNA, 13 nt, Human
augcuagaacucc

SEQ ID NO: 1248247 - RNA, 18 nt, Human
agucagucugaugagaac

SEQ ID NO: 1248248 - RNA, 20 nt, Human
gcuguaucuuguuuuuccac

SEQ ID NO: 1248249 - RNA, 22 nt, Human
uacauaagggaggaaaaaaaau

SEQ ID NO: 1248250 - RNA, 20 nt, Human
ccaaauguucaucaaugaau

SEQ ID NO: 1248251 - RNA, 21 nt, Human
ucaccugggcugaggcauccu

SEQ ID NO: 1248252 - RNA, 22 nt, Human
uccugaccuaugaaacagagaa

SEQ ID NO: 1248253 - RNA, 20 nt, Human
ccaccuucuggguucaagcg

SEQ ID NO: 1248254 - RNA, 13 nt, Human
acaugagagacag

SEQ ID NO: 1248255 - RNA, 22 nt, Human
acuggcaguuuuccauugguuu

SEQ ID NO: 1248256 - RNA, 16 nt, Human
uguggcauuuucacuu

SEQ ID NO: 1248257 - RNA, 16 nt, Human
aucagucauaacuaaa

SEQ ID NO: 1248258 - RNA, 18 nt, Human
cuuccucugagccuuggg

SEQ ID NO: 1248259 - RNA, 15 nt, Human
guaaggggaauugag

SEQ ID NO: 1248260 - RNA, 15 nt, Human
ugcaaccuccaccuu

SEQ ID NO: 1248261 - RNA, 20 nt, Human
uaccagcccuacaccauucc

SEQ ID NO: 1248262 - RNA, 15 nt, Human
ucaauuccucuggga

SEQ ID NO: 1248263 - RNA, 13 nt, Human
uuaugcuaaguga

SEQ ID NO: 1248264 - RNA, 19 nt, Human
agaaauucugcaagcuuuu

SEQ ID NO: 1248265 - RNA, 21 nt, Human
agagauuuuuaaauaaagaau

SEQ ID NO: 1248266 - RNA, 19 nt, Human
gcuggagugcaguggcgca

SEQ ID NO: 1248267 - RNA, 11 nt, Human
guaaugaaaau

SEQ ID NO: 1248268 - RNA, 21 nt, Human
auuauauuuauuacuguaaga

SEQ ID NO: 1248269 - RNA, 15 nt, Human
cugccuccccuccuc

SEQ ID NO: 1248270 - RNA, 12 nt, Human
ccuucagccuga

SEQ ID NO: 1248271 - RNA, 18 nt, Human
uaaaauccauacauuugu

SEQ ID NO: 1248272 - RNA, 19 nt, Human
auuguugacaacugugacu

SEQ ID NO: 1248273 - RNA, 14 nt, Human
ccagcuggccggga

SEQ ID NO: 1248274 - RNA, 15 nt, Human
auuuaacauuauuua

SEQ ID NO: 1248275 - RNA, 16 nt, Human
agagggaauugcagag

SEQ ID NO: 1248276 - RNA, 16 nt, Human
uaauuucaugaaaaga

SEQ ID NO: 1248277 - RNA, 22 nt, Human
ucuggguuccuuccucugagcc

SEQ ID NO: 1248278 - RNA, 21 nt, Human
cuagauacugaauguaaacaa

SEQ ID NO: 1248279 - RNA, 21 nt, Human
uuguuuuaaaauuaaagcuaa

SEQ ID NO: 1248280 - RNA, 23 nt, Human
aaugcuuaugaaacuaagauuug

SEQ ID NO: 1248281 - RNA, 22 nt, Human
uucuuaaaugggcuacuuuguc

SEQ ID NO: 1248282 - RNA, 13 nt, Human
agccucagucucc

SEQ ID NO: 1248283 - RNA, 14 nt, Human
ugaagauguagagg

SEQ ID NO: 1248284 - RNA, 12 nt, Human
cuauuauagaau

SEQ ID NO: 1248285 - RNA, 20 nt, Human
uggacuuuccagagaccagu

SEQ ID NO: 1248286 - RNA, 23 nt, Human
caguuagagauuuuuaaauaaag

SEQ ID NO: 1248287 - RNA, 19 nt, Human
cuggccuucggccuccauc

SEQ ID NO: 1248288 - RNA, 15 nt, Human
aggcuccaaacugga

SEQ ID NO: 1248289 - RNA, 23 nt, Human
uagucauuugcugagcauguacu

SEQ ID NO: 1248290 - RNA, 12 nt, Human
accaaucauuuu

SEQ ID NO: 1248291 - RNA, 21 nt, Human
cuuuuaaguugcugaugaacu

SEQ ID NO: 1248292 - RNA, 23 nt, Human
uguaaucccagcacuuugggagg

SEQ ID NO: 1248293 - RNA, 15 nt, Human
cuaucuuugagcgcc

SEQ ID NO: 1248294 - RNA, 13 nt, Human
aaauaaaaauaaa

SEQ ID NO: 1248295 - RNA, 18 nt, Human
ucacauuggcuauuuaaa

SEQ ID NO: 1248296 - RNA, 22 nt, Human
guauuuuuaccuuuuuccuucc

SEQ ID NO: 1248297 - RNA, 17 nt, Human
cucagucucccucccuu

SEQ ID NO: 1248298 - RNA, 19 nt, Human
acaguuuuccuucucaucu

SEQ ID NO: 1248299 - RNA, 16 nt, Human
uuuguaauauuucucu

SEQ ID NO: 1248300 - RNA, 16 nt, Human
uaggauguugaaaaag

SEQ ID NO: 1248301 - RNA, 19 nt, Human
aaguccuacaagcuaaaau

SEQ ID NO: 1248302 - RNA, 18 nt, Human
ucuuugguggagauaaag

SEQ ID NO: 1248303 - RNA, 18 nt, Human
uguuucuugagaagagaa

SEQ ID NO: 1248304 - RNA, 17 nt, Human
cccuccaccucccugca

SEQ ID NO: 1248305 - RNA, 18 nt, Human
cuguaucuuguuuuucca

SEQ ID NO: 1248306 - RNA, 18 nt, Human
cacuuucccucuuggugc

SEQ ID NO: 1248307 - RNA, 11 nt, Human
gagaagagaau

SEQ ID NO: 1248308 - RNA, 17 nt, Human
ucauccugcaggcagcu

SEQ ID NO: 1248309 - RNA, 19 nt, Human
caguuagagauuuuuaaau

SEQ ID NO: 1248310 - RNA, 15 nt, Human
uaucaguccucuuuc

SEQ ID NO: 1248311 - RNA, 22 nt, Human
ucaggagauuucaugccuggug

SEQ ID NO: 1248312 - RNA, 21 nt, Human
ugccuaucagcauuuuacuac

SEQ ID NO: 1248313 - RNA, 14 nt, Human
uaacauuauuuaua

SEQ ID NO: 1248314 - RNA, 15 nt, Human
ccaucccucccucca

SEQ ID NO: 1248315 - RNA, 14 nt, Human
ccuugaugaagaag

SEQ ID NO: 1248316 - RNA, 22 nt, Human
agcauauguuuuuguaaguuua

SEQ ID NO: 1248317 - RNA, 13 nt, Human
gcugcccucuccu

SEQ ID NO: 1248318 - RNA, 13 nt, Human
agugucuggcacu

SEQ ID NO: 1248319 - RNA, 21 nt, Human
caaauuaaggcauaagaaaac

SEQ ID NO: 1248320 - RNA, 17 nt, Human
acauguucacuuauuga

SEQ ID NO: 1248321 - RNA, 11 nt, Human
uuuucaucuuc

SEQ ID NO: 1248322 - RNA, 20 nt, Human
gcuugcagagaugaggccgc

SEQ ID NO: 1248323 - RNA, 15 nt, Human
aggcgugagccacca

SEQ ID NO: 1248324 - RNA, 19 nt, Human
augaaguacucauacaugu

SEQ ID NO: 1248325 - RNA, 17 nt, Human
auggaacucaaggaaau

SEQ ID NO: 1248326 - RNA, 14 nt, Human
acuuggucugugag

SEQ ID NO: 1248327 - RNA, 19 nt, Human
gcacuuuaacacagugucu

SEQ ID NO: 1248328 - RNA, 16 nt, Human
cuucaacucccugccc

SEQ ID NO: 1248329 - RNA, 15 nt, Human
uaauauauguauuau

SEQ ID NO: 1248330 - RNA, 22 nt, Human
acuucauuuaaaauauuuuuau

SEQ ID NO: 1248331 - RNA, 21 nt, Human
aguauacuguauuuuuaccuu

SEQ ID NO: 1248332 - RNA, 20 nt, Human
gcccaucuccgucucccaaa

SEQ ID NO: 1248333 - RNA, 12 nt, Human
uagggaccugcu

SEQ ID NO: 1248334 - RNA, 11 nt, Human
aauuccacagc

SEQ ID NO: 1248335 - RNA, 16 nt, Human
cuuuggaugcacuuua

SEQ ID NO: 1248336 - RNA, 19 nt, Human
aauucuaaaugaauguuua

SEQ ID NO: 1248337 - RNA, 16 nt, Human
auccuccacaauagca

SEQ ID NO: 1248338 - RNA, 18 nt, Human
gauaauaugagaaucaga

SEQ ID NO: 1248339 - RNA, 19 nt, Human
aauuuuguuauguauauuu

SEQ ID NO: 1248340 - RNA, 13 nt, Human
uuaugaaacauua

SEQ ID NO: 1248341 - RNA, 13 nt, Human
cuaugaaauauua

SEQ ID NO: 1248342 - RNA, 23 nt, Human
aagugauccgcccaucuccgucu

SEQ ID NO: 1248343 - RNA, 16 nt, Human
uuuacaauugaaauga

SEQ ID NO: 1248344 - RNA, 13 nt, Human
uuaaaaaagaaac

SEQ ID NO: 1248345 - RNA, 20 nt, Human
gccauggagguuaagcacuu

SEQ ID NO: 1248346 - RNA, 19 nt, Human
uaguuuaugauuccaccua

SEQ ID NO: 1248347 - RNA, 11 nt, Human
cucaucauaaa

SEQ ID NO: 1248348 - RNA, 16 nt, Human
uguauuuauuuuuuua

SEQ ID NO: 1248349 - RNA, 18 nt, Human
gacauuugcucauggaau

SEQ ID NO: 1248350 - RNA, 17 nt, Human
aauauuugaauuuuaaa

SEQ ID NO: 1248351 - RNA, 20 nt, Human
cuuugacaaccaugagacca

SEQ ID NO: 1248352 - RNA, 18 nt, Human
gcccuggugggcagagag

SEQ ID NO: 1248353 - RNA, 20 nt, Human
agaggagaaacuggaacucu

SEQ ID NO: 1248354 - RNA, 17 nt, Human
ucugggauagcugaccc

SEQ ID NO: 1248355 - RNA, 19 nt, Human
cauuucaaaagguauuuau

SEQ ID NO: 1248356 - RNA, 16 nt, Human
uaaugaaaaugaauau

SEQ ID NO: 1248357 - RNA, 19 nt, Human
aucauuuuaauuauuauuc

SEQ ID NO: 1248358 - RNA, 21 nt, Human
caucauaaaauaaaguauaua

SEQ ID NO: 1248359 - RNA, 23 nt, Human
gccaaaaaccaaauuuguauuua

SEQ ID NO: 1248360 - RNA, 22 nt, Human
uuggucuugauaagcuauguug

SEQ ID NO: 1248361 - RNA, 14 nt, Human
uauuauuuauauau

SEQ ID NO: 1248362 - RNA, 16 nt, Human
cugccuccccuccucu

SEQ ID NO: 1248363 - RNA, 17 nt, Human
ugaaaugacuaaaaaac

SEQ ID NO: 1248364 - RNA, 23 nt, Human
guauuugaguguuuuaagauaaa

SEQ ID NO: 1248365 - RNA, 14 nt, Human
auauuuauuauuuu

SEQ ID NO: 1248366 - RNA, 12 nt, Human
cuggcugggagu

SEQ ID NO: 1248367 - RNA, 16 nt, Human
auuuaacauuauuuau

SEQ ID NO: 1248368 - RNA, 18 nt, Human
cagggaggacgcucucug

SEQ ID NO: 1248369 - RNA, 19 nt, Human
cuuugguggagauaaagau

SEQ ID NO: 1248370 - RNA, 19 nt, Human
uauaauauacuauauuuau

SEQ ID NO: 1248371 - RNA, 12 nt, Human
gagaaauuugcc

SEQ ID NO: 1248372 - RNA, 17 nt, Human
uggugaaaugcagaguc

SEQ ID NO: 1248373 - RNA, 17 nt, Human
ucuauuagccacaaaau

SEQ ID NO: 1248374 - RNA, 18 nt, Human
uuuauauaugugaaauaa

SEQ ID NO: 1248375 - RNA, 22 nt, Human
gcuugcagagaugaggccgcca

SEQ ID NO: 1248376 - RNA, 17 nt, Human
uccacaacacacagauu

SEQ ID NO: 1248377 - RNA, 22 nt, Human
gaagaguggguuucacaaguga

SEQ ID NO: 1248378 - RNA, 21 nt, Human
caagacucugucucaaaaaau

SEQ ID NO: 1248379 - RNA, 16 nt, Human
ugcaauacuucaauac

SEQ ID NO: 1248380 - RNA, 12 nt, Human
caaauuccagaa

SEQ ID NO: 1248381 - RNA, 23 nt, Human
acuuauuuauuguuguuggaggc

SEQ ID NO: 1248382 - RNA, 22 nt, Human
agugagcagucaggaaagagaa

SEQ ID NO: 1248383 - RNA, 14 nt, Human
aagacuaugaggaa

SEQ ID NO: 1248384 - RNA, 14 nt, Human
cccugccccccagc

SEQ ID NO: 1248385 - RNA, 23 nt, Human
acaguguuuucugggauaaguaa

SEQ ID NO: 1248386 - RNA, 14 nt, Human
ucuaucuauuuauu

SEQ ID NO: 1248387 - RNA, 13 nt, Human
gagaauauuagcu

SEQ ID NO: 1248388 - RNA, 13 nt, Human
agcgacagugaga

SEQ ID NO: 1248389 - RNA, 13 nt, Human
cauacaguaauuu

SEQ ID NO: 1248390 - RNA, 14 nt, Human
cuggaauguaauca

SEQ ID NO: 1248391 - RNA, 18 nt, Human
caugagaccacuguuauc

SEQ ID NO: 1248392 - RNA, 14 nt, Human
guuaagcaacaucu

SEQ ID NO: 1248393 - RNA, 16 nt, Human
guuccuuccucugagc

SEQ ID NO: 1248394 - RNA, 16 nt, Human
ccucaaaacuucagac

SEQ ID NO: 1248395 - RNA, 13 nt, Human
guuacucugaagg

SEQ ID NO: 1248396 - RNA, 18 nt, Human
ugguuccauucucucucc

SEQ ID NO: 1248397 - RNA, 19 nt, Human
cuccugggcagcugccucc

SEQ ID NO: 1248398 - RNA, 18 nt, Human
aaaucuaaaucuauuuau

SEQ ID NO: 1248399 - RNA, 13 nt, Human
cccaaaaggcaga

SEQ ID NO: 1248400 - RNA, 19 nt, Human
aaucuuaacucauugcaac

SEQ ID NO: 1248401 - RNA, 12 nt, Human
uguaacuuauga

SEQ ID NO: 1248402 - RNA, 17 nt, Human
ccagcaguucagagcug

SEQ ID NO: 1248403 - RNA, 14 nt, Human
cuagcgcagccaug

SEQ ID NO: 1248404 - RNA, 16 nt, Human
uaaaauccauacauuu

SEQ ID NO: 1248405 - RNA, 13 nt, Human
cuggccugcugga

SEQ ID NO: 1248406 - RNA, 20 nt, Human
agccuuggggcugaugcagu

SEQ ID NO: 1248407 - RNA, 13 nt, Human
cuuacagagaaaa

SEQ ID NO: 1248408 - RNA, 23 nt, Human
aaagcccagcuugaaaccuucac

SEQ ID NO: 1248409 - RNA, 15 nt, Human
cugccucuaaaaggc

SEQ ID NO: 1248410 - RNA, 23 nt, Human
ucauauaauaaauguacauuaau

SEQ ID NO: 1248411 - RNA, 13 nt, Human
gccaugcuggcca

SEQ ID NO: 1248412 - RNA, 13 nt, Human
agagguccacaac

SEQ ID NO: 1248413 - RNA, 22 nt, Human
uugacccacaagaaaugaaagc

SEQ ID NO: 1248414 - RNA, 15 nt, Human
ucauuuguuaaaauu

SEQ ID NO: 1248415 - RNA, 14 nt, Human
cugucucaguccau

SEQ ID NO: 1248416 - RNA, 13 nt, Human
uuauucacaagac

SEQ ID NO: 1248417 - RNA, 15 nt, Human
uuacagagacagaaa

SEQ ID NO: 1248418 - RNA, 13 nt, Human
ggggcucugggau

SEQ ID NO: 1248419 - RNA, 13 nt, Human
auuucaacuguuu

SEQ ID NO: 1248420 - RNA, 14 nt, Human
uuauuuuuuaagua

SEQ ID NO: 1248421 - RNA, 21 nt, Human
auugaaaggcauucucugaag

SEQ ID NO: 1248422 - RNA, 15 nt, Human
cuacaagacacagug

SEQ ID NO: 1248423 - RNA, 20 nt, Human
aauucuaaaugaauguuuac

SEQ ID NO: 1248424 - RNA, 23 nt, Human
ggcaaagacuauucccuucuaac

SEQ ID NO: 1248425 - RNA, 16 nt, Human
cuccauccugaggcuc

SEQ ID NO: 1248426 - RNA, 13 nt, Human
caaauuuguauuu

SEQ ID NO: 1248427 - RNA, 14 nt, Human
auuaauucaccuuc

SEQ ID NO: 1248428 - RNA, 17 nt, Human
cacuggcucccuggaag

SEQ ID NO: 1248429 - RNA, 12 nt, Human
ugcccucuccug

SEQ ID NO: 1248430 - RNA, 19 nt, Human
uuagacccucaugcugcca

SEQ ID NO: 1248431 - RNA, 13 nt, Human
ugggaggcugaga

SEQ ID NO: 1248432 - RNA, 16 nt, Human
auacaauuauuuuuac

SEQ ID NO: 1248433 - RNA, 22 nt, Human
agugacuuaguguacaugaaag

SEQ ID NO: 1248434 - RNA, 22 nt, Human
gccuccccuccucugcuugcca

SEQ ID NO: 1248435 - RNA, 18 nt, Human
aagaagacaacauuaaaa

SEQ ID NO: 1248436 - RNA, 16 nt, Human
agauaaagauuucuug

SEQ ID NO: 1248437 - RNA, 18 nt, Human
gccagcaguucagagcug

SEQ ID NO: 1248438 - RNA, 15 nt, Human
ugagcucagcccugg

SEQ ID NO: 1248439 - RNA, 23 nt, Human
ugcaauauuugaauuuuaaaucu

SEQ ID NO: 1248440 - RNA, 22 nt, Human
agacucugucucaaaaaauaaa

SEQ ID NO: 1248441 - RNA, 16 nt, Human
gcacuuuaaacauuua

SEQ ID NO: 1248442 - RNA, 21 nt, Human
ccuggugccucaccccuugcc

SEQ ID NO: 1248443 - RNA, 21 nt, Human
ucucuggcgacaguuuuccuu

SEQ ID NO: 1248444 - RNA, 21 nt, Human
uaauuuugaauaaauaaaugu

SEQ ID NO: 1248445 - RNA, 14 nt, Human
cucccucccuuggg

SEQ ID NO: 1248446 - RNA, 22 nt, Human
ucauugcaaccuccaccuucug

SEQ ID NO: 1248447 - RNA, 18 nt, Human
cucucuuauagaauauuu

SEQ ID NO: 1248448 - RNA, 12 nt, Human
aaggaugccccg

SEQ ID NO: 1248449 - RNA, 22 nt, Human
aaagcacgaaauguuauuuuuu

SEQ ID NO: 1248450 - RNA, 13 nt, Human
uauuuauuuuaau

SEQ ID NO: 1248451 - RNA, 18 nt, Human
agcuuacuuaaaauugua

SEQ ID NO: 1248452 - RNA, 17 nt, Human
cugggucucaguguccu

SEQ ID NO: 1248453 - RNA, 14 nt, Human
cuuuccagagacca

SEQ ID NO: 1248454 - RNA, 16 nt, Human
uaagaaauaugcacaa

SEQ ID NO: 1248455 - RNA, 23 nt, Human
augguauuugaguguuuuaagau

SEQ ID NO: 1248456 - RNA, 12 nt, Human
uuaucauuuuca

SEQ ID NO: 1248457 - RNA, 17 nt, Human
ccucagucucccucccu

SEQ ID NO: 1248458 - RNA, 16 nt, Human
ccuauauccugugacu

SEQ ID NO: 1248459 - RNA, 15 nt, Human
auuaucaauaucuaa

SEQ ID NO: 1248460 - RNA, 14 nt, Human
ucuuuuuuuuaaua

SEQ ID NO: 1248461 - RNA, 9 nt, Human
uccucugcu

SEQ ID NO: 1248462 - RNA, 16 nt, Human
auaaaaugagcaaaag

SEQ ID NO: 1248463 - RNA, 21 nt, Human
augucauuugcuggagcucug

SEQ ID NO: 1248464 - RNA, 15 nt, Human
uucugcacacagcac

SEQ ID NO: 1248465 - RNA, 22 nt, Human
cagcaggauagagugggacagu

SEQ ID NO: 1248466 - RNA, 15 nt, Human
gcaacccaaauguuc

SEQ ID NO: 1248467 - RNA, 22 nt, Human
cuaaauaaagcuugcaacaaaa

SEQ ID NO: 1248468 - RNA, 23 nt, Human
acguaaucguguccccuauccua

SEQ ID NO: 1248469 - RNA, 18 nt, Human
gccuaucagcauuuuacu

SEQ ID NO: 1248470 - RNA, 23 nt, Human
gauuacaaggcuuuaucucaggg

SEQ ID NO: 1248471 - RNA, 21 nt, Human
augugaaauaaaaguagaaua

SEQ ID NO: 1248472 - RNA, 13 nt, Human
acccuugccaugg

SEQ ID NO: 1248473 - RNA, 15 nt, Human
uccauccugaggcuc

SEQ ID NO: 1248474 - RNA, 19 nt, Human
ccccucuggcuccagcugg

SEQ ID NO: 1248475 - RNA, 16 nt, Human
auauguaccauguaca

SEQ ID NO: 1248476 - RNA, 21 nt, Human
cugcuggauucaagugauccg

SEQ ID NO: 1248477 - RNA, 13 nt, Human
gcaaccuccaccu

SEQ ID NO: 1248478 - RNA, 17 nt, Human
augccccgucccccucu

SEQ ID NO: 1248479 - RNA, 21 nt, Human
uuauaauauacuauauuuaug

SEQ ID NO: 1248480 - RNA, 15 nt, Human
augauaacuggaaac

SEQ ID NO: 1248481 - RNA, 22 nt, Human
gaauuaaguuuuuuuuuaaaaa

SEQ ID NO: 1248482 - RNA, 18 nt, Human
uaauaauguuucaaacau

SEQ ID NO: 1248483 - RNA, 17 nt, Human
guugcugggggggauug

SEQ ID NO: 1248484 - RNA, 22 nt, Human
aguguugacaguucauauguac

SEQ ID NO: 1248485 - RNA, 13 nt, Human
ugcaacaaaauuc

SEQ ID NO: 1248486 - RNA, 19 nt, Human
cuguauuuuuaccuuuuuc

SEQ ID NO: 1248487 - RNA, 13 nt, Human
auccugcaggcag

SEQ ID NO: 1248488 - RNA, 22 nt, Human
uacugagagugaacaaauuuac

SEQ ID NO: 1248489 - RNA, 15 nt, Human
cgggagccugaucac

SEQ ID NO: 1248490 - RNA, 16 nt, Human
cucaauaaaguacaag

SEQ ID NO: 1248491 - RNA, 14 nt, Human
uaguuucccuugca

SEQ ID NO: 1248492 - RNA, 15 nt, Human
cuauauccugugacu

SEQ ID NO: 1248493 - RNA, 20 nt, Human
agcaagugaauuuuucucua

SEQ ID NO: 1248494 - RNA, 22 nt, Human
uagaauauuuauuaccucugau

SEQ ID NO: 1248495 - RNA, 15 nt, Human
acaaccugucccagc

SEQ ID NO: 1248496 - RNA, 16 nt, Human
uuuucaaaauuggacu

SEQ ID NO: 1248497 - RNA, 18 nt, Human
uucuggguucaagcgauu

SEQ ID NO: 1248498 - RNA, 12 nt, Human
aucauuuucaaa

SEQ ID NO: 1248499 - RNA, 21 nt, Human
accuccaccuucuggguucaa

SEQ ID NO: 1248500 - RNA, 19 nt, Human
auugaaaggcauucucuga

SEQ ID NO: 1248501 - RNA, 13 nt, Human
uuacaauugaaau

SEQ ID NO: 1248502 - RNA, 22 nt, Human
cccaugauguuuagaaacacaa

SEQ ID NO: 1248503 - RNA, 12 nt, Human
gguauuuuaauc

SEQ ID NO: 1248504 - RNA, 11 nt, Human
cagccagcagu

SEQ ID NO: 1248505 - RNA, 22 nt, Human
aaaagauuaugaucucagaaau

SEQ ID NO: 1248506 - RNA, 16 nt, Human
auuuguauaaaauaau

SEQ ID NO: 1248507 - RNA, 15 nt, Human
agacagcucugcaua

SEQ ID NO: 1248508 - RNA, 15 nt, Human
ggcuuagacccucau

SEQ ID NO: 1248509 - RNA, 13 nt, Human
gcucuggaaacca

SEQ ID NO: 1248510 - RNA, 17 nt, Human
caguccucuuucaaagg

SEQ ID NO: 1248511 - RNA, 14 nt, Human
uaugaauuacauuu

SEQ ID NO: 1248512 - RNA, 14 nt, Human
gaauuuucuuccaa

SEQ ID NO: 1248513 - RNA, 16 nt, Human
uccugcaauuccacuu

SEQ ID NO: 1248514 - RNA, 19 nt, Human
cacuuuaacacagugucug

SEQ ID NO: 1248515 - RNA, 14 nt, Human
guugccaaggcugg

SEQ ID NO: 1248516 - RNA, 19 nt, Human
ggucucaguguccucaucu

SEQ ID NO: 1248517 - RNA, 22 nt, Human
cacagauuugagcucagcccug

SEQ ID NO: 1248518 - RNA, 22 nt, Human
cagagcugcccucuccugggca

SEQ ID NO: 1248519 - RNA, 17 nt, Human
ucuccugggcagcugcc

SEQ ID NO: 1248520 - RNA, 15 nt, Human
acagaagcuuccauu

SEQ ID NO: 1248521 - RNA, 18 nt, Human
cugcagacaugagagaca

SEQ ID NO: 1248522 - RNA, 12 nt, Human
cauuugcugagc

SEQ ID NO: 1248523 - RNA, 16 nt, Human
gccuaucagcauuuua

SEQ ID NO: 1248524 - RNA, 18 nt, Human
cagagcugcccucuccug

SEQ ID NO: 1248525 - RNA, 13 nt, Human
guauuuauauauu

SEQ ID NO: 1248526 - RNA, 22 nt, Human
uuuuuccccaaaaagaauggga

SEQ ID NO: 1248527 - RNA, 18 nt, Human
cuaauuuaucuugucucu

SEQ ID NO: 1248528 - RNA, 12 nt, Human
gcaguuuuccau

SEQ ID NO: 1248529 - RNA, 12 nt, Human
guguauauuuuu

SEQ ID NO: 1248530 - RNA, 11 nt, Human
acugggacagg

SEQ ID NO: 1248531 - RNA, 20 nt, Human
caggugacccugaugaaaac

SEQ ID NO: 1248532 - RNA, 21 nt, Human
aauuaggcaaggcuaugugau

SEQ ID NO: 1248533 - RNA, 19 nt, Human
uuuaugcauacaguaauuu

SEQ ID NO: 1248534 - RNA, 15 nt, Human
cuauauuaucaugca

SEQ ID NO: 1248535 - RNA, 12 nt, Human
uuuuuuuuaaac

SEQ ID NO: 1248536 - RNA, 23 nt, Human
auugcagaguacuggcugaugga

SEQ ID NO: 1248537 - RNA, 20 nt, Human
ccccuauccuacuuccccuu

SEQ ID NO: 1248538 - RNA, 21 nt, Human
auauacuccuaguaauuuaag

SEQ ID NO: 1248539 - RNA, 11 nt, Human
auuauuauuua

SEQ ID NO: 1248540 - RNA, 20 nt, Human
ucccuuuugcugccucuaaa

SEQ ID NO: 1248541 - RNA, 19 nt, Human
auuuuccuggacaguuuuc

SEQ ID NO: 1248542 - RNA, 15 nt, Human
auuuauaacucauca

SEQ ID NO: 1248543 - RNA, 15 nt, Human
guuuccuagcgcagc

SEQ ID NO: 1248544 - RNA, 14 nt, Human
cuuaaaauguaauu

SEQ ID NO: 1248545 - RNA, 12 nt, Human
aaugaauguuua

SEQ ID NO: 1248546 - RNA, 23 nt, Human
cuuaaagaauuuucaaaaucaaa

SEQ ID NO: 1248547 - RNA, 15 nt, Human
accccuucauccucu

SEQ ID NO: 1248548 - RNA, 12 nt, Human
aaaagaaagaaa

SEQ ID NO: 1248549 - RNA, 21 nt, Human
acuugggcgggacacaggcuc

SEQ ID NO: 1248550 - RNA, 18 nt, Human
uuuuuaauuauuauuuau

SEQ ID NO: 1248551 - RNA, 23 nt, Human
uugauagcaagugaauuuuucuc

SEQ ID NO: 1248552 - RNA, 24 nt, Human
uauuuauaaauauauuuaagauaa

SEQ ID NO: 1248553 - RNA, 14 nt, Human
ucccucccuccacc

SEQ ID NO: 1248554 - RNA, 18 nt, Human
gaaaggccagcaaauucg

SEQ ID NO: 1248555 - RNA, 17 nt, Human
acuuuauauuauuuuga

SEQ ID NO: 1248556 - RNA, 19 nt, Human
uuguguaaugaaaaugaau

SEQ ID NO: 1248557 - RNA, 15 nt, Human
aauuccaggaaaauc

SEQ ID NO: 1248558 - RNA, 22 nt, Human
cccagcccuccuuaucaaagga

SEQ ID NO: 1248559 - RNA, 19 nt, Human
gcucauggaauuggagcuc

SEQ ID NO: 1248560 - RNA, 22 nt, Human
cagaagcuuccauuccaagccu

SEQ ID NO: 1248561 - RNA, 23 nt, Human
gcuauucacaaccacucauucaa

SEQ ID NO: 1248562 - RNA, 22 nt, Human
guaauuuaagauuuuguuuuua

SEQ ID NO: 1248563 - RNA, 13 nt, Human
aauaaauguacau

SEQ ID NO: 1248564 - RNA, 14 nt, Human
uucagccugaaaga

SEQ ID NO: 1248565 - RNA, 18 nt, Human
gaugaacucuuaaucaaa

SEQ ID NO: 1248566 - RNA, 19 nt, Human
gccaucccucccuccaccu

SEQ ID NO: 1248567 - RNA, 17 nt, Human
ucauacuucuuaggguu

SEQ ID NO: 1248568 - RNA, 21 nt, Human
auucccuccugcuacucuguu

SEQ ID NO: 1248569 - RNA, 23 nt, Human
cauuguggucacaggaaguagag

SEQ ID NO: 1248570 - RNA, 21 nt, Human
ccaaggaugccccgucccccu

SEQ ID NO: 1248571 - RNA, 20 nt, Human
cuuuugcugccucuaaaagg

SEQ ID NO: 1248572 - RNA, 23 nt, Human
acaguucauauguaccauguaca

SEQ ID NO: 1248573 - RNA, 21 nt, Human
gugacauguuuacaaaccuca

SEQ ID NO: 1248574 - RNA, 23 nt, Human
cuaaauaaagcuugcaacaaaau

SEQ ID NO: 1248575 - RNA, 15 nt, Human
gcuguugagcuguuu

SEQ ID NO: 1248576 - RNA, 15 nt, Human
auauuuuuuguuaaa

SEQ ID NO: 1248577 - RNA, 23 nt, Human
gcccuggugccucaccccuugcc

SEQ ID NO: 1248578 - RNA, 23 nt, Human
ccagccugggugacagagcaaga

SEQ ID NO: 1248579 - RNA, 15 nt, Human
gacagggaggacgcu

SEQ ID NO: 1248580 - RNA, 15 nt, Human
acauaagggaggaaa

SEQ ID NO: 1248581 - RNA, 21 nt, Human
ugcagaguacuggcugaugga

SEQ ID NO: 1248582 - RNA, 21 nt, Human
ucccugcaauaaaauggguuu

SEQ ID NO: 1248583 - RNA, 14 nt, Human
cucugccucagaaa

SEQ ID NO: 1248584 - RNA, 16 nt, Human
auaucaauuuaaaaaa

SEQ ID NO: 1248585 - RNA, 15 nt, Human
cccugccccccagcc

SEQ ID NO: 1248586 - RNA, 20 nt, Human
aguccuacaagcuaaaauua

SEQ ID NO: 1248587 - RNA, 23 nt, Human
aucaccaaggcugauuaaaccaa

SEQ ID NO: 1248588 - RNA, 23 nt, Human
auacuucauuuaaaauauuuuua

SEQ ID NO: 1248589 - RNA, 16 nt, Human
acaugaaguccaagca

SEQ ID NO: 1248590 - RNA, 20 nt, Human
uugauagaguguuaucaguc

SEQ ID NO: 1248591 - RNA, 13 nt, Human
gccuccccuccuc

SEQ ID NO: 1248592 - RNA, 17 nt, Human
aauaaguauuuauaaua

SEQ ID NO: 1248593 - RNA, 18 nt, Human
cagcuuauugucuaguga

SEQ ID NO: 1248594 - RNA, 17 nt, Human
auaucaauuuaaaaaaa

SEQ ID NO: 1248595 - RNA, 13 nt, Human
auacuauccaguu

SEQ ID NO: 1248596 - RNA, 21 nt, Human
gcugcccucuccugggcagcu

SEQ ID NO: 1248597 - RNA, 18 nt, Human
auuugcuggagcucugcc

SEQ ID NO: 1248598 - RNA, 12 nt, Human
cucuaacucaga

SEQ ID NO: 1248599 - RNA, 14 nt, Human
uguggcuguaucuu

SEQ ID NO: 1248600 - RNA, 20 nt, Human
aaacagaacuauggaaaaaa

SEQ ID NO: 1248601 - RNA, 23 nt, Human
ucaaccaaauggagugacuuagu

SEQ ID NO: 1248602 - RNA, 15 nt, Human
caaaacuuucuuuuc

SEQ ID NO: 1248603 - RNA, 16 nt, Human
uuuucucuaggaaaua

SEQ ID NO: 1248604 - RNA, 20 nt, Human
uuauuaccucugauaccuca

SEQ ID NO: 1248605 - RNA, 22 nt, Human
acauccuacaagacacagugac

SEQ ID NO: 1248606 - RNA, 16 nt, Human
uagagugggacaguuc

SEQ ID NO: 1248607 - RNA, 14 nt, Human
ccagacacuuuuuu

SEQ ID NO: 1248608 - RNA, 21 nt, Human
uccugagaccagccaaccugg

SEQ ID NO: 1248609 - RNA, 14 nt, Human
auuaauauauguau

SEQ ID NO: 1248610 - RNA, 15 nt, Human
gacuuacuauuuauu

SEQ ID NO: 1248611 - RNA, 16 nt, Human
aagucugauuuuccug

SEQ ID NO: 1248612 - RNA, 15 nt, Human
uggcgcgcaccugua

SEQ ID NO: 1248613 - RNA, 19 nt, Human
uuaaacaaaaaaagcauug

SEQ ID NO: 1248614 - RNA, 20 nt, Human
ugagcagugcuugaaugaag

SEQ ID NO: 1248615 - RNA, 24 nt, Human
uucacuuuuggcuuguaaaguaca

SEQ ID NO: 1248616 - RNA, 14 nt, Human
cgucccccucuggc

SEQ ID NO: 1248617 - RNA, 17 nt, Human
gcuccaaacuggagcuu

SEQ ID NO: 1248618 - RNA, 19 nt, Human
uguugacaacugugacugu

SEQ ID NO: 1248619 - RNA, 18 nt, Human
cucuggccuucggccucc

SEQ ID NO: 1248620 - RNA, 15 nt, Human
cuggacucaccuccc

SEQ ID NO: 1248621 - RNA, 15 nt, Human
aaauauuuauuuuaa

SEQ ID NO: 1248622 - RNA, 16 nt, Human
caacaguuuuuuaugc

SEQ ID NO: 1248623 - RNA, 20 nt, Human
agcaguucagagcugcccuc

SEQ ID NO: 1248624 - RNA, 20 nt, Human
aaauaauuuuuauauuugaa

SEQ ID NO: 1248625 - RNA, 15 nt, Human
uaauguuacauuauu

SEQ ID NO: 1248626 - RNA, 20 nt, Human
acuagaguuuagcuggaaaa

SEQ ID NO: 1248627 - RNA, 12 nt, Human
auacagugucuu

SEQ ID NO: 1248628 - RNA, 20 nt, Human
cuuaacucauugcaaccucc

SEQ ID NO: 1248629 - RNA, 16 nt, Human
caccuguaaucccagc

SEQ ID NO: 1248630 - RNA, 16 nt, Human
ccccaucucuucuggg

SEQ ID NO: 1248631 - RNA, 15 nt, Human
augagaagaaugacu

SEQ ID NO: 1248632 - RNA, 18 nt, Human
ugcuacucuguuccuuca

SEQ ID NO: 1248633 - RNA, 16 nt, Human
auuauacccccugcaa

SEQ ID NO: 1248634 - RNA, 15 nt, Human
ucuggggcucuggga

SEQ ID NO: 1248635 - RNA, 22 nt, Human
gaguggcgcgcgccaccacgcc

SEQ ID NO: 1248636 - RNA, 13 nt, Human
cugcuuucaucuu

SEQ ID NO: 1248637 - RNA, 17 nt, Human
cuggcaaggguucaccu

SEQ ID NO: 1248638 - RNA, 16 nt, Human
uagauacugaauguaa

SEQ ID NO: 1248639 - RNA, 14 nt, Human
aagggucucccucu

SEQ ID NO: 1248640 - RNA, 19 nt, Human
uaaaucuauuuauuaauau

SEQ ID NO: 1248641 - RNA, 15 nt, Human
ugaaacccugucucu

SEQ ID NO: 1248642 - RNA, 15 nt, Human
uaauuauuauuuaua

SEQ ID NO: 1248643 - RNA, 21 nt, Human
auaguuguaccgcaaugugac

SEQ ID NO: 1248644 - RNA, 16 nt, Human
aauauauaugaauaaa

SEQ ID NO: 1248645 - RNA, 12 nt, Human
auaaaauggguu

SEQ ID NO: 1248646 - RNA, 19 nt, Human
aaaauugugaucagaccau

SEQ ID NO: 1248647 - RNA, 21 nt, Human
aaaauaugccccauucaacau

SEQ ID NO: 1248648 - RNA, 16 nt, Human
uaucaaaagaaagaaa

SEQ ID NO: 1248649 - RNA, 21 nt, Human
auugugaucagaccauaaugu

SEQ ID NO: 1248650 - RNA, 17 nt, Human
guacauuuccaaauuca

SEQ ID NO: 1248651 - RNA, 14 nt, Human
cuguaaucccagcu

SEQ ID NO: 1248652 - RNA, 22 nt, Human
uccauggugugcuggcuuaaaa

SEQ ID NO: 1248653 - RNA, 13 nt, Human
augaacuuuccac

SEQ ID NO: 1248654 - RNA, 16 nt, Human
uaaaaucuaauucaaa

SEQ ID NO: 1248655 - RNA, 17 nt, Human
cuuugggaggcugaggc

SEQ ID NO: 1248656 - RNA, 20 nt, Human
ccagcuacuugggaggcuga

SEQ ID NO: 1248657 - RNA, 19 nt, Human
agcagcuuauucacaagac

SEQ ID NO: 1248658 - RNA, 19 nt, Human
auuacaggcgugagccacc

SEQ ID NO: 1248659 - RNA, 22 nt, Human
guacauuaauuaccuugagcca

SEQ ID NO: 1248660 - RNA, 15 nt, Human
uaggaaauauuuauu

SEQ ID NO: 1248661 - RNA, 18 nt, Human
guuggaaaaugugcaaua

SEQ ID NO: 1248662 - RNA, 21 nt, Human
aagauuaugaucucagaaauu

SEQ ID NO: 1248663 - RNA, 16 nt, Human
auguuauuuuuuaauu

SEQ ID NO: 1248664 - RNA, 22 nt, Human
cccuugccauggagguuaagca

SEQ ID NO: 1248665 - RNA, 22 nt, Human
agcuacuugggaggcugaggca

SEQ ID NO: 1248666 - RNA, 16 nt, Human
uuaacauuauuuauau

SEQ ID NO: 1248667 - RNA, 18 nt, Human
ugcuuguuagcaaaaugg

SEQ ID NO: 1248668 - RNA, 19 nt, Human
cucauugcaaccuccaccu

SEQ ID NO: 1248669 - RNA, 15 nt, Human
cuguacuuuuuccag

SEQ ID NO: 1248670 - RNA, 22 nt, Human
gcaaccuccaccuucuggguuc

SEQ ID NO: 1248671 - RNA, 16 nt, Human
ucuauuaggaaauauu

SEQ ID NO: 1248672 - RNA, 12 nt, Human
ucauuuuaauua

SEQ ID NO: 1248673 - RNA, 16 nt, Human
uacagggcauuuuggu

SEQ ID NO: 1248674 - RNA, 19 nt, Human
aaucuacacuccagugaga

SEQ ID NO: 1248675 - RNA, 14 nt, Human
auuuauauauguau

SEQ ID NO: 1248676 - RNA, 18 nt, Human
cugagccuugggaccccu

SEQ ID NO: 1248677 - RNA, 14 nt, Human
auuuauuuuaauaa

SEQ ID NO: 1248678 - RNA, 21 nt, Human
auucauagcagcuuauucaca

SEQ ID NO: 1248679 - RNA, 14 nt, Human
cuuaugaaccuuua

SEQ ID NO: 1248680 - RNA, 19 nt, Human
agccagcaguucagagcug

SEQ ID NO: 1248681 - RNA, 20 nt, Human
aagaauuuucaaaaucaaau

SEQ ID NO: 1248682 - RNA, 23 nt, Human
aggcuuacacccacaguggaaag

SEQ ID NO: 1248683 - RNA, 12 nt, Human
cuaaaucuauuu

SEQ ID NO: 1248684 - RNA, 23 nt, Human
uuuauaugcuucuguuuuauaau

SEQ ID NO: 1248685 - RNA, 24 nt, Human
uggccgggagccugaucaccugcc

SEQ ID NO: 1248686 - RNA, 19 nt, Human
ucacaagugaaaaacaucc

SEQ ID NO: 1248687 - RNA, 16 nt, Human
auuuuacuuuuccauu

SEQ ID NO: 1248688 - RNA, 15 nt, Human
uccagacacuuuuuu

SEQ ID NO: 1248689 - RNA, 20 nt, Human
uccagagggaauugcagagu

SEQ ID NO: 1248690 - RNA, 22 nt, Human
ccgggaggcagagguugcagug

SEQ ID NO: 1248691 - RNA, 15 nt, Human
accugggcauucuug

SEQ ID NO: 1248692 - RNA, 19 nt, Human
ccgggcgugguggugagug

SEQ ID NO: 1248693 - RNA, 14 nt, Human
aguuuuuuuuuaaa

SEQ ID NO: 1248694 - RNA, 20 nt, Human
cuguaaaauggagacaccac

SEQ ID NO: 1248695 - RNA, 22 nt, Human
uuccuagcgcagccaugugauu

SEQ ID NO: 1248696 - RNA, 17 nt, Human
gaggcauccuuccucac

SEQ ID NO: 1248697 - RNA, 18 nt, Human
cgaugguacauauuucuu

SEQ ID NO: 1248698 - RNA, 22 nt, Human
accuaacgaaguauccuucagc

SEQ ID NO: 1248699 - RNA, 21 nt, Human
uuuccauugguuuaccuguga

SEQ ID NO: 1248700 - RNA, 20 nt, Human
uaauaaauguacauuaauua

SEQ ID NO: 1248701 - RNA, 15 nt, Human
uuuaauuucaugaaa

SEQ ID NO: 1248702 - RNA, 21 nt, Human
gucucagugucaaugcagccc

SEQ ID NO: 1248703 - RNA, 16 nt, Human
uauauaaauuuuccca

SEQ ID NO: 1248704 - RNA, 20 nt, Human
cccuuccuaauuccacagcu

SEQ ID NO: 1248705 - RNA, 16 nt, Human
cuugccugcaggcaug

SEQ ID NO: 1248706 - RNA, 19 nt, Human
gccagcaguucagagcugc

SEQ ID NO: 1248707 - RNA, 18 nt, Human
aaaacuuucuuuucugga

SEQ ID NO: 1248708 - RNA, 18 nt, Human
cgggaguggcgcgcgcca

SEQ ID NO: 1248709 - RNA, 13 nt, Human
ugagcgacaguga

SEQ ID NO: 1248710 - RNA, 23 nt, Human
gauuuuguuuuuaaacuggaaau

SEQ ID NO: 1248711 - RNA, 20 nt, Human
cacagcacgggggccaagga

SEQ ID NO: 1248712 - RNA, 16 nt, Human
cuccugggcagcugcc

SEQ ID NO: 1248713 - RNA, 18 nt, Human
uaaguuuuuuuuuaaaaa

SEQ ID NO: 1248714 - RNA, 18 nt, Human
cagaguacuggcugaugg

SEQ ID NO: 1248715 - RNA, 16 nt, Human
auuucuauuuauuuac

SEQ ID NO: 1248716 - RNA, 18 nt, Human
ucuaugaaauauuauguu

SEQ ID NO: 1248717 - RNA, 16 nt, Human
cccacuggacucaccu

SEQ ID NO: 1248718 - RNA, 12 nt, Human
aucccucccucc

SEQ ID NO: 1248719 - RNA, 20 nt, Human
aguuuaugcauacaguaauu

SEQ ID NO: 1248720 - RNA, 19 nt, Human
aaauuugccaauuuacuuu

SEQ ID NO: 1248721 - RNA, 20 nt, Human
aauuaccuugagccaguaau

SEQ ID NO: 1248722 - RNA, 14 nt, Human
cuauggaaaaaaag

SEQ ID NO: 1248723 - RNA, 22 nt, Human
gcagagacgggguuugccaugc

SEQ ID NO: 1248724 - RNA, 16 nt, Human
ucaaucaaauaaguau

SEQ ID NO: 1248725 - RNA, 15 nt, Human
uuaacauuauuuaua

SEQ ID NO: 1248726 - RNA, 12 nt, Human
acaacugugacu

SEQ ID NO: 1248727 - RNA, 23 nt, Human
auuaaagcuaaaguaucuguauu

SEQ ID NO: 1248728 - RNA, 12 nt, Human
auuuauuaauau

SEQ ID NO: 1248729 - RNA, 22 nt, Human
auuuauauggggaauauauuuu

SEQ ID NO: 1248730 - RNA, 16 nt, Human
accuguuuuuaagcug

SEQ ID NO: 1248731 - RNA, 12 nt, Human
aaguuucuggga

SEQ ID NO: 1248732 - RNA, 15 nt, Human
aaucucaauauuuca

SEQ ID NO: 1248733 - RNA, 12 nt, Human
acaagacacagu

SEQ ID NO: 1248734 - RNA, 16 nt, Human
ccaucccucccuccac

SEQ ID NO: 1248735 - RNA, 19 nt, Human
ucauaacaauuuuaggagg

SEQ ID NO: 1248736 - RNA, 19 nt, Human
gaaccuuuacauccagaua

SEQ ID NO: 1248737 - RNA, 16 nt, Human
aaacaaacgaaaaaca

SEQ ID NO: 1248738 - RNA, 21 nt, Human
aaggaagaaauuccaggaaaa

SEQ ID NO: 1248739 - RNA, 22 nt, Human
agcagcauaaauguugacaugg

SEQ ID NO: 1248740 - RNA, 15 nt, Human
ucaguccucuuucaa

SEQ ID NO: 1248741 - RNA, 18 nt, Human
acugccgguuugaaaaua

SEQ ID NO: 1248742 - RNA, 14 nt, Human
ugccaucccucccu

SEQ ID NO: 1248743 - RNA, 19 nt, Human
cugccccccagcccuccuu

SEQ ID NO: 1248744 - RNA, 17 nt, Human
cauuguuugucugucuu

SEQ ID NO: 1248745 - RNA, 13 nt, Human
cuauuuauuaaua

SEQ ID NO: 1248746 - RNA, 23 nt, Human
ccagcuacuugggaggcugaggc

SEQ ID NO: 1248747 - RNA, 12 nt, Human
acuuguugagau

SEQ ID NO: 1248748 - RNA, 15 nt, Human
ccucauguccacugg

SEQ ID NO: 1248749 - RNA, 19 nt, Human
agagacgggguuugccaug

SEQ ID NO: 1248750 - RNA, 16 nt, Human
aaauauuuauuuuaau

SEQ ID NO: 1248751 - RNA, 18 nt, Human
ccugcagacaugagagac

SEQ ID NO: 1248752 - RNA, 22 nt, Human
auuacaguuagagauuuuuaaa

SEQ ID NO: 1248753 - RNA, 23 nt, Human
gauguacauuuccaaauucacaa

SEQ ID NO: 1248754 - RNA, 20 nt, Human
cuggauguggagggggcgcg

SEQ ID NO: 1248755 - RNA, 16 nt, Human
gcaucuuacugaaggu

SEQ ID NO: 1248756 - RNA, 21 nt, Human
uagcagacaguguuuucuggg

SEQ ID NO: 1248757 - RNA, 21 nt, Human
acucugaagggcaucaugcau

SEQ ID NO: 1248758 - RNA, 19 nt, Human
auauuugcaagacauagaa

SEQ ID NO: 1248759 - RNA, 22 nt, Human
caaucaaauaaguauuuauaau

SEQ ID NO: 1248760 - RNA, 14 nt, Human
uacagagaaaagac

SEQ ID NO: 1248761 - RNA, 18 nt, Human
gaagcaaaauuuuuucuc

SEQ ID NO: 1248762 - RNA, 13 nt, Human
ccacaacacacag

SEQ ID NO: 1248763 - RNA, 16 nt, Human
ccugaucaccugcccu

SEQ ID NO: 1248764 - RNA, 17 nt, Human
aucaugccccuguacuc

SEQ ID NO: 1248765 - RNA, 22 nt, Human
gaacuuuccacauucagagcuu

SEQ ID NO: 1248766 - RNA, 19 nt, Human
cugcuugccaucccucccu

SEQ ID NO: 1248767 - RNA, 22 nt, Human
aaugaaauggugaaaugcagag

SEQ ID NO: 1248768 - RNA, 18 nt, Human
auauacuccuaguaauuu

SEQ ID NO: 1248769 - RNA, 22 nt, Human
aacucccugccccccagcccuc

SEQ ID NO: 1248770 - RNA, 15 nt, Human
uaaaaguagaauaaa

SEQ ID NO: 1248771 - RNA, 19 nt, Human
gaucucagaaauuguaucu

SEQ ID NO: 1248772 - RNA, 17 nt, Human
cccucugggucucagug

SEQ ID NO: 1248773 - RNA, 18 nt, Human
accuguaaucauauaaua

SEQ ID NO: 1248774 - RNA, 21 nt, Human
acgcucucuggccuucggccu

SEQ ID NO: 1248775 - RNA, 16 nt, Human
auuuugguaaaauacu

SEQ ID NO: 1248776 - RNA, 15 nt, Human
gcuugccaucccucc

SEQ ID NO: 1248777 - RNA, 18 nt, Human
gauuaugaucucagaaau

SEQ ID NO: 1248778 - RNA, 13 nt, Human
ccagcacagccuc

SEQ ID NO: 1248779 - RNA, 19 nt, Human
uauccaaagcugaauacau

SEQ ID NO: 1248780 - RNA, 16 nt, Human
ggcugagccucagucu

SEQ ID NO: 1248781 - RNA, 13 nt, Human
cuagaauuuauuc

SEQ ID NO: 1248782 - RNA, 14 nt, Human
ugcuucuguuuuau

SEQ ID NO: 1248783 - RNA, 20 nt, Human
cacuguggguagacacacau

SEQ ID NO: 1248784 - RNA, 20 nt, Human
ucaaaauggagggaauaaua

SEQ ID NO: 1248785 - RNA, 18 nt, Human
accaggcuugccugcagg

SEQ ID NO: 1248786 - RNA, 22 nt, Human
ucaacuccaaacugacucuuaa

SEQ ID NO: 1248787 - RNA, 18 nt, Human
uccugccugcaauauuug

SEQ ID NO: 1248788 - RNA, 13 nt, Human
uacuauauuuaug

SEQ ID NO: 1248789 - RNA, 19 nt, Human
uuuauaucaauuuaaaaaa

SEQ ID NO: 1248790 - RNA, 19 nt, Human
acaaggcuuuaucucaggg

SEQ ID NO: 1248791 - RNA, 19 nt, Human
agcugauaucaugccccug

SEQ ID NO: 1248792 - RNA, 21 nt, Human
cuugaaauagugucugaugaa

SEQ ID NO: 1248793 - RNA, 21 nt, Human
cuuuauuuuuuaaguauuuau

SEQ ID NO: 1248794 - RNA, 19 nt, Human
cucugccucagaaaacaag

SEQ ID NO: 1248795 - RNA, 16 nt, Human
gacauuugcucaugga

SEQ ID NO: 1248796 - RNA, 19 nt, Human
auugaggacacugauaugg

SEQ ID NO: 1248797 - RNA, 22 nt, Human
aaagauuaugaucucagaaauu

SEQ ID NO: 1248798 - RNA, 17 nt, Human
guugauagcaagugaau

SEQ ID NO: 1248799 - RNA, 14 nt, Human
uagaauauuuauua

SEQ ID NO: 1248800 - RNA, 20 nt, Human
ucuuaacucauugcaaccuc

SEQ ID NO: 1248801 - RNA, 21 nt, Human
ugaagguaaaauugaaaggca

SEQ ID NO: 1248802 - RNA, 12 nt, Human
ucagaaauuuaa

SEQ ID NO: 1248803 - RNA, 18 nt, Human
acaucuagcaaauguuau

SEQ ID NO: 1248804 - RNA, 18 nt, Human
aaauugaaaggcauucuc

SEQ ID NO: 1248805 - RNA, 22 nt, Human
cagcccuggugggcagagaggu

SEQ ID NO: 1248806 - RNA, 12 nt, Human
accccugagcuu

SEQ ID NO: 1248807 - RNA, 13 nt, Human
agcagauuuuaau

SEQ ID NO: 1248808 - RNA, 18 nt, Human
agaacuauggaaaaaaag

SEQ ID NO: 1248809 - RNA, 16 nt, Human
augcuguauuuuaaaa

SEQ ID NO: 1248810 - RNA, 14 nt, Human
acucagaaacauca

SEQ ID NO: 1248811 - RNA, 14 nt, Human
agaagaaugacuau

SEQ ID NO: 1248812 - RNA, 19 nt, Human
gcaugggccuagcccacug

SEQ ID NO: 1248813 - RNA, 18 nt, Human
cuuugagcgcccacuaga

SEQ ID NO: 1248814 - RNA, 19 nt, Human
agccugaucaccugcccug

SEQ ID NO: 1248815 - RNA, 17 nt, Human
uccugccugcaauauuu

SEQ ID NO: 1248816 - RNA, 22 nt, Human
aaacaaggaugaauuaaguuuu

SEQ ID NO: 1248817 - RNA, 14 nt, Human
accugggcauucuu

SEQ ID NO: 1248818 - RNA, 15 nt, Human
gcuuuucaaaauugg

SEQ ID NO: 1248819 - RNA, 18 nt, Human
cauauguaccauguacau

SEQ ID NO: 1248820 - RNA, 14 nt, Human
cucccugcccccca

SEQ ID NO: 1248821 - RNA, 23 nt, Human
aauuauggcugguaacauagguu

SEQ ID NO: 1248822 - RNA, 20 nt, Human
cuaauucaaacuaauagaau

SEQ ID NO: 1248823 - RNA, 22 nt, Human
agacucugucucaguccaugaa

SEQ ID NO: 1248824 - RNA, 23 nt, Human
aggaugguucccuugaugaagaa

SEQ ID NO: 1248825 - RNA, 19 nt, Human
cucauggaauuggagcucg

SEQ ID NO: 1248826 - RNA, 17 nt, Human
aaacaaaaaaagcauug

SEQ ID NO: 1248827 - RNA, 12 nt, Human
uucagccugaaa

SEQ ID NO: 1248828 - RNA, 21 nt, Human
aaucaccaaggcugauuaaac

SEQ ID NO: 1248829 - RNA, 20 nt, Human
ugagagacacacugaagaag

SEQ ID NO: 1248830 - RNA, 17 nt, Human
ugaaauggugaaaugca

SEQ ID NO: 1248831 - RNA, 14 nt, Human
auagugucugauga

SEQ ID NO: 1248832 - RNA, 19 nt, Human
cugcaaagcccagcuugaa

SEQ ID NO: 1248833 - RNA, 13 nt, Human
aauguaaacaaag

SEQ ID NO: 1248834 - RNA, 21 nt, Human
acagcccuucuuuccacagaa

SEQ ID NO: 1248835 - RNA, 16 nt, Human
ucagucucccucccuu

SEQ ID NO: 1248836 - RNA, 14 nt, Human
acuuccucagcugu

SEQ ID NO: 1248837 - RNA, 19 nt, Human
accucaguuuuaucauuuu

SEQ ID NO: 1248838 - RNA, 14 nt, Human
auuuauuauuuuca

SEQ ID NO: 1248839 - RNA, 18 nt, Human
aaguugauaugccuuuuc

SEQ ID NO: 1248840 - RNA, 22 nt, Human
cauguacauccauggugugcug

SEQ ID NO: 1248841 - RNA, 16 nt, Human
aaaaauacaaaaauua

SEQ ID NO: 1248842 - RNA, 23 nt, Human
ucaaucaaauaaguauuuauaau

SEQ ID NO: 1248843 - RNA, 15 nt, Human
ccuccccuccucugc

SEQ ID NO: 1248844 - RNA, 20 nt, Human
cugcaauauuugaauuuuaa

SEQ ID NO: 1248845 - RNA, 13 nt, Human
ccugccccccagc

SEQ ID NO: 1248846 - RNA, 14 nt, Human
caagacucugucuc

SEQ ID NO: 1248847 - RNA, 14 nt, Human
cuggcuuaaaaugu

SEQ ID NO: 1248848 - RNA, 15 nt, Human
uuugaguguuuuaag

SEQ ID NO: 1248849 - RNA, 17 nt, Human
aggcuagaaccaccugc

SEQ ID NO: 1248850 - RNA, 19 nt, Human
aaaaguauaaauaaaauga

SEQ ID NO: 1248851 - RNA, 12 nt, Human
augagagacagc

SEQ ID NO: 1248852 - RNA, 14 nt, Human
uccacaacacacag

SEQ ID NO: 1248853 - RNA, 20 nt, Human
ccaaucauuuuaauuauuau

SEQ ID NO: 1248854 - RNA, 13 nt, Human
ccaaaagguauuu

SEQ ID NO: 1248855 - RNA, 23 nt, Human
uugccugcaggcaugagucaguc

SEQ ID NO: 1248856 - RNA, 22 nt, Human
cauaaauguugacaugggacau

SEQ ID NO: 1248857 - RNA, 23 nt, Human
caacugugacuguacccaaaugg

SEQ ID NO: 1248858 - RNA, 16 nt, Human
uucccaacuccagaaa

SEQ ID NO: 1248859 - RNA, 18 nt, Human
aaaagccaaaaaccaaau

SEQ ID NO: 1248860 - RNA, 20 nt, Human
uaaaauguaauuaaucuugu

SEQ ID NO: 1248861 - RNA, 18 nt, Human
gcaaagcccagcuugaaa

SEQ ID NO: 1248862 - RNA, 20 nt, Human
auauaauaaauguacauuaa

SEQ ID NO: 1248863 - RNA, 15 nt, Human
auuuuaaaagaauga

SEQ ID NO: 1248864 - RNA, 14 nt, Human
uugccugcaggcau

SEQ ID NO: 1248865 - RNA, 13 nt, Human
auguaucuuauuc

SEQ ID NO: 1248866 - RNA, 22 nt, Human
uuuauggcacuaguauuucuau

SEQ ID NO: 1248867 - RNA, 20 nt, Human
uagcuuuacuguuuguuaug

SEQ ID NO: 1248868 - RNA, 16 nt, Human
ucaucaaugaaugaau

SEQ ID NO: 1248869 - RNA, 12 nt, Human
ucauucaaaagu

SEQ ID NO: 1248870 - RNA, 15 nt, Human
cagugucuggcacuu

SEQ ID NO: 1248871 - RNA, 19 nt, Human
uauuauucuucauaacaau

SEQ ID NO: 1248872 - RNA, 23 nt, Human
ggagggggcgcgugcaggcagca

SEQ ID NO: 1248873 - RNA, 13 nt, Human
aaaaauuuuauag

SEQ ID NO: 1248874 - RNA, 19 nt, Human
ugaucaccugcccugcuga

SEQ ID NO: 1248875 - RNA, 19 nt, Human
cagcuucucauccugcagg

SEQ ID NO: 1248876 - RNA, 15 nt, Human
uaacugcuacaaaua

SEQ ID NO: 1248877 - RNA, 14 nt, Human
uugaauuuuaaauc

SEQ ID NO: 1248878 - RNA, 18 nt, Human
ugaauaucuauuaauaua

SEQ ID NO: 1248879 - RNA, 15 nt, Human
uggacucaccucccc

SEQ ID NO: 1248880 - RNA, 15 nt, Human
uugacccacaagaaa

SEQ ID NO: 1248881 - RNA, 13 nt, Human
uaugaaauauuau

SEQ ID NO: 1248882 - RNA, 16 nt, Human
uaccuuuugcuguggc

SEQ ID NO: 1248883 - RNA, 16 nt, Human
aauuucuucaacuccc

SEQ ID NO: 1248884 - RNA, 13 nt, Human
uacauguuuucuu

SEQ ID NO: 1248885 - RNA, 18 nt, Human
caaggcuagaaccaccug

SEQ ID NO: 1248886 - RNA, 15 nt, Human
uaucuauuaauauau

SEQ ID NO: 1248887 - RNA, 16 nt, Human
guaaucauauaauaaa

SEQ ID NO: 1248888 - RNA, 19 nt, Human
aagguauuuauugagcacc

SEQ ID NO: 1248889 - RNA, 15 nt, Human
acuggcucccuggaa

SEQ ID NO: 1248890 - RNA, 22 nt, Human
caagagaauugcuugaacccag

SEQ ID NO: 1248891 - RNA, 13 nt, Human
cagucugaugaga

SEQ ID NO: 1248892 - RNA, 16 nt, Human
aaauuuucccaaaacu

SEQ ID NO: 1248893 - RNA, 15 nt, Human
ggaauuuucuuccaa

SEQ ID NO: 1248894 - RNA, 15 nt, Human
uaucaauuuaaaaaa

SEQ ID NO: 1248895 - RNA, 18 nt, Human
gaggcuccacuuggucug

SEQ ID NO: 1248896 - RNA, 13 nt, Human
ugccugcaggcau

SEQ ID NO: 1248897 - RNA, 17 nt, Human
auuuuuaccuuuuuccu

SEQ ID NO: 1248898 - RNA, 16 nt, Human
acuuuaacacaguguc

SEQ ID NO: 1248899 - RNA, 18 nt, Human
acggagauaucccaggaa

SEQ ID NO: 1248900 - RNA, 20 nt, Human
aagaugguaccaccagucug

SEQ ID NO: 1248901 - RNA, 17 nt, Human
agcgacagugagacucu

SEQ ID NO: 1248902 - RNA, 21 nt, Human
cugcuugccaucccucccucc

SEQ ID NO: 1248903 - RNA, 16 nt, Human
gcagcugccuccccuc

SEQ ID NO: 1248904 - RNA, 14 nt, Human
acaagagcuuaaca

SEQ ID NO: 1248905 - RNA, 19 nt, Human
agaguuuagcuggaaaagu

SEQ ID NO: 1248906 - RNA, 15 nt, Human
auagcagauuuuaau

SEQ ID NO: 1248907 - RNA, 16 nt, Human
uuacaucuuucacauu

SEQ ID NO: 1248908 - RNA, 20 nt, Human
ucugcuugccaucccucccu

SEQ ID NO: 1248909 - RNA, 14 nt, Human
cuuugugaaaaaaa

SEQ ID NO: 1248910 - RNA, 13 nt, Human
cacaacacacaga

SEQ ID NO: 1248911 - RNA, 21 nt, Human
cuaguaucaaaagaaagaaaa

SEQ ID NO: 1248912 - RNA, 14 nt, Human
uccaagccugacca

SEQ ID NO: 1248913 - RNA, 14 nt, Human
cuacaaauacucuu

SEQ ID NO: 1248914 - RNA, 19 nt, Human
ucagugucaaugcagcccc

SEQ ID NO: 1248915 - RNA, 13 nt, Human
uaauuuuaaguaa

SEQ ID NO: 1248916 - RNA, 15 nt, Human
uccaaauucacaagu

SEQ ID NO: 1248917 - RNA, 17 nt, Human
uuucugcuuuaauuuca

SEQ ID NO: 1248918 - RNA, 14 nt, Human
aauuccucugggaa

SEQ ID NO: 1248919 - RNA, 16 nt, Human
gcuugaacccaggaga

SEQ ID NO: 1248920 - RNA, 19 nt, Human
aaauuagaggucuccaaaa

SEQ ID NO: 1248921 - RNA, 17 nt, Human
cagcaguucagagcugc

SEQ ID NO: 1248922 - RNA, 21 nt, Human
cuggagcuugaaauagugucu

SEQ ID NO: 1248923 - RNA, 20 nt, Human
auaaccaugcccaagaauga

SEQ ID NO: 1248924 - RNA, 14 nt, Human
aaugagcaaaaguu

SEQ ID NO: 1248925 - RNA, 17 nt, Human
uguucuaagaagugaaa

SEQ ID NO: 1248926 - RNA, 22 nt, Human
ucucuacuaaaaauacaaaaau

SEQ ID NO: 1248927 - RNA, 19 nt, Human
uguuacauuauuaucaaca

SEQ ID NO: 1248928 - RNA, 15 nt, Human
acucaccucccccau

SEQ ID NO: 1248929 - RNA, 15 nt, Human
ccccugagcuugcag

SEQ ID NO: 1248930 - RNA, 12 nt, Human
aaaugaaagcag

SEQ ID NO: 1248931 - RNA, 16 nt, Human
ugacuauuauagaaug

SEQ ID NO: 1248932 - RNA, 17 nt, Human
ggccaugggacagggag

SEQ ID NO: 1248933 - RNA, 16 nt, Human
cauucucucuccugua

SEQ ID NO: 1248934 - RNA, 15 nt, Human
uuccugagaccagcc

SEQ ID NO: 1248935 - RNA, 19 nt, Human
uauuuauugcugaaugacu

SEQ ID NO: 1248936 - RNA, 12 nt, Human
uaaaauugaaag

SEQ ID NO: 1248937 - RNA, 22 nt, Human
gucucuacuaaaaauacaaaaa

SEQ ID NO: 1248938 - RNA, 14 nt, Human
uuaauuucaugaaa

SEQ ID NO: 1248939 - RNA, 17 nt, Human
uauagcauauguuuuug

SEQ ID NO: 1248940 - RNA, 16 nt, Human
gcaagcuuuucaaaau

SEQ ID NO: 1248941 - RNA, 19 nt, Human
uggagggggcgcgugcagg

SEQ ID NO: 1248942 - RNA, 16 nt, Human
caggcugagccucagu

SEQ ID NO: 1248943 - RNA, 15 nt, Human
auuuauuuuuuuacu

SEQ ID NO: 1248944 - RNA, 14 nt, Human
cacuuauaggaauu

SEQ ID NO: 1248945 - RNA, 20 nt, Human
agugauacuauccaguuacu

SEQ ID NO: 1248946 - RNA, 15 nt, Human
gagaugcuagaacuc

SEQ ID NO: 1248947 - RNA, 18 nt, Human
ucuucaacucccugcccc

SEQ ID NO: 1248948 - RNA, 21 nt, Human
uaaguuuaugcauacaguaau

SEQ ID NO: 1248949 - RNA, 16 nt, Human
agugucaaugcagccc

SEQ ID NO: 1248950 - RNA, 19 nt, Human
uggcgcgcgccaccacgcc

SEQ ID NO: 1248951 - RNA, 22 nt, Human
gaaaauaugccugcaaucugag

SEQ ID NO: 1248952 - RNA, 18 nt, Human
ucuucuagguucuaaaaa

SEQ ID NO: 1248953 - RNA, 17 nt, Human
cccacuagacccacugg

SEQ ID NO: 1248954 - RNA, 15 nt, Human
ugacuggccugcugg

SEQ ID NO: 1248955 - RNA, 16 nt, Human
uuuccacuacugcuac

SEQ ID NO: 1248956 - RNA, 16 nt, Human
cacuggacucaccucc

SEQ ID NO: 1248957 - RNA, 19 nt, Human
gagguacugagagugaaca

SEQ ID NO: 1248958 - RNA, 20 nt, Human
acuaaauugacacuuaaaaa

SEQ ID NO: 1248959 - RNA, 19 nt, Human
auuacagaugggcaaauua

SEQ ID NO: 1248960 - RNA, 23 nt, Human
agcccuccuuaucaaaggacacc

SEQ ID NO: 1248961 - RNA, 14 nt, Human
agaaaugaaagcag

SEQ ID NO: 1248962 - RNA, 19 nt, Human
uuaucaauaucuaauauau

SEQ ID NO: 1248963 - RNA, 14 nt, Human
auggugugcuggcu

SEQ ID NO: 1248964 - RNA, 15 nt, Human
uccgucucccaaagu

SEQ ID NO: 1248965 - RNA, 19 nt, Human
gugucaggugacccugaug

SEQ ID NO: 1248966 - RNA, 17 nt, Human
cuggagugcaguggcgc

SEQ ID NO: 1248967 - RNA, 14 nt, Human
uuauaaguuacaua

SEQ ID NO: 1248968 - RNA, 21 nt, Human
ugagccagugucaggaggaag

SEQ ID NO: 1248969 - RNA, 18 nt, Human
uaauuauuauucuucaua

SEQ ID NO: 1248970 - RNA, 17 nt, Human
agucccaggcugagccu

SEQ ID NO: 1248971 - RNA, 23 nt, Human
caacggggugaaacccugucucu

SEQ ID NO: 1248972 - RNA, 18 nt, Human
aucuucagaccuagaaua

SEQ ID NO: 1248973 - RNA, 22 nt, Human
ucccuuuugcugccucuaaaag

SEQ ID NO: 1248974 - RNA, 15 nt, Human
acuuaugaaccuuua

SEQ ID NO: 1248975 - RNA, 13 nt, Human
guuggaggcugca

SEQ ID NO: 1248976 - RNA, 20 nt, Human
aacauuauuuauauggggaa

SEQ ID NO: 1248977 - RNA, 18 nt, Human
ucuucagaccuagaauaa

SEQ ID NO: 1248978 - RNA, 19 nt, Human
auccauggugugcuggcuu

SEQ ID NO: 1248979 - RNA, 23 nt, Human
caggcaugagucagucugaugag

SEQ ID NO: 1248980 - RNA, 14 nt, Human
caccaacuuugaag

SEQ ID NO: 1248981 - RNA, 15 nt, Human
gccucuuagaugcag

SEQ ID NO: 1248982 - RNA, 13 nt, Human
cccugcacuccag

SEQ ID NO: 1248983 - RNA, 17 nt, Human
gacaguguuuucuggga

SEQ ID NO: 1248984 - RNA, 21 nt, Human
auguacaugaagaagcuaaau

SEQ ID NO: 1248985 - RNA, 17 nt, Human
ucaaauaaguauuuaua

SEQ ID NO: 1248986 - RNA, 16 nt, Human
aauaugcacaauagca

SEQ ID NO: 1248987 - RNA, 20 nt, Human
auguuauuuuuuaauuauua

SEQ ID NO: 1248988 - RNA, 18 nt, Human
acucuuaagaagacugca

SEQ ID NO: 1248989 - RNA, 23 nt, Human
uggaaauguuuacagauccccaa

SEQ ID NO: 1248990 - RNA, 22 nt, Human
aauuuaaaaaaaaaccugagcc

SEQ ID NO: 1248991 - RNA, 20 nt, Human
uuucuucaacucccugcccc

SEQ ID NO: 1248992 - RNA, 14 nt, Human
uacuuuguccuuuu

SEQ ID NO: 1248993 - RNA, 24 nt, Human
uggugugcuggcuuaaaauguaau

SEQ ID NO: 1248994 - RNA, 23 nt, Human
auauauguauuuauaaauauauu

SEQ ID NO: 1248995 - RNA, 12 nt, Human
ugagagacacac

SEQ ID NO: 1248996 - RNA, 13 nt, Human
ucuacuaaaaaua

SEQ ID NO: 1248997 - RNA, 15 nt, Human
gcaaccuccaccuuc

SEQ ID NO: 1248998 - RNA, 17 nt, Human
uuguuagcaaaauggau

SEQ ID NO: 1248999 - RNA, 16 nt, Human
aggccaugggacaggg

SEQ ID NO: 1249000 - RNA, 13 nt, Human
ccucuccugggca

SEQ ID NO: 1249001 - RNA, 23 nt, Human
uaauuuguaguguuggagaagaa

SEQ ID NO: 1249002 - RNA, 23 nt, Human
augcuaaucagggaggucauuuu

SEQ ID NO: 1249003 - RNA, 23 nt, Human
ccuaaccucauuccccaaccacu

SEQ ID NO: 1249004 - RNA, 18 nt, Human
ucugggucucaguguccu

SEQ ID NO: 1249005 - RNA, 16 nt, Human
augccccgucccccuc

SEQ ID NO: 1249006 - RNA, 17 nt, Human
agcagucagaagaccug

SEQ ID NO: 1249007 - RNA, 16 nt, Human
agugggacaguuccug

SEQ ID NO: 1249008 - RNA, 20 nt, Human
uccagccugagcgacaguga

SEQ ID NO: 1249009 - RNA, 14 nt, Human
cauuuucaaaaugg

SEQ ID NO: 1249010 - RNA, 19 nt, Human
gagggaauugcagaguacu

SEQ ID NO: 1249011 - RNA, 13 nt, Human
cauuucuauuuau

SEQ ID NO: 1249012 - RNA, 22 nt, Human
agcuuguauuccuuuuucucuc

SEQ ID NO: 1249013 - RNA, 12 nt, Human
uuucuauuuauu

SEQ ID NO: 1249014 - RNA, 19 nt, Human
uggaacaguuaccucugcc

SEQ ID NO: 1249015 - RNA, 18 nt, Human
auucuuacauguuuucuu

SEQ ID NO: 1249016 - RNA, 17 nt, Human
cauguauuuauuuuuuu

SEQ ID NO: 1249017 - RNA, 19 nt, Human
cauaagaaaacuaagaaau

SEQ ID NO: 1249018 - RNA, 16 nt, Human
auuuaagguauauaaa

SEQ ID NO: 1249019 - RNA, 13 nt, Human
cuuaucaaaggac

SEQ ID NO: 1249020 - RNA, 20 nt, Human
ccaggcauccuccacaauag

SEQ ID NO: 1249021 - RNA, 17 nt, Human
cugagcgacagugagac

SEQ ID NO: 1249022 - RNA, 21 nt, Human
augcaucuuacugaagguaaa

SEQ ID NO: 1249023 - RNA, 19 nt, Human
aaaacuaagaaauaugcac

SEQ ID NO: 1249024 - RNA, 16 nt, Human
cagagcugcccucucc

SEQ ID NO: 1249025 - RNA, 16 nt, Human
ccacuuauaggaauug

SEQ ID NO: 1249026 - RNA, 22 nt, Human
gacagggaaagggucucccucu

SEQ ID NO: 1249027 - RNA, 19 nt, Human
gcauccuuccucacaccag

SEQ ID NO: 1249028 - RNA, 18 nt, Human
auuaaguuuuuuuuuaaa

SEQ ID NO: 1249029 - RNA, 16 nt, Human
uggagacaccaccacc

SEQ ID NO: 1249030 - RNA, 18 nt, Human
agccugaucaccugcccu

SEQ ID NO: 1249031 - RNA, 14 nt, Human
auuguccaggucua

SEQ ID NO: 1249032 - RNA, 20 nt, Human
uuccuaaccagccuggucaa

SEQ ID NO: 1249033 - RNA, 14 nt, Human
caauuccucuggga

SEQ ID NO: 1249034 - RNA, 22 nt, Human
aucccagcacuuugggaggcug

SEQ ID NO: 1249035 - RNA, 20 nt, Human
acuucuuaggguuaugauua

SEQ ID NO: 1249036 - RNA, 21 nt, Human
aguuguugcccacagcuguau

SEQ ID NO: 1249037 - RNA, 15 nt, Human
accugggcugaggca

SEQ ID NO: 1249038 - RNA, 20 nt, Human
uauauauguauuuauaaaua

SEQ ID NO: 1249039 - RNA, 17 nt, Human
acaaguccagccuggca

SEQ ID NO: 1249040 - RNA, 22 nt, Human
ugaaacuaagauuuguaauauu

SEQ ID NO: 1249041 - RNA, 19 nt, Human
cggagccccuugggcaggu

SEQ ID NO: 1249042 - RNA, 18 nt, Human
cccucuccugggcagcug

SEQ ID NO: 1249043 - RNA, 18 nt, Human
guugaagaugcuuguauu

SEQ ID NO: 1249044 - RNA, 21 nt, Human
gauaaguaaguuugauuucau

SEQ ID NO: 1249045 - RNA, 15 nt, Human
ucccccaucucuucu

SEQ ID NO: 1249046 - RNA, 19 nt, Human
uaauacagggcauuuuggu

SEQ ID NO: 1249047 - RNA, 14 nt, Human
cccugaugaaaaca

SEQ ID NO: 1249048 - RNA, 16 nt, Human
uugcuaggucacagag

SEQ ID NO: 1249049 - RNA, 21 nt, Human
caagacugcacaucaaaauau

SEQ ID NO: 1249050 - RNA, 16 nt, Human
caugguuuagaaagcu

SEQ ID NO: 1249051 - RNA, 17 nt, Human
caagaagccacagaccu

SEQ ID NO: 1249052 - RNA, 20 nt, Human
accagccaaccugggggcuu

SEQ ID NO: 1249053 - RNA, 20 nt, Human
acaugagguacugagaguga

SEQ ID NO: 1249054 - RNA, 21 nt, Human
guccccuauccuacuuccccu

SEQ ID NO: 1249055 - RNA, 20 nt, Human
aauguuacauuauuaucaac

SEQ ID NO: 1249056 - RNA, 20 nt, Human
auagagacuuugugaaaaaa

SEQ ID NO: 1249057 - RNA, 14 nt, Human
uuaauuauuauuua

SEQ ID NO: 1249058 - RNA, 17 nt, Human
uaucuuuuuuuuaauaa

SEQ ID NO: 1249059 - RNA, 21 nt, Human
uuuguauaaaauaauuuuuau

SEQ ID NO: 1249060 - RNA, 19 nt, Human
uagcaacuuuuguguaaug

SEQ ID NO: 1249061 - RNA, 13 nt, Human
auuuauugagcac

SEQ ID NO: 1249062 - RNA, 12 nt, Human
aggcuggagugc

SEQ ID NO: 1249063 - RNA, 22 nt, Human
gccucuaaaaggccugucccug

SEQ ID NO: 1249064 - RNA, 14 nt, Human
ucuugucucugggc

SEQ ID NO: 1249065 - RNA, 14 nt, Human
uugcuggagcucug

SEQ ID NO: 1249066 - RNA, 21 nt, Human
uauguauuauuuauaauuccu

SEQ ID NO: 1249067 - RNA, 19 nt, Human
accccugagcuugcagaga

SEQ ID NO: 1249068 - RNA, 17 nt, Human
auuauaauauacuauau

SEQ ID NO: 1249069 - RNA, 14 nt, Human
ugagaaaccuuauu

SEQ ID NO: 1249070 - RNA, 23 nt, Human
uauguuaaaacugggacagggga

SEQ ID NO: 1249071 - RNA, 18 nt, Human
ccauccugccccugagcc

SEQ ID NO: 1249072 - RNA, 18 nt, Human
caagccucauguccacug

SEQ ID NO: 1249073 - RNA, 18 nt, Human
cugccuccccuccucugc

SEQ ID NO: 1249074 - RNA, 21 nt, Human
cucugcuugccaucccucccu

SEQ ID NO: 1249075 - RNA, 16 nt, Human
agcauauguuuuugua

SEQ ID NO: 1249076 - RNA, 12 nt, Human
ccaucccucccu

SEQ ID NO: 1249077 - RNA, 18 nt, Human
auagcaagugaauuuuuc

SEQ ID NO: 1249078 - RNA, 15 nt, Human
auacuguauuuuuac

SEQ ID NO: 1249079 - RNA, 19 nt, Human
gaggacuugggcgggacac

SEQ ID NO: 1249080 - RNA, 14 nt, Human
cugaggcuccacuu

SEQ ID NO: 1249081 - RNA, 18 nt, Human
guuucaaacauauauaac

SEQ ID NO: 1249082 - RNA, 20 nt, Human
uaugcuucuguuuuauaauu

SEQ ID NO: 1249083 - RNA, 11 nt, Human
ccaaggcugga

SEQ ID NO: 1249084 - RNA, 15 nt, Human
agucugaugagaacu

SEQ ID NO: 1249085 - RNA, 13 nt, Human
uauauauagaauc

SEQ ID NO: 1249086 - RNA, 19 nt, Human
uaauuccuauauccuguga

SEQ ID NO: 1249087 - RNA, 15 nt, Human
ugucaauaaaaucca

SEQ ID NO: 1249088 - RNA, 20 nt, Human
auuacauuuguauaaaauaa

SEQ ID NO: 1249089 - RNA, 20 nt, Human
aaaucucuauuaggaaauau

SEQ ID NO: 1249090 - RNA, 13 nt, Human
aucuacacuccag

SEQ ID NO: 1249091 - RNA, 14 nt, Human
cucccuuggggccu

SEQ ID NO: 1249092 - RNA, 20 nt, Human
uuaaugccacuaaauugaca

SEQ ID NO: 1249093 - RNA, 17 nt, Human
cagugcuugaaugaagu

SEQ ID NO: 1249094 - RNA, 21 nt, Human
aauuuuucucuaacucagaaa

SEQ ID NO: 1249095 - RNA, 18 nt, Human
ccuuccuaauuccacagc

SEQ ID NO: 1249096 - RNA, 20 nt, Human
uuccacagaagcuccaggua

SEQ ID NO: 1249097 - RNA, 20 nt, Human
accucccugcaauaaaaugg

SEQ ID NO: 1249098 - RNA, 21 nt, Human
aaauaauuuuuauauuugaaa

SEQ ID NO: 1249099 - RNA, 16 nt, Human
acuuuccagagaccag

SEQ ID NO: 1249100 - RNA, 13 nt, Human
acagcccuucuuu

SEQ ID NO: 1249101 - RNA, 23 nt, Human
agacagcuucucauccugcaggc

SEQ ID NO: 1249102 - RNA, 17 nt, Human
ggcuugaggacuugggc

SEQ ID NO: 1249103 - RNA, 23 nt, Human
uaauccuuuguuuucugacuaau

SEQ ID NO: 1249104 - RNA, 13 nt, Human
ucucaaaaaauaa

SEQ ID NO: 1249105 - RNA, 20 nt, Human
ugcuggauucaagugauccg

SEQ ID NO: 1249106 - RNA, 15 nt, Human
auauuuaacauuauu

SEQ ID NO: 1249107 - RNA, 12 nt, Human
uacuaaaaauac

SEQ ID NO: 1249108 - RNA, 17 nt, Human
ccuccaccuucuggguu

SEQ ID NO: 1249109 - RNA, 16 nt, Human
aguaacggaacaguau

SEQ ID NO: 1249110 - RNA, 16 nt, Human
gacaaaaacaaacaaa

SEQ ID NO: 1249111 - RNA, 13 nt, Human
uaaguuucuggga

SEQ ID NO: 1249112 - RNA, 21 nt, Human
aaaagcauuguaacuuaugaa

SEQ ID NO: 1249113 - RNA, 14 nt, Human
cucauccugcaggc

SEQ ID NO: 1249114 - RNA, 15 nt, Human
gaggucaggaguucc

SEQ ID NO: 1249115 - RNA, 16 nt, Human
cuggaucucacaagca

SEQ ID NO: 1249116 - RNA, 17 nt, Human
uuauauuugaaauauug

SEQ ID NO: 1249117 - RNA, 21 nt, Human
caacacacagauuugagcuca

SEQ ID NO: 1249118 - RNA, 20 nt, Human
ccagcuugaaaccuucacuu

SEQ ID NO: 1249119 - RNA, 15 nt, Human
uugcucauggaauug

SEQ ID NO: 1249120 - RNA, 15 nt, Human
agccucaagaugaag

SEQ ID NO: 1249121 - RNA, 22 nt, Human
aucccucccuccaccucccugc

SEQ ID NO: 1249122 - RNA, 19 nt, Human
gaauuuuuuucaucuucuc

SEQ ID NO: 1249123 - RNA, 22 nt, Human
cuccagagggaauugcagagua

SEQ ID NO: 1249124 - RNA, 15 nt, Human
ucuugagaagagaau

SEQ ID NO: 1249125 - RNA, 16 nt, Human
aauugacccacaagaa

SEQ ID NO: 1249126 - RNA, 13 nt, Human
ccuaaccagccug

SEQ ID NO: 1249127 - RNA, 13 nt, Human
gaagaacugaaau

SEQ ID NO: 1249128 - RNA, 21 nt, Human
auauuuaagauaauuauaaua

SEQ ID NO: 1249129 - RNA, 14 nt, Human
uagcauauguuuuu

SEQ ID NO: 1249130 - RNA, 16 nt, Human
uauuugaauuuuaaau

SEQ ID NO: 1249131 - RNA, 13 nt, Human
ucucccucccuug

SEQ ID NO: 1249132 - RNA, 12 nt, Human
acagagacagaa

SEQ ID NO: 1249133 - RNA, 23 nt, Human
cucugcuugccaucccucccucc

SEQ ID NO: 1249134 - RNA, 20 nt, Human
acuaaaaaggcauguaauug

SEQ ID NO: 1249135 - RNA, 21 nt, Human
ugagggcuugaggacuugggc

SEQ ID NO: 1249136 - RNA, 18 nt, Human
uugaaaaaguauaaauaa

SEQ ID NO: 1249137 - RNA, 18 nt, Human
auaauauacuauauuuau

SEQ ID NO: 1249138 - RNA, 16 nt, Human
acgccuguaaucccag

SEQ ID NO: 1249139 - RNA, 13 nt, Human
aauuucaugaaaa

SEQ ID NO: 1249140 - RNA, 15 nt, Human
aucugagccagugcu

SEQ ID NO: 1249141 - RNA, 14 nt, Human
ggcgcgugcaggca

SEQ ID NO: 1249142 - RNA, 14 nt, Human
aguucagagcugcc

SEQ ID NO: 1249143 - RNA, 18 nt, Human
uccuacaagcuaaaauua

SEQ ID NO: 1249144 - RNA, 22 nt, Human
ccaaacauccuacaagacacag

SEQ ID NO: 1249145 - RNA, 16 nt, Human
cucuuuuuagagaaau

SEQ ID NO: 1249146 - RNA, 14 nt, Human
ggccuucggccucc

SEQ ID NO: 1249147 - RNA, 23 nt, Human
cugaaaucauacuucuuaggguu

SEQ ID NO: 1249148 - RNA, 21 nt, Human
acaauuauuuuuacaguucuc

SEQ ID NO: 1249149 - RNA, 14 nt, Human
cugauuuuccugga

SEQ ID NO: 1249150 - RNA, 16 nt, Human
gaucucagaaauugua

SEQ ID NO: 1249151 - RNA, 17 nt, Human
cacuuuauauuauuuug

SEQ ID NO: 1249152 - RNA, 15 nt, Human
cucuacuaaaaauac

SEQ ID NO: 1249153 - RNA, 19 nt, Human
acuaucucauuuccaagca

SEQ ID NO: 1249154 - RNA, 15 nt, Human
auuucagaagaaauu

SEQ ID NO: 1249155 - RNA, 16 nt, Human
auauccugugacuguc

SEQ ID NO: 1249156 - RNA, 20 nt, Human
gacauaagcaaagacuauga

SEQ ID NO: 1249157 - RNA, 15 nt, Human
uaaaaugagcaaaag

SEQ ID NO: 1249158 - RNA, 10 nt, Human
ccugagcccc

SEQ ID NO: 1249159 - RNA, 17 nt, Human
ucucauccugcaggcag

SEQ ID NO: 1249160 - RNA, 14 nt, Human
gaaagcagaacagu

SEQ ID NO: 1249161 - RNA, 20 nt, Human
uuaacacaugauccugcaau

SEQ ID NO: 1249162 - RNA, 21 nt, Human
gaaagcagggacuugaaccca

SEQ ID NO: 1249163 - RNA, 15 nt, Human
ggccuccauccugag

SEQ ID NO: 1249164 - RNA, 13 nt, Human
aaaugaaagcagg

SEQ ID NO: 1249165 - RNA, 16 nt, Human
ccugcaaagcccagcu

SEQ ID NO: 1249166 - RNA, 14 nt, Human
agugugaccaggca

SEQ ID NO: 1249167 - RNA, 17 nt, Human
ucuauuaauauauguau

SEQ ID NO: 1249168 - RNA, 14 nt, Human
cuguuuuuaagcug

SEQ ID NO: 1249169 - RNA, 18 nt, Human
uuccugagaccagccaac

SEQ ID NO: 1249170 - RNA, 15 nt, Human
uggcaguuuuccauu

SEQ ID NO: 1249171 - RNA, 21 nt, Human
cuuugaaaaaguauaaauaaa

SEQ ID NO: 1249172 - RNA, 16 nt, Human
augacuaaaaaacaaa

SEQ ID NO: 1249173 - RNA, 22 nt, Human
gggacaguuccugagaccagcc

SEQ ID NO: 1249174 - RNA, 13 nt, Human
uuaguguacauga

SEQ ID NO: 1249175 - RNA, 20 nt, Human
gauugugccccugcacucca

SEQ ID NO: 1249176 - RNA, 18 nt, Human
cccugaccucccucuaau

SEQ ID NO: 1249177 - RNA, 18 nt, Human
aaaucuauuuauuaauau

SEQ ID NO: 1249178 - RNA, 21 nt, Human
aaacaucaguuacucugaagg

SEQ ID NO: 1249179 - RNA, 16 nt, Human
aauaaagaauuuuaaa

SEQ ID NO: 1249180 - RNA, 18 nt, Human
ucaauacuucauuuaaaa

SEQ ID NO: 1249181 - RNA, 17 nt, Human
auaagggaggaaaaaaa

SEQ ID NO: 1249182 - RNA, 15 nt, Human
aaauaaguauuuaua

SEQ ID NO: 1249183 - RNA, 13 nt, Human
uagucuuauaaua

SEQ ID NO: 1249184 - RNA, 19 nt, Human
auuaucuaucuaucuauuu

SEQ ID NO: 1249185 - RNA, 21 nt, Human
caauucuauuacgugcaauac

SEQ ID NO: 1249186 - RNA, 22 nt, Human
aauaguucaaagccaaguuuau

SEQ ID NO: 1249187 - RNA, 23 nt, Human
cuuuggcaaaugagccggagccc

SEQ ID NO: 1249188 - RNA, 22 nt, Human
cugagcagugcuugaaugaagu

SEQ ID NO: 1249189 - RNA, 21 nt, Human
uugccaaggcuggagugcagu

SEQ ID NO: 1249190 - RNA, 19 nt, Human
cuugccaucccucccucca

SEQ ID NO: 1249191 - RNA, 16 nt, Human
cugaucaccugcccug

SEQ ID NO: 1249192 - RNA, 16 nt, Human
agacaaauucuguuuc

SEQ ID NO: 1249193 - RNA, 23 nt, Human
ucuggcacuugggacaaaaacaa

SEQ ID NO: 1249194 - RNA, 14 nt, Human
augcuguauucuuc

SEQ ID NO: 1249195 - RNA, 16 nt, Human
cuguacuccagccugg

SEQ ID NO: 1249196 - RNA, 23 nt, Human
cuaaguugcaccaacuuugaagu

SEQ ID NO: 1249197 - RNA, 17 nt, Human
agacgggguuugccaug

SEQ ID NO: 1249198 - RNA, 19 nt, Human
ccugccuaagugcagcccc

SEQ ID NO: 1249199 - RNA, 15 nt, Human
cucccugccccccag

SEQ ID NO: 1249200 - RNA, 22 nt, Human
ugaauuuuuuucaucuucucug

SEQ ID NO: 1249201 - RNA, 23 nt, Human
caauuauaagcuguuuuuauaua

SEQ ID NO: 1249202 - RNA, 21 nt, Human
auggcagcuuuccucaaaacu

SEQ ID NO: 1249203 - RNA, 16 nt, Human
uguauuauuuauaauu

SEQ ID NO: 1249204 - RNA, 19 nt, Human
ccaaucauuuuaauuauua

SEQ ID NO: 1249205 - RNA, 17 nt, Human
uuuauuacaucuuucac

SEQ ID NO: 1249206 - RNA, 16 nt, Human
uggcaagcucuaucac

SEQ ID NO: 1249207 - RNA, 16 nt, Human
cuggcaguuuuccauu

SEQ ID NO: 1249208 - RNA, 18 nt, Human
uuuguuaaaugauuucau

SEQ ID NO: 1249209 - RNA, 16 nt, Human
ucucuauuaggaaaua

SEQ ID NO: 1249210 - RNA, 19 nt, Human
gaauuacaggcgugagcca

SEQ ID NO: 1249211 - RNA, 17 nt, Human
ucuagguucuaaaaauu

SEQ ID NO: 1249212 - RNA, 21 nt, Human
uguuuuaagauaaauuauaag

SEQ ID NO: 1249213 - RNA, 13 nt, Human
ucccucccuccac

SEQ ID NO: 1249214 - RNA, 16 nt, Human
uguucuaagaagugaa

SEQ ID NO: 1249215 - RNA, 17 nt, Human
uggcgcaaucuuaacuc

SEQ ID NO: 1249216 - RNA, 15 nt, Human
aagucugauuuuccu

SEQ ID NO: 1249217 - RNA, 23 nt, Human
ugcagagguccacaacacacaga

SEQ ID NO: 1249218 - RNA, 16 nt, Human
auggagguuaagcacu

SEQ ID NO: 1249219 - RNA, 21 nt, Human
uuacaggcgugagccaccaaa

SEQ ID NO: 1249220 - RNA, 15 nt, Human
ucuuauagaauauuu

SEQ ID NO: 1249221 - RNA, 15 nt, Human
caauaaaauggguuu

SEQ ID NO: 1249222 - RNA, 16 nt, Human
cauaauguuacauuau

SEQ ID NO: 1249223 - RNA, 16 nt, Human
gucucccaaagugcug

SEQ ID NO: 1249224 - RNA, 19 nt, Human
cuuuuuuuuuuuuuuaaac

SEQ ID NO: 1249225 - RNA, 13 nt, Human
acacacaugaagu

SEQ ID NO: 1249226 - RNA, 19 nt, Human
ugcaccaacuuugaagucu

SEQ ID NO: 1249227 - RNA, 14 nt, Human
cuuggucugugaga

SEQ ID NO: 1249228 - RNA, 14 nt, Human
gcugcaaaauguua

SEQ ID NO: 1249229 - RNA, 21 nt, Human
cgacagugagacucugucuca

SEQ ID NO: 1249230 - RNA, 15 nt, Human
uuccuucucaucugu

SEQ ID NO: 1249231 - RNA, 18 nt, Human
ggaggacgcucucuggcc

SEQ ID NO: 1249232 - RNA, 23 nt, Human
gcugucuauguggcuguaucuug

SEQ ID NO: 1249233 - RNA, 15 nt, Human
gccagugucaggagg

SEQ ID NO: 1249234 - RNA, 18 nt, Human
uuuauggcacuaguauuu

SEQ ID NO: 1249235 - RNA, 23 nt, Human
ucacaccaggcuugccugcaggc

SEQ ID NO: 1249236 - RNA, 14 nt, Human
ccagccagcaguuc

SEQ ID NO: 1249237 - RNA, 20 nt, Human
uacugccgguuugaaaauau

SEQ ID NO: 1249238 - RNA, 12 nt, Human
ggcugaugcagu

SEQ ID NO: 1249239 - RNA, 17 nt, Human
caauuauaucaguccuc

SEQ ID NO: 1249240 - RNA, 21 nt, Human
augaggcauuugcagcugugc

SEQ ID NO: 1249241 - RNA, 18 nt, Human
acagaaagcagaacagug

SEQ ID NO: 1249242 - RNA, 19 nt, Human
ugcacacagcacgggggcc

SEQ ID NO: 1249243 - RNA, 15 nt, Human
uuuuaagauaaauua

SEQ ID NO: 1249244 - RNA, 16 nt, Human
acuacuuuaaaaaaaa

SEQ ID NO: 1249245 - RNA, 20 nt, Human
ugauuuuacaauugaaauga

SEQ ID NO: 1249246 - RNA, 21 nt, Human
guuugccaugcuggccaggcu

SEQ ID NO: 1249247 - RNA, 16 nt, Human
caaauuccagaaugau

SEQ ID NO: 1249248 - RNA, 15 nt, Human
auguuguuauuuaaa

SEQ ID NO: 1249249 - RNA, 12 nt, Human
acaagaaaugaa

SEQ ID NO: 1249250 - RNA, 12 nt, Human
ugaugaaaacau

SEQ ID NO: 1249251 - RNA, 15 nt, Human
uggaguaaaucgcua

SEQ ID NO: 1249252 - RNA, 18 nt, Human
ugaucagaccauaauguu

SEQ ID NO: 1249253 - RNA, 17 nt, Human
uaauuuuuauauuugaa

SEQ ID NO: 1249254 - RNA, 15 nt, Human
cacuuuaacacagug

SEQ ID NO: 1249255 - RNA, 14 nt, Human
accaggcauccucc

SEQ ID NO: 1249256 - RNA, 13 nt, Human
uuauaauauacua

SEQ ID NO: 1249257 - RNA, 22 nt, Human
cugaggcauccuuccucacacc

SEQ ID NO: 1249258 - RNA, 13 nt, Human
aauuaaucuugua

SEQ ID NO: 1249259 - RNA, 14 nt, Human
aaucucaauauuuc

SEQ ID NO: 1249260 - RNA, 21 nt, Human
aaaucuauuuauuaauauuua

SEQ ID NO: 1249261 - RNA, 20 nt, Human
auaucaguccucuuucaaag

SEQ ID NO: 1249262 - RNA, 17 nt, Human
gucacacaaccuguccc

SEQ ID NO: 1249263 - RNA, 16 nt, Human
ggaugccccguccccc

SEQ ID NO: 1249264 - RNA, 14 nt, Human
aucaugcaucuuac

SEQ ID NO: 1249265 - RNA, 21 nt, Human
cuaaaucuauuuauuaauauu

SEQ ID NO: 1249266 - RNA, 16 nt, Human
ugaaguacucauacau

SEQ ID NO: 1249267 - RNA, 22 nt, Human
gagccucagucucccucccuug

SEQ ID NO: 1249268 - RNA, 13 nt, Human
auagcauauguuu

SEQ ID NO: 1249269 - RNA, 12 nt, Human
uugggaggcuga

SEQ ID NO: 1249270 - RNA, 20 nt, Human
auucccagccagcacagccu

SEQ ID NO: 1249271 - RNA, 20 nt, Human
gacauuugcucauggaauug

SEQ ID NO: 1249272 - RNA, 18 nt, Human
ccugcuggauguggaggg

SEQ ID NO: 1249273 - RNA, 20 nt, Human
ugcauugagaacugcauaug

SEQ ID NO: 1249274 - RNA, 14 nt, Human
uuuuaauuuugaau

SEQ ID NO: 1249275 - RNA, 17 nt, Human
ugcacaucaaaauaugc

SEQ ID NO: 1249276 - RNA, 15 nt, Human
agaauuaauggaaua

SEQ ID NO: 1249277 - RNA, 20 nt, Human
ugauccgcccaucuccgucu

SEQ ID NO: 1249278 - RNA, 23 nt, Human
ccuucauccucugagugugacca

SEQ ID NO: 1249279 - RNA, 21 nt, Human
auuuuuaaauaaagaauuuua

SEQ ID NO: 1249280 - RNA, 21 nt, Human
uuucaaaaucaaauuccagaa

SEQ ID NO: 1249281 - RNA, 22 nt, Human
auuucugugggagaauucuuac

SEQ ID NO: 1249282 - RNA, 19 nt, Human
auuuacagagacagaaagc

SEQ ID NO: 1249283 - RNA, 15 nt, Human
acuuuccagagacca

SEQ ID NO: 1249284 - RNA, 16 nt, Human
cuuuaacacagugucu

SEQ ID NO: 1249285 - RNA, 18 nt, Human
uaugugauguggcaaauc

SEQ ID NO: 1249286 - RNA, 14 nt, Human
uagggaccugcugu

SEQ ID NO: 1249287 - RNA, 20 nt, Human
ccacauggcuucaccugucc

SEQ ID NO: 1249288 - RNA, 21 nt, Human
uuuucucuaacucagaaacau

SEQ ID NO: 1249289 - RNA, 13 nt, Human
aucucaauauuuc

SEQ ID NO: 1249290 - RNA, 15 nt, Human
auuuacugagcuucu

SEQ ID NO: 1249291 - RNA, 14 nt, Human
ugcucauggaauug

SEQ ID NO: 1249292 - RNA, 12 nt, Human
cuggcuccagcu

SEQ ID NO: 1249293 - RNA, 18 nt, Human
gaggcugaggcgggugga

SEQ ID NO: 1249294 - RNA, 21 nt, Human
ggggagccaacagaagcuucc

SEQ ID NO: 1249295 - RNA, 18 nt, Human
cuuuuuuuuuuuuuuaaa

SEQ ID NO: 1249296 - RNA, 19 nt, Human
augaauuacauuuguauaa

SEQ ID NO: 1249297 - RNA, 15 nt, Human
gccucagucucccuc

SEQ ID NO: 1249298 - RNA, 16 nt, Human
auaauuauaauauacu

SEQ ID NO: 1249299 - RNA, 22 nt, Human
ugaccauacuaauuauaccccc

SEQ ID NO: 1249300 - RNA, 14 nt, Human
aaauuccagaauga

SEQ ID NO: 1249301 - RNA, 22 nt, Human
uuuaauaauguuucaaacauau

SEQ ID NO: 1249302 - RNA, 16 nt, Human
gauaaacucagaaauu

SEQ ID NO: 1249303 - RNA, 21 nt, Human
auuaucuaucuaucuauuuau

SEQ ID NO: 1249304 - RNA, 14 nt, Human
acaucuuucacauu

SEQ ID NO: 1249305 - RNA, 19 nt, Human
agucaaauugugugaaagg

SEQ ID NO: 1249306 - RNA, 20 nt, Human
ccagugagacagcucugcau

SEQ ID NO: 1249307 - RNA, 22 nt, Human
caaaaacaaacaaacgaaaaac

SEQ ID NO: 1249308 - RNA, 22 nt, Human
aaagggucucccucuguugcca

SEQ ID NO: 1249309 - RNA, 22 nt, Human
cuuaccugggcauucuuguuuc

SEQ ID NO: 1249310 - RNA, 15 nt, Human
aguucugaagaagau

SEQ ID NO: 1249311 - RNA, 10 nt, Human
uauaacucau

SEQ ID NO: 1249312 - RNA, 14 nt, Human
gccgggcauggugg

SEQ ID NO: 1249313 - RNA, 13 nt, Human
agacagcucugca

SEQ ID NO: 1249314 - RNA, 23 nt, Human
ucggccuccauccugaggcucca

SEQ ID NO: 1249315 - RNA, 17 nt, Human
auuuguuaaaauuauca

SEQ ID NO: 1249316 - RNA, 20 nt, Human
acaagacacagugaccauac

SEQ ID NO: 1249317 - RNA, 16 nt, Human
cagacaugagagacag

SEQ ID NO: 1249318 - RNA, 20 nt, Human
uccccaaaaagaaugggaug

SEQ ID NO: 1249319 - RNA, 22 nt, Human
auuaugaucucagaaauuguau

SEQ ID NO: 1249320 - RNA, 20 nt, Human
agauuuuuaaauaaagaauu

SEQ ID NO: 1249321 - RNA, 17 nt, Human
gugacuguacccaaaug

SEQ ID NO: 1249322 - RNA, 19 nt, Human
acagugauuaccagggacu

SEQ ID NO: 1249323 - RNA, 20 nt, Human
cuacuuccccuuccuaauuc

SEQ ID NO: 1249324 - RNA, 16 nt, Human
ggcagagagguaggga

SEQ ID NO: 1249325 - RNA, 20 nt, Human
ucaugcaaaugcuguauucu

SEQ ID NO: 1249326 - RNA, 21 nt, Human
cacuugaacccgggaggcaga

SEQ ID NO: 1249327 - RNA, 22 nt, Human
uagcaguugaaacaagaagcca

SEQ ID NO: 1249328 - RNA, 22 nt, Human
ccagcaaauucgcugcaaccug

SEQ ID NO: 1249329 - RNA, 14 nt, Human
aauggcuaagcaaa

SEQ ID NO: 1249330 - RNA, 22 nt, Human
uagacacacaugaaguccaagc

SEQ ID NO: 1249331 - RNA, 15 nt, Human
auguguggcauuuuc

SEQ ID NO: 1249332 - RNA, 21 nt, Human
cuugaggacuugggcgggaca

SEQ ID NO: 1249333 - RNA, 13 nt, Human
acacagugucugg

SEQ ID NO: 1249334 - RNA, 20 nt, Human
uuaugugcaauaaaauguau

SEQ ID NO: 1249335 - RNA, 19 nt, Human
cuggacucaccucccccau

SEQ ID NO: 1249336 - RNA, 18 nt, Human
caagugauccgcccaucu

SEQ ID NO: 1249337 - RNA, 14 nt, Human
gccugcaauauuug

SEQ ID NO: 1249338 - RNA, 19 nt, Human
auauuuaacauuauuuaua

SEQ ID NO: 1249339 - RNA, 15 nt, Human
agaauuuuaaaacuc

SEQ ID NO: 1249340 - RNA, 14 nt, Human
cucuaggacauaaa

SEQ ID NO: 1249341 - RNA, 13 nt, Human
cccuccuuaucaa

SEQ ID NO: 1249342 - RNA, 17 nt, Human
agcugccuccccuccuc

SEQ ID NO: 1249343 - RNA, 12 nt, Human
agaccagccaac

SEQ ID NO: 1249344 - RNA, 15 nt, Human
gagauuccugagcca

SEQ ID NO: 1249345 - RNA, 14 nt, Human
auagagugggacag

SEQ ID NO: 1249346 - RNA, 14 nt, Human
uaucauuuucaaaa

SEQ ID NO: 1249347 - RNA, 13 nt, Human
caacucccugccc

SEQ ID NO: 1249348 - RNA, 19 nt, Human
aguucagagcugcccucuc

SEQ ID NO: 1249349 - RNA, 16 nt, Human
accuguaaucauauaa

SEQ ID NO: 1249350 - RNA, 14 nt, Human
acaggcgugagcca

SEQ ID NO: 1249351 - RNA, 14 nt, Human
ucccuccaccuccc

SEQ ID NO: 1249352 - RNA, 22 nt, Human
aaacauuucaaaagguauuuau

SEQ ID NO: 1249353 - RNA, 18 nt, Human
caaggcugauuaaaccaa

SEQ ID NO: 1249354 - RNA, 19 nt, Human
acaguuagagauuuuuaaa

SEQ ID NO: 1249355 - RNA, 20 nt, Human
uagauaaacucagaaauuua

SEQ ID NO: 1249356 - RNA, 23 nt, Human
caugcugucuacacuaagagaga

SEQ ID NO: 1249357 - RNA, 17 nt, Human
cauucaaaaguugaaau

SEQ ID NO: 1249358 - RNA, 23 nt, Human
aauagcagacaguguuuucuggg

SEQ ID NO: 1249359 - RNA, 13 nt, Human
auuuauugcugaa

SEQ ID NO: 1249360 - RNA, 16 nt, Human
agguugcagugagccg

SEQ ID NO: 1249361 - RNA, 20 nt, Human
auugaaucccuuaaacucag

SEQ ID NO: 1249362 - RNA, 21 nt, Human
ccaaucauuuuaauuauuauu

SEQ ID NO: 1249363 - RNA, 14 nt, Human
gagagugaacaaau

SEQ ID NO: 1249364 - RNA, 11 nt, Human
cagcaguucag

SEQ ID NO: 1249365 - RNA, 22 nt, Human
aguugguaucaaccaaauggag

SEQ ID NO: 1249366 - RNA, 17 nt, Human
aaugacuaaaaaacaaa

SEQ ID NO: 1249367 - RNA, 18 nt, Human
uuacuguaagaaaauauc

SEQ ID NO: 1249368 - RNA, 16 nt, Human
auccuugaagauuuac

SEQ ID NO: 1249369 - RNA, 16 nt, Human
cuagaaccaccugccu

SEQ ID NO: 1249370 - RNA, 15 nt, Human
auuugaguguuuuaa

SEQ ID NO: 1249371 - RNA, 14 nt, Human
aauaucuauuaaua

SEQ ID NO: 1249372 - RNA, 22 nt, Human
gaggggagcaugggaagugacg

SEQ ID NO: 1249373 - RNA, 19 nt, Human
ugauuacaaggcuuuaucu

SEQ ID NO: 1249374 - RNA, 12 nt, Human
auaaaaauaaau

SEQ ID NO: 1249375 - RNA, 20 nt, Human
cugaagaguggguuucacaa

SEQ ID NO: 1249376 - RNA, 23 nt, Human
cuuaagaagacugcauuauauuu

SEQ ID NO: 1249377 - RNA, 16 nt, Human
uaugaaccuuuacauc

SEQ ID NO: 1249378 - RNA, 19 nt, Human
aaugaauggcuaagcaaaa

SEQ ID NO: 1249379 - RNA, 18 nt, Human
ucauuauugguugggcug

SEQ ID NO: 1249380 - RNA, 15 nt, Human
cacuuggucugugag

SEQ ID NO: 1249381 - RNA, 17 nt, Human
uguuaucagucauaacu

SEQ ID NO: 1249382 - RNA, 16 nt, Human
uucuggguucaagcga

SEQ ID NO: 1249383 - RNA, 15 nt, Human
ccucagucucccucc

SEQ ID NO: 1249384 - RNA, 15 nt, Human
uauuuauuaauauuu

SEQ ID NO: 1249385 - RNA, 18 nt, Human
uauuuugcauaguaccaa

SEQ ID NO: 1249386 - RNA, 14 nt, Human
auugucuagugaaa

SEQ ID NO: 1249387 - RNA, 19 nt, Human
ggagccugaucaccugccc

SEQ ID NO: 1249388 - RNA, 15 nt, Human
ugauuucauucaaua

SEQ ID NO: 1249389 - RNA, 16 nt, Human
gaagauguagaggaga

SEQ ID NO: 1249390 - RNA, 14 nt, Human
auuauaauauacua

SEQ ID NO: 1249391 - RNA, 19 nt, Human
accugucccagcgagggac

SEQ ID NO: 1249392 - RNA, 14 nt, Human
uucacaagugaaaa

SEQ ID NO: 1249393 - RNA, 16 nt, Human
gucuaucuuugagcgc

SEQ ID NO: 1249394 - RNA, 13 nt, Human
gcgggacacaggc

SEQ ID NO: 1249395 - RNA, 21 nt, Human
ccuccaccucccugcaauaaa

SEQ ID NO: 1249396 - RNA, 16 nt, Human
accucaagccagccuu

SEQ ID NO: 1249397 - RNA, 21 nt, Human
accagggccuggcugggagug

SEQ ID NO: 1249398 - RNA, 12 nt, Human
caggacagcccu

SEQ ID NO: 1249399 - RNA, 18 nt, Human
gacuauuauagaauggaa

SEQ ID NO: 1249400 - RNA, 16 nt, Human
cuguaucuuguuuuuc

SEQ ID NO: 1249401 - RNA, 22 nt, Human
uauaagcuguuuuuauauaugu

SEQ ID NO: 1249402 - RNA, 19 nt, Human
uggaaauguuuacagaucc

SEQ ID NO: 1249403 - RNA, 22 nt, Human
uucuaauagaacucaguuuuaa

SEQ ID NO: 1249404 - RNA, 15 nt, Human
acaggguuuauguuu

SEQ ID NO: 1249405 - RNA, 17 nt, Human
aauguaucuuauucaca

SEQ ID NO: 1249406 - RNA, 22 nt, Human
acacagugucuggcacuuggga

SEQ ID NO: 1249407 - RNA, 21 nt, Human
gcaaaauuuuuucucuaggaa

SEQ ID NO: 1249408 - RNA, 23 nt, Human
cacagauuugagcucagcccugg

SEQ ID NO: 1249409 - RNA, 21 nt, Human
aggguuaugauuaaguaauga

SEQ ID NO: 1249410 - RNA, 16 nt, Human
uuaaauauaauaugca

SEQ ID NO: 1249411 - RNA, 22 nt, Human
gcgacaguuuuccuucucaucu

SEQ ID NO: 1249412 - RNA, 16 nt, Human
cuggacuuuccagaga

SEQ ID NO: 1249413 - RNA, 20 nt, Human
uauuagcuuuacuguuuguu

SEQ ID NO: 1249414 - RNA, 13 nt, Human
aagcuguggccag

SEQ ID NO: 1249415 - RNA, 18 nt, Human
acugggguggguggggca

SEQ ID NO: 1249416 - RNA, 14 nt, Human
uaacucagaaacau

SEQ ID NO: 1249417 - RNA, 17 nt, Human
ugacagcccaagggugg

SEQ ID NO: 1249418 - RNA, 19 nt, Human
agggaauugcagaguacug

SEQ ID NO: 1249419 - RNA, 20 nt, Human
auauuuuauaucaauuuaaa

SEQ ID NO: 1249420 - RNA, 18 nt, Human
uaaauugacacuuaaaaa

SEQ ID NO: 1249421 - RNA, 17 nt, Human
aauuugguucuaggccg

SEQ ID NO: 1249422 - RNA, 17 nt, Human
agagacagaaagcagaa

SEQ ID NO: 1249423 - RNA, 20 nt, Human
acaguggaaagacagcuucu

SEQ ID NO: 1249424 - RNA, 15 nt, Human
uuaauuuguaguguu

SEQ ID NO: 1249425 - RNA, 14 nt, Human
gcugccuccccucc

SEQ ID NO: 1249426 - RNA, 17 nt, Human
gccuaagugcagccccg

SEQ ID NO: 1249427 - RNA, 15 nt, Human
aagugaaaaucuaca

SEQ ID NO: 1249428 - RNA, 17 nt, Human
uguaaugaaaaugaaua

SEQ ID NO: 1249429 - RNA, 16 nt, Human
caaccacuucauucuu

SEQ ID NO: 1249430 - RNA, 16 nt, Human
uccucacaccaggcuu

SEQ ID NO: 1249431 - RNA, 19 nt, Human
aaccaaauuuguauuuaag

SEQ ID NO: 1249432 - RNA, 13 nt, Human
cucaaaaaauaaa

SEQ ID NO: 1249433 - RNA, 20 nt, Human
uaccaacagugagagcccuu

SEQ ID NO: 1249434 - RNA, 15 nt, Human
caagcucacagaccu

SEQ ID NO: 1249435 - RNA, 15 nt, Human
caaaaaccaaauuug

SEQ ID NO: 1249436 - RNA, 18 nt, Human
aaaggcauucucugaaga

SEQ ID NO: 1249437 - RNA, 20 nt, Human
accuuuugcuguggcaaaug

SEQ ID NO: 1249438 - RNA, 22 nt, Human
ugcaauaaaauggguuuuacug

SEQ ID NO: 1249439 - RNA, 23 nt, Human
aaauuaucaauaucuaauauaua

SEQ ID NO: 1249440 - RNA, 15 nt, Human
augagaccacuguua

SEQ ID NO: 1249441 - RNA, 23 nt, Human
ggcgacucuauagacucuaggac

SEQ ID NO: 1249442 - RNA, 12 nt, Human
ucacauacaauu

SEQ ID NO: 1249443 - RNA, 17 nt, Human
auuauuuauauauguau

SEQ ID NO: 1249444 - RNA, 19 nt, Human
ccccuauccuacuuccccu

SEQ ID NO: 1249445 - RNA, 17 nt, Human
cccaaagugcugggaau

SEQ ID NO: 1249446 - RNA, 12 nt, Human
uguuuuucacau

SEQ ID NO: 1249447 - RNA, 20 nt, Human
uacaguuagagauuuuuaaa

SEQ ID NO: 1249448 - RNA, 14 nt, Human
gccuccccuccucu

SEQ ID NO: 1249449 - RNA, 16 nt, Human
agugagacagcucugc

SEQ ID NO: 1249450 - RNA, 13 nt, Human
uuccccuaaccuc

SEQ ID NO: 1249451 - RNA, 15 nt, Human
auccuaauaaaaagg

SEQ ID NO: 1249452 - RNA, 12 nt, Human
uguaaauagaaa

SEQ ID NO: 1249453 - RNA, 14 nt, Human
auagcaucucagga

SEQ ID NO: 1249454 - RNA, 10 nt, Human
aaaauguaau

SEQ ID NO: 1249455 - RNA, 15 nt, Human
aaaaaagaaacauuu

SEQ ID NO: 1249456 - RNA, 12 nt, Human
ggaggcugagau

SEQ ID NO: 1249457 - RNA, 19 nt, Human
gagacuuugugaaaaaaaa

SEQ ID NO: 1249458 - RNA, 17 nt, Human
acuuuuaaguugcugau

SEQ ID NO: 1249459 - RNA, 13 nt, Human
aagacucugucuc

SEQ ID NO: 1249460 - RNA, 15 nt, Human
uauuagccacaaaau

SEQ ID NO: 1249461 - RNA, 20 nt, Human
aacaaugcuguauuuuaaaa

SEQ ID NO: 1249462 - RNA, 21 nt, Human
uauauauguauuuauaaauau

SEQ ID NO: 1249463 - RNA, 21 nt, Human
uccucugcuugccaucccucc

SEQ ID NO: 1249464 - RNA, 21 nt, Human
guuugacaagguucuucccuu

SEQ ID NO: 1249465 - RNA, 12 nt, Human
ggggcucuggga

SEQ ID NO: 1249466 - RNA, 22 nt, Human
auuuuaauuuugaauaaauaaa

SEQ ID NO: 1249467 - RNA, 18 nt, Human
aggugacccugaugaaaa

SEQ ID NO: 1249468 - RNA, 19 nt, Human
gauuuuacaauugaaauga

SEQ ID NO: 1249469 - RNA, 22 nt, Human
ccucuaauuuaucuugucucug

SEQ ID NO: 1249470 - RNA, 10 nt, Human
gcuugccauc

SEQ ID NO: 1249471 - RNA, 19 nt, Human
uguaguguuggagaagaac

SEQ ID NO: 1249472 - RNA, 22 nt, Human
ccucuccugggcagcugccucc

SEQ ID NO: 1249473 - RNA, 20 nt, Human
auuuuuaaauaaagaauuuu

SEQ ID NO: 1249474 - RNA, 11 nt, Human
aagccaaaaac

SEQ ID NO: 1249475 - RNA, 13 nt, Human
ucaucauaaaaua

SEQ ID NO: 1249476 - RNA, 13 nt, Human
ucuaagaagugaa

SEQ ID NO: 1249477 - RNA, 17 nt, Human
auauuugaaauauugac

SEQ ID NO: 1249478 - RNA, 12 nt, Human
agcccaauauua

SEQ ID NO: 1249479 - RNA, 18 nt, Human
uuccauagagacuuugug

SEQ ID NO: 1249480 - RNA, 23 nt, Human
ccagcacuuugggaggcugaggc

SEQ ID NO: 1249481 - RNA, 21 nt, Human
cugggauagcugacccagccc

SEQ ID NO: 1249482 - RNA, 21 nt, Human
aauuuuuauauuugaaauauu

SEQ ID NO: 1249483 - RNA, 21 nt, Human
aagaagcccaauauuauaauu

SEQ ID NO: 1249484 - RNA, 18 nt, Human
ucucaaaaaauaaaaaua

SEQ ID NO: 1249485 - RNA, 22 nt, Human
auugacuauuauagaauggaac

SEQ ID NO: 1249486 - RNA, 15 nt, Human
uugaaauagugucug

SEQ ID NO: 1249487 - RNA, 18 nt, Human
gaacucugagcagugcuu

SEQ ID NO: 1249488 - RNA, 19 nt, Human
gacagucaccucauggaau

SEQ ID NO: 1249489 - RNA, 16 nt, Human
aagggaggaaaaaaaa

SEQ ID NO: 1249490 - RNA, 16 nt, Human
gacauagaauuaacac

SEQ ID NO: 1249491 - RNA, 23 nt, Human
uaguaccaaucauuuuaauuauu

SEQ ID NO: 1249492 - RNA, 20 nt, Human
uugaacccgggaggcagagg

SEQ ID NO: 1249493 - RNA, 21 nt, Human
aggguucaccugggcugaggc

SEQ ID NO: 1249494 - RNA, 22 nt, Human
uccaaacagaacuauggaaaaa

SEQ ID NO: 1249495 - RNA, 12 nt, Human
uuaauaaaccau

SEQ ID NO: 1249496 - RNA, 17 nt, Human
auaaaguacaagagcuu

SEQ ID NO: 1249497 - RNA, 22 nt, Human
auaacaaugcuguauuuuaaaa

SEQ ID NO: 1249498 - RNA, 24 nt, Human
accugcuguuuccuagcgcagcca

SEQ ID NO: 1249499 - RNA, 17 nt, Human
agcauuuauaaauggac

SEQ ID NO: 1249500 - RNA, 21 nt, Human
acuaagauuuguaauauuucu

SEQ ID NO: 1249501 - RNA, 13 nt, Human
cugcacuccagcc

SEQ ID NO: 1249502 - RNA, 23 nt, Human
aauauugcaaggcaaagacuauu

SEQ ID NO: 1249503 - RNA, 21 nt, Human
gagggaauaauaccuaagccu

SEQ ID NO: 1249504 - RNA, 17 nt, Human
caaaauuggacuuaaaa

SEQ ID NO: 1249505 - RNA, 17 nt, Human
uuagcuuuacuguuugu

SEQ ID NO: 1249506 - RNA, 15 nt, Human
uguuacauuauuauc

SEQ ID NO: 1249507 - RNA, 19 nt, Human
uggguuucacaagugaaaa

SEQ ID NO: 1249508 - RNA, 19 nt, Human
uccagccuggcaaggguuc

SEQ ID NO: 1249509 - RNA, 20 nt, Human
uguauuuguuuguauuuugu

SEQ ID NO: 1249510 - RNA, 17 nt, Human
ugaucaccugcccugcu

SEQ ID NO: 1249511 - RNA, 15 nt, Human
auaucaauuuaaaaa

SEQ ID NO: 1249512 - RNA, 15 nt, Human
gggcuugaggacuug

SEQ ID NO: 1249513 - RNA, 14 nt, Human
gcaaagcccagcuu

SEQ ID NO: 1249514 - RNA, 19 nt, Human
ugagcaccugcaggcguga

SEQ ID NO: 1249515 - RNA, 17 nt, Human
augcuggccaggcuggu

SEQ ID NO: 1249516 - RNA, 18 nt, Human
uuuuauaucaauuuaaaa

SEQ ID NO: 1249517 - RNA, 22 nt, Human
ucuccugggcagcugccucccc

SEQ ID NO: 1249518 - RNA, 15 nt, Human
cucguggaacaguua

SEQ ID NO: 1249519 - RNA, 20 nt, Human
ugcauacaguaauuuuaagu

SEQ ID NO: 1249520 - RNA, 17 nt, Human
ucuuauagaauauuuau

SEQ ID NO: 1249521 - RNA, 14 nt, Human
ggcagcugccuccc

SEQ ID NO: 1249522 - RNA, 19 nt, Human
aauagcauaaguuucuggg

SEQ ID NO: 1249523 - RNA, 22 nt, Human
accaaucaugaauuaguuuuau

SEQ ID NO: 1249524 - RNA, 11 nt, Human
gccaugggaca

SEQ ID NO: 1249525 - RNA, 13 nt, Human
aagauuuguaaua

SEQ ID NO: 1249526 - RNA, 21 nt, Human
uuuuaaguaauuucagaagaa

SEQ ID NO: 1249527 - RNA, 22 nt, Human
cgcaccuguaaucccagcuacu

SEQ ID NO: 1249528 - RNA, 22 nt, Human
cucuccugggcagcugccuccc

SEQ ID NO: 1249529 - RNA, 19 nt, Human
gagccucagucucccuccc

SEQ ID NO: 1249530 - RNA, 23 nt, Human
cuaguaauuggaaaggcagcucu

SEQ ID NO: 1249531 - RNA, 13 nt, Human
aaagccaaaaacc

SEQ ID NO: 1249532 - RNA, 17 nt, Human
augcauacaguaauuuu

SEQ ID NO: 1249533 - RNA, 20 nt, Human
agcugcccucuccugggcag

SEQ ID NO: 1249534 - RNA, 13 nt, Human
uuuucaauauuua

SEQ ID NO: 1249535 - RNA, 14 nt, Human
auccagaaauaaug

SEQ ID NO: 1249536 - RNA, 14 nt, Human
gccccgggaguggc

SEQ ID NO: 1249537 - RNA, 22 nt, Human
cugucuggacuuuccagagacc

SEQ ID NO: 1249538 - RNA, 19 nt, Human
gauccgcccaucuccgucu

SEQ ID NO: 1249539 - RNA, 20 nt, Human
auuaaggcauaagaaaacua

SEQ ID NO: 1249540 - RNA, 14 nt, Human
cagcagagacgggg

SEQ ID NO: 1249541 - RNA, 15 nt, Human
acaagacccaaaagg

SEQ ID NO: 1249542 - RNA, 20 nt, Human
aggcugagaugggagaauca

SEQ ID NO: 1249543 - RNA, 22 nt, Human
augugcaauaugugauguggca

SEQ ID NO: 1249544 - RNA, 22 nt, Human
agaggauguguggcauuuucac

SEQ ID NO: 1249545 - RNA, 19 nt, Human
aaauggugaaaugcagagu

SEQ ID NO: 1249546 - RNA, 16 nt, Human
cugauggguuucucca

SEQ ID NO: 1249547 - RNA, 18 nt, Human
acauguuacaacacggac

SEQ ID NO: 1249548 - RNA, 11 nt, Human
cuuugccuuua

SEQ ID NO: 1249549 - RNA, 12 nt, Human
acacuuaaaaau

SEQ ID NO: 1249550 - RNA, 16 nt, Human
cagcugccuccccucc

SEQ ID NO: 1249551 - RNA, 18 nt, Human
auuuauuuacugagcuuc

SEQ ID NO: 1249552 - RNA, 22 nt, Human
ggguuccuuccucugagccuug

SEQ ID NO: 1249553 - RNA, 21 nt, Human
uaccaaucauuuuaauuauua

SEQ ID NO: 1249554 - RNA, 23 nt, Human
ccucuguugccaaggcuggagug

SEQ ID NO: 1249555 - RNA, 12 nt, Human
gaauuggagcuc

SEQ ID NO: 1249556 - RNA, 22 nt, Human
uguaauuaaucuuguaaauaua

SEQ ID NO: 1249557 - RNA, 16 nt, Human
ccuaagugcagccccg

SEQ ID NO: 1249558 - RNA, 20 nt, Human
uuccugaccuaugaaacaga

SEQ ID NO: 1249559 - RNA, 22 nt, Human
cugauauauguguuuuucacau

SEQ ID NO: 1249560 - RNA, 23 nt, Human
uguugcccacagcuguaugauuc

SEQ ID NO: 1249561 - RNA, 23 nt, Human
uccuuaucacugacacaaaaagu

SEQ ID NO: 1249562 - RNA, 23 nt, Human
caagggaguuaggcuauucacaa

SEQ ID NO: 1249563 - RNA, 16 nt, Human
auucugcaagcuuuuc

SEQ ID NO: 1249564 - RNA, 17 nt, Human
caguauucccuuuugcu

SEQ ID NO: 1249565 - RNA, 12 nt, Human
agacucugucuc

SEQ ID NO: 1249566 - RNA, 17 nt, Human
gcuucucauccugcagg

SEQ ID NO: 1249567 - RNA, 16 nt, Human
accaggcuugccugca

SEQ ID NO: 1249568 - RNA, 22 nt, Human
uuauuuauaacaaccuaaauuu

SEQ ID NO: 1249569 - RNA, 18 nt, Human
cuuaguguacaugaaagc

SEQ ID NO: 1249570 - RNA, 14 nt, Human
uagcaaauguuaug

SEQ ID NO: 1249571 - RNA, 15 nt, Human
auggugaaaugcaga

SEQ ID NO: 1249572 - RNA, 15 nt, Human
auauauguauuuaua

SEQ ID NO: 1249573 - RNA, 15 nt, Human
ugccucuaaaaggcc

SEQ ID NO: 1249574 - RNA, 14 nt, Human
aucaaaagaaagaa

SEQ ID NO: 1249575 - RNA, 14 nt, Human
gauuaguacacacu

SEQ ID NO: 1249576 - RNA, 18 nt, Human
cugggcagcugccucccc

SEQ ID NO: 1249577 - RNA, 22 nt, Human
auuacaggcgugagccaccaaa

SEQ ID NO: 1249578 - RNA, 16 nt, Human
caaccuaaauuugguu

SEQ ID NO: 1249579 - RNA, 19 nt, Human
auccuacaagacacaguga

SEQ ID NO: 1249580 - RNA, 18 nt, Human
ugggcacaggguuuaugu

SEQ ID NO: 1249581 - RNA, 14 nt, Human
aauaaaguauauau

SEQ ID NO: 1249582 - RNA, 23 nt, Human
ucuaccaaaaaucucaauauuuc

SEQ ID NO: 1249583 - RNA, 15 nt, Human
gaaacauuacaguua

SEQ ID NO: 1249584 - RNA, 17 nt, Human
ucugugagaugcuagaa

SEQ ID NO: 1249585 - RNA, 15 nt, Human
aaauaauuuuuauau

SEQ ID NO: 1249586 - RNA, 15 nt, Human
uaagauaauuauaau

SEQ ID NO: 1249587 - RNA, 15 nt, Human
agaauaccacaggaa

SEQ ID NO: 1249588 - RNA, 21 nt, Human
uucgcugauauauguguuuuu

SEQ ID NO: 1249589 - RNA, 15 nt, Human
aauaucuaauauaua

SEQ ID NO: 1249590 - RNA, 13 nt, Human
gcuugccugcagg

SEQ ID NO: 1249591 - RNA, 22 nt, Human
ucuccagagggaauugcagagu

SEQ ID NO: 1249592 - RNA, 21 nt, Human
acaauuauaagcuguuuuuau

SEQ ID NO: 1249593 - RNA, 15 nt, Human
ccugcaaagcccagc

SEQ ID NO: 1249594 - RNA, 20 nt, Human
auauguauuuauaaauauau

SEQ ID NO: 1249595 - RNA, 18 nt, Human
cagaaagcagaacaguga

SEQ ID NO: 1249596 - RNA, 14 nt, Human
auuuaaaauauuuu

SEQ ID NO: 1249597 - RNA, 16 nt, Human
ugugagaugcuagaac

SEQ ID NO: 1249598 - RNA, 20 nt, Human
uggucucgaacugcuggauu

SEQ ID NO: 1249599 - RNA, 22 nt, Human
uauuucagauaaucacaauaca

SEQ ID NO: 1249600 - RNA, 12 nt, Human
uauaaauaaaau

SEQ ID NO: 1249601 - RNA, 15 nt, Human
uguuuuaaaauuaaa

SEQ ID NO: 1249602 - RNA, 14 nt, Human
gagccaccaaaccc

SEQ ID NO: 1249603 - RNA, 23 nt, Human
ggaugguucccuugaugaagaag

SEQ ID NO: 1249604 - RNA, 23 nt, Human
caaagcaugggccuagcccacug

SEQ ID NO: 1249605 - RNA, 21 nt, Human
gccugauuaaaguuaaauaaa

SEQ ID NO: 1249606 - RNA, 14 nt, Human
ugugcaauauguga

SEQ ID NO: 1249607 - RNA, 15 nt, Human
gugaccacugcagaa

SEQ ID NO: 1249608 - RNA, 15 nt, Human
uacccuuugaaaaag

SEQ ID NO: 1249609 - RNA, 20 nt, Human
uucuguaaucuucagaccua

SEQ ID NO: 1249610 - RNA, 13 nt, Human
uguaacuuaugaa

SEQ ID NO: 1249611 - RNA, 22 nt, Human
ugccuccccuccucugcuugcc

SEQ ID NO: 1249612 - RNA, 19 nt, Human
ugccaucccucccuccacc

SEQ ID NO: 1249613 - RNA, 22 nt, Human
cucagcccuggugggcagagag

SEQ ID NO: 1249614 - RNA, 15 nt, Human
gugcaggcagcagga

SEQ ID NO: 1249615 - RNA, 16 nt, Human
acucagggagcauuua

SEQ ID NO: 1249616 - RNA, 22 nt, Human
auuaaggcuucucuuaaacacu

SEQ ID NO: 1249617 - RNA, 23 nt, Human
ucuuagaugcaguucugaagaag

SEQ ID NO: 1249618 - RNA, 15 nt, Human
uaaauaaauguaucu

SEQ ID NO: 1249619 - RNA, 16 nt, Human
aacugcuggauucaag

SEQ ID NO: 1249620 - RNA, 21 nt, Human
ccucuguucugcacacagcac

SEQ ID NO: 1249621 - RNA, 20 nt, Human
cccugccccccagcccuccu

SEQ ID NO: 1249622 - RNA, 20 nt, Human
ccauacuaauuauacccccu

SEQ ID NO: 1249623 - RNA, 14 nt, Human
ccugccccugagcc

SEQ ID NO: 1249624 - RNA, 20 nt, Human
ggccuaugcagagguccaca

SEQ ID NO: 1249625 - RNA, 19 nt, Human
ccuggucgucgucuugacu

SEQ ID NO: 1249626 - RNA, 13 nt, Human
ggaaaauguguau

SEQ ID NO: 1249627 - RNA, 23 nt, Human
aaauuuacagagacagaaagcag

SEQ ID NO: 1249628 - RNA, 17 nt, Human
uaucaauuuaaaaaaaa

SEQ ID NO: 1249629 - RNA, 14 nt, Human
uuaugauuaaguaa

SEQ ID NO: 1249630 - RNA, 19 nt, Human
gagugacuuaguguacaug

SEQ ID NO: 1249631 - RNA, 21 nt, Human
ugugaucagaccauaauguua

SEQ ID NO: 1249632 - RNA, 15 nt, Human
ugccccgucccccuc

SEQ ID NO: 1249633 - RNA, 17 nt, Human
cuggagggaagccuugg

SEQ ID NO: 1249634 - RNA, 23 nt, Human
uuuucaaaaucaaauuccagaau

SEQ ID NO: 1249635 - RNA, 20 nt, Human
cccugcacuccagccugagc

SEQ ID NO: 1249636 - RNA, 13 nt, Human
uauauuuuuagac

SEQ ID NO: 1249637 - RNA, 16 nt, Human
aagaaugagaagaaug

SEQ ID NO: 1249638 - RNA, 15 nt, Human
cacuucacuuuuuuu

SEQ ID NO: 1249639 - RNA, 20 nt, Human
cuggacuuuccagagaccag

SEQ ID NO: 1249640 - RNA, 17 nt, Human
uuacagagacagaaagc

SEQ ID NO: 1249641 - RNA, 16 nt, Human
uaaggcauaagaaaac

SEQ ID NO: 1249642 - RNA, 12 nt, Human
agcaguaacuga

SEQ ID NO: 1249643 - RNA, 12 nt, Human
caucuuucacau

SEQ ID NO: 1249644 - RNA, 17 nt, Human
aaccuagggugauauua

SEQ ID NO: 1249645 - RNA, 14 nt, Human
aaauuuucccaaaa

SEQ ID NO: 1249646 - RNA, 15 nt, Human
cagaccauaauguua

SEQ ID NO: 1249647 - RNA, 20 nt, Human
uaagaaauaugcacaauagc

SEQ ID NO: 1249648 - RNA, 11 nt, Human
aagucuuccau

SEQ ID NO: 1249649 - RNA, 19 nt, Human
cuuccagauccuggaaauc

SEQ ID NO: 1249650 - RNA, 15 nt, Human
cauguacauccaugg

SEQ ID NO: 1249651 - RNA, 17 nt, Human
caacauggugaaacccc

SEQ ID NO: 1249652 - RNA, 22 nt, Human
cucccacuagacaaguccagcc

SEQ ID NO: 1249653 - RNA, 20 nt, Human
uagaugcaguucugaagaag

SEQ ID NO: 1249654 - RNA, 18 nt, Human
acucauugcaaccuccac

SEQ ID NO: 1249655 - RNA, 16 nt, Human
gcuugccugcaggcau

SEQ ID NO: 1249656 - RNA, 23 nt, Human
ggucuaucuuugagcgcccacua

SEQ ID NO: 1249657 - RNA, 19 nt, Human
ugccucaguuuccugaccu

SEQ ID NO: 1249658 - RNA, 17 nt, Human
cugaucaccugcccugc

SEQ ID NO: 1249659 - RNA, 22 nt, Human
uuaagcacuuuaacacaguguc

SEQ ID NO: 1249660 - RNA, 16 nt, Human
cuucggccuccauccu

SEQ ID NO: 1249661 - RNA, 19 nt, Human
cauuuuacuacuuuaaaaa

SEQ ID NO: 1249662 - RNA, 12 nt, Human
cuuuaauuucau

SEQ ID NO: 1249663 - RNA, 22 nt, Human
cugcuagaguucugucuggacu

SEQ ID NO: 1249664 - RNA, 19 nt, Human
cacacuaugguauuugagu

SEQ ID NO: 1249665 - RNA, 15 nt, Human
gagaaucagaucauu

SEQ ID NO: 1249666 - RNA, 20 nt, Human
aaggaugccccgucccccuc

SEQ ID NO: 1249667 - RNA, 20 nt, Human
agcuuauugucuagugaaac

SEQ ID NO: 1249668 - RNA, 14 nt, Human
cauagguuuuuagu

SEQ ID NO: 1249669 - RNA, 14 nt, Human
agaguacuggcuga

SEQ ID NO: 1249670 - RNA, 14 nt, Human
cugagcauguacug

SEQ ID NO: 1249671 - RNA, 17 nt, Human
auuaauggaauauguaa

SEQ ID NO: 1249672 - RNA, 18 nt, Human
ucacagaggaucugcuug

SEQ ID NO: 1249673 - RNA, 15 nt, Human
cgacaguuuuccuuc

SEQ ID NO: 1249674 - RNA, 22 nt, Human
aggacaccauuuuggcaagcuc

SEQ ID NO: 1249675 - RNA, 17 nt, Human
aagcccaauauuauaau

SEQ ID NO: 1249676 - RNA, 22 nt, Human
agugucugaugaauguuaaauu

SEQ ID NO: 1249677 - RNA, 13 nt, Human
aaaaaaagccaaa

SEQ ID NO: 1249678 - RNA, 22 nt, Human
gaaaggagaaguuaagcaacau

SEQ ID NO: 1249679 - RNA, 16 nt, Human
gacaagcucacagacc

SEQ ID NO: 1249680 - RNA, 14 nt, Human
cacuaacauauaau

SEQ ID NO: 1249681 - RNA, 20 nt, Human
cuaaaugucaaucagccuag

SEQ ID NO: 1249682 - RNA, 12 nt, Human
aucguguccccu

SEQ ID NO: 1249683 - RNA, 22 nt, Human
aaacauccuacaagacacagug

SEQ ID NO: 1249684 - RNA, 21 nt, Human
acagugauuaccagggacuga

SEQ ID NO: 1249685 - RNA, 18 nt, Human
acuagaauuuauucaauu

SEQ ID NO: 1249686 - RNA, 17 nt, Human
cugagcagugcuugaau

SEQ ID NO: 1249687 - RNA, 22 nt, Human
aaguuguagguaauauugcaag

SEQ ID NO: 1249688 - RNA, 19 nt, Human
cuauuuauuuauuuauuug

SEQ ID NO: 1249689 - RNA, 14 nt, Human
augaaauaacuagg

SEQ ID NO: 1249690 - RNA, 13 nt, Human
acuucacuuuuuu

SEQ ID NO: 1249691 - RNA, 17 nt, Human
uguuucgcugauauaug

SEQ ID NO: 1249692 - RNA, 15 nt, Human
cacuaugguauuuga

SEQ ID NO: 1249693 - RNA, 18 nt, Human
uacaguaauuuuaaguaa

SEQ ID NO: 1249694 - RNA, 21 nt, Human
auuuuaguaagagauuccuga

SEQ ID NO: 1249695 - RNA, 13 nt, Human
gcagccaaccuaa

SEQ ID NO: 1249696 - RNA, 22 nt, Human
auagagacuuugugaaaaaaaa

SEQ ID NO: 1249697 - RNA, 14 nt, Human
gcaguucagagcug

SEQ ID NO: 1249698 - RNA, 15 nt, Human
acucaucaaucaaau

SEQ ID NO: 1249699 - RNA, 23 nt, Human
gaugaaaacauagcaucucagga

SEQ ID NO: 1249700 - RNA, 22 nt, Human
ugaauggcuaagcaaaauguga

SEQ ID NO: 1249701 - RNA, 16 nt, Human
guaacauagguuuuua

SEQ ID NO: 1249702 - RNA, 14 nt, Human
ggaguuccuaacca

SEQ ID NO: 1249703 - RNA, 21 nt, Human
caagacccaaaaggcagaagc

SEQ ID NO: 1249704 - RNA, 20 nt, Human
caggcuccaaacuggagcuu

SEQ ID NO: 1249705 - RNA, 12 nt, Human
auuauuauuuau

SEQ ID NO: 1249706 - RNA, 15 nt, Human
uaugaaacauuacag

SEQ ID NO: 1249707 - RNA, 21 nt, Human
uaaauaaauguaucuuauuca

SEQ ID NO: 1249708 - RNA, 20 nt, Human
ggucucaguguccucaucug

SEQ ID NO: 1249709 - RNA, 15 nt, Human
ucuucagaccuagaa

SEQ ID NO: 1249710 - RNA, 14 nt, Human
uguuguuauuuaaa

SEQ ID NO: 1249711 - RNA, 21 nt, Human
uguaauuaaucuuguaaauau

SEQ ID NO: 1249712 - RNA, 15 nt, Human
ucaaucaaauaagua

SEQ ID NO: 1249713 - RNA, 15 nt, Human
accugacagcccaag

SEQ ID NO: 1249714 - RNA, 14 nt, Human
aggcugaggcaaga

SEQ ID NO: 1249715 - RNA, 13 nt, Human
gguggguggggca

SEQ ID NO: 1249716 - RNA, 21 nt, Human
cugcccugcugagucccaggc

SEQ ID NO: 1249717 - RNA, 15 nt, Human
ucucugccuugguau

SEQ ID NO: 1249718 - RNA, 21 nt, Human
uccauccugaggcuccacuug

SEQ ID NO: 1249719 - RNA, 13 nt, Human
cuggccaggcugg

SEQ ID NO: 1249720 - RNA, 14 nt, Human
acucagaaauuuaa

SEQ ID NO: 1249721 - RNA, 16 nt, Human
ugcacaucaaaauaug

SEQ ID NO: 1249722 - RNA, 16 nt, Human
ugcuguauuuuaaaag

SEQ ID NO: 1249723 - RNA, 19 nt, Human
aauuuuuauauuugaaaua

SEQ ID NO: 1249724 - RNA, 17 nt, Human
aaauaaagaauuuuaaa

SEQ ID NO: 1249725 - RNA, 14 nt, Human
aaaaauacaaaaau

SEQ ID NO: 1249726 - RNA, 18 nt, Human
auuaugaucucagaaauu

SEQ ID NO: 1249727 - RNA, 21 nt, Human
ugggucucaguguccucaucu

SEQ ID NO: 1249728 - RNA, 15 nt, Human
auggaauauguaaau

SEQ ID NO: 1249729 - RNA, 13 nt, Human
aauaaaaauaaau

SEQ ID NO: 1249730 - RNA, 22 nt, Human
cuggcaaggguucaccugggcu

SEQ ID NO: 1249731 - RNA, 18 nt, Human
ugcugccucuaaaaggcc

SEQ ID NO: 1249732 - RNA, 15 nt, Human
uugccaugagcuaga

SEQ ID NO: 1249733 - RNA, 16 nt, Human
ucccugccccccagcc

SEQ ID NO: 1249734 - RNA, 22 nt, Human
uacaugagguacugagagugaa

SEQ ID NO: 1249735 - RNA, 15 nt, Human
cuuuggggagccaac

SEQ ID NO: 1249736 - RNA, 13 nt, Human
cagugcuuggccc

SEQ ID NO: 1249737 - RNA, 20 nt, Human
guuccuuccucugagccuug

SEQ ID NO: 1249738 - RNA, 16 nt, Human
auacauguuacaacac

SEQ ID NO: 1249739 - RNA, 21 nt, Human
cauuuuacuacuuuaaaaaaa

SEQ ID NO: 1249740 - RNA, 22 nt, Human
gcuucucauccugcaggcagcu

SEQ ID NO: 1249741 - RNA, 20 nt, Human
ucaggugacccugaugaaaa

SEQ ID NO: 1249742 - RNA, 18 nt, Human
aauagcagacaguguuuu

SEQ ID NO: 1249743 - RNA, 20 nt, Human
cuaagaaauaugcacaauag

SEQ ID NO: 1249744 - RNA, 21 nt, Human
uguacauuuccaaauucacaa

SEQ ID NO: 1249745 - RNA, 16 nt, Human
ccucuccugggcagcu

SEQ ID NO: 1249746 - RNA, 13 nt, Human
aagugcugggaau

SEQ ID NO: 1249747 - RNA, 13 nt, Human
uuugccaugcugg

SEQ ID NO: 1249748 - RNA, 18 nt, Human
cuccauccugaggcucca

SEQ ID NO: 1249749 - RNA, 21 nt, Human
aaugacuaaaaaacaaagaag

SEQ ID NO: 1249750 - RNA, 19 nt, Human
cugcuggauucaagugauc

SEQ ID NO: 1249751 - RNA, 13 nt, Human
uugcaaccuccac

SEQ ID NO: 1249752 - RNA, 21 nt, Human
ugcaauaaaauggguuuuacu

SEQ ID NO: 1249753 - RNA, 15 nt, Human
gucaaugcagccccc

SEQ ID NO: 1249754 - RNA, 19 nt, Human
uucucuaacucagaaacau

SEQ ID NO: 1249755 - RNA, 11 nt, Human
aaauauauuua

SEQ ID NO: 1249756 - RNA, 23 nt, Human
ccagcaguucagagcugcccucu

SEQ ID NO: 1249757 - RNA, 14 nt, Human
ucuggcacuuggga

SEQ ID NO: 1249758 - RNA, 22 nt, Human
cuccugggcagcugccuccccu

SEQ ID NO: 1249759 - RNA, 16 nt, Human
ugacaagguucuuccc

SEQ ID NO: 1249760 - RNA, 10 nt, Human
caacauuaaa

SEQ ID NO: 1249761 - RNA, 17 nt, Human
auuuuaaaucuaaaucu

SEQ ID NO: 1249762 - RNA, 13 nt, Human
gcuguugagcugu

SEQ ID NO: 1249763 - RNA, 17 nt, Human
gagauaucccaggaaaa

SEQ ID NO: 1249764 - RNA, 17 nt, Human
ugccuccccuccucugc

SEQ ID NO: 1249765 - RNA, 14 nt, Human
gagcucagcccugg

SEQ ID NO: 1249766 - RNA, 14 nt, Human
aaccugagccccaa

SEQ ID NO: 1249767 - RNA, 14 nt, Human
ugagaugcuagaac

SEQ ID NO: 1249768 - RNA, 15 nt, Human
ggaaaugaaagaaag

SEQ ID NO: 1249769 - RNA, 18 nt, Human
auauuauaauuuuuuuca

SEQ ID NO: 1249770 - RNA, 22 nt, Human
aaaaaaccugagccccaaaagg

SEQ ID NO: 1249771 - RNA, 16 nt, Human
uguuuccuagcgcagc

SEQ ID NO: 1249772 - RNA, 20 nt, Human
caguuagagauuuuuaaaua

SEQ ID NO: 1249773 - RNA, 20 nt, Human
gcuggaauugaauucccugc

SEQ ID NO: 1249774 - RNA, 15 nt, Human
uuuaagauaauuaua

SEQ ID NO: 1249775 - RNA, 21 nt, Human
ucuuaaagaauuuucaaaauc

SEQ ID NO: 1249776 - RNA, 13 nt, Human
gcccucuccuggg

SEQ ID NO: 1249777 - RNA, 12 nt, Human
gccaaggcugga

SEQ ID NO: 1249778 - RNA, 21 nt, Human
cagagguccacaacacacaga

SEQ ID NO: 1249779 - RNA, 23 nt, Human
aguguacaugaaagcguaaagag

SEQ ID NO: 1249780 - RNA, 12 nt, Human
uauucacaagac

SEQ ID NO: 1249781 - RNA, 22 nt, Human
auucuugaaagcuguggccagc

SEQ ID NO: 1249782 - RNA, 17 nt, Human
cauggagguuaagcacu

SEQ ID NO: 1249783 - RNA, 16 nt, Human
auaacuggaaacuuca

SEQ ID NO: 1249784 - RNA, 14 nt, Human
uaauuucaugaaaa

SEQ ID NO: 1249785 - RNA, 22 nt, Human
agaaaccuuauuguaccucucu

SEQ ID NO: 1249786 - RNA, 18 nt, Human
caugaauuaguuuuauau

SEQ ID NO: 1249787 - RNA, 16 nt, Human
auuccaccuacaugag

SEQ ID NO: 1249788 - RNA, 16 nt, Human
cauuuugguaaaauac

SEQ ID NO: 1249789 - RNA, 19 nt, Human
ccagcaguucagagcugcc

SEQ ID NO: 1249790 - RNA, 15 nt, Human
ugguuuagaaagcuu

SEQ ID NO: 1249791 - RNA, 14 nt, Human
uuucuuaaagaauu

SEQ ID NO: 1249792 - RNA, 17 nt, Human
acuucauuuaaaauauu

SEQ ID NO: 1249793 - RNA, 14 nt, Human
aucauauaauaaau

SEQ ID NO: 1249794 - RNA, 16 nt, Human
aaauaaguauuuauaa

SEQ ID NO: 1249795 - RNA, 15 nt, Human
cucccuuggggccua

SEQ ID NO: 1249796 - RNA, 19 nt, Human
uacugagccuuguaauucu

SEQ ID NO: 1249797 - RNA, 23 nt, Human
aaguauccuucagccugaaagag

SEQ ID NO: 1249798 - RNA, 18 nt, Human
aacucagggagcauuuau

SEQ ID NO: 1249799 - RNA, 20 nt, Human
aacucauuuguuaaaauuau

SEQ ID NO: 1249800 - RNA, 21 nt, Human
accaccugccuauauuuuuug

SEQ ID NO: 1249801 - RNA, 15 nt, Human
augaauuaaguuuuu

SEQ ID NO: 1249802 - RNA, 20 nt, Human
auaagccagacaucaacaga

SEQ ID NO: 1249803 - RNA, 21 nt, Human
auauuuauaacucaucauaaa

SEQ ID NO: 1249804 - RNA, 14 nt, Human
agaugcuagaacuc

SEQ ID NO: 1249805 - RNA, 18 nt, Human
ugcuggauucaagugauc

SEQ ID NO: 1249806 - RNA, 23 nt, Human
acauagaauaguguuggaaaaug

SEQ ID NO: 1249807 - RNA, 15 nt, Human
agccugaaagaggaa

SEQ ID NO: 1249808 - RNA, 14 nt, Human
guauuauuuauaau

SEQ ID NO: 1249809 - RNA, 20 nt, Human
aaggagccaaacauccuaca

SEQ ID NO: 1249810 - RNA, 16 nt, Human
uuuaacacagugucug

SEQ ID NO: 1249811 - RNA, 15 nt, Human
uaccuuuuuccuucc

SEQ ID NO: 1249812 - RNA, 11 nt, Human
caguucagagc

SEQ ID NO: 1249813 - RNA, 14 nt, Human
aaaacuucagacau

SEQ ID NO: 1249814 - RNA, 13 nt, Human
ccugagcuugcag

SEQ ID NO: 1249815 - RNA, 14 nt, Human
auuggacuuaaaau

SEQ ID NO: 1249816 - RNA, 22 nt, Human
agugucuuacagagaaaagaca

SEQ ID NO: 1249817 - RNA, 16 nt, Human
cugauacuuuuuucau

SEQ ID NO: 1249818 - RNA, 16 nt, Human
cacuuuuuuucuuuuc

SEQ ID NO: 1249819 - RNA, 15 nt, Human
cuaauauauaugaau

SEQ ID NO: 1249820 - RNA, 13 nt, Human
gguauuugagugu

SEQ ID NO: 1249821 - RNA, 23 nt, Human
gcuuuuuuuuuuuuucuuaaaga

SEQ ID NO: 1249822 - RNA, 16 nt, Human
ccaggaaacucugcau

SEQ ID NO: 1249823 - RNA, 20 nt, Human
uuucagaagaaauucugcaa

SEQ ID NO: 1249824 - RNA, 19 nt, Human
cugucccagcgagggacac

SEQ ID NO: 1249825 - RNA, 17 nt, Human
agaauugcuugaaccca

SEQ ID NO: 1249826 - RNA, 21 nt, Human
aaugugacuuaaugccacuaa

SEQ ID NO: 1249827 - RNA, 16 nt, Human
ucaaaaaauaaaaaua

SEQ ID NO: 1249828 - RNA, 18 nt, Human
ccauaauguuacauuauu

SEQ ID NO: 1249829 - RNA, 20 nt, Human
accucugccucagaaaacaa

SEQ ID NO: 1249830 - RNA, 15 nt, Human
acucugagcagugcu

SEQ ID NO: 1249831 - RNA, 15 nt, Human
agcaaaauggauaug

SEQ ID NO: 1249832 - RNA, 14 nt, Human
aucagucauaacua

SEQ ID NO: 1249833 - RNA, 13 nt, Human
uuaaacaaaaaaa

SEQ ID NO: 1249834 - RNA, 19 nt, Human
uaaacuggaaauaaaagau

SEQ ID NO: 1249835 - RNA, 16 nt, Human
gcugccuccccuccuc

SEQ ID NO: 1249836 - RNA, 12 nt, Human
uucuaaaugaau

SEQ ID NO: 1249837 - RNA, 18 nt, Human
ucacacaaccugucccag

SEQ ID NO: 1249838 - RNA, 17 nt, Human
auguugacaugggacau

SEQ ID NO: 1249839 - RNA, 17 nt, Human
gucucccaaagugcugg

SEQ ID NO: 1249840 - RNA, 16 nt, Human
cuuauagaauauuuau

SEQ ID NO: 1249841 - RNA, 15 nt, Human
uauaauuuuuuucaa

SEQ ID NO: 1249842 - RNA, 21 nt, Human
aaaauuuuuucucuaggaaau

SEQ ID NO: 1249843 - RNA, 16 nt, Human
uauauguguuuuucac

SEQ ID NO: 1249844 - RNA, 17 nt, Human
ccaccucccugcaauaa

SEQ ID NO: 1249845 - RNA, 14 nt, Human
auacaguaauuuua

SEQ ID NO: 1249846 - RNA, 19 nt, Human
aauuaauggaauauguaaa

SEQ ID NO: 1249847 - RNA, 15 nt, Human
aaagcguaaagagga

SEQ ID NO: 1249848 - RNA, 13 nt, Human
gguccacaacaca

SEQ ID NO: 1249849 - RNA, 19 nt, Human
aauauuucucucuuuuuag

SEQ ID NO: 1249850 - RNA, 19 nt, Human
uauuuuaauaauguuucaa

SEQ ID NO: 1249851 - RNA, 16 nt, Human
agugauccgcccaucu

SEQ ID NO: 1249852 - RNA, 23 nt, Human
cucauguccacugguucuucuug

SEQ ID NO: 1249853 - RNA, 17 nt, Human
ucuccuguacuuuuucc

SEQ ID NO: 1249854 - RNA, 21 nt, Human
gaaauguuuacagauccccaa

SEQ ID NO: 1249855 - RNA, 14 nt, Human
ccuaaccagccugg

SEQ ID NO: 1249856 - RNA, 20 nt, Human
aaguaaguuugauuucauua

SEQ ID NO: 1249857 - RNA, 17 nt, Human
gaaagaagcccaauauu

SEQ ID NO: 1249858 - RNA, 14 nt, Human
guuacauuauuauc

SEQ ID NO: 1249859 - RNA, 20 nt, Human
aucccucccuccaccucccu

SEQ ID NO: 1249860 - RNA, 21 nt, Human
aaacauuacaguuagagauuu

SEQ ID NO: 1249861 - RNA, 18 nt, Human
augcccaagaaugagaag

SEQ ID NO: 1249862 - RNA, 23 nt, Human
ggaacaguuaccucugccucaga

SEQ ID NO: 1249863 - RNA, 18 nt, Human
ucuuauagaauauuuauu

SEQ ID NO: 1249864 - RNA, 22 nt, Human
gaagggcaucaugcaucuuacu

SEQ ID NO: 1249865 - RNA, 14 nt, Human
auccuugaagauuu

SEQ ID NO: 1249866 - RNA, 21 nt, Human
ucuuucacauuggcuauuuaa

SEQ ID NO: 1249867 - RNA, 13 nt, Human
uugggacaaaaac

SEQ ID NO: 1249868 - RNA, 21 nt, Human
ggaaaggaguagaaaaagcag

SEQ ID NO: 1249869 - RNA, 16 nt, Human
cuguaaucccagcacu

SEQ ID NO: 1249870 - RNA, 18 nt, Human
cagagacagaaagcagaa

SEQ ID NO: 1249871 - RNA, 23 nt, Human
agccuugggaccccugagcuugc

SEQ ID NO: 1249872 - RNA, 20 nt, Human
cagcaggucucaugggggug

SEQ ID NO: 1249873 - RNA, 16 nt, Human
cuagaacucccuuuca

SEQ ID NO: 1249874 - RNA, 17 nt, Human
ugugaacgauuuagaaa

SEQ ID NO: 1249875 - RNA, 14 nt, Human
uuucacaagugaaa

SEQ ID NO: 1249876 - RNA, 14 nt, Human
uagaauuaauggaa

SEQ ID NO: 1249877 - RNA, 15 nt, Human
uagauguagauaaac

SEQ ID NO: 1249878 - RNA, 22 nt, Human
accccugagcuugcagagauga

SEQ ID NO: 1249879 - RNA, 12 nt, Human
aauuagaugaac

SEQ ID NO: 1249880 - RNA, 19 nt, Human
cuccgucucccaaagugcu

SEQ ID NO: 1249881 - RNA, 14 nt, Human
acuuauugacuauu

SEQ ID NO: 1249882 - RNA, 12 nt, Human
uaacuuaugaac

SEQ ID NO: 1249883 - RNA, 19 nt, Human
aaagaagacaacauuaaaa

SEQ ID NO: 1249884 - RNA, 12 nt, Human
aaugcagccccc

SEQ ID NO: 1249885 - RNA, 18 nt, Human
ccuggaucucacaagcac

SEQ ID NO: 1249886 - RNA, 17 nt, Human
gucauaacuaaauaaag

SEQ ID NO: 1249887 - RNA, 23 nt, Human
aaaauguguauuuuauuacaucu

SEQ ID NO: 1249888 - RNA, 14 nt, Human
gucccaggcugagc

SEQ ID NO: 1249889 - RNA, 18 nt, Human
agcaaaauuuuuucucua

SEQ ID NO: 1249890 - RNA, 20 nt, Human
uuucccucuuggugccucag

SEQ ID NO: 1249891 - RNA, 17 nt, Human
augcagagguccacaac

SEQ ID NO: 1249892 - RNA, 19 nt, Human
caaggaugccccguccccc

SEQ ID NO: 1249893 - RNA, 13 nt, Human
aaauaaaguauau

SEQ ID NO: 1249894 - RNA, 13 nt, Human
ccucccccaucuc

SEQ ID NO: 1249895 - RNA, 23 nt, Human
agaaugagaagaaugacuaugca

SEQ ID NO: 1249896 - RNA, 13 nt, Human
auugcaaggcaaa

SEQ ID NO: 1249897 - RNA, 17 nt, Human
ccucugcuugccauccc

SEQ ID NO: 1249898 - RNA, 23 nt, Human
cuucacuuuuuuucuuuucucug

SEQ ID NO: 1249899 - RNA, 21 nt, Human
caguuacugccgguuugaaaa

SEQ ID NO: 1249900 - RNA, 16 nt, Human
cugcacuccagccuga

SEQ ID NO: 1249901 - RNA, 19 nt, Human
uccaccucccugcaauaaa

SEQ ID NO: 1249902 - RNA, 21 nt, Human
cagccugggugacagagcaag

SEQ ID NO: 1249903 - RNA, 14 nt, Human
acaguaauuuuaag

SEQ ID NO: 1249904 - RNA, 19 nt, Human
acauuuguauaaaauaauu

SEQ ID NO: 1249905 - RNA, 17 nt, Human
agaaaggccagcaaauu

SEQ ID NO: 1249906 - RNA, 12 nt, Human
aaugaaagaaag

SEQ ID NO: 1249907 - RNA, 16 nt, Human
ccugagcuugcagaga

SEQ ID NO: 1249908 - RNA, 22 nt, Human
uacaguuagagauuuuuaaaua

SEQ ID NO: 1249909 - RNA, 17 nt, Human
auucccuuuugcugccu

SEQ ID NO: 1249910 - RNA, 22 nt, Human
gagcugcccucuccugggcagc

SEQ ID NO: 1249911 - RNA, 23 nt, Human
cgggguuugccaugcuggccagg

SEQ ID NO: 1249912 - RNA, 14 nt, Human
auauuaucaugcaa

SEQ ID NO: 1249913 - RNA, 15 nt, Human
acugaagaagcacca

SEQ ID NO: 1249914 - RNA, 14 nt, Human
gacaguuuuccuuc

SEQ ID NO: 1249915 - RNA, 21 nt, Human
aauuucagaagaaauucugca

SEQ ID NO: 1249916 - RNA, 19 nt, Human
acuuaaaaucuaauucaaa

SEQ ID NO: 1249917 - RNA, 15 nt, Human
aagaagcuaaauccu

SEQ ID NO: 1249918 - RNA, 23 nt, Human
uccaccucccugcaauaaaaugg

SEQ ID NO: 1249919 - RNA, 22 nt, Human
uaugcaaccuuuggaugcacuu

SEQ ID NO: 1249920 - RNA, 15 nt, Human
ugccaucccucccuc

SEQ ID NO: 1249921 - RNA, 17 nt, Human
ccugagcuugcagagau

SEQ ID NO: 1249922 - RNA, 19 nt, Human
uccauccugaggcuccacu

SEQ ID NO: 1249923 - RNA, 18 nt, Human
auguguggcauuuucacu

SEQ ID NO: 1249924 - RNA, 14 nt, Human
ggccgggagccuga

SEQ ID NO: 1249925 - RNA, 18 nt, Human
agugucaaugcagccccc

SEQ ID NO: 1249926 - RNA, 19 nt, Human
aguaauuucagaagaaauu

SEQ ID NO: 1249927 - RNA, 19 nt, Human
ugucuggcacuugggacaa

SEQ ID NO: 1249928 - RNA, 13 nt, Human
aaucauauaauaa

SEQ ID NO: 1249929 - RNA, 21 nt, Human
uaauuauaauauacuauauuu

SEQ ID NO: 1249930 - RNA, 22 nt, Human
ucuacuaaaaauacaaaaaaaa

SEQ ID NO: 1249931 - RNA, 15 nt, Human
gauuaaaguuaaaua

SEQ ID NO: 1249932 - RNA, 17 nt, Human
uaaaaggccugucccug

SEQ ID NO: 1249933 - RNA, 18 nt, Human
uuuugugaagcaaaauuu

SEQ ID NO: 1249934 - RNA, 11 nt, Human
cagcaaauucg

SEQ ID NO: 1249935 - RNA, 17 nt, Human
uucaaaaguugaaauua

SEQ ID NO: 1249936 - RNA, 20 nt, Human
guuuaugcauacaguaauuu

SEQ ID NO: 1249937 - RNA, 23 nt, Human
ugagcugauaucaugccccugua

SEQ ID NO: 1249938 - RNA, 16 nt, Human
auauggggaauauauu

SEQ ID NO: 1249939 - RNA, 16 nt, Human
gagaccuguaaucaua

SEQ ID NO: 1249940 - RNA, 14 nt, Human
guauuuuaaaagaa

SEQ ID NO: 1249941 - RNA, 21 nt, Human
ugcccucuccugggcagcugc

SEQ ID NO: 1249942 - RNA, 21 nt, Human
aacuuuuguguaaugaaaaug

SEQ ID NO: 1249943 - RNA, 20 nt, Human
uauaauaaauguacauuaau

SEQ ID NO: 1249944 - RNA, 19 nt, Human
gauuuuuaaauaaagaauu

SEQ ID NO: 1249945 - RNA, 13 nt, Human
aacuggaaauaaa

SEQ ID NO: 1249946 - RNA, 17 nt, Human
uauugcugaaugacuac

SEQ ID NO: 1249947 - RNA, 20 nt, Human
ggguuccuuccucugagccu

SEQ ID NO: 1249948 - RNA, 19 nt, Human
agauuugagcucagcccug

SEQ ID NO: 1249949 - RNA, 14 nt, Human
aauauuauguuaaa

SEQ ID NO: 1249950 - RNA, 18 nt, Human
uacauuuguauaaaauaa

SEQ ID NO: 1249951 - RNA, 15 nt, Human
ggauagagugggaca

SEQ ID NO: 1249952 - RNA, 22 nt, Human
aaugggcacaggguuuauguuu

SEQ ID NO: 1249953 - RNA, 15 nt, Human
gcacagccucuuaga

SEQ ID NO: 1249954 - RNA, 12 nt, Human
ugcaggcagcag

SEQ ID NO: 1249955 - RNA, 14 nt, Human
ucuccugggcagcu

SEQ ID NO: 1249956 - RNA, 21 nt, Human
cagcauuuuacuacuuuaaaa

SEQ ID NO: 1249957 - RNA, 22 nt, Human
uuaauggaauauguaaauagaa

SEQ ID NO: 1249958 - RNA, 16 nt, Human
cucgaacugcuggauu

SEQ ID NO: 1249959 - RNA, 14 nt, Human
ugcuagaacucccu

SEQ ID NO: 1249960 - RNA, 22 nt, Human
uauuucuaugaaauauuauguu

SEQ ID NO: 1249961 - RNA, 22 nt, Human
gucucccucuguugccaaggcu

SEQ ID NO: 1249962 - RNA, 17 nt, Human
guguaaugaaaaugaau

SEQ ID NO: 1249963 - RNA, 16 nt, Human
agcaagacucugucuc

SEQ ID NO: 1249964 - RNA, 17 nt, Human
cugaagggcaucaugca

SEQ ID NO: 1249965 - RNA, 17 nt, Human
guaucuuguuuuuccac

SEQ ID NO: 1249966 - RNA, 15 nt, Human
aaaauggguuuuacu

SEQ ID NO: 1249967 - RNA, 16 nt, Human
auugcugaaugacuac

SEQ ID NO: 1249968 - RNA, 19 nt, Human
auaaaauaaaguauauaua

SEQ ID NO: 1249969 - RNA, 22 nt, Human
cgucucccaaagugcugggaau

SEQ ID NO: 1249970 - RNA, 14 nt, Human
augaaacauuacag

SEQ ID NO: 1249971 - RNA, 18 nt, Human
auuuuuaaauaaagaauu

SEQ ID NO: 1249972 - RNA, 20 nt, Human
cagagacgggguuugccaug

SEQ ID NO: 1249973 - RNA, 20 nt, Human
uaggaauugacccacaagaa

SEQ ID NO: 1249974 - RNA, 19 nt, Human
acuuauugacuauuauaga

SEQ ID NO: 1249975 - RNA, 19 nt, Human
gaccugacagcccaagggu

SEQ ID NO: 1249976 - RNA, 23 nt, Human
uauuucucucuuuuuagagaaau

SEQ ID NO: 1249977 - RNA, 17 nt, Human
ucagagcugcccucucc

SEQ ID NO: 1249978 - RNA, 18 nt, Human
uagagacuuugugaaaaa

SEQ ID NO: 1249979 - RNA, 14 nt, Human
aauuauaauauacu

SEQ ID NO: 1249980 - RNA, 16 nt, Human
gaugaucauguauuua

SEQ ID NO: 1249981 - RNA, 18 nt, Human
ccaaguuuauauacaauu

SEQ ID NO: 1249982 - RNA, 22 nt, Human
uugcaagacauagaauaguguu

SEQ ID NO: 1249983 - RNA, 23 nt, Human
ccacuucauucuugaaagcugug

SEQ ID NO: 1249984 - RNA, 22 nt, Human
cugaggcuccacuuggucugug

SEQ ID NO: 1249985 - RNA, 20 nt, Human
ucuucauagcagauuuuaau

SEQ ID NO: 1249986 - RNA, 19 nt, Human
ugaaacauuacaguuagag

SEQ ID NO: 1249987 - RNA, 13 nt, Human
cauuuucacuuuu

SEQ ID NO: 1249988 - RNA, 16 nt, Human
ucuuggucucaguguc

SEQ ID NO: 1249989 - RNA, 16 nt, Human
ggcagcugccuccccu

SEQ ID NO: 1249990 - RNA, 18 nt, Human
ugugaccacugcagaaga

SEQ ID NO: 1249991 - RNA, 22 nt, Human
ggcauuuaggccaugggacagg

SEQ ID NO: 1249992 - RNA, 20 nt, Human
acaagcuuuuuuuuuuuuuc

SEQ ID NO: 1249993 - RNA, 13 nt, Human
uaaguaauuucag

SEQ ID NO: 1249994 - RNA, 17 nt, Human
auuuuaauuauuauucu

SEQ ID NO: 1249995 - RNA, 23 nt, Human
aguguccucaucuguaaaaugga

SEQ ID NO: 1249996 - RNA, 13 nt, Human
ucauccugcaggc

SEQ ID NO: 1249997 - RNA, 20 nt, Human
uauuuuguguucaguacaau

SEQ ID NO: 1249998 - RNA, 20 nt, Human
guuauuuauaacaaccuaaa

SEQ ID NO: 1249999 - RNA, 14 nt, Human
auuuaugaguuuuu

SEQ ID NO: 1250000 - RNA, 18 nt, Human
uuuuaaaaaagaaacauu

SEQ ID NO: 1250001 - RNA, 17 nt, Human
aaaaucuaauucaaacu

SEQ ID NO: 1250002 - RNA, 12 nt, Human
acccuauauuuu

SEQ ID NO: 1250003 - RNA, 15 nt, Human
gcugcccucuccugg

SEQ ID NO: 1250004 - RNA, 12 nt, Human
uugccugcaggc

SEQ ID NO: 1250005 - RNA, 20 nt, Human
ggagauggaaguugcaguga

SEQ ID NO: 1250006 - RNA, 17 nt, Human
acugauacccuuugaaa

SEQ ID NO: 1250007 - RNA, 18 nt, Human
uacagagaaaagacauaa

SEQ ID NO: 1250008 - RNA, 17 nt, Human
aguuccugagaccagcc

SEQ ID NO: 1250009 - RNA, 16 nt, Human
cucaguguccucaucu

SEQ ID NO: 1250010 - RNA, 13 nt, Human
uuuaagauaaauu

SEQ ID NO: 1250011 - RNA, 21 nt, Human
gaacuuuccacauucagagcu

SEQ ID NO: 1250012 - RNA, 23 nt, Human
ugauggguuucuccagagggaau

SEQ ID NO: 1250013 - RNA, 17 nt, Human
acaccagagauaauaug

SEQ ID NO: 1250014 - RNA, 15 nt, Human
aguuuuugauagcuu

SEQ ID NO: 1250015 - RNA, 21 nt, Human
auaguaccaaucauuuuaauu

SEQ ID NO: 1250016 - RNA, 19 nt, Human
uauauuuuuuaugaaacau

SEQ ID NO: 1250017 - RNA, 22 nt, Human
agcccuccuuaucaaaggacac

SEQ ID NO: 1250018 - RNA, 18 nt, Human
agauuaugaucucagaaa

SEQ ID NO: 1250019 - RNA, 18 nt, Human
uucucuaggaaauauuua

SEQ ID NO: 1250020 - RNA, 22 nt, Human
auggaaauguuuacagaucccc

SEQ ID NO: 1250021 - RNA, 17 nt, Human
uauaagcuguuuuuaua

SEQ ID NO: 1250022 - RNA, 23 nt, Human
cugcaauaaaauggguuuuacug

SEQ ID NO: 1250023 - RNA, 15 nt, Human
cuuuucccaacucca

SEQ ID NO: 1250024 - RNA, 19 nt, Human
agcuucucauccugcaggc

SEQ ID NO: 1250025 - RNA, 20 nt, Human
aaucucuauuaggaaauauu

SEQ ID NO: 1250026 - RNA, 18 nt, Human
cagucucccucccuuggg

SEQ ID NO: 1250027 - RNA, 14 nt, Human
uggccugcuggaug

SEQ ID NO: 1250028 - RNA, 16 nt, Human
aagaaugacuaugcaa

SEQ ID NO: 1250029 - RNA, 19 nt, Human
aauuccaggaaaaucugca

SEQ ID NO: 1250030 - RNA, 20 nt, Human
uagcauauguuuuuguaagu

SEQ ID NO: 1250031 - RNA, 23 nt, Human
ccaccucccugcaauaaaauggg

SEQ ID NO: 1250032 - RNA, 14 nt, Human
uauaauuccuauau

SEQ ID NO: 1250033 - RNA, 13 nt, Human
auuuuaaaagaau

SEQ ID NO: 1250034 - RNA, 22 nt, Human
aauaugccccauucaacaucua

SEQ ID NO: 1250035 - RNA, 15 nt, Human
ucagucauaacuaaa

SEQ ID NO: 1250036 - RNA, 20 nt, Human
aagaaauucugcaagcuuuu

SEQ ID NO: 1250037 - RNA, 13 nt, Human
agcugccuccccu

SEQ ID NO: 1250038 - RNA, 22 nt, Human
auagaauauuuauuaccucuga

SEQ ID NO: 1250039 - RNA, 18 nt, Human
acauuguuugucugucuu

SEQ ID NO: 1250040 - RNA, 18 nt, Human
cuggggccuguugaagau

SEQ ID NO: 1250041 - RNA, 22 nt, Human
aggguccuuugggaaaggagaa

SEQ ID NO: 1250042 - RNA, 18 nt, Human
gaaaacauagcaucucag

SEQ ID NO: 1250043 - RNA, 22 nt, Human
uggugugcuggcuuaaaaugua

SEQ ID NO: 1250044 - RNA, 13 nt, Human
gcuugccaucccu

SEQ ID NO: 1250045 - RNA, 15 nt, Human
uggaaauaaaagauu

SEQ ID NO: 1250046 - RNA, 14 nt, Human
guuacucugaaggg

SEQ ID NO: 1250047 - RNA, 17 nt, Human
cuaaaauuagaugaacu

SEQ ID NO: 1250048 - RNA, 22 nt, Human
ugaaacagagaaaauaaaagca

SEQ ID NO: 1250049 - RNA, 20 nt, Human
aucuguaaaauggagacacc

SEQ ID NO: 1250050 - RNA, 15 nt, Human
gggacaguuccugag

SEQ ID NO: 1250051 - RNA, 20 nt, Human
aaauccuugaagauuuacca

SEQ ID NO: 1250052 - RNA, 20 nt, Human
ugugcuggcuuaaaauguaa

SEQ ID NO: 1250053 - RNA, 21 nt, Human
auuuauauauuuauaacucau

SEQ ID NO: 1250054 - RNA, 17 nt, Human
cuccuguacuuuuucca

SEQ ID NO: 1250055 - RNA, 20 nt, Human
ugccaugcuggccaggcugg

SEQ ID NO: 1250056 - RNA, 16 nt, Human
uauccuacuuccccuu

SEQ ID NO: 1250057 - RNA, 17 nt, Human
ucaaaaguugaaauuaa

SEQ ID NO: 1250058 - RNA, 13 nt, Human
aacacaacuauau

SEQ ID NO: 1250059 - RNA, 23 nt, Human
ggccuccauccugaggcuccacu

SEQ ID NO: 1250060 - RNA, 22 nt, Human
aauugacccacaagaaaugaaa

SEQ ID NO: 1250061 - RNA, 14 nt, Human
uucaauauuuauua

SEQ ID NO: 1250062 - RNA, 17 nt, Human
cuaucucauuuccaagc

SEQ ID NO: 1250063 - RNA, 19 nt, Human
ugacaagguucuucccuuu

SEQ ID NO: 1250064 - RNA, 15 nt, Human
accacuguuaucaaa

SEQ ID NO: 1250065 - RNA, 15 nt, Human
aauauaauaugcaca

SEQ ID NO: 1250066 - RNA, 18 nt, Human
auauuuuuaugugcaaua

SEQ ID NO: 1250067 - RNA, 22 nt, Human
ccuguugaagaugcuuguauuu

SEQ ID NO: 1250068 - RNA, 15 nt, Human
aucaaccaaauggag

SEQ ID NO: 1250069 - RNA, 17 nt, Human
agaaauuccaggaaaau

SEQ ID NO: 1250070 - RNA, 16 nt, Human
cccuccaccucccugc

SEQ ID NO: 1250071 - RNA, 19 nt, Human
acuggacucaccuccccca

SEQ ID NO: 1250072 - RNA, 23 nt, Human
agaaugauuaugaauuacauuug

SEQ ID NO: 1250073 - RNA, 14 nt, Human
uuaugaaccuuuac

SEQ ID NO: 1250074 - RNA, 16 nt, Human
cuucacuuuuuuucuu

SEQ ID NO: 1250075 - RNA, 22 nt, Human
gaaacuaccagcccuacaccau

SEQ ID NO: 1250076 - RNA, 16 nt, Human
aaggguggguggggug

SEQ ID NO: 1250077 - RNA, 12 nt, Human
caccuguuuuua

SEQ ID NO: 1250078 - RNA, 18 nt, Human
gacuuugugaaaaaaaau

SEQ ID NO: 1250079 - RNA, 20 nt, Human
ggcuuagacccucaugcugc

SEQ ID NO: 1250080 - RNA, 12 nt, Human
aaucaauguuuc

SEQ ID NO: 1250081 - RNA, 16 nt, Human
cccuauccuacuuccc

SEQ ID NO: 1250082 - RNA, 14 nt, Human
auaaagaauuuuaa

SEQ ID NO: 1250083 - RNA, 14 nt, Human
uauuuaaagacaaa

SEQ ID NO: 1250084 - RNA, 19 nt, Human
guauuuaagguauauaaau

SEQ ID NO: 1250085 - RNA, 21 nt, Human
gaggcugaggcggguggauca

SEQ ID NO: 1250086 - RNA, 11 nt, Human
accucccugca

SEQ ID NO: 1250087 - RNA, 15 nt, Human
guucugcagauaaac

SEQ ID NO: 1250088 - RNA, 18 nt, Human
auauauuuauaacucauc

SEQ ID NO: 1250089 - RNA, 17 nt, Human
uaaauccuuuacuguua

SEQ ID NO: 1250090 - RNA, 15 nt, Human
gacucaucaaucaaa

SEQ ID NO: 1250091 - RNA, 11 nt, Human
aggaguuuggc

SEQ ID NO: 1250092 - RNA, 23 nt, Human
ccccucuggcuccagcuggccgg

SEQ ID NO: 1250093 - RNA, 15 nt, Human
gcuguauuuuaaaag

SEQ ID NO: 1250094 - RNA, 16 nt, Human
augaaagcguaaagag

SEQ ID NO: 1250095 - RNA, 18 nt, Human
ucugaugagaacucugag

SEQ ID NO: 1250096 - RNA, 19 nt, Human
agcucugcccauccugccc

SEQ ID NO: 1250097 - RNA, 14 nt, Human
aauacucuuaggaa

SEQ ID NO: 1250098 - RNA, 16 nt, Human
ugcaugguuuagaaag

SEQ ID NO: 1250099 - RNA, 13 nt, Human
uuguauuuuacuu

SEQ ID NO: 1250100 - RNA, 17 nt, Human
aaaaguauaaauaaaau

SEQ ID NO: 1250101 - RNA, 18 nt, Human
gaaaauaucacuugucaa

SEQ ID NO: 1250102 - RNA, 17 nt, Human
aagaaaggccagcaaau

SEQ ID NO: 1250103 - RNA, 22 nt, Human
aauaaauguaucuuauucacau

SEQ ID NO: 1250104 - RNA, 16 nt, Human
guaucuuguuuuucca

SEQ ID NO: 1250105 - RNA, 21 nt, Human
ugaaaaugaauaucuauuaau

SEQ ID NO: 1250106 - RNA, 16 nt, Human
uaauacuagucuuaua

SEQ ID NO: 1250107 - RNA, 17 nt, Human
cucguggaacaguuacc

SEQ ID NO: 1250108 - RNA, 16 nt, Human
ugccuuuauaaucuuu

SEQ ID NO: 1250109 - RNA, 12 nt, Human
gcuggauucaag

SEQ ID NO: 1250110 - RNA, 17 nt, Human
cuuccuaauuccacagc

SEQ ID NO: 1250111 - RNA, 16 nt, Human
uauuuauuaauauuua

SEQ ID NO: 1250112 - RNA, 13 nt, Human
gcugccuccccuc

SEQ ID NO: 1250113 - RNA, 21 nt, Human
ucaaaauuggacuuaaaaucu

SEQ ID NO: 1250114 - RNA, 12 nt, Human
cuacaagacaca

SEQ ID NO: 1250115 - RNA, 13 nt, Human
auuuauuugagac

SEQ ID NO: 1250116 - RNA, 20 nt, Human
uguaagaaaauaucacuugu

SEQ ID NO: 1250117 - RNA, 13 nt, Human
auaucuaauauau

SEQ ID NO: 1250118 - RNA, 12 nt, Human
auuaauauaugu

SEQ ID NO: 1250119 - RNA, 12 nt, Human
uuuuauauuuga

SEQ ID NO: 1250120 - RNA, 14 nt, Human
acacugaagaagca

SEQ ID NO: 1250121 - RNA, 18 nt, Human
uuuucucuccucucccca

SEQ ID NO: 1250122 - RNA, 18 nt, Human
ccugccuaagugcagccc

SEQ ID NO: 1250123 - RNA, 18 nt, Human
aaaugacuaaaaaacaaa

SEQ ID NO: 1250124 - RNA, 14 nt, Human
augaaccuuuacau

SEQ ID NO: 1250125 - RNA, 15 nt, Human
aaagaaagaaaauca

SEQ ID NO: 1250126 - RNA, 14 nt, Human
cacuguuaucaaaa

SEQ ID NO: 1250127 - RNA, 17 nt, Human
agggccuggcugggagu

SEQ ID NO: 1250128 - RNA, 17 nt, Human
ggaauauguaaauagaa

SEQ ID NO: 1250129 - RNA, 16 nt, Human
ccccugcacuccagcc

SEQ ID NO: 1250130 - RNA, 22 nt, Human
agaauucuuacauguuuucuuu

SEQ ID NO: 1250131 - RNA, 18 nt, Human
auuuugaauccagaaaua

SEQ ID NO: 1250132 - RNA, 14 nt, Human
cuccaccucccugc

SEQ ID NO: 1250133 - RNA, 22 nt, Human
gacucaccucccccaucucuuc

SEQ ID NO: 1250134 - RNA, 17 nt, Human
ccaaaagguauuuuaau

SEQ ID NO: 1250135 - RNA, 15 nt, Human
cacaggacagcccuu

SEQ ID NO: 1250136 - RNA, 14 nt, Human
cuggccgggagccu

SEQ ID NO: 1250137 - RNA, 17 nt, Human
uguuuuuauauauguga

SEQ ID NO: 1250138 - RNA, 21 nt, Human
aucuuuuuuuuaauaaaccau

SEQ ID NO: 1250139 - RNA, 15 nt, Human
ugagcgcccacuaga

SEQ ID NO: 1250140 - RNA, 12 nt, Human
gagugggacagu

SEQ ID NO: 1250141 - RNA, 18 nt, Human
aggaaggcuuacacccac

SEQ ID NO: 1250142 - RNA, 22 nt, Human
uguaccucucuuauagaauauu

SEQ ID NO: 1250143 - RNA, 11 nt, Human
ucuuuucucug

SEQ ID NO: 1250144 - RNA, 16 nt, Human
acuaugaggaauauuu

SEQ ID NO: 1250145 - RNA, 20 nt, Human
aaaagacauaagcaaagacu

SEQ ID NO: 1250146 - RNA, 15 nt, Human
ggcaauagucaaauu

SEQ ID NO: 1250147 - RNA, 13 nt, Human
agggaccugcugu

SEQ ID NO: 1250148 - RNA, 19 nt, Human
ugaacaaauuuacagagac

SEQ ID NO: 1250149 - RNA, 15 nt, Human
ugcagauaaacagua

SEQ ID NO: 1250150 - RNA, 12 nt, Human
guagacacacau

SEQ ID NO: 1250151 - RNA, 14 nt, Human
agcuugaaauagug

SEQ ID NO: 1250152 - RNA, 22 nt, Human
acuggccugcuggauguggagg

SEQ ID NO: 1250153 - RNA, 21 nt, Human
gacagcuucucauccugcagg

SEQ ID NO: 1250154 - RNA, 19 nt, Human
guuagagauuuuuaaauaa

SEQ ID NO: 1250155 - RNA, 23 nt, Human
auuagggugguauuuagucuauu

SEQ ID NO: 1250156 - RNA, 20 nt, Human
ccauaauguuacauuauuau

SEQ ID NO: 1250157 - RNA, 15 nt, Human
uaauauacuauauuu

SEQ ID NO: 1250158 - RNA, 22 nt, Human
uggguuccuuccucugagccuu

SEQ ID NO: 1250159 - RNA, 14 nt, Human
guauacuguauuuu

SEQ ID NO: 1250160 - RNA, 15 nt, Human
agagacagaaagcag

SEQ ID NO: 1250161 - RNA, 18 nt, Human
ugaguggaugauguuucg

SEQ ID NO: 1250162 - RNA, 23 nt, Human
uacuucauuuaaaauauuuuuau

SEQ ID NO: 1250163 - RNA, 15 nt, Human
uuuguccuuuuuguu

SEQ ID NO: 1250164 - RNA, 14 nt, Human
auuuucccaaaacu

SEQ ID NO: 1250165 - RNA, 15 nt, Human
caacauuaaaacaau

SEQ ID NO: 1250166 - RNA, 15 nt, Human
ugccccccagcccuc

SEQ ID NO: 1250167 - RNA, 12 nt, Human
agauaucccagg

SEQ ID NO: 1250168 - RNA, 16 nt, Human
auaaagaauuuuaaaa

SEQ ID NO: 1250169 - RNA, 17 nt, Human
cuccuuaucaaaggaca

SEQ ID NO: 1250170 - RNA, 13 nt, Human
agcucugcccauc

SEQ ID NO: 1250171 - RNA, 19 nt, Human
cccaggaguuuggccagaa

SEQ ID NO: 1250172 - RNA, 19 nt, Human
gaggcagagguugcaguga

SEQ ID NO: 1250173 - RNA, 22 nt, Human
uuuauaacucaucauaaaauaa

SEQ ID NO: 1250174 - RNA, 21 nt, Human
cucugucucaaaaaauaaaaa

SEQ ID NO: 1250175 - RNA, 19 nt, Human
uacauguuuucuuugcuuu

SEQ ID NO: 1250176 - RNA, 20 nt, Human
uuaaguuuuuuuuuaaaaaa

SEQ ID NO: 1250177 - RNA, 18 nt, Human
auuuaggccaugggacag

SEQ ID NO: 1250178 - RNA, 17 nt, Human
uuaaauggucaauuuug

SEQ ID NO: 1250179 - RNA, 22 nt, Human
aaacuggaaauaaaagauugua

SEQ ID NO: 1250180 - RNA, 13 nt, Human
acaguuuuccuuc

SEQ ID NO: 1250181 - RNA, 23 nt, Human
agcuuccauuccaagccugacca

SEQ ID NO: 1250182 - RNA, 14 nt, Human
cucugcuugccauc

SEQ ID NO: 1250183 - RNA, 15 nt, Human
accaaggcugauuaa

SEQ ID NO: 1250184 - RNA, 18 nt, Human
gcaagacauagaauagug

SEQ ID NO: 1250185 - RNA, 18 nt, Human
aguaauuucagaagaaau

SEQ ID NO: 1250186 - RNA, 15 nt, Human
cuauuuauugcugaa

SEQ ID NO: 1250187 - RNA, 23 nt, Human
accuuuguagccacuucacuuuu

SEQ ID NO: 1250188 - RNA, 14 nt, Human
agcuguugagcugu

SEQ ID NO: 1250189 - RNA, 17 nt, Human
aaacauccuacaagaca

SEQ ID NO: 1250190 - RNA, 17 nt, Human
aggcaugagucagucug

SEQ ID NO: 1250191 - RNA, 20 nt, Human
gccucuaaaaggccuguccc

SEQ ID NO: 1250192 - RNA, 11 nt, Human
aauaaauaaau

SEQ ID NO: 1250193 - RNA, 19 nt, Human
aggucuaccaaaaaucuca

SEQ ID NO: 1250194 - RNA, 14 nt, Human
aaucuuguaaauau

SEQ ID NO: 1250195 - RNA, 18 nt, Human
auuucaugauuucauuuc

SEQ ID NO: 1250196 - RNA, 19 nt, Human
aucuguaaaauggagacac

SEQ ID NO: 1250197 - RNA, 19 nt, Human
aagacuaugaggaauauuu

SEQ ID NO: 1250198 - RNA, 16 nt, Human
ucaccugggcugaggc

SEQ ID NO: 1250199 - RNA, 14 nt, Human
uaugcauacaguaa

SEQ ID NO: 1250200 - RNA, 24 nt, Human
uugccaaggcuggagugcaguggc

SEQ ID NO: 1250201 - RNA, 20 nt, Human
aauuuuuucucuaggaaaua

SEQ ID NO: 1250202 - RNA, 15 nt, Human
aauugacccacaaga

SEQ ID NO: 1250203 - RNA, 15 nt, Human
ccagauccuggaaau

SEQ ID NO: 1250204 - RNA, 15 nt, Human
auugcugaaugacua

SEQ ID NO: 1250205 - RNA, 15 nt, Human
cauagccaggaaacu

SEQ ID NO: 1250206 - RNA, 11 nt, Human
ggcacuuggga

SEQ ID NO: 1250207 - RNA, 18 nt, Human
uugggcgggacacaggcu

SEQ ID NO: 1250208 - RNA, 13 nt, Human
uugcaagacauag

SEQ ID NO: 1250209 - RNA, 15 nt, Human
cuaguaauuggaaag

SEQ ID NO: 1250210 - RNA, 13 nt, Human
acaguaauuuuaa

SEQ ID NO: 1250211 - RNA, 14 nt, Human
auauuuaacauuau

SEQ ID NO: 1250212 - RNA, 20 nt, Human
cagaaacaucaguuacucug

SEQ ID NO: 1250213 - RNA, 18 nt, Human
ugacuuaguguacaugaa

SEQ ID NO: 1250214 - RNA, 19 nt, Human
uaaauguaucuuauucaca

SEQ ID NO: 1250215 - RNA, 14 nt, Human
gaccuagaauaaua

SEQ ID NO: 1250216 - RNA, 12 nt, Human
cuaagaagugaa

SEQ ID NO: 1250217 - RNA, 12 nt, Human
acucccugcccc

SEQ ID NO: 1250218 - RNA, 18 nt, Human
cucuacuaaaaauacaaa

SEQ ID NO: 1250219 - RNA, 21 nt, Human
uuaaaauauuuuuaugugcaa

SEQ ID NO: 1250220 - RNA, 21 nt, Human
gccuuuucccaacuccagaaa

SEQ ID NO: 1250221 - RNA, 19 nt, Human
cucuguucugcacacagca

SEQ ID NO: 1250222 - RNA, 19 nt, Human
agaugcuagaacucccuuu

SEQ ID NO: 1250223 - RNA, 16 nt, Human
ggcagcuuuuucucuc

SEQ ID NO: 1250224 - RNA, 20 nt, Human
ugaccaggcauccuccacaa

SEQ ID NO: 1250225 - RNA, 20 nt, Human
aacaaacgaaaaacauuuca

SEQ ID NO: 1250226 - RNA, 15 nt, Human
aagcacgaaauguua

SEQ ID NO: 1250227 - RNA, 23 nt, Human
cucuacuaaaaauacaaaaaaaa

SEQ ID NO: 1250228 - RNA, 14 nt, Human
ccaaauuuguauuu

SEQ ID NO: 1250229 - RNA, 15 nt, Human
uuacuacuuuaaaaa

SEQ ID NO: 1250230 - RNA, 15 nt, Human
ugacaacuugaauaa

SEQ ID NO: 1250231 - RNA, 13 nt, Human
aaauccuugaaga

SEQ ID NO: 1250232 - RNA, 23 nt, Human
cuugauaaauggcuuccuggcaa

SEQ ID NO: 1250233 - RNA, 15 nt, Human
cugagcauguacuga

SEQ ID NO: 1250234 - RNA, 16 nt, Human
ccuuuauaaucuuuua

SEQ ID NO: 1250235 - RNA, 17 nt, Human
cagcaggauagaguggg

SEQ ID NO: 1250236 - RNA, 16 nt, Human
auuucaugauuucauu

SEQ ID NO: 1250237 - RNA, 17 nt, Human
ucacaagugaaaaacau

SEQ ID NO: 1250238 - RNA, 14 nt, Human
uugagaagagaaua

SEQ ID NO: 1250239 - RNA, 20 nt, Human
ugagcgcccacuagacccac

SEQ ID NO: 1250240 - RNA, 17 nt, Human
uagcauaaguuucuggg

SEQ ID NO: 1250241 - RNA, 17 nt, Human
gaacucugagcagugcu

SEQ ID NO: 1250242 - RNA, 15 nt, Human
uauuauuuauauaug

SEQ ID NO: 1250243 - RNA, 19 nt, Human
aaauaugccccauucaaca

SEQ ID NO: 1250244 - RNA, 17 nt, Human
uuuccacauucagagcu

SEQ ID NO: 1250245 - RNA, 18 nt, Human
uggaugcacuuuauauua

SEQ ID NO: 1250246 - RNA, 15 nt, Human
aagccagauuuuccu

SEQ ID NO: 1250247 - RNA, 19 nt, Human
ccaugcuggccaggcuggu

SEQ ID NO: 1250248 - RNA, 23 nt, Human
cugcaaucugagccagugcuuua

SEQ ID NO: 1250249 - RNA, 21 nt, Human
gggagccugaucaccugcccu

SEQ ID NO: 1250250 - RNA, 17 nt, Human
agaaaugaaagcaggga

SEQ ID NO: 1250251 - RNA, 18 nt, Human
cugaccucccucuaauuu

SEQ ID NO: 1250252 - RNA, 20 nt, Human
gugugcuggcuuaaaaugua

SEQ ID NO: 1250253 - RNA, 19 nt, Human
auuuauaaauggacaaaug

SEQ ID NO: 1250254 - RNA, 19 nt, Human
cgauuuagaaagaagccca

SEQ ID NO: 1250255 - RNA, 22 nt, Human
aucucuucuggguuccuuccuc

SEQ ID NO: 1250256 - RNA, 18 nt, Human
auaaauggacaaaugcuu

SEQ ID NO: 1250257 - RNA, 13 nt, Human
aaauaaagaauuu

SEQ ID NO: 1250258 - RNA, 17 nt, Human
caagacccaaaaggcag

SEQ ID NO: 1250259 - RNA, 12 nt, Human
cauuauauuuau

SEQ ID NO: 1250260 - RNA, 12 nt, Human
uuuuuuuuaaaa

SEQ ID NO: 1250261 - RNA, 18 nt, Human
ccacuuggucugugagau

SEQ ID NO: 1250262 - RNA, 14 nt, Human
gaagaaauucugca

SEQ ID NO: 1250263 - RNA, 17 nt, Human
ccuauccuacuuccccu

SEQ ID NO: 1250264 - RNA, 19 nt, Human
cuuccuaauuccacagcug

SEQ ID NO: 1250265 - RNA, 21 nt, Human
uccuacaagacacagugacca

SEQ ID NO: 1250266 - RNA, 13 nt, Human
uggccaggcuggu

SEQ ID NO: 1250267 - RNA, 22 nt, Human
cuaacauauaauguuguuauuu

SEQ ID NO: 1250268 - RNA, 15 nt, Human
uuuuuaaauaaagaa

SEQ ID NO: 1250269 - RNA, 18 nt, Human
ccaagccuggcaagggaa

SEQ ID NO: 1250270 - RNA, 15 nt, Human
cuagauacugaaugu

SEQ ID NO: 1250271 - RNA, 15 nt, Human
aaucccuuaaacuca

SEQ ID NO: 1250272 - RNA, 18 nt, Human
cccaggaguuuggccaga

SEQ ID NO: 1250273 - RNA, 13 nt, Human
gaccuagaauaau

SEQ ID NO: 1250274 - RNA, 15 nt, Human
uauuuauuuuaauaa

SEQ ID NO: 1250275 - RNA, 17 nt, Human
aaagcagggacuugaac

SEQ ID NO: 1250276 - RNA, 18 nt, Human
uuauuacuguaagaaaau

SEQ ID NO: 1250277 - RNA, 14 nt, Human
gaugcuuguauuuu

SEQ ID NO: 1250278 - RNA, 17 nt, Human
aggguguguaaguagau

SEQ ID NO: 1250279 - RNA, 20 nt, Human
guccccuauccuacuucccc

SEQ ID NO: 1250280 - RNA, 16 nt, Human
gagaaacuggaacucu

SEQ ID NO: 1250281 - RNA, 17 nt, Human
cacaggcuccaaacugg

SEQ ID NO: 1250282 - RNA, 16 nt, Human
cguggacuuacuauuu

SEQ ID NO: 1250283 - RNA, 22 nt, Human
cuucagccugaaagaggaauga

SEQ ID NO: 1250284 - RNA, 12 nt, Human
guauuauuuaua

SEQ ID NO: 1250285 - RNA, 18 nt, Human
gccuucggccuccauccu

SEQ ID NO: 1250286 - RNA, 13 nt, Human
ccuccccuccucu

SEQ ID NO: 1250287 - RNA, 16 nt, Human
cucauccugcaggcag

SEQ ID NO: 1250288 - RNA, 14 nt, Human
aaaauuggacuuaa

SEQ ID NO: 1250289 - RNA, 16 nt, Human
gccucuaaaaggccug

SEQ ID NO: 1250290 - RNA, 16 nt, Human
gacuggccugcuggau

SEQ ID NO: 1250291 - RNA, 17 nt, Human
ccugcaggcaugaguca

SEQ ID NO: 1250292 - RNA, 18 nt, Human
acauguuuucuuugcuuu

SEQ ID NO: 1250293 - RNA, 18 nt, Human
cugggaauuacaggcgug

SEQ ID NO: 1250294 - RNA, 17 nt, Human
ugaaaagauuaugaucu

SEQ ID NO: 1250295 - RNA, 14 nt, Human
ggacucaccucccc

SEQ ID NO: 1250296 - RNA, 16 nt, Human
auuauaauuuuuuuca

SEQ ID NO: 1250297 - RNA, 19 nt, Human
cccugccccccagcccucc

SEQ ID NO: 1250298 - RNA, 19 nt, Human
uccagaaauaaugaaauaa

SEQ ID NO: 1250299 - RNA, 18 nt, Human
ggacacaggcuccaaacu

SEQ ID NO: 1250300 - RNA, 20 nt, Human
cuccacaauagcagacagug

SEQ ID NO: 1250301 - RNA, 22 nt, Human
gcagagagguagggauggggcu

SEQ ID NO: 1250302 - RNA, 13 nt, Human
agagauuccugag

SEQ ID NO: 1250303 - RNA, 15 nt, Human
cuaagcaaaauguga

SEQ ID NO: 1250304 - RNA, 23 nt, Human
uccaaacugacucuuaagaagac

SEQ ID NO: 1250305 - RNA, 20 nt, Human
acuccagugagacagcucug

SEQ ID NO: 1250306 - RNA, 23 nt, Human
uagauguauagguugaugguggu

SEQ ID NO: 1250307 - RNA, 22 nt, Human
cagacuuuuuuuuuuuuuuaaa

SEQ ID NO: 1250308 - RNA, 18 nt, Human
ucacgccuguaaucccag

SEQ ID NO: 1250309 - RNA, 15 nt, Human
cuccugguuccuagg

SEQ ID NO: 1250310 - RNA, 19 nt, Human
acagucaccucauggaauu

SEQ ID NO: 1250311 - RNA, 16 nt, Human
caaauggaaaguaacu

SEQ ID NO: 1250312 - RNA, 11 nt, Human
ucaccugcccu

SEQ ID NO: 1250313 - RNA, 14 nt, Human
ugagcucagcccug

SEQ ID NO: 1250314 - RNA, 14 nt, Human
caggaguuuggcca

SEQ ID NO: 1250315 - RNA, 21 nt, Human
cgaaguauccuucagccugaa

SEQ ID NO: 1250316 - RNA, 22 nt, Human
gaauuucuucaacucccugccc

SEQ ID NO: 1250317 - RNA, 15 nt, Human
auuccccuaaccuca

SEQ ID NO: 1250318 - RNA, 22 nt, Human
cucugggauagcugacccagcc

SEQ ID NO: 1250319 - RNA, 13 nt, Human
ugccaaggcugga

SEQ ID NO: 1250320 - RNA, 19 nt, Human
uagugagcagucaggaaag

SEQ ID NO: 1250321 - RNA, 17 nt, Human
uauaauaaauguacauu

SEQ ID NO: 1250322 - RNA, 20 nt, Human
aauuaauggaauauguaaau

SEQ ID NO: 1250323 - RNA, 13 nt, Human
gggaguggcgcgc

SEQ ID NO: 1250324 - RNA, 23 nt, Human
cccacuggacucaccucccccau

SEQ ID NO: 1250325 - RNA, 18 nt, Human
cuuguaauucuaaaugaa

SEQ ID NO: 1250326 - RNA, 18 nt, Human
acugccuucucaacucca

SEQ ID NO: 1250327 - RNA, 13 nt, Human
ggaaguagaggag

SEQ ID NO: 1250328 - RNA, 14 nt, Human
uauagaauauuuau

SEQ ID NO: 1250329 - RNA, 20 nt, Human
cagccugagcgacagugaga

SEQ ID NO: 1250330 - RNA, 20 nt, Human
acagcuucucauccugcagg

SEQ ID NO: 1250331 - RNA, 16 nt, Human
uugccauaauuacuau

SEQ ID NO: 1250332 - RNA, 22 nt, Human
caauuauaagcuguuuuuauau

SEQ ID NO: 1250333 - RNA, 12 nt, Human
uacccucugggu

SEQ ID NO: 1250334 - RNA, 13 nt, Human
ugaaaugcagagu

SEQ ID NO: 1250335 - RNA, 15 nt, Human
caggaaguagaggag

SEQ ID NO: 1250336 - RNA, 14 nt, Human
aaacaaaaaaagca

SEQ ID NO: 1250337 - RNA, 13 nt, Human
cauuuguauaaaa

SEQ ID NO: 1250338 - RNA, 15 nt, Human
ugcuguauuuuaaaa

SEQ ID NO: 1250339 - RNA, 21 nt, Human
uagauaaacucagaaauuuaa

SEQ ID NO: 1250340 - RNA, 18 nt, Human
gauagguuaccaguaacg

SEQ ID NO: 1250341 - RNA, 15 nt, Human
ccuguacuccagccu

SEQ ID NO: 1250342 - RNA, 17 nt, Human
aagcuugcaacaaaauu

SEQ ID NO: 1250343 - RNA, 20 nt, Human
ucagagcugcccucuccugg

SEQ ID NO: 1250344 - RNA, 19 nt, Human
cgaucuuugacucuuuugc

SEQ ID NO: 1250345 - RNA, 17 nt, Human
acaaaugcuuaugaaac

SEQ ID NO: 1250346 - RNA, 21 nt, Human
gcacuguggguagacacacau

SEQ ID NO: 1250347 - RNA, 13 nt, Human
aaaaauacaaaaa

SEQ ID NO: 1250348 - RNA, 23 nt, Human
caaggcuggagugcaguggcgca

SEQ ID NO: 1250349 - RNA, 18 nt, Human
uauuucucucuuuuuaga

SEQ ID NO: 1250350 - RNA, 15 nt, Human
ucuuguuuuuccacu

SEQ ID NO: 1250351 - RNA, 16 nt, Human
gucagaagaccugguc

SEQ ID NO: 1250352 - RNA, 22 nt, Human
auuuuauuacaucuuucacauu

SEQ ID NO: 1250353 - RNA, 20 nt, Human
aauauauguauuauuuauaa

SEQ ID NO: 1250354 - RNA, 15 nt, Human
ucuauuuauuaauau

SEQ ID NO: 1250355 - RNA, 19 nt, Human
auuacaguuagagauuuuu

SEQ ID NO: 1250356 - RNA, 18 nt, Human
uaaggcuucucuuaaaca

SEQ ID NO: 1250357 - RNA, 22 nt, Human
ccucccuuggggccuaugcaga

SEQ ID NO: 1250358 - RNA, 18 nt, Human
caucccucccuccaccuc

SEQ ID NO: 1250359 - RNA, 17 nt, Human
gccccccagcccuccuu

SEQ ID NO: 1250360 - RNA, 18 nt, Human
cccacuggacucaccucc

SEQ ID NO: 1250361 - RNA, 23 nt, Human
ccugacagcccaagggugggugg

SEQ ID NO: 1250362 - RNA, 14 nt, Human
aauugcagaguacu

SEQ ID NO: 1250363 - RNA, 23 nt, Human
uguuauagguuguuggauaaauc

SEQ ID NO: 1250364 - RNA, 14 nt, Human
cuggagcucugccc

SEQ ID NO: 1250365 - RNA, 22 nt, Human
uaaaauaauuuuuauauuugaa

SEQ ID NO: 1250366 - RNA, 18 nt, Human
cacuuuuggcuuguaaag

SEQ ID NO: 1250367 - RNA, 21 nt, Human
ugagcucagcccuggugggca

SEQ ID NO: 1250368 - RNA, 20 nt, Human
ccagcuggccgggagccuga

SEQ ID NO: 1250369 - RNA, 18 nt, Human
ccacauucagagcuuacu

SEQ ID NO: 1250370 - RNA, 18 nt, Human
ccuccaccucccugcaau

SEQ ID NO: 1250371 - RNA, 21 nt, Human
accacccuugccauggagguu

SEQ ID NO: 1250372 - RNA, 13 nt, Human
gcauacaguaauu

SEQ ID NO: 1250373 - RNA, 15 nt, Human
gauagguuaccagua

SEQ ID NO: 1250374 - RNA, 22 nt, Human
gaauuuuucucuaacucagaaa

SEQ ID NO: 1250375 - RNA, 16 nt, Human
uuauaagcuguuuuua

SEQ ID NO: 1250376 - RNA, 19 nt, Human
aucucugauacuuuuuuca

SEQ ID NO: 1250377 - RNA, 19 nt, Human
ggcuuuagggaccugcugu

SEQ ID NO: 1250378 - RNA, 23 nt, Human
gggccuaugcagagguccacaac

SEQ ID NO: 1250379 - RNA, 22 nt, Human
caaggcuuagacccucaugcug

SEQ ID NO: 1250380 - RNA, 22 nt, Human
cuccgucucccaaagugcuggg

SEQ ID NO: 1250381 - RNA, 18 nt, Human
cuaaaaaggcauguaauu

SEQ ID NO: 1250382 - RNA, 18 nt, Human
gcagugcuuggcccagga

SEQ ID NO: 1250383 - RNA, 16 nt, Human
gaaccuuuacauccag

SEQ ID NO: 1250384 - RNA, 23 nt, Human
cagacuuuuuuuuuuuuuuaaac

SEQ ID NO: 1250385 - RNA, 21 nt, Human
aucaagccaucggagcugcua

SEQ ID NO: 1250386 - RNA, 11 nt, Human
gcuguuuccau

SEQ ID NO: 1250387 - RNA, 21 nt, Human
guggccagcuuguuauuuaua

SEQ ID NO: 1250388 - RNA, 16 nt, Human
ucccugcaauaaaaug

SEQ ID NO: 1250389 - RNA, 15 nt, Human
gccuugggaccccug

SEQ ID NO: 1250390 - RNA, 19 nt, Human
cugagccucagucucccuc

SEQ ID NO: 1250391 - RNA, 18 nt, Human
ugucuggacuuuccagag

SEQ ID NO: 1250392 - RNA, 14 nt, Human
ucuuguuuuuccac

SEQ ID NO: 1250393 - RNA, 14 nt, Human
gagccagugucagg

SEQ ID NO: 1250394 - RNA, 13 nt, Human
ucuuauucacauc

SEQ ID NO: 1250395 - RNA, 21 nt, Human
cucaguccaugaagauguaga

SEQ ID NO: 1250396 - RNA, 12 nt, Human
ggacgagaauga

SEQ ID NO: 1250397 - RNA, 21 nt, Human
cuaccuuuugcuguggcaaau

SEQ ID NO: 1250398 - RNA, 14 nt, Human
auauuugaaauauu

SEQ ID NO: 1250399 - RNA, 13 nt, Human
agaagacaacauu

SEQ ID NO: 1250400 - RNA, 18 nt, Human
aagacucugucucaaaaa

SEQ ID NO: 1250401 - RNA, 17 nt, Human
ccugccccccagcccuc

SEQ ID NO: 1250402 - RNA, 21 nt, Human
uaucuaauauauaugaauaaa

SEQ ID NO: 1250403 - RNA, 18 nt, Human
auuuuaauuuugaauaaa

SEQ ID NO: 1250404 - RNA, 13 nt, Human
agagcaagacucu

SEQ ID NO: 1250405 - RNA, 16 nt, Human
ccuggugggcagagag

SEQ ID NO: 1250406 - RNA, 16 nt, Human
ugaauuaguuuuauau

SEQ ID NO: 1250407 - RNA, 17 nt, Human
agcucugcccauccugc

SEQ ID NO: 1250408 - RNA, 23 nt, Human
ugccucuaaaaggccugucccug

SEQ ID NO: 1250409 - RNA, 22 nt, Human
aauuacauuuguauaaaauaau

SEQ ID NO: 1250410 - RNA, 22 nt, Human
uagauacugaauguaaacaaag

SEQ ID NO: 1250411 - RNA, 16 nt, Human
augcauacaguaauuu

SEQ ID NO: 1250412 - RNA, 20 nt, Human
aaaguaacucauuuguuaaa

SEQ ID NO: 1250413 - RNA, 18 nt, Human
uaacuggcaguuuuccau

SEQ ID NO: 1250414 - RNA, 17 nt, Human
cuacaagcuaaaauuag

SEQ ID NO: 1250415 - RNA, 15 nt, Human
cugaagaguggguuu

SEQ ID NO: 1250416 - RNA, 13 nt, Human
aauguuacauuau

SEQ ID NO: 1250417 - RNA, 22 nt, Human
cuuccauuccaagccugaccac

SEQ ID NO: 1250418 - RNA, 20 nt, Human
aauaagccagacaucaacag

SEQ ID NO: 1250419 - RNA, 15 nt, Human
agugacaagcucaca

SEQ ID NO: 1250420 - RNA, 16 nt, Human
uacauuuguauaaaau

SEQ ID NO: 1250421 - RNA, 21 nt, Human
aggcagcaggauagaguggga

SEQ ID NO: 1250422 - RNA, 16 nt, Human
gaggacuugggcggga

SEQ ID NO: 1250423 - RNA, 17 nt, Human
augagccggagccccuu

SEQ ID NO: 1250424 - RNA, 16 nt, Human
aaauuagccgggcaug

SEQ ID NO: 1250425 - RNA, 18 nt, Human
aaaaugugcaauauguga

SEQ ID NO: 1250426 - RNA, 24 nt, Human
aaaggccugucccugcagacauga

SEQ ID NO: 1250427 - RNA, 16 nt, Human
caggcuugccugcagg

SEQ ID NO: 1250428 - RNA, 12 nt, Human
guauauauagaa

SEQ ID NO: 1250429 - RNA, 22 nt, Human
ccauacuaauuauacccccugc

SEQ ID NO: 1250430 - RNA, 15 nt, Human
aaugauuaugaauua

SEQ ID NO: 1250431 - RNA, 18 nt, Human
cuuuccacagaagcucca

SEQ ID NO: 1250432 - RNA, 14 nt, Human
ccuuaucaaaggac

SEQ ID NO: 1250433 - RNA, 13 nt, Human
auugcauuaaaua

SEQ ID NO: 1250434 - RNA, 16 nt, Human
cgccuguaaucccagc

SEQ ID NO: 1250435 - RNA, 20 nt, Human
aguuccugagaccagccaac

SEQ ID NO: 1250436 - RNA, 14 nt, Human
aauaguuuaugauu

SEQ ID NO: 1250437 - RNA, 21 nt, Human
ugugauguggcaaaucucuau

SEQ ID NO: 1250438 - RNA, 18 nt, Human
gccccgggaguggcgcgc

SEQ ID NO: 1250439 - RNA, 23 nt, Human
ucaggaguuccuaaccagccugg

SEQ ID NO: 1250440 - RNA, 18 nt, Human
agcaaauguuaugcauaa

SEQ ID NO: 1250441 - RNA, 19 nt, Human
cauccauggugugcuggcu

SEQ ID NO: 1250442 - RNA, 13 nt, Human
guccucuuucaaa

SEQ ID NO: 1250443 - RNA, 14 nt, Human
gugggacaguuccu

SEQ ID NO: 1250444 - RNA, 13 nt, Human
caccaaggagcca

SEQ ID NO: 1250445 - RNA, 14 nt, Human
aacucaguuuuaac

SEQ ID NO: 1250446 - RNA, 13 nt, Human
acucugcauucua

SEQ ID NO: 1250447 - RNA, 14 nt, Human
uggacaguuuucug

SEQ ID NO: 1250448 - RNA, 15 nt, Human
aagaaauaugcacaa

SEQ ID NO: 1250449 - RNA, 22 nt, Human
caagcucuaucaccaaggagcc

SEQ ID NO: 1250450 - RNA, 16 nt, Human
uaugacacaucucuga

SEQ ID NO: 1250451 - RNA, 22 nt, Human
uuacauguuuucuuugcuuuaa

SEQ ID NO: 1250452 - RNA, 22 nt, Human
cuccagccugagcgacagugag

SEQ ID NO: 1250453 - RNA, 12 nt, Human
uuuauaaauaua

SEQ ID NO: 1250454 - RNA, 17 nt, Human
cauuuguauaaaauaau

SEQ ID NO: 1250455 - RNA, 19 nt, Human
uguauuuauaaauauauuu

SEQ ID NO: 1250456 - RNA, 20 nt, Human
ucaaaacuucagacauagaa

SEQ ID NO: 1250457 - RNA, 14 nt, Human
ccccugagcuugca

SEQ ID NO: 1250458 - RNA, 13 nt, Human
uauuucuaugaaa

SEQ ID NO: 1250459 - RNA, 19 nt, Human
gugacuuaaugccacuaaa

SEQ ID NO: 1250460 - RNA, 16 nt, Human
cagaagaaauucugca

SEQ ID NO: 1250461 - RNA, 16 nt, Human
ucugcagauaaacagu

SEQ ID NO: 1250462 - RNA, 19 nt, Human
gcuaccuuuugcuguggca

SEQ ID NO: 1250463 - RNA, 18 nt, Human
uguugauagcaagugaau

SEQ ID NO: 1250464 - RNA, 22 nt, Human
caaauuuacagagacagaaagc

SEQ ID NO: 1250465 - RNA, 12 nt, Human
aagagcuuaaca

SEQ ID NO: 1250466 - RNA, 21 nt, Human
accaacacuaacauauaaugu

SEQ ID NO: 1250467 - RNA, 16 nt, Human
cuggccugcuggaugu

SEQ ID NO: 1250468 - RNA, 16 nt, Human
uacuuuguuauuuuuc

SEQ ID NO: 1250469 - RNA, 14 nt, Human
uauaauaugcacac

SEQ ID NO: 1250470 - RNA, 18 nt, Human
accucccugcaauaaaau

SEQ ID NO: 1250471 - RNA, 17 nt, Human
acacaaccugucccagc

SEQ ID NO: 1250472 - RNA, 20 nt, Human
agccuaguugaucagcuuau

SEQ ID NO: 1250473 - RNA, 17 nt, Human
uccucugagccuuggga

SEQ ID NO: 1250474 - RNA, 19 nt, Human
cuuugaaaaaguauaaaua

SEQ ID NO: 1250475 - RNA, 14 nt, Human
gcuggagcucugcc

SEQ ID NO: 1250476 - RNA, 13 nt, Human
auaaacucagaaa

SEQ ID NO: 1250477 - RNA, 23 nt, Human
aauagcaguugaaacaagaagcc

SEQ ID NO: 1250478 - RNA, 22 nt, Human
caucgcaauguaagacucggga

SEQ ID NO: 1250479 - RNA, 20 nt, Human
uaaagaauuuucaaaaucaa

SEQ ID NO: 1250480 - RNA, 21 nt, Human
ccccugcaaagcccagcuuga

SEQ ID NO: 1250481 - RNA, 14 nt, Human
gagcccauggcacu

SEQ ID NO: 1250482 - RNA, 23 nt, Human
uagagacuuugugaaaaaaaauu

SEQ ID NO: 1250483 - RNA, 22 nt, Human
uauauauuuauaacucaucaua

SEQ ID NO: 1250484 - RNA, 16 nt, Human
uuuauaacucaucaua

SEQ ID NO: 1250485 - RNA, 20 nt, Human
aguucagagcugcccucucc

SEQ ID NO: 1250486 - RNA, 14 nt, Human
uuccugagccagug

SEQ ID NO: 1250487 - RNA, 15 nt, Human
uuuccaaauucacaa

SEQ ID NO: 1250488 - RNA, 19 nt, Human
aguauuucuaugaaauauu

SEQ ID NO: 1250489 - RNA, 15 nt, Human
gcaagcucuaucacc

SEQ ID NO: 1250490 - RNA, 20 nt, Human
agaccagccaaccugggggc

SEQ ID NO: 1250491 - RNA, 16 nt, Human
ucuguauugcauuaaa

SEQ ID NO: 1250492 - RNA, 13 nt, Human
augauuccaccua

SEQ ID NO: 1250493 - RNA, 14 nt, Human
aaaaggaagaaauu

SEQ ID NO: 1250494 - RNA, 14 nt, Human
ccugggcugaggca

SEQ ID NO: 1250495 - RNA, 15 nt, Human
uccuguacuuuuucc

SEQ ID NO: 1250496 - RNA, 23 nt, Human
gaaaaaguucugcagauaaacag

SEQ ID NO: 1250497 - RNA, 15 nt, Human
caaagaagacaacau

SEQ ID NO: 1250498 - RNA, 21 nt, Human
ucucagaaauuguaucuuagu

SEQ ID NO: 1250499 - RNA, 23 nt, Human
augaaacuaagauuuguaauauu

SEQ ID NO: 1250500 - RNA, 17 nt, Human
auauuuuuuaugaaaca

SEQ ID NO: 1250501 - RNA, 20 nt, Human
agcuugcaacaaaauucucu

SEQ ID NO: 1250502 - RNA, 14 nt, Human
cauuuuaauuauua

SEQ ID NO: 1250503 - RNA, 21 nt, Human
uuuauauaagcuuguauuccu

SEQ ID NO: 1250504 - RNA, 16 nt, Human
auccuuuguuuucuga

SEQ ID NO: 1250505 - RNA, 21 nt, Human
guuacucugaagggcaucaug

SEQ ID NO: 1250506 - RNA, 17 nt, Human
ucucaaaaaauaaaaau

SEQ ID NO: 1250507 - RNA, 15 nt, Human
gcgugagccaccaaa

SEQ ID NO: 1250508 - RNA, 20 nt, Human
acuuaccugggcauucuugu

SEQ ID NO: 1250509 - RNA, 16 nt, Human
uaacauuauuuauaug

SEQ ID NO: 1250510 - RNA, 22 nt, Human
ggcagcuuuccucaaaacuuca

SEQ ID NO: 1250511 - RNA, 14 nt, Human
uccuaguaauuuaa

SEQ ID NO: 1250512 - RNA, 15 nt, Human
auaauuuugugaagc

SEQ ID NO: 1250513 - RNA, 22 nt, Human
augggaugaucauguauuuauu

SEQ ID NO: 1250514 - RNA, 15 nt, Human
acaauuauaagcugu

SEQ ID NO: 1250515 - RNA, 24 nt, Human
aaagacagcuucucauccugcagg

SEQ ID NO: 1250516 - RNA, 15 nt, Human
uaucuaauauauaug

SEQ ID NO: 1250517 - RNA, 20 nt, Human
cucccugccccccagcccuc

SEQ ID NO: 1250518 - RNA, 15 nt, Human
caaauaaguauuuau

SEQ ID NO: 1250519 - RNA, 14 nt, Human
aaguaauuucagaa

SEQ ID NO: 1250520 - RNA, 12 nt, Human
agugcagccccg

SEQ ID NO: 1250521 - RNA, 14 nt, Human
ucccucuguugcca

SEQ ID NO: 1250522 - RNA, 12 nt, Human
auuuauauaugu

SEQ ID NO: 1250523 - RNA, 12 nt, Human
uaaguauuuaua

SEQ ID NO: 1250524 - RNA, 19 nt, Human
uauauguguuuuucacauu

SEQ ID NO: 1250525 - RNA, 21 nt, Human
ucuuuucuggaauguaaucaa

SEQ ID NO: 1250526 - RNA, 14 nt, Human
uaguaucaaaagaa

SEQ ID NO: 1250527 - RNA, 15 nt, Human
cuucaacucccugcc

SEQ ID NO: 1250528 - RNA, 17 nt, Human
agaugggagaaucacuu

SEQ ID NO: 1250529 - RNA, 14 nt, Human
uaccuuuuuccuuc

SEQ ID NO: 1250530 - RNA, 18 nt, Human
aggaagaaauuccaggaa

SEQ ID NO: 1250531 - RNA, 23 nt, Human
agcagugcuugaaugaaguugua

SEQ ID NO: 1250532 - RNA, 17 nt, Human
aucaaggguacacugcc

SEQ ID NO: 1250533 - RNA, 21 nt, Human
aaauaaagcuugcaacaaaau

SEQ ID NO: 1250534 - RNA, 21 nt, Human
aguuucaguugauuuuacaau

SEQ ID NO: 1250535 - RNA, 14 nt, Human
auauuauuuugaau

SEQ ID NO: 1250536 - RNA, 14 nt, Human
ccucaucuguaaaa

SEQ ID NO: 1250537 - RNA, 12 nt, Human
agccagcaguuc

SEQ ID NO: 1250538 - RNA, 16 nt, Human
auuuuuccccaaaaag

SEQ ID NO: 1250539 - RNA, 15 nt, Human
auauacuauauuuau

SEQ ID NO: 1250540 - RNA, 13 nt, Human
agggucucccucu

SEQ ID NO: 1250541 - RNA, 15 nt, Human
agccccgggaguggc

SEQ ID NO: 1250542 - RNA, 15 nt, Human
gcagcugccuccccu

SEQ ID NO: 1250543 - RNA, 19 nt, Human
guccaggucuaccaaaaau

SEQ ID NO: 1250544 - RNA, 21 nt, Human
gccaucccucccuccaccucc

SEQ ID NO: 1250545 - RNA, 15 nt, Human
uauguauuuauaaau

SEQ ID NO: 1250546 - RNA, 14 nt, Human
aagaagugaaaauc

SEQ ID NO: 1250547 - RNA, 19 nt, Human
aacucuuaaucaaauagca

SEQ ID NO: 1250548 - RNA, 13 nt, Human
aaaaaugguuuaa

SEQ ID NO: 1250549 - RNA, 17 nt, Human
cuacacuccagugagac

SEQ ID NO: 1250550 - RNA, 15 nt, Human
acuagaauuuauuca

SEQ ID NO: 1250551 - RNA, 19 nt, Human
agcaucucaggagauuuca

SEQ ID NO: 1250552 - RNA, 16 nt, Human
auaauguuguuauuua

SEQ ID NO: 1250553 - RNA, 18 nt, Human
caguuguugcccacagcu

SEQ ID NO: 1250554 - RNA, 19 nt, Human
cuccagcuggccgggagcc

SEQ ID NO: 1250555 - RNA, 19 nt, Human
gggaccugcuguuuccuag

SEQ ID NO: 1250556 - RNA, 15 nt, Human
caccgaguggcccuu

SEQ ID NO: 1250557 - RNA, 15 nt, Human
acuacuuuaaaaaaa

SEQ ID NO: 1250558 - RNA, 17 nt, Human
aauauugcaaggcaaag

SEQ ID NO: 1250559 - RNA, 18 nt, Human
ugaaaaaguucugcagau

SEQ ID NO: 1250560 - RNA, 14 nt, Human
gcaaaugcuguauu

SEQ ID NO: 1250561 - RNA, 12 nt, Human
auacuauauuua

SEQ ID NO: 1250562 - RNA, 15 nt, Human
uaacauagguuuuua

SEQ ID NO: 1250563 - RNA, 12 nt, Human
auuuuaaaagaa

SEQ ID NO: 1250564 - RNA, 20 nt, Human
caagaaugagaagaaugacu

SEQ ID NO: 1250565 - RNA, 21 nt, Human
aauaaaguauauauagaaucu

SEQ ID NO: 1250566 - RNA, 19 nt, Human
uauuauaauuuuuuucaau

SEQ ID NO: 1250567 - RNA, 18 nt, Human
ucacaaccacucauucaa

SEQ ID NO: 1250568 - RNA, 15 nt, Human
uuuaaagacaaagac

SEQ ID NO: 1250569 - RNA, 14 nt, Human
uuaugaaacauuac

SEQ ID NO: 1250570 - RNA, 16 nt, Human
acagagacagaaagca

SEQ ID NO: 1250571 - RNA, 17 nt, Human
uuuuuccagacacuuuu

SEQ ID NO: 1250572 - RNA, 18 nt, Human
ccugaaagaggaaugaag

SEQ ID NO: 1250573 - RNA, 23 nt, Human
cacuggacucaccucccccaucu

SEQ ID NO: 1250574 - RNA, 11 nt, Human
aaggcuggagu

SEQ ID NO: 1250575 - RNA, 17 nt, Human
accugagccccaaaagg

SEQ ID NO: 1250576 - RNA, 14 nt, Human
agagguccacaaca

SEQ ID NO: 1250577 - RNA, 11 nt, Human
uaugugcaaua

SEQ ID NO: 1250578 - RNA, 16 nt, Human
uauuauuuauauaugu

SEQ ID NO: 1250579 - RNA, 12 nt, Human
agcuugcaacaa

SEQ ID NO: 1250580 - RNA, 20 nt, Human
ucauuccccaaccacuucau

SEQ ID NO: 1250581 - RNA, 23 nt, Human
uuuuaaacaaaaaaagcauugua

SEQ ID NO: 1250582 - RNA, 12 nt, Human
acuauggaaaaa

SEQ ID NO: 1250583 - RNA, 16 nt, Human
ccuguacuccagccug

SEQ ID NO: 1250584 - RNA, 14 nt, Human
ggaaguagaggagg

SEQ ID NO: 1250585 - RNA, 16 nt, Human
cacuuaaaaaugguuu

SEQ ID NO: 1250586 - RNA, 21 nt, Human
caccagucugacuguuuccau

SEQ ID NO: 1250587 - RNA, 19 nt, Human
cuacuaaaaauacaaaaau

SEQ ID NO: 1250588 - RNA, 18 nt, Human
auggugaaaugcagaguc

SEQ ID NO: 1250589 - RNA, 13 nt, Human
gacauaagcaaag

SEQ ID NO: 1250590 - RNA, 16 nt, Human
uugucaauaaaaucca

SEQ ID NO: 1250591 - RNA, 19 nt, Human
caucaaggguacacugccu

SEQ ID NO: 1250592 - RNA, 12 nt, Human
caucuucucugg

SEQ ID NO: 1250593 - RNA, 15 nt, Human
ucucauccugcaggc

SEQ ID NO: 1250594 - RNA, 13 nt, Human
aaaaaauaaaaau

SEQ ID NO: 1250595 - RNA, 14 nt, Human
agcucguggaacag

SEQ ID NO: 1250596 - RNA, 17 nt, Human
uccagcuggccgggagc

SEQ ID NO: 1250597 - RNA, 14 nt, Human
uccuguacuuuuuc

SEQ ID NO: 1250598 - RNA, 14 nt, Human
cgcccaucuccguc

SEQ ID NO: 1250599 - RNA, 20 nt, Human
uucgaugguacauauuucuu

SEQ ID NO: 1250600 - RNA, 15 nt, Human
aauuguaucuuaguu

SEQ ID NO: 1250601 - RNA, 17 nt, Human
ccacuggacucaccucc

SEQ ID NO: 1250602 - RNA, 22 nt, Human
aaucugcacugugggcuuuuau

SEQ ID NO: 1250603 - RNA, 16 nt, Human
caccacccuugccaug

SEQ ID NO: 1250604 - RNA, 12 nt, Human
ucuuaaagaauu

SEQ ID NO: 1250605 - RNA, 14 nt, Human
ucuauuuauuuacu

SEQ ID NO: 1250606 - RNA, 20 nt, Human
gagccucagucucccucccu

SEQ ID NO: 1250607 - RNA, 19 nt, Human
aucggagcugcuagaguuc

SEQ ID NO: 1250608 - RNA, 14 nt, Human
uauuuuuaccuuuu

SEQ ID NO: 1250609 - RNA, 20 nt, Human
uuuaauuuugaauaaauaaa

SEQ ID NO: 1250610 - RNA, 19 nt, Human
uucccuugaugaagaaguu

SEQ ID NO: 1250611 - RNA, 20 nt, Human
uuucuagggaaaugaaagaa

SEQ ID NO: 1250612 - RNA, 21 nt, Human
uagggugauauuaaccagggg

SEQ ID NO: 1250613 - RNA, 17 nt, Human
gaaaaucaggcuggcca

SEQ ID NO: 1250614 - RNA, 17 nt, Human
uuauaucaauuuaaaaa

SEQ ID NO: 1250615 - RNA, 15 nt, Human
auccugccccugagc

SEQ ID NO: 1250616 - RNA, 16 nt, Human
aacucaucauaaaaua

SEQ ID NO: 1250617 - RNA, 17 nt, Human
auauauguauuauuuau

SEQ ID NO: 1250618 - RNA, 19 nt, Human
uucaauacuucauuuaaaa

SEQ ID NO: 1250619 - RNA, 17 nt, Human
cuggcugggaguggcau

SEQ ID NO: 1250620 - RNA, 16 nt, Human
ucacaagugaaaaaca

SEQ ID NO: 1250621 - RNA, 22 nt, Human
uaaucagggaggucauuuuggu

SEQ ID NO: 1250622 - RNA, 17 nt, Human
caauacuucauuuaaaa

SEQ ID NO: 1250623 - RNA, 23 nt, Human
ccuugggcaggucacacaaccug

SEQ ID NO: 1250624 - RNA, 17 nt, Human
cuggacucaccuccccc

SEQ ID NO: 1250625 - RNA, 17 nt, Human
uuuaagauaauuauaau

SEQ ID NO: 1250626 - RNA, 16 nt, Human
cuucuggguuccuucc

SEQ ID NO: 1250627 - RNA, 15 nt, Human
cagcugccuccccuc

SEQ ID NO: 1250628 - RNA, 12 nt, Human
aacucagaaauu

SEQ ID NO: 1250629 - RNA, 23 nt, Human
acuuugugaaaaaaaauuuuaua

SEQ ID NO: 1250630 - RNA, 22 nt, Human
caaugcuguauuuuaaaagaau

SEQ ID NO: 1250631 - RNA, 22 nt, Human
aggcuccacuuggucugugaga

SEQ ID NO: 1250632 - RNA, 23 nt, Human
aaauugugaucagaccauaaugu

SEQ ID NO: 1250633 - RNA, 15 nt, Human
aagccuggcaaggga

SEQ ID NO: 1250634 - RNA, 17 nt, Human
gacucaccucccccauc

SEQ ID NO: 1250635 - RNA, 18 nt, Human
uaauuuugaauaaauaaa

SEQ ID NO: 1250636 - RNA, 17 nt, Human
auuuauaacaaccuaaa

SEQ ID NO: 1250637 - RNA, 18 nt, Human
cccacuagacccacugga

SEQ ID NO: 1250638 - RNA, 23 nt, Human
gcagccaugugauuacccucugg

SEQ ID NO: 1250639 - RNA, 23 nt, Human
gaggcauuuaggccaugggacag

SEQ ID NO: 1250640 - RNA, 14 nt, Human
aggcaagagaauug

SEQ ID NO: 1250641 - RNA, 13 nt, Human
ccuccaccucccu

SEQ ID NO: 1250642 - RNA, 22 nt, Human
aaugcuuaugaaacuaagauuu

SEQ ID NO: 1250643 - RNA, 17 nt, Human
caucccucccuccaccu

SEQ ID NO: 1250644 - RNA, 19 nt, Human
auguuuacagauccccaag

SEQ ID NO: 1250645 - RNA, 21 nt, Human
cuaaauugacacuuaaaaaug

SEQ ID NO: 1250646 - RNA, 17 nt, Human
gacuuuccuaaaucaau

SEQ ID NO: 1250647 - RNA, 22 nt, Human
gaaaaugaauaucuauuaauau

SEQ ID NO: 1250648 - RNA, 15 nt, Human
acaaagacaaauucu

SEQ ID NO: 1250649 - RNA, 18 nt, Human
cauauaauaaauguacau

SEQ ID NO: 1250650 - RNA, 23 nt, Human
gggucucccucuguugccaaggc

SEQ ID NO: 1250651 - RNA, 13 nt, Human
ucuaucuauuuau

SEQ ID NO: 1250652 - RNA, 18 nt, Human
uacuuuuuucauuauugg

SEQ ID NO: 1250653 - RNA, 19 nt, Human
caaucaaauaaguauuuau

SEQ ID NO: 1250654 - RNA, 19 nt, Human
gccccccagcccuccuuau

SEQ ID NO: 1250655 - RNA, 16 nt, Human
gaaucacuugaacccg

SEQ ID NO: 1250656 - RNA, 14 nt, Human
agcaaguauuagaa

SEQ ID NO: 1250657 - RNA, 15 nt, Human
gacgugacuggccug

SEQ ID NO: 1250658 - RNA, 17 nt, Human
cugauggguuucuccag

SEQ ID NO: 1250659 - RNA, 14 nt, Human
uuaauuauuauucu

SEQ ID NO: 1250660 - RNA, 13 nt, Human
gucucaguguccu

SEQ ID NO: 1250661 - RNA, 12 nt, Human
acaguuuuccuu

SEQ ID NO: 1250662 - RNA, 15 nt, Human
acaucaacagauaaa

SEQ ID NO: 1250663 - RNA, 16 nt, Human
cauccuuccucacacc

SEQ ID NO: 1250664 - RNA, 23 nt, Human
caccucauggaauuggagcucgu

SEQ ID NO: 1250665 - RNA, 13 nt, Human
cugagagugaaca

SEQ ID NO: 1250666 - RNA, 15 nt, Human
cuaagugcagccccg

SEQ ID NO: 1250667 - RNA, 22 nt, Human
aucauaaaauaaaguauauaua

SEQ ID NO: 1250668 - RNA, 15 nt, Human
cuggccaggcugguc

SEQ ID NO: 1250669 - RNA, 18 nt, Human
auaaaguauauauagaau

SEQ ID NO: 1250670 - RNA, 17 nt, Human
cauagagacuuugugaa

SEQ ID NO: 1250671 - RNA, 16 nt, Human
cagucucccucccuug

SEQ ID NO: 1250672 - RNA, 15 nt, Human
ggcagcuuuuucucu

SEQ ID NO: 1250673 - RNA, 18 nt, Human
gauggguuugacaagguu

SEQ ID NO: 1250674 - RNA, 18 nt, Human
guuuaugcauacaguaau

SEQ ID NO: 1250675 - RNA, 23 nt, Human
cugacuaauuaggcaaggcuaug

SEQ ID NO: 1250676 - RNA, 14 nt, Human
aaagaauuuuaaaa

SEQ ID NO: 1250677 - RNA, 21 nt, Human
gaagaaauuccaggaaaaucu

SEQ ID NO: 1250678 - RNA, 17 nt, Human
gcuuuauuuuuuaagua

SEQ ID NO: 1250679 - RNA, 18 nt, Human
cauggaauuggagcucgu

SEQ ID NO: 1250680 - RNA, 22 nt, Human
cuccugccuaagugcagccccg

SEQ ID NO: 1250681 - RNA, 18 nt, Human
aauuuuuuucaauauuua

SEQ ID NO: 1250682 - RNA, 20 nt, Human
augcuucuguuuuauaauuu

SEQ ID NO: 1250683 - RNA, 19 nt, Human
acuuuuuuuuuuuuuuaaa

SEQ ID NO: 1250684 - RNA, 14 nt, Human
ggcuccagcuggcc

SEQ ID NO: 1250685 - RNA, 14 nt, Human
ggcgcgcgccacca

SEQ ID NO: 1250686 - RNA, 20 nt, Human
cugcacacagcacgggggcc

SEQ ID NO: 1250687 - RNA, 20 nt, Human
uauauguguuuuucacauuu

SEQ ID NO: 1250688 - RNA, 21 nt, Human
gcccaagggugggugggguga

SEQ ID NO: 1250689 - RNA, 22 nt, Human
gaccuguaaucauauaauaaau

SEQ ID NO: 1250690 - RNA, 13 nt, Human
aagcauuccaacu

SEQ ID NO: 1250691 - RNA, 17 nt, Human
ugguaaaauacuucuug

SEQ ID NO: 1250692 - RNA, 19 nt, Human
ucagagcugcccucuccug

SEQ ID NO: 1250693 - RNA, 18 nt, Human
guaauauugcaaggcaaa

SEQ ID NO: 1250694 - RNA, 16 nt, Human
aaauaguuuaugauuc

SEQ ID NO: 1250695 - RNA, 13 nt, Human
ggaaagggucucc

SEQ ID NO: 1250696 - RNA, 21 nt, Human
aauguuauuuuuuaauuauua

SEQ ID NO: 1250697 - RNA, 17 nt, Human
gguccgaagucuuccau

SEQ ID NO: 1250698 - RNA, 16 nt, Human
aaguaauuucagaaga

SEQ ID NO: 1250699 - RNA, 20 nt, Human
agagauuuuuaaauaaagaa

SEQ ID NO: 1250700 - RNA, 13 nt, Human
uuaacauuauuua

SEQ ID NO: 1250701 - RNA, 22 nt, Human
cuuccuaauuccacagcugcuc

SEQ ID NO: 1250702 - RNA, 17 nt, Human
caaagcacgaaauguua

SEQ ID NO: 1250703 - RNA, 19 nt, Human
cagaaagcagaacagugau

SEQ ID NO: 1250704 - RNA, 22 nt, Human
agacccacuggacucaccuccc

SEQ ID NO: 1250705 - RNA, 20 nt, Human
gccaauauccuaauaaaaag

SEQ ID NO: 1250706 - RNA, 18 nt, Human
uuuccuucucaucuguga

SEQ ID NO: 1250707 - RNA, 21 nt, Human
uuuuuuuaaacaaaaaaagca

SEQ ID NO: 1250708 - RNA, 13 nt, Human
ccaaggaugcccc

SEQ ID NO: 1250709 - RNA, 19 nt, Human
auucccagccagcacagcc

SEQ ID NO: 1250710 - RNA, 14 nt, Human
agcugaacuuguug

SEQ ID NO: 1250711 - RNA, 15 nt, Human
aaguauauauagaau

SEQ ID NO: 1250712 - RNA, 19 nt, Human
uuuauaauuccuauauccu

SEQ ID NO: 1250713 - RNA, 22 nt, Human
ugggcacuguggguagacacac

SEQ ID NO: 1250714 - RNA, 21 nt, Human
acuccuaguaauuuaagauuu

SEQ ID NO: 1250715 - RNA, 16 nt, Human
ucuucaacucccugcc

SEQ ID NO: 1250716 - RNA, 17 nt, Human
cuucuagguucuaaaaa

SEQ ID NO: 1250717 - RNA, 17 nt, Human
uucucuaggaaauauuu

SEQ ID NO: 1250718 - RNA, 23 nt, Human
cugauaucaugccccuguacucc

SEQ ID NO: 1250719 - RNA, 20 nt, Human
aaucuauuuauuaauauuua

SEQ ID NO: 1250720 - RNA, 22 nt, Human
cuagauacugaauguaaacaaa

SEQ ID NO: 1250721 - RNA, 14 nt, Human
ucaccuguuuuuaa

SEQ ID NO: 1250722 - RNA, 16 nt, Human
gccuggcugggagugg

SEQ ID NO: 1250723 - RNA, 17 nt, Human
auguuuacagaucccca

SEQ ID NO: 1250724 - RNA, 16 nt, Human
uguccccuauccuacu

SEQ ID NO: 1250725 - RNA, 24 nt, Human
acauuugcgaaugguuccauucuc

SEQ ID NO: 1250726 - RNA, 14 nt, Human
aacuaagauuugua

SEQ ID NO: 1250727 - RNA, 16 nt, Human
guucugcacacagcac

SEQ ID NO: 1250728 - RNA, 13 nt, Human
aggcuagauguau

SEQ ID NO: 1250729 - RNA, 20 nt, Human
auuaaggcuucucuuaaaca

SEQ ID NO: 1250730 - RNA, 19 nt, Human
aacuauauuaucaugcaaa

SEQ ID NO: 1250731 - RNA, 17 nt, Human
cugcccucuccugggca

SEQ ID NO: 1250732 - RNA, 16 nt, Human
gcuuuuucucucccac

SEQ ID NO: 1250733 - RNA, 21 nt, Human
caacccccauuucuauuuauu

SEQ ID NO: 1250734 - RNA, 18 nt, Human
aagucugauuuuccugga

SEQ ID NO: 1250735 - RNA, 22 nt, Human
uauccuacuuccccuuccuaau

SEQ ID NO: 1250736 - RNA, 14 nt, Human
augauguuuagaaa

SEQ ID NO: 1250737 - RNA, 21 nt, Human
ugaacugauggguuucuccag

SEQ ID NO: 1250738 - RNA, 17 nt, Human
guguauuuucagcagag

SEQ ID NO: 1250739 - RNA, 15 nt, Human
gcaggcaugagucag

SEQ ID NO: 1250740 - RNA, 20 nt, Human
caauucuauuacgugcaaua

SEQ ID NO: 1250741 - RNA, 19 nt, Human
guacugagagugaacaaau

SEQ ID NO: 1250742 - RNA, 21 nt, Human
aagacaacauuaaaacaauau

SEQ ID NO: 1250743 - RNA, 14 nt, Human
auuacaucuuucac

SEQ ID NO: 1250744 - RNA, 14 nt, Human
ucucccucuguugc

SEQ ID NO: 1250745 - RNA, 21 nt, Human
uuacaguuagagauuuuuaaa

SEQ ID NO: 1250746 - RNA, 13 nt, Human
ugccaauauccua

SEQ ID NO: 1250747 - RNA, 16 nt, Human
gauagcuuuauuuuuu

SEQ ID NO: 1250748 - RNA, 16 nt, Human
gccaaggaugccccgu

SEQ ID NO: 1250749 - RNA, 15 nt, Human
acccggccugauuaa

SEQ ID NO: 1250750 - RNA, 18 nt, Human
cccaggcugagccucagu

SEQ ID NO: 1250751 - RNA, 13 nt, Human
cuggcuuaaaaug

SEQ ID NO: 1250752 - RNA, 23 nt, Human
uacuugggagaccuguaaucaua

SEQ ID NO: 1250753 - RNA, 17 nt, Human
acaugaaagcguaaaga

SEQ ID NO: 1250754 - RNA, 21 nt, Human
uuguaauucuaaaugaauguu

SEQ ID NO: 1250755 - RNA, 16 nt, Human
ccuacaugagguacug

SEQ ID NO: 1250756 - RNA, 19 nt, Human
ccauccugccccugagccc

SEQ ID NO: 1250757 - RNA, 17 nt, Human
gauuuuuaaauaaagaa

SEQ ID NO: 1250758 - RNA, 15 nt, Human
uuaaagacaaagaca

SEQ ID NO: 1250759 - RNA, 23 nt, Human
uuuuccuuccuuaucacugacac

SEQ ID NO: 1250760 - RNA, 15 nt, Human
uuuguaauauuucuc

SEQ ID NO: 1250761 - RNA, 23 nt, Human
agaccauaauguuacauuauuau

SEQ ID NO: 1250762 - RNA, 21 nt, Human
gacagaaagcagaacagugau

SEQ ID NO: 1250763 - RNA, 16 nt, Human
cauggugaaaccccgu

SEQ ID NO: 1250764 - RNA, 23 nt, Human
uaaauauaauaugcacacagugc

SEQ ID NO: 1250765 - RNA, 18 nt, Human
auuuauuacuguaagaaa

SEQ ID NO: 1250766 - RNA, 18 nt, Human
aagggaauuucuucaacu

SEQ ID NO: 1250767 - RNA, 16 nt, Human
auuuuaauaauguuuc

SEQ ID NO: 1250768 - RNA, 17 nt, Human
gcaugucagacagaacu

SEQ ID NO: 1250769 - RNA, 20 nt, Human
uuuaugaaacauuacaguua

SEQ ID NO: 1250770 - RNA, 20 nt, Human
cuccaccucccugcaauaaa

SEQ ID NO: 1250771 - RNA, 21 nt, Human
caauuauaagcuguuuuuaua

SEQ ID NO: 1250772 - RNA, 21 nt, Human
uacaugagguacugagaguga

SEQ ID NO: 1250773 - RNA, 16 nt, Human
guuacauuauuaucaa

SEQ ID NO: 1250774 - RNA, 16 nt, Human
gcaggauagaguggga

SEQ ID NO: 1250775 - RNA, 22 nt, Human
aaauauauuuaagauaauuaua

SEQ ID NO: 1250776 - RNA, 14 nt, Human
acuggccugcugga

SEQ ID NO: 1250777 - RNA, 13 nt, Human
uauuuauuuuuuu

SEQ ID NO: 1250778 - RNA, 19 nt, Human
caauuauaucaguccucuu

SEQ ID NO: 1250779 - RNA, 19 nt, Human
cagcacgggggccaaggau

SEQ ID NO: 1250780 - RNA, 13 nt, Human
gcaguucagagcu

SEQ ID NO: 1250781 - RNA, 19 nt, Human
aauguuuacagauccccaa

SEQ ID NO: 1250782 - RNA, 19 nt, Human
aaaacaaagaagacaacau

SEQ ID NO: 1250783 - RNA, 22 nt, Human
ugagacucugucucaguccaug

SEQ ID NO: 1250784 - RNA, 16 nt, Human
cagcuucucauccugc

SEQ ID NO: 1250785 - RNA, 11 nt, Human
uccucugggaa

SEQ ID NO: 1250786 - RNA, 20 nt, Human
caagcucuaucaccaaggag

SEQ ID NO: 1250787 - RNA, 20 nt, Human
aaguauuuauauauuuauaa

SEQ ID NO: 1250788 - RNA, 19 nt, Human
uaucucauuuccaagcaag

SEQ ID NO: 1250789 - RNA, 17 nt, Human
uuugaauccagaaauaa

SEQ ID NO: 1250790 - RNA, 20 nt, Human
uuugugaaaaaaaauuuuau

SEQ ID NO: 1250791 - RNA, 19 nt, Human
cuaguaucaaaagaaagaa

SEQ ID NO: 1250792 - RNA, 21 nt, Human
agggugauauuaaccaggggc

SEQ ID NO: 1250793 - RNA, 20 nt, Human
guucugcagauaaacaguag

SEQ ID NO: 1250794 - RNA, 14 nt, Human
cccacuggcucccu

SEQ ID NO: 1250795 - RNA, 21 nt, Human
cagugagacagcucugcauac

SEQ ID NO: 1250796 - RNA, 17 nt, Human
cuguauugcauuaaaua

SEQ ID NO: 1250797 - RNA, 23 nt, Human
gaaacguguauauuuuuuaugaa

SEQ ID NO: 1250798 - RNA, 11 nt, Human
uuuuuaaacaa

SEQ ID NO: 1250799 - RNA, 17 nt, Human
aaagaaacauuugguaa

SEQ ID NO: 1250800 - RNA, 15 nt, Human
augggacagggagga

SEQ ID NO: 1250801 - RNA, 16 nt, Human
gaauggcuaagcaaaa

SEQ ID NO: 1250802 - RNA, 23 nt, Human
caacuuugaagucugauuuuccu

SEQ ID NO: 1250803 - RNA, 18 nt, Human
agaaccuaaguuucaguu

SEQ ID NO: 1250804 - RNA, 17 nt, Human
aacaguuaccucugccu

SEQ ID NO: 1250805 - RNA, 12 nt, Human
ucuacacuccag

SEQ ID NO: 1250806 - RNA, 16 nt, Human
aaauauuauguuaaaa

SEQ ID NO: 1250807 - RNA, 18 nt, Human
uucacaagugaaaaacau

SEQ ID NO: 1250808 - RNA, 16 nt, Human
guuuuuuuuuaaaaaa

SEQ ID NO: 1250809 - RNA, 16 nt, Human
uaaauguacauuaauu

SEQ ID NO: 1250810 - RNA, 19 nt, Human
auucaaaaguugaaauuaa

SEQ ID NO: 1250811 - RNA, 15 nt, Human
acauguuuucuuugc

SEQ ID NO: 1250812 - RNA, 22 nt, Human
cccccugcaaagcccagcuuga

SEQ ID NO: 1250813 - RNA, 14 nt, Human
caguucugaagaag

SEQ ID NO: 1250814 - RNA, 15 nt, Human
ggccuucggccucca

SEQ ID NO: 1250815 - RNA, 14 nt, Human
cagauuugagcuca

SEQ ID NO: 1250816 - RNA, 16 nt, Human
auccuacaagacacag

SEQ ID NO: 1250817 - RNA, 15 nt, Human
ugaauaucuauuaau

SEQ ID NO: 1250818 - RNA, 18 nt, Human
cagcuacuugggaggcug

SEQ ID NO: 1250819 - RNA, 13 nt, Human
uuuuaaaaaagaa

SEQ ID NO: 1250820 - RNA, 14 nt, Human
uaauuauuauucuu

SEQ ID NO: 1250821 - RNA, 18 nt, Human
auuuucuuccaaacagaa

SEQ ID NO: 1250822 - RNA, 22 nt, Human
acagauuugagcucagcccugg

SEQ ID NO: 1250823 - RNA, 20 nt, Human
auuuuuaccuuuuuccuucc

SEQ ID NO: 1250824 - RNA, 11 nt, Human
cagcugccucc

SEQ ID NO: 1250825 - RNA, 16 nt, Human
acugaauguaaacaaa

SEQ ID NO: 1250826 - RNA, 16 nt, Human
uacccucugggucuca

SEQ ID NO: 1250827 - RNA, 13 nt, Human
ugaaagcguaaag

SEQ ID NO: 1250828 - RNA, 13 nt, Human
ccgggaguggcgc

SEQ ID NO: 1250829 - RNA, 13 nt, Human
gguggggugaggg

SEQ ID NO: 1250830 - RNA, 20 nt, Human
auaguucaaagccaaguuua

SEQ ID NO: 1250831 - RNA, 15 nt, Human
ccaaggagccaaaca

SEQ ID NO: 1250832 - RNA, 17 nt, Human
aagcugaauacauucug

SEQ ID NO: 1250833 - RNA, 13 nt, Human
caaaaaaagcauu

SEQ ID NO: 1250834 - RNA, 23 nt, Human
uuaucagucauaacuaaauaaag

SEQ ID NO: 1250835 - RNA, 18 nt, Human
aaauauuuauuuuaauaa

SEQ ID NO: 1250836 - RNA, 23 nt, Human
aauagaaacguguauauuuuuua

SEQ ID NO: 1250837 - RNA, 16 nt, Human
auuguuugucugucuu

SEQ ID NO: 1250838 - RNA, 21 nt, Human
cacaacuauauuaucaugcaa

SEQ ID NO: 1250839 - RNA, 14 nt, Human
uccaaacagaacua

SEQ ID NO: 1250840 - RNA, 15 nt, Human
aauaaugaaauaacu

SEQ ID NO: 1250841 - RNA, 16 nt, Human
aauuucagaagaaauu

SEQ ID NO: 1250842 - RNA, 21 nt, Human
aauacuucauuuaaaauauuu

SEQ ID NO: 1250843 - RNA, 15 nt, Human
aaucuaaaucuauuu

SEQ ID NO: 1250844 - RNA, 17 nt, Human
uugugaagcaaaauuuu

SEQ ID NO: 1250845 - RNA, 20 nt, Human
auauauguguuuuucacauu

SEQ ID NO: 1250846 - RNA, 18 nt, Human
aaagaaaaucaggcuggc

SEQ ID NO: 1250847 - RNA, 20 nt, Human
acgugacuggccugcuggau

SEQ ID NO: 1250848 - RNA, 23 nt, Human
uuuagaaagaagcccaauauuau

SEQ ID NO: 1250849 - RNA, 13 nt, Human
cuauuuaaagaca

SEQ ID NO: 1250850 - RNA, 17 nt, Human
auucaaaaguugaaauu

SEQ ID NO: 1250851 - RNA, 13 nt, Human
ucugauuuuccug

SEQ ID NO: 1250852 - RNA, 23 nt, Human
ucccagccagcaguucagagcug

SEQ ID NO: 1250853 - RNA, 17 nt, Human
agcugacccagccccuu

SEQ ID NO: 1250854 - RNA, 14 nt, Human
agcucuaucaccaa

SEQ ID NO: 1250855 - RNA, 21 nt, Human
uuucgaugguacauauuucuu

SEQ ID NO: 1250856 - RNA, 17 nt, Human
auuucaugaaaagauua

SEQ ID NO: 1250857 - RNA, 19 nt, Human
ucaauucuauuacgugcaa

SEQ ID NO: 1250858 - RNA, 16 nt, Human
aguagauuaagagaug

SEQ ID NO: 1250859 - RNA, 21 nt, Human
agucucccucccuuggggccu

SEQ ID NO: 1250860 - RNA, 17 nt, Human
gccaugggacagggagg

SEQ ID NO: 1250861 - RNA, 21 nt, Human
ugcaggcagcuuuuucucucc

SEQ ID NO: 1250862 - RNA, 19 nt, Human
uauuuacugagcuucucug

SEQ ID NO: 1250863 - RNA, 16 nt, Human
ugcgaaugguuccauu

SEQ ID NO: 1250864 - RNA, 17 nt, Human
caccagggccuggcugg

SEQ ID NO: 1250865 - RNA, 13 nt, Human
ccucauggaauug

SEQ ID NO: 1250866 - RNA, 17 nt, Human
guguccccuauccuacu

SEQ ID NO: 1250867 - RNA, 15 nt, Human
uugaauccagaaaua

SEQ ID NO: 1250868 - RNA, 17 nt, Human
gccuccccuccucugcu

SEQ ID NO: 1250869 - RNA, 22 nt, Human
gaagugaaaaucuacacuccag

SEQ ID NO: 1250870 - RNA, 11 nt, Human
augggacaggg

SEQ ID NO: 1250871 - RNA, 22 nt, Human
ccacagcuguaugauucccagc

SEQ ID NO: 1250872 - RNA, 15 nt, Human
ugccuccccuccucu

SEQ ID NO: 1250873 - RNA, 15 nt, Human
ucaaaagguauuuau

SEQ ID NO: 1250874 - RNA, 21 nt, Human
ucaguuuccugaccuaugaaa

SEQ ID NO: 1250875 - RNA, 19 nt, Human
acaauagcagacaguguuu

SEQ ID NO: 1250876 - RNA, 20 nt, Human
guaucaaaagaaagaaaauc

SEQ ID NO: 1250877 - RNA, 18 nt, Human
cauaguaccaaucauuuu

SEQ ID NO: 1250878 - RNA, 16 nt, Human
gugagacagcucugca

SEQ ID NO: 1250879 - RNA, 12 nt, Human
gcaaagcccagc

SEQ ID NO: 1250880 - RNA, 20 nt, Human
ccauuguggucacaggaagu

SEQ ID NO: 1250881 - RNA, 16 nt, Human
uaauuuaagauuuugu

SEQ ID NO: 1250882 - RNA, 11 nt, Human
ggucacaggaa

SEQ ID NO: 1250883 - RNA, 13 nt, Human
uacagagacagaa

SEQ ID NO: 1250884 - RNA, 22 nt, Human
auguacauuuccaaauucacaa

SEQ ID NO: 1250885 - RNA, 20 nt, Human
ggccaugggacagggaggac

SEQ ID NO: 1250886 - RNA, 18 nt, Human
cccucuggcuccagcugg

SEQ ID NO: 1250887 - RNA, 23 nt, Human
gggagccugaucaccugcccugc

SEQ ID NO: 1250888 - RNA, 23 nt, Human
auuacaucuuucacauuggcuau

SEQ ID NO: 1250889 - RNA, 13 nt, Human
ucauuuaaaauau

SEQ ID NO: 1250890 - RNA, 17 nt, Human
uagagugggacaguucc

SEQ ID NO: 1250891 - RNA, 20 nt, Human
gcccauccugccccugagcc

SEQ ID NO: 1250892 - RNA, 19 nt, Human
auaaaguauauauagaauc

SEQ ID NO: 1250893 - RNA, 17 nt, Human
agacuuugugaaaaaaa

SEQ ID NO: 1250894 - RNA, 13 nt, Human
uuauugagcaccu

SEQ ID NO: 1250895 - RNA, 23 nt, Human
cuccuguacuuuuuccagacacu

SEQ ID NO: 1250896 - RNA, 22 nt, Human
ccaucccucccuccaccucccu

SEQ ID NO: 1250897 - RNA, 22 nt, Human
acuucacuuuuuuucuuuucuc

SEQ ID NO: 1250898 - RNA, 20 nt, Human
aacucaucauaaaauaaagu

SEQ ID NO: 1250899 - RNA, 17 nt, Human
ugcccaagaaugagaag

SEQ ID NO: 1250900 - RNA, 16 nt, Human
aaucauuuuaauuauu

SEQ ID NO: 1250901 - RNA, 22 nt, Human
uuauaaucuuuuauacaguguc

SEQ ID NO: 1250902 - RNA, 17 nt, Human
cagacaucaacagauaa

SEQ ID NO: 1250903 - RNA, 15 nt, Human
auaaagaauuuuaaa

SEQ ID NO: 1250904 - RNA, 17 nt, Human
agauagguuaccaguaa

SEQ ID NO: 1250905 - RNA, 17 nt, Human
cgugacuggccugcugg

SEQ ID NO: 1250906 - RNA, 18 nt, Human
uguggucacaggaaguag

SEQ ID NO: 1250907 - RNA, 14 nt, Human
uauaaauuuuccca

SEQ ID NO: 1250908 - RNA, 20 nt, Human
cucuacuaaaaauacaaaaa

SEQ ID NO: 1250909 - RNA, 16 nt, Human
cagcuuuuucucuccc

SEQ ID NO: 1250910 - RNA, 20 nt, Human
uaaaauuaucaauaucuaau

SEQ ID NO: 1250911 - RNA, 22 nt, Human
cccuauccuacuuccccuuccu

SEQ ID NO: 1250912 - RNA, 17 nt, Human
uuagccgggcauggugg

SEQ ID NO: 1250913 - RNA, 12 nt, Human
uacaauugaaau

SEQ ID NO: 1250914 - RNA, 16 nt, Human
acacaaccugucccag

SEQ ID NO: 1250915 - RNA, 17 nt, Human
uaagaaauaugcacaau

SEQ ID NO: 1250916 - RNA, 16 nt, Human
acuuuggcaaaugagc

SEQ ID NO: 1250917 - RNA, 18 nt, Human
uuagagauuuuuaaauaa

SEQ ID NO: 1250918 - RNA, 17 nt, Human
cugagaugggagaauca

SEQ ID NO: 1250919 - RNA, 20 nt, Human
gaauccagaaauaaugaaau

SEQ ID NO: 1250920 - RNA, 14 nt, Human
aaaagaaacauuug

SEQ ID NO: 1250921 - RNA, 17 nt, Human
cuuguuagcaaaaugga

SEQ ID NO: 1250922 - RNA, 19 nt, Human
ugagcgcccacuagaccca

SEQ ID NO: 1250923 - RNA, 19 nt, Human
acugcuggauucaagugau

SEQ ID NO: 1250924 - RNA, 18 nt, Human
uguauuuuuaccuuuuuc

SEQ ID NO: 1250925 - RNA, 18 nt, Human
cuuuaauuucaugaaaag

SEQ ID NO: 1250926 - RNA, 21 nt, Human
gcuggaauugaauucccugcc

SEQ ID NO: 1250927 - RNA, 20 nt, Human
auuuauauauuuauaacuca

SEQ ID NO: 1250928 - RNA, 23 nt, Human
cugcccucuccugggcagcugcc

SEQ ID NO: 1250929 - RNA, 11 nt, Human
ggguuucucca

SEQ ID NO: 1250930 - RNA, 18 nt, Human
uggugugcuggcuuaaaa

SEQ ID NO: 1250931 - RNA, 17 nt, Human
aaauuaaggcauaagaa

SEQ ID NO: 1250932 - RNA, 15 nt, Human
gaugcacuuuauauu

SEQ ID NO: 1250933 - RNA, 13 nt, Human
uagaauaauacua

SEQ ID NO: 1250934 - RNA, 17 nt, Human
cauuugcacuauuggaa

SEQ ID NO: 1250935 - RNA, 13 nt, Human
aguuaccucugcc

SEQ ID NO: 1250936 - RNA, 20 nt, Human
cuugccauaauuacuauguc

SEQ ID NO: 1250937 - RNA, 18 nt, Human
cagcugcucaauaaagua

SEQ ID NO: 1250938 - RNA, 19 nt, Human
gaaauaaaaguagaauaaa

SEQ ID NO: 1250939 - RNA, 17 nt, Human
gacagucaccucaugga

SEQ ID NO: 1250940 - RNA, 15 nt, Human
ugcuucuguuuuaua

SEQ ID NO: 1250941 - RNA, 21 nt, Human
ugggaggcugagaugggagaa

SEQ ID NO: 1250942 - RNA, 19 nt, Human
gagccugaucaccugcccu

SEQ ID NO: 1250943 - RNA, 21 nt, Human
gcuaaguugcaccaacuuuga

SEQ ID NO: 1250944 - RNA, 13 nt, Human
cacacugaagaag

SEQ ID NO: 1250945 - RNA, 15 nt, Human
ccuugccaugugcua

SEQ ID NO: 1250946 - RNA, 19 nt, Human
cuugccugcaggcaugagu

SEQ ID NO: 1250947 - RNA, 21 nt, Human
caagcuuuuuuuuuuuuucuu

SEQ ID NO: 1250948 - RNA, 17 nt, Human
cacgccuguaaucccag

SEQ ID NO: 1250949 - RNA, 21 nt, Human
ucacuuaauccuuuguuuucu

SEQ ID NO: 1250950 - RNA, 17 nt, Human
uaacugcauugagaacu

SEQ ID NO: 1250951 - RNA, 16 nt, Human
uauguauuauuuauaa

SEQ ID NO: 1250952 - RNA, 17 nt, Human
cuuguuauuuauaacaa

SEQ ID NO: 1250953 - RNA, 21 nt, Human
cccccauuguggucacaggaa

SEQ ID NO: 1250954 - RNA, 14 nt, Human
ucaucauaaaauaa

SEQ ID NO: 1250955 - RNA, 15 nt, Human
uauguauuauuuaua

SEQ ID NO: 1250956 - RNA, 18 nt, Human
acuucaauacuucauuua

SEQ ID NO: 1250957 - RNA, 15 nt, Human
auuuguuuguauuuu

SEQ ID NO: 1250958 - RNA, 17 nt, Human
aacguguauauuuuuua

SEQ ID NO: 1250959 - RNA, 20 nt, Human
aaacuuuaugcuaagugaaa

SEQ ID NO: 1250960 - RNA, 19 nt, Human
cacaggaaccacaagacug

SEQ ID NO: 1250961 - RNA, 19 nt, Human
cuucuggguucaagcgauu

SEQ ID NO: 1250962 - RNA, 21 nt, Human
aggacagcccuucuuuccaca

SEQ ID NO: 1250963 - RNA, 15 nt, Human
ucauuuaaaauauuu

SEQ ID NO: 1250964 - RNA, 16 nt, Human
ugugcuggcuuaaaau

SEQ ID NO: 1250965 - RNA, 13 nt, Human
cuugacuuuggca

SEQ ID NO: 1250966 - RNA, 14 nt, Human
uguacuuuuuccag

SEQ ID NO: 1250967 - RNA, 22 nt, Human
uccuuuucgaugguacauauuu

SEQ ID NO: 1250968 - RNA, 18 nt, Human
uccagaaauaaugaaaua

SEQ ID NO: 1250969 - RNA, 14 nt, Human
gaaaggagaaguua

SEQ ID NO: 1250970 - RNA, 19 nt, Human
aguaacucauuuguuaaaa

SEQ ID NO: 1250971 - RNA, 15 nt, Human
cauccugcaggcagc

SEQ ID NO: 1250972 - RNA, 19 nt, Human
cccccucuggcuccagcug

SEQ ID NO: 1250973 - RNA, 17 nt, Human
accagggccuggcuggg

SEQ ID NO: 1250974 - RNA, 15 nt, Human
caccuucuggguuca

SEQ ID NO: 1250975 - RNA, 17 nt, Human
gagacaccaccacccuu

SEQ ID NO: 1250976 - RNA, 18 nt, Human
caugaagauguagaggag

SEQ ID NO: 1250977 - RNA, 20 nt, Human
gagccugaucaccugcccug

SEQ ID NO: 1250978 - RNA, 19 nt, Human
ggaauuucuucaacucccu

SEQ ID NO: 1250979 - RNA, 21 nt, Human
auaauuuuuauauuugaaaua

SEQ ID NO: 1250980 - RNA, 17 nt, Human
gcaugguuuagaaagcu

SEQ ID NO: 1250981 - RNA, 17 nt, Human
aguauuucuaugaaaua

SEQ ID NO: 1250982 - RNA, 17 nt, Human
gacaaaugcuuaugaaa

SEQ ID NO: 1250983 - RNA, 15 nt, Human
ccuugguauagcaua

SEQ ID NO: 1250984 - RNA, 23 nt, Human
cagaaauuuaauucauguuucuu

SEQ ID NO: 1250985 - RNA, 16 nt, Human
ugccucaccccuugcc

SEQ ID NO: 1250986 - RNA, 13 nt, Human
ccucugcuugcca

SEQ ID NO: 1250987 - RNA, 20 nt, Human
acaccaccacccuugccaug

SEQ ID NO: 1250988 - RNA, 19 nt, Human
cugcuggauguggaggggg

SEQ ID NO: 1250989 - RNA, 16 nt, Human
cuaaaucuauuuauua

SEQ ID NO: 1250990 - RNA, 21 nt, Human
aaugacacuagcuaauaucaa

SEQ ID NO: 1250991 - RNA, 14 nt, Human
uuaaaguuaaauaa

SEQ ID NO: 1250992 - RNA, 12 nt, Human
cccccagcccuc

SEQ ID NO: 1250993 - RNA, 16 nt, Human
cacuguuaucaaaacu

SEQ ID NO: 1250994 - RNA, 21 nt, Human
auugaaaugacuaaaaaacaa

SEQ ID NO: 1250995 - RNA, 17 nt, Human
uccuacaagcuaaaauu

SEQ ID NO: 1250996 - RNA, 20 nt, Human
uuaauauuuaacauuauuua

SEQ ID NO: 1250997 - RNA, 19 nt, Human
auaaugaaauaacuaggcg

SEQ ID NO: 1250998 - RNA, 18 nt, Human
ggauagcugacccagccc

SEQ ID NO: 1250999 - RNA, 15 nt, Human
ggucucgaacugcug

SEQ ID NO: 1251000 - RNA, 15 nt, Human
uuuucugcuuuaauu

SEQ ID NO: 1251001 - RNA, 12 nt, Human
guccucuuucaa

SEQ ID NO: 1251002 - RNA, 20 nt, Human
agcaaagacuaugaggaaua

SEQ ID NO: 1251003 - RNA, 17 nt, Human
auuugcagcugugccau

SEQ ID NO: 1251004 - RNA, 20 nt, Human
uuuauaacucaucauaaaau

SEQ ID NO: 1251005 - RNA, 23 nt, Human
gucucccucccuuggggccuaug

SEQ ID NO: 1251006 - RNA, 17 nt, Human
auuuacuuuguuauuuu

SEQ ID NO: 1251007 - RNA, 18 nt, Human
ccucuccugggcagcugc

SEQ ID NO: 1251008 - RNA, 14 nt, Human
uauuuauuuuaaua

SEQ ID NO: 1251009 - RNA, 20 nt, Human
uauacuguauuuuuaccuuu

SEQ ID NO: 1251010 - RNA, 11 nt, Human
ggcuuguaaag

SEQ ID NO: 1251011 - RNA, 22 nt, Human
gaugguucccuugaugaagaag

SEQ ID NO: 1251012 - RNA, 21 nt, Human
auugggaaaggaguagaaaaa

SEQ ID NO: 1251013 - RNA, 15 nt, Human
aauguuacauuauua

SEQ ID NO: 1251014 - RNA, 12 nt, Human
uuauauacaauu

SEQ ID NO: 1251015 - RNA, 20 nt, Human
aaauuaaggcauaagaaaac

SEQ ID NO: 1251016 - RNA, 20 nt, Human
agcccuggugggcagagagg

SEQ ID NO: 1251017 - RNA, 16 nt, Human
cagaagcaacccaaau

SEQ ID NO: 1251018 - RNA, 14 nt, Human
auuuguauaaaaua

SEQ ID NO: 1251019 - RNA, 23 nt, Human
uccguggcacugcauacaaucug

SEQ ID NO: 1251020 - RNA, 15 nt, Human
guacuggcugaugga

SEQ ID NO: 1251021 - RNA, 13 nt, Human
caucccucccucc

SEQ ID NO: 1251022 - RNA, 18 nt, Human
cucccuuggggccuaugc

SEQ ID NO: 1251023 - RNA, 15 nt, Human
cagaacuauggaaaa

SEQ ID NO: 1251024 - RNA, 12 nt, Human
cuuccucugagc

SEQ ID NO: 1251025 - RNA, 18 nt, Human
cuggaaacuucagcgguu

SEQ ID NO: 1251026 - RNA, 15 nt, Human
auauguauuuauaaa

SEQ ID NO: 1251027 - RNA, 21 nt, Human
gugaaauaguucaaagccaag

SEQ ID NO: 1251028 - RNA, 21 nt, Human
cuucucuuaaacacuaaaaag

SEQ ID NO: 1251029 - RNA, 19 nt, Human
ugacacuagcuaauaucaa

SEQ ID NO: 1251030 - RNA, 21 nt, Human
cauuucaaaagguauuuauug

SEQ ID NO: 1251031 - RNA, 16 nt, Human
ucaguguccucaucug

SEQ ID NO: 1251032 - RNA, 14 nt, Human
uuuguauaaaauaa

SEQ ID NO: 1251033 - RNA, 23 nt, Human
ggaggcagagguugcagugagcc

SEQ ID NO: 1251034 - RNA, 18 nt, Human
gccccgucccccucuggc

SEQ ID NO: 1251035 - RNA, 23 nt, Human
cacaagaaaugaaagcagggacu

SEQ ID NO: 1251036 - RNA, 22 nt, Human
caucccucccuccaccucccug

SEQ ID NO: 1251037 - RNA, 18 nt, Human
uaaaucuauuuauuaaua

SEQ ID NO: 1251038 - RNA, 22 nt, Human
cugucucacuuaauccuuuguu

SEQ ID NO: 1251039 - RNA, 20 nt, Human
ugagaccacuguuaucaaaa

SEQ ID NO: 1251040 - RNA, 15 nt, Human
uccaagccucauguc

SEQ ID NO: 1251041 - RNA, 21 nt, Human
cccugcagacaugagagacag

SEQ ID NO: 1251042 - RNA, 19 nt, Human
uauguaacugcauugagaa

SEQ ID NO: 1251043 - RNA, 13 nt, Human
aacucccugcccc

SEQ ID NO: 1251044 - RNA, 21 nt, Human
ucaaauuccagaaugauuuua

SEQ ID NO: 1251045 - RNA, 11 nt, Human
aauuauuauuu

SEQ ID NO: 1251046 - RNA, 12 nt, Human
aguuuuccuucu

SEQ ID NO: 1251047 - RNA, 15 nt, Human
gggcucuggaaacca

SEQ ID NO: 1251048 - RNA, 14 nt, Human
uggagacaccacca

SEQ ID NO: 1251049 - RNA, 14 nt, Human
aagcucuaucacca

SEQ ID NO: 1251050 - RNA, 17 nt, Human
acugugacuguacccaa

SEQ ID NO: 1251051 - RNA, 16 nt, Human
agccucagucucccuc

SEQ ID NO: 1251052 - RNA, 22 nt, Human
gugauuacccucugggucucag

SEQ ID NO: 1251053 - RNA, 15 nt, Human
caaauucuguuucuu

SEQ ID NO: 1251054 - RNA, 13 nt, Human
uaaauuugguucu

SEQ ID NO: 1251055 - RNA, 14 nt, Human
gaaacauuacaguu

SEQ ID NO: 1251056 - RNA, 13 nt, Human
ccaggcugagccu

SEQ ID NO: 1251057 - RNA, 15 nt, Human
aggagauggaaguug

SEQ ID NO: 1251058 - RNA, 12 nt, Human
aauugcagagua

SEQ ID NO: 1251059 - RNA, 13 nt, Human
ccauuccaagccu

SEQ ID NO: 1251060 - RNA, 14 nt, Human
uccaccucccugca

SEQ ID NO: 1251061 - RNA, 17 nt, Human
uguugacaacugugacu

SEQ ID NO: 1251062 - RNA, 12 nt, Human
aaaacaaagaag

SEQ ID NO: 1251063 - RNA, 13 nt, Human
gaaccuaggguga

SEQ ID NO: 1251064 - RNA, 14 nt, Human
cccucuccugggca

SEQ ID NO: 1251065 - RNA, 15 nt, Human
uugacacuuaaaaau

SEQ ID NO: 1251066 - RNA, 14 nt, Human
cugacccagccccu

SEQ ID NO: 1251067 - RNA, 15 nt, Human
cucccuccaccuccc

SEQ ID NO: 1251068 - RNA, 20 nt, Human
aacuaauagaauuaauggaa

SEQ ID NO: 1251069 - RNA, 14 nt, Human
gaaggcuuacaccc

SEQ ID NO: 1251070 - RNA, 16 nt, Human
agacaccaccacccuu

SEQ ID NO: 1251071 - RNA, 16 nt, Human
uuuggcuuguaaagua

SEQ ID NO: 1251072 - RNA, 16 nt, Human
aucaguuacucugaag

SEQ ID NO: 1251073 - RNA, 21 nt, Human
aauaauguuucaaacauauau

SEQ ID NO: 1251074 - RNA, 15 nt, Human
cugacucuuaagaag

SEQ ID NO: 1251075 - RNA, 17 nt, Human
ugaccacugcagaagac

SEQ ID NO: 1251076 - RNA, 14 nt, Human
uuuguaauauuucu

SEQ ID NO: 1251077 - RNA, 15 nt, Human
ccucuaaaaggccug

SEQ ID NO: 1251078 - RNA, 21 nt, Human
uggcuuaaaauguaauuaauc

SEQ ID NO: 1251079 - RNA, 22 nt, Human
cagcacgggggccaaggaugcc

SEQ ID NO: 1251080 - RNA, 23 nt, Human
acucuauguucuaagaagugaaa

SEQ ID NO: 1251081 - RNA, 21 nt, Human
cuuuucaaaauuggacuuaaa

SEQ ID NO: 1251082 - RNA, 17 nt, Human
aaggccugucccugcag

SEQ ID NO: 1251083 - RNA, 13 nt, Human
gcgugcaggcagc

SEQ ID NO: 1251084 - RNA, 17 nt, Human
cucgugggacagucacc

SEQ ID NO: 1251085 - RNA, 11 nt, Human
augcugccaau

SEQ ID NO: 1251086 - RNA, 19 nt, Human
cuacuugggaggcugaggc

SEQ ID NO: 1251087 - RNA, 13 nt, Human
cucagaaaacaag

SEQ ID NO: 1251088 - RNA, 14 nt, Human
auuuauugagcacc

SEQ ID NO: 1251089 - RNA, 18 nt, Human
cuuuucccaacuccagaa

SEQ ID NO: 1251090 - RNA, 22 nt, Human
ccggagccccuugggcagguca

SEQ ID NO: 1251091 - RNA, 11 nt, Human
uccauuguaau

SEQ ID NO: 1251092 - RNA, 18 nt, Human
agcugccuccccuccucu

SEQ ID NO: 1251093 - RNA, 16 nt, Human
guacccaaauggaaag

SEQ ID NO: 1251094 - RNA, 22 nt, Human
aaggcaaagcacgaaauguuau

SEQ ID NO: 1251095 - RNA, 18 nt, Human
aauucaaacuaauagaau

SEQ ID NO: 1251096 - RNA, 23 nt, Human
caucauaaaauaaaguauauaua

SEQ ID NO: 1251097 - RNA, 23 nt, Human
auaucuuuuuuuuaauaaaccau

SEQ ID NO: 1251098 - RNA, 17 nt, Human
uauaauauacuauauuu

SEQ ID NO: 1251099 - RNA, 16 nt, Human
aucaauuuaaaaaaaa

SEQ ID NO: 1251100 - RNA, 23 nt, Human
auuacaguuagagauuuuuaaau

SEQ ID NO: 1251101 - RNA, 13 nt, Human
acaugaagaagcu

SEQ ID NO: 1251102 - RNA, 19 nt, Human
uggcaagcucuaucaccaa

SEQ ID NO: 1251103 - RNA, 13 nt, Human
aaaaagccaaaaa

SEQ ID NO: 1251104 - RNA, 16 nt, Human
gacaaccaugagacca

SEQ ID NO: 1251105 - RNA, 22 nt, Human
auaucuuuuuuuuaauaaacca

SEQ ID NO: 1251106 - RNA, 23 nt, Human
auagcauauguuuuuguaaguuu

SEQ ID NO: 1251107 - RNA, 20 nt, Human
auuacuguaagaaaauauca

SEQ ID NO: 1251108 - RNA, 12 nt, Human
aauuuuucucua

SEQ ID NO: 1251109 - RNA, 20 nt, Human
caaauguucaucaaugaaug

SEQ ID NO: 1251110 - RNA, 15 nt, Human
gauuccugagccagu

SEQ ID NO: 1251111 - RNA, 10 nt, Human
acauauuucu

SEQ ID NO: 1251112 - RNA, 14 nt, Human
cucagucucccucc

SEQ ID NO: 1251113 - RNA, 12 nt, Human
uuguuuuuccac

SEQ ID NO: 1251114 - RNA, 21 nt, Human
guuuuuauauaugugaaauaa

SEQ ID NO: 1251115 - RNA, 15 nt, Human
acaaaaacaaacaaa

SEQ ID NO: 1251116 - RNA, 22 nt, Human
gcacagccucuuagaugcaguu

SEQ ID NO: 1251117 - RNA, 23 nt, Human
auaauguuacauuauuaucaaca

SEQ ID NO: 1251118 - RNA, 20 nt, Human
ggcaggucacacaaccuguc

SEQ ID NO: 1251119 - RNA, 14 nt, Human
caaggcuagaacca

SEQ ID NO: 1251120 - RNA, 16 nt, Human
agaugcuagaacuccc

SEQ ID NO: 1251121 - RNA, 21 nt, Human
cuauuauagaauggaacucaa

SEQ ID NO: 1251122 - RNA, 19 nt, Human
ugggacaggggagaaccua

SEQ ID NO: 1251123 - RNA, 17 nt, Human
cuuccucugagccuugg

SEQ ID NO: 1251124 - RNA, 20 nt, Human
uuaaauggucaauuuuguua

SEQ ID NO: 1251125 - RNA, 18 nt, Human
uguuauuuuuuaauuauu

SEQ ID NO: 1251126 - RNA, 22 nt, Human
auuacuguaagaaaauaucacu

SEQ ID NO: 1251127 - RNA, 19 nt, Human
aacuauggaaaaaaaggaa

SEQ ID NO: 1251128 - RNA, 13 nt, Human
uuacaaggcuuua

SEQ ID NO: 1251129 - RNA, 22 nt, Human
ucucuuaaacacuaaaaaggca

SEQ ID NO: 1251130 - RNA, 15 nt, Human
aauuuuuuucaucuu

SEQ ID NO: 1251131 - RNA, 21 nt, Human
ucuucaacucccugcccccca

SEQ ID NO: 1251132 - RNA, 17 nt, Human
aauauuuuuaugugcaa

SEQ ID NO: 1251133 - RNA, 14 nt, Human
cugccgcaacaguu

SEQ ID NO: 1251134 - RNA, 12 nt, Human
acaugagguacu

SEQ ID NO: 1251135 - RNA, 16 nt, Human
aagauuuguaauauuu

SEQ ID NO: 1251136 - RNA, 14 nt, Human
uguaacugcauuga

SEQ ID NO: 1251137 - RNA, 21 nt, Human
acaguuaccucugccucagaa

SEQ ID NO: 1251138 - RNA, 17 nt, Human
uaauuuaugaguuuuug

SEQ ID NO: 1251139 - RNA, 14 nt, Human
ggccagaagucaag

SEQ ID NO: 1251140 - RNA, 13 nt, Human
uggcuccagcugg

SEQ ID NO: 1251141 - RNA, 20 nt, Human
agagacacacugaagaagca

SEQ ID NO: 1251142 - RNA, 20 nt, Human
uauuuauaaauauauuuaag

SEQ ID NO: 1251143 - RNA, 15 nt, Human
uauuguaccucucuu

SEQ ID NO: 1251144 - RNA, 15 nt, Human
aguauuuauauauuu

SEQ ID NO: 1251145 - RNA, 14 nt, Human
cuuaggaagagaaa

SEQ ID NO: 1251146 - RNA, 16 nt, Human
agaacucugagcagug

SEQ ID NO: 1251147 - RNA, 21 nt, Human
auuuuccugaaaacccuugcc

SEQ ID NO: 1251148 - RNA, 18 nt, Human
ggaaagacagcuucucau

SEQ ID NO: 1251149 - RNA, 17 nt, Human
agaaucacuugaacccg

SEQ ID NO: 1251150 - RNA, 19 nt, Human
gcugcccucuccugggcag

SEQ ID NO: 1251151 - RNA, 16 nt, Human
ggccuccauccugagg

SEQ ID NO: 1251152 - RNA, 14 nt, Human
cuacuuuaaaaaaa

SEQ ID NO: 1251153 - RNA, 17 nt, Human
gccugcuggauguggag

SEQ ID NO: 1251154 - RNA, 17 nt, Human
gcgccaccacgcccagc

SEQ ID NO: 1251155 - RNA, 13 nt, Human
aucaaugaaugaa

SEQ ID NO: 1251156 - RNA, 18 nt, Human
aaaugugcaauaugugau

SEQ ID NO: 1251157 - RNA, 19 nt, Human
ucuccugggcagcugccuc

SEQ ID NO: 1251158 - RNA, 22 nt, Human
uaaauaaagcuugcaacaaaau

SEQ ID NO: 1251159 - RNA, 17 nt, Human
augauuucauuucaacu

SEQ ID NO: 1251160 - RNA, 15 nt, Human
agccucagucucccu

SEQ ID NO: 1251161 - RNA, 11 nt, Human
caucuagugag

SEQ ID NO: 1251162 - RNA, 16 nt, Human
cugcuggauucaagug

SEQ ID NO: 1251163 - RNA, 18 nt, Human
gccuuggggcugaugcag

SEQ ID NO: 1251164 - RNA, 18 nt, Human
gugacuuuccuaaaucaa

SEQ ID NO: 1251165 - RNA, 15 nt, Human
acuugugcaguguug

SEQ ID NO: 1251166 - RNA, 15 nt, Human
guugcagugagcuga

SEQ ID NO: 1251167 - RNA, 11 nt, Human
uacgugcaaua

SEQ ID NO: 1251168 - RNA, 14 nt, Human
gccaugcuggccag

SEQ ID NO: 1251169 - RNA, 19 nt, Human
cucugcauacucauuagga

SEQ ID NO: 1251170 - RNA, 23 nt, Human
ugacguaggaacgguaaauuucu

SEQ ID NO: 1251171 - RNA, 22 nt, Human
augcccaagaaugagaagaaug

SEQ ID NO: 1251172 - RNA, 16 nt, Human
acuccuaguaauuuaa

SEQ ID NO: 1251173 - RNA, 17 nt, Human
acuugaacccauauuug

SEQ ID NO: 1251174 - RNA, 16 nt, Human
ugacaagcucacagac

SEQ ID NO: 1251175 - RNA, 23 nt, Human
cucuccugggcagcugccucccc

SEQ ID NO: 1251176 - RNA, 12 nt, Human
gccccugagccc

SEQ ID NO: 1251177 - RNA, 19 nt, Human
ucaguccaugaagauguag

SEQ ID NO: 1251178 - RNA, 21 nt, Human
cugagccucagucucccuccc

SEQ ID NO: 1251179 - RNA, 22 nt, Human
agaagcaccaaucaugaauuag

SEQ ID NO: 1251180 - RNA, 14 nt, Human
uguuucuuaaaugg

SEQ ID NO: 1251181 - RNA, 22 nt, Human
cuucaacucccugccccccagc

SEQ ID NO: 1251182 - RNA, 12 nt, Human
acugaaaucaua

SEQ ID NO: 1251183 - RNA, 23 nt, Human
cagccaugugauuacccucuggg

SEQ ID NO: 1251184 - RNA, 18 nt, Human
caugccccuguacuccag

SEQ ID NO: 1251185 - RNA, 22 nt, Human
gccaauauccuaauaaaaaggu

SEQ ID NO: 1251186 - RNA, 16 nt, Human
ucuaguacuugggaga

SEQ ID NO: 1251187 - RNA, 19 nt, Human
aagcgauucucuuuauuca

SEQ ID NO: 1251188 - RNA, 13 nt, Human
uuuguaauauuuc

SEQ ID NO: 1251189 - RNA, 22 nt, Human
uaucaaaacuuucuuuucugga

SEQ ID NO: 1251190 - RNA, 21 nt, Human
ccuucacauccuguguuucua

SEQ ID NO: 1251191 - RNA, 15 nt, Human
ccccaaaaagaaugg

SEQ ID NO: 1251192 - RNA, 15 nt, Human
cuggguuccuuccuc

SEQ ID NO: 1251193 - RNA, 15 nt, Human
uacaucuuucacauu

SEQ ID NO: 1251194 - RNA, 18 nt, Human
agaagcaacccaaauguu

SEQ ID NO: 1251195 - RNA, 20 nt, Human
uuuaguaagagauuccugag

SEQ ID NO: 1251196 - RNA, 22 nt, Human
uuuaauuauuauucuucauaac

SEQ ID NO: 1251197 - RNA, 23 nt, Human
cuuguaaaguacagacuuuuuuu

SEQ ID NO: 1251198 - RNA, 20 nt, Human
aucucugauacuuuuuucau

SEQ ID NO: 1251199 - RNA, 19 nt, Human
auuggagcucgugggacag

SEQ ID NO: 1251200 - RNA, 18 nt, Human
auauguauuuauaaauau

SEQ ID NO: 1251201 - RNA, 15 nt, Human
guggcgcgcaccugu

SEQ ID NO: 1251202 - RNA, 14 nt, Human
ugguauguuuucag

SEQ ID NO: 1251203 - RNA, 13 nt, Human
cucugagccuugg

SEQ ID NO: 1251204 - RNA, 23 nt, Human
auucaauaucuuuuuuuuaauaa

SEQ ID NO: 1251205 - RNA, 22 nt, Human
ugacuaugcaaccuuuggaugc

SEQ ID NO: 1251206 - RNA, 19 nt, Human
ucucuuaaacacuaaaaag

SEQ ID NO: 1251207 - RNA, 18 nt, Human
auuauaagcuguuuuuau

SEQ ID NO: 1251208 - RNA, 20 nt, Human
aauuuugugaagcaaaauuu

SEQ ID NO: 1251209 - RNA, 13 nt, Human
uguacuuuuucca

SEQ ID NO: 1251210 - RNA, 23 nt, Human
cauagauguagauaaacucagaa

SEQ ID NO: 1251211 - RNA, 14 nt, Human
cauuuccaaauuca

SEQ ID NO: 1251212 - RNA, 19 nt, Human
auacuaauuauacccccug

SEQ ID NO: 1251213 - RNA, 20 nt, Human
aauuaaguuuuuuuuuaaaa

SEQ ID NO: 1251214 - RNA, 15 nt, Human
cucgugggacaguca

SEQ ID NO: 1251215 - RNA, 19 nt, Human
cggccuccauccugaggcu

SEQ ID NO: 1251216 - RNA, 15 nt, Human
ccacaagaaaugaaa

SEQ ID NO: 1251217 - RNA, 19 nt, Human
ucaacauggugaaaccccg

SEQ ID NO: 1251218 - RNA, 17 nt, Human
ccuguaaucccagcacu

SEQ ID NO: 1251219 - RNA, 21 nt, Human
uggcuguaucuuguuuuucca

SEQ ID NO: 1251220 - RNA, 11 nt, Human
aauugcagagu

SEQ ID NO: 1251221 - RNA, 16 nt, Human
aaaauccauacauuug

SEQ ID NO: 1251222 - RNA, 14 nt, Human
uaagcuguuuccau

SEQ ID NO: 1251223 - RNA, 15 nt, Human
cuaaaaaacaaagaa

SEQ ID NO: 1251224 - RNA, 13 nt, Human
auaauaaauguac

SEQ ID NO: 1251225 - RNA, 15 nt, Human
auuaaauauaauaug

SEQ ID NO: 1251226 - RNA, 23 nt, Human
auauaacaaugcuguauuuuaaa

SEQ ID NO: 1251227 - RNA, 21 nt, Human
gaaauuccaggaaaaucugca

SEQ ID NO: 1251228 - RNA, 15 nt, Human
aaggguacacugccu

SEQ ID NO: 1251229 - RNA, 11 nt, Human
aaguauauaua

SEQ ID NO: 1251230 - RNA, 13 nt, Human
acccucugggucu

SEQ ID NO: 1251231 - RNA, 13 nt, Human
cucuaacucagaa

SEQ ID NO: 1251232 - RNA, 18 nt, Human
gcaauaaaauggguuuua

SEQ ID NO: 1251233 - RNA, 23 nt, Human
uucagcagagacgggguuugcca

SEQ ID NO: 1251234 - RNA, 12 nt, Human
caugggaaguga

SEQ ID NO: 1251235 - RNA, 13 nt, Human
caguauccaguac

SEQ ID NO: 1251236 - RNA, 16 nt, Human
uaacucagaaacauca

SEQ ID NO: 1251237 - RNA, 14 nt, Human
cugccccccagccc

SEQ ID NO: 1251238 - RNA, 20 nt, Human
uacaguaauuuuaaguaauu

SEQ ID NO: 1251239 - RNA, 19 nt, Human
caccuguuuuuaagcuguu

SEQ ID NO: 1251240 - RNA, 18 nt, Human
acuggacucaccuccccc

SEQ ID NO: 1251241 - RNA, 20 nt, Human
uugcaagacauagaauagug

SEQ ID NO: 1251242 - RNA, 17 nt, Human
acucuacccauauuaca

SEQ ID NO: 1251243 - RNA, 11 nt, Human
uucacagggga

SEQ ID NO: 1251244 - RNA, 17 nt, Human
auuuuacaauugaaaug

SEQ ID NO: 1251245 - RNA, 21 nt, Human
gcugccuccccuccucugcuu

SEQ ID NO: 1251246 - RNA, 19 nt, Human
uagaaaaagcaguaacuga

SEQ ID NO: 1251247 - RNA, 16 nt, Human
aauuuucccaaaacug

SEQ ID NO: 1251248 - RNA, 18 nt, Human
cucauccugcaggcagcu

SEQ ID NO: 1251249 - RNA, 14 nt, Human
uccuauguaacugc

SEQ ID NO: 1251250 - RNA, 17 nt, Human
agaacucccuuucaaca

SEQ ID NO: 1251251 - RNA, 16 nt, Human
cuacacuccagugaga

SEQ ID NO: 1251252 - RNA, 21 nt, Human
cuccugggcagcugccucccc

SEQ ID NO: 1251253 - RNA, 20 nt, Human
gcugcccucuccugggcagc

SEQ ID NO: 1251254 - RNA, 15 nt, Human
accagggagccccuu

SEQ ID NO: 1251255 - RNA, 14 nt, Human
ugagcauguacuga

SEQ ID NO: 1251256 - RNA, 22 nt, Human
aauuaucuaucuaucuauuuau

SEQ ID NO: 1251257 - RNA, 11 nt, Human
acuaaaaauac

SEQ ID NO: 1251258 - RNA, 17 nt, Human
ugguucccuugaugaag

SEQ ID NO: 1251259 - RNA, 14 nt, Human
cuccagugagacag

SEQ ID NO: 1251260 - RNA, 19 nt, Human
gaggcugaggcaagagaau

SEQ ID NO: 1251261 - RNA, 17 nt, Human
uagaauaguguuggaaa

SEQ ID NO: 1251262 - RNA, 17 nt, Human
ugggaauuuucuuccaa

SEQ ID NO: 1251263 - RNA, 14 nt, Human
agauguagaggaga

SEQ ID NO: 1251264 - RNA, 18 nt, Human
uauguauuuauaaauaua

SEQ ID NO: 1251265 - RNA, 20 nt, Human
gcagcugccuccccuccucu

SEQ ID NO: 1251266 - RNA, 19 nt, Human
aaauggagugacuuagugu

SEQ ID NO: 1251267 - RNA, 14 nt, Human
cagauccccaagcc

SEQ ID NO: 1251268 - RNA, 17 nt, Human
cugaugaauguuaaauu

SEQ ID NO: 1251269 - RNA, 16 nt, Human
guuuauuucacuugau

SEQ ID NO: 1251270 - RNA, 21 nt, Human
acucaucauaaaauaaaguau

SEQ ID NO: 1251271 - RNA, 12 nt, Human
cccucuccuggg

SEQ ID NO: 1251272 - RNA, 14 nt, Human
gaaagcuguggcca

SEQ ID NO: 1251273 - RNA, 19 nt, Human
uacuucuuaggguuaugau

SEQ ID NO: 1251274 - RNA, 18 nt, Human
caacaguuuuuuaugcua

SEQ ID NO: 1251275 - RNA, 15 nt, Human
gcccacuagacccac

SEQ ID NO: 1251276 - RNA, 14 nt, Human
uagcugacccagcc

SEQ ID NO: 1251277 - RNA, 19 nt, Human
uauaauuuuuuucaauauu

SEQ ID NO: 1251278 - RNA, 18 nt, Human
acagagacagaaagcaga

SEQ ID NO: 1251279 - RNA, 21 nt, Human
caaagcccagcuugaaaccuu

SEQ ID NO: 1251280 - RNA, 22 nt, Human
auccagauagguuaccaguaac

SEQ ID NO: 1251281 - RNA, 12 nt, Human
gcgugcaggcag

SEQ ID NO: 1251282 - RNA, 14 nt, Human
uucuagguucuaaa

SEQ ID NO: 1251283 - RNA, 14 nt, Human
aaagagaacuucca

SEQ ID NO: 1251284 - RNA, 14 nt, Human
gacagcaggucuca

SEQ ID NO: 1251285 - RNA, 13 nt, Human
uguauauuuuaua

SEQ ID NO: 1251286 - RNA, 22 nt, Human
gugaacaaauuuacagagacag

SEQ ID NO: 1251287 - RNA, 18 nt, Human
guugccaaggcuggagug

SEQ ID NO: 1251288 - RNA, 22 nt, Human
aagacauaagcaaagacuauga

SEQ ID NO: 1251289 - RNA, 11 nt, Human
ccugagcccca

SEQ ID NO: 1251290 - RNA, 17 nt, Human
agugagacagcucugca

SEQ ID NO: 1251291 - RNA, 18 nt, Human
agcaacaucuagcaaaug

SEQ ID NO: 1251292 - RNA, 20 nt, Human
cagcuuguuauuuauaacaa

SEQ ID NO: 1251293 - RNA, 12 nt, Human
gcgcagccaugu

SEQ ID NO: 1251294 - RNA, 23 nt, Human
aaaucucuauuaggaaauauucu

SEQ ID NO: 1251295 - RNA, 19 nt, Human
cuagaguuuagcuggaaaa

SEQ ID NO: 1251296 - RNA, 23 nt, Human
uccagguagaggguguguaagua

SEQ ID NO: 1251297 - RNA, 13 nt, Human
uauuuauauauuu

SEQ ID NO: 1251298 - RNA, 14 nt, Human
cugcugagucccag

SEQ ID NO: 1251299 - RNA, 17 nt, Human
uuuuaucauuuucaaaa

SEQ ID NO: 1251300 - RNA, 21 nt, Human
cuauucacaaccacucauuca

SEQ ID NO: 1251301 - RNA, 12 nt, Human
ucagaagaccug

SEQ ID NO: 1251302 - RNA, 22 nt, Human
uacuccuaguaauuuaagauuu

SEQ ID NO: 1251303 - RNA, 17 nt, Human
auguauuuauaaauaua

SEQ ID NO: 1251304 - RNA, 23 nt, Human
gaccccugagcuugcagagauga

SEQ ID NO: 1251305 - RNA, 20 nt, Human
auuuugguaaaauacuucuu

SEQ ID NO: 1251306 - RNA, 19 nt, Human
uacaauuauuuuuacaguu

SEQ ID NO: 1251307 - RNA, 13 nt, Human
cuguacuuuuucc

SEQ ID NO: 1251308 - RNA, 16 nt, Human
cugggucucagugucc

SEQ ID NO: 1251309 - RNA, 15 nt, Human
uauauuuuuuaugaa

SEQ ID NO: 1251310 - RNA, 16 nt, Human
cagggacuugaaccca

SEQ ID NO: 1251311 - RNA, 14 nt, Human
augaagaagcuaaa

SEQ ID NO: 1251312 - RNA, 22 nt, Human
cuuuccacagaagcuccaggua

SEQ ID NO: 1251313 - RNA, 14 nt, Human
cagagguugcagug

SEQ ID NO: 1251314 - RNA, 14 nt, Human
aguauuuauauauu

SEQ ID NO: 1251315 - RNA, 18 nt, Human
gacccacuggacucaccu

SEQ ID NO: 1251316 - RNA, 14 nt, Human
uaaagaauuuuaaa

SEQ ID NO: 1251317 - RNA, 13 nt, Human
aauauuuaacauu

SEQ ID NO: 1251318 - RNA, 15 nt, Human
cuuacuauuuauugc

SEQ ID NO: 1251319 - RNA, 22 nt, Human
uuccccuuccuaauuccacagc

SEQ ID NO: 1251320 - RNA, 20 nt, Human
ucaauaaaauccauacauuu

SEQ ID NO: 1251321 - RNA, 19 nt, Human
agaaacaucaguuacucug

SEQ ID NO: 1251322 - RNA, 21 nt, Human
accaaggagccaaacauccua

SEQ ID NO: 1251323 - RNA, 12 nt, Human
aauaaaguacaa

SEQ ID NO: 1251324 - RNA, 14 nt, Human
acauauauaacaau

SEQ ID NO: 1251325 - RNA, 19 nt, Human
ugacuuaguguacaugaaa

SEQ ID NO: 1251326 - RNA, 19 nt, Human
aggcauccuccacaauagc

SEQ ID NO: 1251327 - RNA, 19 nt, Human
gaauggaacucaaggaaau

SEQ ID NO: 1251328 - RNA, 15 nt, Human
caauauuugaauuuu

SEQ ID NO: 1251329 - RNA, 18 nt, Human
auaaauguaucuuauuca

SEQ ID NO: 1251330 - RNA, 18 nt, Human
cugcucaauaaaguacaa

SEQ ID NO: 1251331 - RNA, 18 nt, Human
agcugcucaauaaaguac

SEQ ID NO: 1251332 - RNA, 23 nt, Human
uguagauaaacucagaaauuuaa

SEQ ID NO: 1251333 - RNA, 19 nt, Human
aaauguaauuaaucuugua

SEQ ID NO: 1251334 - RNA, 22 nt, Human
uuuccaagcaaguauuagaaua

SEQ ID NO: 1251335 - RNA, 20 nt, Human
uaagauuuuguuuuuaaacu

SEQ ID NO: 1251336 - RNA, 15 nt, Human
ucaguuacucugaag

SEQ ID NO: 1251337 - RNA, 21 nt, Human
caccagggccuggcugggagu

SEQ ID NO: 1251338 - RNA, 23 nt, Human
uuacauuauuaucaacaauagug

SEQ ID NO: 1251339 - RNA, 22 nt, Human
gccaucccucccuccaccuccc

SEQ ID NO: 1251340 - RNA, 21 nt, Human
gugcuuaucccauagccagga

SEQ ID NO: 1251341 - RNA, 14 nt, Human
cugcaaagcccagc

SEQ ID NO: 1251342 - RNA, 18 nt, Human
uaucaaaagaaagaaaau

SEQ ID NO: 1251343 - RNA, 15 nt, Human
gaaauucugcaagcu

SEQ ID NO: 1251344 - RNA, 14 nt, Human
auguaaauagaaac

SEQ ID NO: 1251345 - RNA, 23 nt, Human
ccaagaaugagaagaaugacuau

SEQ ID NO: 1251346 - RNA, 16 nt, Human
uggcugggaguggcau

SEQ ID NO: 1251347 - RNA, 12 nt, Human
aucaacaauagu

SEQ ID NO: 1251348 - RNA, 15 nt, Human
cuuaaaauguaauua

SEQ ID NO: 1251349 - RNA, 17 nt, Human
ggaaauauuuauuuuaa

SEQ ID NO: 1251350 - RNA, 15 nt, Human
cauguccacugguuc

SEQ ID NO: 1251351 - RNA, 15 nt, Human
uguauuuuaaaagaa

SEQ ID NO: 1251352 - RNA, 14 nt, Human
auaauuauaauaua

SEQ ID NO: 1251353 - RNA, 21 nt, Human
uccuucagccugaaagaggaa

SEQ ID NO: 1251354 - RNA, 17 nt, Human
uaaguugcugaugaacu

SEQ ID NO: 1251355 - RNA, 20 nt, Human
augcaguuguugcccacagc

SEQ ID NO: 1251356 - RNA, 23 nt, Human
aaaauaucacuugucaauaaaau

SEQ ID NO: 1251357 - RNA, 15 nt, Human
auuuuuuaauuauua

SEQ ID NO: 1251358 - RNA, 13 nt, Human
uagauaaacucag

SEQ ID NO: 1251359 - RNA, 14 nt, Human
cgcgcgccaccacg

SEQ ID NO: 1251360 - RNA, 17 nt, Human
uaauuccacagcugcuc

SEQ ID NO: 1251361 - RNA, 18 nt, Human
gaaauggugaaaugcaga

SEQ ID NO: 1251362 - RNA, 14 nt, Human
aacugcauugagaa

SEQ ID NO: 1251363 - RNA, 19 nt, Human
ggaaaggagaaguuaagca

SEQ ID NO: 1251364 - RNA, 23 nt, Human
ucauuucaaaacucauuuccuau

SEQ ID NO: 1251365 - RNA, 15 nt, Human
uucggccuccauccu

SEQ ID NO: 1251366 - RNA, 19 nt, Human
ccccugagcuugcagagau

SEQ ID NO: 1251367 - RNA, 16 nt, Human
uuuaagauuuuguuuu

SEQ ID NO: 1251368 - RNA, 13 nt, Human
agaauuuauucaa

SEQ ID NO: 1251369 - RNA, 16 nt, Human
uuagagauuuuuaaau

SEQ ID NO: 1251370 - RNA, 14 nt, Human
aauauuuauuuuaa

SEQ ID NO: 1251371 - RNA, 17 nt, Human
ccccauuucuauuuauu

SEQ ID NO: 1251372 - RNA, 18 nt, Human
cauuuccuauguaacugc

SEQ ID NO: 1251373 - RNA, 21 nt, Human
aauggauaugacacaucucug

SEQ ID NO: 1251374 - RNA, 11 nt, Human
ucaccuccccc

SEQ ID NO: 1251375 - RNA, 12 nt, Human
uaguacacacuu

SEQ ID NO: 1251376 - RNA, 22 nt, Human
ugaaaaaguucugcagauaaac

SEQ ID NO: 1251377 - RNA, 14 nt, Human
cgcuaccuuuugcu

SEQ ID NO: 1251378 - RNA, 19 nt, Human
ccccugcaaagcccagcuu

SEQ ID NO: 1251379 - RNA, 18 nt, Human
gaagcaccaaucaugaau

SEQ ID NO: 1251380 - RNA, 13 nt, Human
agcccagcuugaa

SEQ ID NO: 1251381 - RNA, 18 nt, Human
uuugacaagguucuuccc

SEQ ID NO: 1251382 - RNA, 13 nt, Human
auaauuauaauau

SEQ ID NO: 1251383 - RNA, 17 nt, Human
ugaaauaagccagacau

SEQ ID NO: 1251384 - RNA, 16 nt, Human
ccuccaccucccugca

SEQ ID NO: 1251385 - RNA, 20 nt, Human
cuuauucacaagacccaaaa

SEQ ID NO: 1251386 - RNA, 21 nt, Human
agccucuuagaugcaguucug

SEQ ID NO: 1251387 - RNA, 15 nt, Human
cacccuugccaugga

SEQ ID NO: 1251388 - RNA, 16 nt, Human
uugacaguucauaugu

SEQ ID NO: 1251389 - RNA, 15 nt, Human
aacuauggaaaaaaa

SEQ ID NO: 1251390 - RNA, 20 nt, Human
aauaauuuuuauauuugaaa

SEQ ID NO: 1251391 - RNA, 18 nt, Human
guagccacuucacuuuuu

SEQ ID NO: 1251392 - RNA, 16 nt, Human
uauaauaaauguacau

SEQ ID NO: 1251393 - RNA, 19 nt, Human
uguuaugcauaaagucagu

SEQ ID NO: 1251394 - RNA, 23 nt, Human
uaaguuuuuuuuuaaaaaagaaa

SEQ ID NO: 1251395 - RNA, 14 nt, Human
gccucagucucccu

SEQ ID NO: 1251396 - RNA, 13 nt, Human
ugcuuggcccagg

SEQ ID NO: 1251397 - RNA, 17 nt, Human
ccucccuccaccucccu

SEQ ID NO: 1251398 - RNA, 21 nt, Human
auuuguauaaaauaauuuuua

SEQ ID NO: 1251399 - RNA, 17 nt, Human
gacaguuccugagacca

SEQ ID NO: 1251400 - RNA, 17 nt, Human
caccucccccaucucuu

SEQ ID NO: 1251401 - RNA, 22 nt, Human
cugcucaauaaaguacaagagc

SEQ ID NO: 1251402 - RNA, 13 nt, Human
uaaggcuucucuu

SEQ ID NO: 1251403 - RNA, 22 nt, Human
aagcacuuuaacacagugucug

SEQ ID NO: 1251404 - RNA, 22 nt, Human
auauauaacaaugcuguauuuu

SEQ ID NO: 1251405 - RNA, 16 nt, Human
aauuacauuuguauaa

SEQ ID NO: 1251406 - RNA, 20 nt, Human
uucgugaaguauacuguauu

SEQ ID NO: 1251407 - RNA, 16 nt, Human
aauuccacagcugcuc

SEQ ID NO: 1251408 - RNA, 22 nt, Human
augcagagguccacaacacaca

SEQ ID NO: 1251409 - RNA, 17 nt, Human
uuauaaucuuucacagg

SEQ ID NO: 1251410 - RNA, 18 nt, Human
gagcccuucaugcauuug

SEQ ID NO: 1251411 - RNA, 13 nt, Human
uguaaaguacaga

SEQ ID NO: 1251412 - RNA, 13 nt, Human
cgggaggcagagg

SEQ ID NO: 1251413 - RNA, 16 nt, Human
auagaauuaauggaau

SEQ ID NO: 1251414 - RNA, 14 nt, Human
auaaaauaauuuuu

SEQ ID NO: 1251415 - RNA, 15 nt, Human
agcucuaucaccaag

SEQ ID NO: 1251416 - RNA, 16 nt, Human
ccucagucucccuccc

SEQ ID NO: 1251417 - RNA, 14 nt, Human
ucuaggaaauauuu

SEQ ID NO: 1251418 - RNA, 20 nt, Human
auaaaguauauauagaaucu

SEQ ID NO: 1251419 - RNA, 14 nt, Human
auuucuaugaaaua

SEQ ID NO: 1251420 - RNA, 14 nt, Human
cuacaagacacagu

SEQ ID NO: 1251421 - RNA, 15 nt, Human
uuguuauuuaaagaa

SEQ ID NO: 1251422 - RNA, 21 nt, Human
acuaauagaauuaauggaaua

SEQ ID NO: 1251423 - RNA, 23 nt, Human
uauaugugaaauaaaaguagaau

SEQ ID NO: 1251424 - RNA, 19 nt, Human
gaauguaaucaauguuucu

SEQ ID NO: 1251425 - RNA, 18 nt, Human
agaaaacuaagaaauaug

SEQ ID NO: 1251426 - RNA, 14 nt, Human
aaugaacacuuaua

SEQ ID NO: 1251427 - RNA, 17 nt, Human
uaaaauaaaguauauau

SEQ ID NO: 1251428 - RNA, 15 nt, Human
cagcaguucagagcu

SEQ ID NO: 1251429 - RNA, 19 nt, Human
acuucagcgguuuauauaa

SEQ ID NO: 1251430 - RNA, 16 nt, Human
acauccuacaagacac

SEQ ID NO: 1251431 - RNA, 16 nt, Human
ugggucucaguguccu

SEQ ID NO: 1251432 - RNA, 21 nt, Human
caucccucccuccaccucccu

SEQ ID NO: 1251433 - RNA, 18 nt, Human
cagauagguuaccaguaa

SEQ ID NO: 1251434 - RNA, 13 nt, Human
acuguuugccuuc

SEQ ID NO: 1251435 - RNA, 17 nt, Human
aucccucccuccaccuc

SEQ ID NO: 1251436 - RNA, 16 nt, Human
cuugccaucccucccu

SEQ ID NO: 1251437 - RNA, 21 nt, Human
ucauucaaaaguugaaauuaa

SEQ ID NO: 1251438 - RNA, 18 nt, Human
ggucacacaaccuguccc

SEQ ID NO: 1251439 - RNA, 21 nt, Human
ugccuguaaucacagcuacuu

SEQ ID NO: 1251440 - RNA, 21 nt, Human
guaaaauacuucuugaagccg

SEQ ID NO: 1251441 - RNA, 16 nt, Human
agccgagccucaagau

SEQ ID NO: 1251442 - RNA, 17 nt, Human
auuuugaauaaauaaau

SEQ ID NO: 1251443 - RNA, 14 nt, Human
acccgggaggcaga

SEQ ID NO: 1251444 - RNA, 18 nt, Human
guaauuucagaagaaauu

SEQ ID NO: 1251445 - RNA, 16 nt, Human
cuuguauuuuacuuuu

SEQ ID NO: 1251446 - RNA, 18 nt, Human
aacuagaauuuauucaau

SEQ ID NO: 1251447 - RNA, 18 nt, Human
gccccugcacuccagccu

SEQ ID NO: 1251448 - RNA, 10 nt, Human
auaacucauc

SEQ ID NO: 1251449 - RNA, 14 nt, Human
aaaaucaaauucca

SEQ ID NO: 1251450 - RNA, 18 nt, Human
gccuagcccacuggcucc

SEQ ID NO: 1251451 - RNA, 19 nt, Human
agccuggucaacaugguga

SEQ ID NO: 1251452 - RNA, 18 nt, Human
auagaaacguguauauuu

SEQ ID NO: 1251453 - RNA, 21 nt, Human
acaugagguacugagagugaa

SEQ ID NO: 1251454 - RNA, 16 nt, Human
aucccucccuccaccu

SEQ ID NO: 1251455 - RNA, 19 nt, Human
auuaaguuuuuuuuuaaaa

SEQ ID NO: 1251456 - RNA, 13 nt, Human
acaucuuucacau

SEQ ID NO: 1251457 - RNA, 17 nt, Human
aaaaagcauuguaacuu

SEQ ID NO: 1251458 - RNA, 21 nt, Human
cuguauuuuuaccuuuuuccu

SEQ ID NO: 1251459 - RNA, 14 nt, Human
accauuuuuacuug

SEQ ID NO: 1251460 - RNA, 13 nt, Human
caacaucuaguga

SEQ ID NO: 1251461 - RNA, 13 nt, Human
aaacauccuacaa

SEQ ID NO: 1251462 - RNA, 23 nt, Human
agagcaagacucugucucaaaaa

SEQ ID NO: 1251463 - RNA, 18 nt, Human
acugagcuucucugugaa

SEQ ID NO: 1251464 - RNA, 16 nt, Human
cugagcgacagugaga

SEQ ID NO: 1251465 - RNA, 17 nt, Human
uagaagcaucacagguu

SEQ ID NO: 1251466 - RNA, 15 nt, Human
cuuaagaagacugca

SEQ ID NO: 1251467 - RNA, 19 nt, Human
aauguuacauuauuaucaa

SEQ ID NO: 1251468 - RNA, 19 nt, Human
gguuccuuccucugagccu

SEQ ID NO: 1251469 - RNA, 12 nt, Human
cacaacacacag

SEQ ID NO: 1251470 - RNA, 20 nt, Human
uuguaccucucuuauagaau

SEQ ID NO: 1251471 - RNA, 23 nt, Human
uaaucauauaauaaauguacauu

SEQ ID NO: 1251472 - RNA, 20 nt, Human
augaauaucuauuaauauau

SEQ ID NO: 1251473 - RNA, 18 nt, Human
auucaaacuaauagaauu

SEQ ID NO: 1251474 - RNA, 17 nt, Human
ucucuuaaacacuaaaa

SEQ ID NO: 1251475 - RNA, 20 nt, Human
gauguagauaaacucagaaa

SEQ ID NO: 1251476 - RNA, 21 nt, Human
uuuuaaauaaagaauuuuaaa

SEQ ID NO: 1251477 - RNA, 17 nt, Human
uaaauaaagaauuuuaa

SEQ ID NO: 1251478 - RNA, 13 nt, Human
gccuggcugggag

SEQ ID NO: 1251479 - RNA, 15 nt, Human
aauugaauucccugc

SEQ ID NO: 1251480 - RNA, 17 nt, Human
ggagcucguggaacagu

SEQ ID NO: 1251481 - RNA, 14 nt, Human
ugcauuaaauauaa

SEQ ID NO: 1251482 - RNA, 22 nt, Human
agaguggaaccaacacuaacau

SEQ ID NO: 1251483 - RNA, 19 nt, Human
uuggcaagcucuaucacca

SEQ ID NO: 1251484 - RNA, 21 nt, Human
aaaagguauuuuaaucaccaa

SEQ ID NO: 1251485 - RNA, 19 nt, Human
ccuguaaucauauaauaaa

SEQ ID NO: 1251486 - RNA, 17 nt, Human
aucuauuaauauaugua

SEQ ID NO: 1251487 - RNA, 19 nt, Human
uaaauauauuuaagauaau

SEQ ID NO: 1251488 - RNA, 23 nt, Human
ggaugaauuaaguuuuuuuuuaa

SEQ ID NO: 1251489 - RNA, 13 nt, Human
ucugcuugccauc

SEQ ID NO: 1251490 - RNA, 17 nt, Human
uaagauuuguaauauuu

SEQ ID NO: 1251491 - RNA, 17 nt, Human
cccacuggacucaccuc

SEQ ID NO: 1251492 - RNA, 16 nt, Human
caggaaguagaggagg

SEQ ID NO: 1251493 - RNA, 12 nt, Human
uaauuccacagc

SEQ ID NO: 1251494 - RNA, 13 nt, Human
uguuagcaaaaug

SEQ ID NO: 1251495 - RNA, 22 nt, Human
aauuguauuuuaguaagagauu

SEQ ID NO: 1251496 - RNA, 17 nt, Human
ccucuggcuccagcugg

SEQ ID NO: 1251497 - RNA, 19 nt, Human
gcacuaguauuucuaugaa

SEQ ID NO: 1251498 - RNA, 16 nt, Human
ucaaaagaaagaaaau

SEQ ID NO: 1251499 - RNA, 20 nt, Human
agaugcaguucugaagaaga

SEQ ID NO: 1251500 - RNA, 16 nt, Human
ugaauccagaaauaau

SEQ ID NO: 1251501 - RNA, 20 nt, Human
uagguucuaaaaauugugau

SEQ ID NO: 1251502 - RNA, 22 nt, Human
cuggggcucugggauagcugac

SEQ ID NO: 1251503 - RNA, 16 nt, Human
ucuucccuuuuacaua

SEQ ID NO: 1251504 - RNA, 18 nt, Human
auccccaagccuggcaag

SEQ ID NO: 1251505 - RNA, 22 nt, Human
uccaaacuggagcuugaaauag

SEQ ID NO: 1251506 - RNA, 15 nt, Human
ggcaagcucuaucac

SEQ ID NO: 1251507 - RNA, 20 nt, Human
ugccccccagcccuccuuau

SEQ ID NO: 1251508 - RNA, 14 nt, Human
guauucuucuuugg

SEQ ID NO: 1251509 - RNA, 20 nt, Human
uaacugcauugagaacugca

SEQ ID NO: 1251510 - RNA, 19 nt, Human
uuaaagcuaaaguaucugu

SEQ ID NO: 1251511 - RNA, 15 nt, Human
acaguucauauguac

SEQ ID NO: 1251512 - RNA, 13 nt, Human
uugccaucccucc

SEQ ID NO: 1251513 - RNA, 19 nt, Human
aaaauggagggaauaauac

SEQ ID NO: 1251514 - RNA, 23 nt, Human
aucccucccuccaccucccugca

SEQ ID NO: 1251515 - RNA, 16 nt, Human
aagcauuuagauguau

SEQ ID NO: 1251516 - RNA, 15 nt, Human
aaaauacaaaaaaaa

SEQ ID NO: 1251517 - RNA, 15 nt, Human
gacucaccuccccca

SEQ ID NO: 1251518 - RNA, 12 nt, Human
aaauauuuuuau

SEQ ID NO: 1251519 - RNA, 22 nt, Human
aagacucugucucaaaaaauaa

SEQ ID NO: 1251520 - RNA, 22 nt, Human
caaacagaacuauggaaaaaaa

SEQ ID NO: 1251521 - RNA, 17 nt, Human
gacuauuauagaaugga

SEQ ID NO: 1251522 - RNA, 13 nt, Human
aaaaugagcaaaa

SEQ ID NO: 1251523 - RNA, 15 nt, Human
gauccugcaauucca

SEQ ID NO: 1251524 - RNA, 15 nt, Human
uuucuugaguuuugu

SEQ ID NO: 1251525 - RNA, 13 nt, Human
cugccuucucaac

SEQ ID NO: 1251526 - RNA, 16 nt, Human
ccugggcagcugccuc

SEQ ID NO: 1251527 - RNA, 16 nt, Human
cuuuaaguguaacugg

SEQ ID NO: 1251528 - RNA, 18 nt, Human
uuaaacacuaaaaaggca

SEQ ID NO: 1251529 - RNA, 15 nt, Human
acauccuacaagaca

SEQ ID NO: 1251530 - RNA, 18 nt, Human
uuauauggggaauauauu

SEQ ID NO: 1251531 - RNA, 16 nt, Human
cuggauguggaggggg

SEQ ID NO: 1251532 - RNA, 15 nt, Human
augcuggccaggcug

SEQ ID NO: 1251533 - RNA, 23 nt, Human
cagaaugauuuuacggagauauc

SEQ ID NO: 1251534 - RNA, 18 nt, Human
aguuuaugcauacaguaa

SEQ ID NO: 1251535 - RNA, 16 nt, Human
auguaaucaauguuuc

SEQ ID NO: 1251536 - RNA, 14 nt, Human
aagcacuuucccuc

SEQ ID NO: 1251537 - RNA, 21 nt, Human
uauaaaauaauuuuuauauuu

SEQ ID NO: 1251538 - RNA, 20 nt, Human
ccagcacuuugggaggcuga

SEQ ID NO: 1251539 - RNA, 17 nt, Human
ggcgcgugcaggcagca

SEQ ID NO: 1251540 - RNA, 18 nt, Human
ugccauaauuacuauguc

SEQ ID NO: 1251541 - RNA, 14 nt, Human
cuaagcauuccaac

SEQ ID NO: 1251542 - RNA, 19 nt, Human
cccauggcacucuauguuc

SEQ ID NO: 1251543 - RNA, 18 nt, Human
guuuccuagcgcagccau

SEQ ID NO: 1251544 - RNA, 16 nt, Human
acuucacuuuuuuucu

SEQ ID NO: 1251545 - RNA, 20 nt, Human
aaacugauacccuuugaaaa

SEQ ID NO: 1251546 - RNA, 12 nt, Human
uaucuuauucac

SEQ ID NO: 1251547 - RNA, 13 nt, Human
uaaguauuuauaa

SEQ ID NO: 1251548 - RNA, 20 nt, Human
cgaaauguuauuuuuuaauu

SEQ ID NO: 1251549 - RNA, 14 nt, Human
agagacagaaagca

SEQ ID NO: 1251550 - RNA, 18 nt, Human
uuucuuaaagaauuuuca

SEQ ID NO: 1251551 - RNA, 16 nt, Human
agguacuucaaauccu

SEQ ID NO: 1251552 - RNA, 18 nt, Human
guuaguauuguccagguc

SEQ ID NO: 1251553 - RNA, 20 nt, Human
uagaauaguguuggaaaaug

SEQ ID NO: 1251554 - RNA, 13 nt, Human
uuuaaaaaagaaa

SEQ ID NO: 1251555 - RNA, 19 nt, Human
auucugcaagcuuuucaaa

SEQ ID NO: 1251556 - RNA, 12 nt, Human
ucugcacacagc

SEQ ID NO: 1251557 - RNA, 13 nt, Human
acacaggcuccaa

SEQ ID NO: 1251558 - RNA, 15 nt, Human
cuucucuucacaguc

SEQ ID NO: 1251559 - RNA, 12 nt, Human
uacagagaaaag

SEQ ID NO: 1251560 - RNA, 23 nt, Human
aggcaugagucagucugaugaga

SEQ ID NO: 1251561 - RNA, 22 nt, Human
auaaagcuugcaacaaaauucu

SEQ ID NO: 1251562 - RNA, 10 nt, Human
acaccaccac

SEQ ID NO: 1251563 - RNA, 17 nt, Human
uagagacuuugugaaaa

SEQ ID NO: 1251564 - RNA, 12 nt, Human
aagcauuguaac

SEQ ID NO: 1251565 - RNA, 17 nt, Human
uuccaagccucaugucc

SEQ ID NO: 1251566 - RNA, 19 nt, Human
uuguuaaaauuaucaauau

SEQ ID NO: 1251567 - RNA, 16 nt, Human
acugacaacuugaaua

SEQ ID NO: 1251568 - RNA, 21 nt, Human
gcccaagaaugagaagaauga

SEQ ID NO: 1251569 - RNA, 12 nt, Human
agcuaaaguauc

SEQ ID NO: 1251570 - RNA, 18 nt, Human
ccaauauuauaauuuuuu

SEQ ID NO: 1251571 - RNA, 19 nt, Human
uauaacucaucauaaaaua

SEQ ID NO: 1251572 - RNA, 19 nt, Human
uaaucauauaauaaaugua

SEQ ID NO: 1251573 - RNA, 19 nt, Human
uauuugcaagacauagaau

SEQ ID NO: 1251574 - RNA, 22 nt, Human
guacaauuauaagcuguuuuua

SEQ ID NO: 1251575 - RNA, 16 nt, Human
aguugcagugagcuga

SEQ ID NO: 1251576 - RNA, 14 nt, Human
ugcuggagcucugc

SEQ ID NO: 1251577 - RNA, 22 nt, Human
cuacuugggaggcugaggcaag

SEQ ID NO: 1251578 - RNA, 18 nt, Human
agugcuuggcccaggagu

SEQ ID NO: 1251579 - RNA, 18 nt, Human
ugaauccagaaauaauga

SEQ ID NO: 1251580 - RNA, 15 nt, Human
cccugcaaagcccag

SEQ ID NO: 1251581 - RNA, 20 nt, Human
auuugccaauuuacuuuguu

SEQ ID NO: 1251582 - RNA, 17 nt, Human
cuauccuacuuccccuu

SEQ ID NO: 1251583 - RNA, 13 nt, Human
aguguccucaucu

SEQ ID NO: 1251584 - RNA, 19 nt, Human
uuuuuuaugaaacauuaca

SEQ ID NO: 1251585 - RNA, 14 nt, Human
acuauggaaaaaaa

SEQ ID NO: 1251586 - RNA, 18 nt, Human
cuugggaauuuucuucca

SEQ ID NO: 1251587 - RNA, 23 nt, Human
gucuccaaaaucggaucuggggc

SEQ ID NO: 1251588 - RNA, 13 nt, Human
agacacagugacc

SEQ ID NO: 1251589 - RNA, 20 nt, Human
cuucaacucccugcccccca

SEQ ID NO: 1251590 - RNA, 14 nt, Human
cacaacacacagau

SEQ ID NO: 1251591 - RNA, 17 nt, Human
uuaaacuggaaauaaaa

SEQ ID NO: 1251592 - RNA, 19 nt, Human
agcuugaaauagugucuga

SEQ ID NO: 1251593 - RNA, 15 nt, Human
gaaaacaaggaugaa

SEQ ID NO: 1251594 - RNA, 15 nt, Human
uucacaagugaaaaa

SEQ ID NO: 1251595 - RNA, 16 nt, Human
caugggacagggagga

SEQ ID NO: 1251596 - RNA, 17 nt, Human
aucaauaucuaauauau

SEQ ID NO: 1251597 - RNA, 10 nt, Human
uucccugccu

SEQ ID NO: 1251598 - RNA, 18 nt, Human
ccuucggccuccauccug

SEQ ID NO: 1251599 - RNA, 23 nt, Human
aaguaucuguauugcauuaaaua

SEQ ID NO: 1251600 - RNA, 13 nt, Human
uucaccuguuuuu

SEQ ID NO: 1251601 - RNA, 18 nt, Human
acugauggguuucuccag

SEQ ID NO: 1251602 - RNA, 14 nt, Human
agaugcuuguauuu

SEQ ID NO: 1251603 - RNA, 18 nt, Human
cuggacaguuuucugcuu

SEQ ID NO: 1251604 - RNA, 12 nt, Human
accagccaaccu

SEQ ID NO: 1251605 - RNA, 18 nt, Human
cagauuugagcucagccc

SEQ ID NO: 1251606 - RNA, 15 nt, Human
gguggggcagugcuu

SEQ ID NO: 1251607 - RNA, 16 nt, Human
gucccagccagcaguu

SEQ ID NO: 1251608 - RNA, 15 nt, Human
agucugauuuuccug

SEQ ID NO: 1251609 - RNA, 17 nt, Human
cccaggcugagccucag

SEQ ID NO: 1251610 - RNA, 16 nt, Human
aaacuggaaauaaaag

SEQ ID NO: 1251611 - RNA, 12 nt, Human
cuuagacccuca

SEQ ID NO: 1251612 - RNA, 19 nt, Human
uauaucaguccucuuucaa

SEQ ID NO: 1251613 - RNA, 20 nt, Human
uuuguuauggcuuaaugaca

SEQ ID NO: 1251614 - RNA, 21 nt, Human
uauguaaauagaaacguguau

SEQ ID NO: 1251615 - RNA, 14 nt, Human
uaaaauccauacau

SEQ ID NO: 1251616 - RNA, 19 nt, Human
auguacauuuccaaauuca

SEQ ID NO: 1251617 - RNA, 15 nt, Human
aucucacaagcacuu

SEQ ID NO: 1251618 - RNA, 15 nt, Human
caagguucuucccuu

SEQ ID NO: 1251619 - RNA, 13 nt, Human
uccuacuuccccu

SEQ ID NO: 1251620 - RNA, 20 nt, Human
auuacaguuagagauuuuua

SEQ ID NO: 1251621 - RNA, 24 nt, Human
ucccugcagacaugagagacagca

SEQ ID NO: 1251622 - RNA, 18 nt, Human
guauagcauauguuuuug

SEQ ID NO: 1251623 - RNA, 17 nt, Human
aauauuuauuaccucug

SEQ ID NO: 1251624 - RNA, 23 nt, Human
ccagagggaauugcagaguacug

SEQ ID NO: 1251625 - RNA, 14 nt, Human
uuuuaaaaaagaaa

SEQ ID NO: 1251626 - RNA, 23 nt, Human
ccaggagauggaaguugcaguga

SEQ ID NO: 1251627 - RNA, 19 nt, Human
ugaauaucuauuaauauau

SEQ ID NO: 1251628 - RNA, 15 nt, Human
auuucaugaaaagau

SEQ ID NO: 1251629 - RNA, 21 nt, Human
ugugauuacccucugggucuc

SEQ ID NO: 1251630 - RNA, 21 nt, Human
guauuuuuaccuuuuuccuuc

SEQ ID NO: 1251631 - RNA, 19 nt, Human
augaaagcagggacuugaa

SEQ ID NO: 1251632 - RNA, 16 nt, Human
accuuauuguaccucu

SEQ ID NO: 1251633 - RNA, 12 nt, Human
uuuuuaaauaaa

SEQ ID NO: 1251634 - RNA, 19 nt, Human
gcacacagcacgggggcca

SEQ ID NO: 1251635 - RNA, 14 nt, Human
cagauccuggaaau

SEQ ID NO: 1251636 - RNA, 13 nt, Human
gcucucuggccuu

SEQ ID NO: 1251637 - RNA, 20 nt, Human
aucaaauuccagaaugauuu

SEQ ID NO: 1251638 - RNA, 22 nt, Human
uacagugucuuacagagaaaag

SEQ ID NO: 1251639 - RNA, 13 nt, Human
ccacuucacuuuu

SEQ ID NO: 1251640 - RNA, 23 nt, Human
aauaugugauguggcaaaucucu

SEQ ID NO: 1251641 - RNA, 14 nt, Human
cucccucuaauuua

SEQ ID NO: 1251642 - RNA, 15 nt, Human
agaaauuguaucuua

SEQ ID NO: 1251643 - RNA, 23 nt, Human
ucucugaagaguggguuucacaa

SEQ ID NO: 1251644 - RNA, 20 nt, Human
cuguauuuuuaccuuuuucc

SEQ ID NO: 1251645 - RNA, 19 nt, Human
uuauggcacuaguauuucu

SEQ ID NO: 1251646 - RNA, 15 nt, Human
uaugugaaauaaaag

SEQ ID NO: 1251647 - RNA, 15 nt, Human
aucuagcaaauguua

SEQ ID NO: 1251648 - RNA, 21 nt, Human
gcccauccugccccugagccc

SEQ ID NO: 1251649 - RNA, 23 nt, Human
acuggcucccuggaagagaucaa

SEQ ID NO: 1251650 - RNA, 22 nt, Human
cugggacaggggagaaccuagg

SEQ ID NO: 1251651 - RNA, 23 nt, Human
caucucuucuggguuccuuccuc

SEQ ID NO: 1251652 - RNA, 15 nt, Human
caccuguaaucccag

SEQ ID NO: 1251653 - RNA, 22 nt, Human
cugcacugugggcuuuuauugc

SEQ ID NO: 1251654 - RNA, 19 nt, Human
uacaguuagagauuuuuaa

SEQ ID NO: 1251655 - RNA, 22 nt, Human
caaccaaauggagugacuuagu

SEQ ID NO: 1251656 - RNA, 19 nt, Human
auuuugguaaaauacuucu

SEQ ID NO: 1251657 - RNA, 23 nt, Human
uacuguauuuuuaccuuuuuccu

SEQ ID NO: 1251658 - RNA, 15 nt, Human
uucauuuaaaauauu

SEQ ID NO: 1251659 - RNA, 20 nt, Human
aacucugcauucuaguacuu

SEQ ID NO: 1251660 - RNA, 15 nt, Human
ucuuuugccauuaaa

SEQ ID NO: 1251661 - RNA, 20 nt, Human
cauagaauaguguuggaaaa

SEQ ID NO: 1251662 - RNA, 16 nt, Human
auuuaagauaauuaua

SEQ ID NO: 1251663 - RNA, 21 nt, Human
cuuucaucuuggucacauaca

SEQ ID NO: 1251664 - RNA, 14 nt, Human
cuaaauuugguucu

SEQ ID NO: 1251665 - RNA, 15 nt, Human
uccgaagucuuccau

SEQ ID NO: 1251666 - RNA, 16 nt, Human
gaaagggucucccucu

SEQ ID NO: 1251667 - RNA, 15 nt, Human
aaucaaauuccagaa

SEQ ID NO: 1251668 - RNA, 19 nt, Human
auuugguucuaggccgggc

SEQ ID NO: 1251669 - RNA, 16 nt, Human
aaagcauuguaacuua

SEQ ID NO: 1251670 - RNA, 21 nt, Human
uuaaaucuaaaucuauuuauu

SEQ ID NO: 1251671 - RNA, 11 nt, Human
agguauuuauu

SEQ ID NO: 1251672 - RNA, 15 nt, Human
aaacuaauagaauua

SEQ ID NO: 1251673 - RNA, 16 nt, Human
uuucuuaaagaauuuu

SEQ ID NO: 1251674 - RNA, 17 nt, Human
auuuuaauaauguuuca

SEQ ID NO: 1251675 - RNA, 16 nt, Human
guauuuauaaauauau

SEQ ID NO: 1251676 - RNA, 19 nt, Human
aaaugaauaucuauuaaua

SEQ ID NO: 1251677 - RNA, 19 nt, Human
caccuguaaucccagcuac

SEQ ID NO: 1251678 - RNA, 12 nt, Human
ucaccccuugcc

SEQ ID NO: 1251679 - RNA, 15 nt, Human
uguuuuuaaacugga

SEQ ID NO: 1251680 - RNA, 15 nt, Human
ugggacagggaggac

SEQ ID NO: 1251681 - RNA, 12 nt, Human
gcuggccaggcu

SEQ ID NO: 1251682 - RNA, 18 nt, Human
aaaaauaaaaauaaaaau

SEQ ID NO: 1251683 - RNA, 16 nt, Human
gacaaagacaaauucu

SEQ ID NO: 1251684 - RNA, 20 nt, Human
ugccuccccuccucugcuug

SEQ ID NO: 1251685 - RNA, 23 nt, Human
uaggcguggacuuacuauuuauu

SEQ ID NO: 1251686 - RNA, 12 nt, Human
ccugucccagcg

SEQ ID NO: 1251687 - RNA, 12 nt, Human
cucauggaauug

SEQ ID NO: 1251688 - RNA, 18 nt, Human
uauaacaaugcuguauuu

SEQ ID NO: 1251689 - RNA, 24 nt, Human
uuaaacaaaaaaagcauuguaacu

SEQ ID NO: 1251690 - RNA, 17 nt, Human
gaaguugcagugagcug

SEQ ID NO: 1251691 - RNA, 19 nt, Human
aaaaagcauuguaacuuau

SEQ ID NO: 1251692 - RNA, 16 nt, Human
cauuuuacuacuuuaa

SEQ ID NO: 1251693 - RNA, 17 nt, Human
uuugaguguuuuaagau

SEQ ID NO: 1251694 - RNA, 18 nt, Human
uuguugacaacugugacu

SEQ ID NO: 1251695 - RNA, 18 nt, Human
aaauauauuuaagauaau

SEQ ID NO: 1251696 - RNA, 17 nt, Human
acccacuggacucaccu

SEQ ID NO: 1251697 - RNA, 15 nt, Human
aguguaaguucacaa

SEQ ID NO: 1251698 - RNA, 23 nt, Human
aauagugucugaugaauguuaaa

SEQ ID NO: 1251699 - RNA, 19 nt, Human
ggaucucacaagcacuuuc

SEQ ID NO: 1251700 - RNA, 12 nt, Human
acacugaagaag

SEQ ID NO: 1251701 - RNA, 15 nt, Human
guggguggggcagug

SEQ ID NO: 1251702 - RNA, 20 nt, Human
gcugccuccccuccucugcu

SEQ ID NO: 1251703 - RNA, 18 nt, Human
uccagcuggccgggagcc

SEQ ID NO: 1251704 - RNA, 18 nt, Human
ccucuggcuccagcuggc

SEQ ID NO: 1251705 - RNA, 20 nt, Human
ggagccugaucaccugcccu

SEQ ID NO: 1251706 - RNA, 12 nt, Human
gaagucuuccau

SEQ ID NO: 1251707 - RNA, 12 nt, Human
gccaucccuccc

SEQ ID NO: 1251708 - RNA, 13 nt, Human
agcuguggccagc

SEQ ID NO: 1251709 - RNA, 20 nt, Human
auauaauguuguuauuuaaa

SEQ ID NO: 1251710 - RNA, 18 nt, Human
agagauuuuuaaauaaag

SEQ ID NO: 1251711 - RNA, 13 nt, Human
acaagagcuuaac

SEQ ID NO: 1251712 - RNA, 21 nt, Human
aaaaaguucugcagauaaaca

SEQ ID NO: 1251713 - RNA, 21 nt, Human
guacauuuccaaauucacaag

SEQ ID NO: 1251714 - RNA, 16 nt, Human
ucuauuuauuaauauu

SEQ ID NO: 1251715 - RNA, 21 nt, Human
ggcuuguaaaguacagacuuu

SEQ ID NO: 1251716 - RNA, 15 nt, Human
uuuuuaaacaaaaaa

SEQ ID NO: 1251717 - RNA, 14 nt, Human
aaagaggaaugaag

SEQ ID NO: 1251718 - RNA, 14 nt, Human
ucccuugaugaaga

SEQ ID NO: 1251719 - RNA, 16 nt, Human
acuaguuucccuugca

SEQ ID NO: 1251720 - RNA, 16 nt, Human
gagcaccugcaggcgu

SEQ ID NO: 1251721 - RNA, 21 nt, Human
ucuagcaaauguuaugcauaa

SEQ ID NO: 1251722 - RNA, 15 nt, Human
ucuaugaaauauuau

SEQ ID NO: 1251723 - RNA, 13 nt, Human
cuugucucugggc

SEQ ID NO: 1251724 - RNA, 13 nt, Human
cacuuuuuuucuu

SEQ ID NO: 1251725 - RNA, 22 nt, Human
aaauguugacaugggacauuug

SEQ ID NO: 1251726 - RNA, 18 nt, Human
agcuucucauccugcagg

SEQ ID NO: 1251727 - RNA, 19 nt, Human
uuucacaagugaaaaacau

SEQ ID NO: 1251728 - RNA, 14 nt, Human
uccacuuggucugu

SEQ ID NO: 1251729 - RNA, 19 nt, Human
aaugaaauggugaaaugca

SEQ ID NO: 1251730 - RNA, 22 nt, Human
ccugggcagcugccuccccucc

SEQ ID NO: 1251731 - RNA, 21 nt, Human
aucggagcugcuagaguucug

SEQ ID NO: 1251732 - RNA, 21 nt, Human
auuguugacaacugugacugu

SEQ ID NO: 1251733 - RNA, 15 nt, Human
ugugucaguggaugc

SEQ ID NO: 1251734 - RNA, 22 nt, Human
aaacagaacuauggaaaaaaag

SEQ ID NO: 1251735 - RNA, 13 nt, Human
gcuggagcucugc

SEQ ID NO: 1251736 - RNA, 12 nt, Human
uuuguaauauuu

SEQ ID NO: 1251737 - RNA, 16 nt, Human
aauuuaagauuuuguu

SEQ ID NO: 1251738 - RNA, 23 nt, Human
aucacagcuacuugggaggcuga

SEQ ID NO: 1251739 - RNA, 20 nt, Human
acuguuaucaaaacuuucuu

SEQ ID NO: 1251740 - RNA, 20 nt, Human
caauuauuuuuacaguucuc

SEQ ID NO: 1251741 - RNA, 18 nt, Human
cugcaauaaaauggguuu

SEQ ID NO: 1251742 - RNA, 12 nt, Human
uccugcaggcag

SEQ ID NO: 1251743 - RNA, 16 nt, Human
ucuacuuuuaaguugc

SEQ ID NO: 1251744 - RNA, 16 nt, Human
ucucuaggaaauauuu

SEQ ID NO: 1251745 - RNA, 17 nt, Human
agacacacugaagaagc

SEQ ID NO: 1251746 - RNA, 13 nt, Human
aaauaaaagauug

SEQ ID NO: 1251747 - RNA, 16 nt, Human
gugacaagcucacaga

SEQ ID NO: 1251748 - RNA, 17 nt, Human
ggagcucgugggacagu

SEQ ID NO: 1251749 - RNA, 22 nt, Human
uauccuaauaaaaaggugacca

SEQ ID NO: 1251750 - RNA, 17 nt, Human
uggggcagugcuuggcc

SEQ ID NO: 1251751 - RNA, 14 nt, Human
uguugccaaggcug

SEQ ID NO: 1251752 - RNA, 16 nt, Human
gaggcuccacuugguc

SEQ ID NO: 1251753 - RNA, 18 nt, Human
gaggaauauuugcaagac

SEQ ID NO: 1251754 - RNA, 17 nt, Human
gacaccaccacccuugc

SEQ ID NO: 1251755 - RNA, 14 nt, Human
gaauuggagcucgu

SEQ ID NO: 1251756 - RNA, 14 nt, Human
gauccuggaaauca

SEQ ID NO: 1251757 - RNA, 17 nt, Human
gcccucuccugggcagc

SEQ ID NO: 1251758 - RNA, 22 nt, Human
gcuuagacccucaugcugccaa

SEQ ID NO: 1251759 - RNA, 21 nt, Human
gcuuagacccucaugcugcca

SEQ ID NO: 1251760 - RNA, 17 nt, Human
gcuucaccuguccccga

SEQ ID NO: 1251761 - RNA, 13 nt, Human
gcucuggaaacca

SEQ ID NO: 1251762 - RNA, 15 nt, Human
gccuccauccugagg

SEQ ID NO: 1251763 - RNA, 18 nt, Human
gccgggcgcgguggcuca

SEQ ID NO: 1251764 - RNA, 16 nt, Human
gccuaguugaucagcu

SEQ ID NO: 1251765 - RNA, 23 nt, Human
cgucuugacuuuggcaaaugagc

SEQ ID NO: 1251766 - RNA, 22 nt, Human
cuaaaaauugugaucagaccau

SEQ ID NO: 1251767 - RNA, 17 nt, Human
cuuccuggcaauaguca

SEQ ID NO: 1251768 - RNA, 20 nt, Human
cuuggcccaggaguuuggcc

SEQ ID NO: 1251769 - RNA, 22 nt, Human
gaauugaauucccugccuggau

SEQ ID NO: 1251770 - RNA, 16 nt, Human
cuggcacuugggacaa

SEQ ID NO: 1251771 - RNA, 19 nt, Human
cuggagugcaguggcgcaa

SEQ ID NO: 1251772 - RNA, 19 nt, Human
cuggccuucggccuccauc

SEQ ID NO: 1251773 - RNA, 13 nt, Human
cuggccuucggcc

SEQ ID NO: 1251774 - RNA, 20 nt, Human
cuuagacccucaugcugcca

SEQ ID NO: 1251775 - RNA, 20 nt, Human
caacuccaaacugacucuua

SEQ ID NO: 1251776 - RNA, 19 nt, Human
cacaagaaaugaaagcagg

SEQ ID NO: 1251777 - RNA, 16 nt, Human
caaggcuuagacccuc

SEQ ID NO: 1251778 - RNA, 18 nt, Human
caaggcuuagacccucau

SEQ ID NO: 1251779 - RNA, 13 nt, Human
cacagaggaucug

SEQ ID NO: 1251780 - RNA, 22 nt, Human
cagccagcaguucagagcugcc

SEQ ID NO: 1251781 - RNA, 18 nt, Human
cauuguaauugcuaucgc

SEQ ID NO: 1251782 - RNA, 20 nt, Human
cagcugccuccccuccucug

SEQ ID NO: 1251783 - RNA, 23 nt, Human
caggaguuccuaaccagccuggu

SEQ ID NO: 1251784 - RNA, 16 nt, Human
cauacuucuuaggguu

SEQ ID NO: 1251785 - RNA, 18 nt, Human
ccuguugaagaugcuugu

SEQ ID NO: 1251786 - RNA, 18 nt, Human
ccuguacuccagccuggg

SEQ ID NO: 1251787 - RNA, 16 nt, Human
ccuguacuuuuuccag

SEQ ID NO: 1251788 - RNA, 19 nt, Human
ccucugcuugccaucccuc

SEQ ID NO: 1251789 - RNA, 18 nt, Human
ccucccuccaccucccug

SEQ ID NO: 1251790 - RNA, 13 nt, Human
ccucacaccaggc

SEQ ID NO: 1251791 - RNA, 16 nt, Human
ccaggaguuuggccag

SEQ ID NO: 1251792 - RNA, 12 nt, Human
ccaccucccugc

SEQ ID NO: 1251793 - RNA, 15 nt, Human
ccauggagguuaagc

SEQ ID NO: 1251794 - RNA, 12 nt, Human
ccaugggacagg

SEQ ID NO: 1251795 - RNA, 16 nt, Human
ccccucuggcuccagc

SEQ ID NO: 1251796 - RNA, 22 nt, Human
agaagucaaggcuuagacccuc

SEQ ID NO: 1251797 - RNA, 16 nt, Human
agacccucaugcugcc

SEQ ID NO: 1251798 - RNA, 19 nt, Human
agacccucaugcugccaau

SEQ ID NO: 1251799 - RNA, 22 nt, Human
aggcuggagugcaguggcgcaa

SEQ ID NO: 1251800 - RNA, 22 nt, Human
aggcuuagacccucaugcugcc

SEQ ID NO: 1251801 - RNA, 23 nt, Human
agauaugaggcauuugcagcugu

SEQ ID NO: 1251802 - RNA, 23 nt, Human
aucacagcuacuugggaggcuga

SEQ ID NO: 1251803 - RNA, 18 nt, Human
aagcccagcuugaaaccu

SEQ ID NO: 1251804 - RNA, 22 nt, Human
acgcucucuggccuucggccuc

SEQ ID NO: 1251805 - RNA, 13 nt, Human
acuccagccuggg

SEQ ID NO: 1251806 - RNA, 13 nt, Human
acaaccuguccca

SEQ ID NO: 1251807 - RNA, 21 nt, Human
acaacacacagauuugagcuc

SEQ ID NO: 1251808 - RNA, 15 nt, Human
acccucugggucuca

SEQ ID NO: 1251809 - RNA, 14 nt, Human
acccgggaggcaga

SEQ ID NO: 1251810 - RNA, 13 nt, Human
aaaaaggugacca

SEQ ID NO: 1251811 - RNA, 13 nt, Human
aacuucagcgguu

SEQ ID NO: 1251812 - RNA, 13 nt, Human
aaauaaugaaaua

SEQ ID NO: 1251813 - RNA, 12 nt, Human
aaggcuggagug

SEQ ID NO: 1251814 - RNA, 19 nt, Human
aaggcuuagacccucaugc

SEQ ID NO: 1251815 - RNA, 20 nt, Human
aagcucuaucaccaaggagc

SEQ ID NO: 1251816 - RNA, 15 nt, Human
aaauuuuauaguguc

SEQ ID NO: 1251817 - RNA, 18 nt, Human
gaacagugauuaccaggg

SEQ ID NO: 1251818 - RNA, 15 nt, Human
gacccucaugcugcc

SEQ ID NO: 1251819 - RNA, 21 nt, Human
gacgguuuaaugggcacaggg

SEQ ID NO: 1251820 - RNA, 13 nt, Human
gacagaaagcaga

SEQ ID NO: 1251821 - RNA, 22 nt, Human
gacagcuucucauccugcaggc

SEQ ID NO: 1251822 - RNA, 17 nt, Human
cuucggccuccauccug

SEQ ID NO: 1251823 - RNA, 23 nt, Human
cugcugagucccaggcugagccu

SEQ ID NO: 1251824 - RNA, 18 nt, Human
cugccuaagugcagcccc

SEQ ID NO: 1251825 - RNA, 15 nt, Human
cugggcagcugccuc

SEQ ID NO: 1251826 - RNA, 19 nt, Human
cugggguggguggggcagu

SEQ ID NO: 1251827 - RNA, 15 nt, Human
cuggccugcuggaug

SEQ ID NO: 1251828 - RNA, 19 nt, Human
cugggaauuacaggcguga

SEQ ID NO: 1251829 - RNA, 16 nt, Human
cuggcaguuuuccauu

SEQ ID NO: 1251830 - RNA, 15 nt, Human
cuggccuucggccuc

SEQ ID NO: 1251831 - RNA, 16 nt, Human
cuggccuucggccucc

SEQ ID NO: 1251832 - RNA, 16 nt, Human
gagggaauugcagagu

SEQ ID NO: 1251833 - RNA, 18 nt, Human
gagaccagccaaccuggg

SEQ ID NO: 1251834 - RNA, 15 nt, Human
gaggcggguggauca

SEQ ID NO: 1251835 - RNA, 17 nt, Human
gaggcuccacuuggucu

SEQ ID NO: 1251836 - RNA, 21 nt, Human
gaggcuccacuuggucuguga

SEQ ID NO: 1251837 - RNA, 14 nt, Human
gaggccacguucuu

SEQ ID NO: 1251838 - RNA, 21 nt, Human
gcccaagggugggugggguga

SEQ ID NO: 1251839 - RNA, 20 nt, Human
gcccaggaguuuggccagaa

SEQ ID NO: 1251840 - RNA, 15 nt, Human
gccccccagcccucc

SEQ ID NO: 1251841 - RNA, 16 nt, Human
gccagcaguucagagc

SEQ ID NO: 1251842 - RNA, 13 nt, Human
gcauauguuucgc

SEQ ID NO: 1251843 - RNA, 15 nt, Human
gcauguaugacguga

SEQ ID NO: 1251844 - RNA, 15 nt, Human
gcaggcgugaccuga

SEQ ID NO: 1251845 - RNA, 14 nt, Human
gcagugcuuggccc

SEQ ID NO: 1251846 - RNA, 21 nt, Human
gcaaauugucacaggacagcc

SEQ ID NO: 1251847 - RNA, 21 nt, Human
gcacacagcacgggggccaag

SEQ ID NO: 1251848 - RNA, 16 nt, Human
cucuggccuucggccu

SEQ ID NO: 1251849 - RNA, 15 nt, Human
cuccugggcagcugc

SEQ ID NO: 1251850 - RNA, 13 nt, Human
cucgugggacagu

SEQ ID NO: 1251851 - RNA, 19 nt, Human
cugaugagaacucugagca

SEQ ID NO: 1251852 - RNA, 21 nt, Human
cgggaguggcgcgcgccacca

SEQ ID NO: 1251853 - RNA, 20 nt, Human
cgggagccugaucaccugcc

SEQ ID NO: 1251854 - RNA, 20 nt, Human
cggccuccauccugaggcuc

SEQ ID NO: 1251855 - RNA, 16 nt, Human
cgugggacagucaccu

SEQ ID NO: 1251856 - RNA, 15 nt, Human
uuagacccucaugcu

SEQ ID NO: 1251857 - RNA, 15 nt, Human
ccuuccucugagccu

SEQ ID NO: 1251858 - RNA, 16 nt, Human
ccuucuggguucaagc

SEQ ID NO: 1251859 - RNA, 16 nt, Human
ccugagcuugcagaga

SEQ ID NO: 1251860 - RNA, 15 nt, Human
ccugccccugagccc

SEQ ID NO: 1251861 - RNA, 21 nt, Human
ccuggcaaggguucaccuggg

SEQ ID NO: 1251862 - RNA, 11 nt, Human
ccucaagccag

SEQ ID NO: 1251863 - RNA, 21 nt, Human
uaguaagagauuccugagcca

SEQ ID NO: 1251864 - RNA, 22 nt, Human
guuccugagaccagccaaccug

SEQ ID NO: 1251865 - RNA, 13 nt, Human
gcugaugaacucu

SEQ ID NO: 1251866 - RNA, 13 nt, Human
gcucucuggccuu

SEQ ID NO: 1251867 - RNA, 20 nt, Human
gcuaucgccaucacagcuga

SEQ ID NO: 1251868 - RNA, 21 nt, Human
gcucagcccuggugggcagag

SEQ ID NO: 1251869 - RNA, 18 nt, Human
gccuuggggcugaugcag

SEQ ID NO: 1251870 - RNA, 21 nt, Human
gcgacaguuuuccuucucauc

SEQ ID NO: 1251871 - RNA, 15 nt, Human
gccucuuagaugcag

SEQ ID NO: 1251872 - RNA, 22 nt, Human
gccuccauccugaggcuccacu

SEQ ID NO: 1251873 - RNA, 13 nt, Human
gccuccauccuga

SEQ ID NO: 1251874 - RNA, 17 nt, Human
ugggacagggaggacgc

SEQ ID NO: 1251875 - RNA, 20 nt, Human
ugccuccccuccucugcuug

SEQ ID NO: 1251876 - RNA, 19 nt, Human
ugagucccaggcugagccu

SEQ ID NO: 1251877 - RNA, 14 nt, Human
cauagaauaguguu

SEQ ID NO: 1251878 - RNA, 14 nt, Human
cagucugacuguuu

SEQ ID NO: 1251879 - RNA, 14 nt, Human
cagugcuuuccgug

SEQ ID NO: 1251880 - RNA, 18 nt, Human
cagugucaaugcagcccc

SEQ ID NO: 1251881 - RNA, 14 nt, Human
caggcagcaggaua

SEQ ID NO: 1251882 - RNA, 13 nt, Human
cagccaggcggcu

SEQ ID NO: 1251883 - RNA, 20 nt, Human
cagcgagggacaccgagugg

SEQ ID NO: 1251884 - RNA, 15 nt, Human
cagcucuaaauguca

SEQ ID NO: 1251885 - RNA, 15 nt, Human
caugcugucuacacu

SEQ ID NO: 1251886 - RNA, 19 nt, Human
caugcugccaauauccuaa

SEQ ID NO: 1251887 - RNA, 13 nt, Human
ccaaauucacaag

SEQ ID NO: 1251888 - RNA, 14 nt, Human
auugugggcucugg

SEQ ID NO: 1251889 - RNA, 15 nt, Human
auugcuaucgccauc

SEQ ID NO: 1251890 - RNA, 19 nt, Human
auuccuauauccugugacu

SEQ ID NO: 1251891 - RNA, 19 nt, Human
caagugauccgcccaucuc

SEQ ID NO: 1251892 - RNA, 14 nt, Human
cacaacacacagau

SEQ ID NO: 1251893 - RNA, 20 nt, Human
cacacagauuugagcucagc

SEQ ID NO: 1251894 - RNA, 15 nt, Human
caccugcaggcguga

SEQ ID NO: 1251895 - RNA, 23 nt, Human
cagagacgggguuugccaugcug

SEQ ID NO: 1251896 - RNA, 19 nt, Human
cagagcugcccucuccugg

SEQ ID NO: 1251897 - RNA, 22 nt, Human
cagagcugcccucuccugggca

SEQ ID NO: 1251898 - RNA, 15 nt, Human
auaccacaggaacca

SEQ ID NO: 1251899 - RNA, 16 nt, Human
aguugcagugagcuga

SEQ ID NO: 1251900 - RNA, 13 nt, Human
auaacucaucaua

SEQ ID NO: 1251901 - RNA, 12 nt, Human
auaugugaaaua

SEQ ID NO: 1251902 - RNA, 18 nt, Human
auuauggcugguaacaua

SEQ ID NO: 1251903 - RNA, 12 nt, Human
aguaaugauaac

SEQ ID NO: 1251904 - RNA, 16 nt, Human
agccugaucaccugcc

SEQ ID NO: 1251905 - RNA, 22 nt, Human
gauggaaguugcagugagcuga

SEQ ID NO: 1251906 - RNA, 17 nt, Human
gcaagcucuaucaccaa

SEQ ID NO: 1251907 - RNA, 13 nt, Human
gaugauguuucgu

SEQ ID NO: 1251908 - RNA, 14 nt, Human
gcaauaaaaugggu

SEQ ID NO: 1251909 - RNA, 21 nt, Human
gcaugaauuuuuuucaucuuc

SEQ ID NO: 1251910 - RNA, 15 nt, Human
gccaccaaacccggc

SEQ ID NO: 1251911 - RNA, 19 nt, Human
gcagaacagugauuaccag

SEQ ID NO: 1251912 - RNA, 16 nt, Human
gcaccugcaggcguga

SEQ ID NO: 1251913 - RNA, 20 nt, Human
gaaaagacauaagcaaagac

SEQ ID NO: 1251914 - RNA, 17 nt, Human
cuuucacaggggacagg

SEQ ID NO: 1251915 - RNA, 20 nt, Human
agccagcaguucagagcugc

SEQ ID NO: 1251916 - RNA, 16 nt, Human
gacgcucucuggccuu

SEQ ID NO: 1251917 - RNA, 12 nt, Human
gagaagaaugac

SEQ ID NO: 1251918 - RNA, 14 nt, Human
gaacugcuggauuc

SEQ ID NO: 1251919 - RNA, 14 nt, Human
cucuggccuucggc

SEQ ID NO: 1251920 - RNA, 16 nt, Human
cucuaucaccaaggag

SEQ ID NO: 1251921 - RNA, 14 nt, Human
cuccccuccucugc

SEQ ID NO: 1251922 - RNA, 14 nt, Human
cugcagacaugaga

SEQ ID NO: 1251923 - RNA, 19 nt, Human
agacagggaaagggucucc

SEQ ID NO: 1251924 - RNA, 20 nt, Human
cucauggaauuggagcucgu

SEQ ID NO: 1251925 - RNA, 18 nt, Human
cucaacuuugacaaccau

SEQ ID NO: 1251926 - RNA, 20 nt, Human
cagugcuuggcccaggaguu

SEQ ID NO: 1251927 - RNA, 22 nt, Human
cagugucuggcacuugggacaa

SEQ ID NO: 1251928 - RNA, 11 nt, Human
caggucuacca

SEQ ID NO: 1251929 - RNA, 21 nt, Human
gcuacucuguuccuucacauc

SEQ ID NO: 1251930 - RNA, 22 nt, Human
gcuaguaauuggaaaggcagcu

SEQ ID NO: 1251931 - RNA, 19 nt, Human
gccagcaguucagagcugc

SEQ ID NO: 1251932 - RNA, 14 nt, Human
ggcuccacuugguc

SEQ ID NO: 1251933 - RNA, 15 nt, Human
ggugaaaugcagagu

SEQ ID NO: 1251934 - RNA, 17 nt, Human
ggcuggagugcaguggc

SEQ ID NO: 1251935 - RNA, 13 nt, Human
gggcagcugccuc

SEQ ID NO: 1251936 - RNA, 12 nt, Human
uacaaucaucaa

SEQ ID NO: 1251937 - RNA, 15 nt, Human
uacuucuugaagccg

SEQ ID NO: 1251938 - RNA, 16 nt, Human
ucugcuugccaucccu

SEQ ID NO: 1251939 - RNA, 15 nt, Human
ucggccuccauccug

SEQ ID NO: 1251940 - RNA, 16 nt, Human
cacgggggccaaggau

SEQ ID NO: 1251941 - RNA, 14 nt, Human
caccucccugcaau

SEQ ID NO: 1251942 - RNA, 23 nt, Human
cacagcugaacuuguugagaucc

SEQ ID NO: 1251943 - RNA, 19 nt, Human
auuguugacaacugugacu

SEQ ID NO: 1251944 - RNA, 14 nt, Human
aucucaauauuuca

SEQ ID NO: 1251945 - RNA, 12 nt, Human
aucuuugagcgc

SEQ ID NO: 1251946 - RNA, 11 nt, Human
accagccuggu

SEQ ID NO: 1251947 - RNA, 21 nt, Human
acagauuugagcucagcccug

SEQ ID NO: 1251948 - RNA, 22 nt, Human
acagcacgggggccaaggaugc

SEQ ID NO: 1251949 - RNA, 16 nt, Human
agccuaguugaucagc

SEQ ID NO: 1251950 - RNA, 22 nt, Human
agccucauguccacugguucuu

SEQ ID NO: 1251951 - RNA, 21 nt, Human
agcccagcuugaaaccuucac

SEQ ID NO: 1251952 - RNA, 21 nt, Human
agcuaaaauuagaugaacuca

SEQ ID NO: 1251953 - RNA, 14 nt, Human
agcuguugagcugu

SEQ ID NO: 1251954 - RNA, 14 nt, Human
acuugggaggcuga

SEQ ID NO: 1251955 - RNA, 21 nt, Human
acugggguggguggggcagug

SEQ ID NO: 1251956 - RNA, 18 nt, Human
acugggguggguggggca

SEQ ID NO: 1251957 - RNA, 14 nt, Human
acccucaugcugcc

SEQ ID NO: 1251958 - RNA, 15 nt, Human
acccucaugcugcca

SEQ ID NO: 1251959 - RNA, 20 nt, Human
accccugagcuugcagagau

SEQ ID NO: 1251960 - RNA, 14 nt, Human
accuucuggguuca

SEQ ID NO: 1251961 - RNA, 21 nt, Human
acaccaggcuugccugcaggc

SEQ ID NO: 1251962 - RNA, 13 nt, Human
acagaggaucugc

SEQ ID NO: 1251963 - RNA, 14 nt, Human
aaaggccugucccu

SEQ ID NO: 1251964 - RNA, 16 nt, Human
ucugggucucaguguc

SEQ ID NO: 1251965 - RNA, 18 nt, Human
uccugggcagcugccucc

SEQ ID NO: 1251966 - RNA, 18 nt, Human
uggugcuuccaaauauug

SEQ ID NO: 1251967 - RNA, 17 nt, Human
ugggauagcugacccag

SEQ ID NO: 1251968 - RNA, 14 nt, Human
uugcuugaacccag

SEQ ID NO: 1251969 - RNA, 20 nt, Human
uugguucuaauagaacucag

SEQ ID NO: 1251970 - RNA, 21 nt, Human
uuuaaaaaaaaaccugagccc

SEQ ID NO: 1251971 - RNA, 18 nt, Human
uguuaaaacugggacagg

SEQ ID NO: 1251972 - RNA, 14 nt, Human
uaauaccuaagccu

SEQ ID NO: 1251973 - RNA, 19 nt, Human
ucaaggcuuagacccucau

SEQ ID NO: 1251974 - RNA, 18 nt, Human
uaucgccaucacagcuga

SEQ ID NO: 1251975 - RNA, 19 nt, Human
ggcagugcuuggcccagga

SEQ ID NO: 1251976 - RNA, 17 nt, Human
ggcagugcuuggcccag

SEQ ID NO: 1251977 - RNA, 17 nt, Human
ggacagucaccucaugg

SEQ ID NO: 1251978 - RNA, 15 nt, Human
ggaauugaggacacu

SEQ ID NO: 1251979 - RNA, 15 nt, Human
ggacauuugcucaug

SEQ ID NO: 1251980 - RNA, 22 nt, Human
ggacagcccuucuuuccacaga

SEQ ID NO: 1251981 - RNA, 19 nt, Human
gcuuuugcuaggucacaga

SEQ ID NO: 1251982 - RNA, 22 nt, Human
ggugacccugaugaaaacauag

SEQ ID NO: 1251983 - RNA, 17 nt, Human
gguauuuuaaucaccaa

SEQ ID NO: 1251984 - RNA, 12 nt, Human
ggguuucacaag

SEQ ID NO: 1251985 - RNA, 15 nt, Human
gggccuaugcagagg

SEQ ID NO: 1251986 - RNA, 17 nt, Human
gggagccugaucaccug

SEQ ID NO: 1251987 - RNA, 15 nt, Human
gggacagggaggacg

SEQ ID NO: 1251988 - RNA, 22 nt, Human
ggcccaggaguuuggccagaag

SEQ ID NO: 1251989 - RNA, 14 nt, Human
ggcgugagccacca

SEQ ID NO: 1251990 - RNA, 13 nt, Human
ggcuauucacaac

SEQ ID NO: 1251991 - RNA, 12 nt, Human
uguuuuucacau

SEQ ID NO: 1251992 - RNA, 14 nt, Human
auacaaaaaaaaaa

SEQ ID NO: 1251993 - RNA, 16 nt, Human
ccaggcugagccucag

SEQ ID NO: 1251994 - RNA, 22 nt, Human
cuuccauuccaagccugaccac

SEQ ID NO: 1251995 - RNA, 12 nt, Human
ccuucagccuga

SEQ ID NO: 1251996 - RNA, 20 nt, Human
guuccuuccucugagccuug

SEQ ID NO: 1251997 - RNA, 16 nt, Human
aauauauaugaauaaa

SEQ ID NO: 1251998 - RNA, 20 nt, Human
cugcaauauuugaauuuuaa

SEQ ID NO: 1251999 - RNA, 15 nt, Human
auguguggcauuuuc

SEQ ID NO: 1252000 - RNA, 23 nt, Human
agaguuuagcuggaaaaguaugu

SEQ ID NO: 1252001 - RNA, 21 nt, Human
ugcaauaaaauggguuuuacu

SEQ ID NO: 1252002 - RNA, 20 nt, Human
aaaguaacucauuuguuaaa

SEQ ID NO: 1252003 - RNA, 17 nt, Human
uuacagagacagaaagc

SEQ ID NO: 1252004 - RNA, 19 nt, Human
gugcaauaaaauguauuug

SEQ ID NO: 1252005 - RNA, 20 nt, Human
ccccuauccuacuuccccuu

SEQ ID NO: 1252006 - RNA, 22 nt, Human
ccagcaaauucgcugcaaccug

SEQ ID NO: 1252007 - RNA, 18 nt, Human
acugacucuuaagaagac

SEQ ID NO: 1252008 - RNA, 22 nt, Human
uuaccucugccucagaaaacaa

SEQ ID NO: 1252009 - RNA, 22 nt, Human
ugaccauacuaauuauaccccc

SEQ ID NO: 1252010 - RNA, 14 nt, Human
cugcugagucccag

SEQ ID NO: 1252011 - RNA, 19 nt, Human
cuaaaauuagaugaacuca

SEQ ID NO: 1252012 - RNA, 18 nt, Human
acucauugcaaccuccac

SEQ ID NO: 1252013 - RNA, 14 nt, Human
guugccaaggcugg

SEQ ID NO: 1252014 - RNA, 17 nt, Human
caccagggccuggcugg

SEQ ID NO: 1252015 - RNA, 19 nt, Human
uuacugccgguuugaaaau

SEQ ID NO: 1252016 - RNA, 22 nt, Human
acuucacuuuuuuucuuuucuc

SEQ ID NO: 1252017 - RNA, 18 nt, Human
ucuaugaaauauuauguu

SEQ ID NO: 1252018 - RNA, 15 nt, Human
aauguuacauuauua

SEQ ID NO: 1252019 - RNA, 21 nt, Human
aagauuaugaucucagaaauu

SEQ ID NO: 1252020 - RNA, 22 nt, Human
gaacuuuccacauucagagcuu

SEQ ID NO: 1252021 - RNA, 20 nt, Human
uccagagggaauugcagagu

SEQ ID NO: 1252022 - RNA, 16 nt, Human
cugccuccccuccucu

SEQ ID NO: 1252023 - RNA, 13 nt, Human
auaaacucagaaa

SEQ ID NO: 1252024 - RNA, 13 nt, Human
cuugacuuuggca

SEQ ID NO: 1252025 - RNA, 14 nt, Human
caguaacggaacag

SEQ ID NO: 1252026 - RNA, 14 nt, Human
aaauuccagaauga

SEQ ID NO: 1252027 - RNA, 19 nt, Human
gcugcccucuccugggcag

SEQ ID NO: 1252028 - RNA, 12 nt, Human
gccaaggcugga

SEQ ID NO: 1252029 - RNA, 19 nt, Human
uauaauauacuauauuuau

SEQ ID NO: 1252030 - RNA, 23 nt, Human
acaguguuuucugggauaaguaa

SEQ ID NO: 1252031 - RNA, 15 nt, Human
uaacugcuacaaaua

SEQ ID NO: 1252032 - RNA, 19 nt, Human
aauucuaaaugaauguuua

SEQ ID NO: 1252033 - RNA, 11 nt, Human
cagccagcagu

SEQ ID NO: 1252034 - RNA, 15 nt, Human
uccccuccucugcuu

SEQ ID NO: 1252035 - RNA, 14 nt, Human
cuuaugaaccuuua

SEQ ID NO: 1252036 - RNA, 21 nt, Human
caagcuuuuuuuuuuuuucuu

SEQ ID NO: 1252037 - RNA, 15 nt, Human
uaugaaacauuacag

SEQ ID NO: 1252038 - RNA, 14 nt, Human
uacagagaaaagac

SEQ ID NO: 1252039 - RNA, 14 nt, Human
cugccgcaacaguu

SEQ ID NO: 1252040 - RNA, 12 nt, Human
gagaaauuugcc

SEQ ID NO: 1252041 - RNA, 19 nt, Human
uguaguguuggagaagaac

SEQ ID NO: 1252042 - RNA, 15 nt, Human
gacgugacuggccug

SEQ ID NO: 1252043 - RNA, 22 nt, Human
gaaaauguguauuuuauuacau

SEQ ID NO: 1252044 - RNA, 19 nt, Human
agcagcuuauucacaagac

SEQ ID NO: 1252045 - RNA, 23 nt, Human
gaaaaaguucugcagauaaacag

SEQ ID NO: 1252046 - RNA, 15 nt, Human
gugaccacugcagaa

SEQ ID NO: 1252047 - RNA, 15 nt, Human
cacuuuaacacagug

SEQ ID NO: 1252048 - RNA, 19 nt, Human
uguugacaacugugacugu

SEQ ID NO: 1252049 - RNA, 16 nt, Human
ccuaagugcagccccg

SEQ ID NO: 1252050 - RNA, 18 nt, Human
cugagccuugggaccccu

SEQ ID NO: 1252051 - RNA, 15 nt, Human
cuacaagacacagug

SEQ ID NO: 1252052 - RNA, 19 nt, Human
acugcuggauucaagugau

SEQ ID NO: 1252053 - RNA, 18 nt, Human
aaccuuauuguaccucuc

SEQ ID NO: 1252054 - RNA, 21 nt, Human
auauuuauaacucaucauaaa

SEQ ID NO: 1252055 - RNA, 21 nt, Human
ccaaggaugccccgucccccu

SEQ ID NO: 1252056 - RNA, 24 nt, Human
uucacuuuuggcuuguaaaguaca

SEQ ID NO: 1252057 - RNA, 13 nt, Human
uuauugagcaccu

SEQ ID NO: 1252058 - RNA, 15 nt, Human
gagaaucagaucauu

SEQ ID NO: 1252059 - RNA, 14 nt, Human
auccagaaauaaug

SEQ ID NO: 1252060 - RNA, 18 nt, Human
aauucaaacuaauagaau

SEQ ID NO: 1252061 - RNA, 19 nt, Human
cugcuggauucaagugauc

SEQ ID NO: 1252062 - RNA, 15 nt, Human
ugguuuagaaagcuu

SEQ ID NO: 1252063 - RNA, 17 nt, Human
guugcugggggggauug

SEQ ID NO: 1252064 - RNA, 13 nt, Human
cuggccugcugga

SEQ ID NO: 1252065 - RNA, 17 nt, Human
cugaugaauguuaaauu

SEQ ID NO: 1252066 - RNA, 17 nt, Human
auauuuuuuaugaaaca

SEQ ID NO: 1252067 - RNA, 22 nt, Human
acagauuugagcucagcccugg

SEQ ID NO: 1252068 - RNA, 12 nt, Human
auuuauauaugu

SEQ ID NO: 1252069 - RNA, 19 nt, Human
aagcgauucucuuuauuca

SEQ ID NO: 1252070 - RNA, 18 nt, Human
ugcuacucuguuccuuca

SEQ ID NO: 1252071 - RNA, 21 nt, Human
uggcuuaaaauguaauuaauc

SEQ ID NO: 1252072 - RNA, 18 nt, Human
acuagaauuuauucaauu

SEQ ID NO: 1252073 - RNA, 15 nt, Human
guugccaaggcugga

SEQ ID NO: 1252074 - RNA, 22 nt, Human
caucccucccuccaccucccug

SEQ ID NO: 1252075 - RNA, 12 nt, Human
gcaguuuuccau

SEQ ID NO: 1252076 - RNA, 18 nt, Human
cauauguaccauguacau

SEQ ID NO: 1252077 - RNA, 16 nt, Human
ccaucccucccuccac

SEQ ID NO: 1252078 - RNA, 15 nt, Human
gcuugccaucccucc

SEQ ID NO: 1252079 - RNA, 17 nt, Human
ccagcaguucagagcug

SEQ ID NO: 1252080 - RNA, 16 nt, Human
ccugaucaccugcccu

SEQ ID NO: 1252081 - RNA, 13 nt, Human
ggggcucugggau

SEQ ID NO: 1252082 - RNA, 18 nt, Human
gccccgggaguggcgcgc

SEQ ID NO: 1252083 - RNA, 16 nt, Human
uauauguguuuuucac

SEQ ID NO: 1252084 - RNA, 13 nt, Human
cucagaaaacaag

SEQ ID NO: 1252085 - RNA, 16 nt, Human
agugucaaugcagccc

SEQ ID NO: 1252086 - RNA, 22 nt, Human
uauauauuuauaacucaucaua

SEQ ID NO: 1252087 - RNA, 23 nt, Human
uuuagaaagaagcccaauauuau

SEQ ID NO: 1252088 - RNA, 17 nt, Human
aauauugcaaggcaaag

SEQ ID NO: 1252089 - RNA, 20 nt, Human
auaucaguccucuuucaaag

SEQ ID NO: 1252090 - RNA, 14 nt, Human
aaaacuucagacau

SEQ ID NO: 1252091 - RNA, 21 nt, Human
cuaagauuuguaauauuucuc

SEQ ID NO: 1252092 - RNA, 12 nt, Human
accccugagcuu

SEQ ID NO: 1252093 - RNA, 12 nt, Human
uuguuuuuccac

SEQ ID NO: 1252094 - RNA, 17 nt, Human
aucaugccccuguacuc

SEQ ID NO: 1252095 - RNA, 15 nt, Human
acuacuuuaaaaaaa

SEQ ID NO: 1252096 - RNA, 16 nt, Human
cacuguuaucaaaacu

SEQ ID NO: 1252097 - RNA, 13 nt, Human
accucaguuuuau

SEQ ID NO: 1252098 - RNA, 14 nt, Human
cuggcuuaaaaugu

SEQ ID NO: 1252099 - RNA, 19 nt, Human
uacugagccuuguaauucu

SEQ ID NO: 1252100 - RNA, 21 nt, Human
ucuuugccuuuauaaucuuuu

SEQ ID NO: 1252101 - RNA, 12 nt, Human
acuuguugagau

SEQ ID NO: 1252102 - RNA, 20 nt, Human
uuaaauggucaauuuuguua

SEQ ID NO: 1252103 - RNA, 20 nt, Human
ucuuaacucauugcaaccuc

SEQ ID NO: 1252104 - RNA, 20 nt, Human
ugagcagugcuugaaugaag

SEQ ID NO: 1252105 - RNA, 19 nt, Human
cuggccuucggccuccauc

SEQ ID NO: 1252106 - RNA, 12 nt, Human
agcaguaacuga

SEQ ID NO: 1252107 - RNA, 17 nt, Human
acucuacccauauuaca

SEQ ID NO: 1252108 - RNA, 11 nt, Human
guaaugaaaau

SEQ ID NO: 1252109 - RNA, 13 nt, Human
aagugcagccccg

SEQ ID NO: 1252110 - RNA, 17 nt, Human
ucuccugggcagcugcc

SEQ ID NO: 1252111 - RNA, 18 nt, Human
uggaauauguaaauagaa

SEQ ID NO: 1252112 - RNA, 21 nt, Human
aauaaaguauauauagaaucu

SEQ ID NO: 1252113 - RNA, 18 nt, Human
cugcucaauaaaguacaa

SEQ ID NO: 1252114 - RNA, 16 nt, Human
aauuucagaagaaauu

SEQ ID NO: 1252115 - RNA, 12 nt, Human
uacaauugaaau

SEQ ID NO: 1252116 - RNA, 21 nt, Human
uuuuauggcacuaguauuucu

SEQ ID NO: 1252117 - RNA, 23 nt, Human
aauuauggcugguaacauagguu

SEQ ID NO: 1252118 - RNA, 23 nt, Human
caguucauauguaccauguacau

SEQ ID NO: 1252119 - RNA, 17 nt, Human
gcaugguuuagaaagcu

SEQ ID NO: 1252120 - RNA, 13 nt, Human
aaauaaaaauaaa

SEQ ID NO: 1252121 - RNA, 22 nt, Human
uacugagagugaacaaauuuac

SEQ ID NO: 1252122 - RNA, 22 nt, Human
gaugguucccuugaugaagaag

SEQ ID NO: 1252123 - RNA, 16 nt, Human
gacaaccaugagacca

SEQ ID NO: 1252124 - RNA, 16 nt, Human
uugucaauaaaaucca

SEQ ID NO: 1252125 - RNA, 22 nt, Human
ucccuuuugcugccucuaaaag

SEQ ID NO: 1252126 - RNA, 20 nt, Human
ggucucaguguccucaucug

SEQ ID NO: 1252127 - RNA, 13 nt, Human
guuggaggcugca

SEQ ID NO: 1252128 - RNA, 12 nt, Human
aaggaugccccg

SEQ ID NO: 1252129 - RNA, 21 nt, Human
gcaaaauuuuuucucuaggaa

SEQ ID NO: 1252130 - RNA, 16 nt, Human
gcaagcuuuucaaaau

SEQ ID NO: 1252131 - RNA, 18 nt, Human
ucuccuguacuuuuucca

SEQ ID NO: 1252132 - RNA, 23 nt, Human
uccguggcacugcauacaaucug

SEQ ID NO: 1252133 - RNA, 14 nt, Human
uguuguuauuuaaa

SEQ ID NO: 1252134 - RNA, 19 nt, Human
cugagccucagucucccuc

SEQ ID NO: 1252135 - RNA, 22 nt, Human
uauccuacuuccccuuccuaau

SEQ ID NO: 1252136 - RNA, 23 nt, Human
ugccucuaaaaggccugucccug

SEQ ID NO: 1252137 - RNA, 18 nt, Human
gagaccacuguuaucaaa

SEQ ID NO: 1252138 - RNA, 20 nt, Human
ggcaggucacacaaccuguc

SEQ ID NO: 1252139 - RNA, 16 nt, Human
ucaguguccucaucug

SEQ ID NO: 1252140 - RNA, 20 nt, Human
auugaaucccuuaaacucag

SEQ ID NO: 1252141 - RNA, 17 nt, Human
cuccaccucccugcaau

SEQ ID NO: 1252142 - RNA, 12 nt, Human
uagggaccugcu

SEQ ID NO: 1252143 - RNA, 23 nt, Human
cauagauguagauaaacucagaa

SEQ ID NO: 1252144 - RNA, 19 nt, Human
ccuccauccugaggcucca

SEQ ID NO: 1252145 - RNA, 22 nt, Human
gcacagccucuuagaugcaguu

SEQ ID NO: 1252146 - RNA, 12 nt, Human
aauaaaguacaa

SEQ ID NO: 1252147 - RNA, 23 nt, Human
ggaggcagagguugcagugagcc

SEQ ID NO: 1252148 - RNA, 14 nt, Human
agagguccacaaca

SEQ ID NO: 1252149 - RNA, 17 nt, Human
agucccaggcugagccu

SEQ ID NO: 1252150 - RNA, 21 nt, Human
uucgcugauauauguguuuuu

SEQ ID NO: 1252151 - RNA, 19 nt, Human
uuaaacaaaaaaagcauug

SEQ ID NO: 1252152 - RNA, 23 nt, Human
agccuugggaccccugagcuugc

SEQ ID NO: 1252153 - RNA, 18 nt, Human
uucacaagugaaaaacau

SEQ ID NO: 1252154 - RNA, 20 nt, Human
cuguaaaauggagacaccac

SEQ ID NO: 1252155 - RNA, 12 nt, Human
cucuaacucaga

SEQ ID NO: 1252156 - RNA, 20 nt, Human
agcccuggugggcagagagg

SEQ ID NO: 1252157 - RNA, 21 nt, Human
caucccucccuccaccucccu

SEQ ID NO: 1252158 - RNA, 21 nt, Human
cuauucacaaccacucauuca

SEQ ID NO: 1252159 - RNA, 12 nt, Human
ucauuuuaauua

SEQ ID NO: 1252160 - RNA, 10 nt, Human
acauauuucu

SEQ ID NO: 1252161 - RNA, 16 nt, Human
acaugaaguccaagca

SEQ ID NO: 1252162 - RNA, 16 nt, Human
auaacuggaaacuuca

SEQ ID NO: 1252163 - RNA, 17 nt, Human
auaguguuggaaaaugu

SEQ ID NO: 1252164 - RNA, 14 nt, Human
uguggcuguaucuu

SEQ ID NO: 1252165 - RNA, 19 nt, Human
accccuucauccucugagu

SEQ ID NO: 1252166 - RNA, 18 nt, Human
uuaaacacuaaaaaggca

SEQ ID NO: 1252167 - RNA, 14 nt, Human
ggcaauagucaaau

SEQ ID NO: 1252168 - RNA, 17 nt, Human
cugugacugucucacuu

SEQ ID NO: 1252169 - RNA, 20 nt, Human
gugagccaccaaacccggcc

SEQ ID NO: 1252170 - RNA, 15 nt, Human
uuucuugaguuuugu

SEQ ID NO: 1252171 - RNA, 18 nt, Human
agaaaacuaagaaauaug

SEQ ID NO: 1252172 - RNA, 14 nt, Human
uacuguauuuuuac

SEQ ID NO: 1252173 - RNA, 15 nt, Human
ugagcucagcccugg

SEQ ID NO: 1252174 - RNA, 18 nt, Human
ucacacaaccugucccag

SEQ ID NO: 1252175 - RNA, 10 nt, Human
auaacucauc

SEQ ID NO: 1252176 - RNA, 14 nt, Human
gccccgggaguggc

SEQ ID NO: 1252177 - RNA, 18 nt, Human
auuaugaucucagaaauu

SEQ ID NO: 1252178 - RNA, 17 nt, Human
auucaaaaguugaaauu

SEQ ID NO: 1252179 - RNA, 19 nt, Human
ucacgccuguaaucccagc

SEQ ID NO: 1252180 - RNA, 14 nt, Human
gugagccaccaaac

SEQ ID NO: 1252181 - RNA, 13 nt, Human
agcugccuccccu

SEQ ID NO: 1252182 - RNA, 14 nt, Human
uugcuggagcucug

SEQ ID NO: 1252183 - RNA, 18 nt, Human
gaagaugcuuguauuuua

SEQ ID NO: 1252184 - RNA, 14 nt, Human
cauuuccaaauuca

SEQ ID NO: 1252185 - RNA, 21 nt, Human
augcaucuuacugaagguaaa

SEQ ID NO: 1252186 - RNA, 16 nt, Human
cauuuugguaaaauac

SEQ ID NO: 1252187 - RNA, 15 nt, Human
ccucagucucccucc

SEQ ID NO: 1252188 - RNA, 22 nt, Human
augcccaagaaugagaagaaug

SEQ ID NO: 1252189 - RNA, 19 nt, Human
auugaggacacugauaugg

SEQ ID NO: 1252190 - RNA, 18 nt, Human
agaaauaugcacaauagc

SEQ ID NO: 1252191 - RNA, 16 nt, Human
ccacuuggucugugag

SEQ ID NO: 1252192 - RNA, 23 nt, Human
cucauguccacugguucuucuug

SEQ ID NO: 1252193 - RNA, 11 nt, Human
ggucacaggaa

SEQ ID NO: 1252194 - RNA, 19 nt, Human
agaaacaucaguuacucug

SEQ ID NO: 1252195 - RNA, 17 nt, Human
uagagugggacaguucc

SEQ ID NO: 1252196 - RNA, 18 nt, Human
caguuagagauuuuuaaa

SEQ ID NO: 1252197 - RNA, 13 nt, Human
ccucugcuugcca

SEQ ID NO: 1252198 - RNA, 14 nt, Human
cacaacacacagau

SEQ ID NO: 1252199 - RNA, 17 nt, Human
gugccuguaaucacagc

SEQ ID NO: 1252200 - RNA, 15 nt, Human
ggauagagugggaca

SEQ ID NO: 1252201 - RNA, 15 nt, Human
gguggggcagugcuu

SEQ ID NO: 1252202 - RNA, 14 nt, Human
auacaguaauuuua

SEQ ID NO: 1252203 - RNA, 16 nt, Human
aguugcagugagcuga

SEQ ID NO: 1252204 - RNA, 15 nt, Human
cccugcaaagcccag

SEQ ID NO: 1252205 - RNA, 18 nt, Human
gaagcaaaauuuuuucuc

SEQ ID NO: 1252206 - RNA, 23 nt, Human
aaauuaaggcuucucuuaaacac

SEQ ID NO: 1252207 - RNA, 16 nt, Human
ugcacaucaaaauaug

SEQ ID NO: 1252208 - RNA, 22 nt, Human
ccauacuaauuauacccccugc

SEQ ID NO: 1252209 - RNA, 19 nt, Human
ugggacaggggagaaccua

SEQ ID NO: 1252210 - RNA, 23 nt, Human
ccagcacuuugggaggcugaggc

SEQ ID NO: 1252211 - RNA, 13 nt, Human
cuaagaaauaugc

SEQ ID NO: 1252212 - RNA, 23 nt, Human
gcuuuuuuuuuuuuucuuaaaga

SEQ ID NO: 1252213 - RNA, 20 nt, Human
acuuugugaaaaaaaauuuu

SEQ ID NO: 1252214 - RNA, 21 nt, Human
auugcuuguuagcaaaaugga

SEQ ID NO: 1252215 - RNA, 15 nt, Human
acuggcucccuggaa

SEQ ID NO: 1252216 - RNA, 14 nt, Human
aagacuaugaggaa

SEQ ID NO: 1252217 - RNA, 21 nt, Human
ccuucacauccuguguuucua

SEQ ID NO: 1252218 - RNA, 15 nt, Human
aaugaauggcuaagc

SEQ ID NO: 1252219 - RNA, 13 nt, Human
cuccaccucccug

SEQ ID NO: 1252220 - RNA, 18 nt, Human
gaaaacauagcaucucag

SEQ ID NO: 1252221 - RNA, 14 nt, Human
aaccugagccccaa

SEQ ID NO: 1252222 - RNA, 14 nt, Human
aaaagaaacauuug

SEQ ID NO: 1252223 - RNA, 21 nt, Human
acaauuauaagcuguuuuuau

SEQ ID NO: 1252224 - RNA, 16 nt, Human
guaaucauauaauaaa

SEQ ID NO: 1252225 - RNA, 22 nt, Human
uaaauaaagcuugcaacaaaau

SEQ ID NO: 1252226 - RNA, 20 nt, Human
agcaguucagagcugcccuc

SEQ ID NO: 1252227 - RNA, 18 nt, Human
gaugaacucuuaaucaaa

SEQ ID NO: 1252228 - RNA, 16 nt, Human
ucuuggucucaguguc

SEQ ID NO: 1252229 - RNA, 19 nt, Human
auuuugguaaaauacuucu

SEQ ID NO: 1252230 - RNA, 22 nt, Human
aacucccugccccccagcccuc

SEQ ID NO: 1252231 - RNA, 17 nt, Human
cugagcgacagugagac

SEQ ID NO: 1252232 - RNA, 22 nt, Human
uuuauggcacuaguauuucuau

SEQ ID NO: 1252233 - RNA, 18 nt, Human
auccccaagccuggcaag

SEQ ID NO: 1252234 - RNA, 19 nt, Human
gcaccugcaggcgugaccu

SEQ ID NO: 1252235 - RNA, 14 nt, Human
guauucuucuuugg

SEQ ID NO: 1252236 - RNA, 20 nt, Human
uaauaaauguacauuaauua

SEQ ID NO: 1252237 - RNA, 23 nt, Human
augaaacuaagauuuguaauauu

SEQ ID NO: 1252238 - RNA, 13 nt, Human
aauuuuuauauuu

SEQ ID NO: 1252239 - RNA, 15 nt, Human
agccucagucucccu

SEQ ID NO: 1252240 - RNA, 18 nt, Human
auauguauuuauaaauau

SEQ ID NO: 1252241 - RNA, 11 nt, Human
aaccugagccc

SEQ ID NO: 1252242 - RNA, 15 nt, Human
gauuccugagccagu

SEQ ID NO: 1252243 - RNA, 23 nt, Human
aguguccucaucuguaaaaugga

SEQ ID NO: 1252244 - RNA, 21 nt, Human
aaugaauggcuaagcaaaaug

SEQ ID NO: 1252245 - RNA, 23 nt, Human
aaauugugaucagaccauaaugu

SEQ ID NO: 1252246 - RNA, 16 nt, Human
aucccucccuccaccu

SEQ ID NO: 1252247 - RNA, 15 nt, Human
aagaagcuaaauccu

SEQ ID NO: 1252248 - RNA, 21 nt, Human
caaucugaggccuccucucuc

SEQ ID NO: 1252249 - RNA, 21 nt, Human
aucaagccaucggagcugcua

SEQ ID NO: 1252250 - RNA, 15 nt, Human
ucucugccuugguau

SEQ ID NO: 1252251 - RNA, 14 nt, Human
gccaugcuggccag

SEQ ID NO: 1252252 - RNA, 20 nt, Human
uaaaauuaucaauaucuaau

SEQ ID NO: 1252253 - RNA, 20 nt, Human
aauucuaaaugaauguuuac

SEQ ID NO: 1252254 - RNA, 20 nt, Human
uuucuucaacucccugcccc

SEQ ID NO: 1252255 - RNA, 23 nt, Human
ccuucauccucugagugugacca

SEQ ID NO: 1252256 - RNA, 23 nt, Human
gauuuuguuuuuaaacuggaaau

SEQ ID NO: 1252257 - RNA, 15 nt, Human
gaggucaggaguucc

SEQ ID NO: 1252258 - RNA, 17 nt, Human
augauuucauuucaacu

SEQ ID NO: 1252259 - RNA, 22 nt, Human
ucaacuccaaacugacucuuaa

SEQ ID NO: 1252260 - RNA, 14 nt, Human
gaaugauuaugaau

SEQ ID NO: 1252261 - RNA, 21 nt, Human
aaauaaagcuugcaacaaaau

SEQ ID NO: 1252262 - RNA, 16 nt, Human
ugacaagcucacagac

SEQ ID NO: 1252263 - RNA, 21 nt, Human
ugaagguaaaauugaaaggca

SEQ ID NO: 1252264 - RNA, 15 nt, Human
gacucaccuccccca

SEQ ID NO: 1252265 - RNA, 23 nt, Human
aauauugcaaggcaaagacuauu

SEQ ID NO: 1252266 - RNA, 14 nt, Human
augaagaagcuaaa

SEQ ID NO: 1252267 - RNA, 16 nt, Human
uguggcauuuucacuu

SEQ ID NO: 1252268 - RNA, 20 nt, Human
auuuauauggggaauauauu

SEQ ID NO: 1252269 - RNA, 22 nt, Human
cugucuggacuuuccagagacc

SEQ ID NO: 1252270 - RNA, 23 nt, Human
cuucaacucccugccccccagcc

SEQ ID NO: 1252271 - RNA, 20 nt, Human
ucaauaaaauccauacauuu

SEQ ID NO: 1252272 - RNA, 21 nt, Human
ugcaggcagcuuuuucucucc

SEQ ID NO: 1252273 - RNA, 21 nt, Human
caccagggccuggcugggagu

SEQ ID NO: 1252274 - RNA, 22 nt, Human
ugccuccccuccucugcuugcc

SEQ ID NO: 1252275 - RNA, 13 nt, Human
ccuaaccagccug

SEQ ID NO: 1252276 - RNA, 13 nt, Human
cauuucuauuuau

SEQ ID NO: 1252277 - RNA, 12 nt, Human
uaucuuauucac

SEQ ID NO: 1252278 - RNA, 15 nt, Human
aguguaaguucacaa

SEQ ID NO: 1252279 - RNA, 14 nt, Human
aguuuuuuuuuaaa

SEQ ID NO: 1252280 - RNA, 22 nt, Human
uggugugcuggcuuaaaaugua

SEQ ID NO: 1252281 - RNA, 14 nt, Human
auuuaaaauauuuu

SEQ ID NO: 1252282 - RNA, 23 nt, Human
ggccuccauccugaggcuccacu

SEQ ID NO: 1252283 - RNA, 15 nt, Human
ccacuucacuuuuuu

SEQ ID NO: 1252284 - RNA, 16 nt, Human
auaaaaugagcaaaag

SEQ ID NO: 1252285 - RNA, 18 nt, Human
aaaacuuucuuuucugga

SEQ ID NO: 1252286 - RNA, 20 nt, Human
cuguauuuuuaccuuuuucc

SEQ ID NO: 1252287 - RNA, 14 nt, Human
gucccaggcugagc

SEQ ID NO: 1252288 - RNA, 16 nt, Human
gaucucagaaauugua

SEQ ID NO: 1252289 - RNA, 19 nt, Human
gauugauagaguguuauca

SEQ ID NO: 1252290 - RNA, 18 nt, Human
acaucuagcaaauguuau

SEQ ID NO: 1252291 - RNA, 14 nt, Human
agcuugaaauagug

SEQ ID NO: 1252292 - RNA, 13 nt, Human
uugccaucccucc

SEQ ID NO: 1252293 - RNA, 20 nt, Human
agcugcccucuccugggcag

SEQ ID NO: 1252294 - RNA, 12 nt, Human
acacuuaaaaau

SEQ ID NO: 1252295 - RNA, 21 nt, Human
cggccugauuaaaguuaaaua

SEQ ID NO: 1252296 - RNA, 17 nt, Human
agaaucacuugaacccg

SEQ ID NO: 1252297 - RNA, 15 nt, Human
uaugugaaauaaaag

SEQ ID NO: 1252298 - RNA, 15 nt, Human
ugccaucccucccuc

SEQ ID NO: 1252299 - RNA, 19 nt, Human
gguauuuauugagcaccug

SEQ ID NO: 1252300 - RNA, 19 nt, Human
aagacucuacccauauuac

SEQ ID NO: 1252301 - RNA, 12 nt, Human
cuaaaucuauuu

SEQ ID NO: 1252302 - RNA, 14 nt, Human
uuauuuuuuaagua

SEQ ID NO: 1252303 - RNA, 14 nt, Human
uugacccacaagaa

SEQ ID NO: 1252304 - RNA, 14 nt, Human
gaaagcuguggcca

SEQ ID NO: 1252305 - RNA, 12 nt, Human
guagacacacau

SEQ ID NO: 1252306 - RNA, 23 nt, Human
gaagccgagccucaagaugaagg

SEQ ID NO: 1252307 - RNA, 16 nt, Human
ccuccaccucccugca

SEQ ID NO: 1252308 - RNA, 24 nt, Human
ucccugcagacaugagagacagca

SEQ ID NO: 1252309 - RNA, 14 nt, Human
auaaaauaauuuuu

SEQ ID NO: 1252310 - RNA, 15 nt, Human
uuaaagacaaagaca

SEQ ID NO: 1252311 - RNA, 16 nt, Human
ucuauuaggaaauauu

SEQ ID NO: 1252312 - RNA, 13 nt, Human
cagcugccucccc

SEQ ID NO: 1252313 - RNA, 16 nt, Human
aauaugcacaauagca

SEQ ID NO: 1252314 - RNA, 15 nt, Human
agcucuaucaccaag

SEQ ID NO: 1252315 - RNA, 15 nt, Human
uaucuauuaauauau

SEQ ID NO: 1252316 - RNA, 17 nt, Human
aucaaggguacacugcc

SEQ ID NO: 1252317 - RNA, 16 nt, Human
uggagacaccaccacc

SEQ ID NO: 1252318 - RNA, 15 nt, Human
gcuuuucaaaauugg

SEQ ID NO: 1252319 - RNA, 22 nt, Human
ucuacuaaaaauacaaaaaaaa

SEQ ID NO: 1252320 - RNA, 15 nt, Human
uuauauuauuuugaa

SEQ ID NO: 1252321 - RNA, 20 nt, Human
guaucaaaagaaagaaaauc

SEQ ID NO: 1252322 - RNA, 14 nt, Human
cuuugugaaaaaaa

SEQ ID NO: 1252323 - RNA, 14 nt, Human
uaauuauuauucuu

SEQ ID NO: 1252324 - RNA, 22 nt, Human
auaaagcuugcaacaaaauucu

SEQ ID NO: 1252325 - RNA, 23 nt, Human
caggcaugagucagucugaugag

SEQ ID NO: 1252326 - RNA, 12 nt, Human
acaagacacagu

SEQ ID NO: 1252327 - RNA, 14 nt, Human
agaagaaugacuau

SEQ ID NO: 1252328 - RNA, 12 nt, Human
auacuauauuua

SEQ ID NO: 1252329 - RNA, 18 nt, Human
cacuuucccucuuggugc

SEQ ID NO: 1252330 - RNA, 15 nt, Human
ucagucauaacuaaa

SEQ ID NO: 1252331 - RNA, 17 nt, Human
aaauaaagaauuuuaaa

SEQ ID NO: 1252332 - RNA, 20 nt, Human
ccagcacuuugggaggcuga

SEQ ID NO: 1252333 - RNA, 12 nt, Human
ucugcacacagc

SEQ ID NO: 1252334 - RNA, 17 nt, Human
aaucuuucacaggggac

SEQ ID NO: 1252335 - RNA, 21 nt, Human
auggcagcuuuccucaaaacu

SEQ ID NO: 1252336 - RNA, 12 nt, Human
ugcccucuccug

SEQ ID NO: 1252337 - RNA, 11 nt, Human
ccugagcccca

SEQ ID NO: 1252338 - RNA, 18 nt, Human
cuggaaacuucagcgguu

SEQ ID NO: 1252339 - RNA, 16 nt, Human
acagagacagaaagca

SEQ ID NO: 1252340 - RNA, 13 nt, Human
auagaguguuauc

SEQ ID NO: 1252341 - RNA, 18 nt, Human
uugaaaaaguauaaauaa

SEQ ID NO: 1252342 - RNA, 16 nt, Human
uguucuaagaagugaa

SEQ ID NO: 1252343 - RNA, 14 nt, Human
auuaauucaccuuc

SEQ ID NO: 1252344 - RNA, 18 nt, Human
cccaggcugagccucagu

SEQ ID NO: 1252345 - RNA, 14 nt, Human
ccugggcagcugcc

SEQ ID NO: 1252346 - RNA, 15 nt, Human
cuaucuuugagcgcc

SEQ ID NO: 1252347 - RNA, 22 nt, Human
auaacaaugcuguauuuuaaaa

SEQ ID NO: 1252348 - RNA, 18 nt, Human
ccaauauuauaauuuuuu

SEQ ID NO: 1252349 - RNA, 16 nt, Human
auaauguuguuauuua

SEQ ID NO: 1252350 - RNA, 15 nt, Human
ggacaguuccugaga

SEQ ID NO: 1252351 - RNA, 13 nt, Human
ucucaaaaaauaa

SEQ ID NO: 1252352 - RNA, 18 nt, Human
auuuugaauccagaaaua

SEQ ID NO: 1252353 - RNA, 14 nt, Human
ggccuucggccucc

SEQ ID NO: 1252354 - RNA, 14 nt, Human
uagcauauguuuuu

SEQ ID NO: 1252355 - RNA, 12 nt, Human
agcuugcaacaa

SEQ ID NO: 1252356 - RNA, 18 nt, Human
ucaaggguacacugccuu

SEQ ID NO: 1252357 - RNA, 15 nt, Human
aguuuuugauagcuu

SEQ ID NO: 1252358 - RNA, 14 nt, Human
cagauccuggaaau

SEQ ID NO: 1252359 - RNA, 17 nt, Human
acaugaaagcguaaaga

SEQ ID NO: 1252360 - RNA, 22 nt, Human
gaagaguggguuucacaaguga

SEQ ID NO: 1252361 - RNA, 14 nt, Human
gacagcaggucuca

SEQ ID NO: 1252362 - RNA, 19 nt, Human
aucggagcugcuagaguuc

SEQ ID NO: 1252363 - RNA, 22 nt, Human
aaauauauuuaagauaauuaua

SEQ ID NO: 1252364 - RNA, 17 nt, Human
cauggagguuaagcacu

SEQ ID NO: 1252365 - RNA, 21 nt, Human
caaagcccagcuugaaaccuu

SEQ ID NO: 1252366 - RNA, 13 nt, Human
gaagaacugaaau

SEQ ID NO: 1252367 - RNA, 14 nt, Human
acuggacucaccuc

SEQ ID NO: 1252368 - RNA, 12 nt, Human
aguuuuccuucu

SEQ ID NO: 1252369 - RNA, 16 nt, Human
cccuccaccucccugc

SEQ ID NO: 1252370 - RNA, 12 nt, Human
acaacugugacu

SEQ ID NO: 1252371 - RNA, 19 nt, Human
ucauaacaauuuuaggagg

SEQ ID NO: 1252372 - RNA, 17 nt, Human
gccuaagugcagccccg

SEQ ID NO: 1252373 - RNA, 16 nt, Human
ugccuuuauaaucuuu

SEQ ID NO: 1252374 - RNA, 13 nt, Human
cuauuuauuaaua

SEQ ID NO: 1252375 - RNA, 15 nt, Human
aaucucaauauuuca

SEQ ID NO: 1252376 - RNA, 23 nt, Human
cucugcuugccaucccucccucc

SEQ ID NO: 1252377 - RNA, 13 nt, Human
uacuauauuuaug

SEQ ID NO: 1252378 - RNA, 13 nt, Human
uauuuauauauuu

SEQ ID NO: 1252379 - RNA, 13 nt, Human
gcuuuaaguguaa

SEQ ID NO: 1252380 - RNA, 23 nt, Human
ugaauuacauuuguauaaaauaa

SEQ ID NO: 1252381 - RNA, 19 nt, Human
aaauuagaggucuccaaaa

SEQ ID NO: 1252382 - RNA, 20 nt, Human
uuauuaccucugauaccuca

SEQ ID NO: 1252383 - RNA, 14 nt, Human
uaguuucccuugca

SEQ ID NO: 1252384 - RNA, 15 nt, Human
cccugccccccagcc

SEQ ID NO: 1252385 - RNA, 14 nt, Human
uuuauaauuccuau

SEQ ID NO: 1252386 - RNA, 14 nt, Human
ugacacuuaaaaau

SEQ ID NO: 1252387 - RNA, 21 nt, Human
ucuuucacauuggcuauuuaa

SEQ ID NO: 1252388 - RNA, 15 nt, Human
cugcccucuccuggg

SEQ ID NO: 1252389 - RNA, 14 nt, Human
cgcuaccuuuugcu

SEQ ID NO: 1252390 - RNA, 12 nt, Human
gcgugcaggcag

SEQ ID NO: 1252391 - RNA, 13 nt, Human
uagucuuauaaua

SEQ ID NO: 1252392 - RNA, 21 nt, Human
uguaauuaaucuuguaaauau

SEQ ID NO: 1252393 - RNA, 15 nt, Human
cauagccaggaaacu

SEQ ID NO: 1252394 - RNA, 14 nt, Human
uagcaaauguuaug

SEQ ID NO: 1252395 - RNA, 16 nt, Human
gcuugaacccaggaga

SEQ ID NO: 1252396 - RNA, 18 nt, Human
cgcgccaccacgcccagc

SEQ ID NO: 1252397 - RNA, 17 nt, Human
gaacucugagcagugcu

SEQ ID NO: 1252398 - RNA, 17 nt, Human
uuauaaucuuucacagg

SEQ ID NO: 1252399 - RNA, 17 nt, Human
aagcccaauauuauaau

SEQ ID NO: 1252400 - RNA, 14 nt, Human
uuuuaauuuugaau

SEQ ID NO: 1252401 - RNA, 17 nt, Human
agacgggguuugccaug

SEQ ID NO: 1252402 - RNA, 16 nt, Human
uaaaaucuaauucaaa

SEQ ID NO: 1252403 - RNA, 12 nt, Human
caccuguuuuua

SEQ ID NO: 1252404 - RNA, 13 nt, Human
ugccaaggcugga

SEQ ID NO: 1252405 - RNA, 14 nt, Human
aggcaagagaauug

SEQ ID NO: 1252406 - RNA, 16 nt, Human
gaauggcuaagcaaaa

SEQ ID NO: 1252407 - RNA, 14 nt, Human
uccacuuggucugu

SEQ ID NO: 1252408 - RNA, 22 nt, Human
uacuccuaguaauuuaagauuu

SEQ ID NO: 1252409 - RNA, 22 nt, Human
ggacagcccuucuuuccacaga

SEQ ID NO: 1252410 - RNA, 18 nt, Human
cgaugguacauauuucuu

SEQ ID NO: 1252411 - RNA, 12 nt, Human
ucauucaaaagu

SEQ ID NO: 1252412 - RNA, 22 nt, Human
uuuccaagcaaguauuagaaua

SEQ ID NO: 1252413 - RNA, 22 nt, Human
accuaacgaaguauccuucagc

SEQ ID NO: 1252414 - RNA, 21 nt, Human
caauucuauuacgugcaauac

SEQ ID NO: 1252415 - RNA, 18 nt, Human
gaacucugagcagugcuu

SEQ ID NO: 1252416 - RNA, 15 nt, Human
augauaacuggaaac

SEQ ID NO: 1252417 - RNA, 18 nt, Human
uauuuauuuuuuuacuuc

SEQ ID NO: 1252418 - RNA, 17 nt, Human
ugcaagacauagaauag

SEQ ID NO: 1252419 - RNA, 15 nt, Human
ccucuaaaaggccug

SEQ ID NO: 1252420 - RNA, 23 nt, Human
caucaacagauaaauaguuuaug

SEQ ID NO: 1252421 - RNA, 16 nt, Human
gcugccuccccuccuc

SEQ ID NO: 1252422 - RNA, 15 nt, Human
ucugcccugcuuuug

SEQ ID NO: 1252423 - RNA, 18 nt, Human
cugauauauguguuuuuc

SEQ ID NO: 1252424 - RNA, 21 nt, Human
cgaaguauccuucagccugaa

SEQ ID NO: 1252425 - RNA, 14 nt, Human
auuuauauauguau

SEQ ID NO: 1252426 - RNA, 15 nt, Human
gucaaugcagccccc

SEQ ID NO: 1252427 - RNA, 19 nt, Human
ugcaccaacuuugaagucu

SEQ ID NO: 1252428 - RNA, 12 nt, Human
uaacuuaugaac

SEQ ID NO: 1252429 - RNA, 21 nt, Human
auucauagcagcuuauucaca

SEQ ID NO: 1252430 - RNA, 16 nt, Human
aauuccacagcugcuc

SEQ ID NO: 1252431 - RNA, 21 nt, Human
auauacuccuaguaauuuaag

SEQ ID NO: 1252432 - RNA, 16 nt, Human
gacaaagacaaauucu

SEQ ID NO: 1252433 - RNA, 20 nt, Human
gacauaagcaaagacuauga

SEQ ID NO: 1252434 - RNA, 22 nt, Human
cuggggcucugggauagcugac

SEQ ID NO: 1252435 - RNA, 16 nt, Human
guucugcacacagcac

SEQ ID NO: 1252436 - RNA, 17 nt, Human
aaacauccuacaagaca

SEQ ID NO: 1252437 - RNA, 13 nt, Human
auuucaacuguuu

SEQ ID NO: 1252438 - RNA, 16 nt, Human
ccugcaaagcccagcu

SEQ ID NO: 1252439 - RNA, 15 nt, Human
ggcugggaguggcau

SEQ ID NO: 1252440 - RNA, 13 nt, Human
ccaccugccuaua

SEQ ID NO: 1252441 - RNA, 18 nt, Human
cuuguaauucuaaaugaa

SEQ ID NO: 1252442 - RNA, 21 nt, Human
cugagccucagucucccuccc

SEQ ID NO: 1252443 - RNA, 12 nt, Human
uccugcaggcag

SEQ ID NO: 1252444 - RNA, 22 nt, Human
aauaguucaaagccaaguuuau

SEQ ID NO: 1252445 - RNA, 19 nt, Human
cuauuuauuuauuuauuug

SEQ ID NO: 1252446 - RNA, 22 nt, Human
gccaauauccuaauaaaaaggu

SEQ ID NO: 1252447 - RNA, 20 nt, Human
auaacucaucauaaaauaaa

SEQ ID NO: 1252448 - RNA, 17 nt, Human
gcuccaaacuggagcuu

SEQ ID NO: 1252449 - RNA, 22 nt, Human
auuacaggcgugagccaccaaa

SEQ ID NO: 1252450 - RNA, 14 nt, Human
agggcuugaggacu

SEQ ID NO: 1252451 - RNA, 16 nt, Human
ugcaaauugucacagg

SEQ ID NO: 1252452 - RNA, 20 nt, Human
caauuauuuuuacaguucuc

SEQ ID NO: 1252453 - RNA, 21 nt, Human
caacacacagauuugagcuca

SEQ ID NO: 1252454 - RNA, 22 nt, Human
agacucugucucaaaaaauaaa

SEQ ID NO: 1252455 - RNA, 17 nt, Human
uuuuccacuacugcuac

SEQ ID NO: 1252456 - RNA, 12 nt, Human
gcaaagcccagc

SEQ ID NO: 1252457 - RNA, 15 nt, Human
cagaccauaauguua

SEQ ID NO: 1252458 - RNA, 19 nt, Human
gaauggaacucaaggaaau

SEQ ID NO: 1252459 - RNA, 23 nt, Human
cuagacccacuggacucaccucc

SEQ ID NO: 1252460 - RNA, 20 nt, Human
acuguuaucaaaacuuucuu

SEQ ID NO: 1252461 - RNA, 15 nt, Human
accugggcauucuug

SEQ ID NO: 1252462 - RNA, 14 nt, Human
uagcugacccagcc

SEQ ID NO: 1252463 - RNA, 17 nt, Human
aacaguuaccucugccu

SEQ ID NO: 1252464 - RNA, 19 nt, Human
ugcuuguuagcaaaaugga

SEQ ID NO: 1252465 - RNA, 19 nt, Human
auguacauuuccaaauuca

SEQ ID NO: 1252466 - RNA, 12 nt, Human
cuucaacucccu

SEQ ID NO: 1252467 - RNA, 16 nt, Human
uguauuauuuauaauu

SEQ ID NO: 1252468 - RNA, 14 nt, Human
ccugccccugagcc

SEQ ID NO: 1252469 - RNA, 15 nt, Human
uguuacauuauuauc

SEQ ID NO: 1252470 - RNA, 14 nt, Human
auuguccaggucua

SEQ ID NO: 1252471 - RNA, 21 nt, Human
aguuguugcccacagcuguau

SEQ ID NO: 1252472 - RNA, 16 nt, Human
cucuaggacauaaauu

SEQ ID NO: 1252473 - RNA, 12 nt, Human
auaaaauggguu

SEQ ID NO: 1252474 - RNA, 14 nt, Human
cugauuuuccugga

SEQ ID NO: 1252475 - RNA, 17 nt, Human
aauuucaugaaaagauu

SEQ ID NO: 1252476 - RNA, 16 nt, Human
caacaguuuuuuaugc

SEQ ID NO: 1252477 - RNA, 16 nt, Human
acugaauguaaacaaa

SEQ ID NO: 1252478 - RNA, 15 nt, Human
ucugcagauaaacag

SEQ ID NO: 1252479 - RNA, 21 nt, Human
aauuuuuuucaucuucucugg

SEQ ID NO: 1252480 - RNA, 22 nt, Human
aaugaaauggugaaaugcagag

SEQ ID NO: 1252481 - RNA, 11 nt, Human
aaauauauuua

SEQ ID NO: 1252482 - RNA, 22 nt, Human
auucuaaaugaauguuuacacu

SEQ ID NO: 1252483 - RNA, 14 nt, Human
agugugaccaggca

SEQ ID NO: 1252484 - RNA, 13 nt, Human
gcugcccucuccu

SEQ ID NO: 1252485 - RNA, 14 nt, Human
ucccuugaugaaga

SEQ ID NO: 1252486 - RNA, 20 nt, Human
aauuuuuucucuaggaaaua

SEQ ID NO: 1252487 - RNA, 16 nt, Human
ucaccugggcugaggc

SEQ ID NO: 1252488 - RNA, 22 nt, Human
cgucucccaaagugcugggaau

SEQ ID NO: 1252489 - RNA, 19 nt, Human
auauuugcaagacauagaa

SEQ ID NO: 1252490 - RNA, 20 nt, Human
gggaggcagagguugcagug

SEQ ID NO: 1252491 - RNA, 17 nt, Human
acauguucacuuauuga

SEQ ID NO: 1252492 - RNA, 21 nt, Human
uguaaaauggugugaccacug

SEQ ID NO: 1252493 - RNA, 19 nt, Human
ggcagugcuuggcccagga

SEQ ID NO: 1252494 - RNA, 17 nt, Human
gagauaucccaggaaaa

SEQ ID NO: 1252495 - RNA, 18 nt, Human
cugcaauaaaauggguuu

SEQ ID NO: 1252496 - RNA, 17 nt, Human
cccucugggucucagug

SEQ ID NO: 1252497 - RNA, 22 nt, Human
cuaauugaaucccuuaaacuca

SEQ ID NO: 1252498 - RNA, 15 nt, Human
aaaauacaaaaaaaa

SEQ ID NO: 1252499 - RNA, 14 nt, Human
acuaaaaauacaaa

SEQ ID NO: 1252500 - RNA, 17 nt, Human
aacguguauauuuuuua

SEQ ID NO: 1252501 - RNA, 15 nt, Human
ccuccccuccucugc

SEQ ID NO: 1252502 - RNA, 21 nt, Human
ccugcaauaaaauggguuuua

SEQ ID NO: 1252503 - RNA, 18 nt, Human
guugccaaggcuggagug

SEQ ID NO: 1252504 - RNA, 13 nt, Human
ucccucccuccac

SEQ ID NO: 1252505 - RNA, 19 nt, Human
cccauggcacucuauguuc

SEQ ID NO: 1252506 - RNA, 15 nt, Human
guugcagugagcuga

SEQ ID NO: 1252507 - RNA, 15 nt, Human
guuuccuagcgcagc

SEQ ID NO: 1252508 - RNA, 23 nt, Human
caauuauaagcuguuuuuauaua

SEQ ID NO: 1252509 - RNA, 14 nt, Human
aacagaagcuucca

SEQ ID NO: 1252510 - RNA, 14 nt, Human
ugcuagaacucccu

SEQ ID NO: 1252511 - RNA, 18 nt, Human
cauaagggaggaaaaaaa

SEQ ID NO: 1252512 - RNA, 17 nt, Human
agcugacccagccccuu

SEQ ID NO: 1252513 - RNA, 20 nt, Human
ggccuaugcagagguccaca

SEQ ID NO: 1252514 - RNA, 15 nt, Human
cucccuuggggccua

SEQ ID NO: 1252515 - RNA, 13 nt, Human
aguuaccucugcc

SEQ ID NO: 1252516 - RNA, 19 nt, Human
auuacaggcgugagccacc

SEQ ID NO: 1252517 - RNA, 14 nt, Human
uugccugcaggcau

SEQ ID NO: 1252518 - RNA, 15 nt, Human
ccccaaaaagaaugg

SEQ ID NO: 1252519 - RNA, 17 nt, Human
gacaguuccugagacca

SEQ ID NO: 1252520 - RNA, 15 nt, Human
gccccugcacuccag

SEQ ID NO: 1252521 - RNA, 13 nt, Human
cacuuuuuuucuu

SEQ ID NO: 1252522 - RNA, 15 nt, Human
ugcagauaaacagua

SEQ ID NO: 1252523 - RNA, 19 nt, Human
augcagagguccacaacac

SEQ ID NO: 1252524 - RNA, 18 nt, Human
gcaaagcccagcuugaaa

SEQ ID NO: 1252525 - RNA, 19 nt, Human
auuuuccuggacaguuuuc

SEQ ID NO: 1252526 - RNA, 19 nt, Human
uacuucuuaggguuaugau

SEQ ID NO: 1252527 - RNA, 12 nt, Human
uuuuuuuuaaaa

SEQ ID NO: 1252528 - RNA, 18 nt, Human
aaauugaaaggcauucuc

SEQ ID NO: 1252529 - RNA, 18 nt, Human
cgggaguggcgcgcgcca

SEQ ID NO: 1252530 - RNA, 14 nt, Human
ugcuguauuuuaaa

SEQ ID NO: 1252531 - RNA, 16 nt, Human
gaagauguagaggaga

SEQ ID NO: 1252532 - RNA, 17 nt, Human
cauguauuuauuuuuuu

SEQ ID NO: 1252533 - RNA, 15 nt, Human
ugccuccccuccucu

SEQ ID NO: 1252534 - RNA, 17 nt, Human
auuucaugaaaagauua

SEQ ID NO: 1252535 - RNA, 11 nt, Human
cagcaaauucg

SEQ ID NO: 1252536 - RNA, 18 nt, Human
aggaaggcuuacacccac

SEQ ID NO: 1252537 - RNA, 15 nt, Human
auuuguuuguauuuu

SEQ ID NO: 1252538 - RNA, 20 nt, Human
guuuaugcauacaguaauuu

SEQ ID NO: 1252539 - RNA, 13 nt, Human
ucucacuuaaucc

SEQ ID NO: 1252540 - RNA, 22 nt, Human
auuuauauggggaauauauuuu

SEQ ID NO: 1252541 - RNA, 22 nt, Human
gagcugcccucuccugggcagc

SEQ ID NO: 1252542 - RNA, 17 nt, Human
ccacugcagaagacagu

SEQ ID NO: 1252543 - RNA, 15 nt, Human
acaguucauauguac

SEQ ID NO: 1252544 - RNA, 21 nt, Human
aacuuuuguguaaugaaaaug

SEQ ID NO: 1252545 - RNA, 12 nt, Human
caaauuccagaa

SEQ ID NO: 1252546 - RNA, 21 nt, Human
acaugagguacugagagugaa

SEQ ID NO: 1252547 - RNA, 22 nt, Human
agcuuguauuccuuuuucucuc

SEQ ID NO: 1252548 - RNA, 13 nt, Human
agcuguggccagc

SEQ ID NO: 1252549 - RNA, 22 nt, Human
ucucuacuaaaaauacaaaaau

SEQ ID NO: 1252550 - RNA, 22 nt, Human
caagagaauugcuugaacccag

SEQ ID NO: 1252551 - RNA, 14 nt, Human
aagcacuuucccuc

SEQ ID NO: 1252552 - RNA, 17 nt, Human
agaaggauguacauuuc

SEQ ID NO: 1252553 - RNA, 21 nt, Human
uaccaaucauuuuaauuauua

SEQ ID NO: 1252554 - RNA, 14 nt, Human
aaguagaauaaaca

SEQ ID NO: 1252555 - RNA, 16 nt, Human
caaauggaaaguaacu

SEQ ID NO: 1252556 - RNA, 13 nt, Human
cccugcacuccag

SEQ ID NO: 1252557 - RNA, 22 nt, Human
caccucccccaucucuucuggg

SEQ ID NO: 1252558 - RNA, 21 nt, Human
ccugaucaccugcccugcuga

SEQ ID NO: 1252559 - RNA, 15 nt, Human
gcaaccuccaccuuc

SEQ ID NO: 1252560 - RNA, 16 nt, Human
cuuuaaguguaacugg

SEQ ID NO: 1252561 - RNA, 14 nt, Human
gugggacaguuccu

SEQ ID NO: 1252562 - RNA, 23 nt, Human
cucuacuaaaaauacaaaaaaaa

SEQ ID NO: 1252563 - RNA, 13 nt, Human
ccacaacacacag

SEQ ID NO: 1252564 - RNA, 18 nt, Human
uuauuacuguaagaaaau

SEQ ID NO: 1252565 - RNA, 16 nt, Human
uccaccucccugcaau

SEQ ID NO: 1252566 - RNA, 14 nt, Human
ugagaaaccuuauu

SEQ ID NO: 1252567 - RNA, 21 nt, Human
ucauucaaaaguugaaauuaa

SEQ ID NO: 1252568 - RNA, 23 nt, Human
cagagguugcagugagccgagau

SEQ ID NO: 1252569 - RNA, 20 nt, Human
ccaaauguucaucaaugaau

SEQ ID NO: 1252570 - RNA, 16 nt, Human
ucccugcaauaaaaug

SEQ ID NO: 1252571 - RNA, 19 nt, Human
ccgggcgugguggugagug

SEQ ID NO: 1252572 - RNA, 17 nt, Human
ucucuuaaacacuaaaa

SEQ ID NO: 1252573 - RNA, 17 nt, Human
aagaaaggccagcaaau

SEQ ID NO: 1252574 - RNA, 14 nt, Human
cuguaaucacagcu

SEQ ID NO: 1252575 - RNA, 13 nt, Human
ugagcgacaguga

SEQ ID NO: 1252576 - RNA, 20 nt, Human
aauauauguauuauuuauaa

SEQ ID NO: 1252577 - RNA, 17 nt, Human
aagcuugcaacaaaauu

SEQ ID NO: 1252578 - RNA, 19 nt, Human
auaauuuuuauauuugaaa

SEQ ID NO: 1252579 - RNA, 12 nt, Human
acagagacagaa

SEQ ID NO: 1252580 - RNA, 19 nt, Human
acuaucucauuuccaagca

SEQ ID NO: 1252581 - RNA, 18 nt, Human
aaggaugccccguccccc

SEQ ID NO: 1252582 - RNA, 24 nt, Human
guccucaucuguaaaauggagaca

SEQ ID NO: 1252583 - RNA, 15 nt, Human
ucaauuccucuggga

SEQ ID NO: 1252584 - RNA, 20 nt, Human
aauguuacauuauuaucaac

SEQ ID NO: 1252585 - RNA, 13 nt, Human
gaucauguauuua

SEQ ID NO: 1252586 - RNA, 21 nt, Human
cccacuggacucaccuccccc

SEQ ID NO: 1252587 - RNA, 15 nt, Human
gagauuucaugccug

SEQ ID NO: 1252588 - RNA, 22 nt, Human
uuuaauuauuauucuucauaac

SEQ ID NO: 1252589 - RNA, 17 nt, Human
cacuuuauauuauuuug

SEQ ID NO: 1252590 - RNA, 18 nt, Human
uuuuuagacucaucaauc

SEQ ID NO: 1252591 - RNA, 15 nt, Human
gcgugagccaccaaa

SEQ ID NO: 1252592 - RNA, 16 nt, Human
auuucaugauuucauu

SEQ ID NO: 1252593 - RNA, 21 nt, Human
uuuauauaagcuuguauuccu

SEQ ID NO: 1252594 - RNA, 18 nt, Human
ucaauacuucauuuaaaa

SEQ ID NO: 1252595 - RNA, 16 nt, Human
ugccuccccuccucug

SEQ ID NO: 1252596 - RNA, 19 nt, Human
ggaucucacaagcacuuuc

SEQ ID NO: 1252597 - RNA, 13 nt, Human
aagcauuccaacu

SEQ ID NO: 1252598 - RNA, 23 nt, Human
cacuggacucaccucccccaucu

SEQ ID NO: 1252599 - RNA, 14 nt, Human
uuuuaaaaaagaaa

SEQ ID NO: 1252600 - RNA, 19 nt, Human
cucauggaauuggagcucg

SEQ ID NO: 1252601 - RNA, 21 nt, Human
cuugccaucccucccuccacc

SEQ ID NO: 1252602 - RNA, 15 nt, Human
caccgaguggcccuu

SEQ ID NO: 1252603 - RNA, 14 nt, Human
uauaauaugcacac

SEQ ID NO: 1252604 - RNA, 16 nt, Human
caggcuugccugcagg

SEQ ID NO: 1252605 - RNA, 20 nt, Human
acuagaguuuagcuggaaaa

SEQ ID NO: 1252606 - RNA, 19 nt, Human
ccccugcaaagcccagcuu

SEQ ID NO: 1252607 - RNA, 17 nt, Human
uuuauuacaucuuucac

SEQ ID NO: 1252608 - RNA, 17 nt, Human
uucaaaaguugaaauua

SEQ ID NO: 1252609 - RNA, 14 nt, Human
auagugucugauga

SEQ ID NO: 1252610 - RNA, 16 nt, Human
acuuuccagagaccag

SEQ ID NO: 1252611 - RNA, 19 nt, Human
uaauacagggcauuuuggu

SEQ ID NO: 1252612 - RNA, 14 nt, Human
cagauccccaagcc

SEQ ID NO: 1252613 - RNA, 13 nt, Human
gccucaguuuccu

SEQ ID NO: 1252614 - RNA, 21 nt, Human
acguaggaacgguaaauuucu

SEQ ID NO: 1252615 - RNA, 16 nt, Human
cugagcgacagugaga

SEQ ID NO: 1252616 - RNA, 19 nt, Human
agcaucucaggagauuuca

SEQ ID NO: 1252617 - RNA, 17 nt, Human
cauuuguauaaaauaau

SEQ ID NO: 1252618 - RNA, 15 nt, Human
cuaguaauuggaaag

SEQ ID NO: 1252619 - RNA, 15 nt, Human
uucauuuaaaauauu

SEQ ID NO: 1252620 - RNA, 22 nt, Human
aggauggcuaguaucaaaagaa

SEQ ID NO: 1252621 - RNA, 19 nt, Human
cuucauuuaaaauauuuuu

SEQ ID NO: 1252622 - RNA, 22 nt, Human
aauuaucuaucuaucuauuuau

SEQ ID NO: 1252623 - RNA, 21 nt, Human
aagacaacauuaaaacaauau

SEQ ID NO: 1252624 - RNA, 15 nt, Human
ccuuccagugucucg

SEQ ID NO: 1252625 - RNA, 19 nt, Human
agaguuuagcuggaaaagu

SEQ ID NO: 1252626 - RNA, 13 nt, Human
ugccaauauccua

SEQ ID NO: 1252627 - RNA, 22 nt, Human
gugaacaaauuuacagagacag

SEQ ID NO: 1252628 - RNA, 15 nt, Human
cucuacuaaaaauac

SEQ ID NO: 1252629 - RNA, 18 nt, Human
gguuaagcacuuuaacac

SEQ ID NO: 1252630 - RNA, 16 nt, Human
uggaaaaugugcaaua

SEQ ID NO: 1252631 - RNA, 21 nt, Human
ugugauguggcaaaucucuau

SEQ ID NO: 1252632 - RNA, 16 nt, Human
acuccuaguaauuuaa

SEQ ID NO: 1252633 - RNA, 20 nt, Human
auucagccccgggaguggcg

SEQ ID NO: 1252634 - RNA, 12 nt, Human
acuauggaaaaa

SEQ ID NO: 1252635 - RNA, 19 nt, Human
acaaauuuacagagacaga

SEQ ID NO: 1252636 - RNA, 16 nt, Human
uauacuguauuuuuac

SEQ ID NO: 1252637 - RNA, 16 nt, Human
aaaguauaaauaaaau

SEQ ID NO: 1252638 - RNA, 16 nt, Human
acugacaacuugaaua

SEQ ID NO: 1252639 - RNA, 16 nt, Human
auauccaaagcugaau

SEQ ID NO: 1252640 - RNA, 18 nt, Human
ccuucggccuccauccug

SEQ ID NO: 1252641 - RNA, 20 nt, Human
uaaagaauuuucaaaaucaa

SEQ ID NO: 1252642 - RNA, 15 nt, Human
cagugucuggcacuu

SEQ ID NO: 1252643 - RNA, 18 nt, Human
ugaauccagaaauaauga

SEQ ID NO: 1252644 - RNA, 18 nt, Human
guugaagaugcuuguauu

SEQ ID NO: 1252645 - RNA, 23 nt, Human
gggucucccucuguugccaaggc

SEQ ID NO: 1252646 - RNA, 14 nt, Human
aguauuuauauauu

SEQ ID NO: 1252647 - RNA, 17 nt, Human
agauccccguguuacug

SEQ ID NO: 1252648 - RNA, 17 nt, Human
auuauaauauacuauau

SEQ ID NO: 1252649 - RNA, 20 nt, Human
uucgaugguacauauuucuu

SEQ ID NO: 1252650 - RNA, 15 nt, Human
cagaucauuucaaaa

SEQ ID NO: 1252651 - RNA, 23 nt, Human
aauagugucugaugaauguuaaa

SEQ ID NO: 1252652 - RNA, 20 nt, Human
caauucuauuacgugcaaua

SEQ ID NO: 1252653 - RNA, 16 nt, Human
ugaauuaguuuuauau

SEQ ID NO: 1252654 - RNA, 16 nt, Human
ucuauuuauuaauauu

SEQ ID NO: 1252655 - RNA, 17 nt, Human
cuaucagcauuuuacua

SEQ ID NO: 1252656 - RNA, 19 nt, Human
aaaacaaagaagacaacau

SEQ ID NO: 1252657 - RNA, 17 nt, Human
agacacacugaagaagc

SEQ ID NO: 1252658 - RNA, 21 nt, Human
uauaauaaauguacauuaauu

SEQ ID NO: 1252659 - RNA, 24 nt, Human
cucaucuguaaaauggagacacca

SEQ ID NO: 1252660 - RNA, 17 nt, Human
caagaaaugaaagcagg

SEQ ID NO: 1252661 - RNA, 20 nt, Human
cuccaccucccugcaauaaa

SEQ ID NO: 1252662 - RNA, 21 nt, Human
aguauacuguauuuuuaccuu

SEQ ID NO: 1252663 - RNA, 21 nt, Human
agcaguucagagcugcccucu

SEQ ID NO: 1252664 - RNA, 16 nt, Human
uuuauaacucaucaua

SEQ ID NO: 1252665 - RNA, 19 nt, Human
ccaaucauuuuaauuauua

SEQ ID NO: 1252666 - RNA, 22 nt, Human
caguauggcagcuuuccucaaa

SEQ ID NO: 1252667 - RNA, 16 nt, Human
cuggccugcuggaugu

SEQ ID NO: 1252668 - RNA, 15 nt, Human
uuuuuaaacaaaaaa

SEQ ID NO: 1252669 - RNA, 23 nt, Human
ucgcugauauauguguuuuucac

SEQ ID NO: 1252670 - RNA, 20 nt, Human
aaaucucuauuaggaaauau

SEQ ID NO: 1252671 - RNA, 17 nt, Human
ucucaaaaaauaaaaau

SEQ ID NO: 1252672 - RNA, 11 nt, Human
ucuuuucucug

SEQ ID NO: 1252673 - RNA, 21 nt, Human
cucuucuggguuccuuccucu

SEQ ID NO: 1252674 - RNA, 15 nt, Human
aggcgugagccacca

SEQ ID NO: 1252675 - RNA, 16 nt, Human
uaacauuauuuauaug

SEQ ID NO: 1252676 - RNA, 17 nt, Human
uuccaagccucaugucc

SEQ ID NO: 1252677 - RNA, 18 nt, Human
uucauagcagauuuuaau

SEQ ID NO: 1252678 - RNA, 14 nt, Human
aaagaauuuuaaaa

SEQ ID NO: 1252679 - RNA, 22 nt, Human
cuccagagggaauugcagagua

SEQ ID NO: 1252680 - RNA, 12 nt, Human
uacagagaaaag

SEQ ID NO: 1252681 - RNA, 14 nt, Human
ggcgcgugcaggca

SEQ ID NO: 1252682 - RNA, 17 nt, Human
uuauauuugaaauauug

SEQ ID NO: 1252683 - RNA, 19 nt, Human
aauuuucuuccaaacagaa

SEQ ID NO: 1252684 - RNA, 15 nt, Human
aucugagccagugcu

SEQ ID NO: 1252685 - RNA, 23 nt, Human
cagccaugugauuacccucuggg

SEQ ID NO: 1252686 - RNA, 17 nt, Human
uuauaucaauuuaaaaa

SEQ ID NO: 1252687 - RNA, 17 nt, Human
agaaaugaaagcaggga

SEQ ID NO: 1252688 - RNA, 21 nt, Human
agagauuuuuaaauaaagaau

SEQ ID NO: 1252689 - RNA, 15 nt, Human
uugaauccagaaaua

SEQ ID NO: 1252690 - RNA, 18 nt, Human
ccugccugcaauauuuga

SEQ ID NO: 1252691 - RNA, 18 nt, Human
uaguaucaaaagaaagaa

SEQ ID NO: 1252692 - RNA, 16 nt, Human
ccuacaugagguacug

SEQ ID NO: 1252693 - RNA, 19 nt, Human
ugagucccaggcugagccu

SEQ ID NO: 1252694 - RNA, 21 nt, Human
caacuuuuguguaaugaaaau

SEQ ID NO: 1252695 - RNA, 17 nt, Human
gccuccccuccucugcu

SEQ ID NO: 1252696 - RNA, 18 nt, Human
ggaaagacagcuucucau

SEQ ID NO: 1252697 - RNA, 18 nt, Human
gccugagcgacagugaga

SEQ ID NO: 1252698 - RNA, 18 nt, Human
aagucugauuuuccugga

SEQ ID NO: 1252699 - RNA, 16 nt, Human
gccaaggaugccccgu

SEQ ID NO: 1252700 - RNA, 20 nt, Human
ggagccugaucaccugcccu

SEQ ID NO: 1252701 - RNA, 20 nt, Human
uauauguguuuuucacauuu

SEQ ID NO: 1252702 - RNA, 17 nt, Human
uuugaguguuuuaagau

SEQ ID NO: 1252703 - RNA, 12 nt, Human
cuacaagacaca

SEQ ID NO: 1252704 - RNA, 19 nt, Human
ugugaaaaaaaauuuuaua

SEQ ID NO: 1252705 - RNA, 12 nt, Human
uaucuaauauau

SEQ ID NO: 1252706 - RNA, 14 nt, Human
cucccugcccccca

SEQ ID NO: 1252707 - RNA, 17 nt, Human
caaucuuaacucauugc

SEQ ID NO: 1252708 - RNA, 15 nt, Human
acccggccugauuaa

SEQ ID NO: 1252709 - RNA, 12 nt, Human
acaguuuuccuu

SEQ ID NO: 1252710 - RNA, 18 nt, Human
caacaguuuuuuaugcua

SEQ ID NO: 1252711 - RNA, 21 nt, Human
uuuccauugguuuaccuguga

SEQ ID NO: 1252712 - RNA, 12 nt, Human
ccugucccagcg

SEQ ID NO: 1252713 - RNA, 22 nt, Human
uucuuaaaugggcuacuuuguc

SEQ ID NO: 1252714 - RNA, 18 nt, Human
auuaaguuuuuuuuuaaa

SEQ ID NO: 1252715 - RNA, 20 nt, Human
uggacuuuccagagaccagu

SEQ ID NO: 1252716 - RNA, 22 nt, Human
ugucucuacuaaaaauacaaaa

SEQ ID NO: 1252717 - RNA, 18 nt, Human
ccuuccuaauuccacagc

SEQ ID NO: 1252718 - RNA, 23 nt, Human
ugacguaggaacgguaaauuucu

SEQ ID NO: 1252719 - RNA, 16 nt, Human
caaaaaccaaauuugu

SEQ ID NO: 1252720 - RNA, 15 nt, Human
aauaaugaaauaacu

SEQ ID NO: 1252721 - RNA, 15 nt, Human
cacccuugccaugga

SEQ ID NO: 1252722 - RNA, 22 nt, Human
gaauuuuucucuaacucagaaa

SEQ ID NO: 1252723 - RNA, 19 nt, Human
cugccccccagcccuccuu

SEQ ID NO: 1252724 - RNA, 23 nt, Human
cucagcccuggugggcagagagg

SEQ ID NO: 1252725 - RNA, 16 nt, Human
guuuuuuuuuaaaaaa

SEQ ID NO: 1252726 - RNA, 15 nt, Human
ugacuggccugcugg

SEQ ID NO: 1252727 - RNA, 13 nt, Human
uugggacaaaaac

SEQ ID NO: 1252728 - RNA, 16 nt, Human
uacauuuguauaaaau

SEQ ID NO: 1252729 - RNA, 16 nt, Human
accuguuuuuaagcug

SEQ ID NO: 1252730 - RNA, 21 nt, Human
cuaccuuuugcuguggcaaau

SEQ ID NO: 1252731 - RNA, 15 nt, Human
cuguacuuuuuccag

SEQ ID NO: 1252732 - RNA, 18 nt, Human
auggugaaaugcagaguc

SEQ ID NO: 1252733 - RNA, 18 nt, Human
cauuuccuauguaacugc

SEQ ID NO: 1252734 - RNA, 13 nt, Human
ucucccucccuug

SEQ ID NO: 1252735 - RNA, 16 nt, Human
aaguaauuucagaaga

SEQ ID NO: 1252736 - RNA, 19 nt, Human
caguuagagauuuuuaaau

SEQ ID NO: 1252737 - RNA, 15 nt, Human
agacaccaccacccu

SEQ ID NO: 1252738 - RNA, 20 nt, Human
auaaauggcuuccuggcaau

SEQ ID NO: 1252739 - RNA, 18 nt, Human
gauggguuugacaagguu

SEQ ID NO: 1252740 - RNA, 16 nt, Human
auauccugugacuguc

SEQ ID NO: 1252741 - RNA, 20 nt, Human
cucuguucugcacacagcac

SEQ ID NO: 1252742 - RNA, 21 nt, Human
caaauuaaggcauaagaaaac

SEQ ID NO: 1252743 - RNA, 20 nt, Human
uauuuuguguucaguacaau

SEQ ID NO: 1252744 - RNA, 13 nt, Human
aagaauuuuaaaa

SEQ ID NO: 1252745 - RNA, 11 nt, Human
uuuucaucuuc

SEQ ID NO: 1252746 - RNA, 12 nt, Human
ucuacacuccag

SEQ ID NO: 1252747 - RNA, 19 nt, Human
uaagauuuuguuuuuaaac

SEQ ID NO: 1252748 - RNA, 17 nt, Human
acugauacccuuugaaa

SEQ ID NO: 1252749 - RNA, 13 nt, Human
agggucucccucu

SEQ ID NO: 1252750 - RNA, 15 nt, Human
caauaaaauggguuu

SEQ ID NO: 1252751 - RNA, 19 nt, Human
gggaccugcuguuuccuag

SEQ ID NO: 1252752 - RNA, 13 nt, Human
ccuacaccauucc

SEQ ID NO: 1252753 - RNA, 14 nt, Human
gagcccauggcacu

SEQ ID NO: 1252754 - RNA, 19 nt, Human
agcuucucauccugcaggc

SEQ ID NO: 1252755 - RNA, 14 nt, Human
agcugaacuuguug

SEQ ID NO: 1252756 - RNA, 22 nt, Human
cccccugcaaagcccagcuuga

SEQ ID NO: 1252757 - RNA, 14 nt, Human
uggacaguuuucug

SEQ ID NO: 1252758 - RNA, 18 nt, Human
acagaaagcagaacagug

SEQ ID NO: 1252759 - RNA, 17 nt, Human
gacucaccucccccauc

SEQ ID NO: 1252760 - RNA, 22 nt, Human
cuccagccugagcgacagugag

SEQ ID NO: 1252761 - RNA, 17 nt, Human
ucacaagugaaaaacau

SEQ ID NO: 1252762 - RNA, 23 nt, Human
cuggccgggagccugaucaccug

SEQ ID NO: 1252763 - RNA, 21 nt, Human
gcccugcugagucccaggcug

SEQ ID NO: 1252764 - RNA, 19 nt, Human
uguauuuauaaauauauuu

SEQ ID NO: 1252765 - RNA, 21 nt, Human
uauuacuguaagaaaauauca

SEQ ID NO: 1252766 - RNA, 16 nt, Human
gaaagggucucccucu

SEQ ID NO: 1252767 - RNA, 15 nt, Human
ccacaagaaaugaaa

SEQ ID NO: 1252768 - RNA, 19 nt, Human
agauuugagcucagcccug

SEQ ID NO: 1252769 - RNA, 11 nt, Human
gcuguuuccau

SEQ ID NO: 1252770 - RNA, 13 nt, Human
auaauaaauguac

SEQ ID NO: 1252771 - RNA, 13 nt, Human
cacacugaagaag

SEQ ID NO: 1252772 - RNA, 15 nt, Human
agcaaaauggauaug

SEQ ID NO: 1252773 - RNA, 17 nt, Human
uuuacuacuuuaaaaaa

SEQ ID NO: 1252774 - RNA, 13 nt, Human
uguacuuuuucca

SEQ ID NO: 1252775 - RNA, 12 nt, Human
acccuauauuuu

SEQ ID NO: 1252776 - RNA, 16 nt, Human
aguccucuuucaaagg

SEQ ID NO: 1252777 - RNA, 17 nt, Human
aguuccugagaccagcc

SEQ ID NO: 1252778 - RNA, 23 nt, Human
aucacagcuacuugggaggcuga

SEQ ID NO: 1252779 - RNA, 18 nt, Human
guuuaugcauacaguaau

SEQ ID NO: 1252780 - RNA, 22 nt, Human
ugaaacagagaaaauaaaagca

SEQ ID NO: 1252781 - RNA, 21 nt, Human
accaacacuaacauauaaugu

SEQ ID NO: 1252782 - RNA, 16 nt, Human
ucauuuugguaaaaua

SEQ ID NO: 1252783 - RNA, 16 nt, Human
uauuuuacuuuuccau

SEQ ID NO: 1252784 - RNA, 23 nt, Human
ucccagccagcaguucagagcug

SEQ ID NO: 1252785 - RNA, 17 nt, Human
cauuugcacuauuggaa

SEQ ID NO: 1252786 - RNA, 18 nt, Human
agccugaucaccugcccu

SEQ ID NO: 1252787 - RNA, 16 nt, Human
aaauauuauguuaaaa

SEQ ID NO: 1252788 - RNA, 14 nt, Human
uccaaacagaacua

SEQ ID NO: 1252789 - RNA, 23 nt, Human
ucaauaucuuuuuuuuaauaaac

SEQ ID NO: 1252790 - RNA, 13 nt, Human
agcucugcccauc

SEQ ID NO: 1252791 - RNA, 15 nt, Human
uaauauauguauuau

SEQ ID NO: 1252792 - RNA, 15 nt, Human
ugagagacagcaggu

SEQ ID NO: 1252793 - RNA, 20 nt, Human
cagcaggucucaugggggug

SEQ ID NO: 1252794 - RNA, 14 nt, Human
cagucugaugagaa

SEQ ID NO: 1252795 - RNA, 13 nt, Human
ccucuggcuccag

SEQ ID NO: 1252796 - RNA, 22 nt, Human
gaccuguaaucauauaauaaau

SEQ ID NO: 1252797 - RNA, 13 nt, Human
uucaccuguuuuu

SEQ ID NO: 1252798 - RNA, 12 nt, Human
uuuauaaauaua

SEQ ID NO: 1252799 - RNA, 12 nt, Human
agggauggggcu

SEQ ID NO: 1252800 - RNA, 14 nt, Human
uugaauaaauaaau

SEQ ID NO: 1252801 - RNA, 21 nt, Human
auugugaucagaccauaaugu

SEQ ID NO: 1252802 - RNA, 21 nt, Human
uauaacucaucauaaaauaaa

SEQ ID NO: 1252803 - RNA, 18 nt, Human
auagucaaauugugugaa

SEQ ID NO: 1252804 - RNA, 21 nt, Human
ucaauagaaggauguacauuu

SEQ ID NO: 1252805 - RNA, 16 nt, Human
gaugaucauguauuua

SEQ ID NO: 1252806 - RNA, 14 nt, Human
uuucacaagugaaa

SEQ ID NO: 1252807 - RNA, 14 nt, Human
aagaagugaaaauc

SEQ ID NO: 1252808 - RNA, 21 nt, Human
agaaauuugccaauuuacuuu

SEQ ID NO: 1252809 - RNA, 18 nt, Human
acuucaauacuucauuua

SEQ ID NO: 1252810 - RNA, 13 nt, Human
uggcuccagcugg

SEQ ID NO: 1252811 - RNA, 15 nt, Human
aaacuaauagaauua

SEQ ID NO: 1252812 - RNA, 17 nt, Human
cccaggcugagccucag

SEQ ID NO: 1252813 - RNA, 14 nt, Human
ggacaguuuucugc

SEQ ID NO: 1252814 - RNA, 19 nt, Human
uagugagcagucaggaaag

SEQ ID NO: 1252815 - RNA, 15 nt, Human
ucuuguuuuuccacu

SEQ ID NO: 1252816 - RNA, 18 nt, Human
ggaggacgcucucuggcc

SEQ ID NO: 1252817 - RNA, 23 nt, Human
auaagcuguuuuuauauauguga

SEQ ID NO: 1252818 - RNA, 16 nt, Human
gaagagaaaccaggga

SEQ ID NO: 1252819 - RNA, 22 nt, Human
ccaucccucccuccaccucccu

SEQ ID NO: 1252820 - RNA, 19 nt, Human
augaaguacucauacaugu

SEQ ID NO: 1252821 - RNA, 20 nt, Human
aucaaauuccagaaugauuu

SEQ ID NO: 1252822 - RNA, 13 nt, Human
aaaaaugguuuaa

SEQ ID NO: 1252823 - RNA, 15 nt, Human
aacaucuagcaaaug

SEQ ID NO: 1252824 - RNA, 18 nt, Human
agcaaaauuuuuucucua

SEQ ID NO: 1252825 - RNA, 18 nt, Human
ccuguuuuuaagcuguuu

SEQ ID NO: 1252826 - RNA, 15 nt, Human
acauccuacaagaca

SEQ ID NO: 1252827 - RNA, 20 nt, Human
auuuauauauuuauaacuca

SEQ ID NO: 1252828 - RNA, 18 nt, Human
caaccuccaccuucuggg

SEQ ID NO: 1252829 - RNA, 20 nt, Human
uaugcuucuguuuuauaauu

SEQ ID NO: 1252830 - RNA, 21 nt, Human
ugagccagugucaggaggaag

SEQ ID NO: 1252831 - RNA, 17 nt, Human
cgugacuggccugcugg

SEQ ID NO: 1252832 - RNA, 22 nt, Human
aaacaaggaugaauuaaguuuu

SEQ ID NO: 1252833 - RNA, 17 nt, Human
caaacauauauaacaau

SEQ ID NO: 1252834 - RNA, 15 nt, Human
auuuuuuaauuauua

SEQ ID NO: 1252835 - RNA, 17 nt, Human
uauuucuuugccuuuau

SEQ ID NO: 1252836 - RNA, 23 nt, Human
uccaaacugacucuuaagaagac

SEQ ID NO: 1252837 - RNA, 16 nt, Human
ugcuggauucaaguga

SEQ ID NO: 1252838 - RNA, 20 nt, Human
uuaaugccacuaaauugaca

SEQ ID NO: 1252839 - RNA, 18 nt, Human
acagaccuaggauuucau

SEQ ID NO: 1252840 - RNA, 23 nt, Human
caguuagagauuuuuaaauaaag

SEQ ID NO: 1252841 - RNA, 18 nt, Human
caugcccaagaaugagaa

SEQ ID NO: 1252842 - RNA, 18 nt, Human
uguauuuuuaccuuuuuc

SEQ ID NO: 1252843 - RNA, 21 nt, Human
auaguuguaccgcaaugugac

SEQ ID NO: 1252844 - RNA, 20 nt, Human
gaauccagaaauaaugaaau

SEQ ID NO: 1252845 - RNA, 17 nt, Human
gcuuuauuuuuuaagua

SEQ ID NO: 1252846 - RNA, 19 nt, Human
aaucuuaacucauugcaac

SEQ ID NO: 1252847 - RNA, 13 nt, Human
ugcaguggcgcaa

SEQ ID NO: 1252848 - RNA, 12 nt, Human
uuucuauuuauu

SEQ ID NO: 1252849 - RNA, 17 nt, Human
cuuccuaauuccacagc

SEQ ID NO: 1252850 - RNA, 16 nt, Human
cgccuguaaucccagc

SEQ ID NO: 1252851 - RNA, 13 nt, Human
uaaguuucuggga

SEQ ID NO: 1252852 - RNA, 19 nt, Human
gaaauaaaaguagaauaaa

SEQ ID NO: 1252853 - RNA, 18 nt, Human
gaacgauuuagaaagaag

SEQ ID NO: 1252854 - RNA, 22 nt, Human
aagacucugucucaaaaaauaa

SEQ ID NO: 1252855 - RNA, 18 nt, Human
ucaaauuccagaaugauu

SEQ ID NO: 1252856 - RNA, 21 nt, Human
ggcaaaucucuauuaggaaau

SEQ ID NO: 1252857 - RNA, 20 nt, Human
cagaaacaucaguuacucug

SEQ ID NO: 1252858 - RNA, 14 nt, Human
uauuauuuauauau

SEQ ID NO: 1252859 - RNA, 14 nt, Human
uucagccugaaaga

SEQ ID NO: 1252860 - RNA, 14 nt, Human
aacuaagauuugua

SEQ ID NO: 1252861 - RNA, 21 nt, Human
cucaguccaugaagauguaga

SEQ ID NO: 1252862 - RNA, 21 nt, Human
aaucaccaaggcugauuaaac

SEQ ID NO: 1252863 - RNA, 16 nt, Human
cauuuguauaaaauaa

SEQ ID NO: 1252864 - RNA, 23 nt, Human
cauagagacuuugugaaaaaaaa

SEQ ID NO: 1252865 - RNA, 14 nt, Human
ugcuucuguuuuau

SEQ ID NO: 1252866 - RNA, 16 nt, Human
auccuccacaauagca

SEQ ID NO: 1252867 - RNA, 22 nt, Human
aaauccuuuacuguuagucauu

SEQ ID NO: 1252868 - RNA, 19 nt, Human
uauguaacugcauugagaa

SEQ ID NO: 1252869 - RNA, 23 nt, Human
uuuguauaaaauaauuuuuauau

SEQ ID NO: 1252870 - RNA, 19 nt, Human
uuuauaauuccuauauccu

SEQ ID NO: 1252871 - RNA, 19 nt, Human
caauuauaucaguccucuu

SEQ ID NO: 1252872 - RNA, 13 nt, Human
guccucuuucaaa

SEQ ID NO: 1252873 - RNA, 21 nt, Human
acuccuaguaauuuaagauuu

SEQ ID NO: 1252874 - RNA, 19 nt, Human
cauccauggugugcuggcu

SEQ ID NO: 1252875 - RNA, 17 nt, Human
ccucagucucccucccu

SEQ ID NO: 1252876 - RNA, 17 nt, Human
auuuacuuuguuauuuu

SEQ ID NO: 1252877 - RNA, 18 nt, Human
aaaaugugcaauauguga

SEQ ID NO: 1252878 - RNA, 17 nt, Human
augagccggagccccuu

SEQ ID NO: 1252879 - RNA, 23 nt, Human
gucuccaaaaucggaucuggggc

SEQ ID NO: 1252880 - RNA, 18 nt, Human
uguggucacaggaaguag

SEQ ID NO: 1252881 - RNA, 21 nt, Human
caccagucugacuguuuccau

SEQ ID NO: 1252882 - RNA, 14 nt, Human
ggaaguagaggagg

SEQ ID NO: 1252883 - RNA, 16 nt, Human
gaggacuugggcggga

SEQ ID NO: 1252884 - RNA, 23 nt, Human
cauuguggucacaggaaguagag

SEQ ID NO: 1252885 - RNA, 15 nt, Human
aauugacccacaaga

SEQ ID NO: 1252886 - RNA, 13 nt, Human
uuacaauugaaau

SEQ ID NO: 1252887 - RNA, 22 nt, Human
cuacuugggaggcugaggcaag

SEQ ID NO: 1252888 - RNA, 18 nt, Human
aaagaaaaucaggcuggc

SEQ ID NO: 1252889 - RNA, 20 nt, Human
gagccucagucucccucccu

SEQ ID NO: 1252890 - RNA, 18 nt, Human
agaaccuaaguuucaguu

SEQ ID NO: 1252891 - RNA, 17 nt, Human
gccaugggacagggagg

SEQ ID NO: 1252892 - RNA, 13 nt, Human
gguggggugaggg

SEQ ID NO: 1252893 - RNA, 22 nt, Human
aauaguguuggaaaaugugcaa

SEQ ID NO: 1252894 - RNA, 17 nt, Human
gacagucaccucaugga

SEQ ID NO: 1252895 - RNA, 20 nt, Human
auuuuuaccuuuuuccuucc

SEQ ID NO: 1252896 - RNA, 17 nt, Human
cuuguuagcaaaaugga

SEQ ID NO: 1252897 - RNA, 21 nt, Human
cacaacuauauuaucaugcaa

SEQ ID NO: 1252898 - RNA, 19 nt, Human
agaaauucugcaagcuuuu

SEQ ID NO: 1252899 - RNA, 22 nt, Human
agugacuuaguguacaugaaag

SEQ ID NO: 1252900 - RNA, 16 nt, Human
uuauaagcuguuuuua

SEQ ID NO: 1252901 - RNA, 16 nt, Human
ucugcagauaaacagu

SEQ ID NO: 1252902 - RNA, 13 nt, Human
ucuaucuauuuau

SEQ ID NO: 1252903 - RNA, 23 nt, Human
uaaauauaauaugcacacagugc

SEQ ID NO: 1252904 - RNA, 17 nt, Human
cuauccuacuuccccuu

SEQ ID NO: 1252905 - RNA, 19 nt, Human
gcuggagugcaguggcgca

SEQ ID NO: 1252906 - RNA, 23 nt, Human
uuuuccuuccuuaucacugacac

SEQ ID NO: 1252907 - RNA, 21 nt, Human
ccccugcaaagcccagcuuga

SEQ ID NO: 1252908 - RNA, 19 nt, Human
uaguuuaugauuccaccua

SEQ ID NO: 1252909 - RNA, 23 nt, Human
aauauuuuuaugugcaauaaaau

SEQ ID NO: 1252910 - RNA, 16 nt, Human
agauaaagauuucuug

SEQ ID NO: 1252911 - RNA, 16 nt, Human
uaagauaaauuauaag

SEQ ID NO: 1252912 - RNA, 13 nt, Human
ccucuccugggca

SEQ ID NO: 1252913 - RNA, 10 nt, Human
ccugagcccc

SEQ ID NO: 1252914 - RNA, 17 nt, Human
cccacuagacccacugg

SEQ ID NO: 1252915 - RNA, 14 nt, Human
uuaauuucaugaaa

SEQ ID NO: 1252916 - RNA, 19 nt, Human
ccaugcuggccaggcuggu

SEQ ID NO: 1252917 - RNA, 19 nt, Human
gugacuuaaugccacuaaa

SEQ ID NO: 1252918 - RNA, 22 nt, Human
caaauuuacagagacagaaagc

SEQ ID NO: 1252919 - RNA, 19 nt, Human
agaugcuagaacucccuuu

SEQ ID NO: 1252920 - RNA, 16 nt, Human
uaaugaaaaugaauau

SEQ ID NO: 1252921 - RNA, 13 nt, Human
aaaaauuuuauag

SEQ ID NO: 1252922 - RNA, 18 nt, Human
guaaauagaaacguguau

SEQ ID NO: 1252923 - RNA, 22 nt, Human
uccugaccuaugaaacagagaa

SEQ ID NO: 1252924 - RNA, 21 nt, Human
cuccagcuggccgggagccug

SEQ ID NO: 1252925 - RNA, 13 nt, Human
uauuucuaugaaa

SEQ ID NO: 1252926 - RNA, 21 nt, Human
caauuauaagcuguuuuuaua

SEQ ID NO: 1252927 - RNA, 14 nt, Human
agauguagaggaga

SEQ ID NO: 1252928 - RNA, 14 nt, Human
gaagaaauucugca

SEQ ID NO: 1252929 - RNA, 20 nt, Human
auuugccaauuuacuuuguu

SEQ ID NO: 1252930 - RNA, 13 nt, Human
acacacaugaagu

SEQ ID NO: 1252931 - RNA, 21 nt, Human
guacauuuccaaauucacaag

SEQ ID NO: 1252932 - RNA, 16 nt, Human
auuuuaauaauguuuc

SEQ ID NO: 1252933 - RNA, 22 nt, Human
uaaucagggaggucauuuuggu

SEQ ID NO: 1252934 - RNA, 17 nt, Human
auauauguauuauuuau

SEQ ID NO: 1252935 - RNA, 21 nt, Human
auugaaaggcauucucugaag

SEQ ID NO: 1252936 - RNA, 13 nt, Human
augcuagaacucc

SEQ ID NO: 1252937 - RNA, 21 nt, Human
caagacucugucucaaaaaau

SEQ ID NO: 1252938 - RNA, 13 nt, Human
ucauuuaaaauau

SEQ ID NO: 1252939 - RNA, 21 nt, Human
gcccaagggugggugggguga

SEQ ID NO: 1252940 - RNA, 19 nt, Human
acuuuuuuuuuuuuuuaaa

SEQ ID NO: 1252941 - RNA, 18 nt, Human
uguuucuugagaagagaa

SEQ ID NO: 1252942 - RNA, 15 nt, Human
uucugcacacagcac

SEQ ID NO: 1252943 - RNA, 23 nt, Human
gaaacguguauauuuuuuaugaa

SEQ ID NO: 1252944 - RNA, 14 nt, Human
uguacuuuuuccag

SEQ ID NO: 1252945 - RNA, 13 nt, Human
cuuaucaaaggac

SEQ ID NO: 1252946 - RNA, 17 nt, Human
auuuugaauaaauaaau

SEQ ID NO: 1252947 - RNA, 13 nt, Human
gagcaccugcagg

SEQ ID NO: 1252948 - RNA, 12 nt, Human
ggcugaugcagu

SEQ ID NO: 1252949 - RNA, 23 nt, Human
uacuugggagaccuguaaucaua

SEQ ID NO: 1252950 - RNA, 13 nt, Human
auacuauccaguu

SEQ ID NO: 1252951 - RNA, 11 nt, Human
gagaagagaau

SEQ ID NO: 1252952 - RNA, 20 nt, Human
acuuaccugggcauucuugu

SEQ ID NO: 1252953 - RNA, 17 nt, Human
cugggucucaguguccu

SEQ ID NO: 1252954 - RNA, 17 nt, Human
aaaaagcauuguaacuu

SEQ ID NO: 1252955 - RNA, 12 nt, Human
guguauauuuuu

SEQ ID NO: 1252956 - RNA, 15 nt, Human
gacuuacuauuuauu

SEQ ID NO: 1252957 - RNA, 20 nt, Human
cuuugacaaccaugagacca

SEQ ID NO: 1252958 - RNA, 17 nt, Human
auggcuaguaucaaaag

SEQ ID NO: 1252959 - RNA, 15 nt, Human
caauauuugaauuuu

SEQ ID NO: 1252960 - RNA, 16 nt, Human
uuuacaauugaaauga

SEQ ID NO: 1252961 - RNA, 20 nt, Human
ugagaccacuguuaucaaaa

SEQ ID NO: 1252962 - RNA, 18 nt, Human
auuuucuuccaaacagaa

SEQ ID NO: 1252963 - RNA, 16 nt, Human
uaaauguacauuaauu

SEQ ID NO: 1252964 - RNA, 16 nt, Human
acuaguuucccuugca

SEQ ID NO: 1252965 - RNA, 15 nt, Human
uccuguacuuuuucc

SEQ ID NO: 1252966 - RNA, 13 nt, Human
caaaaaaagcauu

SEQ ID NO: 1252967 - RNA, 17 nt, Human
uggugaaaugcagaguc

SEQ ID NO: 1252968 - RNA, 13 nt, Human
aaacauccuacaa

SEQ ID NO: 1252969 - RNA, 16 nt, Human
gcaggauagaguggga

SEQ ID NO: 1252970 - RNA, 15 nt, Human
ccuggugggcagaga

SEQ ID NO: 1252971 - RNA, 16 nt, Human
ugccucaccccuugcc

SEQ ID NO: 1252972 - RNA, 20 nt, Human
gccauggagguuaagcacuu

SEQ ID NO: 1252973 - RNA, 22 nt, Human
uagauacugaauguaaacaaag

SEQ ID NO: 1252974 - RNA, 16 nt, Human
uaauuuaagauuuugu

SEQ ID NO: 1252975 - RNA, 21 nt, Human
ugaacugauggguuucuccag

SEQ ID NO: 1252976 - RNA, 17 nt, Human
uuguuagcaaaauggau

SEQ ID NO: 1252977 - RNA, 17 nt, Human
agcucugcccauccugc

SEQ ID NO: 1252978 - RNA, 13 nt, Human
ccaggcugagccu

SEQ ID NO: 1252979 - RNA, 13 nt, Human
agagcaagacucu

SEQ ID NO: 1252980 - RNA, 18 nt, Human
ggucacacaaccuguccc

SEQ ID NO: 1252981 - RNA, 19 nt, Human
cauuucaaaagguauuuau

SEQ ID NO: 1252982 - RNA, 18 nt, Human
agcuuacuuaaaauugua

SEQ ID NO: 1252983 - RNA, 23 nt, Human
uggaaauguuuacagauccccaa

SEQ ID NO: 1252984 - RNA, 15 nt, Human
uauguauuauuuaua

SEQ ID NO: 1252985 - RNA, 17 nt, Human
ccugccccccagcccuc

SEQ ID NO: 1252986 - RNA, 13 nt, Human
agaagacaacauu

SEQ ID NO: 1252987 - RNA, 21 nt, Human
caacccccauuucuauuuauu

SEQ ID NO: 1252988 - RNA, 18 nt, Human
cagcuacuugggaggcug

SEQ ID NO: 1252989 - RNA, 18 nt, Human
gccuucggccuccauccu

SEQ ID NO: 1252990 - RNA, 14 nt, Human
agagacagaaagca

SEQ ID NO: 1252991 - RNA, 21 nt, Human
uccuacaagacacagugacca

SEQ ID NO: 1252992 - RNA, 17 nt, Human
agacuuugugaaaaaaa

SEQ ID NO: 1252993 - RNA, 14 nt, Human
augauguuuagaaa

SEQ ID NO: 1252994 - RNA, 15 nt, Human
agugacaagcucaca

SEQ ID NO: 1252995 - RNA, 13 nt, Human
acacuuaaaaaug

SEQ ID NO: 1252996 - RNA, 13 nt, Human
augauuccaccua

SEQ ID NO: 1252997 - RNA, 14 nt, Human
aaaauuggacuuaa

SEQ ID NO: 1252998 - RNA, 17 nt, Human
cccacuggacucaccuc

SEQ ID NO: 1252999 - RNA, 14 nt, Human
agaauauuagcuuu

SEQ ID NO: 1253000 - RNA, 14 nt, Human
cuuaaaauguaauu

SEQ ID NO: 1253001 - RNA, 20 nt, Human
auaguucaaagccaaguuua

SEQ ID NO: 1253002 - RNA, 22 nt, Human
cagcaggauagagugggacagu

SEQ ID NO: 1253003 - RNA, 13 nt, Human
uuaacauuauuua

SEQ ID NO: 1253004 - RNA, 18 nt, Human
ugccauaauuacuauguc

SEQ ID NO: 1253005 - RNA, 18 nt, Human
guaauauugcaaggcaaa

SEQ ID NO: 1253006 - RNA, 11 nt, Human
uccauuguaau

SEQ ID NO: 1253007 - RNA, 15 nt, Human
caccuucuggguuca

SEQ ID NO: 1253008 - RNA, 13 nt, Human
acaucuuucacau

SEQ ID NO: 1253009 - RNA, 16 nt, Human
cucauccugcaggcag

SEQ ID NO: 1253010 - RNA, 13 nt, Human
ucugauuuuccug

SEQ ID NO: 1253011 - RNA, 17 nt, Human
ucccugcaauaaaaugg

SEQ ID NO: 1253012 - RNA, 20 nt, Human
gcaaaucucuauuaggaaau

SEQ ID NO: 1253013 - RNA, 21 nt, Human
caucauaaaauaaaguauaua

SEQ ID NO: 1253014 - RNA, 15 nt, Human
ggcagcuuuuucucu

SEQ ID NO: 1253015 - RNA, 19 nt, Human
cagaaagcagaacagugau

SEQ ID NO: 1253016 - RNA, 18 nt, Human
auucaaacuaauagaauu

SEQ ID NO: 1253017 - RNA, 19 nt, Human
uuggcaagcucuaucacca

SEQ ID NO: 1253018 - RNA, 14 nt, Human
ucccucccuccacc

SEQ ID NO: 1253019 - RNA, 21 nt, Human
guggccagcuuguuauuuaua

SEQ ID NO: 1253020 - RNA, 17 nt, Human
cagacaucaacagauaa

SEQ ID NO: 1253021 - RNA, 22 nt, Human
auuaaggcuucucuuaaacacu

SEQ ID NO: 1253022 - RNA, 16 nt, Human
uacccucugggucuca

SEQ ID NO: 1253023 - RNA, 16 nt, Human
gagaccuguaaucaua

SEQ ID NO: 1253024 - RNA, 12 nt, Human
cuggcuccagcu

SEQ ID NO: 1253025 - RNA, 17 nt, Human
auuauuuauauauguau

SEQ ID NO: 1253026 - RNA, 12 nt, Human
aaugaaagaaag

SEQ ID NO: 1253027 - RNA, 21 nt, Human
agucucccucccuuggggccu

SEQ ID NO: 1253028 - RNA, 24 nt, Human
uggugugcuggcuuaaaauguaau

SEQ ID NO: 1253029 - RNA, 22 nt, Human
gaagggcaucaugcaucuuacu

SEQ ID NO: 1253030 - RNA, 12 nt, Human
uuauauacaauu

SEQ ID NO: 1253031 - RNA, 18 nt, Human
cuaauuuaucuugucucu

SEQ ID NO: 1253032 - RNA, 19 nt, Human
aucauuuuaauuauuauuc

SEQ ID NO: 1253033 - RNA, 17 nt, Human
uccagcuggccgggagc

SEQ ID NO: 1253034 - RNA, 13 nt, Human
auccugcaggcag

SEQ ID NO: 1253035 - RNA, 16 nt, Human
ucaucuuggucacaua

SEQ ID NO: 1253036 - RNA, 22 nt, Human
gagacgggguuugccaugcugg

SEQ ID NO: 1253037 - RNA, 13 nt, Human
aaauaaaguauau

SEQ ID NO: 1253038 - RNA, 15 nt, Human
auuuaacauuauuua

SEQ ID NO: 1253039 - RNA, 15 nt, Human
guacuggcugaugga

SEQ ID NO: 1253040 - RNA, 13 nt, Human
agcgacagugaga

SEQ ID NO: 1253041 - RNA, 13 nt, Human
gccaugcuggcca

SEQ ID NO: 1253042 - RNA, 13 nt, Human
cagcaguucagag

SEQ ID NO: 1253043 - RNA, 18 nt, Human
cagagacagaaagcagaa

SEQ ID NO: 1253044 - RNA, 13 nt, Human
uuuucaauauuua

SEQ ID NO: 1253045 - RNA, 13 nt, Human
ugggaggcugaga

SEQ ID NO: 1253046 - RNA, 21 nt, Human
auuuuaguaagagauuccuga

SEQ ID NO: 1253047 - RNA, 15 nt, Human
ugccccgucccccuc

SEQ ID NO: 1253048 - RNA, 16 nt, Human
cuuuaugcuaagugaa

SEQ ID NO: 1253049 - RNA, 23 nt, Human
guauuugaguguuuuaagauaaa

SEQ ID NO: 1253050 - RNA, 12 nt, Human
ggacgagaauga

SEQ ID NO: 1253051 - RNA, 22 nt, Human
aauguuauuuuuuaauuauuau

SEQ ID NO: 1253052 - RNA, 16 nt, Human
cuccauccugaggcuc

SEQ ID NO: 1253053 - RNA, 19 nt, Human
aguaauuucagaagaaauu

SEQ ID NO: 1253054 - RNA, 13 nt, Human
aauccagaaauaa

SEQ ID NO: 1253055 - RNA, 15 nt, Human
acacuaacauauaau

SEQ ID NO: 1253056 - RNA, 23 nt, Human
auuacaucuuucacauuggcuau

SEQ ID NO: 1253057 - RNA, 15 nt, Human
cgggagccugaucac

SEQ ID NO: 1253058 - RNA, 19 nt, Human
aacuagaauuuauucaauu

SEQ ID NO: 1253059 - RNA, 13 nt, Human
cauacaguaauuu

SEQ ID NO: 1253060 - RNA, 17 nt, Human
aauauuugaauuuuaaa

SEQ ID NO: 1253061 - RNA, 20 nt, Human
uaagugaaauaagccagaca

SEQ ID NO: 1253062 - RNA, 16 nt, Human
auuuguauaaaauaau

SEQ ID NO: 1253063 - RNA, 22 nt, Human
agcauauguuuuuguaaguuua

SEQ ID NO: 1253064 - RNA, 20 nt, Human
uuugcaagccagauuuuccu

SEQ ID NO: 1253065 - RNA, 15 nt, Human
auaaagaauuuuaaa

SEQ ID NO: 1253066 - RNA, 23 nt, Human
uuuucaaaaucaaauuccagaau

SEQ ID NO: 1253067 - RNA, 14 nt, Human
uauaaauuuuccca

SEQ ID NO: 1253068 - RNA, 23 nt, Human
ugcaauauuugaauuuuaaaucu

SEQ ID NO: 1253069 - RNA, 19 nt, Human
auauuuaacauuauuuaua

SEQ ID NO: 1253070 - RNA, 22 nt, Human
cuggcaaggguucaccugggcu

SEQ ID NO: 1253071 - RNA, 24 nt, Human
ccccugagcuugcagagaugaggc

SEQ ID NO: 1253072 - RNA, 16 nt, Human
ucuguuccuucacauc

SEQ ID NO: 1253073 - RNA, 16 nt, Human
acgggguuugccaugc

SEQ ID NO: 1253074 - RNA, 20 nt, Human
ccugggcagcugccuccccu

SEQ ID NO: 1253075 - RNA, 20 nt, Human
acaagacacagugaccauac

SEQ ID NO: 1253076 - RNA, 15 nt, Human
gaccagagcuacuga

SEQ ID NO: 1253077 - RNA, 18 nt, Human
cagucucccucccuuggg

SEQ ID NO: 1253078 - RNA, 19 nt, Human
cccacuggacucaccuccc

SEQ ID NO: 1253079 - RNA, 14 nt, Human
uuuguauaaaauaa

SEQ ID NO: 1253080 - RNA, 14 nt, Human
auuuguauaaaaua

SEQ ID NO: 1253081 - RNA, 18 nt, Human
auguguggcauuuucacu

SEQ ID NO: 1253082 - RNA, 19 nt, Human
auuguugacaacugugacu

SEQ ID NO: 1253083 - RNA, 16 nt, Human
agagggaauugcagag

SEQ ID NO: 1253084 - RNA, 16 nt, Human
cugcacuccagccuga

SEQ ID NO: 1253085 - RNA, 14 nt, Human
uggagacaccacca

SEQ ID NO: 1253086 - RNA, 19 nt, Human
aaauuggacuuaaaaucua

SEQ ID NO: 1253087 - RNA, 18 nt, Human
gaaaauaucacuugucaa

SEQ ID NO: 1253088 - RNA, 15 nt, Human
uagauguagauaaac

SEQ ID NO: 1253089 - RNA, 17 nt, Human
caacauggugaaacccc

SEQ ID NO: 1253090 - RNA, 17 nt, Human
ccaaaagguauuuuaau

SEQ ID NO: 1253091 - RNA, 15 nt, Human
uuacagagacagaaa

SEQ ID NO: 1253092 - RNA, 16 nt, Human
ugcgaaugguuccauu

SEQ ID NO: 1253093 - RNA, 13 nt, Human
ugauagcuuuauu

SEQ ID NO: 1253094 - RNA, 16 nt, Human
aucauauaauaaaugu

SEQ ID NO: 1253095 - RNA, 23 nt, Human
gccaaaaaccaaauuuguauuua

SEQ ID NO: 1253096 - RNA, 15 nt, Human
aaugauuaugaauua

SEQ ID NO: 1253097 - RNA, 16 nt, Human
uugggcugagcaguca

SEQ ID NO: 1253098 - RNA, 18 nt, Human
ccuugggaccccugagcu

SEQ ID NO: 1253099 - RNA, 15 nt, Human
auauauguauuuaua

SEQ ID NO: 1253100 - RNA, 19 nt, Human
cuggacucaccucccccau

SEQ ID NO: 1253101 - RNA, 18 nt, Human
auauauuuauaacucauc

SEQ ID NO: 1253102 - RNA, 21 nt, Human
uaguauuucuaugaaauauua

SEQ ID NO: 1253103 - RNA, 20 nt, Human
gaaacauuugguaaggggaa

SEQ ID NO: 1253104 - RNA, 21 nt, Human
uuuucaggcuagauguaugua

SEQ ID NO: 1253105 - RNA, 15 nt, Human
accccuucauccucu

SEQ ID NO: 1253106 - RNA, 15 nt, Human
gcuguauuuuaaaag

SEQ ID NO: 1253107 - RNA, 17 nt, Human
gaaaaucaggcuggcca

SEQ ID NO: 1253108 - RNA, 14 nt, Human
uauuuauuuuaaua

SEQ ID NO: 1253109 - RNA, 10 nt, Human
auagugucuu

SEQ ID NO: 1253110 - RNA, 22 nt, Human
uuggucuugauaagcuauguug

SEQ ID NO: 1253111 - RNA, 14 nt, Human
augaaauaacuagg

SEQ ID NO: 1253112 - RNA, 21 nt, Human
uaauuuugaauaaauaaaugu

SEQ ID NO: 1253113 - RNA, 21 nt, Human
auccccaagccuggcaaggga

SEQ ID NO: 1253114 - RNA, 14 nt, Human
aauauuauguuaaa

SEQ ID NO: 1253115 - RNA, 17 nt, Human
agggccuggcugggagu

SEQ ID NO: 1253116 - RNA, 15 nt, Human
auuuauaacucauca

SEQ ID NO: 1253117 - RNA, 18 nt, Human
uacauuuguauaaaauaa

SEQ ID NO: 1253118 - RNA, 21 nt, Human
augucauuugcuggagcucug

SEQ ID NO: 1253119 - RNA, 23 nt, Human
cagaaauuuaauucauguuucuu

SEQ ID NO: 1253120 - RNA, 15 nt, Human
uccauccugaggcuc

SEQ ID NO: 1253121 - RNA, 13 nt, Human
aaaaaaagccaaa

SEQ ID NO: 1253122 - RNA, 15 nt, Human
cuauauccugugacu

SEQ ID NO: 1253123 - RNA, 16 nt, Human
aagaaugacuaugcaa

SEQ ID NO: 1253124 - RNA, 18 nt, Human
ugggcacaggguuuaugu

SEQ ID NO: 1253125 - RNA, 22 nt, Human
uccuuuucgaugguacauauuu

SEQ ID NO: 1253126 - RNA, 18 nt, Human
uacaguaauuuuaaguaa

SEQ ID NO: 1253127 - RNA, 19 nt, Human
caaacagaacuauggaaaa

SEQ ID NO: 1253128 - RNA, 12 nt, Human
aauugcagagua

SEQ ID NO: 1253129 - RNA, 14 nt, Human
agaguacuggcuga

SEQ ID NO: 1253130 - RNA, 23 nt, Human
ugagcugauaucaugccccugua

SEQ ID NO: 1253131 - RNA, 19 nt, Human
uaaacuggaaauaaaagau

SEQ ID NO: 1253132 - RNA, 16 nt, Human
guaacauagguuuuua

SEQ ID NO: 1253133 - RNA, 16 nt, Human
aagacugcacaucaaa

SEQ ID NO: 1253134 - RNA, 22 nt, Human
agacucuacccauauuacagau

SEQ ID NO: 1253135 - RNA, 16 nt, Human
gacaagcucacagacc

SEQ ID NO: 1253136 - RNA, 19 nt, Human
ugaaacauuacaguuagag

SEQ ID NO: 1253137 - RNA, 13 nt, Human
aauaaauguacau

SEQ ID NO: 1253138 - RNA, 12 nt, Human
ucuuaagaagac

SEQ ID NO: 1253139 - RNA, 16 nt, Human
ccucuccugggcagcu

SEQ ID NO: 1253140 - RNA, 23 nt, Human
augguauuugaguguuuuaagau

SEQ ID NO: 1253141 - RNA, 17 nt, Human
ucaaaaguugaaauuaa

SEQ ID NO: 1253142 - RNA, 14 nt, Human
uuauauauguauuu

SEQ ID NO: 1253143 - RNA, 21 nt, Human
accuccaccuucuggguucaa

SEQ ID NO: 1253144 - RNA, 19 nt, Human
ugccucaguuuccugaccu

SEQ ID NO: 1253145 - RNA, 12 nt, Human
gaauuggagcuc

SEQ ID NO: 1253146 - RNA, 12 nt, Human
aucauuuucaaa

SEQ ID NO: 1253147 - RNA, 21 nt, Human
uccguggcacugcauacaauc

SEQ ID NO: 1253148 - RNA, 19 nt, Human
agucaaauugugugaaagg

SEQ ID NO: 1253149 - RNA, 15 nt, Human
gaaacauuacaguua

SEQ ID NO: 1253150 - RNA, 17 nt, Human
aaaaucuaauucaaacu

SEQ ID NO: 1253151 - RNA, 21 nt, Human
cuagauacugaauguaaacaa

SEQ ID NO: 1253152 - RNA, 12 nt, Human
uugccugcaggc

SEQ ID NO: 1253153 - RNA, 15 nt, Human
ccugcaaagcccagc

SEQ ID NO: 1253154 - RNA, 19 nt, Human
cuuugaaaaaguauaaaua

SEQ ID NO: 1253155 - RNA, 18 nt, Human
uuuugugaagcaaaauuu

SEQ ID NO: 1253156 - RNA, 13 nt, Human
uuuaagauaaauu

SEQ ID NO: 1253157 - RNA, 17 nt, Human
ccucaguuuuaucauuu

SEQ ID NO: 1253158 - RNA, 14 nt, Human
gcugauuaaaccaa

SEQ ID NO: 1253159 - RNA, 15 nt, Human
ucuaaaucuauuuau

SEQ ID NO: 1253160 - RNA, 20 nt, Human
cucccuccaccucccugcaa

SEQ ID NO: 1253161 - RNA, 21 nt, Human
auucccuccugcuacucuguu

SEQ ID NO: 1253162 - RNA, 13 nt, Human
cacaccaggcuug

SEQ ID NO: 1253163 - RNA, 17 nt, Human
acucaccucccccaucu

SEQ ID NO: 1253164 - RNA, 20 nt, Human
cuggacuuuccagagaccag

SEQ ID NO: 1253165 - RNA, 13 nt, Human
gcaaccuccaccu

SEQ ID NO: 1253166 - RNA, 12 nt, Human
uuaucauuuuca

SEQ ID NO: 1253167 - RNA, 14 nt, Human
uauguauauuuuau

SEQ ID NO: 1253168 - RNA, 18 nt, Human
uaaaauggagacaccacc

SEQ ID NO: 1253169 - RNA, 13 nt, Human
ucauccugcaggc

SEQ ID NO: 1253170 - RNA, 22 nt, Human
uauuucuaugaaauauuauguu

SEQ ID NO: 1253171 - RNA, 20 nt, Human
cuugccauaauuacuauguc

SEQ ID NO: 1253172 - RNA, 16 nt, Human
caguucagagcugccc

SEQ ID NO: 1253173 - RNA, 16 nt, Human
uuuaauuucaugaaaa

SEQ ID NO: 1253174 - RNA, 15 nt, Human
ccaucccucccucca

SEQ ID NO: 1253175 - RNA, 19 nt, Human
gccugaucaccugcccugc

SEQ ID NO: 1253176 - RNA, 16 nt, Human
auuccaccuacaugag

SEQ ID NO: 1253177 - RNA, 23 nt, Human
gauuacaaggcuuuaucucaggg

SEQ ID NO: 1253178 - RNA, 18 nt, Human
ugccuccccuccucugcu

SEQ ID NO: 1253179 - RNA, 17 nt, Human
augauuaaguaaugaua

SEQ ID NO: 1253180 - RNA, 20 nt, Human
aaacuuuaugcuaagugaaa

SEQ ID NO: 1253181 - RNA, 14 nt, Human
cugacccagccccu

SEQ ID NO: 1253182 - RNA, 23 nt, Human
ucaugcauuugcacuauuggaag

SEQ ID NO: 1253183 - RNA, 17 nt, Human
augccccgucccccucu

SEQ ID NO: 1253184 - RNA, 20 nt, Human
aaggagccaaacauccuaca

SEQ ID NO: 1253185 - RNA, 14 nt, Human
caguucugaagaag

SEQ ID NO: 1253186 - RNA, 17 nt, Human
uuagccgggcauggugg

SEQ ID NO: 1253187 - RNA, 17 nt, Human
gagacaccaccacccuu

SEQ ID NO: 1253188 - RNA, 23 nt, Human
gggcagcugccuccccuccucug

SEQ ID NO: 1253189 - RNA, 18 nt, Human
gauaauaugagaaucaga

SEQ ID NO: 1253190 - RNA, 16 nt, Human
cuccucugcuugccau

SEQ ID NO: 1253191 - RNA, 20 nt, Human
acggacgaaccuugaaaacu

SEQ ID NO: 1253192 - RNA, 14 nt, Human
aucagucauaacua

SEQ ID NO: 1253193 - RNA, 22 nt, Human
cugcuagaguucugucuggacu

SEQ ID NO: 1253194 - RNA, 20 nt, Human
ucccuuuugcugccucuaaa

SEQ ID NO: 1253195 - RNA, 19 nt, Human
uuagacccucaugcugcca

SEQ ID NO: 1253196 - RNA, 14 nt, Human
uaauuucaugaaaa

SEQ ID NO: 1253197 - RNA, 14 nt, Human
uucuaugaaauauu

SEQ ID NO: 1253198 - RNA, 21 nt, Human
aauaauguuucaaacauauau

SEQ ID NO: 1253199 - RNA, 22 nt, Human
auaucuuuuuuuuaauaaacca

SEQ ID NO: 1253200 - RNA, 16 nt, Human
uuuaacacagugucug

SEQ ID NO: 1253201 - RNA, 14 nt, Human
ucuuuuuuuuaaua

SEQ ID NO: 1253202 - RNA, 16 nt, Human
ccuauauccugugacu

SEQ ID NO: 1253203 - RNA, 14 nt, Human
aaauuuucccaaaa

SEQ ID NO: 1253204 - RNA, 12 nt, Human
ucuccugggcag

SEQ ID NO: 1253205 - RNA, 15 nt, Human
aagaaauaugcacaa

SEQ ID NO: 1253206 - RNA, 12 nt, Human
aaaagaaagaaa

SEQ ID NO: 1253207 - RNA, 19 nt, Human
cacacuaugguauuugagu

SEQ ID NO: 1253208 - RNA, 17 nt, Human
aaggccugucccugcag

SEQ ID NO: 1253209 - RNA, 12 nt, Human
caucuuucacau

SEQ ID NO: 1253210 - RNA, 14 nt, Human
agguucuucccuuu

SEQ ID NO: 1253211 - RNA, 14 nt, Human
auuuauugagcacc

SEQ ID NO: 1253212 - RNA, 20 nt, Human
aggagauggaaguugcagug

SEQ ID NO: 1253213 - RNA, 16 nt, Human
aagucugauuuuccug

SEQ ID NO: 1253214 - RNA, 13 nt, Human
gccuccccuccuc

SEQ ID NO: 1253215 - RNA, 20 nt, Human
ggagauggaaguugcaguga

SEQ ID NO: 1253216 - RNA, 14 nt, Human
agcgcagccaugug

SEQ ID NO: 1253217 - RNA, 21 nt, Human
aggcagcaggauagaguggga

SEQ ID NO: 1253218 - RNA, 22 nt, Human
cccagcccuccuuaucaaagga

SEQ ID NO: 1253219 - RNA, 15 nt, Human
auguauuuauaaaua

SEQ ID NO: 1253220 - RNA, 20 nt, Human
uuaauauuuaacauuauuua

SEQ ID NO: 1253221 - RNA, 15 nt, Human
cauguacauccaugg

SEQ ID NO: 1253222 - RNA, 22 nt, Human
ggcagcuuuccucaaaacuuca

SEQ ID NO: 1253223 - RNA, 20 nt, Human
cuaaaugucaaucagccuag

SEQ ID NO: 1253224 - RNA, 20 nt, Human
acgugacuggccugcuggau

SEQ ID NO: 1253225 - RNA, 15 nt, Human
gccccauucaacauc

SEQ ID NO: 1253226 - RNA, 17 nt, Human
cacuggcucccuggaag

SEQ ID NO: 1253227 - RNA, 18 nt, Human
caguuguugcccacagcu

SEQ ID NO: 1253228 - RNA, 21 nt, Human
ucccugcaauaaaauggguuu

SEQ ID NO: 1253229 - RNA, 19 nt, Human
auuucuucaacucccugcc

SEQ ID NO: 1253230 - RNA, 19 nt, Human
ugagcaccugcaggcguga

SEQ ID NO: 1253231 - RNA, 19 nt, Human
cuugccugcaggcaugagu

SEQ ID NO: 1253232 - RNA, 16 nt, Human
agcaagacucugucuc

SEQ ID NO: 1253233 - RNA, 14 nt, Human
aaguaauuucagaa

SEQ ID NO: 1253234 - RNA, 21 nt, Human
gaggcugaggcggguggauca

SEQ ID NO: 1253235 - RNA, 19 nt, Human
uauauguguuuuucacauu

SEQ ID NO: 1253236 - RNA, 17 nt, Human
gcuucucauccugcagg

SEQ ID NO: 1253237 - RNA, 19 nt, Human
ugacaagguucuucccuuu

SEQ ID NO: 1253238 - RNA, 23 nt, Human
cuccuguacuuuuuccagacacu

SEQ ID NO: 1253239 - RNA, 14 nt, Human
caacacuaacauau

SEQ ID NO: 1253240 - RNA, 20 nt, Human
auauguauuuauaaauauau

SEQ ID NO: 1253241 - RNA, 17 nt, Human
aauguaucuuauucaca

SEQ ID NO: 1253242 - RNA, 14 nt, Human
ucucaaaaaauaaa

SEQ ID NO: 1253243 - RNA, 19 nt, Human
auucaaaaguugaaauuaa

SEQ ID NO: 1253244 - RNA, 20 nt, Human
aguccuacaagcuaaaauua

SEQ ID NO: 1253245 - RNA, 17 nt, Human
cacuagacaaguccagc

SEQ ID NO: 1253246 - RNA, 17 nt, Human
cuuaaagaauuuucaaa

SEQ ID NO: 1253247 - RNA, 17 nt, Human
ucauacuucuuaggguu

SEQ ID NO: 1253248 - RNA, 23 nt, Human
auaauguuacauuauuaucaaca

SEQ ID NO: 1253249 - RNA, 15 nt, Human
auuuacugagcuucu

SEQ ID NO: 1253250 - RNA, 20 nt, Human
gcccauccugccccugagcc

SEQ ID NO: 1253251 - RNA, 15 nt, Human
uugccaugagcuaga

SEQ ID NO: 1253252 - RNA, 19 nt, Human
cuucuggguucaagcgauu

SEQ ID NO: 1253253 - RNA, 16 nt, Human
auaaagaauuuuaaaa

SEQ ID NO: 1253254 - RNA, 19 nt, Human
uccucugcuugccaucccu

SEQ ID NO: 1253255 - RNA, 11 nt, Human
uaugugcaaua

SEQ ID NO: 1253256 - RNA, 15 nt, Human
accuguaaucauaua

SEQ ID NO: 1253257 - RNA, 15 nt, Human
augaggaauauuugc

SEQ ID NO: 1253258 - RNA, 17 nt, Human
ccaccucccugcaauaa

SEQ ID NO: 1253259 - RNA, 16 nt, Human
cccucccuccaccucc

SEQ ID NO: 1253260 - RNA, 19 nt, Human
agucaaugaacuuuccaca

SEQ ID NO: 1253261 - RNA, 19 nt, Human
caucaaggguacacugccu

SEQ ID NO: 1253262 - RNA, 20 nt, Human
guucugcagauaaacaguag

SEQ ID NO: 1253263 - RNA, 14 nt, Human
aaaaauacaaaaau

SEQ ID NO: 1253264 - RNA, 12 nt, Human
aaaacaaagaag

SEQ ID NO: 1253265 - RNA, 13 nt, Human
uguaacuuaugaa

SEQ ID NO: 1253266 - RNA, 19 nt, Human
agcucugcccauccugccc

SEQ ID NO: 1253267 - RNA, 17 nt, Human
cuaucucauuuccaagc

SEQ ID NO: 1253268 - RNA, 17 nt, Human
uaaauccuuuacuguua

SEQ ID NO: 1253269 - RNA, 14 nt, Human
cucagucucccucc

SEQ ID NO: 1253270 - RNA, 13 nt, Human
gcaguucagagcu

SEQ ID NO: 1253271 - RNA, 11 nt, Human
uuuuuaaacaa

SEQ ID NO: 1253272 - RNA, 19 nt, Human
aacuauggaaaaaaaggaa

SEQ ID NO: 1253273 - RNA, 18 nt, Human
uacagagaaaagacauaa

SEQ ID NO: 1253274 - RNA, 14 nt, Human
cuccaccuucuggg

SEQ ID NO: 1253275 - RNA, 14 nt, Human
auugucuagugaaa

SEQ ID NO: 1253276 - RNA, 19 nt, Human
ugacacuagcuaauaucaa

SEQ ID NO: 1253277 - RNA, 21 nt, Human
auaguaccaaucauuuuaauu

SEQ ID NO: 1253278 - RNA, 16 nt, Human
agccucagucucccuc

SEQ ID NO: 1253279 - RNA, 18 nt, Human
ccauaauguuacauuauu

SEQ ID NO: 1253280 - RNA, 20 nt, Human
uuucuagggaaaugaaagaa

SEQ ID NO: 1253281 - RNA, 15 nt, Human
ucaaucaaauaagua

SEQ ID NO: 1253282 - RNA, 22 nt, Human
gacucaccucccccaucucuuc

SEQ ID NO: 1253283 - RNA, 15 nt, Human
aagccuggcaaggga

SEQ ID NO: 1253284 - RNA, 15 nt, Human
ccaaggagccaaaca

SEQ ID NO: 1253285 - RNA, 17 nt, Human
acugugacuguacccaa

SEQ ID NO: 1253286 - RNA, 14 nt, Human
uaugaauuacauuu

SEQ ID NO: 1253287 - RNA, 17 nt, Human
uguuucgcugauauaug

SEQ ID NO: 1253288 - RNA, 23 nt, Human
gucucccucccuuggggccuaug

SEQ ID NO: 1253289 - RNA, 21 nt, Human
cugcccugcugagucccaggc

SEQ ID NO: 1253290 - RNA, 14 nt, Human
ggcgcgcgccacca

SEQ ID NO: 1253291 - RNA, 16 nt, Human
aacugcuggauucaag

SEQ ID NO: 1253292 - RNA, 14 nt, Human
cauagguuuuuagu

SEQ ID NO: 1253293 - RNA, 18 nt, Human
ggauagcugacccagccc

SEQ ID NO: 1253294 - RNA, 20 nt, Human
ugcaauaaaauguauuuguu

SEQ ID NO: 1253295 - RNA, 18 nt, Human
ucacagaggaucugcuug

SEQ ID NO: 1253296 - RNA, 13 nt, Human
gcugccuccccuc

SEQ ID NO: 1253297 - RNA, 19 nt, Human
cuucuggguuccuuccucu

SEQ ID NO: 1253298 - RNA, 13 nt, Human
gagaauauuagcu

SEQ ID NO: 1253299 - RNA, 20 nt, Human
cugcacuccagccugagcga

SEQ ID NO: 1253300 - RNA, 15 nt, Human
uuuuacaauugaaau

SEQ ID NO: 1253301 - RNA, 15 nt, Human
aguacagacuuuuuu

SEQ ID NO: 1253302 - RNA, 19 nt, Human
ggaauuucuucaacucccu

SEQ ID NO: 1253303 - RNA, 23 nt, Human
accuguaaucauauaauaaaugu

SEQ ID NO: 1253304 - RNA, 20 nt, Human
aacucauuuguuaaaauuau

SEQ ID NO: 1253305 - RNA, 15 nt, Human
acuggccugcuggau

SEQ ID NO: 1253306 - RNA, 16 nt, Human
cucgaacugcuggauu

SEQ ID NO: 1253307 - RNA, 14 nt, Human
agaugcuagaacuc

SEQ ID NO: 1253308 - RNA, 20 nt, Human
aguucagagcugcccucucc

SEQ ID NO: 1253309 - RNA, 19 nt, Human
gagacuuugugaaaaaaaa

SEQ ID NO: 1253310 - RNA, 20 nt, Human
cuaagaaauaugcacaauag

SEQ ID NO: 1253311 - RNA, 22 nt, Human
cacagauuugagcucagcccug

SEQ ID NO: 1253312 - RNA, 12 nt, Human
guccucuuucaa

SEQ ID NO: 1253313 - RNA, 18 nt, Human
aaagcacuuauuuauugu

SEQ ID NO: 1253314 - RNA, 22 nt, Human
aggguccuuugggaaaggagaa

SEQ ID NO: 1253315 - RNA, 19 nt, Human
acaguuagagauuuuuaaa

SEQ ID NO: 1253316 - RNA, 22 nt, Human
aauaugccccauucaacaucua

SEQ ID NO: 1253317 - RNA, 16 nt, Human
acccagccccuugaga

SEQ ID NO: 1253318 - RNA, 13 nt, Human
aacuggaaauaaa

SEQ ID NO: 1253319 - RNA, 16 nt, Human
uccugcaauuccacuu

SEQ ID NO: 1253320 - RNA, 19 nt, Human
ugccaucccucccuccacc

SEQ ID NO: 1253321 - RNA, 21 nt, Human
cuauuauagaauggaacucaa

SEQ ID NO: 1253322 - RNA, 13 nt, Human
aaauccuugaaga

SEQ ID NO: 1253323 - RNA, 19 nt, Human
cacuuuaacacagugucug

SEQ ID NO: 1253324 - RNA, 21 nt, Human
ucucacaagcacuuucccucu

SEQ ID NO: 1253325 - RNA, 12 nt, Human
gguauuuuaauc

SEQ ID NO: 1253326 - RNA, 23 nt, Human
acucuauguucuaagaagugaaa

SEQ ID NO: 1253327 - RNA, 17 nt, Human
acaccagagauaauaug

SEQ ID NO: 1253328 - RNA, 16 nt, Human
aaauaguuuaugauuc

SEQ ID NO: 1253329 - RNA, 16 nt, Human
gacauagaauuaacac

SEQ ID NO: 1253330 - RNA, 22 nt, Human
aaaucaggguuaguauugucca

SEQ ID NO: 1253331 - RNA, 14 nt, Human
gccuccccuccucu

SEQ ID NO: 1253332 - RNA, 18 nt, Human
uauuuugcauaguaccaa

SEQ ID NO: 1253333 - RNA, 23 nt, Human
auugcagaguacuggcugaugga

SEQ ID NO: 1253334 - RNA, 16 nt, Human
ccuguacuccagccug

SEQ ID NO: 1253335 - RNA, 15 nt, Human
aaguauauauagaau

SEQ ID NO: 1253336 - RNA, 14 nt, Human
agaccagccaaccu

SEQ ID NO: 1253337 - RNA, 16 nt, Human
uaaaauccauacauuu

SEQ ID NO: 1253338 - RNA, 15 nt, Human
gccuugggaccccug

SEQ ID NO: 1253339 - RNA, 23 nt, Human
caagagaauugcuugaacccagg

SEQ ID NO: 1253340 - RNA, 20 nt, Human
agaaugggaugaucauguau

SEQ ID NO: 1253341 - RNA, 15 nt, Human
uguuuuaaaauuaaa

SEQ ID NO: 1253342 - RNA, 15 nt, Human
cucccuccaccuccc

SEQ ID NO: 1253343 - RNA, 20 nt, Human
auuuuuaaauaaagaauuuu

SEQ ID NO: 1253344 - RNA, 21 nt, Human
aggguuaugauuaaguaauga

SEQ ID NO: 1253345 - RNA, 20 nt, Human
ucuucuggguuccuuccucu

SEQ ID NO: 1253346 - RNA, 15 nt, Human
cuauauuaucaugca

SEQ ID NO: 1253347 - RNA, 12 nt, Human
ucaacaugguga

SEQ ID NO: 1253348 - RNA, 19 nt, Human
guacaagagcuuaacagug

SEQ ID NO: 1253349 - RNA, 16 nt, Human
caccacccuugccaug

SEQ ID NO: 1253350 - RNA, 21 nt, Human
guuugccaugcuggccaggcu

SEQ ID NO: 1253351 - RNA, 22 nt, Human
ugauaguuguaccgcaauguga

SEQ ID NO: 1253352 - RNA, 22 nt, Human
gggcagugcuuggcccaggagu

SEQ ID NO: 1253353 - RNA, 21 nt, Human
aauggaauauguaaauagaaa

SEQ ID NO: 1253354 - RNA, 13 nt, Human
gagacagcucugc

SEQ ID NO: 1253355 - RNA, 21 nt, Human
gacagcuucucauccugcagg

SEQ ID NO: 1253356 - RNA, 18 nt, Human
aggaagaaauuccaggaa

SEQ ID NO: 1253357 - RNA, 22 nt, Human
aauaaauguaucuuauucacau

SEQ ID NO: 1253358 - RNA, 23 nt, Human
aguacucauacauguuacaacac

SEQ ID NO: 1253359 - RNA, 14 nt, Human
uauuuuuuaugaaa

SEQ ID NO: 1253360 - RNA, 17 nt, Human
ugaaaugacuaaaaaac

SEQ ID NO: 1253361 - RNA, 13 nt, Human
ccuccaccucccu

SEQ ID NO: 1253362 - RNA, 16 nt, Human
cuaaaucuauuuauua

SEQ ID NO: 1253363 - RNA, 19 nt, Human
ucaguccaugaagauguag

SEQ ID NO: 1253364 - RNA, 21 nt, Human
accaccugccuauauuuuuug

SEQ ID NO: 1253365 - RNA, 22 nt, Human
agaggauguguggcauuuucac

SEQ ID NO: 1253366 - RNA, 17 nt, Human
auguuuacagaucccca

SEQ ID NO: 1253367 - RNA, 11 nt, Human
auuauuauuua

SEQ ID NO: 1253368 - RNA, 22 nt, Human
aucccagcuacuugggaggcug

SEQ ID NO: 1253369 - RNA, 23 nt, Human
agaaugauuaugaauuacauuug

SEQ ID NO: 1253370 - RNA, 16 nt, Human
ucaaaagguauuuauu

SEQ ID NO: 1253371 - RNA, 16 nt, Human
ccuccuuaucaaagga

SEQ ID NO: 1253372 - RNA, 14 nt, Human
uauuuuuaccuuuu

SEQ ID NO: 1253373 - RNA, 13 nt, Human
uaaauuugguucu

SEQ ID NO: 1253374 - RNA, 19 nt, Human
guauuuaagguauauaaau

SEQ ID NO: 1253375 - RNA, 19 nt, Human
auugaaaggcauucucuga

SEQ ID NO: 1253376 - RNA, 14 nt, Human
uuaugaaacauuac

SEQ ID NO: 1253377 - RNA, 14 nt, Human
uauaauuccuauau

SEQ ID NO: 1253378 - RNA, 18 nt, Human
auauuauaauuuuuuuca

SEQ ID NO: 1253379 - RNA, 17 nt, Human
auuuauaacaaccuaaa

SEQ ID NO: 1253380 - RNA, 21 nt, Human
ccuggaucucacaagcacuuu

SEQ ID NO: 1253381 - RNA, 13 nt, Human
uuuauagugucuu

SEQ ID NO: 1253382 - RNA, 12 nt, Human
uaaguauuuaua

SEQ ID NO: 1253383 - RNA, 17 nt, Human
uaaaucuauuuauuaau

SEQ ID NO: 1253384 - RNA, 20 nt, Human
ugccaugcuggccaggcugg

SEQ ID NO: 1253385 - RNA, 22 nt, Human
cucugagccuugggaccccuga

SEQ ID NO: 1253386 - RNA, 18 nt, Human
uuuggcuuguaaaguaca

SEQ ID NO: 1253387 - RNA, 18 nt, Human
auuuuaauuuugaauaaa

SEQ ID NO: 1253388 - RNA, 18 nt, Human
ccugccuaagugcagccc

SEQ ID NO: 1253389 - RNA, 15 nt, Human
cacaggcuccaaacu

SEQ ID NO: 1253390 - RNA, 15 nt, Human
uuuaauuucaugaaa

SEQ ID NO: 1253391 - RNA, 16 nt, Human
gugacuggccugcugg

SEQ ID NO: 1253392 - RNA, 12 nt, Human
cccccagcccuc

SEQ ID NO: 1253393 - RNA, 13 nt, Human
ccugagcuugcag

SEQ ID NO: 1253394 - RNA, 15 nt, Human
ugaaacccugucucu

SEQ ID NO: 1253395 - RNA, 19 nt, Human
gcucauggaauuggagcuc

SEQ ID NO: 1253396 - RNA, 15 nt, Human
gggcucuggaaacca

SEQ ID NO: 1253397 - RNA, 18 nt, Human
uaauaauguuucaaacau

SEQ ID NO: 1253398 - RNA, 14 nt, Human
auauuuaagauaau

SEQ ID NO: 1253399 - RNA, 23 nt, Human
agauuaugaucucagaaauugua

SEQ ID NO: 1253400 - RNA, 13 nt, Human
aauaaaaauaaau

SEQ ID NO: 1253401 - RNA, 20 nt, Human
caggcuccaaacuggagcuu

SEQ ID NO: 1253402 - RNA, 17 nt, Human
cuucuagguucuaaaaa

SEQ ID NO: 1253403 - RNA, 21 nt, Human
uuaaaauauuuuuaugugcaa

SEQ ID NO: 1253404 - RNA, 19 nt, Human
cugucccagcgagggacac

SEQ ID NO: 1253405 - RNA, 17 nt, Human
ugaagguaaaauugaaa

SEQ ID NO: 1253406 - RNA, 12 nt, Human
gggcgcgguggc

SEQ ID NO: 1253407 - RNA, 15 nt, Human
aggagauggaaguug

SEQ ID NO: 1253408 - RNA, 13 nt, Human
ugaaagcguaaag

SEQ ID NO: 1253409 - RNA, 14 nt, Human
ucuggcacuuggga

SEQ ID NO: 1253410 - RNA, 20 nt, Human
gccucuaaaaggccuguccc

SEQ ID NO: 1253411 - RNA, 13 nt, Human
agcaguucagagc

SEQ ID NO: 1253412 - RNA, 17 nt, Human
cuuccucugagccuugg

SEQ ID NO: 1253413 - RNA, 14 nt, Human
caaucaaauaagua

SEQ ID NO: 1253414 - RNA, 17 nt, Human
uuauuacuguaagaaaa

SEQ ID NO: 1253415 - RNA, 17 nt, Human
uccuacaagacacagug

SEQ ID NO: 1253416 - RNA, 14 nt, Human
ucuuguuuuuccac

SEQ ID NO: 1253417 - RNA, 16 nt, Human
cugagcuugcagagau

SEQ ID NO: 1253418 - RNA, 21 nt, Human
gcugcccucuccugggcagcu

SEQ ID NO: 1253419 - RNA, 20 nt, Human
gccaaggcuggagugcagug

SEQ ID NO: 1253420 - RNA, 18 nt, Human
gaaaggccagcaaauucg

SEQ ID NO: 1253421 - RNA, 20 nt, Human
aaaagauuaugaucucagaa

SEQ ID NO: 1253422 - RNA, 15 nt, Human
caacauuaaaacaau

SEQ ID NO: 1253423 - RNA, 15 nt, Human
ugccccccagcccuc

SEQ ID NO: 1253424 - RNA, 16 nt, Human
gggcuuuagggaccug

SEQ ID NO: 1253425 - RNA, 14 nt, Human
guauuauuuauaau

SEQ ID NO: 1253426 - RNA, 18 nt, Human
caagugauccgcccaucu

SEQ ID NO: 1253427 - RNA, 16 nt, Human
aucaguuacucugaag

SEQ ID NO: 1253428 - RNA, 16 nt, Human
ccaggaaacucugcau

SEQ ID NO: 1253429 - RNA, 15 nt, Human
cuucaacucccugcc

SEQ ID NO: 1253430 - RNA, 14 nt, Human
cccacuggcucccu

SEQ ID NO: 1253431 - RNA, 22 nt, Human
uuaauggaauauguaaauagaa

SEQ ID NO: 1253432 - RNA, 20 nt, Human
auugcuugaacccaggagau

SEQ ID NO: 1253433 - RNA, 23 nt, Human
aaacucagggagcauuuauaaau

SEQ ID NO: 1253434 - RNA, 17 nt, Human
agaugggagaaucacuu

SEQ ID NO: 1253435 - RNA, 16 nt, Human
ccccaucucuucuggg

SEQ ID NO: 1253436 - RNA, 20 nt, Human
caaauguucaucaaugaaug

SEQ ID NO: 1253437 - RNA, 20 nt, Human
auuaaggcuucucuuaaaca

SEQ ID NO: 1253438 - RNA, 12 nt, Human
gcuguugagcug

SEQ ID NO: 1253439 - RNA, 19 nt, Human
ucucuuaaacacuaaaaag

SEQ ID NO: 1253440 - RNA, 18 nt, Human
uuuccuauguaacugcau

SEQ ID NO: 1253441 - RNA, 21 nt, Human
auuuuuucucuaggaaauauu

SEQ ID NO: 1253442 - RNA, 15 nt, Human
cuggacucaccuccc

SEQ ID NO: 1253443 - RNA, 14 nt, Human
uuucuuaaagaauu

SEQ ID NO: 1253444 - RNA, 17 nt, Human
guugauagcaagugaau

SEQ ID NO: 1253445 - RNA, 16 nt, Human
guuacauuauuaucaa

SEQ ID NO: 1253446 - RNA, 20 nt, Human
aauaagccagacaucaacag

SEQ ID NO: 1253447 - RNA, 23 nt, Human
ggcgacucuauagacucuaggac

SEQ ID NO: 1253448 - RNA, 15 nt, Human
ccagcacagccucuu

SEQ ID NO: 1253449 - RNA, 13 nt, Human
ugugacuuuccua

SEQ ID NO: 1253450 - RNA, 21 nt, Human
ucuucaacucccugcccccca

SEQ ID NO: 1253451 - RNA, 23 nt, Human
ggaacaguuaccucugccucaga

SEQ ID NO: 1253452 - RNA, 15 nt, Human
cuauuuauugcugaa

SEQ ID NO: 1253453 - RNA, 16 nt, Human
auuauacccccugcaa

SEQ ID NO: 1253454 - RNA, 14 nt, Human
cuggagcucugccc

SEQ ID NO: 1253455 - RNA, 19 nt, Human
uacuucauuuaaaauauuu

SEQ ID NO: 1253456 - RNA, 13 nt, Human
uuaaacaaaaaaa

SEQ ID NO: 1253457 - RNA, 13 nt, Human
uuuuuuuuuuucu

SEQ ID NO: 1253458 - RNA, 20 nt, Human
uuuaguaagagauuccugag

SEQ ID NO: 1253459 - RNA, 14 nt, Human
agcuguugagcugu

SEQ ID NO: 1253460 - RNA, 19 nt, Human
cccaggaguuuggccagaa

SEQ ID NO: 1253461 - RNA, 14 nt, Human
uaugcauacaguaa

SEQ ID NO: 1253462 - RNA, 12 nt, Human
gcaguucagagc

SEQ ID NO: 1253463 - RNA, 15 nt, Human
cuugaaaacuuuaug

SEQ ID NO: 1253464 - RNA, 14 nt, Human
auaucuaauauaua

SEQ ID NO: 1253465 - RNA, 19 nt, Human
aaguccuacaagcuaaaau

SEQ ID NO: 1253466 - RNA, 17 nt, Human
ugagaagagaauauuag

SEQ ID NO: 1253467 - RNA, 21 nt, Human
aaugacuaaaaaacaaagaag

SEQ ID NO: 1253468 - RNA, 23 nt, Human
cuuaagaagacugcauuauauuu

SEQ ID NO: 1253469 - RNA, 18 nt, Human
ugguucuaauagaacuca

SEQ ID NO: 1253470 - RNA, 21 nt, Human
ugaacaaauuuacagagacag

SEQ ID NO: 1253471 - RNA, 17 nt, Human
agaaauuccaggaaaau

SEQ ID NO: 1253472 - RNA, 19 nt, Human
aagacuaugaggaauauuu

SEQ ID NO: 1253473 - RNA, 19 nt, Human
aagcuuguauuccuuuuuc

SEQ ID NO: 1253474 - RNA, 20 nt, Human
cagagacgggguuugccaug

SEQ ID NO: 1253475 - RNA, 23 nt, Human
aauauuuauuuuaauaauguuuc

SEQ ID NO: 1253476 - RNA, 13 nt, Human
uuuaaacaaaaaa

SEQ ID NO: 1253477 - RNA, 17 nt, Human
acuuuuaaguugcugau

SEQ ID NO: 1253478 - RNA, 22 nt, Human
cagaguacuggcugauggagua

SEQ ID NO: 1253479 - RNA, 15 nt, Human
gacagggaggacgcu

SEQ ID NO: 1253480 - RNA, 15 nt, Human
ggcuuagacccucau

SEQ ID NO: 1253481 - RNA, 21 nt, Human
uccauccugaggcuccacuug

SEQ ID NO: 1253482 - RNA, 16 nt, Human
cugcuggauucaagug

SEQ ID NO: 1253483 - RNA, 21 nt, Human
cuauguucuaagaagugaaaa

SEQ ID NO: 1253484 - RNA, 21 nt, Human
ugaccauacuaauuauacccc

SEQ ID NO: 1253485 - RNA, 21 nt, Human
gaagaaauuccaggaaaaucu

SEQ ID NO: 1253486 - RNA, 19 nt, Human
uucagagcugcccucuccu

SEQ ID NO: 1253487 - RNA, 23 nt, Human
ggucucagugucaaugcagcccc

SEQ ID NO: 1253488 - RNA, 12 nt, Human
agauaucccagg

SEQ ID NO: 1253489 - RNA, 13 nt, Human
uaccuuuuuccuu

SEQ ID NO: 1253490 - RNA, 13 nt, Human
gcuguugagcugu

SEQ ID NO: 1253491 - RNA, 17 nt, Human
ugcacaucaaaauaugc

SEQ ID NO: 1253492 - RNA, 13 nt, Human
ccucccccaucuc

SEQ ID NO: 1253493 - RNA, 18 nt, Human
aaaugacuaaaaaacaaa

SEQ ID NO: 1253494 - RNA, 21 nt, Human
auucagagcuuacuuaaaauu

SEQ ID NO: 1253495 - RNA, 14 nt, Human
caggaguuuggcca

SEQ ID NO: 1253496 - RNA, 14 nt, Human
cugagcauguacug

SEQ ID NO: 1253497 - RNA, 21 nt, Human
ucuuaaagaauuuucaaaauc

SEQ ID NO: 1253498 - RNA, 14 nt, Human
gagccaccaaaccc

SEQ ID NO: 1253499 - RNA, 22 nt, Human
guacacugccuucucaacucca

SEQ ID NO: 1253500 - RNA, 15 nt, Human
cugccucuaaaaggc

SEQ ID NO: 1253501 - RNA, 15 nt, Human
uaaaaguagaauaaa

SEQ ID NO: 1253502 - RNA, 20 nt, Human
acaagcuuuuuuuuuuuuuc

SEQ ID NO: 1253503 - RNA, 18 nt, Human
accuguaaucauauaaua

SEQ ID NO: 1253504 - RNA, 13 nt, Human
auguaucuuauuc

SEQ ID NO: 1253505 - RNA, 21 nt, Human
aauuuacagagacagaaagca

SEQ ID NO: 1253506 - RNA, 13 nt, Human
gaccuagaauaau

SEQ ID NO: 1253507 - RNA, 22 nt, Human
agacuuugugaaaaaaaauuuu

SEQ ID NO: 1253508 - RNA, 16 nt, Human
auuaauucaccuucca

SEQ ID NO: 1253509 - RNA, 20 nt, Human
gaacguaaucguguccccua

SEQ ID NO: 1253510 - RNA, 20 nt, Human
uaagaaauaugcacaauagc

SEQ ID NO: 1253511 - RNA, 22 nt, Human
accccugagcuugcagagauga

SEQ ID NO: 1253512 - RNA, 18 nt, Human
gacccacuggacucaccu

SEQ ID NO: 1253513 - RNA, 18 nt, Human
agacuuugugaaaaaaaa

SEQ ID NO: 1253514 - RNA, 22 nt, Human
uccauggugugcuggcuuaaaa

SEQ ID NO: 1253515 - RNA, 21 nt, Human
gggagccugaucaccugcccu

SEQ ID NO: 1253516 - RNA, 20 nt, Human
cccgggaguggcgcgcgcca

SEQ ID NO: 1253517 - RNA, 18 nt, Human
gccuuggggcugaugcag

SEQ ID NO: 1253518 - RNA, 18 nt, Human
acugccuucucaacucca

SEQ ID NO: 1253519 - RNA, 14 nt, Human
uuaugauuaaguaa

SEQ ID NO: 1253520 - RNA, 21 nt, Human
aauuucagaagaaauucugca

SEQ ID NO: 1253521 - RNA, 15 nt, Human
agacagcucugcaua

SEQ ID NO: 1253522 - RNA, 14 nt, Human
ggccagaagucaag

SEQ ID NO: 1253523 - RNA, 18 nt, Human
auccuucagccugaaaga

SEQ ID NO: 1253524 - RNA, 21 nt, Human
aaacaaaaaaagcauuguaac

SEQ ID NO: 1253525 - RNA, 15 nt, Human
guucugcagauaaac

SEQ ID NO: 1253526 - RNA, 17 nt, Human
auuuguuaaaauuauca

SEQ ID NO: 1253527 - RNA, 21 nt, Human
ugggucucaguguccucaucu

SEQ ID NO: 1253528 - RNA, 17 nt, Human
aaauguucaucaaugaa

SEQ ID NO: 1253529 - RNA, 17 nt, Human
uaaacaaaaaaagcauu

SEQ ID NO: 1253530 - RNA, 17 nt, Human
ugguucccuugaugaag

SEQ ID NO: 1253531 - RNA, 14 nt, Human
cucccucccuuggg

SEQ ID NO: 1253532 - RNA, 14 nt, Human
cuuuauauuauuuu

SEQ ID NO: 1253533 - RNA, 17 nt, Human
gccugcuggauguggag

SEQ ID NO: 1253534 - RNA, 17 nt, Human
uauaauaaauguacauu

SEQ ID NO: 1253535 - RNA, 22 nt, Human
gcaugaauuuuuuucaucuucu

SEQ ID NO: 1253536 - RNA, 22 nt, Human
cucugcuugccaucccucccuc

SEQ ID NO: 1253537 - RNA, 17 nt, Human
ucugucucaaaaaauaa

SEQ ID NO: 1253538 - RNA, 19 nt, Human
cucugcauacucauuagga

SEQ ID NO: 1253539 - RNA, 18 nt, Human
cucucuuauagaauauuu

SEQ ID NO: 1253540 - RNA, 23 nt, Human
gaggcauuuaggccaugggacag

SEQ ID NO: 1253541 - RNA, 19 nt, Human
gaacacccuauauuuugca

SEQ ID NO: 1253542 - RNA, 14 nt, Human
cuauggaaaaaaag

SEQ ID NO: 1253543 - RNA, 16 nt, Human
uauauaaauuuuccca

SEQ ID NO: 1253544 - RNA, 19 nt, Human
auguuuacagauccccaag

SEQ ID NO: 1253545 - RNA, 21 nt, Human
ucaguuuccugaccuaugaaa

SEQ ID NO: 1253546 - RNA, 13 nt, Human
agccuugcuccug

SEQ ID NO: 1253547 - RNA, 15 nt, Human
aaucccuuaaacuca

SEQ ID NO: 1253548 - RNA, 18 nt, Human
cugagucccaggcugagc

SEQ ID NO: 1253549 - RNA, 13 nt, Human
guauuuauauauu

SEQ ID NO: 1253550 - RNA, 15 nt, Human
aggcuggagugcagu

SEQ ID NO: 1253551 - RNA, 13 nt, Human
cuggccaggcugg

SEQ ID NO: 1253552 - RNA, 12 nt, Human
caugggaaguga

SEQ ID NO: 1253553 - RNA, 17 nt, Human
ugaucagaccauaaugu

SEQ ID NO: 1253554 - RNA, 20 nt, Human
uagaugcaguucugaagaag

SEQ ID NO: 1253555 - RNA, 20 nt, Human
caaacauccuacaagacaca

SEQ ID NO: 1253556 - RNA, 12 nt, Human
ucagaaauuuaa

SEQ ID NO: 1253557 - RNA, 21 nt, Human
accagggccuggcugggagug

SEQ ID NO: 1253558 - RNA, 12 nt, Human
auaaaaauaaau

SEQ ID NO: 1253559 - RNA, 23 nt, Human
cugauaucaugccccuguacucc

SEQ ID NO: 1253560 - RNA, 20 nt, Human
aaauccuugaagauuuacca

SEQ ID NO: 1253561 - RNA, 23 nt, Human
gauauuaaccaggggccaugaau

SEQ ID NO: 1253562 - RNA, 18 nt, Human
caucccucccuccaccuc

SEQ ID NO: 1253563 - RNA, 18 nt, Human
acauuguuugucugucuu

SEQ ID NO: 1253564 - RNA, 22 nt, Human
acuggccugcuggauguggagg

SEQ ID NO: 1253565 - RNA, 21 nt, Human
aucuuuuuuuuaauaaaccau

SEQ ID NO: 1253566 - RNA, 15 nt, Human
uauuuauuaauauuu

SEQ ID NO: 1253567 - RNA, 13 nt, Human
acccuugccaugg

SEQ ID NO: 1253568 - RNA, 17 nt, Human
aaaauuggacuuaaaau

SEQ ID NO: 1253569 - RNA, 16 nt, Human
ccuuuauaaucuuuua

SEQ ID NO: 1253570 - RNA, 11 nt, Human
uucacagggga

SEQ ID NO: 1253571 - RNA, 16 nt, Human
aaaauccauacauuug

SEQ ID NO: 1253572 - RNA, 17 nt, Human
aaauucugcaagcuuuu

SEQ ID NO: 1253573 - RNA, 16 nt, Human
ccugagcgacagugag

SEQ ID NO: 1253574 - RNA, 23 nt, Human
auauaacaaugcuguauuuuaaa

SEQ ID NO: 1253575 - RNA, 12 nt, Human
ucaugcugccaa

SEQ ID NO: 1253576 - RNA, 12 nt, Human
aaugaauguuua

SEQ ID NO: 1253577 - RNA, 19 nt, Human
gaaaauaaaagcacuuauu

SEQ ID NO: 1253578 - RNA, 23 nt, Human
caauauuugaauuuuaaaucuaa

SEQ ID NO: 1253579 - RNA, 15 nt, Human
cauccugcaggcagc

SEQ ID NO: 1253580 - RNA, 16 nt, Human
cuccugggcagcugcc

SEQ ID NO: 1253581 - RNA, 21 nt, Human
cagagucaaugaacuuuccac

SEQ ID NO: 1253582 - RNA, 14 nt, Human
ccuccaccucccug

SEQ ID NO: 1253583 - RNA, 17 nt, Human
gaauaucuauuaauaua

SEQ ID NO: 1253584 - RNA, 17 nt, Human
uuagcuuuacuguuugu

SEQ ID NO: 1253585 - RNA, 19 nt, Human
cucauugcaaccuccaccu

SEQ ID NO: 1253586 - RNA, 13 nt, Human
uauauuuuuagac

SEQ ID NO: 1253587 - RNA, 18 nt, Human
uccagauacacccaaagu

SEQ ID NO: 1253588 - RNA, 15 nt, Human
acugaagaagcacca

SEQ ID NO: 1253589 - RNA, 23 nt, Human
cccacuggacucaccucccccau

SEQ ID NO: 1253590 - RNA, 13 nt, Human
uaauuuuuuucaa

SEQ ID NO: 1253591 - RNA, 14 nt, Human
cagucucccucccu

SEQ ID NO: 1253592 - RNA, 16 nt, Human
uuuaagauuuuguuuu

SEQ ID NO: 1253593 - RNA, 20 nt, Human
uguaagaaaauaucacuugu

SEQ ID NO: 1253594 - RNA, 18 nt, Human
uauuucucucuuuuuaga

SEQ ID NO: 1253595 - RNA, 20 nt, Human
ccuccugccuaagugcagcc

SEQ ID NO: 1253596 - RNA, 15 nt, Human
acuugugcaguguug

SEQ ID NO: 1253597 - RNA, 21 nt, Human
ucagaucauuucaaaacucau

SEQ ID NO: 1253598 - RNA, 23 nt, Human
ggcaaagacuauucccuucuaac

SEQ ID NO: 1253599 - RNA, 16 nt, Human
gcacuuuaaacauuua

SEQ ID NO: 1253600 - RNA, 20 nt, Human
ucuugggaauuuucuuccaa

SEQ ID NO: 1253601 - RNA, 16 nt, Human
gauaauuauaauauac

SEQ ID NO: 1253602 - RNA, 18 nt, Human
augcccaagaaugagaag

SEQ ID NO: 1253603 - RNA, 22 nt, Human
gugccucaccccuugccauaau

SEQ ID NO: 1253604 - RNA, 23 nt, Human
uguuauagguuguuggauaaauc

SEQ ID NO: 1253605 - RNA, 19 nt, Human
aguaacucauuuguuaaaa

SEQ ID NO: 1253606 - RNA, 18 nt, Human
ccugcagacaugagagac

SEQ ID NO: 1253607 - RNA, 21 nt, Human
uuacauuuguauaaaauaauu

SEQ ID NO: 1253608 - RNA, 16 nt, Human
cagcuucucauccugc

SEQ ID NO: 1253609 - RNA, 23 nt, Human
uucagcagagacgggguuugcca

SEQ ID NO: 1253610 - RNA, 22 nt, Human
agccaaacauccuacaagacac

SEQ ID NO: 1253611 - RNA, 19 nt, Human
ccagcaguucagagcugcc

SEQ ID NO: 1253612 - RNA, 13 nt, Human
aacucuuaaucaa

SEQ ID NO: 1253613 - RNA, 11 nt, Human
gcaugguuuag

SEQ ID NO: 1253614 - RNA, 15 nt, Human
cugaggcaagagaau

SEQ ID NO: 1253615 - RNA, 11 nt, Human
aagucuuccau

SEQ ID NO: 1253616 - RNA, 20 nt, Human
agcuugcaacaaaauucucu

SEQ ID NO: 1253617 - RNA, 22 nt, Human
ugagacucugucucaguccaug

SEQ ID NO: 1253618 - RNA, 11 nt, Human
caguucagagc

SEQ ID NO: 1253619 - RNA, 13 nt, Human
guuugauuucauu

SEQ ID NO: 1253620 - RNA, 21 nt, Human
ugccuaucagcauuuuacuac

SEQ ID NO: 1253621 - RNA, 17 nt, Human
uaugcuaagugaaauaa

SEQ ID NO: 1253622 - RNA, 20 nt, Human
agcaagugaauuuuucucua

SEQ ID NO: 1253623 - RNA, 22 nt, Human
ucaguugauuuuacaauugaaa

SEQ ID NO: 1253624 - RNA, 13 nt, Human
uuuuaaaaaagaa

SEQ ID NO: 1253625 - RNA, 19 nt, Human
ggacucaccucccccaucu

SEQ ID NO: 1253626 - RNA, 16 nt, Human
cuagaaccaccugccu

SEQ ID NO: 1253627 - RNA, 16 nt, Human
gcaucuuacugaaggu

SEQ ID NO: 1253628 - RNA, 15 nt, Human
uguguuuauuucacu

SEQ ID NO: 1253629 - RNA, 22 nt, Human
cagagcugcccucuccugggca

SEQ ID NO: 1253630 - RNA, 18 nt, Human
gaaaugaaagcagggacu

SEQ ID NO: 1253631 - RNA, 23 nt, Human
aauguauuuguuuguauuuugug

SEQ ID NO: 1253632 - RNA, 21 nt, Human
cuucucuuaaacacuaaaaag

SEQ ID NO: 1253633 - RNA, 12 nt, Human
gguuuauauaag

SEQ ID NO: 1253634 - RNA, 18 nt, Human
cagaguacuggcugaugg

SEQ ID NO: 1253635 - RNA, 15 nt, Human
uucauguacauccau

SEQ ID NO: 1253636 - RNA, 20 nt, Human
cagcuuguuauuuauaacaa

SEQ ID NO: 1253637 - RNA, 15 nt, Human
ugccucuaaaaggcc

SEQ ID NO: 1253638 - RNA, 20 nt, Human
uagcauauguuuuuguaagu

SEQ ID NO: 1253639 - RNA, 16 nt, Human
aaacaaacgaaaaaca

SEQ ID NO: 1253640 - RNA, 19 nt, Human
ggucucaguguccucaucu

SEQ ID NO: 1253641 - RNA, 19 nt, Human
ccccucuggcuccagcugg

SEQ ID NO: 1253642 - RNA, 19 nt, Human
guccaggucuaccaaaaau

SEQ ID NO: 1253643 - RNA, 14 nt, Human
ccagacacuuuuuu

SEQ ID NO: 1253644 - RNA, 13 nt, Human
aacacaacuauau

SEQ ID NO: 1253645 - RNA, 23 nt, Human
cggagauaucccaggaaaauuaa

SEQ ID NO: 1253646 - RNA, 21 nt, Human
guaaucauauaauaaauguac

SEQ ID NO: 1253647 - RNA, 14 nt, Human
uugaauuuuaaauc

SEQ ID NO: 1253648 - RNA, 22 nt, Human
ccgggagccugaucaccugccc

SEQ ID NO: 1253649 - RNA, 15 nt, Human
ugacaacuugaauaa

SEQ ID NO: 1253650 - RNA, 15 nt, Human
uuacuacuuuaaaaa

SEQ ID NO: 1253651 - RNA, 15 nt, Human
uuuguccuuuuuguu

SEQ ID NO: 1253652 - RNA, 18 nt, Human
aauuuuuuucaauauuua

SEQ ID NO: 1253653 - RNA, 23 nt, Human
auguuaaaacugggacaggggag

SEQ ID NO: 1253654 - RNA, 16 nt, Human
ugaaguccaagcauuu

SEQ ID NO: 1253655 - RNA, 20 nt, Human
gcccaucuccgucucccaaa

SEQ ID NO: 1253656 - RNA, 17 nt, Human
ccacuggacucaccucc

SEQ ID NO: 1253657 - RNA, 15 nt, Human
uauuaucaugcaaau

SEQ ID NO: 1253658 - RNA, 18 nt, Human
gaaauggugaaaugcaga

SEQ ID NO: 1253659 - RNA, 14 nt, Human
ugccaucccucccu

SEQ ID NO: 1253660 - RNA, 14 nt, Human
ugugcaauauguga

SEQ ID NO: 1253661 - RNA, 15 nt, Human
cagucucccucccuu

SEQ ID NO: 1253662 - RNA, 22 nt, Human
cacuaguauuucuaugaaauau

SEQ ID NO: 1253663 - RNA, 22 nt, Human
gaauuaauggaauauguaaaua

SEQ ID NO: 1253664 - RNA, 14 nt, Human
uauaaucuuuuaua

SEQ ID NO: 1253665 - RNA, 15 nt, Human
cucgugggacaguca

SEQ ID NO: 1253666 - RNA, 16 nt, Human
uaccuuuugcuguggc

SEQ ID NO: 1253667 - RNA, 17 nt, Human
uaaguugcugaugaacu

SEQ ID NO: 1253668 - RNA, 11 nt, Human
uuguuuuucca

SEQ ID NO: 1253669 - RNA, 14 nt, Human
ucaucauaaaauaa

SEQ ID NO: 1253670 - RNA, 19 nt, Human
ugagcgcccacuagaccca

SEQ ID NO: 1253671 - RNA, 17 nt, Human
aucccagcacuuuggga

SEQ ID NO: 1253672 - RNA, 23 nt, Human
accuuuguagccacuucacuuuu

SEQ ID NO: 1253673 - RNA, 15 nt, Human
ugugggcuuuuauug

SEQ ID NO: 1253674 - RNA, 23 nt, Human
uuuuaaacaaaaaaagcauugua

SEQ ID NO: 1253675 - RNA, 20 nt, Human
gcugauauauguguuuuuca

SEQ ID NO: 1253676 - RNA, 14 nt, Human
uuaauuauuauucu

SEQ ID NO: 1253677 - RNA, 14 nt, Human
agcucguggaacag

SEQ ID NO: 1253678 - RNA, 20 nt, Human
gcagacaguguuuucuggga

SEQ ID NO: 1253679 - RNA, 15 nt, Human
uggggcuuccuaacu

SEQ ID NO: 1253680 - RNA, 13 nt, Human
gcaggcagcagga

SEQ ID NO: 1253681 - RNA, 15 nt, Human
ucagucucccucccu

SEQ ID NO: 1253682 - RNA, 21 nt, Human
uuuuuuuaaacaaaaaaagca

SEQ ID NO: 1253683 - RNA, 15 nt, Human
uuuauacagugucuu

SEQ ID NO: 1253684 - RNA, 19 nt, Human
uaaaucuauuuauuaauau

SEQ ID NO: 1253685 - RNA, 23 nt, Human
ccagcaguucagagcugcccucu

SEQ ID NO: 1253686 - RNA, 17 nt, Human
ugaucaccugcccugcu

SEQ ID NO: 1253687 - RNA, 15 nt, Human
uauuguaccucucuu

SEQ ID NO: 1253688 - RNA, 14 nt, Human
ccaugggacaggga

SEQ ID NO: 1253689 - RNA, 15 nt, Human
auggaauauguaaau

SEQ ID NO: 1253690 - RNA, 17 nt, Human
guacauuuccaaauuca

SEQ ID NO: 1253691 - RNA, 13 nt, Human
uguaaaguacaga

SEQ ID NO: 1253692 - RNA, 22 nt, Human
aagcacuuuaacacagugucug

SEQ ID NO: 1253693 - RNA, 15 nt, Human
ggaaaugaaagaaag

SEQ ID NO: 1253694 - RNA, 10 nt, Human
gcuugccauc

SEQ ID NO: 1253695 - RNA, 14 nt, Human
aauaaaauggguuu

SEQ ID NO: 1253696 - RNA, 18 nt, Human
uacuuuuuucauuauugg

SEQ ID NO: 1253697 - RNA, 13 nt, Human
ccaaggaugcccc

SEQ ID NO: 1253698 - RNA, 13 nt, Human
cuuccaaacagaa

SEQ ID NO: 1253699 - RNA, 12 nt, Human
uguaaauagaaa

SEQ ID NO: 1253700 - RNA, 19 nt, Human
uggaacaguuaccucugcc

SEQ ID NO: 1253701 - RNA, 23 nt, Human
cugggguggguggggcagugcuu

SEQ ID NO: 1253702 - RNA, 18 nt, Human
acuuuaugcuaagugaaa

SEQ ID NO: 1253703 - RNA, 19 nt, Human
ugugcuggcuuaaaaugua

SEQ ID NO: 1253704 - RNA, 16 nt, Human
accaggcuugccugca

SEQ ID NO: 1253705 - RNA, 21 nt, Human
accaaucauuuuaauuauuau

SEQ ID NO: 1253706 - RNA, 21 nt, Human
cuaguaucaaaagaaagaaaa

SEQ ID NO: 1253707 - RNA, 15 nt, Human
ucaguuacucugaag

SEQ ID NO: 1253708 - RNA, 15 nt, Human
auccugccccugagc

SEQ ID NO: 1253709 - RNA, 15 nt, Human
auugugaucagacca

SEQ ID NO: 1253710 - RNA, 20 nt, Human
acugucucacuuaauccuuu

SEQ ID NO: 1253711 - RNA, 19 nt, Human
uccaaagcugaauacauuc

SEQ ID NO: 1253712 - RNA, 14 nt, Human
aauuccucugggaa

SEQ ID NO: 1253713 - RNA, 19 nt, Human
gaggcagagguugcaguga

SEQ ID NO: 1253714 - RNA, 22 nt, Human
cucagcccuggugggcagagag

SEQ ID NO: 1253715 - RNA, 15 nt, Human
aagcacgaaauguua

SEQ ID NO: 1253716 - RNA, 14 nt, Human
ccuaaccagccugg

SEQ ID NO: 1253717 - RNA, 16 nt, Human
auugcugaaugacuac

SEQ ID NO: 1253718 - RNA, 17 nt, Human
uugccaucccucccucc

SEQ ID NO: 1253719 - RNA, 14 nt, Human
uagaauuaauggaa

SEQ ID NO: 1253720 - RNA, 16 nt, Human
acugauggguuucucc

SEQ ID NO: 1253721 - RNA, 23 nt, Human
ucauuucaaaacucauuuccuau

SEQ ID NO: 1253722 - RNA, 21 nt, Human
caagacccaaaaggcagaagc

SEQ ID NO: 1253723 - RNA, 18 nt, Human
uuuuaaaaaagaaacauu

SEQ ID NO: 1253724 - RNA, 12 nt, Human
cucccugccccc

SEQ ID NO: 1253725 - RNA, 17 nt, Human
cuuugaugauuaauuca

SEQ ID NO: 1253726 - RNA, 17 nt, Human
agaaacguguauauuuu

SEQ ID NO: 1253727 - RNA, 18 nt, Human
agugcuuggcccaggagu

SEQ ID NO: 1253728 - RNA, 23 nt, Human
aguguacaugaaagcguaaagag

SEQ ID NO: 1253729 - RNA, 16 nt, Human
uuagagauuuuuaaau

SEQ ID NO: 1253730 - RNA, 22 nt, Human
auuacaguuagagauuuuuaaa

SEQ ID NO: 1253731 - RNA, 21 nt, Human
cauauguuuuuguaaguuuau

SEQ ID NO: 1253732 - RNA, 15 nt, Human
auugcugaaugacua

SEQ ID NO: 1253733 - RNA, 18 nt, Human
aaguugauaugccuuuuc

SEQ ID NO: 1253734 - RNA, 21 nt, Human
uuucgaugguacauauuucuu

SEQ ID NO: 1253735 - RNA, 13 nt, Human
acaguaauuuuaa

SEQ ID NO: 1253736 - RNA, 17 nt, Human
cugaagggcaucaugca

SEQ ID NO: 1253737 - RNA, 21 nt, Human
gcuggaauugaauucccugcc

SEQ ID NO: 1253738 - RNA, 17 nt, Human
guguaaugaaaaugaau

SEQ ID NO: 1253739 - RNA, 15 nt, Human
cuggccaggcugguc

SEQ ID NO: 1253740 - RNA, 12 nt, Human
aaacaaaaaaag

SEQ ID NO: 1253741 - RNA, 17 nt, Human
aucccucccuccaccuc

SEQ ID NO: 1253742 - RNA, 15 nt, Human
ccagauccuggaaau

SEQ ID NO: 1253743 - RNA, 21 nt, Human
acuaauagaauuaauggaaua

SEQ ID NO: 1253744 - RNA, 18 nt, Human
cuccagccugagcgacag

SEQ ID NO: 1253745 - RNA, 17 nt, Human
cuggcaaggguucaccu

SEQ ID NO: 1253746 - RNA, 14 nt, Human
ccacuggacucacc

SEQ ID NO: 1253747 - RNA, 15 nt, Human
uacaucuuucacauu

SEQ ID NO: 1253748 - RNA, 14 nt, Human
cuacaaauacucuu

SEQ ID NO: 1253749 - RNA, 23 nt, Human
aaguaucuguauugcauuaaaua

SEQ ID NO: 1253750 - RNA, 20 nt, Human
aggcugagaugggagaauca

SEQ ID NO: 1253751 - RNA, 21 nt, Human
auuuuccugaaaacccuugcc

SEQ ID NO: 1253752 - RNA, 22 nt, Human
uacaguuagagauuuuuaaaua

SEQ ID NO: 1253753 - RNA, 12 nt, Human
uaagaagacugc

SEQ ID NO: 1253754 - RNA, 14 nt, Human
ccuugaugaagaag

SEQ ID NO: 1253755 - RNA, 20 nt, Human
auaaaguauauauagaaucu

SEQ ID NO: 1253756 - RNA, 16 nt, Human
cuuauagaauauuuau

SEQ ID NO: 1253757 - RNA, 22 nt, Human
cucccacuagacaaguccagcc

SEQ ID NO: 1253758 - RNA, 16 nt, Human
ccugccccccagcccu

SEQ ID NO: 1253759 - RNA, 18 nt, Human
ucccuccaccucccugca

SEQ ID NO: 1253760 - RNA, 17 nt, Human
cugaucaccugcccugc

SEQ ID NO: 1253761 - RNA, 20 nt, Human
aauuuugugaagcaaaauuu

SEQ ID NO: 1253762 - RNA, 21 nt, Human
aaauccuuuacuguuagucau

SEQ ID NO: 1253763 - RNA, 19 nt, Human
cgauuuagaaagaagccca

SEQ ID NO: 1253764 - RNA, 18 nt, Human
cagggaggacgcucucug

SEQ ID NO: 1253765 - RNA, 17 nt, Human
aaaaguauaaauaaaau

SEQ ID NO: 1253766 - RNA, 19 nt, Human
auuuauaaauggacaaaug

SEQ ID NO: 1253767 - RNA, 20 nt, Human
ggccaugggacagggaggac

SEQ ID NO: 1253768 - RNA, 14 nt, Human
cagagguugcagug

SEQ ID NO: 1253769 - RNA, 22 nt, Human
gcgacucuauagacucuaggac

SEQ ID NO: 1253770 - RNA, 16 nt, Human
gacauuugcucaugga

SEQ ID NO: 1253771 - RNA, 15 nt, Human
ucucagaaauuguau

SEQ ID NO: 1253772 - RNA, 18 nt, Human
ucuucuagguucuaaaaa

SEQ ID NO: 1253773 - RNA, 23 nt, Human
caccucauggaauuggagcucgu

SEQ ID NO: 1253774 - RNA, 14 nt, Human
acuauggaaaaaaa

SEQ ID NO: 1253775 - RNA, 20 nt, Human
ggguuccuuccucugagccu

SEQ ID NO: 1253776 - RNA, 17 nt, Human
guguccccuauccuacu

SEQ ID NO: 1253777 - RNA, 18 nt, Human
acugccgguuugaaaaua

SEQ ID NO: 1253778 - RNA, 14 nt, Human
cacaaaauugggaa

SEQ ID NO: 1253779 - RNA, 15 nt, Human
uauguauuuauaaau

SEQ ID NO: 1253780 - RNA, 20 nt, Human
uagaauaguguuggaaaaug

SEQ ID NO: 1253781 - RNA, 21 nt, Human
auauuucuuugccuuuauaau

SEQ ID NO: 1253782 - RNA, 23 nt, Human
cucagucucccucccuuggggcc

SEQ ID NO: 1253783 - RNA, 19 nt, Human
gauuuuuaaauaaagaauu

SEQ ID NO: 1253784 - RNA, 15 nt, Human
agagacagaaagcag

SEQ ID NO: 1253785 - RNA, 18 nt, Human
ucuauuaggaaauauucu

SEQ ID NO: 1253786 - RNA, 22 nt, Human
uguaccucucuuauagaauauu

SEQ ID NO: 1253787 - RNA, 17 nt, Human
auuuuaaaucuaaaucu

SEQ ID NO: 1253788 - RNA, 18 nt, Human
ugaguggaugauguuucg

SEQ ID NO: 1253789 - RNA, 13 nt, Human
auaauuauaauau

SEQ ID NO: 1253790 - RNA, 23 nt, Human
cuuaaagaauuuucaaaaucaaa

SEQ ID NO: 1253791 - RNA, 17 nt, Human
aggccaugggacaggga

SEQ ID NO: 1253792 - RNA, 17 nt, Human
caguauucccuuuugcu

SEQ ID NO: 1253793 - RNA, 16 nt, Human
acuuuaacacaguguc

SEQ ID NO: 1253794 - RNA, 19 nt, Human
gcaugggccuagcccacug

SEQ ID NO: 1253795 - RNA, 17 nt, Human
auuugcagcugugccau

SEQ ID NO: 1253796 - RNA, 13 nt, Human
uuaaaaaagaaac

SEQ ID NO: 1253797 - RNA, 22 nt, Human
guacaauuauaagcuguuuuua

SEQ ID NO: 1253798 - RNA, 20 nt, Human
uggucucgaacugcuggauu

SEQ ID NO: 1253799 - RNA, 19 nt, Human
uaaaaauaaaaauaaauuu

SEQ ID NO: 1253800 - RNA, 20 nt, Human
acuaauagaauuaauggaau

SEQ ID NO: 1253801 - RNA, 22 nt, Human
uggguuccuuccucugagccuu

SEQ ID NO: 1253802 - RNA, 14 nt, Human
ggccgggagccuga

SEQ ID NO: 1253803 - RNA, 16 nt, Human
ucaaucaaauaaguau

SEQ ID NO: 1253804 - RNA, 23 nt, Human
auauauguauuuauaaauauauu

SEQ ID NO: 1253805 - RNA, 16 nt, Human
uguuuccuagcgcagc

SEQ ID NO: 1253806 - RNA, 15 nt, Human
caagacucugucuca

SEQ ID NO: 1253807 - RNA, 18 nt, Human
cugaccucccucuaauuu

SEQ ID NO: 1253808 - RNA, 17 nt, Human
uauugcugaaugacuac

SEQ ID NO: 1253809 - RNA, 17 nt, Human
auuuuaauaauguuuca

SEQ ID NO: 1253810 - RNA, 22 nt, Human
uccaaacuggagcuugaaauag

SEQ ID NO: 1253811 - RNA, 20 nt, Human
uauuuauaaauauauuuaag

SEQ ID NO: 1253812 - RNA, 20 nt, Human
gaccauacuaauuauacccc

SEQ ID NO: 1253813 - RNA, 17 nt, Human
cccagccagcaguucag

SEQ ID NO: 1253814 - RNA, 19 nt, Human
ugucuggcacuugggacaa

SEQ ID NO: 1253815 - RNA, 20 nt, Human
accucccugcaauaaaaugg

SEQ ID NO: 1253816 - RNA, 15 nt, Human
ugcuguauuuuaaaa

SEQ ID NO: 1253817 - RNA, 13 nt, Human
cauuuucacuuuu

SEQ ID NO: 1253818 - RNA, 15 nt, Human
agaauuaauggaaua

SEQ ID NO: 1253819 - RNA, 19 nt, Human
cagcuucucauccugcagg

SEQ ID NO: 1253820 - RNA, 18 nt, Human
gauagguuaccaguaacg

SEQ ID NO: 1253821 - RNA, 21 nt, Human
uuuguauaaaauaauuuuuau

SEQ ID NO: 1253822 - RNA, 13 nt, Human
cccuccuuaucaa

SEQ ID NO: 1253823 - RNA, 14 nt, Human
cuaagcauuccaac

SEQ ID NO: 1253824 - RNA, 18 nt, Human
cugggaauuacaggcgug

SEQ ID NO: 1253825 - RNA, 20 nt, Human
ucaugcaaaugcuguauucu

SEQ ID NO: 1253826 - RNA, 23 nt, Human
uuuauaugcuucuguuuuauaau

SEQ ID NO: 1253827 - RNA, 13 nt, Human
ugcuugccauccc

SEQ ID NO: 1253828 - RNA, 16 nt, Human
cacuaguauuucuaug

SEQ ID NO: 1253829 - RNA, 22 nt, Human
aguugguaucaaccaaauggag

SEQ ID NO: 1253830 - RNA, 21 nt, Human
cccccucuggcuccagcuggc

SEQ ID NO: 1253831 - RNA, 23 nt, Human
aaaucucuauuaggaaauauucu

SEQ ID NO: 1253832 - RNA, 20 nt, Human
ccagugagacagcucugcau

SEQ ID NO: 1253833 - RNA, 15 nt, Human
agaaauuguaucuua

SEQ ID NO: 1253834 - RNA, 16 nt, Human
cuggauguggaggggg

SEQ ID NO: 1253835 - RNA, 20 nt, Human
gcagagaugaggccgccaug

SEQ ID NO: 1253836 - RNA, 15 nt, Human
cacaggacagcccuu

SEQ ID NO: 1253837 - RNA, 12 nt, Human
agcuaaaguauc

SEQ ID NO: 1253838 - RNA, 21 nt, Human
auuugaguguuuuaagauaaa

SEQ ID NO: 1253839 - RNA, 18 nt, Human
auagcaagugaauuuuuc

SEQ ID NO: 1253840 - RNA, 12 nt, Human
gaagucuuccau

SEQ ID NO: 1253841 - RNA, 19 nt, Human
uuaaagcuaaaguaucugu

SEQ ID NO: 1253842 - RNA, 16 nt, Human
gccaugugcuaguaau

SEQ ID NO: 1253843 - RNA, 23 nt, Human
caaggcuggagugcaguggcgca

SEQ ID NO: 1253844 - RNA, 18 nt, Human
ucugaugagaacucugag

SEQ ID NO: 1253845 - RNA, 19 nt, Human
aaaacuaagaaauaugcac

SEQ ID NO: 1253846 - RNA, 18 nt, Human
uauaacaaugcuguauuu

SEQ ID NO: 1253847 - RNA, 12 nt, Human
uacuaaaaauac

SEQ ID NO: 1253848 - RNA, 21 nt, Human
acaauuauuuuuacaguucuc

SEQ ID NO: 1253849 - RNA, 23 nt, Human
aucccucccuccaccucccugca

SEQ ID NO: 1253850 - RNA, 20 nt, Human
cgaaauguuauuuuuuaauu

SEQ ID NO: 1253851 - RNA, 14 nt, Human
uccuucacauccug

SEQ ID NO: 1253852 - RNA, 14 nt, Human
aaagaggaaugaag

SEQ ID NO: 1253853 - RNA, 17 nt, Human
uuaaacuggaaauaaaa

SEQ ID NO: 1253854 - RNA, 13 nt, Human
cauuuguauaaaa

SEQ ID NO: 1253855 - RNA, 14 nt, Human
auagagugggacag

SEQ ID NO: 1253856 - RNA, 11 nt, Human
augugcaauau

SEQ ID NO: 1253857 - RNA, 18 nt, Human
ccuccaccucccugcaau

SEQ ID NO: 1253858 - RNA, 23 nt, Human
acuggcucccuggaagagaucaa

SEQ ID NO: 1253859 - RNA, 14 nt, Human
agucugacuguuuc

SEQ ID NO: 1253860 - RNA, 13 nt, Human
ugagccaccaaac

SEQ ID NO: 1253861 - RNA, 16 nt, Human
auuuaagguauauaaa

SEQ ID NO: 1253862 - RNA, 13 nt, Human
uuauaauauacua

SEQ ID NO: 1253863 - RNA, 19 nt, Human
uauccaaagcugaauacau

SEQ ID NO: 1253864 - RNA, 13 nt, Human
agcauuuauaaau

SEQ ID NO: 1253865 - RNA, 21 nt, Human
auauuuaagauaauuauaaua

SEQ ID NO: 1253866 - RNA, 23 nt, Human
cgggguuugccaugcuggccagg

SEQ ID NO: 1253867 - RNA, 20 nt, Human
cugugguccgaagucuucca

SEQ ID NO: 1253868 - RNA, 15 nt, Human
agaagagaauauuag

SEQ ID NO: 1253869 - RNA, 12 nt, Human
ccccuugccaua

SEQ ID NO: 1253870 - RNA, 18 nt, Human
cccugaccucccucuaau

SEQ ID NO: 1253871 - RNA, 17 nt, Human
uuucugcuuuaauuuca

SEQ ID NO: 1253872 - RNA, 12 nt, Human
uuauuauuuaua

SEQ ID NO: 1253873 - RNA, 19 nt, Human
aauguuacauuauuaucaa

SEQ ID NO: 1253874 - RNA, 13 nt, Human
ccacuucacuuuu

SEQ ID NO: 1253875 - RNA, 13 nt, Human
aaaugaaagcagg

SEQ ID NO: 1253876 - RNA, 20 nt, Human
guuauuuauaacaaccuaaa

SEQ ID NO: 1253877 - RNA, 16 nt, Human
cuggcaguuuuccauu

SEQ ID NO: 1253878 - RNA, 17 nt, Human
ucagagcugcccucucc

SEQ ID NO: 1253879 - RNA, 13 nt, Human
auuuuaaaagaau

SEQ ID NO: 1253880 - RNA, 22 nt, Human
gcgacaguuuuccuucucaucu

SEQ ID NO: 1253881 - RNA, 14 nt, Human
caccaacuuugaag

SEQ ID NO: 1253882 - RNA, 17 nt, Human
aauauuuuuaugugcaa

SEQ ID NO: 1253883 - RNA, 18 nt, Human
gcagugcuuggcccagga

SEQ ID NO: 1253884 - RNA, 11 nt, Human
ucaccuccccc

SEQ ID NO: 1253885 - RNA, 22 nt, Human
gaaacuaccagcccuacaccau

SEQ ID NO: 1253886 - RNA, 16 nt, Human
aacagaagcuuccauu

SEQ ID NO: 1253887 - RNA, 17 nt, Human
auuugcacuauuggaag

SEQ ID NO: 1253888 - RNA, 16 nt, Human
cuugccaucccucccu

SEQ ID NO: 1253889 - RNA, 18 nt, Human
uaaggcuucucuuaaaca

SEQ ID NO: 1253890 - RNA, 22 nt, Human
auuucuugaguuuuguuuuaaa

SEQ ID NO: 1253891 - RNA, 18 nt, Human
acagagacagaaagcaga

SEQ ID NO: 1253892 - RNA, 20 nt, Human
aaucauauaauaaauguaca

SEQ ID NO: 1253893 - RNA, 19 nt, Human
uauaacucaucauaaaaua

SEQ ID NO: 1253894 - RNA, 22 nt, Human
uugcaagacauagaauaguguu

SEQ ID NO: 1253895 - RNA, 18 nt, Human
cagccucuuagaugcagu

SEQ ID NO: 1253896 - RNA, 21 nt, Human
gaacuuuccacauucagagcu

SEQ ID NO: 1253897 - RNA, 13 nt, Human
uauauauagaauc

SEQ ID NO: 1253898 - RNA, 16 nt, Human
ucuuacugaagguaaa

SEQ ID NO: 1253899 - RNA, 14 nt, Human
uauagaauauuuau

SEQ ID NO: 1253900 - RNA, 10 nt, Human
caacucccug

SEQ ID NO: 1253901 - RNA, 11 nt, Human
ucaccugcccu

SEQ ID NO: 1253902 - RNA, 16 nt, Human
accucaagccagccuu

SEQ ID NO: 1253903 - RNA, 14 nt, Human
uuaauuauuauuua

SEQ ID NO: 1253904 - RNA, 14 nt, Human
caugagucagucug

SEQ ID NO: 1253905 - RNA, 17 nt, Human
ucucauccugcaggcag

SEQ ID NO: 1253906 - RNA, 18 nt, Human
cuuugaagucugauuuuc

SEQ ID NO: 1253907 - RNA, 14 nt, Human
gcaaagcccagcuu

SEQ ID NO: 1253908 - RNA, 15 nt, Human
gcagagguugcagug

SEQ ID NO: 1253909 - RNA, 16 nt, Human
cuggacuuuccagaga

SEQ ID NO: 1253910 - RNA, 22 nt, Human
uccaaacagaacuauggaaaaa

SEQ ID NO: 1253911 - RNA, 18 nt, Human
ggccuggcugggaguggc

SEQ ID NO: 1253912 - RNA, 13 nt, Human
aguuuuccuucuc

SEQ ID NO: 1253913 - RNA, 14 nt, Human
guuacauuauuauc

SEQ ID NO: 1253914 - RNA, 13 nt, Human
aaauaaaagauug

SEQ ID NO: 1253915 - RNA, 19 nt, Human
aagauuaugaucucagaaa

SEQ ID NO: 1253916 - RNA, 14 nt, Human
augcuguauucuuc

SEQ ID NO: 1253917 - RNA, 13 nt, Human
aaaaugagcaaaa

SEQ ID NO: 1253918 - RNA, 15 nt, Human
aucaaccaaauggag

SEQ ID NO: 1253919 - RNA, 19 nt, Human
uacauguuuucuuugcuuu

SEQ ID NO: 1253920 - RNA, 23 nt, Human
ucucugaagaguggguuucacaa

SEQ ID NO: 1253921 - RNA, 14 nt, Human
agaugcuuguauuu

SEQ ID NO: 1253922 - RNA, 12 nt, Human
auuaauauaugu

SEQ ID NO: 1253923 - RNA, 12 nt, Human
uuuuauauuuga

SEQ ID NO: 1253924 - RNA, 19 nt, Human
cuaauuuguguauuuucag

SEQ ID NO: 1253925 - RNA, 16 nt, Human
auuuaagauaauuaua

SEQ ID NO: 1253926 - RNA, 16 nt, Human
agucuuauaauagguu

SEQ ID NO: 1253927 - RNA, 17 nt, Human
ccuccaccuucuggguu

SEQ ID NO: 1253928 - RNA, 19 nt, Human
caccaacuuugaagucuga

SEQ ID NO: 1253929 - RNA, 21 nt, Human
gcccaagaaugagaagaauga

SEQ ID NO: 1253930 - RNA, 20 nt, Human
auuaauauauguauuauuua

SEQ ID NO: 1253931 - RNA, 13 nt, Human
uguaauucuaaau

SEQ ID NO: 1253932 - RNA, 20 nt, Human
cuucaacucccugcccccca

SEQ ID NO: 1253933 - RNA, 15 nt, Human
ggacucaccuccccc

SEQ ID NO: 1253934 - RNA, 17 nt, Human
aucuauuaauauaugua

SEQ ID NO: 1253935 - RNA, 17 nt, Human
auagaauggaacucaag

SEQ ID NO: 1253936 - RNA, 22 nt, Human
uuccuagcgcagccaugugauu

SEQ ID NO: 1253937 - RNA, 19 nt, Human
uccagaaagugacaagcuc

SEQ ID NO: 1253938 - RNA, 20 nt, Human
auuacaguuagagauuuuua

SEQ ID NO: 1253939 - RNA, 12 nt, Human
aaauauuuuuau

SEQ ID NO: 1253940 - RNA, 14 nt, Human
uccuauguaacugc

SEQ ID NO: 1253941 - RNA, 16 nt, Human
gagaaacuggaacucu

SEQ ID NO: 1253942 - RNA, 19 nt, Human
aaaaagcauuguaacuuau

SEQ ID NO: 1253943 - RNA, 15 nt, Human
caagguucuucccuu

SEQ ID NO: 1253944 - RNA, 20 nt, Human
uauaauaaauguacauuaau

SEQ ID NO: 1253945 - RNA, 15 nt, Human
cuaagcaaaauguga

SEQ ID NO: 1253946 - RNA, 24 nt, Human
accugcuguuuccuagcgcagcca

SEQ ID NO: 1253947 - RNA, 12 nt, Human
caacccaaaugu

SEQ ID NO: 1253948 - RNA, 17 nt, Human
ugggaauuuucuuccaa

SEQ ID NO: 1253949 - RNA, 18 nt, Human
ccucccuccaccucccug

SEQ ID NO: 1253950 - RNA, 20 nt, Human
uuccacagaagcuccaggua

SEQ ID NO: 1253951 - RNA, 19 nt, Human
uauaucaguccucuuucaa

SEQ ID NO: 1253952 - RNA, 17 nt, Human
uauagcauauguuuuug

SEQ ID NO: 1253953 - RNA, 19 nt, Human
uaucacuugucaauaaaau

SEQ ID NO: 1253954 - RNA, 23 nt, Human
ccccucuggcuccagcuggccgg

SEQ ID NO: 1253955 - RNA, 19 nt, Human
auauugcaaggcaaagacu

SEQ ID NO: 1253956 - RNA, 19 nt, Human
cugacagcccaaggguggg

SEQ ID NO: 1253957 - RNA, 15 nt, Human
auuccccuaaccuca

SEQ ID NO: 1253958 - RNA, 15 nt, Human
uuugaauaaauaaau

SEQ ID NO: 1253959 - RNA, 15 nt, Human
gauagguuaccagua

SEQ ID NO: 1253960 - RNA, 13 nt, Human
accaaauggagug

SEQ ID NO: 1253961 - RNA, 14 nt, Human
accuucuggguuca

SEQ ID NO: 1253962 - RNA, 22 nt, Human
ccucccuuggggccuaugcaga

SEQ ID NO: 1253963 - RNA, 20 nt, Human
uguauuuguuuguauuuugu

SEQ ID NO: 1253964 - RNA, 14 nt, Human
uauuugaaauauug

SEQ ID NO: 1253965 - RNA, 13 nt, Human
aauuagaugaacu

SEQ ID NO: 1253966 - RNA, 21 nt, Human
uccucugcuugccaucccucc

SEQ ID NO: 1253967 - RNA, 16 nt, Human
auacaguaauuuuaag

SEQ ID NO: 1253968 - RNA, 21 nt, Human
accaaggagccaaacauccua

SEQ ID NO: 1253969 - RNA, 17 nt, Human
ccucugcuugccauccc

SEQ ID NO: 1253970 - RNA, 13 nt, Human
uuccccuaaccuc

SEQ ID NO: 1253971 - RNA, 14 nt, Human
aauacucuuaggaa

SEQ ID NO: 1253972 - RNA, 15 nt, Human
uaauguuacauuauu

SEQ ID NO: 1253973 - RNA, 18 nt, Human
gaggcugaggcgggugga

SEQ ID NO: 1253974 - RNA, 21 nt, Human
aucggagcugcuagaguucug

SEQ ID NO: 1253975 - RNA, 16 nt, Human
aagcauuuagauguau

SEQ ID NO: 1253976 - RNA, 14 nt, Human
uccaagccugacca

SEQ ID NO: 1253977 - RNA, 19 nt, Human
auuaucuaucuaucuauuu

SEQ ID NO: 1253978 - RNA, 22 nt, Human
auuucugugggagaauucuuac

SEQ ID NO: 1253979 - RNA, 18 nt, Human
uggagggaagccuugggg

SEQ ID NO: 1253980 - RNA, 17 nt, Human
cugcauauguuucgcug

SEQ ID NO: 1253981 - RNA, 18 nt, Human
caguauucccuuuugcug

SEQ ID NO: 1253982 - RNA, 23 nt, Human
aguaauuggaaaggcagcucuaa

SEQ ID NO: 1253983 - RNA, 19 nt, Human
uauuuauugcugaaugacu

SEQ ID NO: 1253984 - RNA, 16 nt, Human
uauuuauuaauauuua

SEQ ID NO: 1253985 - RNA, 15 nt, Human
ugggacagggaggac

SEQ ID NO: 1253986 - RNA, 19 nt, Human
ucaccaaggcugauuaaac

SEQ ID NO: 1253987 - RNA, 13 nt, Human
gaggcaagagaau

SEQ ID NO: 1253988 - RNA, 17 nt, Human
uuuucaccuguuuuuaa

SEQ ID NO: 1253989 - RNA, 23 nt, Human
uaauccuuuguuuucugacuaau

SEQ ID NO: 1253990 - RNA, 15 nt, Human
uauaauauacuauau

SEQ ID NO: 1253991 - RNA, 12 nt, Human
gcuggccaggcu

SEQ ID NO: 1253992 - RNA, 11 nt, Human
caacucccugc

SEQ ID NO: 1253993 - RNA, 23 nt, Human
agagcaagacucugucucaaaaa

SEQ ID NO: 1253994 - RNA, 14 nt, Human
uucuagguucuaaa

SEQ ID NO: 1253995 - RNA, 22 nt, Human
uguugcccacagcuguaugauu

SEQ ID NO: 1253996 - RNA, 16 nt, Human
ugacuauuauagaaug

SEQ ID NO: 1253997 - RNA, 19 nt, Human
uagagauuuuuaaauaaag

SEQ ID NO: 1253998 - RNA, 14 nt, Human
ugcucauggaauug

SEQ ID NO: 1253999 - RNA, 22 nt, Human
uacagugucuuacagagaaaag

SEQ ID NO: 1254000 - RNA, 19 nt, Human
cucaccucccccaucucuu

SEQ ID NO: 1254001 - RNA, 22 nt, Human
agcacagccucuuagaugcagu

SEQ ID NO: 1254002 - RNA, 18 nt, Human
uuuguuaaaugauuucau

SEQ ID NO: 1254003 - RNA, 14 nt, Human
uuaugaaccuuuac

SEQ ID NO: 1254004 - RNA, 16 nt, Human
ucagaccuagaauaau

SEQ ID NO: 1254005 - RNA, 17 nt, Human
cugccucagaaaacaag

SEQ ID NO: 1254006 - RNA, 15 nt, Human
augaaccuuuacauc

SEQ ID NO: 1254007 - RNA, 15 nt, Human
ccugccccccagccc

SEQ ID NO: 1254008 - RNA, 13 nt, Human
auguggcuguauc

SEQ ID NO: 1254009 - RNA, 21 nt, Human
uuaaaucuaaaucuauuuauu

SEQ ID NO: 1254010 - RNA, 17 nt, Human
uagaagcaucacagguu

SEQ ID NO: 1254011 - RNA, 12 nt, Human
ggaggcugagau

SEQ ID NO: 1254012 - RNA, 21 nt, Human
acucugucucaaaaaauaaaa

SEQ ID NO: 1254013 - RNA, 15 nt, Human
aagaauuuuaaaacu

SEQ ID NO: 1254014 - RNA, 20 nt, Human
uucauuuaaaauauuuuuau

SEQ ID NO: 1254015 - RNA, 12 nt, Human
cacacagugcuu

SEQ ID NO: 1254016 - RNA, 16 nt, Human
ugagaugcuagaacuc

SEQ ID NO: 1254017 - RNA, 15 nt, Human
aaaucuaaaucuauu

SEQ ID NO: 1254018 - RNA, 19 nt, Human
ccugccuaagugcagcccc

SEQ ID NO: 1254019 - RNA, 23 nt, Human
cuuuggcaaaugagccggagccc

SEQ ID NO: 1254020 - RNA, 15 nt, Human
aacauagguuuuuag

SEQ ID NO: 1254021 - RNA, 21 nt, Human
ggcuuguaaaguacagacuuu

SEQ ID NO: 1254022 - RNA, 16 nt, Human
aguucagagcugcccu

SEQ ID NO: 1254023 - RNA, 22 nt, Human
auuuuuuaaguauuuauauauu

SEQ ID NO: 1254024 - RNA, 19 nt, Human
ugcacacagcacgggggcc

SEQ ID NO: 1254025 - RNA, 19 nt, Human
cugucucaaaaaauaaaaa

SEQ ID NO: 1254026 - RNA, 14 nt, Human
aacugcauugagaa

SEQ ID NO: 1254027 - RNA, 17 nt, Human
acccacuggacucaccu

SEQ ID NO: 1254028 - RNA, 22 nt, Human
gugugaccacugcagaagacag

SEQ ID NO: 1254029 - RNA, 18 nt, Human
auauacuccuaguaauuu

SEQ ID NO: 1254030 - RNA, 14 nt, Human
gccugcaauauuug

SEQ ID NO: 1254031 - RNA, 19 nt, Human
cggccuccauccugaggcu

SEQ ID NO: 1254032 - RNA, 15 nt, Human
agccucaagaugaag

SEQ ID NO: 1254033 - RNA, 16 nt, Human
cuuagacccucaugcu

SEQ ID NO: 1254034 - RNA, 21 nt, Human
guauuuuuaccuuuuuccuuc

SEQ ID NO: 1254035 - RNA, 21 nt, Human
cuugaggacuugggcgggaca

SEQ ID NO: 1254036 - RNA, 15 nt, Human
cagcaguucagagcu

SEQ ID NO: 1254037 - RNA, 21 nt, Human
acgcucucuggccuucggccu

SEQ ID NO: 1254038 - RNA, 20 nt, Human
auaacaaugcuguauuuuaa

SEQ ID NO: 1254039 - RNA, 17 nt, Human
cuccugggcagcugccu

SEQ ID NO: 1254040 - RNA, 13 nt, Human
uuuauauuauuuu

SEQ ID NO: 1254041 - RNA, 13 nt, Human
uauuuauuaauau

SEQ ID NO: 1254042 - RNA, 19 nt, Human
uaaagaacacccuauauuu

SEQ ID NO: 1254043 - RNA, 14 nt, Human
uaaagaauuuuaaa

SEQ ID NO: 1254044 - RNA, 17 nt, Human
cuccuguacuuuuucca

SEQ ID NO: 1254045 - RNA, 19 nt, Human
aggucacacaaccuguccc

SEQ ID NO: 1254046 - RNA, 20 nt, Human
uccagccugagcgacaguga

SEQ ID NO: 1254047 - RNA, 17 nt, Human
caaaauuggacuuaaaa

SEQ ID NO: 1254048 - RNA, 15 nt, Human
uuaccuuuuuccuuc

SEQ ID NO: 1254049 - RNA, 17 nt, Human
aaccuagggugauauua

SEQ ID NO: 1254050 - RNA, 13 nt, Human
uaaggcuucucuu

SEQ ID NO: 1254051 - RNA, 17 nt, Human
augcauacaguaauuuu

SEQ ID NO: 1254052 - RNA, 16 nt, Human
uaugaaccuuuacauc

SEQ ID NO: 1254053 - RNA, 19 nt, Human
cucuccugggcagcugccu

SEQ ID NO: 1254054 - RNA, 23 nt, Human
cugcaauaaaauggguuuuacug

SEQ ID NO: 1254055 - RNA, 21 nt, Human
aaaauaugccccauucaacau

SEQ ID NO: 1254056 - RNA, 15 nt, Human
ugccugcaggcauga

SEQ ID NO: 1254057 - RNA, 22 nt, Human
aucucuucuggguuccuuccuc

SEQ ID NO: 1254058 - RNA, 18 nt, Human
caugccccuguacuccag

SEQ ID NO: 1254059 - RNA, 16 nt, Human
gucuaucuuugagcgc

SEQ ID NO: 1254060 - RNA, 18 nt, Human
gaccccugagcuugcaga

SEQ ID NO: 1254061 - RNA, 12 nt, Human
cauuauauuuau

SEQ ID NO: 1254062 - RNA, 16 nt, Human
uuaaacuggaaauaaa

SEQ ID NO: 1254063 - RNA, 22 nt, Human
gcagccaugugauuacccucug

SEQ ID NO: 1254064 - RNA, 17 nt, Human
ccuguaaucccagcacu

SEQ ID NO: 1254065 - RNA, 21 nt, Human
caguauucccuuuugcugccu

SEQ ID NO: 1254066 - RNA, 14 nt, Human
uguuauuuuuuaau

SEQ ID NO: 1254067 - RNA, 21 nt, Human
cucuccugggcagcugccucc

SEQ ID NO: 1254068 - RNA, 18 nt, Human
uuccugagaccagccaac

SEQ ID NO: 1254069 - RNA, 16 nt, Human
gagcaccugcaggcgu

SEQ ID NO: 1254070 - RNA, 15 nt, Human
acaggguuuauguuu

SEQ ID NO: 1254071 - RNA, 23 nt, Human
cugagaccagccaaccugggggc

SEQ ID NO: 1254072 - RNA, 14 nt, Human
gacuggccugcugg

SEQ ID NO: 1254073 - RNA, 18 nt, Human
ccugcuggauguggaggg

SEQ ID NO: 1254074 - RNA, 15 nt, Human
gaaauaguucaaagc

SEQ ID NO: 1254075 - RNA, 13 nt, Human
cacuuucccucuu

SEQ ID NO: 1254076 - RNA, 23 nt, Human
ccacuucauucuugaaagcugug

SEQ ID NO: 1254077 - RNA, 16 nt, Human
cuagaacucccuuuca

SEQ ID NO: 1254078 - RNA, 17 nt, Human
ucagucauaacuaaaua

SEQ ID NO: 1254079 - RNA, 20 nt, Human
ugauccgcccaucuccgucu

SEQ ID NO: 1254080 - RNA, 22 nt, Human
aaauguugacaugggacauuug

SEQ ID NO: 1254081 - RNA, 17 nt, Human
ugaaaagauuaugaucu

SEQ ID NO: 1254082 - RNA, 24 nt, Human
uuaaacaaaaaaagcauuguaacu

SEQ ID NO: 1254083 - RNA, 13 nt, Human
agcagauuuuaau

SEQ ID NO: 1254084 - RNA, 23 nt, Human
agcccuccuuaucaaaggacacc

SEQ ID NO: 1254085 - RNA, 19 nt, Human
accugucccagcgagggac

SEQ ID NO: 1254086 - RNA, 12 nt, Human
uugggaggcuga

SEQ ID NO: 1254087 - RNA, 21 nt, Human
ucaaaauuggacuuaaaaucu

SEQ ID NO: 1254088 - RNA, 14 nt, Human
ccugccccccagcc

SEQ ID NO: 1254089 - RNA, 16 nt, Human
gucccagccagcaguu

SEQ ID NO: 1254090 - RNA, 16 nt, Human
cugaucaccugcccug

SEQ ID NO: 1254091 - RNA, 15 nt, Human
uguaccauguacaug

SEQ ID NO: 1254092 - RNA, 21 nt, Human
uuucaaaaucaaauuccagaa

SEQ ID NO: 1254093 - RNA, 21 nt, Human
aaaagguauuuuaaucaccaa

SEQ ID NO: 1254094 - RNA, 17 nt, Human
cuuuuuuuuuuuuucuu

SEQ ID NO: 1254095 - RNA, 21 nt, Human
uugccaaggcuggagugcagu

SEQ ID NO: 1254096 - RNA, 17 nt, Human
agagacagaaagcagaa

SEQ ID NO: 1254097 - RNA, 14 nt, Human
cucuaggacauaaa

SEQ ID NO: 1254098 - RNA, 18 nt, Human
ucuucuggguuccuuccu

SEQ ID NO: 1254099 - RNA, 13 nt, Human
aauuucaugaaaa

SEQ ID NO: 1254100 - RNA, 20 nt, Human
uccaagccucauguccacug

SEQ ID NO: 1254101 - RNA, 16 nt, Human
cuguacuccagccugg

SEQ ID NO: 1254102 - RNA, 23 nt, Human
agaaugagaagaaugacuaugca

SEQ ID NO: 1254103 - RNA, 14 nt, Human
aaucucaauauuuc

SEQ ID NO: 1254104 - RNA, 20 nt, Human
uuaaguuuuuuuuuaaaaaa

SEQ ID NO: 1254105 - RNA, 15 nt, Human
auaucaauuuaaaaa

SEQ ID NO: 1254106 - RNA, 21 nt, Human
ccuccaccucccugcaauaaa

SEQ ID NO: 1254107 - RNA, 14 nt, Human
uuuucaaaauggag

SEQ ID NO: 1254108 - RNA, 17 nt, Human
ccaaaaaucucaauauu

SEQ ID NO: 1254109 - RNA, 14 nt, Human
ggcagcugccuccc

SEQ ID NO: 1254110 - RNA, 23 nt, Human
acaaauacucuuaggaagagaaa

SEQ ID NO: 1254111 - RNA, 22 nt, Human
uuuaauaauguuucaaacauau

SEQ ID NO: 1254112 - RNA, 15 nt, Human
uccuacaagacacag

SEQ ID NO: 1254113 - RNA, 13 nt, Human
aucucaauauuuc

SEQ ID NO: 1254114 - RNA, 18 nt, Human
gugacuuuccuaaaucaa

SEQ ID NO: 1254115 - RNA, 21 nt, Human
gcugccuccccuccucugcuu

SEQ ID NO: 1254116 - RNA, 16 nt, Human
agcauauguuuuugua

SEQ ID NO: 1254117 - RNA, 21 nt, Human
ccagcaguucagagcugcccu

SEQ ID NO: 1254118 - RNA, 18 nt, Human
gaaacguguauauuuuuu

SEQ ID NO: 1254119 - RNA, 16 nt, Human
cagacaugagagacag

SEQ ID NO: 1254120 - RNA, 19 nt, Human
uccaccucccugcaauaaa

SEQ ID NO: 1254121 - RNA, 23 nt, Human
aggcuuacacccacaguggaaag

SEQ ID NO: 1254122 - RNA, 19 nt, Human
agccugaucaccugcccug

SEQ ID NO: 1254123 - RNA, 18 nt, Human
agaacuauggaaaaaaag

SEQ ID NO: 1254124 - RNA, 19 nt, Human
gugucuggcacuugggaca

SEQ ID NO: 1254125 - RNA, 17 nt, Human
ucuagguucuaaaaauu

SEQ ID NO: 1254126 - RNA, 19 nt, Human
cucugccucagaaaacaag

SEQ ID NO: 1254127 - RNA, 14 nt, Human
guuacucugaaggg

SEQ ID NO: 1254128 - RNA, 14 nt, Human
gaaagcagaacagu

SEQ ID NO: 1254129 - RNA, 21 nt, Human
gaaauguuuacagauccccaa

SEQ ID NO: 1254130 - RNA, 20 nt, Human
uaugugaaauaaaaguagaa

SEQ ID NO: 1254131 - RNA, 20 nt, Human
uuaacacaugauccugcaau

SEQ ID NO: 1254132 - RNA, 21 nt, Human
gaaagcagggacuugaaccca

SEQ ID NO: 1254133 - RNA, 14 nt, Human
cuuaggaagagaaa

SEQ ID NO: 1254134 - RNA, 23 nt, Human
caaagcaugggccuagcccacug

SEQ ID NO: 1254135 - RNA, 22 nt, Human
gaauuucuucaacucccugccc

SEQ ID NO: 1254136 - RNA, 13 nt, Human
uaucuauuaauau

SEQ ID NO: 1254137 - RNA, 22 nt, Human
gcccaucuccgucucccaaagu

SEQ ID NO: 1254138 - RNA, 23 nt, Human
uguugcccacagcuguaugauuc

SEQ ID NO: 1254139 - RNA, 16 nt, Human
guaauucuaaaugaau

SEQ ID NO: 1254140 - RNA, 15 nt, Human
agaauuuuaaaacuc

SEQ ID NO: 1254141 - RNA, 14 nt, Human
uauauuauuuugaa

SEQ ID NO: 1254142 - RNA, 18 nt, Human
cacuccagugagacagcu

SEQ ID NO: 1254143 - RNA, 15 nt, Human
uuuuaagauaaauua

SEQ ID NO: 1254144 - RNA, 18 nt, Human
ugcugccucuaaaaggcc

SEQ ID NO: 1254145 - RNA, 20 nt, Human
uagcuuuacuguuuguuaug

SEQ ID NO: 1254146 - RNA, 21 nt, Human
uagaaagaagcccaauauuau

SEQ ID NO: 1254147 - RNA, 15 nt, Human
uaaaucuaaaucuau

SEQ ID NO: 1254148 - RNA, 13 nt, Human
agaauauuuauua

SEQ ID NO: 1254149 - RNA, 19 nt, Human
aaauuugccaauuuacuuu

SEQ ID NO: 1254150 - RNA, 15 nt, Human
uggaguaaaucgcua

SEQ ID NO: 1254151 - RNA, 16 nt, Human
auaauuauaauauacu

SEQ ID NO: 1254152 - RNA, 13 nt, Human
ccccagcccuccu

SEQ ID NO: 1254153 - RNA, 14 nt, Human
ucuccugggcagcu

SEQ ID NO: 1254154 - RNA, 13 nt, Human
aauucuaaaugaa

SEQ ID NO: 1254155 - RNA, 15 nt, Human
acaagacccaaaagg

SEQ ID NO: 1254156 - RNA, 19 nt, Human
augaauuacauuuguauaa

SEQ ID NO: 1254157 - RNA, 15 nt, Human
ucuucagaccuagaa

SEQ ID NO: 1254158 - RNA, 20 nt, Human
aacaaugcuguauuuuaaaa

SEQ ID NO: 1254159 - RNA, 17 nt, Human
ucaaauaaguauuuaua

SEQ ID NO: 1254160 - RNA, 23 nt, Human
aaauuuacagagacagaaagcag

SEQ ID NO: 1254161 - RNA, 21 nt, Human
uacauuauuaucaacaauagu

SEQ ID NO: 1254162 - RNA, 18 nt, Human
gagucccaggcugagccu

SEQ ID NO: 1254163 - RNA, 19 nt, Human
gucaaucagccuaguugau

SEQ ID NO: 1254164 - RNA, 23 nt, Human
gaugaaaacauagcaucucagga

SEQ ID NO: 1254165 - RNA, 16 nt, Human
aggguguguaaguaga

SEQ ID NO: 1254166 - RNA, 17 nt, Human
agcugccuccccuccuc

SEQ ID NO: 1254167 - RNA, 18 nt, Human
uagagacuuugugaaaaa

SEQ ID NO: 1254168 - RNA, 23 nt, Human
ccaccucccugcaauaaaauggg

SEQ ID NO: 1254169 - RNA, 22 nt, Human
caaaacugauacccuuugaaaa

SEQ ID NO: 1254170 - RNA, 19 nt, Human
gcuuguauuccuuuuucuc

SEQ ID NO: 1254171 - RNA, 21 nt, Human
aaauaauuuuuauauuugaaa

SEQ ID NO: 1254172 - RNA, 21 nt, Human
uguauaaaauaauuuuuauau

SEQ ID NO: 1254173 - RNA, 16 nt, Human
ucacuuaauccuuugu

SEQ ID NO: 1254174 - RNA, 15 nt, Human
accuguaaucccagc

SEQ ID NO: 1254175 - RNA, 23 nt, Human
cugcaaucugagccagugcuuua

SEQ ID NO: 1254176 - RNA, 14 nt, Human
acccgggaggcaga

SEQ ID NO: 1254177 - RNA, 18 nt, Human
aaacccggccugauuaaa

SEQ ID NO: 1254178 - RNA, 23 nt, Human
auuaaagcuaaaguaucuguauu

SEQ ID NO: 1254179 - RNA, 19 nt, Human
aaauggugaaaugcagagu

SEQ ID NO: 1254180 - RNA, 21 nt, Human
uuuauaauagcaacuuuugug

SEQ ID NO: 1254181 - RNA, 17 nt, Human
cugcacuccagccugag

SEQ ID NO: 1254182 - RNA, 15 nt, Human
acuuuccagagacca

SEQ ID NO: 1254183 - RNA, 23 nt, Human
uccagguagaggguguguaagua

SEQ ID NO: 1254184 - RNA, 17 nt, Human
gccaucccucccuccac

SEQ ID NO: 1254185 - RNA, 18 nt, Human
augguauuugaguguuuu

SEQ ID NO: 1254186 - RNA, 23 nt, Human
uucucucuccuguacuuuuucca

SEQ ID NO: 1254187 - RNA, 22 nt, Human
ugcaauaaaauggguuuuacug

SEQ ID NO: 1254188 - RNA, 14 nt, Human
ugagcaaaaguuga

SEQ ID NO: 1254189 - RNA, 22 nt, Human
gaugcaguuguugcccacagcu

SEQ ID NO: 1254190 - RNA, 22 nt, Human
caaaaacaaacaaacgaaaaac

SEQ ID NO: 1254191 - RNA, 18 nt, Human
auaauauacuauauuuau

SEQ ID NO: 1254192 - RNA, 23 nt, Human
uuuccaucaaggguacacugccu

SEQ ID NO: 1254193 - RNA, 19 nt, Human
cauuuuacuacuuuaaaaa

SEQ ID NO: 1254194 - RNA, 22 nt, Human
uagacacacaugaaguccaagc

SEQ ID NO: 1254195 - RNA, 21 nt, Human
aagaagcccaauauuauaauu

SEQ ID NO: 1254196 - RNA, 16 nt, Human
gcuugccugcaggcau

SEQ ID NO: 1254197 - RNA, 21 nt, Human
ccaaucauuuuaauuauuauu

SEQ ID NO: 1254198 - RNA, 12 nt, Human
aggcuggagugc

SEQ ID NO: 1254199 - RNA, 15 nt, Human
ucccccaucucuucu

SEQ ID NO: 1254200 - RNA, 13 nt, Human
auuuauugcugaa

SEQ ID NO: 1254201 - RNA, 19 nt, Human
uagcaacuuuuguguaaug

SEQ ID NO: 1254202 - RNA, 14 nt, Human
cagcugccuccccu

SEQ ID NO: 1254203 - RNA, 17 nt, Human
ggagcucguggaacagu

SEQ ID NO: 1254204 - RNA, 16 nt, Human
cagcuuuccucaaaac

SEQ ID NO: 1254205 - RNA, 13 nt, Human
uuugccaugcugg

SEQ ID NO: 1254206 - RNA, 19 nt, Human
acagucaccucauggaauu

SEQ ID NO: 1254207 - RNA, 12 nt, Human
gcgcagccaugu

SEQ ID NO: 1254208 - RNA, 17 nt, Human
cguaaucguguccccua

SEQ ID NO: 1254209 - RNA, 16 nt, Human
uaaggcauaagaaaac

SEQ ID NO: 1254210 - RNA, 16 nt, Human
ccuaugcagaggucca

SEQ ID NO: 1254211 - RNA, 20 nt, Human
aauuaaguuuuuuuuuaaaa

SEQ ID NO: 1254212 - RNA, 12 nt, Human
gagugggacagu

SEQ ID NO: 1254213 - RNA, 19 nt, Human
gagccucagucucccuccc

SEQ ID NO: 1254214 - RNA, 15 nt, Human
acucaccucccccau

SEQ ID NO: 1254215 - RNA, 14 nt, Human
auauuuaacauuau

SEQ ID NO: 1254216 - RNA, 16 nt, Human
acucagggagcauuua

SEQ ID NO: 1254217 - RNA, 15 nt, Human
aagaagugaaaaucu

SEQ ID NO: 1254218 - RNA, 19 nt, Human
ccuguaaucauauaauaaa

SEQ ID NO: 1254219 - RNA, 15 nt, Human
auggugaaaugcaga

SEQ ID NO: 1254220 - RNA, 22 nt, Human
cuucagccugaaagaggaauga

SEQ ID NO: 1254221 - RNA, 19 nt, Human
cccugcaaagcccagcuug

SEQ ID NO: 1254222 - RNA, 16 nt, Human
cugagccucagucucc

SEQ ID NO: 1254223 - RNA, 23 nt, Human
aauagcagacaguguuuucuggg

SEQ ID NO: 1254224 - RNA, 15 nt, Human
aucaaaggacaccau

SEQ ID NO: 1254225 - RNA, 18 nt, Human
ugaauaucuauuaauaua

SEQ ID NO: 1254226 - RNA, 14 nt, Human
uuaaguguaacugg

SEQ ID NO: 1254227 - RNA, 17 nt, Human
cccccugcaaagcccag

SEQ ID NO: 1254228 - RNA, 12 nt, Human
cuuccucacacc

SEQ ID NO: 1254229 - RNA, 15 nt, Human
uaaauaaauguaucu

SEQ ID NO: 1254230 - RNA, 21 nt, Human
aauuuuuauauuugaaauauu

SEQ ID NO: 1254231 - RNA, 23 nt, Human
uuguaacuuaugaaccuuuacau

SEQ ID NO: 1254232 - RNA, 17 nt, Human
uacuauuuauugcugaa

SEQ ID NO: 1254233 - RNA, 15 nt, Human
ucaaaggacaccauu

SEQ ID NO: 1254234 - RNA, 15 nt, Human
cuaaaaaacaaagaa

SEQ ID NO: 1254235 - RNA, 21 nt, Human
ugagcucagcccuggugggca

SEQ ID NO: 1254236 - RNA, 14 nt, Human
gccagcaguucaga

SEQ ID NO: 1254237 - RNA, 13 nt, Human
cucgaacugcugg

SEQ ID NO: 1254238 - RNA, 21 nt, Human
ccucuguucugcacacagcac

SEQ ID NO: 1254239 - RNA, 22 nt, Human
auuaugaucucagaaauuguau

SEQ ID NO: 1254240 - RNA, 17 nt, Human
ggaaaaaaaggaagaaa

SEQ ID NO: 1254241 - RNA, 21 nt, Human
gaaacagagaaaauaaaagca

SEQ ID NO: 1254242 - RNA, 19 nt, Human
gauuuuacaauugaaauga

SEQ ID NO: 1254243 - RNA, 20 nt, Human
acuucuuaggguuaugauua

SEQ ID NO: 1254244 - RNA, 23 nt, Human
uuuaguaagagauuccugagcca

SEQ ID NO: 1254245 - RNA, 15 nt, Human
gccucagucucccuc

SEQ ID NO: 1254246 - RNA, 13 nt, Human
uuguauuuuacuu

SEQ ID NO: 1254247 - RNA, 16 nt, Human
gauaaacucagaaauu

SEQ ID NO: 1254248 - RNA, 14 nt, Human
gccgggcauggugg

SEQ ID NO: 1254249 - RNA, 23 nt, Human
aucagcauuuuacuacuuuaaaa

SEQ ID NO: 1254250 - RNA, 16 nt, Human
acaaggaugaauuaag

SEQ ID NO: 1254251 - RNA, 23 nt, Human
caacggggugaaacccugucucu

SEQ ID NO: 1254252 - RNA, 19 nt, Human
accucaguuuuaucauuuu

SEQ ID NO: 1254253 - RNA, 18 nt, Human
agauccccaagccuggca

SEQ ID NO: 1254254 - RNA, 19 nt, Human
agaccuguaaucauauaau

SEQ ID NO: 1254255 - RNA, 15 nt, Human
uuugaaaauaugccu

SEQ ID NO: 1254256 - RNA, 14 nt, Human
cagcagagacgggg

SEQ ID NO: 1254257 - RNA, 21 nt, Human
aaaagcauuguaacuuaugaa

SEQ ID NO: 1254258 - RNA, 18 nt, Human
gccuagcccacuggcucc

SEQ ID NO: 1254259 - RNA, 22 nt, Human
gaugcaguucugaagaagaugg

SEQ ID NO: 1254260 - RNA, 17 nt, Human
agaaacaucaguuacuc

SEQ ID NO: 1254261 - RNA, 23 nt, Human
ugagucagucugaugagaacucu

SEQ ID NO: 1254262 - RNA, 20 nt, Human
uaccaacagugagagcccuu

SEQ ID NO: 1254263 - RNA, 15 nt, Human
uccagauccuggaaa

SEQ ID NO: 1254264 - RNA, 20 nt, Human
ccauacuaauuauacccccu

SEQ ID NO: 1254265 - RNA, 23 nt, Human
caugcugucuacacuaagagaga

SEQ ID NO: 1254266 - RNA, 16 nt, Human
caucuagcaaauguua

SEQ ID NO: 1254267 - RNA, 16 nt, Human
gaaggcuuacacccac

SEQ ID NO: 1254268 - RNA, 12 nt, Human
auuuucaaaaug

SEQ ID NO: 1254269 - RNA, 17 nt, Human
ccucugggucucagugu

SEQ ID NO: 1254270 - RNA, 22 nt, Human
ucuccagagggaauugcagagu

SEQ ID NO: 1254271 - RNA, 15 nt, Human
cauuccaagccucau

SEQ ID NO: 1254272 - RNA, 17 nt, Human
uaauuuuuauauuugaa

SEQ ID NO: 1254273 - RNA, 16 nt, Human
gaguggguuucacaag

SEQ ID NO: 1254274 - RNA, 14 nt, Human
uucacaagugaaaa

SEQ ID NO: 1254275 - RNA, 22 nt, Human
gaggggagcaugggaagugacg

SEQ ID NO: 1254276 - RNA, 22 nt, Human
gagucccaggcugagccucagu

SEQ ID NO: 1254277 - RNA, 14 nt, Human
uaucauuuucaaaa

SEQ ID NO: 1254278 - RNA, 19 nt, Human
ccccugagcuugcagagau

SEQ ID NO: 1254279 - RNA, 18 nt, Human
cccaagccuggcaaggga

SEQ ID NO: 1254280 - RNA, 13 nt, Human
acggggugaaacc

SEQ ID NO: 1254281 - RNA, 15 nt, Human
acuuaugaaccuuua

SEQ ID NO: 1254282 - RNA, 15 nt, Human
caggcagcuuuuucu

SEQ ID NO: 1254283 - RNA, 18 nt, Human
aucuucagaccuagaaua

SEQ ID NO: 1254284 - RNA, 21 nt, Human
cuuucaucuuggucacauaca

SEQ ID NO: 1254285 - RNA, 14 nt, Human
auuggacuuaaaau

SEQ ID NO: 1254286 - RNA, 15 nt, Human
uugacccacaagaaa

SEQ ID NO: 1254287 - RNA, 20 nt, Human
accaaucauuuuaauuauua

SEQ ID NO: 1254288 - RNA, 22 nt, Human
uucuaauagaacucaguuuuaa

SEQ ID NO: 1254289 - RNA, 22 nt, Human
cugcuugccaucccucccucca

SEQ ID NO: 1254290 - RNA, 20 nt, Human
cccugccccccagcccuccu

SEQ ID NO: 1254291 - RNA, 22 nt, Human
cuuguaaaguacagacuuuuuu

SEQ ID NO: 1254292 - RNA, 18 nt, Human
uccuacaagcuaaaauua

SEQ ID NO: 1254293 - RNA, 21 nt, Human
cauuuuacuacuuuaaaaaaa

SEQ ID NO: 1254294 - RNA, 14 nt, Human
ugaaacaagaagcc

SEQ ID NO: 1254295 - RNA, 21 nt, Human
ucaugccccuguacuccagcc

SEQ ID NO: 1254296 - RNA, 16 nt, Human
ucaaaagaaagaaaau

SEQ ID NO: 1254297 - RNA, 15 nt, Human
uugaaauagugucug

SEQ ID NO: 1254298 - RNA, 17 nt, Human
cauucaaaaguugaaau

SEQ ID NO: 1254299 - RNA, 15 nt, Human
cugcacuccagccug

SEQ ID NO: 1254300 - RNA, 21 nt, Human
cugggauagcugacccagccc

SEQ ID NO: 1254301 - RNA, 20 nt, Human
aaggaugccccgucccccuc

SEQ ID NO: 1254302 - RNA, 16 nt, Human
ucaaauaaguauuuau

SEQ ID NO: 1254303 - RNA, 16 nt, Human
aauuuaagauuuuguu

SEQ ID NO: 1254304 - RNA, 17 nt, Human
aaaugcuguauucuucu

SEQ ID NO: 1254305 - RNA, 17 nt, Human
ucuccuguacuuuuucc

SEQ ID NO: 1254306 - RNA, 14 nt, Human
aauggcuaagcaaa

SEQ ID NO: 1254307 - RNA, 22 nt, Human
gcuucucauccugcaggcagcu

SEQ ID NO: 1254308 - RNA, 20 nt, Human
cuacuuccccuuccuaauuc

SEQ ID NO: 1254309 - RNA, 23 nt, Human
ucacaccaggcuugccugcaggc

SEQ ID NO: 1254310 - RNA, 20 nt, Human
ccugccuaagugcagccccg

SEQ ID NO: 1254311 - RNA, 20 nt, Human
auuauaauuuuuuucaauau

SEQ ID NO: 1254312 - RNA, 23 nt, Human
ggggagccaacagaagcuuccau

SEQ ID NO: 1254313 - RNA, 18 nt, Human
uucuagcuguugagcugu

SEQ ID NO: 1254314 - RNA, 23 nt, Human
ccaggagauggaaguugcaguga

SEQ ID NO: 1254315 - RNA, 15 nt, Human
aacuauggaaaaaaa

SEQ ID NO: 1254316 - RNA, 12 nt, Human
cccucuccuggg

SEQ ID NO: 1254317 - RNA, 15 nt, Human
auccuaauaaaaagg

SEQ ID NO: 1254318 - RNA, 15 nt, Human
uggcgcgcaccugua

SEQ ID NO: 1254319 - RNA, 15 nt, Human
gccuguaaucccagc

SEQ ID NO: 1254320 - RNA, 14 nt, Human
uacaguaauuuuaa

SEQ ID NO: 1254321 - RNA, 15 nt, Human
cacuaugguauuuga

SEQ ID NO: 1254322 - RNA, 20 nt, Human
uuguagguaauauugcaagg

SEQ ID NO: 1254323 - RNA, 20 nt, Human
uuaugugcaauaaaauguau

SEQ ID NO: 1254324 - RNA, 11 nt, Human
gccaugggaca

SEQ ID NO: 1254325 - RNA, 19 nt, Human
aagcauuccaacuaucuca

SEQ ID NO: 1254326 - RNA, 18 nt, Human
ccugcaaagcccagcuug

SEQ ID NO: 1254327 - RNA, 17 nt, Human
uauaauuuuuuucaaua

SEQ ID NO: 1254328 - RNA, 20 nt, Human
cugaagaguggguuucacaa

SEQ ID NO: 1254329 - RNA, 20 nt, Human
caugagagacagcaggucuc

SEQ ID NO: 1254330 - RNA, 15 nt, Human
cucguggaacaguua

SEQ ID NO: 1254331 - RNA, 15 nt, Human
caucaguuacucuga

SEQ ID NO: 1254332 - RNA, 15 nt, Human
ugauuucauucaaua

SEQ ID NO: 1254333 - RNA, 13 nt, Human
ggucucccucugu

SEQ ID NO: 1254334 - RNA, 18 nt, Human
aaauauauuuaagauaau

SEQ ID NO: 1254335 - RNA, 21 nt, Human
cuauuuauuuauuuauuugag

SEQ ID NO: 1254336 - RNA, 18 nt, Human
ucuucaacucccugcccc

SEQ ID NO: 1254337 - RNA, 18 nt, Human
cuuuacuguuagucauuu

SEQ ID NO: 1254338 - RNA, 22 nt, Human
gaaauaagccagacaucaacag

SEQ ID NO: 1254339 - RNA, 22 nt, Human
auagagacuuugugaaaaaaaa

SEQ ID NO: 1254340 - RNA, 22 nt, Human
gucucuacuaaaaauacaaaaa

SEQ ID NO: 1254341 - RNA, 18 nt, Human
uuccauagagacuuugug

SEQ ID NO: 1254342 - RNA, 14 nt, Human
gagcucagcccugg

SEQ ID NO: 1254343 - RNA, 22 nt, Human
gaauaauacuagucuuauaaua

SEQ ID NO: 1254344 - RNA, 14 nt, Human
cuggccgggagccu

SEQ ID NO: 1254345 - RNA, 18 nt, Human
uuugacaagguucuuccc

SEQ ID NO: 1254346 - RNA, 18 nt, Human
cugggcagcugccucccc

SEQ ID NO: 1254347 - RNA, 22 nt, Human
ugaauggcuaagcaaaauguga

SEQ ID NO: 1254348 - RNA, 18 nt, Human
ucugggucucaguguccu

SEQ ID NO: 1254349 - RNA, 21 nt, Human
cuggucucgaacugcuggauu

SEQ ID NO: 1254350 - RNA, 15 nt, Human
cuuuggggagccaac

SEQ ID NO: 1254351 - RNA, 18 nt, Human
auaaauguaucuuauuca

SEQ ID NO: 1254352 - RNA, 21 nt, Human
cuaccaaaaaucucaauauuu

SEQ ID NO: 1254353 - RNA, 16 nt, Human
acgccuguaaucccag

SEQ ID NO: 1254354 - RNA, 16 nt, Human
aagggaggaaaaaaaa

SEQ ID NO: 1254355 - RNA, 16 nt, Human
ucaaagccaaguuuau

SEQ ID NO: 1254356 - RNA, 22 nt, Human
cuggagcuugaaauagugucug

SEQ ID NO: 1254357 - RNA, 14 nt, Human
aaauuggacuuaaa

SEQ ID NO: 1254358 - RNA, 13 nt, Human
acaagagcuuaac

SEQ ID NO: 1254359 - RNA, 19 nt, Human
gaggacuugggcgggacac

SEQ ID NO: 1254360 - RNA, 20 nt, Human
ugagucccaggcugagccuc

SEQ ID NO: 1254361 - RNA, 18 nt, Human
cucuacuaaaaauacaaa

SEQ ID NO: 1254362 - RNA, 14 nt, Human
aucaaaagaaagaa

SEQ ID NO: 1254363 - RNA, 16 nt, Human
ugguacuagauacuga

SEQ ID NO: 1254364 - RNA, 16 nt, Human
agacaaauucuguuuc

SEQ ID NO: 1254365 - RNA, 16 nt, Human
gacaacugugacugua

SEQ ID NO: 1254366 - RNA, 23 nt, Human
agcuuuuuuuuuuuuucuuaaag

SEQ ID NO: 1254367 - RNA, 14 nt, Human
auggugugcuggcu

SEQ ID NO: 1254368 - RNA, 15 nt, Human
uggcucacgccugua

SEQ ID NO: 1254369 - RNA, 18 nt, Human
ucacgccuguaaucccag

SEQ ID NO: 1254370 - RNA, 12 nt, Human
ucacauacaauu

SEQ ID NO: 1254371 - RNA, 22 nt, Human
ccucuaauuuaucuugucucug

SEQ ID NO: 1254372 - RNA, 19 nt, Human
aauuaauggaauauguaaa

SEQ ID NO: 1254373 - RNA, 14 nt, Human
acaucuuucacauu

SEQ ID NO: 1254374 - RNA, 15 nt, Human
accugacagcccaag

SEQ ID NO: 1254375 - RNA, 12 nt, Human
uauaaauaaaau

SEQ ID NO: 1254376 - RNA, 20 nt, Human
uugaacccgggaggcagagg

SEQ ID NO: 1254377 - RNA, 22 nt, Human
cgcaccuguaaucccagcuacu

SEQ ID NO: 1254378 - RNA, 21 nt, Human
auuaucuaucuaucuauuuau

SEQ ID NO: 1254379 - RNA, 20 nt, Human
aacucugcauucuaguacuu

SEQ ID NO: 1254380 - RNA, 15 nt, Human
caaaaaccaaauuug

SEQ ID NO: 1254381 - RNA, 16 nt, Human
aaauaaguauuuauaa

SEQ ID NO: 1254382 - RNA, 22 nt, Human
cauuaaaacaauauuguuucua

SEQ ID NO: 1254383 - RNA, 18 nt, Human
ugaucagaccauaauguu

SEQ ID NO: 1254384 - RNA, 16 nt, Human
caaauuccagaaugau

SEQ ID NO: 1254385 - RNA, 14 nt, Human
uugcagugagcuga

SEQ ID NO: 1254386 - RNA, 18 nt, Human
uaagaaaacuaagaaaua

SEQ ID NO: 1254387 - RNA, 22 nt, Human
caucucuucuggguuccuuccu

SEQ ID NO: 1254388 - RNA, 22 nt, Human
ugauuuuacggagauaucccag

SEQ ID NO: 1254389 - RNA, 14 nt, Human
aagaaugacuaugc

SEQ ID NO: 1254390 - RNA, 11 nt, Human
accauuuuuac

SEQ ID NO: 1254391 - RNA, 19 nt, Human
ucaucaaucaaauaaguau

SEQ ID NO: 1254392 - RNA, 13 nt, Human
acaacauuaaaac

SEQ ID NO: 1254393 - RNA, 18 nt, Human
acugauggguuucuccag

SEQ ID NO: 1254394 - RNA, 22 nt, Human
auuuuaauuuugaauaaauaaa

SEQ ID NO: 1254395 - RNA, 22 nt, Human
caaacagaacuauggaaaaaaa

SEQ ID NO: 1254396 - RNA, 17 nt, Human
cauucugcuuucaucuu

SEQ ID NO: 1254397 - RNA, 18 nt, Human
uaacuagaauuuauucaa

SEQ ID NO: 1254398 - RNA, 20 nt, Human
aauaauuuuuauauuugaaa

SEQ ID NO: 1254399 - RNA, 22 nt, Human
ggcauuuaggccaugggacagg

SEQ ID NO: 1254400 - RNA, 13 nt, Human
gcagccaaccuaa

SEQ ID NO: 1254401 - RNA, 16 nt, Human
uauguaccauguacau

SEQ ID NO: 1254402 - RNA, 15 nt, Human
uuuaaguaauuucag

SEQ ID NO: 1254403 - RNA, 21 nt, Human
uauguauuauuuauaauuccu

SEQ ID NO: 1254404 - RNA, 18 nt, Human
acauuugcucauggaauu

SEQ ID NO: 1254405 - RNA, 12 nt, Human
guauuauuuaua

SEQ ID NO: 1254406 - RNA, 16 nt, Human
cucuuuuuagagaaau

SEQ ID NO: 1254407 - RNA, 14 nt, Human
gcaguucagagcug

SEQ ID NO: 1254408 - RNA, 19 nt, Human
caaaugcuuaugaaacuaa

SEQ ID NO: 1254409 - RNA, 20 nt, Human
gccgggcgugguggugagug

SEQ ID NO: 1254410 - RNA, 13 nt, Human
cuugccugcaggc

SEQ ID NO: 1254411 - RNA, 16 nt, Human
aagaaugagaagaaug

SEQ ID NO: 1254412 - RNA, 13 nt, Human
ucaucauaaaaua

SEQ ID NO: 1254413 - RNA, 15 nt, Human
auuucauucaauauc

SEQ ID NO: 1254414 - RNA, 15 nt, Human
ucuuuucucugccuu

SEQ ID NO: 1254415 - RNA, 22 nt, Human
acacagugucuggcacuuggga

SEQ ID NO: 1254416 - RNA, 16 nt, Human
cugcugagucccaggc

SEQ ID NO: 1254417 - RNA, 15 nt, Human
caagcucacagaccu

SEQ ID NO: 1254418 - RNA, 14 nt, Human
gccugucccugcag

SEQ ID NO: 1254419 - RNA, 16 nt, Human
uucacauccuguguuu

SEQ ID NO: 1254420 - RNA, 18 nt, Human
uacauacugcugucuaug

SEQ ID NO: 1254421 - RNA, 14 nt, Human
uuauaaguuacaua

SEQ ID NO: 1254422 - RNA, 17 nt, Human
uguaaugaaaaugaaua

SEQ ID NO: 1254423 - RNA, 13 nt, Human
cucaaaaaauaaa

SEQ ID NO: 1254424 - RNA, 14 nt, Human
aacauuauuuauau

SEQ ID NO: 1254425 - RNA, 16 nt, Human
agugggacaguuccug

SEQ ID NO: 1254426 - RNA, 21 nt, Human
ugcccauccugccccugagcc

SEQ ID NO: 1254427 - RNA, 15 nt, Human
uauccuaauaaaaag

SEQ ID NO: 1254428 - RNA, 11 nt, Human
uaaaaauaaau

SEQ ID NO: 1254429 - RNA, 19 nt, Human
gcuugccaucccucccucc

SEQ ID NO: 1254430 - RNA, 14 nt, Human
uauuugaauuuuaa

SEQ ID NO: 1254431 - RNA, 19 nt, Human
cagcuuuuucucucccacu

SEQ ID NO: 1254432 - RNA, 22 nt, Human
ucgucgucuugacuuuggcaaa

SEQ ID NO: 1254433 - RNA, 23 nt, Human
caaaagguauuuauugagcaccu

SEQ ID NO: 1254434 - RNA, 12 nt, Human
uuuuuguaaguu

SEQ ID NO: 1254435 - RNA, 18 nt, Human
guuucaaacauauauaac

SEQ ID NO: 1254436 - RNA, 16 nt, Human
ugagcucagcccuggu

SEQ ID NO: 1254437 - RNA, 21 nt, Human
auuccuauauccugugacugu

SEQ ID NO: 1254438 - RNA, 15 nt, Human
uagggugauauuaac

SEQ ID NO: 1254439 - RNA, 19 nt, Human
ccccuauccuacuuccccu

SEQ ID NO: 1254440 - RNA, 14 nt, Human
aucauauaauaaau

SEQ ID NO: 1254441 - RNA, 16 nt, Human
ccucagucucccuccc

SEQ ID NO: 1254442 - RNA, 14 nt, Human
aucaugcaucuuac

SEQ ID NO: 1254443 - RNA, 20 nt, Human
ucaucugugauucccuccug

SEQ ID NO: 1254444 - RNA, 12 nt, Human
cuuuaauuucau

SEQ ID NO: 1254445 - RNA, 20 nt, Human
cuuuuuuuuuuuuuuaaaca

SEQ ID NO: 1254446 - RNA, 23 nt, Human
uuagaugcaguucugaagaagau

SEQ ID NO: 1254447 - RNA, 17 nt, Human
cugauuaaaguuaaaua

SEQ ID NO: 1254448 - RNA, 15 nt, Human
augagaccacuguua

SEQ ID NO: 1254449 - RNA, 22 nt, Human
agacucgggauuaguacacacu

SEQ ID NO: 1254450 - RNA, 16 nt, Human
ugguagggggaaaaug

SEQ ID NO: 1254451 - RNA, 11 nt, Human
uccucuuucaa

SEQ ID NO: 1254452 - RNA, 24 nt, Human
uuuucgaugguacauauuucuuug

SEQ ID NO: 1254453 - RNA, 18 nt, Human
ugcuggauucaagugauc

SEQ ID NO: 1254454 - RNA, 20 nt, Human
auuaaggcauaagaaaacua

SEQ ID NO: 1254455 - RNA, 13 nt, Human
uuuaaaaaaaaac

SEQ ID NO: 1254456 - RNA, 22 nt, Human
aauuuuuucucuaggaaauauu

SEQ ID NO: 1254457 - RNA, 19 nt, Human
ugaguuuuugauagcuuua

SEQ ID NO: 1254458 - RNA, 12 nt, Human
cagauuuuccug

SEQ ID NO: 1254459 - RNA, 19 nt, Human
cauggaauuggagcucgug

SEQ ID NO: 1254460 - RNA, 21 nt, Human
auuuauauggggaauauauuu

SEQ ID NO: 1254461 - RNA, 15 nt, Human
cuacaagcuaaaauu

SEQ ID NO: 1254462 - RNA, 19 nt, Human
auuaaguuuuuuuuuaaaa

SEQ ID NO: 1254463 - RNA, 14 nt, Human
auaaauauauuuaa

SEQ ID NO: 1254464 - RNA, 14 nt, Human
aaaaauaaaaauaa

SEQ ID NO: 1254465 - RNA, 16 nt, Human
ugacacuuaaaaaugg

SEQ ID NO: 1254466 - RNA, 23 nt, Human
uccuuaucacugacacaaaaagu

SEQ ID NO: 1254467 - RNA, 16 nt, Human
uauguucuaagaagug

SEQ ID NO: 1254468 - RNA, 13 nt, Human
cugccuccccucc

SEQ ID NO: 1254469 - RNA, 15 nt, Human
augcuggccaggcug

SEQ ID NO: 1254470 - RNA, 15 nt, Human
cagacagaacuugaa

SEQ ID NO: 1254471 - RNA, 12 nt, Human
cauauaauguug

SEQ ID NO: 1254472 - RNA, 20 nt, Human
uuccugaccuaugaaacaga

SEQ ID NO: 1254473 - RNA, 16 nt, Human
agagguccacaacaca

SEQ ID NO: 1254474 - RNA, 15 nt, Human
aauaucuaauauaua

SEQ ID NO: 1254475 - RNA, 14 nt, Human
gcugggaauuacag

SEQ ID NO: 1254476 - RNA, 16 nt, Human
cacuuuuuuucuuuuc

SEQ ID NO: 1254477 - RNA, 13 nt, Human
uggccaggcuggu

SEQ ID NO: 1254478 - RNA, 11 nt, Human
cuuugccuuua

SEQ ID NO: 1254479 - RNA, 18 nt, Human
aagacaacauuaaaacaa

SEQ ID NO: 1254480 - RNA, 23 nt, Human
auucucucuccuguacuuuuucc

SEQ ID NO: 1254481 - RNA, 12 nt, Human
cacaacacacag

SEQ ID NO: 1254482 - RNA, 16 nt, Human
ggcagcuuuuucucuc

SEQ ID NO: 1254483 - RNA, 15 nt, Human
acucuuuugccauua

SEQ ID NO: 1254484 - RNA, 22 nt, Human
caguguccucaucuguaaaaug

SEQ ID NO: 1254485 - RNA, 18 nt, Human
cccacuggacucaccucc

SEQ ID NO: 1254486 - RNA, 17 nt, Human
acuuccagauccuggaa

SEQ ID NO: 1254487 - RNA, 23 nt, Human
uauaugugaaauaaaaguagaau

SEQ ID NO: 1254488 - RNA, 21 nt, Human
ugugaucagaccauaauguua

SEQ ID NO: 1254489 - RNA, 20 nt, Human
uugcaaccuccaccuucugg

SEQ ID NO: 1254490 - RNA, 22 nt, Human
uuauuuauaacaaccuaaauuu

SEQ ID NO: 1254491 - RNA, 19 nt, Human
agggaauugcagaguacug

SEQ ID NO: 1254492 - RNA, 16 nt, Human
cacuggacucaccucc

SEQ ID NO: 1254493 - RNA, 22 nt, Human
gucacaggaaguagaggaggcc

SEQ ID NO: 1254494 - RNA, 14 nt, Human
ccaaauuuguauuu

SEQ ID NO: 1254495 - RNA, 16 nt, Human
ucucuauuaggaaaua

SEQ ID NO: 1254496 - RNA, 16 nt, Human
aauuucuucaacuccc

SEQ ID NO: 1254497 - RNA, 21 nt, Human
uuuucgaugguacauauuucu

SEQ ID NO: 1254498 - RNA, 14 nt, Human
cuuggucugugaga

SEQ ID NO: 1254499 - RNA, 14 nt, Human
ugaucaccugcccu

SEQ ID NO: 1254500 - RNA, 19 nt, Human
ggagccugaucaccugccc

SEQ ID NO: 1254501 - RNA, 12 nt, Human
gcuauucacaac

SEQ ID NO: 1254502 - RNA, 15 nt, Human
auuugaguguuuuaa

SEQ ID NO: 1254503 - RNA, 15 nt, Human
caguuuuaucauuuu

SEQ ID NO: 1254504 - RNA, 22 nt, Human
uucaauaucuuuuuuuuaauaa

SEQ ID NO: 1254505 - RNA, 17 nt, Human
cagugcuuggcccagga

SEQ ID NO: 1254506 - RNA, 17 nt, Human
cugcaggcgugaccuga

SEQ ID NO: 1254507 - RNA, 17 nt, Human
cauuguuugucugucuu

SEQ ID NO: 1254508 - RNA, 12 nt, Human
ugaugaaaacau

SEQ ID NO: 1254509 - RNA, 12 nt, Human
acaagaaaugaa

SEQ ID NO: 1254510 - RNA, 18 nt, Human
cuuuccacagaagcucca

SEQ ID NO: 1254511 - RNA, 16 nt, Human
cacuuaaaaaugguuu

SEQ ID NO: 1254512 - RNA, 17 nt, Human
uugugaagcaaaauuuu

SEQ ID NO: 1254513 - RNA, 16 nt, Human
auuucuauuuauuuac

SEQ ID NO: 1254514 - RNA, 19 nt, Human
uagaaaaagcaguaacuga

SEQ ID NO: 1254515 - RNA, 18 nt, Human
cuccauccugaggcucca

SEQ ID NO: 1254516 - RNA, 20 nt, Human
cccuuccuaauuccacagcu

SEQ ID NO: 1254517 - RNA, 17 nt, Human
aguauuucuaugaaaua

SEQ ID NO: 1254518 - RNA, 18 nt, Human
ugucuggacuuuccagag

SEQ ID NO: 1254519 - RNA, 14 nt, Human
ugcuuguuagcaaa

SEQ ID NO: 1254520 - RNA, 17 nt, Human
uuuuuccagacacuuuu

SEQ ID NO: 1254521 - RNA, 22 nt, Human
ucuggguuccuuccucugagcc

SEQ ID NO: 1254522 - RNA, 21 nt, Human
ucaccugggcugaggcauccu

SEQ ID NO: 1254523 - RNA, 16 nt, Human
uuuucaaaauuggacu

SEQ ID NO: 1254524 - RNA, 21 nt, Human
uuucaaaacucauuuccuaug

SEQ ID NO: 1254525 - RNA, 13 nt, Human
aacucccugcccc

SEQ ID NO: 1254526 - RNA, 16 nt, Human
ugcaauacuucaauac

SEQ ID NO: 1254527 - RNA, 17 nt, Human
aguaauuucagaagaaa

SEQ ID NO: 1254528 - RNA, 20 nt, Human
agauuuuuaaauaaagaauu

SEQ ID NO: 1254529 - RNA, 18 nt, Human
uuauuuagggaacugcuu

SEQ ID NO: 1254530 - RNA, 22 nt, Human
aggaugccccgucccccucugg

SEQ ID NO: 1254531 - RNA, 22 nt, Human
aggcuccacuuggucugugaga

SEQ ID NO: 1254532 - RNA, 23 nt, Human
ucaggaguuccuaaccagccugg

SEQ ID NO: 1254533 - RNA, 16 nt, Human
auacaauuauuuuuac

SEQ ID NO: 1254534 - RNA, 19 nt, Human
cugcuugccaucccucccu

SEQ ID NO: 1254535 - RNA, 16 nt, Human
cucaauaaaguacaag

SEQ ID NO: 1254536 - RNA, 16 nt, Human
aguagauuaagagaug

SEQ ID NO: 1254537 - RNA, 20 nt, Human
aaauuaaggcauaagaaaac

SEQ ID NO: 1254538 - RNA, 21 nt, Human
uagcagacaguguuuucuggg

SEQ ID NO: 1254539 - RNA, 19 nt, Human
gagccugaucaccugcccu

SEQ ID NO: 1254540 - RNA, 16 nt, Human
uguauuuauuuuuuua

SEQ ID NO: 1254541 - RNA, 18 nt, Human
aauucacaaguuguguuu

SEQ ID NO: 1254542 - RNA, 14 nt, Human
acucagaaacauca

SEQ ID NO: 1254543 - RNA, 16 nt, Human
auugucuagugaaacu

SEQ ID NO: 1254544 - RNA, 19 nt, Human
gacagucaccucauggaau

SEQ ID NO: 1254545 - RNA, 17 nt, Human
uaagaaauaugcacaau

SEQ ID NO: 1254546 - RNA, 14 nt, Human
uccuaguaauuuaa

SEQ ID NO: 1254547 - RNA, 18 nt, Human
agucagucugaugagaac

SEQ ID NO: 1254548 - RNA, 22 nt, Human
auguacauuuccaaauucacaa

SEQ ID NO: 1254549 - RNA, 17 nt, Human
augcacacagugcuuuc

SEQ ID NO: 1254550 - RNA, 11 nt, Human
uauuauuuaua

SEQ ID NO: 1254551 - RNA, 14 nt, Human
gaaaggagaaguua

SEQ ID NO: 1254552 - RNA, 22 nt, Human
cuccugccuaagugcagccccg

SEQ ID NO: 1254553 - RNA, 13 nt, Human
cuguacuuuuucc

SEQ ID NO: 1254554 - RNA, 18 nt, Human
caugagaccacuguuauc

SEQ ID NO: 1254555 - RNA, 22 nt, Human
uugacccacaagaaaugaaagc

SEQ ID NO: 1254556 - RNA, 21 nt, Human
cuaaaucuauuuauuaauauu

SEQ ID NO: 1254557 - RNA, 12 nt, Human
uuuuuuuuaaac

SEQ ID NO: 1254558 - RNA, 14 nt, Human
acauauauaacaau

SEQ ID NO: 1254559 - RNA, 19 nt, Human
uucucuaacucagaaacau

SEQ ID NO: 1254560 - RNA, 22 nt, Human
cuucaacucccugccccccagc

SEQ ID NO: 1254561 - RNA, 15 nt, Human
caaauucuguuucuu

SEQ ID NO: 1254562 - RNA, 14 nt, Human
uccaccucccugca

SEQ ID NO: 1254563 - RNA, 18 nt, Human
ucucaaaaaauaaaaaua

SEQ ID NO: 1254564 - RNA, 22 nt, Human
aaacauccuacaagacacagug

SEQ ID NO: 1254565 - RNA, 19 nt, Human
auacuaauuauacccccug

SEQ ID NO: 1254566 - RNA, 14 nt, Human
ggcugggaguggca

SEQ ID NO: 1254567 - RNA, 17 nt, Human
cugauggguuucuccag

SEQ ID NO: 1254568 - RNA, 15 nt, Human
gaccacugcagaaga

SEQ ID NO: 1254569 - RNA, 13 nt, Human
aauauuuaacauu

SEQ ID NO: 1254570 - RNA, 20 nt, Human
gcuguaucuuguuuuuccac

SEQ ID NO: 1254571 - RNA, 13 nt, Human
cucugagccuugg

SEQ ID NO: 1254572 - RNA, 19 nt, Human
uacaauuauuuuuacaguu

SEQ ID NO: 1254573 - RNA, 15 nt, Human
auuaaauauaauaug

SEQ ID NO: 1254574 - RNA, 13 nt, Human
accuagaauaaua

SEQ ID NO: 1254575 - RNA, 21 nt, Human
acagcccuucuuuccacagaa

SEQ ID NO: 1254576 - RNA, 22 nt, Human
cugaggcauccuuccucacacc

SEQ ID NO: 1254577 - RNA, 15 nt, Human
aaauaauuuuuauau

SEQ ID NO: 1254578 - RNA, 14 nt, Human
ccucagucucccuc

SEQ ID NO: 1254579 - RNA, 18 nt, Human
cugcagacaugagagaca

SEQ ID NO: 1254580 - RNA, 12 nt, Human
agcccaauauua

SEQ ID NO: 1254581 - RNA, 14 nt, Human
cagugucaggagga

SEQ ID NO: 1254582 - RNA, 14 nt, Human
gcugccuccccucc

SEQ ID NO: 1254583 - RNA, 22 nt, Human
cagcccuggugggcagagaggu

SEQ ID NO: 1254584 - RNA, 18 nt, Human
gagcccuucaugcauuug

SEQ ID NO: 1254585 - RNA, 14 nt, Human
ugagaugcuagaac

SEQ ID NO: 1254586 - RNA, 21 nt, Human
ucucuggcgacaguuuuccuu

SEQ ID NO: 1254587 - RNA, 22 nt, Human
uguaauuaaucuuguaaauaua

SEQ ID NO: 1254588 - RNA, 14 nt, Human
aagggucucccucu

SEQ ID NO: 1254589 - RNA, 14 nt, Human
uuucuaugaaauau

SEQ ID NO: 1254590 - RNA, 14 nt, Human
agccagcaguucag

SEQ ID NO: 1254591 - RNA, 21 nt, Human
uuauaauauacuauauuuaug

SEQ ID NO: 1254592 - RNA, 13 nt, Human
ccagcacagccuc

SEQ ID NO: 1254593 - RNA, 12 nt, Human
auuauuauuuau

SEQ ID NO: 1254594 - RNA, 17 nt, Human
augcacuuuauauuauu

SEQ ID NO: 1254595 - RNA, 19 nt, Human
cugcuggauguggaggggg

SEQ ID NO: 1254596 - RNA, 22 nt, Human
caaucaaauaaguauuuauaau

SEQ ID NO: 1254597 - RNA, 14 nt, Human
uguaacugcauuga

SEQ ID NO: 1254598 - RNA, 19 nt, Human
guacugagagugaacaaau

SEQ ID NO: 1254599 - RNA, 12 nt, Human
uucucuaggaaa

SEQ ID NO: 1254600 - RNA, 16 nt, Human
caaccacuucauucuu

SEQ ID NO: 1254601 - RNA, 17 nt, Human
agaacucccuuucaaca

SEQ ID NO: 1254602 - RNA, 17 nt, Human
uaauuuaugaguuuuug

SEQ ID NO: 1254603 - RNA, 19 nt, Human
ucaauucuauuacgugcaa

SEQ ID NO: 1254604 - RNA, 20 nt, Human
acaccaccacccuugccaug

SEQ ID NO: 1254605 - RNA, 22 nt, Human
aguguugacaguucauauguac

SEQ ID NO: 1254606 - RNA, 14 nt, Human
acaggcgugagcca

SEQ ID NO: 1254607 - RNA, 19 nt, Human
gauccgcccaucuccgucu

SEQ ID NO: 1254608 - RNA, 14 nt, Human
cucugccucagaaa

SEQ ID NO: 1254609 - RNA, 17 nt, Human
uaucaauuuaaaaaaaa

SEQ ID NO: 1254610 - RNA, 16 nt, Human
gcagcugccuccccuc

SEQ ID NO: 1254611 - RNA, 18 nt, Human
caccuguccccgaaacua

SEQ ID NO: 1254612 - RNA, 19 nt, Human
uggcaagcucuaucaccaa

SEQ ID NO: 1254613 - RNA, 17 nt, Human
uaacugcauugagaacu

SEQ ID NO: 1254614 - RNA, 23 nt, Human
ccagccugggugacagagcaaga

SEQ ID NO: 1254615 - RNA, 19 nt, Human
agagacgggguuugccaug

SEQ ID NO: 1254616 - RNA, 17 nt, Human
gacaaaugcuuaugaaa

SEQ ID NO: 1254617 - RNA, 14 nt, Human
cuuuccagagacca

SEQ ID NO: 1254618 - RNA, 15 nt, Human
aauuccaggaaaauc

SEQ ID NO: 1254619 - RNA, 13 nt, Human
uauuuauuuuaau

SEQ ID NO: 1254620 - RNA, 14 nt, Human
cucuggcuccagcu

SEQ ID NO: 1254621 - RNA, 20 nt, Human
gagccugaucaccugcccug

SEQ ID NO: 1254622 - RNA, 15 nt, Human
ccuugguauagcaua

SEQ ID NO: 1254623 - RNA, 22 nt, Human
gaauuaaguuuuuuuuuaaaaa

SEQ ID NO: 1254624 - RNA, 14 nt, Human
auuccaccugcaau

SEQ ID NO: 1254625 - RNA, 16 nt, Human
uaacucagaaacauca

SEQ ID NO: 1254626 - RNA, 15 nt, Human
auuuauuuuuuuacu

SEQ ID NO: 1254627 - RNA, 13 nt, Human
caucccucccucc

SEQ ID NO: 1254628 - RNA, 23 nt, Human
auucaauaucuuuuuuuuaauaa

SEQ ID NO: 1254629 - RNA, 22 nt, Human
auucuugaaagcuguggccagc

SEQ ID NO: 1254630 - RNA, 17 nt, Human
agaauugcuugaaccca

SEQ ID NO: 1254631 - RNA, 23 nt, Human
auagcauauguuuuuguaaguuu

SEQ ID NO: 1254632 - RNA, 19 nt, Human
ccuggucgucgucuugacu

SEQ ID NO: 1254633 - RNA, 19 nt, Human
aguucagagcugcccucuc

SEQ ID NO: 1254634 - RNA, 13 nt, Human
acuucacuuuuuu

SEQ ID NO: 1254635 - RNA, 18 nt, Human
aaucauauaauaaaugua

SEQ ID NO: 1254636 - RNA, 17 nt, Human
cuggagggaagccuugg

SEQ ID NO: 1254637 - RNA, 23 nt, Human
aagugauccgcccaucuccgucu

SEQ ID NO: 1254638 - RNA, 14 nt, Human
ccuuaucaaaggac

SEQ ID NO: 1254639 - RNA, 18 nt, Human
guuggaaaaugugcaaua

SEQ ID NO: 1254640 - RNA, 18 nt, Human
aaaagccaaaaaccaaau

SEQ ID NO: 1254641 - RNA, 13 nt, Human
cuauggaaaaaaa

SEQ ID NO: 1254642 - RNA, 22 nt, Human
agcagcauaaauguugacaugg

SEQ ID NO: 1254643 - RNA, 21 nt, Human
cuaaauugacacuuaaaaaug

SEQ ID NO: 1254644 - RNA, 13 nt, Human
aagugcugggaau

SEQ ID NO: 1254645 - RNA, 15 nt, Human
aucaauuuaaaaaaa

SEQ ID NO: 1254646 - RNA, 20 nt, Human
caagaaugagaagaaugacu

SEQ ID NO: 1254647 - RNA, 17 nt, Human
cuggagugcaguggcgc

SEQ ID NO: 1254648 - RNA, 21 nt, Human
cugcuggauucaagugauccg

SEQ ID NO: 1254649 - RNA, 17 nt, Human
aaggaaaucugugucag

SEQ ID NO: 1254650 - RNA, 15 nt, Human
ucacaggacagcccu

SEQ ID NO: 1254651 - RNA, 12 nt, Human
uuauuuuuuaau

SEQ ID NO: 1254652 - RNA, 22 nt, Human
cuagauacugaauguaaacaaa

SEQ ID NO: 1254653 - RNA, 19 nt, Human
aaaaguauaaauaaaauga

SEQ ID NO: 1254654 - RNA, 14 nt, Human
aauguaucuuauuc

SEQ ID NO: 1254655 - RNA, 21 nt, Human
ucaaauuccagaaugauuuua

SEQ ID NO: 1254656 - RNA, 21 nt, Human
acagugauuaccagggacuga

SEQ ID NO: 1254657 - RNA, 13 nt, Human
gguauuugagugu

SEQ ID NO: 1254658 - RNA, 21 nt, Human
cucagugucaaugcagccccc

SEQ ID NO: 1254659 - RNA, 14 nt, Human
acucagaaauuuaa

SEQ ID NO: 1254660 - RNA, 18 nt, Human
auagaauuaacacaugau

SEQ ID NO: 1254661 - RNA, 14 nt, Human
uuuguaauauuucu

SEQ ID NO: 1254662 - RNA, 21 nt, Human
acuugggcgggacacaggcuc

SEQ ID NO: 1254663 - RNA, 20 nt, Human
uuaaguaauuucagaagaaa

SEQ ID NO: 1254664 - RNA, 18 nt, Human
ccugaaagaggaaugaag

SEQ ID NO: 1254665 - RNA, 14 nt, Human
uugccaugugcuag

SEQ ID NO: 1254666 - RNA, 21 nt, Human
aauguuauuuuuuaauuauua

SEQ ID NO: 1254667 - RNA, 15 nt, Human
aaagcguaaagagga

SEQ ID NO: 1254668 - RNA, 18 nt, Human
uaaaucuauuuauuaaua

SEQ ID NO: 1254669 - RNA, 18 nt, Human
auauaauguuguuauuua

SEQ ID NO: 1254670 - RNA, 21 nt, Human
cucaaaacuucagacauagaa

SEQ ID NO: 1254671 - RNA, 19 nt, Human
uuuaaaaaaaaaaaaaaag

SEQ ID NO: 1254672 - RNA, 18 nt, Human
gaggcuccacuuggucug

SEQ ID NO: 1254673 - RNA, 20 nt, Human
gccaauauccuaauaaaaag

SEQ ID NO: 1254674 - RNA, 22 nt, Human
cagaagcuuccauuccaagccu

SEQ ID NO: 1254675 - RNA, 13 nt, Human
ccucauggaauug

SEQ ID NO: 1254676 - RNA, 18 nt, Human
gcuugaggacuugggcgg

SEQ ID NO: 1254677 - RNA, 17 nt, Human
aauaaguauuuauaaua

SEQ ID NO: 1254678 - RNA, 16 nt, Human
auucugcaagcuuuuc

SEQ ID NO: 1254679 - RNA, 18 nt, Human
uucagagcugcccucucc

SEQ ID NO: 1254680 - RNA, 22 nt, Human
cuggguuccuuccucugagccu

SEQ ID NO: 1254681 - RNA, 13 nt, Human
gcucuggaaacca

SEQ ID NO: 1254682 - RNA, 22 nt, Human
uuuuuccccaaaaagaauggga

SEQ ID NO: 1254683 - RNA, 21 nt, Human
auugaaaugacuaaaaaacaa

SEQ ID NO: 1254684 - RNA, 11 nt, Human
augcugccaau

SEQ ID NO: 1254685 - RNA, 18 nt, Human
ccucuccugggcagcugc

SEQ ID NO: 1254686 - RNA, 21 nt, Human
cccugcagacaugagagacag

SEQ ID NO: 1254687 - RNA, 18 nt, Human
uggucaauuuuguuaugu

SEQ ID NO: 1254688 - RNA, 23 nt, Human
cugacuaauuaggcaaggcuaug

SEQ ID NO: 1254689 - RNA, 14 nt, Human
gagaagagaauauu

SEQ ID NO: 1254690 - RNA, 15 nt, Human
auuucuaugaaauau

SEQ ID NO: 1254691 - RNA, 13 nt, Human
gacauaagcaaag

SEQ ID NO: 1254692 - RNA, 19 nt, Human
uauaauuuuuuucaauauu

SEQ ID NO: 1254693 - RNA, 16 nt, Human
aucaaauaaguauuua

SEQ ID NO: 1254694 - RNA, 20 nt, Human
acaguggaaagacagcuucu

SEQ ID NO: 1254695 - RNA, 14 nt, Human
ugagcuugcagaga

SEQ ID NO: 1254696 - RNA, 13 nt, Human
uagauaaacucag

SEQ ID NO: 1254697 - RNA, 15 nt, Human
acagaagcuuccauu

SEQ ID NO: 1254698 - RNA, 16 nt, Human
ugacaagguucuuccc

SEQ ID NO: 1254699 - RNA, 17 nt, Human
uggcuaagcaaaaugug

SEQ ID NO: 1254700 - RNA, 16 nt, Human
cagcugccuccccucc

SEQ ID NO: 1254701 - RNA, 18 nt, Human
gccccgucccccucuggc

SEQ ID NO: 1254702 - RNA, 24 nt, Human
uggccgggagccugaucaccugcc

SEQ ID NO: 1254703 - RNA, 13 nt, Human
agccucagucucc

SEQ ID NO: 1254704 - RNA, 18 nt, Human
cagagcugcccucuccug

SEQ ID NO: 1254705 - RNA, 16 nt, Human
auuuuaaguaauuuca

SEQ ID NO: 1254706 - RNA, 20 nt, Human
uccccaaaaagaaugggaug

SEQ ID NO: 1254707 - RNA, 19 nt, Human
ucagagcugcccucuccug

SEQ ID NO: 1254708 - RNA, 17 nt, Human
ucugugagaugcuagaa

SEQ ID NO: 1254709 - RNA, 23 nt, Human
auacuucauuuaaaauauuuuua

SEQ ID NO: 1254710 - RNA, 13 nt, Human
ugccugcaggcau

SEQ ID NO: 1254711 - RNA, 20 nt, Human
ucugcuugccaucccucccu

SEQ ID NO: 1254712 - RNA, 22 nt, Human
agugucuuacagagaaaagaca

SEQ ID NO: 1254713 - RNA, 19 nt, Human
uauuauucuucauaacaau

SEQ ID NO: 1254714 - RNA, 15 nt, Human
uaccuuuuuccuucc

SEQ ID NO: 1254715 - RNA, 20 nt, Human
uuuauaacucaucauaaaau

SEQ ID NO: 1254716 - RNA, 14 nt, Human
gaaggcuuacaccc

SEQ ID NO: 1254717 - RNA, 23 nt, Human
uuacauuauuaucaacaauagug

SEQ ID NO: 1254718 - RNA, 18 nt, Human
auaauguuguuauuuaaa

SEQ ID NO: 1254719 - RNA, 16 nt, Human
acuuaaaaucuaauuc

SEQ ID NO: 1254720 - RNA, 23 nt, Human
cauucucucuccuguacuuuuuc

SEQ ID NO: 1254721 - RNA, 13 nt, Human
ggaaagggucucc

SEQ ID NO: 1254722 - RNA, 23 nt, Human
acuuugugaaaaaaaauuuuaua

SEQ ID NO: 1254723 - RNA, 15 nt, Human
cugacucuuaagaag

SEQ ID NO: 1254724 - RNA, 19 nt, Human
uucccuugaugaagaaguu

SEQ ID NO: 1254725 - RNA, 12 nt, Human
ggggcucuggga

SEQ ID NO: 1254726 - RNA, 20 nt, Human
auucccagccagcacagccu

SEQ ID NO: 1254727 - RNA, 20 nt, Human
ccaggcauccuccacaauag

SEQ ID NO: 1254728 - RNA, 22 nt, Human
ugggcacuguggguagacacac

SEQ ID NO: 1254729 - RNA, 15 nt, Human
gacaguauggcagcu

SEQ ID NO: 1254730 - RNA, 15 nt, Human
auauuuuuuguuaaa

SEQ ID NO: 1254731 - RNA, 19 nt, Human
aaucuacacuccagugaga

SEQ ID NO: 1254732 - RNA, 18 nt, Human
acucuaggacauaaauua

SEQ ID NO: 1254733 - RNA, 17 nt, Human
cagcaguucagagcugc

SEQ ID NO: 1254734 - RNA, 14 nt, Human
aucaccaaggcuga

SEQ ID NO: 1254735 - RNA, 15 nt, Human
cuuaagaagacugca

SEQ ID NO: 1254736 - RNA, 22 nt, Human
gagccucagucucccucccuug

SEQ ID NO: 1254737 - RNA, 13 nt, Human
agacagcucugca

SEQ ID NO: 1254738 - RNA, 17 nt, Human
uguucuaagaagugaaa

SEQ ID NO: 1254739 - RNA, 19 nt, Human
auuuugugaagcaaaauuu

SEQ ID NO: 1254740 - RNA, 17 nt, Human
caccucccccaucucuu

SEQ ID NO: 1254741 - RNA, 13 nt, Human
uaauuuuaaguaa

SEQ ID NO: 1254742 - RNA, 22 nt, Human
aaaagauuaugaucucagaaau

SEQ ID NO: 1254743 - RNA, 15 nt, Human
auuuuaaaagaauga

SEQ ID NO: 1254744 - RNA, 21 nt, Human
gugacauguuuacaaaccuca

SEQ ID NO: 1254745 - RNA, 18 nt, Human
auucuuacauguuuucuu

SEQ ID NO: 1254746 - RNA, 21 nt, Human
cuuuuaaguugcugaugaacu

SEQ ID NO: 1254747 - RNA, 17 nt, Human
cugcccucuccugggca

SEQ ID NO: 1254748 - RNA, 22 nt, Human
gugauuacccucugggucucag

SEQ ID NO: 1254749 - RNA, 21 nt, Human
cuguuuguuauggcuuaauga

SEQ ID NO: 1254750 - RNA, 23 nt, Human
cuaguaauuggaaaggcagcucu

SEQ ID NO: 1254751 - RNA, 19 nt, Human
auaaugaaauaacuaggcg

SEQ ID NO: 1254752 - RNA, 21 nt, Human
aauuaggcaaggcuaugugau

SEQ ID NO: 1254753 - RNA, 17 nt, Human
ucagaccauaauguuac

SEQ ID NO: 1254754 - RNA, 21 nt, Human
cagcauuuuacuacuuuaaaa

SEQ ID NO: 1254755 - RNA, 13 nt, Human
uauuuauuuuuuu

SEQ ID NO: 1254756 - RNA, 21 nt, Human
cagugagacagcucugcauac

SEQ ID NO: 1254757 - RNA, 23 nt, Human
gaccccugagcuugcagagauga

SEQ ID NO: 1254758 - RNA, 13 nt, Human
cagugcuuggccc

SEQ ID NO: 1254759 - RNA, 23 nt, Human
uaaauauacuccuaguaauuuaa

SEQ ID NO: 1254760 - RNA, 14 nt, Human
guauuuuaaaagaa

SEQ ID NO: 1254761 - RNA, 22 nt, Human
uagaauauuuauuaccucugau

SEQ ID NO: 1254762 - RNA, 18 nt, Human
acuggacucaccuccccc

SEQ ID NO: 1254763 - RNA, 19 nt, Human
ggcaaggguucaccugggc

SEQ ID NO: 1254764 - RNA, 15 nt, Human
auaucuauuaauaua

SEQ ID NO: 1254765 - RNA, 22 nt, Human
ccacagcuguaugauucccagc

SEQ ID NO: 1254766 - RNA, 23 nt, Human
aaaauaucacuugucaauaaaau

SEQ ID NO: 1254767 - RNA, 21 nt, Human
uccugagaccagccaaccugg

SEQ ID NO: 1254768 - RNA, 19 nt, Human
gaaccuuuacauccagaua

SEQ ID NO: 1254769 - RNA, 13 nt, Human
acacagugucugg

SEQ ID NO: 1254770 - RNA, 16 nt, Human
ggcugagccucagucu

SEQ ID NO: 1254771 - RNA, 19 nt, Human
aagguauuuauugagcacc

SEQ ID NO: 1254772 - RNA, 17 nt, Human
ugaaauggugaaaugca

SEQ ID NO: 1254773 - RNA, 15 nt, Human
agucaccucauggaa

SEQ ID NO: 1254774 - RNA, 20 nt, Human
acuaaauugacacuuaaaaa

SEQ ID NO: 1254775 - RNA, 15 nt, Human
ggccuucggccucca

SEQ ID NO: 1254776 - RNA, 16 nt, Human
aggccaugggacaggg

SEQ ID NO: 1254777 - RNA, 14 nt, Human
ggaguuccuaacca

SEQ ID NO: 1254778 - RNA, 19 nt, Human
uuaucaauaucuaauauau

SEQ ID NO: 1254779 - RNA, 20 nt, Human
agugauacuauccaguuacu

SEQ ID NO: 1254780 - RNA, 18 nt, Human
acugggguggguggggca

SEQ ID NO: 1254781 - RNA, 15 nt, Human
uuguuauuuaaagaa

SEQ ID NO: 1254782 - RNA, 15 nt, Human
auagcagauuuuaau

SEQ ID NO: 1254783 - RNA, 17 nt, Human
uccucugagccuuggga

SEQ ID NO: 1254784 - RNA, 13 nt, Human
uuugguucuaaua

SEQ ID NO: 1254785 - RNA, 19 nt, Human
caccuguuuuuaagcuguu

SEQ ID NO: 1254786 - RNA, 22 nt, Human
ugacuaugcaaccuuuggaugc

SEQ ID NO: 1254787 - RNA, 15 nt, Human
uuaacauuauuuaua

SEQ ID NO: 1254788 - RNA, 17 nt, Human
gcaagcucuaucaccaa

SEQ ID NO: 1254789 - RNA, 10 nt, Human
accugagccc

SEQ ID NO: 1254790 - RNA, 16 nt, Human
aucaaaagaaagaaaa

SEQ ID NO: 1254791 - RNA, 18 nt, Human
cuuuucccaacuccagaa

SEQ ID NO: 1254792 - RNA, 16 nt, Human
uaugugcaauaaaaug

SEQ ID NO: 1254793 - RNA, 19 nt, Human
gaggcugaggcaagagaau

SEQ ID NO: 1254794 - RNA, 16 nt, Human
aaaaauacaaaaauua

SEQ ID NO: 1254795 - RNA, 14 nt, Human
cugucucaguccau

SEQ ID NO: 1254796 - RNA, 17 nt, Human
acaagaaaugaaagcag

SEQ ID NO: 1254797 - RNA, 14 nt, Human
uaaauaguuuauga

SEQ ID NO: 1254798 - RNA, 19 nt, Human
uugggaaaggaguagaaaa

SEQ ID NO: 1254799 - RNA, 22 nt, Human
gaguggcgcgcgccaccacgcc

SEQ ID NO: 1254800 - RNA, 20 nt, Human
augaauaucuauuaauauau

SEQ ID NO: 1254801 - RNA, 18 nt, Human
cauauaauaaauguacau

SEQ ID NO: 1254802 - RNA, 15 nt, Human
acuucauuuaaaaua

SEQ ID NO: 1254803 - RNA, 19 nt, Human
cuacuugggaggcugaggc

SEQ ID NO: 1254804 - RNA, 23 nt, Human
ggucuaucuuugagcgcccacua

SEQ ID NO: 1254805 - RNA, 15 nt, Human
gcaagcucuaucacc

SEQ ID NO: 1254806 - RNA, 16 nt, Human
agaugcuagaacuccc

SEQ ID NO: 1254807 - RNA, 18 nt, Human
auaaaguauauauagaau

SEQ ID NO: 1254808 - RNA, 20 nt, Human
aucccucccuccaccucccu

SEQ ID NO: 1254809 - RNA, 16 nt, Human
aaauuagccgggcaug

SEQ ID NO: 1254810 - RNA, 18 nt, Human
cuuugagcgcccacuaga

SEQ ID NO: 1254811 - RNA, 18 nt, Human
uaaaaugagcaaaaguug

SEQ ID NO: 1254812 - RNA, 14 nt, Human
augaaacauuacag

SEQ ID NO: 1254813 - RNA, 21 nt, Human
uauauauguauuuauaaauau

SEQ ID NO: 1254814 - RNA, 19 nt, Human
uggguuucacaagugaaaa

SEQ ID NO: 1254815 - RNA, 17 nt, Human
auuuuaauuauuauucu

SEQ ID NO: 1254816 - RNA, 17 nt, Human
cuuguuauuuauaacaa

SEQ ID NO: 1254817 - RNA, 19 nt, Human
uauauuuuuuaugaaacau

SEQ ID NO: 1254818 - RNA, 16 nt, Human
gccuaucagcauuuua

SEQ ID NO: 1254819 - RNA, 18 nt, Human
aacucagggagcauuuau

SEQ ID NO: 1254820 - RNA, 22 nt, Human
guaauuuaagauuuuguuuuua

SEQ ID NO: 1254821 - RNA, 21 nt, Human
aaaauuuuuucucuaggaaau

SEQ ID NO: 1254822 - RNA, 20 nt, Human
ucucuccuguacuuuuucca

SEQ ID NO: 1254823 - RNA, 23 nt, Human
caucauaaaauaaaguauauaua

SEQ ID NO: 1254824 - RNA, 20 nt, Human
uuugugaaaaaaaauuuuau

SEQ ID NO: 1254825 - RNA, 18 nt, Human
ggggcgcgugcaggcagc

SEQ ID NO: 1254826 - RNA, 20 nt, Human
uucuguaaucuucagaccua

SEQ ID NO: 1254827 - RNA, 17 nt, Human
auuuuuaccuuuuuccu

SEQ ID NO: 1254828 - RNA, 16 nt, Human
cuguaucuuguuuuuc

SEQ ID NO: 1254829 - RNA, 16 nt, Human
ggcagcugccuccccu

SEQ ID NO: 1254830 - RNA, 15 nt, Human
auauacuauauuuau

SEQ ID NO: 1254831 - RNA, 12 nt, Human
cuuccucugagc

SEQ ID NO: 1254832 - RNA, 13 nt, Human
cacaacacacaga

SEQ ID NO: 1254833 - RNA, 17 nt, Human
accagggccuggcuggg

SEQ ID NO: 1254834 - RNA, 15 nt, Human
acaaaaacaaacaaa

SEQ ID NO: 1254835 - RNA, 14 nt, Human
aagcucuaucacca

SEQ ID NO: 1254836 - RNA, 13 nt, Human
gcuugccaucccu

SEQ ID NO: 1254837 - RNA, 17 nt, Human
gucacacaaccuguccc

SEQ ID NO: 1254838 - RNA, 14 nt, Human
ucccuccaccuccc

SEQ ID NO: 1254839 - RNA, 21 nt, Human
uuuucucuaacucagaaacau

SEQ ID NO: 1254840 - RNA, 23 nt, Human
aggaugguucccuugaugaagaa

SEQ ID NO: 1254841 - RNA, 15 nt, Human
ugaauaucuauuaau

SEQ ID NO: 1254842 - RNA, 17 nt, Human
ugccuccccuccucugc

SEQ ID NO: 1254843 - RNA, 21 nt, Human
cuggccuucggccuccauccu

SEQ ID NO: 1254844 - RNA, 17 nt, Human
gacaguguuuucuggga

SEQ ID NO: 1254845 - RNA, 17 nt, Human
cagugcuugaaugaagu

SEQ ID NO: 1254846 - RNA, 14 nt, Human
aaauaaguauuuau

SEQ ID NO: 1254847 - RNA, 15 nt, Human
uauaauuuuuuucaa

SEQ ID NO: 1254848 - RNA, 15 nt, Human
uaucuaauauauaug

SEQ ID NO: 1254849 - RNA, 12 nt, Human
gccccugagccc

SEQ ID NO: 1254850 - RNA, 21 nt, Human
uacauaagggaggaaaaaaaa

SEQ ID NO: 1254851 - RNA, 20 nt, Human
ccagcuacuugggaggcuga

SEQ ID NO: 1254852 - RNA, 23 nt, Human
gauguacauuuccaaauucacaa

SEQ ID NO: 1254853 - RNA, 21 nt, Human
aaugugacuuaaugccacuaa

SEQ ID NO: 1254854 - RNA, 16 nt, Human
auguuauuuuuuaauu

SEQ ID NO: 1254855 - RNA, 15 nt, Human
cagugucaggaggaa

SEQ ID NO: 1254856 - RNA, 18 nt, Human
uuggggccuaugcagagg

SEQ ID NO: 1254857 - RNA, 15 nt, Human
aguucugaagaagau

SEQ ID NO: 1254858 - RNA, 17 nt, Human
gaaagaagcccaauauu

SEQ ID NO: 1254859 - RNA, 17 nt, Human
gguccgaagucuuccau

SEQ ID NO: 1254860 - RNA, 19 nt, Human
cuccugggcagcugccucc

SEQ ID NO: 1254861 - RNA, 21 nt, Human
cuuuauuuuuuaaguauuuau

SEQ ID NO: 1254862 - RNA, 16 nt, Human
ggcagagagguaggga

SEQ ID NO: 1254863 - RNA, 16 nt, Human
uuacagagaaaagaca

SEQ ID NO: 1254864 - RNA, 23 nt, Human
cugaaaucauacuucuuaggguu

SEQ ID NO: 1254865 - RNA, 16 nt, Human
agaacucugagcagug

SEQ ID NO: 1254866 - RNA, 20 nt, Human
ucuucauagcagauuuuaau

SEQ ID NO: 1254867 - RNA, 15 nt, Human
gcugcccucuccugg

SEQ ID NO: 1254868 - RNA, 18 nt, Human
uaaauugacacuuaaaaa

SEQ ID NO: 1254869 - RNA, 13 nt, Human
uugcaaccuccac

SEQ ID NO: 1254870 - RNA, 15 nt, Human
ucuggggcucuggga

SEQ ID NO: 1254871 - RNA, 15 nt, Human
gaugcacuuuauauu

SEQ ID NO: 1254872 - RNA, 16 nt, Human
auauguaccauguaca

SEQ ID NO: 1254873 - RNA, 23 nt, Human
uauguuaaaacugggacagggga

SEQ ID NO: 1254874 - RNA, 16 nt, Human
aacucuuaaucaaaua

SEQ ID NO: 1254875 - RNA, 22 nt, Human
aauuacauuuguauaaaauaau

SEQ ID NO: 1254876 - RNA, 16 nt, Human
cagggacuugaaccca

SEQ ID NO: 1254877 - RNA, 15 nt, Human
ucaguccucuuucaa

SEQ ID NO: 1254878 - RNA, 18 nt, Human
aaaggcauucucugaaga

SEQ ID NO: 1254879 - RNA, 18 nt, Human
gauuaugaucucagaaau

SEQ ID NO: 1254880 - RNA, 18 nt, Human
guuuccuagcgcagccau

SEQ ID NO: 1254881 - RNA, 18 nt, Human
caaggcugauuaaaccaa

SEQ ID NO: 1254882 - RNA, 16 nt, Human
auuuuacuuuuccauu

SEQ ID NO: 1254883 - RNA, 13 nt, Human
uuauucacaagac

SEQ ID NO: 1254884 - RNA, 14 nt, Human
agaaugagaagaau

SEQ ID NO: 1254885 - RNA, 17 nt, Human
acacaaccugucccagc

SEQ ID NO: 1254886 - RNA, 16 nt, Human
gccucagucucccucc

SEQ ID NO: 1254887 - RNA, 15 nt, Human
cuuuucccaacucca

SEQ ID NO: 1254888 - RNA, 12 nt, Human
ucaccccuugcc

SEQ ID NO: 1254889 - RNA, 17 nt, Human
gcgccaccacgcccagc

SEQ ID NO: 1254890 - RNA, 17 nt, Human
cuaaaauuagaugaacu

SEQ ID NO: 1254891 - RNA, 12 nt, Human
augagagacagc

SEQ ID NO: 1254892 - RNA, 13 nt, Human
gcuugccugcagg

SEQ ID NO: 1254893 - RNA, 18 nt, Human
auuuauuuacugagcuuc

SEQ ID NO: 1254894 - RNA, 13 nt, Human
accgaguggcccu

SEQ ID NO: 1254895 - RNA, 14 nt, Human
ucuauuaggaaaua

SEQ ID NO: 1254896 - RNA, 20 nt, Human
ugagaacugcauauguuucg

SEQ ID NO: 1254897 - RNA, 14 nt, Human
uugaggacuugggc

SEQ ID NO: 1254898 - RNA, 10 nt, Human
aaaauguaau

SEQ ID NO: 1254899 - RNA, 15 nt, Human
gcacagccucuuaga

SEQ ID NO: 1254900 - RNA, 15 nt, Human
cacuuggucugugag

SEQ ID NO: 1254901 - RNA, 14 nt, Human
aauaguuuaugauu

SEQ ID NO: 1254902 - RNA, 20 nt, Human
ugcuggauucaagugauccg

SEQ ID NO: 1254903 - RNA, 19 nt, Human
uaaucauauaauaaaugua

SEQ ID NO: 1254904 - RNA, 20 nt, Human
agaccagccaaccugggggc

SEQ ID NO: 1254905 - RNA, 15 nt, Human
ggucucgaacugcug

SEQ ID NO: 1254906 - RNA, 12 nt, Human
aaugcagccccc

SEQ ID NO: 1254907 - RNA, 21 nt, Human
gucucagugucaaugcagccc

SEQ ID NO: 1254908 - RNA, 20 nt, Human
ccauaauguuacauuauuau

SEQ ID NO: 1254909 - RNA, 13 nt, Human
cucuaacucagaa

SEQ ID NO: 1254910 - RNA, 21 nt, Human
caguuacugccgguuugaaaa

SEQ ID NO: 1254911 - RNA, 14 nt, Human
caauuccucuggga

SEQ ID NO: 1254912 - RNA, 17 nt, Human
aaagaaacauuugguaa

SEQ ID NO: 1254913 - RNA, 20 nt, Human
cacagcacgggggccaagga

SEQ ID NO: 1254914 - RNA, 16 nt, Human
auccuacaagacacag

SEQ ID NO: 1254915 - RNA, 15 nt, Human
augaauuaaguuuuu

SEQ ID NO: 1254916 - RNA, 16 nt, Human
accucugccucagaaa

SEQ ID NO: 1254917 - RNA, 14 nt, Human
agcuuuucaaaauu

SEQ ID NO: 1254918 - RNA, 14 nt, Human
uaagcuguuuccau

SEQ ID NO: 1254919 - RNA, 19 nt, Human
aguauuucuaugaaauauu

SEQ ID NO: 1254920 - RNA, 23 nt, Human
acguaaucguguccccuauccua

SEQ ID NO: 1254921 - RNA, 13 nt, Human
caaauuuguauuu

SEQ ID NO: 1254922 - RNA, 14 nt, Human
cccugaugaaaaca

SEQ ID NO: 1254923 - RNA, 23 nt, Human
cugcccucuccugggcagcugcc

SEQ ID NO: 1254924 - RNA, 14 nt, Human
cugccccccagccc

SEQ ID NO: 1254925 - RNA, 16 nt, Human
ucagucucccucccuu

SEQ ID NO: 1254926 - RNA, 17 nt, Human
cuuugggaggcugaggc

SEQ ID NO: 1254927 - RNA, 15 nt, Human
ucaaccaaauggagu

SEQ ID NO: 1254928 - RNA, 21 nt, Human
agauacugaauguaaacaaag

SEQ ID NO: 1254929 - RNA, 21 nt, Human
gaagugaaaaucuacacucca

SEQ ID NO: 1254930 - RNA, 22 nt, Human
uaaacuggaaauaaaagauugu

SEQ ID NO: 1254931 - RNA, 14 nt, Human
gccucagucucccu

SEQ ID NO: 1254932 - RNA, 20 nt, Human
agccuuggggcugaugcagu

SEQ ID NO: 1254933 - RNA, 22 nt, Human
agacucugucucaguccaugaa

SEQ ID NO: 1254934 - RNA, 23 nt, Human
ucuuagaugcaguucugaagaag

SEQ ID NO: 1254935 - RNA, 17 nt, Human
uuaaauggucaauuuug

SEQ ID NO: 1254936 - RNA, 16 nt, Human
guuuauuucacuugau

SEQ ID NO: 1254937 - RNA, 20 nt, Human
aaaagacauaagcaaagacu

SEQ ID NO: 1254938 - RNA, 19 nt, Human
uaucucauuuccaagcaag

SEQ ID NO: 1254939 - RNA, 20 nt, Human
aaacugauacccuuugaaaa

SEQ ID NO: 1254940 - RNA, 21 nt, Human
auaauuuuuauauuugaaaua

SEQ ID NO: 1254941 - RNA, 19 nt, Human
cuuggggccuaugcagagg

SEQ ID NO: 1254942 - RNA, 16 nt, Human
augacuaaaaaacaaa

SEQ ID NO: 1254943 - RNA, 15 nt, Human
ugcuucuguuuuaua

SEQ ID NO: 1254944 - RNA, 23 nt, Human
gcuauucacaaccacucauucaa

SEQ ID NO: 1254945 - RNA, 22 nt, Human
uagcagacaguguuuucuggga

SEQ ID NO: 1254946 - RNA, 16 nt, Human
agacaccaccacccuu

SEQ ID NO: 1254947 - RNA, 18 nt, Human
uucucuaggaaauauuua

SEQ ID NO: 1254948 - RNA, 22 nt, Human
ugaaaaaguucugcagauaaac

SEQ ID NO: 1254949 - RNA, 12 nt, Human
aucccucccucc

SEQ ID NO: 1254950 - RNA, 20 nt, Human
uaggaauugacccacaagaa

SEQ ID NO: 1254951 - RNA, 20 nt, Human
gcacuugggacaaaaacaaa

SEQ ID NO: 1254952 - RNA, 17 nt, Human
ccugcaauaaaaugggu

SEQ ID NO: 1254953 - RNA, 21 nt, Human
auuuauauauuuauaacucau

SEQ ID NO: 1254954 - RNA, 14 nt, Human
ugagcauguacuga

SEQ ID NO: 1254955 - RNA, 18 nt, Human
ucacaaccacucauucaa

SEQ ID NO: 1254956 - RNA, 19 nt, Human
ugacuuaguguacaugaaa

SEQ ID NO: 1254957 - RNA, 23 nt, Human
uacuguauuuuuaccuuuuuccu

SEQ ID NO: 1254958 - RNA, 12 nt, Human
auuuuaaaagaa

SEQ ID NO: 1254959 - RNA, 17 nt, Human
ucucuggccuucggccu

SEQ ID NO: 1254960 - RNA, 13 nt, Human
uaaguaauuucag

SEQ ID NO: 1254961 - RNA, 16 nt, Human
uauguauuauuuauaa

SEQ ID NO: 1254962 - RNA, 17 nt, Human
uccugccugcaauauuu

SEQ ID NO: 1254963 - RNA, 18 nt, Human
cucauccugcaggcagcu

SEQ ID NO: 1254964 - RNA, 22 nt, Human
cugcucaauaaaguacaagagc

SEQ ID NO: 1254965 - RNA, 16 nt, Human
cauuuuacuacuuuaa

SEQ ID NO: 1254966 - RNA, 18 nt, Human
uauguauuuauaaauaua

SEQ ID NO: 1254967 - RNA, 17 nt, Human
uagagacuuugugaaaa

SEQ ID NO: 1254968 - RNA, 20 nt, Human
ugcauacaguaauuuuaagu

SEQ ID NO: 1254969 - RNA, 16 nt, Human
uauccuacuuccccuu

SEQ ID NO: 1254970 - RNA, 20 nt, Human
augcuucuguuuuauaauuu

SEQ ID NO: 1254971 - RNA, 22 nt, Human
cuccugggcagcugccuccccu

SEQ ID NO: 1254972 - RNA, 17 nt, Human
ucuauuaauauauguau

SEQ ID NO: 1254973 - RNA, 17 nt, Human
agugagacagcucugca

SEQ ID NO: 1254974 - RNA, 19 nt, Human
auuacagaugggcaaauua

SEQ ID NO: 1254975 - RNA, 14 nt, Human
uaaacaaaggaauu

SEQ ID NO: 1254976 - RNA, 13 nt, Human
acccucugggucu

SEQ ID NO: 1254977 - RNA, 13 nt, Human
ucuaagaagugaa

SEQ ID NO: 1254978 - RNA, 14 nt, Human
auuuauuauuuuca

SEQ ID NO: 1254979 - RNA, 17 nt, Human
gccugagcgacagugag

SEQ ID NO: 1254980 - RNA, 15 nt, Human
aucucacaagcacuu

SEQ ID NO: 1254981 - RNA, 20 nt, Human
auugguuuaccugugaaaua

SEQ ID NO: 1254982 - RNA, 16 nt, Human
ugcaugguuuagaaag

SEQ ID NO: 1254983 - RNA, 15 nt, Human
cgacaguuuuccuuc

SEQ ID NO: 1254984 - RNA, 21 nt, Human
gccugaucaccugcccugcug

SEQ ID NO: 1254985 - RNA, 12 nt, Human
gucccaggcuga

SEQ ID NO: 1254986 - RNA, 18 nt, Human
aaaucuauuuauuaauau

SEQ ID NO: 1254987 - RNA, 14 nt, Human
uccuguacuuuuuc

SEQ ID NO: 1254988 - RNA, 16 nt, Human
ucuacuuuuaaguugc

SEQ ID NO: 1254989 - RNA, 20 nt, Human
uacaguaauuuuaaguaauu

SEQ ID NO: 1254990 - RNA, 16 nt, Human
gucucccaaagugcug

SEQ ID NO: 1254991 - RNA, 20 nt, Human
uuuaugaaacauuacaguua

SEQ ID NO: 1254992 - RNA, 15 nt, Human
gccagugucaggagg

SEQ ID NO: 1254993 - RNA, 18 nt, Human
aauagcagacaguguuuu

SEQ ID NO: 1254994 - RNA, 21 nt, Human
cuugaaauagugucugaugaa

SEQ ID NO: 1254995 - RNA, 19 nt, Human
uuaauauauguauuauuua

SEQ ID NO: 1254996 - RNA, 16 nt, Human
ggaaagggucucccuc

SEQ ID NO: 1254997 - RNA, 19 nt, Human
cugcaaagcccagcuugaa

SEQ ID NO: 1254998 - RNA, 14 nt, Human
agguugcagugagc

SEQ ID NO: 1254999 - RNA, 13 nt, Human
guuacucugaagg

SEQ ID NO: 1255000 - RNA, 13 nt, Human
ucuacuaaaaaua

SEQ ID NO: 1255001 - RNA, 15 nt, Human
auguaaacaaaggaa

SEQ ID NO: 1255002 - RNA, 14 nt, Human
aaaaucaaauucca

SEQ ID NO: 1255003 - RNA, 21 nt, Human
cucugucucaaaaaauaaaaa

SEQ ID NO: 1255004 - RNA, 21 nt, Human
uaaaauaaaguauauauagaa

SEQ ID NO: 1255005 - RNA, 17 nt, Human
ccccauuucuauuuauu

SEQ ID NO: 1255006 - RNA, 15 nt, Human
ugugucaguggaugc

SEQ ID NO: 1255007 - RNA, 21 nt, Human
cuuugaaaaaguauaaauaaa

SEQ ID NO: 1255008 - RNA, 16 nt, Human
auugagcaccugcagg

SEQ ID NO: 1255009 - RNA, 13 nt, Human
ggccuggcuggga

SEQ ID NO: 1255010 - RNA, 23 nt, Human
ucaaucaaauaaguauuuauaau

SEQ ID NO: 1255011 - RNA, 11 nt, Human
caucuagugag

SEQ ID NO: 1255012 - RNA, 11 nt, Human
aggaguuuggc

SEQ ID NO: 1255013 - RNA, 12 nt, Human
ucagaagaccug

SEQ ID NO: 1255014 - RNA, 14 nt, Human
acaagagcuuaaca

SEQ ID NO: 1255015 - RNA, 17 nt, Human
ucugggauagcugaccc

SEQ ID NO: 1255016 - RNA, 21 nt, Human
aaacaucaguuacucugaagg

SEQ ID NO: 1255017 - RNA, 22 nt, Human
agaguggaaccaacacuaacau

SEQ ID NO: 1255018 - RNA, 12 nt, Human
cagaacagugau

SEQ ID NO: 1255019 - RNA, 15 nt, Human
cugcuggauguggag

SEQ ID NO: 1255020 - RNA, 19 nt, Human
cuugccaucccucccucca

SEQ ID NO: 1255021 - RNA, 16 nt, Human
aaugaaagcagggacu

SEQ ID NO: 1255022 - RNA, 20 nt, Human
gauguagauaaacucagaaa

SEQ ID NO: 1255023 - RNA, 19 nt, Human
uuucacaagugaaaaacau

SEQ ID NO: 1255024 - RNA, 18 nt, Human
auuuaggccaugggacag

SEQ ID NO: 1255025 - RNA, 14 nt, Human
cccucuccugggca

SEQ ID NO: 1255026 - RNA, 15 nt, Human
uccaaauucacaagu

SEQ ID NO: 1255027 - RNA, 16 nt, Human
uuaacauuauuuauau

SEQ ID NO: 1255028 - RNA, 16 nt, Human
augaaagcguaaagag

SEQ ID NO: 1255029 - RNA, 20 nt, Human
auuuugguaaaauacuucuu

SEQ ID NO: 1255030 - RNA, 19 nt, Human
gaauuacaggcgugagcca

SEQ ID NO: 1255031 - RNA, 19 nt, Human
uaauuccuauauccuguga

SEQ ID NO: 1255032 - RNA, 21 nt, Human
auaauuuuuuucaauauuuau

SEQ ID NO: 1255033 - RNA, 14 nt, Human
cucccucuaauuua

SEQ ID NO: 1255034 - RNA, 15 nt, Human
ucuuauagaauauuu

SEQ ID NO: 1255035 - RNA, 16 nt, Human
cauucucucuccugua

SEQ ID NO: 1255036 - RNA, 17 nt, Human
aaaguacaagagcuuaa

SEQ ID NO: 1255037 - RNA, 19 nt, Human
cgcccacuagacccacugg

SEQ ID NO: 1255038 - RNA, 18 nt, Human
cuugggaauuuucuucca

SEQ ID NO: 1255039 - RNA, 22 nt, Human
uuauaaucuuuuauacaguguc

SEQ ID NO: 1255040 - RNA, 18 nt, Human
cucccuuggggccuaugc

SEQ ID NO: 1255041 - RNA, 11 nt, Human
ccaaggcugga

SEQ ID NO: 1255042 - RNA, 18 nt, Human
aagggaauuucuucaacu

SEQ ID NO: 1255043 - RNA, 21 nt, Human
auuuguauaaaauaauuuuua

SEQ ID NO: 1255044 - RNA, 20 nt, Human
caggugacccugaugaaaac

SEQ ID NO: 1255045 - RNA, 23 nt, Human
ccucuguugccaaggcuggagug

SEQ ID NO: 1255046 - RNA, 17 nt, Human
caagaaugagaagaaug

SEQ ID NO: 1255047 - RNA, 20 nt, Human
accagccaaccugggggcuu

SEQ ID NO: 1255048 - RNA, 23 nt, Human
caacugugacuguacccaaaugg

SEQ ID NO: 1255049 - RNA, 12 nt, Human
uaguacacacuu

SEQ ID NO: 1255050 - RNA, 18 nt, Human
guauagcauauguuuuug

SEQ ID NO: 1255051 - RNA, 16 nt, Human
ucaucaaucaaauaag

SEQ ID NO: 1255052 - RNA, 16 nt, Human
augcuaagugaaauaa

SEQ ID NO: 1255053 - RNA, 23 nt, Human
gggagccugaucaccugcccugc

SEQ ID NO: 1255054 - RNA, 14 nt, Human
ucuaucuauuuauu

SEQ ID NO: 1255055 - RNA, 15 nt, Human
auauuuaacauuauu

SEQ ID NO: 1255056 - RNA, 18 nt, Human
auagaaacguguauauuu

SEQ ID NO: 1255057 - RNA, 20 nt, Human
aauaucuuuuuuuuaauaaa

SEQ ID NO: 1255058 - RNA, 17 nt, Human
agcgacagugagacucu

SEQ ID NO: 1255059 - RNA, 20 nt, Human
aagaugguaccaccagucug

SEQ ID NO: 1255060 - RNA, 14 nt, Human
auuuauuuuaauaa

SEQ ID NO: 1255061 - RNA, 19 nt, Human
ugaacaaauuuacagagac

SEQ ID NO: 1255062 - RNA, 11 nt, Human
cagcugccucc

SEQ ID NO: 1255063 - RNA, 16 nt, Human
cugauggguuucucca

SEQ ID NO: 1255064 - RNA, 20 nt, Human
ugaccaggcauccuccacaa

SEQ ID NO: 1255065 - RNA, 21 nt, Human
cuguauuuuuaccuuuuuccu

SEQ ID NO: 1255066 - RNA, 13 nt, Human
uugcaagacauag

SEQ ID NO: 1255067 - RNA, 20 nt, Human
auuacuguaagaaaauauca

SEQ ID NO: 1255068 - RNA, 19 nt, Human
aaagaagacaacauuaaaa

SEQ ID NO: 1255069 - RNA, 19 nt, Human
ucacaagugaaaaacaucc

SEQ ID NO: 1255070 - RNA, 22 nt, Human
uuccccuuccuaauuccacagc

SEQ ID NO: 1255071 - RNA, 14 nt, Human
auguaaauagaaac

SEQ ID NO: 1255072 - RNA, 14 nt, Human
cagauuugagcuca

SEQ ID NO: 1255073 - RNA, 22 nt, Human
cugauauauguguuuuucacau

SEQ ID NO: 1255074 - RNA, 20 nt, Human
cugagccucagucucccucc

SEQ ID NO: 1255075 - RNA, 19 nt, Human
agccagcaguucagagcug

SEQ ID NO: 1255076 - RNA, 19 nt, Human
cuuugguggagauaaagau

SEQ ID NO: 1255077 - RNA, 20 nt, Human
ucagagcugcccucuccugg

SEQ ID NO: 1255078 - RNA, 23 nt, Human
cuugauaaauggcuuccuggcaa

SEQ ID NO: 1255079 - RNA, 19 nt, Human
ucuccugggcagcugccuc

SEQ ID NO: 1255080 - RNA, 9 nt, Human
uccucugcu

SEQ ID NO: 1255081 - RNA, 14 nt, Human
cucugcuugccauc

SEQ ID NO: 1255082 - RNA, 19 nt, Human
aaaauggagggaauaauac

SEQ ID NO: 1255083 - RNA, 13 nt, Human
uacagacuuuuuu

SEQ ID NO: 1255084 - RNA, 19 nt, Human
gagugacuuaguguacaug

SEQ ID NO: 1255085 - RNA, 18 nt, Human
agcuucucauccugcagg

SEQ ID NO: 1255086 - RNA, 19 nt, Human
caaggaugccccguccccc

SEQ ID NO: 1255087 - RNA, 23 nt, Human
aggcaugagucagucugaugaga

SEQ ID NO: 1255088 - RNA, 17 nt, Human
cucgugggacagucacc

SEQ ID NO: 1255089 - RNA, 23 nt, Human
ugcagagguccacaacacacaga

SEQ ID NO: 1255090 - RNA, 21 nt, Human
aggcagcuuuuucucucccac

SEQ ID NO: 1255091 - RNA, 16 nt, Human
acuucacuuuuuuucu

SEQ ID NO: 1255092 - RNA, 17 nt, Human
agcagucagaagaccug

SEQ ID NO: 1255093 - RNA, 15 nt, Human
uaauauacuauauuu

SEQ ID NO: 1255094 - RNA, 22 nt, Human
caaccaaauggagugacuuagu

SEQ ID NO: 1255095 - RNA, 15 nt, Human
uuauacagugucuua

SEQ ID NO: 1255096 - RNA, 16 nt, Human
agguacuucaaauccu

SEQ ID NO: 1255097 - RNA, 17 nt, Human
agguccacaacacacag

SEQ ID NO: 1255098 - RNA, 20 nt, Human
ugagcgcccacuagacccac

SEQ ID NO: 1255099 - RNA, 15 nt, Human
acaaccugucccagc

SEQ ID NO: 1255100 - RNA, 12 nt, Human
ugagagacacac

SEQ ID NO: 1255101 - RNA, 14 nt, Human
gaccuagaauaaua

SEQ ID NO: 1255102 - RNA, 20 nt, Human
ggcuggagugcaguggcgca

SEQ ID NO: 1255103 - RNA, 14 nt, Human
cugaggcuccacuu

SEQ ID NO: 1255104 - RNA, 19 nt, Human
uauuuacugagcuucucug

SEQ ID NO: 1255105 - RNA, 14 nt, Human
aaucuuguaaauau

SEQ ID NO: 1255106 - RNA, 18 nt, Human
gaagcaccaaucaugaau

SEQ ID NO: 1255107 - RNA, 11 nt, Human
aauugcagagu

SEQ ID NO: 1255108 - RNA, 13 nt, Human
uccuacuuccccu

SEQ ID NO: 1255109 - RNA, 13 nt, Human
uuaguguacauga

SEQ ID NO: 1255110 - RNA, 16 nt, Human
acacaaccugucccag

SEQ ID NO: 1255111 - RNA, 22 nt, Human
aaugaaagaaaggccagcaaau

SEQ ID NO: 1255112 - RNA, 17 nt, Human
acuuuauauuauuuuga

SEQ ID NO: 1255113 - RNA, 19 nt, Human
gugucaggugacccugaug

SEQ ID NO: 1255114 - RNA, 21 nt, Human
augugaaauaaaaguagaaua

SEQ ID NO: 1255115 - RNA, 16 nt, Human
auuuaacauuauuuau

SEQ ID NO: 1255116 - RNA, 19 nt, Human
gcacuaguauuucuaugaa

SEQ ID NO: 1255117 - RNA, 22 nt, Human
gacagggaaagggucucccucu

SEQ ID NO: 1255118 - RNA, 23 nt, Human
guuucacaagugaaaaacaucca

SEQ ID NO: 1255119 - RNA, 16 nt, Human
acauccuacaagacac

SEQ ID NO: 1255120 - RNA, 15 nt, Human
gauccugcaauucca

SEQ ID NO: 1255121 - RNA, 11 nt, Human
ugcuugccauc

SEQ ID NO: 1255122 - RNA, 18 nt, Human
ugugaccacugcagaaga

SEQ ID NO: 1255123 - RNA, 22 nt, Human
aauuguauuuuaguaagagauu

SEQ ID NO: 1255124 - RNA, 16 nt, Human
ugggucucaguguccu

SEQ ID NO: 1255125 - RNA, 20 nt, Human
uuccuaaccagccuggucaa

SEQ ID NO: 1255126 - RNA, 20 nt, Human
uaacugcauugagaacugca

SEQ ID NO: 1255127 - RNA, 19 nt, Human
uccccuauccuacuucccc

SEQ ID NO: 1255128 - RNA, 20 nt, Human
auguuauuuuuuaauuauua

SEQ ID NO: 1255129 - RNA, 18 nt, Human
aucuacacuccagugaga

SEQ ID NO: 1255130 - RNA, 19 nt, Human
caccuguaaucccagcuac

SEQ ID NO: 1255131 - RNA, 16 nt, Human
ucuucccuuuuacaua

SEQ ID NO: 1255132 - RNA, 15 nt, Human
aaucaaauuccagaa

SEQ ID NO: 1255133 - RNA, 15 nt, Human
uuuaccuuuuuccuu

SEQ ID NO: 1255134 - RNA, 20 nt, Human
cuggauguggagggggcgcg

SEQ ID NO: 1255135 - RNA, 19 nt, Human
agaccuaggauuucaugau

SEQ ID NO: 1255136 - RNA, 16 nt, Human
ucuaaaucuauuuauu

SEQ ID NO: 1255137 - RNA, 16 nt, Human
aguaacggaacaguau

SEQ ID NO: 1255138 - RNA, 19 nt, Human
agcugauaucaugccccug

SEQ ID NO: 1255139 - RNA, 15 nt, Human
uguauuuauaaauau

SEQ ID NO: 1255140 - RNA, 19 nt, Human
gcauccuuccucacaccag

SEQ ID NO: 1255141 - RNA, 15 nt, Human
cagcugccuccccuc

SEQ ID NO: 1255142 - RNA, 14 nt, Human
accauuuuuacuug

SEQ ID NO: 1255143 - RNA, 12 nt, Human
uaauuccacagc

SEQ ID NO: 1255144 - RNA, 16 nt, Human
aaucuaauucaaacua

SEQ ID NO: 1255145 - RNA, 12 nt, Human
aagcauuguaac

SEQ ID NO: 1255146 - RNA, 20 nt, Human
uugcaagacauagaauagug

SEQ ID NO: 1255147 - RNA, 16 nt, Human
ucaucaaugaaugaau

SEQ ID NO: 1255148 - RNA, 15 nt, Human
guaaggggaauugag

SEQ ID NO: 1255149 - RNA, 15 nt, Human
ucuauuuauuaauau

SEQ ID NO: 1255150 - RNA, 14 nt, Human
cuguuuuuaagcug

SEQ ID NO: 1255151 - RNA, 20 nt, Human
agccuaguugaucagcuuau

SEQ ID NO: 1255152 - RNA, 15 nt, Human
cccuguacuccagcc

SEQ ID NO: 1255153 - RNA, 17 nt, Human
cuauauccugugacugu

SEQ ID NO: 1255154 - RNA, 14 nt, Human
aaaagaaagaaaau

SEQ ID NO: 1255155 - RNA, 14 nt, Human
agcaaguauuagaa

SEQ ID NO: 1255156 - RNA, 16 nt, Human
ucuguauugcauuaaa

SEQ ID NO: 1255157 - RNA, 14 nt, Human
acuuauugacuauu

SEQ ID NO: 1255158 - RNA, 15 nt, Human
uugcucauggaauug

SEQ ID NO: 1255159 - RNA, 13 nt, Human
agagauuccugag

SEQ ID NO: 1255160 - RNA, 14 nt, Human
cuacuuuaaaaaaa

SEQ ID NO: 1255161 - RNA, 13 nt, Human
gaaugagaagaau

SEQ ID NO: 1255162 - RNA, 13 nt, Human
ugaaaugcagagu

SEQ ID NO: 1255163 - RNA, 14 nt, Human
ggacucaccucccc

SEQ ID NO: 1255164 - RNA, 16 nt, Human
uuaaagaauuuucaaa

SEQ ID NO: 1255165 - RNA, 15 nt, Human
accagggagccccuu

SEQ ID NO: 1255166 - RNA, 15 nt, Human
acaauuauaagcugu

SEQ ID NO: 1255167 - RNA, 16 nt, Human
gacuggccugcuggau

SEQ ID NO: 1255168 - RNA, 13 nt, Human
gcauacaguaauu

SEQ ID NO: 1255169 - RNA, 22 nt, Human
ccaaacauccuacaagacacag

SEQ ID NO: 1255170 - RNA, 15 nt, Human
augagaagaaugacu

SEQ ID NO: 1255171 - RNA, 14 nt, Human
gacaguuuuccuuc

SEQ ID NO: 1255172 - RNA, 15 nt, Human
agccccgggaguggc

SEQ ID NO: 1255173 - RNA, 17 nt, Human
aaaccuuauuguaccuc

SEQ ID NO: 1255174 - RNA, 21 nt, Human
aaaaaguucugcagauaaaca

SEQ ID NO: 1255175 - RNA, 18 nt, Human
aaaaguucugcagauaaa

SEQ ID NO: 1255176 - RNA, 17 nt, Human
gacuauuauagaaugga

SEQ ID NO: 1255177 - RNA, 21 nt, Human
cuggcuuaaaauguaauuaau

SEQ ID NO: 1255178 - RNA, 15 nt, Human
auuucaugaaaagau

SEQ ID NO: 1255179 - RNA, 13 nt, Human
acacaggcuccaa

SEQ ID NO: 1255180 - RNA, 16 nt, Human
uaugacacaucucuga

SEQ ID NO: 1255181 - RNA, 21 nt, Human
cgacagugagacucugucuca

SEQ ID NO: 1255182 - RNA, 21 nt, Human
ggaaaggaguagaaaaagcag

SEQ ID NO: 1255183 - RNA, 12 nt, Human
cuggccaggcug

SEQ ID NO: 1255184 - RNA, 20 nt, Human
cucccugccccccagcccuc

SEQ ID NO: 1255185 - RNA, 22 nt, Human
acucauuuccuauguaacugca

SEQ ID NO: 1255186 - RNA, 14 nt, Human
ucuaggaaauauuu

SEQ ID NO: 1255187 - RNA, 21 nt, Human
aagacucgggauuaguacaca

SEQ ID NO: 1255188 - RNA, 21 nt, Human
uuccuaauuccacagcugcuc

SEQ ID NO: 1255189 - RNA, 18 nt, Human
ugaaaaaguucugcagau

SEQ ID NO: 1255190 - RNA, 16 nt, Human
cucccaaagugcuggg

SEQ ID NO: 1255191 - RNA, 19 nt, Human
aaauggagugacuuagugu

SEQ ID NO: 1255192 - RNA, 21 nt, Human
uauaaaauaauuuuuauauuu

SEQ ID NO: 1255193 - RNA, 14 nt, Human
ucucccucuguugc

SEQ ID NO: 1255194 - RNA, 17 nt, Human
auaagggaggaaaaaaa

SEQ ID NO: 1255195 - RNA, 21 nt, Human
uuacaguuagagauuuuuaaa

SEQ ID NO: 1255196 - RNA, 14 nt, Human
aaaguauaaauaaa

SEQ ID NO: 1255197 - RNA, 12 nt, Human
agccagcaguuc

SEQ ID NO: 1255198 - RNA, 13 nt, Human
aaaaauacaaaaa

SEQ ID NO: 1255199 - RNA, 20 nt, Human
caagcucuaucaccaaggag

SEQ ID NO: 1255200 - RNA, 22 nt, Human
caccagucugacuguuuccauc

SEQ ID NO: 1255201 - RNA, 20 nt, Human
uacugccgguuugaaaauau

SEQ ID NO: 1255202 - RNA, 15 nt, Human
gacucaucaaucaaa

SEQ ID NO: 1255203 - RNA, 11 nt, Human
gugaaaaaaaa

SEQ ID NO: 1255204 - RNA, 22 nt, Human
caagcucuaucaccaaggagcc

SEQ ID NO: 1255205 - RNA, 18 nt, Human
uaacuggcaguuuuccau

SEQ ID NO: 1255206 - RNA, 12 nt, Human
cuauuauagaau

SEQ ID NO: 1255207 - RNA, 14 nt, Human
uguaaguuuaugca

SEQ ID NO: 1255208 - RNA, 14 nt, Human
uucaauauuuauua

SEQ ID NO: 1255209 - RNA, 23 nt, Human
ccugacagcccaagggugggugg

SEQ ID NO: 1255210 - RNA, 15 nt, Human
acauuuccaaauuca

SEQ ID NO: 1255211 - RNA, 15 nt, Human
uuuaaagacaaagac

SEQ ID NO: 1255212 - RNA, 13 nt, Human
agacacagugacc

SEQ ID NO: 1255213 - RNA, 14 nt, Human
ugcauuaaauauaa

SEQ ID NO: 1255214 - RNA, 16 nt, Human
aacucaucauaaaaua

SEQ ID NO: 1255215 - RNA, 23 nt, Human
uauuucucucuuuuuagagaaau

SEQ ID NO: 1255216 - RNA, 20 nt, Human
auagagacuuugugaaaaaa

SEQ ID NO: 1255217 - RNA, 16 nt, Human
cuucaacucccugccc

SEQ ID NO: 1255218 - RNA, 17 nt, Human
cuacacuccagugagac

SEQ ID NO: 1255219 - RNA, 19 nt, Human
uggggcagugcuuggccca

SEQ ID NO: 1255220 - RNA, 22 nt, Human
gaauaguguuggaaaaugugca

SEQ ID NO: 1255221 - RNA, 20 nt, Human
auaaccaugcccaagaauga

SEQ ID NO: 1255222 - RNA, 22 nt, Human
augcagagguccacaacacaca

SEQ ID NO: 1255223 - RNA, 15 nt, Human
ucuuuugccauuaaa

SEQ ID NO: 1255224 - RNA, 13 nt, Human
gcugggaguggca

SEQ ID NO: 1255225 - RNA, 14 nt, Human
ccucaucuguaaaa

SEQ ID NO: 1255226 - RNA, 15 nt, Human
ugcaauuccacuuau

SEQ ID NO: 1255227 - RNA, 21 nt, Human
ugugauuacccucugggucuc

SEQ ID NO: 1255228 - RNA, 19 nt, Human
uauauuuuuuguuaaauga

SEQ ID NO: 1255229 - RNA, 15 nt, Human
cuucucuucacaguc

SEQ ID NO: 1255230 - RNA, 22 nt, Human
augagaccacuguuaucaaaac

SEQ ID NO: 1255231 - RNA, 12 nt, Human
acucccugcccc

SEQ ID NO: 1255232 - RNA, 19 nt, Human
aauauuauguuaaaacugg

SEQ ID NO: 1255233 - RNA, 20 nt, Human
aaucuauuuauuaauauuua

SEQ ID NO: 1255234 - RNA, 12 nt, Human
ucuuaaagaauu

SEQ ID NO: 1255235 - RNA, 16 nt, Human
caaggguggguggggu

SEQ ID NO: 1255236 - RNA, 21 nt, Human
aauggauaugacacaucucug

SEQ ID NO: 1255237 - RNA, 13 nt, Human
ccagcccuccuua

SEQ ID NO: 1255238 - RNA, 19 nt, Human
acuuaaaaucuaauucaaa

SEQ ID NO: 1255239 - RNA, 21 nt, Human
auuuuuaugugcaauaaaaug

SEQ ID NO: 1255240 - RNA, 19 nt, Human
gcacacagcacgggggcca

SEQ ID NO: 1255241 - RNA, 18 nt, Human
aaauauuuauuuuaauaa

SEQ ID NO: 1255242 - RNA, 20 nt, Human
agaugcaguucugaagaaga

SEQ ID NO: 1255243 - RNA, 21 nt, Human
uacuucauuuaaaauauuuuu

SEQ ID NO: 1255244 - RNA, 15 nt, Human
uaaagaauuuucaaa

SEQ ID NO: 1255245 - RNA, 18 nt, Human
cuggacaguuuucugcuu

SEQ ID NO: 1255246 - RNA, 21 nt, Human
cuccugggcagcugccucccc

SEQ ID NO: 1255247 - RNA, 22 nt, Human
cuuuccacagaagcuccaggua

SEQ ID NO: 1255248 - RNA, 12 nt, Human
aauuagaugaac

SEQ ID NO: 1255249 - RNA, 17 nt, Human
cuggacucaccuccccc

SEQ ID NO: 1255250 - RNA, 13 nt, Human
uuccucugagccu

SEQ ID NO: 1255251 - RNA, 15 nt, Human
aagccagauuuuccu

SEQ ID NO: 1255252 - RNA, 14 nt, Human
uaugugaaauaaaa

SEQ ID NO: 1255253 - RNA, 14 nt, Human
accacaagacugca

SEQ ID NO: 1255254 - RNA, 22 nt, Human
aucccucccuccaccucccugc

SEQ ID NO: 1255255 - RNA, 21 nt, Human
uuacaggcgugagccaccaaa

SEQ ID NO: 1255256 - RNA, 20 nt, Human
ccagcuugaaaccuucacuu

SEQ ID NO: 1255257 - RNA, 15 nt, Human
caccuguaaucccag

SEQ ID NO: 1255258 - RNA, 12 nt, Human
uacccucugggu

SEQ ID NO: 1255259 - RNA, 15 nt, Human
uucacaagugaaaaa

SEQ ID NO: 1255260 - RNA, 16 nt, Human
ugaauccagaaauaau

SEQ ID NO: 1255261 - RNA, 15 nt, Human
acuuuggcaaaugag

SEQ ID NO: 1255262 - RNA, 22 nt, Human
aguauguuagugcaaauuguca

SEQ ID NO: 1255263 - RNA, 21 nt, Human
uuaucuaucuaucuauuuauu

SEQ ID NO: 1255264 - RNA, 17 nt, Human
caaagcacgaaauguua

SEQ ID NO: 1255265 - RNA, 19 nt, Human
uuccucccuucucuucaca

SEQ ID NO: 1255266 - RNA, 15 nt, Human
cagccagcacagccu

SEQ ID NO: 1255267 - RNA, 18 nt, Human
uccagcuggccgggagcc

SEQ ID NO: 1255268 - RNA, 12 nt, Human
cuuagacccuca

SEQ ID NO: 1255269 - RNA, 20 nt, Human
ucaggaggaaggcuuacacc

SEQ ID NO: 1255270 - RNA, 12 nt, Human
cucauggaauug

SEQ ID NO: 1255271 - RNA, 15 nt, Human
gcaggcaugagucag

SEQ ID NO: 1255272 - RNA, 15 nt, Human
uuuguaauauuucuc

SEQ ID NO: 1255273 - RNA, 17 nt, Human
ccuauccuacuuccccu

SEQ ID NO: 1255274 - RNA, 15 nt, Human
acucugagcagugcu

SEQ ID NO: 1255275 - RNA, 16 nt, Human
aucagucauaacuaaa

SEQ ID NO: 1255276 - RNA, 16 nt, Human
gaaucacuugaacccg

SEQ ID NO: 1255277 - RNA, 20 nt, Human
auaaauuuucccaaaacuga

SEQ ID NO: 1255278 - RNA, 12 nt, Human
uaaaauugaaag

SEQ ID NO: 1255279 - RNA, 21 nt, Human
uguuuuaagauaaauuauaag

SEQ ID NO: 1255280 - RNA, 23 nt, Human
gcagccaugugauuacccucugg

SEQ ID NO: 1255281 - RNA, 21 nt, Human
uaaguuuaugcauacaguaau

SEQ ID NO: 1255282 - RNA, 17 nt, Human
gacuuuccuaaaucaau

SEQ ID NO: 1255283 - RNA, 17 nt, Human
cccuccaccucccugca

SEQ ID NO: 1255284 - RNA, 20 nt, Human
cuuaaagaauuuucaaaauc

SEQ ID NO: 1255285 - RNA, 21 nt, Human
uacaugagguacugagaguga

SEQ ID NO: 1255286 - RNA, 16 nt, Human
uuauagaauauuuauu

SEQ ID NO: 1255287 - RNA, 22 nt, Human
cuccgucucccaaagugcuggg

SEQ ID NO: 1255288 - RNA, 18 nt, Human
cauggaauuggagcucgu

SEQ ID NO: 1255289 - RNA, 22 nt, Human
auccagauagguuaccaguaac

SEQ ID NO: 1255290 - RNA, 16 nt, Human
uaucaaaagaaagaaa

SEQ ID NO: 1255291 - RNA, 23 nt, Human
uagucauuugcugagcauguacu

SEQ ID NO: 1255292 - RNA, 16 nt, Human
gauagcuuuauuuuuu

SEQ ID NO: 1255293 - RNA, 16 nt, Human
gaaccuuuacauccag

SEQ ID NO: 1255294 - RNA, 14 nt, Human
ucugcuugccaucc

SEQ ID NO: 1255295 - RNA, 14 nt, Human
ucagucucccuccc

SEQ ID NO: 1255296 - RNA, 19 nt, Human
auaauacaccagagauaau

SEQ ID NO: 1255297 - RNA, 17 nt, Human
ugugaacgauuuagaaa

SEQ ID NO: 1255298 - RNA, 13 nt, Human
agugucuggcacu

SEQ ID NO: 1255299 - RNA, 20 nt, Human
agaggagaaacuggaacucu

SEQ ID NO: 1255300 - RNA, 23 nt, Human
cuaaguugcaccaacuuugaagu

SEQ ID NO: 1255301 - RNA, 23 nt, Human
aaaauguguauuuuauuacaucu

SEQ ID NO: 1255302 - RNA, 15 nt, Human
aagucugauuuuccu

SEQ ID NO: 1255303 - RNA, 21 nt, Human
auuguugacaacugugacugu

SEQ ID NO: 1255304 - RNA, 22 nt, Human
caaggcuuagacccucaugcug

SEQ ID NO: 1255305 - RNA, 14 nt, Human
cuccaccucccugc

SEQ ID NO: 1255306 - RNA, 17 nt, Human
ugaaauaagccagacau

SEQ ID NO: 1255307 - RNA, 18 nt, Human
uuguugacaacugugacu

SEQ ID NO: 1255308 - RNA, 21 nt, Human
augaggcauuugcagcugugc

SEQ ID NO: 1255309 - RNA, 13 nt, Human
uuauagaauauuu

SEQ ID NO: 1255310 - RNA, 13 nt, Human
caaaaagaauggg

SEQ ID NO: 1255311 - RNA, 13 nt, Human
cugagagugaaca

SEQ ID NO: 1255312 - RNA, 20 nt, Human
aagaauuuucaaaaucaaau

SEQ ID NO: 1255313 - RNA, 17 nt, Human
aggcuagaaccaccugc

SEQ ID NO: 1255314 - RNA, 13 nt, Human
caacaucuaguga

SEQ ID NO: 1255315 - RNA, 20 nt, Human
ucauuccccaaccacuucau

SEQ ID NO: 1255316 - RNA, 21 nt, Human
acaguuaccucugccucagaa

SEQ ID NO: 1255317 - RNA, 19 nt, Human
uguuacauuauuaucaaca

SEQ ID NO: 1255318 - RNA, 22 nt, Human
cuuccuaauuccacagcugcuc

SEQ ID NO: 1255319 - RNA, 23 nt, Human
agcuuccauuccaagccugacca

SEQ ID NO: 1255320 - RNA, 16 nt, Human
uaauuucaugaaaaga

SEQ ID NO: 1255321 - RNA, 21 nt, Human
ccugucccugcagacaugaga

SEQ ID NO: 1255322 - RNA, 19 nt, Human
gccccccagcccuccuuau

SEQ ID NO: 1255323 - RNA, 20 nt, Human
cacuagacccacuggacuca

SEQ ID NO: 1255324 - RNA, 18 nt, Human
ucuucagaccuagaauaa

SEQ ID NO: 1255325 - RNA, 20 nt, Human
agagauuuuuaaauaaagaa

SEQ ID NO: 1255326 - RNA, 16 nt, Human
gccuggcugggagugg

SEQ ID NO: 1255327 - RNA, 12 nt, Human
acacugaagaag

SEQ ID NO: 1255328 - RNA, 22 nt, Human
acuggcaguuuuccauugguuu

SEQ ID NO: 1255329 - RNA, 23 nt, Human
aaaucuauuuauuaauauuuaac

SEQ ID NO: 1255330 - RNA, 19 nt, Human
gucaaauugugugaaaggu

SEQ ID NO: 1255331 - RNA, 13 nt, Human
gcagaacagugau

SEQ ID NO: 1255332 - RNA, 19 nt, Human
cuuuuuuuuuuuuuuaaac

SEQ ID NO: 1255333 - RNA, 17 nt, Human
uaaaaggccugucccug

SEQ ID NO: 1255334 - RNA, 22 nt, Human
cauguacauccauggugugcug

SEQ ID NO: 1255335 - RNA, 18 nt, Human
agcaaauguuaugcauaa

SEQ ID NO: 1255336 - RNA, 17 nt, Human
ggacacaggcuccaaac

SEQ ID NO: 1255337 - RNA, 19 nt, Human
gcacuuuaacacagugucu

SEQ ID NO: 1255338 - RNA, 13 nt, Human
aauguaaacaaag

SEQ ID NO: 1255339 - RNA, 21 nt, Human
guaaaauacuucuugaagccg

SEQ ID NO: 1255340 - RNA, 16 nt, Human
uacauuuccaaauuca

SEQ ID NO: 1255341 - RNA, 14 nt, Human
uaaaauccauacau

SEQ ID NO: 1255342 - RNA, 19 nt, Human
ucagugucaaugcagcccc

SEQ ID NO: 1255343 - RNA, 20 nt, Human
aguuccugagaccagccaac

SEQ ID NO: 1255344 - RNA, 17 nt, Human
cucagucucccucccuu

SEQ ID NO: 1255345 - RNA, 16 nt, Human
aaauauuuauuuuaau

SEQ ID NO: 1255346 - RNA, 16 nt, Human
gcuuuuucucucccac

SEQ ID NO: 1255347 - RNA, 21 nt, Human
uauguaaauagaaacguguau

SEQ ID NO: 1255348 - RNA, 17 nt, Human
guaucuuguuuuuccac

SEQ ID NO: 1255349 - RNA, 13 nt, Human
auugcauuaaaua

SEQ ID NO: 1255350 - RNA, 21 nt, Human
acuggcucccuggaagagauc

SEQ ID NO: 1255351 - RNA, 14 nt, Human
gcugcaaaauguua

SEQ ID NO: 1255352 - RNA, 20 nt, Human
auauauguguuuuucacauu

SEQ ID NO: 1255353 - RNA, 15 nt, Human
aauauaauaugcaca

SEQ ID NO: 1255354 - RNA, 20 nt, Human
gugugcuggcuuaaaaugua

SEQ ID NO: 1255355 - RNA, 16 nt, Human
gccuaagugcagcccc

SEQ ID NO: 1255356 - RNA, 18 nt, Human
aagaagacaacauuaaaa

SEQ ID NO: 1255357 - RNA, 13 nt, Human
cgggaggcagagg

SEQ ID NO: 1255358 - RNA, 20 nt, Human
cacuguggguagacacacau

SEQ ID NO: 1255359 - RNA, 23 nt, Human
agcagugcuugaaugaaguugua

SEQ ID NO: 1255360 - RNA, 12 nt, Human
auguauuauuua

SEQ ID NO: 1255361 - RNA, 18 nt, Human
gaauucuuacauguuuuc

SEQ ID NO: 1255362 - RNA, 19 nt, Human
cgaucuuugacucuuuugc

SEQ ID NO: 1255363 - RNA, 18 nt, Human
gccagcaguucagagcug

SEQ ID NO: 1255364 - RNA, 19 nt, Human
ccauccugccccugagccc

SEQ ID NO: 1255365 - RNA, 22 nt, Human
gggacaguuccugagaccagcc

SEQ ID NO: 1255366 - RNA, 11 nt, Human
aaguauauaua

SEQ ID NO: 1255367 - RNA, 21 nt, Human
cuguuccuucacauccugugu

SEQ ID NO: 1255368 - RNA, 23 nt, Human
ucuggcacuugggacaaaaacaa

SEQ ID NO: 1255369 - RNA, 19 nt, Human
uggagggggcgcgugcagg

SEQ ID NO: 1255370 - RNA, 20 nt, Human
gauugugccccugcacucca

SEQ ID NO: 1255371 - RNA, 19 nt, Human
uugccaucccucccuccac

SEQ ID NO: 1255372 - RNA, 16 nt, Human
uacuuuguuauuuuuc

SEQ ID NO: 1255373 - RNA, 15 nt, Human
gaucauguauuuauu

SEQ ID NO: 1255374 - RNA, 22 nt, Human
cugagcagugcuugaaugaagu

SEQ ID NO: 1255375 - RNA, 21 nt, Human
uuccuggacaguuuucugcuu

SEQ ID NO: 1255376 - RNA, 14 nt, Human
aaugagcaaaaguu

SEQ ID NO: 1255377 - RNA, 19 nt, Human
uacaguuagagauuuuuaa

SEQ ID NO: 1255378 - RNA, 22 nt, Human
caccaaacccggccugauuaaa

SEQ ID NO: 1255379 - RNA, 16 nt, Human
uucccaacuccagaaa

SEQ ID NO: 1255380 - RNA, 21 nt, Human
uuuuaaauaaagaauuuuaaa

SEQ ID NO: 1255381 - RNA, 15 nt, Human
auaauuuugugaagc

SEQ ID NO: 1255382 - RNA, 14 nt, Human
cuguaaucccagcu

SEQ ID NO: 1255383 - RNA, 21 nt, Human
guuacucugaagggcaucaug

SEQ ID NO: 1255384 - RNA, 20 nt, Human
cagccugagcgacagugaga

SEQ ID NO: 1255385 - RNA, 15 nt, Human
aaccugggggcuuua

SEQ ID NO: 1255386 - RNA, 16 nt, Human
aagauuuguaauauuu

SEQ ID NO: 1255387 - RNA, 13 nt, Human
auugucuagugaa

SEQ ID NO: 1255388 - RNA, 23 nt, Human
ccaagaaugagaagaaugacuau

SEQ ID NO: 1255389 - RNA, 14 nt, Human
aauauuuauuuuaa

SEQ ID NO: 1255390 - RNA, 21 nt, Human
caagacugcacaucaaaauau

SEQ ID NO: 1255391 - RNA, 16 nt, Human
uugcuaggucacagag

SEQ ID NO: 1255392 - RNA, 15 nt, Human
aauuuuuuucaucuu

SEQ ID NO: 1255393 - RNA, 22 nt, Human
cucugggauagcugacccagcc

SEQ ID NO: 1255394 - RNA, 21 nt, Human
uuguuuuaaaauuaaagcuaa

SEQ ID NO: 1255395 - RNA, 17 nt, Human
ccugcaggcaugaguca

SEQ ID NO: 1255396 - RNA, 13 nt, Human
uuaugcuaaguga

SEQ ID NO: 1255397 - RNA, 20 nt, Human
aaguaaguuugauuucauua

SEQ ID NO: 1255398 - RNA, 18 nt, Human
acauguuuucuuugcuuu

SEQ ID NO: 1255399 - RNA, 19 nt, Human
auccauggugugcuggcuu

SEQ ID NO: 1255400 - RNA, 16 nt, Human
ggccuccauccugagg

SEQ ID NO: 1255401 - RNA, 16 nt, Human
auccuuuguuuucuga

SEQ ID NO: 1255402 - RNA, 13 nt, Human
uuacaaggcuuua

SEQ ID NO: 1255403 - RNA, 20 nt, Human
aacauuauuuauauggggaa

SEQ ID NO: 1255404 - RNA, 20 nt, Human
aucucugauacuuuuuucau

SEQ ID NO: 1255405 - RNA, 13 nt, Human
uggcaguuuucca

SEQ ID NO: 1255406 - RNA, 24 nt, Human
acauuugcgaaugguuccauucuc

SEQ ID NO: 1255407 - RNA, 18 nt, Human
uccagaaauaaugaaaua

SEQ ID NO: 1255408 - RNA, 14 nt, Human
auaaucuuuuauac

SEQ ID NO: 1255409 - RNA, 18 nt, Human
agaagcaacccaaauguu

SEQ ID NO: 1255410 - RNA, 19 nt, Human
acaaggcuuuaucucaggg

SEQ ID NO: 1255411 - RNA, 22 nt, Human
uacauaagggaggaaaaaaaau

SEQ ID NO: 1255412 - RNA, 16 nt, Human
uauauuuuuuaugaaa

SEQ ID NO: 1255413 - RNA, 17 nt, Human
uucaguugauuuuacaa

SEQ ID NO: 1255414 - RNA, 18 nt, Human
ucacauuggcuauuuaaa

SEQ ID NO: 1255415 - RNA, 16 nt, Human
uuaauauauguauuau

SEQ ID NO: 1255416 - RNA, 22 nt, Human
gaagugaaaaucuacacuccag

SEQ ID NO: 1255417 - RNA, 16 nt, Human
ugcuguauuuuaaaag

SEQ ID NO: 1255418 - RNA, 16 nt, Human
cuacacuccagugaga

SEQ ID NO: 1255419 - RNA, 14 nt, Human
auauuuauuauuuu

SEQ ID NO: 1255420 - RNA, 15 nt, Human
aaucuaaaucuauuu

SEQ ID NO: 1255421 - RNA, 18 nt, Human
accaccugccuauauuuu

SEQ ID NO: 1255422 - RNA, 23 nt, Human
ccagcuacuugggaggcugaggc

SEQ ID NO: 1255423 - RNA, 13 nt, Human
caccaaggagcca

SEQ ID NO: 1255424 - RNA, 21 nt, Human
auuauauuuauuacuguaaga

SEQ ID NO: 1255425 - RNA, 15 nt, Human
ccuugccaugugcua

SEQ ID NO: 1255426 - RNA, 16 nt, Human
ccugggcagcugccuc

SEQ ID NO: 1255427 - RNA, 13 nt, Human
aaauaaagaauuu

SEQ ID NO: 1255428 - RNA, 13 nt, Human
auuuauugagcac

SEQ ID NO: 1255429 - RNA, 20 nt, Human
augaaguuguagguaauauu

SEQ ID NO: 1255430 - RNA, 22 nt, Human
cagacuuuuuuuuuuuuuuaaa

SEQ ID NO: 1255431 - RNA, 19 nt, Human
auuauggcugguaacauag

SEQ ID NO: 1255432 - RNA, 11 nt, Human
aauaucuauua

SEQ ID NO: 1255433 - RNA, 13 nt, Human
agagguccacaac

SEQ ID NO: 1255434 - RNA, 13 nt, Human
uaauuuuuauauu

SEQ ID NO: 1255435 - RNA, 18 nt, Human
ugguuccauucucucucc

SEQ ID NO: 1255436 - RNA, 13 nt, Human
cccaaaaggcaga

SEQ ID NO: 1255437 - RNA, 19 nt, Human
auucccagccagcacagcc

SEQ ID NO: 1255438 - RNA, 24 nt, Human
aaagacagcuucucauccugcagg

SEQ ID NO: 1255439 - RNA, 18 nt, Human
guauuuguuuguauuuug

SEQ ID NO: 1255440 - RNA, 15 nt, Human
uauuauuuauauaug

SEQ ID NO: 1255441 - RNA, 17 nt, Human
ggaaauauuuauuuuaa

SEQ ID NO: 1255442 - RNA, 17 nt, Human
acuugaacccauauuug

SEQ ID NO: 1255443 - RNA, 19 nt, Human
uagcuuuauuuuuuaagua

SEQ ID NO: 1255444 - RNA, 14 nt, Human
agaaaugaaagcag

SEQ ID NO: 1255445 - RNA, 17 nt, Human
uuuaagauaauuauaau

SEQ ID NO: 1255446 - RNA, 16 nt, Human
auaucuauuaauauau

SEQ ID NO: 1255447 - RNA, 23 nt, Human
aauagcaguugaaacaagaagcc

SEQ ID NO: 1255448 - RNA, 16 nt, Human
acuuuggcaaaugagc

SEQ ID NO: 1255449 - RNA, 18 nt, Human
uaaaauccauacauuugu

SEQ ID NO: 1255450 - RNA, 22 nt, Human
aaucugcacugugggcuuuuau

SEQ ID NO: 1255451 - RNA, 23 nt, Human
ggaugaauuaaguuuuuuuuuaa

SEQ ID NO: 1255452 - RNA, 16 nt, Human
aggcuugccugcaggc

SEQ ID NO: 1255453 - RNA, 13 nt, Human
ucugcuugccauc

SEQ ID NO: 1255454 - RNA, 20 nt, Human
aacucaucauaaaauaaagu

SEQ ID NO: 1255455 - RNA, 23 nt, Human
aucucuucuggguuccuuccucu

SEQ ID NO: 1255456 - RNA, 17 nt, Human
ggcgcgugcaggcagca

SEQ ID NO: 1255457 - RNA, 15 nt, Human
uguauuuuaaaagaa

SEQ ID NO: 1255458 - RNA, 20 nt, Human
cugcacacagcacgggggcc

SEQ ID NO: 1255459 - RNA, 19 nt, Human
accccugagcuugcagaga

SEQ ID NO: 1255460 - RNA, 18 nt, Human
uucuggguucaagcgauu

SEQ ID NO: 1255461 - RNA, 14 nt, Human
acucuauagacucu

SEQ ID NO: 1255462 - RNA, 18 nt, Human
cuuccucugagccuuggg

SEQ ID NO: 1255463 - RNA, 19 nt, Human
uauuauaauuuuuuucaau

SEQ ID NO: 1255464 - RNA, 12 nt, Human
cauuugcugagc

SEQ ID NO: 1255465 - RNA, 16 nt, Human
uugccauaauuacuau

SEQ ID NO: 1255466 - RNA, 15 nt, Human
cuuacuauuuauugc

SEQ ID NO: 1255467 - RNA, 20 nt, Human
ccaccuucuggguucaagcg

SEQ ID NO: 1255468 - RNA, 22 nt, Human
aaugggcacaggguuuauguuu

SEQ ID NO: 1255469 - RNA, 13 nt, Human
ccaaaagguauuu

SEQ ID NO: 1255470 - RNA, 14 nt, Human
ugaagauguagagg

SEQ ID NO: 1255471 - RNA, 21 nt, Human
ccuggugccucaccccuugcc

SEQ ID NO: 1255472 - RNA, 20 nt, Human
ucaaaacuucagacauagaa

SEQ ID NO: 1255473 - RNA, 14 nt, Human
ggcacuugggacaa

SEQ ID NO: 1255474 - RNA, 14 nt, Human
ccacccuugccaug

SEQ ID NO: 1255475 - RNA, 19 nt, Human
acaauagcagacaguguuu

SEQ ID NO: 1255476 - RNA, 15 nt, Human
guggcgcgcaccugu

SEQ ID NO: 1255477 - RNA, 20 nt, Human
ugccccccagcccuccuuau

SEQ ID NO: 1255478 - RNA, 19 nt, Human
ggaaaggagaaguuaagca

SEQ ID NO: 1255479 - RNA, 13 nt, Human
auccugaggcucc

SEQ ID NO: 1255480 - RNA, 23 nt, Human
uacuucauuuaaaauauuuuuau

SEQ ID NO: 1255481 - RNA, 15 nt, Human
ugucaauaaaaucca

SEQ ID NO: 1255482 - RNA, 22 nt, Human
uauuuauaaauauauuuaagau

SEQ ID NO: 1255483 - RNA, 22 nt, Human
guguccccuauccuacuucccc

SEQ ID NO: 1255484 - RNA, 14 nt, Human
aguucagagcugcc

SEQ ID NO: 1255485 - RNA, 21 nt, Human
ucuuuucuggaauguaaucaa

SEQ ID NO: 1255486 - RNA, 20 nt, Human
caggcugagccucagucucc

SEQ ID NO: 1255487 - RNA, 22 nt, Human
auggaaauguuuacagaucccc

SEQ ID NO: 1255488 - RNA, 23 nt, Human
uugauagcaagugaauuuuucuc

SEQ ID NO: 1255489 - RNA, 23 nt, Human
cagacuuuuuuuuuuuuuuaaac

SEQ ID NO: 1255490 - RNA, 18 nt, Human
uuuuuaauuauuauuuau

SEQ ID NO: 1255491 - RNA, 22 nt, Human
cucuggccuucggccuccaucc

SEQ ID NO: 1255492 - RNA, 11 nt, Human
cucaucauaaa

SEQ ID NO: 1255493 - RNA, 14 nt, Human
ugagacucugucuc

SEQ ID NO: 1255494 - RNA, 17 nt, Human
ucuauuagccacaaaau

SEQ ID NO: 1255495 - RNA, 12 nt, Human
aagagcuuaaca

SEQ ID NO: 1255496 - RNA, 12 nt, Human
ugcaggcagcag

SEQ ID NO: 1255497 - RNA, 17 nt, Human
guguauuuucagcagag

SEQ ID NO: 1255498 - RNA, 15 nt, Human
gaaaacaaggaugaa

SEQ ID NO: 1255499 - RNA, 19 nt, Human
ucaauauuuauuauuuuca

SEQ ID NO: 1255500 - RNA, 14 nt, Human
cauuuuaauuauua

SEQ ID NO: 1255501 - RNA, 18 nt, Human
aagacucugucucaaaaa

SEQ ID NO: 1255502 - RNA, 19 nt, Human
uuuuuuaugaaacauuaca

SEQ ID NO: 1255503 - RNA, 21 nt, Human
ucucagaaauuguaucuuagu

SEQ ID NO: 1255504 - RNA, 18 nt, Human
accucccugcaauaaaau

SEQ ID NO: 1255505 - RNA, 10 nt, Human
uucccugccu

SEQ ID NO: 1255506 - RNA, 15 nt, Human
caaagaagacaacau

SEQ ID NO: 1255507 - RNA, 18 nt, Human
accaggcuugccugcagg

SEQ ID NO: 1255508 - RNA, 18 nt, Human
ccacauucagagcuuacu

SEQ ID NO: 1255509 - RNA, 18 nt, Human
cccaggaguuuggccaga

SEQ ID NO: 1255510 - RNA, 16 nt, Human
gucagaagaccugguc

SEQ ID NO: 1255511 - RNA, 16 nt, Human
acuaugaggaauauuu

SEQ ID NO: 1255512 - RNA, 14 nt, Human
aaaaggaagaaauu

SEQ ID NO: 1255513 - RNA, 14 nt, Human
cgcccaucuccguc

SEQ ID NO: 1255514 - RNA, 21 nt, Human
uccugggcagcugccuccccu

SEQ ID NO: 1255515 - RNA, 15 nt, Human
caggaaguagaggag

SEQ ID NO: 1255516 - RNA, 16 nt, Human
augcauacaguaauuu

SEQ ID NO: 1255517 - RNA, 19 nt, Human
guuagagauuuuuaaauaa

SEQ ID NO: 1255518 - RNA, 14 nt, Human
uuccugagccagug

SEQ ID NO: 1255519 - RNA, 17 nt, Human
uccacaacacacagauu

SEQ ID NO: 1255520 - RNA, 22 nt, Human
auuuuauuacaucuuucacauu

SEQ ID NO: 1255521 - RNA, 12 nt, Human
uucccugaccuc

SEQ ID NO: 1255522 - RNA, 14 nt, Human
auuacaucuuucac

SEQ ID NO: 1255523 - RNA, 16 nt, Human
cuucuggguuccuucc

SEQ ID NO: 1255524 - RNA, 14 nt, Human
ucccucuguugcca

SEQ ID NO: 1255525 - RNA, 15 nt, Human
uaacauagguuuuua

SEQ ID NO: 1255526 - RNA, 13 nt, Human
aguguccucaucu

SEQ ID NO: 1255527 - RNA, 15 nt, Human
uuuaccugugaaaua

SEQ ID NO: 1255528 - RNA, 19 nt, Human
aauuuuguuauguauauuu

SEQ ID NO: 1255529 - RNA, 21 nt, Human
uccaccucccugcaauaaaau

SEQ ID NO: 1255530 - RNA, 16 nt, Human
cuuuggaugcacuuua

SEQ ID NO: 1255531 - RNA, 14 nt, Human
aauugcagaguacu

SEQ ID NO: 1255532 - RNA, 17 nt, Human
ccucuggcuccagcugg

SEQ ID NO: 1255533 - RNA, 23 nt, Human
ccagagggaauugcagaguacug

SEQ ID NO: 1255534 - RNA, 15 nt, Human
augggacagggagga

SEQ ID NO: 1255535 - RNA, 16 nt, Human
auuauaauuuuuuuca

SEQ ID NO: 1255536 - RNA, 18 nt, Human
uuagagauuuuuaaauaa

SEQ ID NO: 1255537 - RNA, 19 nt, Human
ugaucaccugcccugcuga

SEQ ID NO: 1255538 - RNA, 18 nt, Human
cccucuccugggcagcug

SEQ ID NO: 1255539 - RNA, 17 nt, Human
uaagauuuguaauauuu

SEQ ID NO: 1255540 - RNA, 12 nt, Human
aaaugaaagcag

SEQ ID NO: 1255541 - RNA, 19 nt, Human
cacaggaaccacaagacug

SEQ ID NO: 1255542 - RNA, 13 nt, Human
ugcaacaaaauuc

SEQ ID NO: 1255543 - RNA, 15 nt, Human
auuaucaauaucuaa

SEQ ID NO: 1255544 - RNA, 18 nt, Human
uggaugcacuuuauauua

SEQ ID NO: 1255545 - RNA, 19 nt, Human
auuacaguuagagauuuuu

SEQ ID NO: 1255546 - RNA, 14 nt, Human
auauuugaaauauu

SEQ ID NO: 1255547 - RNA, 23 nt, Human
uaaguuuuuuuuuaaaaaagaaa

SEQ ID NO: 1255548 - RNA, 21 nt, Human
cugcuugccaucccucccucc

SEQ ID NO: 1255549 - RNA, 19 nt, Human
cagcacgggggccaaggau

SEQ ID NO: 1255550 - RNA, 20 nt, Human
agcaaagacuaugaggaaua

SEQ ID NO: 1255551 - RNA, 22 nt, Human
aaagcacgaaauguuauuuuuu

SEQ ID NO: 1255552 - RNA, 16 nt, Human
ugugcuggcuuaaaau

SEQ ID NO: 1255553 - RNA, 14 nt, Human
uggacucaccuccc

SEQ ID NO: 1255554 - RNA, 18 nt, Human
gccuaucagcauuuuacu

SEQ ID NO: 1255555 - RNA, 23 nt, Human
uagagacuuugugaaaaaaaauu

SEQ ID NO: 1255556 - RNA, 14 nt, Human
auuuucccaaaacu

SEQ ID NO: 1255557 - RNA, 14 nt, Human
auaaagaauuuuaa

SEQ ID NO: 1255558 - RNA, 18 nt, Human
caaagacuaugaggaaua

SEQ ID NO: 1255559 - RNA, 15 nt, Human
auuugguaaggggaa

SEQ ID NO: 1255560 - RNA, 14 nt, Human
uaccuuuuuccuuc

SEQ ID NO: 1255561 - RNA, 14 nt, Human
gcuggagcucugcc

SEQ ID NO: 1255562 - RNA, 22 nt, Human
uaucaaaacuuucuuuucugga

SEQ ID NO: 1255563 - RNA, 23 nt, Human
aauagaaacguguauauuuuuua

SEQ ID NO: 1255564 - RNA, 15 nt, Human
cuggguuccuuccuc

SEQ ID NO: 1255565 - RNA, 14 nt, Human
ucaaugcagccccc

SEQ ID NO: 1255566 - RNA, 15 nt, Human
aucuagcaaauguua

SEQ ID NO: 1255567 - RNA, 23 nt, Human
caucucuucuggguuccuuccuc

SEQ ID NO: 1255568 - RNA, 14 nt, Human
gagccagugucagg

SEQ ID NO: 1255569 - RNA, 18 nt, Human
ugcuuguuagcaaaaugg

SEQ ID NO: 1255570 - RNA, 15 nt, Human
aucuaauauauauga

SEQ ID NO: 1255571 - RNA, 19 nt, Human
cuacuaaaaauacaaaaau

SEQ ID NO: 1255572 - RNA, 14 nt, Human
auauuauuuugaau

SEQ ID NO: 1255573 - RNA, 13 nt, Human
ugcuuggcccagg

SEQ ID NO: 1255574 - RNA, 17 nt, Human
aauauuuauuaccucug

SEQ ID NO: 1255575 - RNA, 21 nt, Human
uaucuaauauauaugaauaaa

SEQ ID NO: 1255576 - RNA, 17 nt, Human
aaauuaaggcauaagaa

SEQ ID NO: 1255577 - RNA, 20 nt, Human
augcaguuguugcccacagc

SEQ ID NO: 1255578 - RNA, 21 nt, Human
ugggaggcugagaugggagaa

SEQ ID NO: 1255579 - RNA, 15 nt, Human
ugcaaccuccaccuu

SEQ ID NO: 1255580 - RNA, 22 nt, Human
gcuugcagagaugaggccgcca

SEQ ID NO: 1255581 - RNA, 16 nt, Human
auggagguuaagcacu

SEQ ID NO: 1255582 - RNA, 20 nt, Human
ugagagacacacugaagaag

SEQ ID NO: 1255583 - RNA, 21 nt, Human
aguuucaguugauuuuacaau

SEQ ID NO: 1255584 - RNA, 14 nt, Human
uaacaauuuuagga

SEQ ID NO: 1255585 - RNA, 15 nt, Human
cuaugaggaauauuu

SEQ ID NO: 1255586 - RNA, 22 nt, Human
augggaugaucauguauuuauu

SEQ ID NO: 1255587 - RNA, 22 nt, Human
agcuacuugggaggcugaggca

SEQ ID NO: 1255588 - RNA, 23 nt, Human
agaccauaauguuacauuauuau

SEQ ID NO: 1255589 - RNA, 15 nt, Human
cugccuccccuccuc

SEQ ID NO: 1255590 - RNA, 15 nt, Human
acaaagacaaauucu

SEQ ID NO: 1255591 - RNA, 14 nt, Human
cacuuauaggaauu

SEQ ID NO: 1255592 - RNA, 15 nt, Human
acauguuuucuuugc

SEQ ID NO: 1255593 - RNA, 14 nt, Human
accugcuguuuccu

SEQ ID NO: 1255594 - RNA, 12 nt, Human
guauauauagaa

SEQ ID NO: 1255595 - RNA, 21 nt, Human
agggugauauuaaccaggggc

SEQ ID NO: 1255596 - RNA, 14 nt, Human
uaguaucaaaagaa

SEQ ID NO: 1255597 - RNA, 20 nt, Human
cacuggcucccuggaagaga

SEQ ID NO: 1255598 - RNA, 16 nt, Human
cagucucccucccuug

SEQ ID NO: 1255599 - RNA, 19 nt, Human
uaguaccaaucauuuuaau

SEQ ID NO: 1255600 - RNA, 20 nt, Human
aacaaacgaaaaacauuuca

SEQ ID NO: 1255601 - RNA, 20 nt, Human
ccaaucauuuuaauuauuau

SEQ ID NO: 1255602 - RNA, 16 nt, Human
ucacaagugaaaaaca

SEQ ID NO: 1255603 - RNA, 13 nt, Human
gcgugcaggcagc

SEQ ID NO: 1255604 - RNA, 14 nt, Human
cuaaauuugguucu

SEQ ID NO: 1255605 - RNA, 22 nt, Human
caucgcaauguaagacucggga

SEQ ID NO: 1255606 - RNA, 16 nt, Human
uauuauuuauauaugu

SEQ ID NO: 1255607 - RNA, 22 nt, Human
ccggagccccuugggcagguca

SEQ ID NO: 1255608 - RNA, 16 nt, Human
uuuguaauauuucucu

SEQ ID NO: 1255609 - RNA, 14 nt, Human
ccagcuggccggga

SEQ ID NO: 1255610 - RNA, 16 nt, Human
cccccagcccuccuua

SEQ ID NO: 1255611 - RNA, 13 nt, Human
aaaaaauaaaaau

SEQ ID NO: 1255612 - RNA, 20 nt, Human
ccagauacacccaaaguauc

SEQ ID NO: 1255613 - RNA, 21 nt, Human
cauuucaaaagguauuuauug

SEQ ID NO: 1255614 - RNA, 16 nt, Human
cauggugaaaccccgu

SEQ ID NO: 1255615 - RNA, 17 nt, Human
ucauccugcaggcagcu

SEQ ID NO: 1255616 - RNA, 16 nt, Human
auguaaucaauguuuc

SEQ ID NO: 1255617 - RNA, 15 nt, Human
uuuccaaauucacaa

SEQ ID NO: 1255618 - RNA, 13 nt, Human
acucugcauucua

SEQ ID NO: 1255619 - RNA, 22 nt, Human
agacccacuggacucaccuccc

SEQ ID NO: 1255620 - RNA, 21 nt, Human
aaugacacuagcuaauaucaa

SEQ ID NO: 1255621 - RNA, 13 nt, Human
uaagugcagcccc

SEQ ID NO: 1255622 - RNA, 19 nt, Human
aacucuuaaucaaauagca

SEQ ID NO: 1255623 - RNA, 21 nt, Human
uagggugauauuaaccagggg

SEQ ID NO: 1255624 - RNA, 12 nt, Human
cuucucuuaaac

SEQ ID NO: 1255625 - RNA, 13 nt, Human
acaugaagaagcu

SEQ ID NO: 1255626 - RNA, 13 nt, Human
aauaaaaagguga

SEQ ID NO: 1255627 - RNA, 21 nt, Human
gauaaguaaguuugauuucau

SEQ ID NO: 1255628 - RNA, 18 nt, Human
uguuauuuuuuaauuauu

SEQ ID NO: 1255629 - RNA, 16 nt, Human
aaauaaugaaauaacu

SEQ ID NO: 1255630 - RNA, 16 nt, Human
ccuggugggcagagag

SEQ ID NO: 1255631 - RNA, 22 nt, Human
aauugacccacaagaaaugaaa

SEQ ID NO: 1255632 - RNA, 23 nt, Human
uuaucagucauaacuaaauaaag

SEQ ID NO: 1255633 - RNA, 19 nt, Human
gcuaccuuuugcuguggca

SEQ ID NO: 1255634 - RNA, 21 nt, Human
uaaaaaggcauguaauugcuu

SEQ ID NO: 1255635 - RNA, 19 nt, Human
aacuauauuaucaugcaaa

SEQ ID NO: 1255636 - RNA, 23 nt, Human
uaauuuguaguguuggagaagaa

SEQ ID NO: 1255637 - RNA, 17 nt, Human
uaucuauuaauauaugu

SEQ ID NO: 1255638 - RNA, 15 nt, Human
acuagaauuuauuca

SEQ ID NO: 1255639 - RNA, 24 nt, Human
aaaggccugucccugcagacauga

SEQ ID NO: 1255640 - RNA, 12 nt, Human
accagccaaccu

SEQ ID NO: 1255641 - RNA, 12 nt, Human
uucuaaaugaau

SEQ ID NO: 1255642 - RNA, 11 nt, Human
aaggcuggagu

SEQ ID NO: 1255643 - RNA, 15 nt, Human
ucauuuaaaauauuu

SEQ ID NO: 1255644 - RNA, 14 nt, Human
aacucaguuuuaac

SEQ ID NO: 1255645 - RNA, 22 nt, Human
uaugcauacaguaauuuuaagu

SEQ ID NO: 1255646 - RNA, 18 nt, Human
cccacuagacccacugga

SEQ ID NO: 1255647 - RNA, 23 nt, Human
uguaaucccagcacuuugggagg

SEQ ID NO: 1255648 - RNA, 19 nt, Human
aaaugaauaucuauuaaua

SEQ ID NO: 1255649 - RNA, 19 nt, Human
aauaaauguaucuuauuca

SEQ ID NO: 1255650 - RNA, 15 nt, Human
gccuccccuccucug

SEQ ID NO: 1255651 - RNA, 22 nt, Human
guauuuuuaccuuuuuccuucc

SEQ ID NO: 1255652 - RNA, 22 nt, Human
caaugcuguauuuuaaaagaau

SEQ ID NO: 1255653 - RNA, 16 nt, Human
cagaagaaauucugca

SEQ ID NO: 1255654 - RNA, 14 nt, Human
auuaauauauguau

SEQ ID NO: 1255655 - RNA, 15 nt, Human
acaucaacagauaaa

SEQ ID NO: 1255656 - RNA, 19 nt, Human
acaaucugaggccuccucu

SEQ ID NO: 1255657 - RNA, 16 nt, Human
caggaaguagaggagg

SEQ ID NO: 1255658 - RNA, 20 nt, Human
uauacuguauuuuuaccuuu

SEQ ID NO: 1255659 - RNA, 20 nt, Human
ugccuccccuccucugcuug

SEQ ID NO: 1255660 - RNA, 14 nt, Human
augaaccuuuacau

SEQ ID NO: 1255661 - RNA, 16 nt, Human
aauuuucccaaaacug

SEQ ID NO: 1255662 - RNA, 18 nt, Human
uguugauagcaagugaau

SEQ ID NO: 1255663 - RNA, 17 nt, Human
uucucuaggaaauauuu

SEQ ID NO: 1255664 - RNA, 14 nt, Human
cugggcagcugccu

SEQ ID NO: 1255665 - RNA, 19 nt, Human
cuagaguuuagcuggaaaa

SEQ ID NO: 1255666 - RNA, 20 nt, Human
aaacagaacuauggaaaaaa

SEQ ID NO: 1255667 - RNA, 15 nt, Human
cuuugaugauuaauu

SEQ ID NO: 1255668 - RNA, 17 nt, Human
caucccucccuccaccu

SEQ ID NO: 1255669 - RNA, 16 nt, Human
uuuucucuaggaaaua

SEQ ID NO: 1255670 - RNA, 18 nt, Human
aguaauuucagaagaaau

SEQ ID NO: 1255671 - RNA, 19 nt, Human
uuguguaaugaaaaugaau

SEQ ID NO: 1255672 - RNA, 19 nt, Human
cuaguaucaaaagaaagaa

SEQ ID NO: 1255673 - RNA, 14 nt, Human
cuggaauguaauca

SEQ ID NO: 1255674 - RNA, 13 nt, Human
aauguuacauuau

SEQ ID NO: 1255675 - RNA, 14 nt, Human
cccugccccccagc

SEQ ID NO: 1255676 - RNA, 17 nt, Human
uccuacaagcuaaaauu

SEQ ID NO: 1255677 - RNA, 14 nt, Human
gaaacauuacaguu

SEQ ID NO: 1255678 - RNA, 17 nt, Human
cuacaagcuaaaauuag

SEQ ID NO: 1255679 - RNA, 16 nt, Human
caggcugagccucagu

SEQ ID NO: 1255680 - RNA, 14 nt, Human
aucuuguuuuucca

SEQ ID NO: 1255681 - RNA, 15 nt, Human
ucucauccugcaggc

SEQ ID NO: 1255682 - RNA, 16 nt, Human
auuuuuccccaaaaag

SEQ ID NO: 1255683 - RNA, 19 nt, Human
uuuaugcauacaguaauuu

SEQ ID NO: 1255684 - RNA, 16 nt, Human
guuccuuccucugagc

SEQ ID NO: 1255685 - RNA, 18 nt, Human
cuuuaauuucaugaaaag

SEQ ID NO: 1255686 - RNA, 23 nt, Human
aaagcccagcuugaaaccuucac

SEQ ID NO: 1255687 - RNA, 15 nt, Human
caaauaaguauuuau

SEQ ID NO: 1255688 - RNA, 21 nt, Human
caauuuuguuauguauauuuu

SEQ ID NO: 1255689 - RNA, 23 nt, Human
ccuugggcaggucacacaaccug

SEQ ID NO: 1255690 - RNA, 14 nt, Human
cacuguuaucaaaa

SEQ ID NO: 1255691 - RNA, 23 nt, Human
ucauauaauaaauguacauuaau

SEQ ID NO: 1255692 - RNA, 19 nt, Human
uucaauacuucauuuaaaa

SEQ ID NO: 1255693 - RNA, 14 nt, Human
ccccugagcuugca

SEQ ID NO: 1255694 - RNA, 17 nt, Human
gaagcaccaaucaugaa

SEQ ID NO: 1255695 - RNA, 12 nt, Human
gcuggauucaag

SEQ ID NO: 1255696 - RNA, 22 nt, Human
ucaggagauuucaugccuggug

SEQ ID NO: 1255697 - RNA, 20 nt, Human
aaucuuucacaggggacagg

SEQ ID NO: 1255698 - RNA, 12 nt, Human
gaauaucuauua

SEQ ID NO: 1255699 - RNA, 20 nt, Human
uugauagaguguuaucaguc

SEQ ID NO: 1255700 - RNA, 19 nt, Human
gccaucccucccuccaccu

SEQ ID NO: 1255701 - RNA, 11 nt, Human
augggacaggg

SEQ ID NO: 1255702 - RNA, 18 nt, Human
cauaguaccaaucauuuu

SEQ ID NO: 1255703 - RNA, 13 nt, Human
cugcuuucaucuu

SEQ ID NO: 1255704 - RNA, 15 nt, Human
auuucagaagaaauu

SEQ ID NO: 1255705 - RNA, 16 nt, Human
gugagacagcucugca

SEQ ID NO: 1255706 - RNA, 16 nt, Human
cagaagcaacccaaau

SEQ ID NO: 1255707 - RNA, 15 nt, Human
cauguccacugguuc

SEQ ID NO: 1255708 - RNA, 14 nt, Human
auuucuaugaaaua

SEQ ID NO: 1255709 - RNA, 17 nt, Human
uccauccugaggcucca

SEQ ID NO: 1255710 - RNA, 20 nt, Human
acuaaaaaggcauguaauug

SEQ ID NO: 1255711 - RNA, 21 nt, Human
gacagaaagcagaacagugau

SEQ ID NO: 1255712 - RNA, 21 nt, Human
gccaucccucccuccaccucc

SEQ ID NO: 1255713 - RNA, 15 nt, Human
cugcagauaaacagu

SEQ ID NO: 1255714 - RNA, 13 nt, Human
gaaccuaggguga

SEQ ID NO: 1255715 - RNA, 12 nt, Human
caucuucucugg

SEQ ID NO: 1255716 - RNA, 14 nt, Human
uaacauuauuuaua

SEQ ID NO: 1255717 - RNA, 19 nt, Human
cagagcugcccucuccugg

SEQ ID NO: 1255718 - RNA, 21 nt, Human
uuguaauucuaaaugaauguu

SEQ ID NO: 1255719 - RNA, 18 nt, Human
gcccuggugggcagagag

SEQ ID NO: 1255720 - RNA, 14 nt, Human
ucaccuguuuuuaa

SEQ ID NO: 1255721 - RNA, 13 nt, Human
aacuaauagaauu

SEQ ID NO: 1255722 - RNA, 12 nt, Human
aacucagaaauu

SEQ ID NO: 1255723 - RNA, 15 nt, Human
uccgucucccaaagu

SEQ ID NO: 1255724 - RNA, 20 nt, Human
cuuuugcugccucuaaaagg

SEQ ID NO: 1255725 - RNA, 19 nt, Human
aucuauuuauuaauauuua

SEQ ID NO: 1255726 - RNA, 17 nt, Human
cagcaggauagaguggg

SEQ ID NO: 1255727 - RNA, 19 nt, Human
ggaucuggggcucugggau

SEQ ID NO: 1255728 - RNA, 19 nt, Human
gaauguaaucaauguuucu

SEQ ID NO: 1255729 - RNA, 15 nt, Human
caggaggaaggcuua

SEQ ID NO: 1255730 - RNA, 20 nt, Human
auauaauaaauguacauuaa

SEQ ID NO: 1255731 - RNA, 16 nt, Human
guaucuuguuuuucca

SEQ ID NO: 1255732 - RNA, 19 nt, Human
auuugguucuaggccgggc

SEQ ID NO: 1255733 - RNA, 14 nt, Human
uuaaaguuaaauaa

SEQ ID NO: 1255734 - RNA, 17 nt, Human
cauagagacuuugugaa

SEQ ID NO: 1255735 - RNA, 13 nt, Human
ccugccccccagc

SEQ ID NO: 1255736 - RNA, 15 nt, Human
ucugucucaguccau

SEQ ID NO: 1255737 - RNA, 15 nt, Human
guggguggggcagug

SEQ ID NO: 1255738 - RNA, 17 nt, Human
agauagguuaccaguaa

SEQ ID NO: 1255739 - RNA, 20 nt, Human
cucuacuaaaaauacaaaaa

SEQ ID NO: 1255740 - RNA, 17 nt, Human
auguauuuauaaauaua

SEQ ID NO: 1255741 - RNA, 15 nt, Human
auaaauauauuuaag

SEQ ID NO: 1255742 - RNA, 14 nt, Human
ucuauuuauuuacu

SEQ ID NO: 1255743 - RNA, 15 nt, Human
cuaagugcagccccg

SEQ ID NO: 1255744 - RNA, 20 nt, Human
auauaauguuguuauuuaaa

SEQ ID NO: 1255745 - RNA, 16 nt, Human
aucaauuuaaaaaaaa

SEQ ID NO: 1255746 - RNA, 23 nt, Human
aaugcuuaugaaacuaagauuug

SEQ ID NO: 1255747 - RNA, 23 nt, Human
auaucuuuuuuuuaauaaaccau

SEQ ID NO: 1255748 - RNA, 15 nt, Human
uuuuuaaauaaagaa

SEQ ID NO: 1255749 - RNA, 18 nt, Human
ccucuggcuccagcuggc

SEQ ID NO: 1255750 - RNA, 16 nt, Human
cagagcugcccucucc

SEQ ID NO: 1255751 - RNA, 14 nt, Human
cuagcgcagccaug

SEQ ID NO: 1255752 - RNA, 17 nt, Human
cuguauugcauuaaaua

SEQ ID NO: 1255753 - RNA, 19 nt, Human
aguguuaucagucauaacu

SEQ ID NO: 1255754 - RNA, 16 nt, Human
guauuuauaaauauau

SEQ ID NO: 1255755 - RNA, 13 nt, Human
cuggcuuaaaaug

SEQ ID NO: 1255756 - RNA, 23 nt, Human
aucaccaaggcugauuaaaccaa

SEQ ID NO: 1255757 - RNA, 14 nt, Human
agcucuaucaccaa

SEQ ID NO: 1255758 - RNA, 20 nt, Human
aaguauuuauauauuuauaa

SEQ ID NO: 1255759 - RNA, 18 nt, Human
ucuuugguggagauaaag

SEQ ID NO: 1255760 - RNA, 22 nt, Human
agaauucuuacauguuuucuuu

SEQ ID NO: 1255761 - RNA, 23 nt, Human
uaaguaaguuugauuucauuaau

SEQ ID NO: 1255762 - RNA, 19 nt, Human
uuauggcacuaguauuucu

SEQ ID NO: 1255763 - RNA, 14 nt, Human
aaugaacacuuaua

SEQ ID NO: 1255764 - RNA, 17 nt, Human
agucugacuguuuccau

SEQ ID NO: 1255765 - RNA, 16 nt, Human
caugguuuagaaagcu

SEQ ID NO: 1255766 - RNA, 16 nt, Human
auuguuugucugucuu

SEQ ID NO: 1255767 - RNA, 15 nt, Human
gcagcugccuccccu

SEQ ID NO: 1255768 - RNA, 19 nt, Human
auaaaguauauauagaauc

SEQ ID NO: 1255769 - RNA, 23 nt, Human
cuaaauaaagcuugcaacaaaau

SEQ ID NO: 1255770 - RNA, 20 nt, Human
aacuaauagaauuaauggaa

SEQ ID NO: 1255771 - RNA, 14 nt, Human
caaggcuagaacca

SEQ ID NO: 1255772 - RNA, 16 nt, Human
caccuguaaucccagc

SEQ ID NO: 1255773 - RNA, 20 nt, Human
ccauuguggucacaggaagu

SEQ ID NO: 1255774 - RNA, 14 nt, Human
gcaaaugcuguauu

SEQ ID NO: 1255775 - RNA, 14 nt, Human
cugcaaagcccagc

SEQ ID NO: 1255776 - RNA, 13 nt, Human
cuauuuaaagaca

SEQ ID NO: 1255777 - RNA, 16 nt, Human
aaucauuuuaauuauu

SEQ ID NO: 1255778 - RNA, 13 nt, Human
cuaugaaauauua

SEQ ID NO: 1255779 - RNA, 13 nt, Human
uuaugaaacauua

SEQ ID NO: 1255780 - RNA, 15 nt, Human
aggcuccaaacugga

SEQ ID NO: 1255781 - RNA, 19 nt, Human
ccucaacccccauuucuau

SEQ ID NO: 1255782 - RNA, 22 nt, Human
ugaaaccccgucucuacuaaaa

SEQ ID NO: 1255783 - RNA, 12 nt, Human
uguaacuuauga

SEQ ID NO: 1255784 - RNA, 18 nt, Human
uauuuaagguauauaaau

SEQ ID NO: 1255785 - RNA, 21 nt, Human
gcuaaguugcaccaacuuuga

SEQ ID NO: 1255786 - RNA, 15 nt, Human
uucggccuccauccu

SEQ ID NO: 1255787 - RNA, 19 nt, Human
aggucuaccaaaaaucuca

SEQ ID NO: 1255788 - RNA, 16 nt, Human
uagagugggacaguuc

SEQ ID NO: 1255789 - RNA, 23 nt, Human
uaaucauauaauaaauguacauu

SEQ ID NO: 1255790 - RNA, 22 nt, Human
acauccuacaagacacagugac

SEQ ID NO: 1255791 - RNA, 11 nt, Human
aauuccacagc

SEQ ID NO: 1255792 - RNA, 21 nt, Human
ugggcauucuuguuucaauuc

SEQ ID NO: 1255793 - RNA, 14 nt, Human
acacugaagaagca

SEQ ID NO: 1255794 - RNA, 23 nt, Human
cccagcccuccuuaucaaaggac

SEQ ID NO: 1255795 - RNA, 18 nt, Human
cugcaggcgugaccugac

SEQ ID NO: 1255796 - RNA, 16 nt, Human
ucucuaggaaauauuu

SEQ ID NO: 1255797 - RNA, 20 nt, Human
agacgggguuugccaugcug

SEQ ID NO: 1255798 - RNA, 12 nt, Human
aauuuuucucua

SEQ ID NO: 1255799 - RNA, 13 nt, Human
cuuacagagaaaa

SEQ ID NO: 1255800 - RNA, 17 nt, Human
aagcugaauacauucug

SEQ ID NO: 1255801 - RNA, 12 nt, Human
agugcagccccg

SEQ ID NO: 1255802 - RNA, 23 nt, Human
ucaaccaaauggagugacuuagu

SEQ ID NO: 1255803 - RNA, 14 nt, Human
agaugaacucaacu

SEQ ID NO: 1255804 - RNA, 15 nt, Human
aauuguaucuuaguu

SEQ ID NO: 1255805 - RNA, 17 nt, Human
cuggcugggaguggcau

SEQ ID NO: 1255806 - RNA, 23 nt, Human
ccuaaccucauuccccaaccacu

SEQ ID NO: 1255807 - RNA, 14 nt, Human
guuaagcaacaucu

SEQ ID NO: 1255808 - RNA, 18 nt, Human
gacauuugcucauggaau

SEQ ID NO: 1255809 - RNA, 18 nt, Human
cuguaucuuguuuuucca

SEQ ID NO: 1255810 - RNA, 19 nt, Human
ugaauaucuauuaauauau

SEQ ID NO: 1255811 - RNA, 13 nt, Human
gucucaguguccu

SEQ ID NO: 1255812 - RNA, 19 nt, Human
auauauuuauaacucauca

SEQ ID NO: 1255813 - RNA, 20 nt, Human
cuuaacucauugcaaccucc

SEQ ID NO: 1255814 - RNA, 12 nt, Human
auaacuggaaac

SEQ ID NO: 1255815 - RNA, 18 nt, Human
gaugcaguucugaagaag

SEQ ID NO: 1255816 - RNA, 18 nt, Human
uuuauauaugugaaauaa

SEQ ID NO: 1255817 - RNA, 16 nt, Human
cauccuuccucacacc

SEQ ID NO: 1255818 - RNA, 19 nt, Human
cuccagcuggccgggagcc

SEQ ID NO: 1255819 - RNA, 21 nt, Human
aggacagcccuucuuuccaca

SEQ ID NO: 1255820 - RNA, 15 nt, Human
uccaagccucauguc

SEQ ID NO: 1255821 - RNA, 20 nt, Human
acuaaauaaagcuugcaaca

SEQ ID NO: 1255822 - RNA, 16 nt, Human
ccacuuauaggaauug

SEQ ID NO: 1255823 - RNA, 18 nt, Human
uucaauaucuuuuuuuua

SEQ ID NO: 1255824 - RNA, 22 nt, Human
aucauaaaauaaaguauauaua

SEQ ID NO: 1255825 - RNA, 16 nt, Human
cauaauguuacauuau

SEQ ID NO: 1255826 - RNA, 16 nt, Human
cagggccuggcuggga

SEQ ID NO: 1255827 - RNA, 22 nt, Human
ucauugcaaccuccaccuucug

SEQ ID NO: 1255828 - RNA, 17 nt, Human
accugagccccaaaagg

SEQ ID NO: 1255829 - RNA, 21 nt, Human
acuuuuuuucuuuucucugcc

SEQ ID NO: 1255830 - RNA, 21 nt, Human
aauacuucauuuaaaauauuu

SEQ ID NO: 1255831 - RNA, 15 nt, Human
uuuucugcuuuaauu

SEQ ID NO: 1255832 - RNA, 16 nt, Human
agauaauuauaauaua

SEQ ID NO: 1255833 - RNA, 15 nt, Human
caaaacuuucuuuuc

SEQ ID NO: 1255834 - RNA, 15 nt, Human
cuagauacugaaugu

SEQ ID NO: 1255835 - RNA, 18 nt, Human
ccauccugccccugagcc

SEQ ID NO: 1255836 - RNA, 20 nt, Human
uagagacuuugugaaaaaaa

SEQ ID NO: 1255837 - RNA, 17 nt, Human
cugagaugggagaauca

SEQ ID NO: 1255838 - RNA, 21 nt, Human
agccucuuagaugcaguucug

SEQ ID NO: 1255839 - RNA, 15 nt, Human
gagaugcuagaacuc

SEQ ID NO: 1255840 - RNA, 20 nt, Human
uuguaccucucuuauagaau

SEQ ID NO: 1255841 - RNA, 21 nt, Human
guuuuuauauaugugaaauaa

SEQ ID NO: 1255842 - RNA, 23 nt, Human
aguucugucuggacuuuccagag

SEQ ID NO: 1255843 - RNA, 19 nt, Human
caaucaaauaaguauuuau

SEQ ID NO: 1255844 - RNA, 20 nt, Human
gcugccuccccuccucugcu

SEQ ID NO: 1255845 - RNA, 13 nt, Human
agcccagcuugaa

SEQ ID NO: 1255846 - RNA, 19 nt, Human
uggugagugccuguaauca

SEQ ID NO: 1255847 - RNA, 18 nt, Human
cagcugcucaauaaagua

SEQ ID NO: 1255848 - RNA, 15 nt, Human
uuuaugcauacagua

SEQ ID NO: 1255849 - RNA, 22 nt, Human
aaugcuuaugaaacuaagauuu

SEQ ID NO: 1255850 - RNA, 17 nt, Human
uuugaauccagaaauaa

SEQ ID NO: 1255851 - RNA, 15 nt, Human
uugacacuuaaaaau

SEQ ID NO: 1255852 - RNA, 16 nt, Human
ugugauuacccucugg

SEQ ID NO: 1255853 - RNA, 20 nt, Human
caaagcacgaaauguuauuu

SEQ ID NO: 1255854 - RNA, 15 nt, Human
auuuucaaaaucaaa

SEQ ID NO: 1255855 - RNA, 17 nt, Human
uguugacaacugugacu

SEQ ID NO: 1255856 - RNA, 13 nt, Human
aaaaagccaaaaa

SEQ ID NO: 1255857 - RNA, 22 nt, Human
uuacauguuuucuuugcuuuaa

SEQ ID NO: 1255858 - RNA, 13 nt, Human
uuuaaaaaagaaa

SEQ ID NO: 1255859 - RNA, 15 nt, Human
uccgaagucuuccau

SEQ ID NO: 1255860 - RNA, 15 nt, Human
gcuguugagcuguuu

SEQ ID NO: 1255861 - RNA, 14 nt, Human
acuggccugcugga

SEQ ID NO: 1255862 - RNA, 19 nt, Human
cccccucuggcuccagcug

SEQ ID NO: 1255863 - RNA, 17 nt, Human
uuuccguggcacugcau

SEQ ID NO: 1255864 - RNA, 22 nt, Human
aaacagaacuauggaaaaaaag

SEQ ID NO: 1255865 - RNA, 23 nt, Human
ugagcaccugcaggcgugaccug

SEQ ID NO: 1255866 - RNA, 20 nt, Human
aguuuaugcauacaguaauu

SEQ ID NO: 1255867 - RNA, 15 nt, Human
ucauuuguuaaaauu

SEQ ID NO: 1255868 - RNA, 14 nt, Human
caagacucugucuc

SEQ ID NO: 1255869 - RNA, 22 nt, Human
aucaccaaggcugauuaaacca

SEQ ID NO: 1255870 - RNA, 15 nt, Human
cagaacuauggaaaa

SEQ ID NO: 1255871 - RNA, 17 nt, Human
gcaccuguaaucccagc

SEQ ID NO: 1255872 - RNA, 18 nt, Human
uaauuuugaauaaauaaa

SEQ ID NO: 1255873 - RNA, 16 nt, Human
ugaaguacucauacau

SEQ ID NO: 1255874 - RNA, 12 nt, Human
accaaucauuuu

SEQ ID NO: 1255875 - RNA, 22 nt, Human
uguuugccuucuacuuuuaagu

SEQ ID NO: 1255876 - RNA, 21 nt, Human
ugaaaaugaauaucuauuaau

SEQ ID NO: 1255877 - RNA, 14 nt, Human
cucaccccuugcca

SEQ ID NO: 1255878 - RNA, 17 nt, Human
uauaauauacuauauuu

SEQ ID NO: 1255879 - RNA, 17 nt, Human
uucuaaaugaauguuua

SEQ ID NO: 1255880 - RNA, 15 nt, Human
uagaaggauguacau

SEQ ID NO: 1255881 - RNA, 23 nt, Human
caacuuugaagucugauuuuccu

SEQ ID NO: 1255882 - RNA, 17 nt, Human
acuugaaugugucaggu

SEQ ID NO: 1255883 - RNA, 16 nt, Human
guacccaaauggaaag

SEQ ID NO: 1255884 - RNA, 17 nt, Human
ccaaggaugccccgucc

SEQ ID NO: 1255885 - RNA, 11 nt, Human
ggcuuguaaag

SEQ ID NO: 1255886 - RNA, 16 nt, Human
uuuggcuuguaaagua

SEQ ID NO: 1255887 - RNA, 22 nt, Human
augaauuuuuuucaucuucucu

SEQ ID NO: 1255888 - RNA, 22 nt, Human
cccaugauguuuagaaacacaa

SEQ ID NO: 1255889 - RNA, 16 nt, Human
uacagggcauuuuggu

SEQ ID NO: 1255890 - RNA, 20 nt, Human
ucaggugacccugaugaaaa

SEQ ID NO: 1255891 - RNA, 19 nt, Human
aauguuuacagauccccaa

SEQ ID NO: 1255892 - RNA, 20 nt, Human
uuucccucuuggugccucag

SEQ ID NO: 1255893 - RNA, 16 nt, Human
cuucacuuuuuuucuu

SEQ ID NO: 1255894 - RNA, 23 nt, Human
gcccuggugccucaccccuugcc

SEQ ID NO: 1255895 - RNA, 17 nt, Human
gagggggcgcgugcagg

SEQ ID NO: 1255896 - RNA, 16 nt, Human
uguccccuauccuacu

SEQ ID NO: 1255897 - RNA, 14 nt, Human
cugagucccaggcu

SEQ ID NO: 1255898 - RNA, 19 nt, Human
cagagaugaggccgccaug

SEQ ID NO: 1255899 - RNA, 16 nt, Human
acauuugcucauggaa

SEQ ID NO: 1255900 - RNA, 21 nt, Human
uguacauuuccaaauucacaa

SEQ ID NO: 1255901 - RNA, 22 nt, Human
auuacuguaagaaaauaucacu

SEQ ID NO: 1255902 - RNA, 15 nt, Human
uuacaucuuucacau

SEQ ID NO: 1255903 - RNA, 20 nt, Human
caguuagagauuuuuaaaua

SEQ ID NO: 1255904 - RNA, 17 nt, Human
ugcccaagaaugagaag

SEQ ID NO: 1255905 - RNA, 16 nt, Human
auauggggaauauauu

SEQ ID NO: 1255906 - RNA, 19 nt, Human
aauauuucucucuuuuuag

SEQ ID NO: 1255907 - RNA, 15 nt, Human
acugcuggauucaag

SEQ ID NO: 1255908 - RNA, 19 nt, Human
auuguauuuuaguaagaga

SEQ ID NO: 1255909 - RNA, 18 nt, Human
uuuucucuccucucccca

SEQ ID NO: 1255910 - RNA, 17 nt, Human
caguccucuuucaaagg

SEQ ID NO: 1255911 - RNA, 16 nt, Human
uuuauauuugaaauau

SEQ ID NO: 1255912 - RNA, 12 nt, Human
auacagugucuu

SEQ ID NO: 1255913 - RNA, 22 nt, Human
cccuauccuacuuccccuuccu

SEQ ID NO: 1255914 - RNA, 13 nt, Human
cacaacuauauug

SEQ ID NO: 1255915 - RNA, 20 nt, Human
uuuaauuuugaauaaauaaa

SEQ ID NO: 1255916 - RNA, 22 nt, Human
agcauuuuacuacuuuaaaaaa

SEQ ID NO: 1255917 - RNA, 21 nt, Human
aaggaagaaauuccaggaaaa

SEQ ID NO: 1255918 - RNA, 15 nt, Human
aaacauccagauaca

SEQ ID NO: 1255919 - RNA, 17 nt, Human
uguuuuuauauauguga

SEQ ID NO: 1255920 - RNA, 18 nt, Human
agcugccuccccuccucu

SEQ ID NO: 1255921 - RNA, 16 nt, Human
cguggacuuacuauuu

SEQ ID NO: 1255922 - RNA, 23 nt, Human
acauagaauaguguuggaaaaug

SEQ ID NO: 1255923 - RNA, 23 nt, Human
ucggccuccauccugaggcucca

SEQ ID NO: 1255924 - RNA, 17 nt, Human
auaucaauuuaaaaaaa

SEQ ID NO: 1255925 - RNA, 18 nt, Human
uugggcgggacacaggcu

SEQ ID NO: 1255926 - RNA, 14 nt, Human
uauauuuauaacuc

SEQ ID NO: 1255927 - RNA, 22 nt, Human
agcccuccuuaucaaaggacac

SEQ ID NO: 1255928 - RNA, 14 nt, Human
agaaauaaugaaau

SEQ ID NO: 1255929 - RNA, 14 nt, Human
aaacaaaaaaagca

SEQ ID NO: 1255930 - RNA, 23 nt, Human
cacagauuugagcucagcccugg

SEQ ID NO: 1255931 - RNA, 17 nt, Human
gaacuuuccacauucag

SEQ ID NO: 1255932 - RNA, 18 nt, Human
auuugcuggagcucugcc

SEQ ID NO: 1255933 - RNA, 12 nt, Human
ccaggcugagcc

SEQ ID NO: 1255934 - RNA, 17 nt, Human
uccugccccugagccca

SEQ ID NO: 1255935 - RNA, 19 nt, Human
acuuauugacuauuauaga

SEQ ID NO: 1255936 - RNA, 14 nt, Human
ggcuccagcuggcc

SEQ ID NO: 1255937 - RNA, 18 nt, Human
ccaaguuuauauacaauu

SEQ ID NO: 1255938 - RNA, 17 nt, Human
ccuacuuccccuuccua

SEQ ID NO: 1255939 - RNA, 15 nt, Human
cccccagcccuccuu

SEQ ID NO: 1255940 - RNA, 18 nt, Human
ugacuuaguguacaugaa

SEQ ID NO: 1255941 - RNA, 12 nt, Human
gcucagcccugg

SEQ ID NO: 1255942 - RNA, 21 nt, Human
ugcagaguacuggcugaugga

SEQ ID NO: 1255943 - RNA, 14 nt, Human
aggcugaggcaaga

SEQ ID NO: 1255944 - RNA, 17 nt, Human
aggcaugagucagucug

SEQ ID NO: 1255945 - RNA, 13 nt, Human
uagaauaauacua

SEQ ID NO: 1255946 - RNA, 14 nt, Human
gaauuuucuuccaa

SEQ ID NO: 1255947 - RNA, 23 nt, Human
caaagacuaugaggaauauuugc

SEQ ID NO: 1255948 - RNA, 11 nt, Human
augugcaauaa

SEQ ID NO: 1255949 - RNA, 12 nt, Human
uuaauaaaccau

SEQ ID NO: 1255950 - RNA, 13 nt, Human
gguccacaacaca

SEQ ID NO: 1255951 - RNA, 15 nt, Human
gauuaaaguuaaaua

SEQ ID NO: 1255952 - RNA, 16 nt, Human
cagauccccaagccug

SEQ ID NO: 1255953 - RNA, 24 nt, Human
cugauauauguguuuuucacauuu

SEQ ID NO: 1255954 - RNA, 18 nt, Human
cuggggccuguugaagau

SEQ ID NO: 1255955 - RNA, 22 nt, Human
agaauggaacucaaggaaaucu

SEQ ID NO: 1255956 - RNA, 21 nt, Human
gacagucaccucauggaauug

SEQ ID NO: 1255957 - RNA, 15 nt, Human
gacaaaugcuuauga

SEQ ID NO: 1255958 - RNA, 15 nt, Human
gucccaggcugagcc

SEQ ID NO: 1255959 - RNA, 22 nt, Human
aaagauuaugaucucagaaauu

SEQ ID NO: 1255960 - RNA, 14 nt, Human
cuucucuucacagu

SEQ ID NO: 1255961 - RNA, 23 nt, Human
acaguucauauguaccauguaca

SEQ ID NO: 1255962 - RNA, 16 nt, Human
uguacaugaagaagcu

SEQ ID NO: 1255963 - RNA, 14 nt, Human
cuggaaaucagggu

SEQ ID NO: 1255964 - RNA, 15 nt, Human
uggaaauaaaagauu

SEQ ID NO: 1255965 - RNA, 18 nt, Human
ggacacaggcuccaaacu

SEQ ID NO: 1255966 - RNA, 17 nt, Human
ucuuauagaauauuuau

SEQ ID NO: 1255967 - RNA, 13 nt, Human
agcuguugagcug

SEQ ID NO: 1255968 - RNA, 15 nt, Human
uaauauugcaaggca

SEQ ID NO: 1255969 - RNA, 21 nt, Human
uggcuguaucuuguuuuucca

SEQ ID NO: 1255970 - RNA, 16 nt, Human
cuguaaucccagcacu

SEQ ID NO: 1255971 - RNA, 20 nt, Human
accucugccucagaaaacaa

SEQ ID NO: 1255972 - RNA, 13 nt, Human
ucuuauucacauc

SEQ ID NO: 1255973 - RNA, 16 nt, Human
uauuugcaagacauag

SEQ ID NO: 1255974 - RNA, 15 nt, Human
uaucaguccucuuuc

SEQ ID NO: 1255975 - RNA, 13 nt, Human
cucaccuccccca

SEQ ID NO: 1255976 - RNA, 17 nt, Human
cugagcagugcuugaau

SEQ ID NO: 1255977 - RNA, 14 nt, Human
uagaauauuuauua

SEQ ID NO: 1255978 - RNA, 14 nt, Human
uaagcuguuuuuau

SEQ ID NO: 1255979 - RNA, 18 nt, Human
agauuaugaucucagaaa

SEQ ID NO: 1255980 - RNA, 19 nt, Human
auaauguuacauuauuauc

SEQ ID NO: 1255981 - RNA, 16 nt, Human
ccugagcuugcagaga

SEQ ID NO: 1255982 - RNA, 20 nt, Human
uacaguuagagauuuuuaaa

SEQ ID NO: 1255983 - RNA, 20 nt, Human
uaccagcccuacaccauucc

SEQ ID NO: 1255984 - RNA, 19 nt, Human
aauuccaggaaaaucugca

SEQ ID NO: 1255985 - RNA, 23 nt, Human
cucuccugggcagcugccucccc

SEQ ID NO: 1255986 - RNA, 14 nt, Human
cgucccccucuggc

SEQ ID NO: 1255987 - RNA, 23 nt, Human
gcuuuggucuaucuuugagcgcc

SEQ ID NO: 1255988 - RNA, 22 nt, Human
uguugagcuguuuucccugacc

SEQ ID NO: 1255989 - RNA, 15 nt, Human
gccaucccucccucc

SEQ ID NO: 1255990 - RNA, 17 nt, Human
cuccuuaucaaaggaca

SEQ ID NO: 1255991 - RNA, 20 nt, Human
gagauaucccaggaaaauua

SEQ ID NO: 1255992 - RNA, 19 nt, Human
auccuacaagacacaguga

SEQ ID NO: 1255993 - RNA, 18 nt, Human
ucuuauagaauauuuauu

SEQ ID NO: 1255994 - RNA, 14 nt, Human
auccuugaagauuu

SEQ ID NO: 1255995 - RNA, 19 nt, Human
cauuguuugucugucuuca

SEQ ID NO: 1255996 - RNA, 14 nt, Human
guauacuguauuuu

SEQ ID NO: 1255997 - RNA, 18 nt, Human
cagaaagcagaacaguga

SEQ ID NO: 1255998 - RNA, 21 nt, Human
gaccuggucgucgucuugacu

SEQ ID NO: 1255999 - RNA, 18 nt, Human
ccuguaaucccagcuacu

SEQ ID NO: 1256000 - RNA, 21 nt, Human
cacuugaacccgggaggcaga

SEQ ID NO: 1256001 - RNA, 23 nt, Human
augaauuaaguuuuuuuuuaaaa

SEQ ID NO: 1256002 - RNA, 23 nt, Human
gggccuaugcagagguccacaac

SEQ ID NO: 1256003 - RNA, 16 nt, Human
ucuucaacucccugcc

SEQ ID NO: 1256004 - RNA, 15 nt, Human
cagacaguguuuucu

SEQ ID NO: 1256005 - RNA, 19 nt, Human
uauuuuaauaauguuucaa

SEQ ID NO: 1256006 - RNA, 13 nt, Human
acaugagagacag

SEQ ID NO: 1256007 - RNA, 16 nt, Human
agguugcagugagccg

SEQ ID NO: 1256008 - RNA, 21 nt, Human
ucuuaggguuaugauuaagua

SEQ ID NO: 1256009 - RNA, 15 nt, Human
acgaaauguuauuuu

SEQ ID NO: 1256010 - RNA, 12 nt, Human
ucccccucuggc

SEQ ID NO: 1256011 - RNA, 15 nt, Human
auuuuuuaaguauuu

SEQ ID NO: 1256012 - RNA, 13 nt, Human
aauuaaucuugua

SEQ ID NO: 1256013 - RNA, 11 nt, Human
acugggacagg

SEQ ID NO: 1256014 - RNA, 15 nt, Human
ggcaauagucaaauu

SEQ ID NO: 1256015 - RNA, 11 nt, Human
ggguuucucca

SEQ ID NO: 1256016 - RNA, 13 nt, Human
cugcacuccagcc

SEQ ID NO: 1256017 - RNA, 13 nt, Human
acaagaaaugaaa

SEQ ID NO: 1256018 - RNA, 15 nt, Human
uacccuuugaaaaag

SEQ ID NO: 1256019 - RNA, 16 nt, Human
ccucaaaacuucagac

SEQ ID NO: 1256020 - RNA, 16 nt, Human
uaaauggacaaaugcu

SEQ ID NO: 1256021 - RNA, 21 nt, Human
aggcaugagucagucugauga

SEQ ID NO: 1256022 - RNA, 18 nt, Human
aaaucuaaaucuauuuau

SEQ ID NO: 1256023 - RNA, 23 nt, Human
uccaccucccugcaauaaaaugg

SEQ ID NO: 1256024 - RNA, 18 nt, Human
uuuccuucucaucuguga

SEQ ID NO: 1256025 - RNA, 19 nt, Human
auuugcaagacauagaaua

SEQ ID NO: 1256026 - RNA, 19 nt, Human
uuuccuaaaucaauucuau

SEQ ID NO: 1256027 - RNA, 23 nt, Human
acuuauuuauuguuguuggaggc

SEQ ID NO: 1256028 - RNA, 21 nt, Human
uaaacuuaccugggcauucuu

SEQ ID NO: 1256029 - RNA, 19 nt, Human
cuccgucucccaaagugcu

SEQ ID NO: 1256030 - RNA, 22 nt, Human
uuaugugcaauaaaauguauuu

SEQ ID NO: 1256031 - RNA, 15 nt, Human
gacccugaugaaaac

SEQ ID NO: 1256032 - RNA, 13 nt, Human
cuucucaacucca

SEQ ID NO: 1256033 - RNA, 19 nt, Human
agacucgggauuaguacac

SEQ ID NO: 1256034 - RNA, 20 nt, Human
augguuuagaaagcuugccc

SEQ ID NO: 1256035 - RNA, 16 nt, Human
uguaugacgugacugg

SEQ ID NO: 1256036 - RNA, 13 nt, Human
gaaaauaugccug

SEQ ID NO: 1256037 - RNA, 13 nt, Human
ccauuccaagccu

SEQ ID NO: 1256038 - RNA, 13 nt, Human
gggaguggcgcgc

SEQ ID NO: 1256039 - RNA, 21 nt, Human
agcuaaguugcaccaacuuug

SEQ ID NO: 1256040 - RNA, 14 nt, Human
ggcgggacacaggc

SEQ ID NO: 1256041 - RNA, 18 nt, Human
caaggcuagaaccaccug

SEQ ID NO: 1256042 - RNA, 22 nt, Human
cuaacauauaauguuguuauuu

SEQ ID NO: 1256043 - RNA, 20 nt, Human
caccagagauaauaugagaa

SEQ ID NO: 1256044 - RNA, 18 nt, Human
auuuuuaaauaaagaauu

SEQ ID NO: 1256045 - RNA, 15 nt, Human
cacuucacuuuuuuu

SEQ ID NO: 1256046 - RNA, 15 nt, Human
uaauuauuauuuaua

SEQ ID NO: 1256047 - RNA, 19 nt, Human
gccagcaguucagagcugc

SEQ ID NO: 1256048 - RNA, 19 nt, Human
gaccugacagcccaagggu

SEQ ID NO: 1256049 - RNA, 20 nt, Human
gcugcccucuccugggcagc

SEQ ID NO: 1256050 - RNA, 16 nt, Human
uagauacugaauguaa

SEQ ID NO: 1256051 - RNA, 19 nt, Human
cccugccccccagcccucc

SEQ ID NO: 1256052 - RNA, 19 nt, Human
uccagaaauaaugaaauaa

SEQ ID NO: 1256053 - RNA, 15 nt, Human
aaguauuuauauauu

SEQ ID NO: 1256054 - RNA, 22 nt, Human
caauuauaagcuguuuuuauau

SEQ ID NO: 1256055 - RNA, 15 nt, Human
cugaagaguggguuu

SEQ ID NO: 1256056 - RNA, 16 nt, Human
cagcuuuuucucuccc

SEQ ID NO: 1256057 - RNA, 22 nt, Human
cccuugccauggagguuaagca

SEQ ID NO: 1256058 - RNA, 17 nt, Human
cccaaagugcugggaau

SEQ ID NO: 1256059 - RNA, 17 nt, Human
agagcugcccucuccug

SEQ ID NO: 1256060 - RNA, 13 nt, Human
aagcuguggccag

SEQ ID NO: 1256061 - RNA, 21 nt, Human
uuaucagucauaacuaaauaa

SEQ ID NO: 1256062 - RNA, 22 nt, Human
ucucuuaaacacuaaaaaggca

SEQ ID NO: 1256063 - RNA, 17 nt, Human
uaaagaauuuucaaaau

SEQ ID NO: 1256064 - RNA, 18 nt, Human
acuuuuguguaaugaaaa

SEQ ID NO: 1256065 - RNA, 18 nt, Human
auaaauggacaaaugcuu

SEQ ID NO: 1256066 - RNA, 20 nt, Human
agauaucccaggaaaauuaa

SEQ ID NO: 1256067 - RNA, 16 nt, Human
uaagaaauaugcacaa

SEQ ID NO: 1256068 - RNA, 20 nt, Human
aucuguaaaauggagacacc

SEQ ID NO: 1256069 - RNA, 15 nt, Human
auauguauuuauaaa

SEQ ID NO: 1256070 - RNA, 21 nt, Human
uagauaaacucagaaauuuaa

SEQ ID NO: 1256071 - RNA, 13 nt, Human
aaaggaagaaauu

SEQ ID NO: 1256072 - RNA, 15 nt, Human
aaauauuuauuuuaa

SEQ ID NO: 1256073 - RNA, 18 nt, Human
cucuggccuucggccucc

SEQ ID NO: 1256074 - RNA, 16 nt, Human
aauuacauuuguauaa

SEQ ID NO: 1256075 - RNA, 23 nt, Human
uguagauaaacucagaaauuuaa

SEQ ID NO: 1256076 - RNA, 18 nt, Human
uaaguuuuuuuuuaaaaa

SEQ ID NO: 1256077 - RNA, 18 nt, Human
auuuauuacuguaagaaa

SEQ ID NO: 1256078 - RNA, 15 nt, Human
gcaacccaaauguuc

SEQ ID NO: 1256079 - RNA, 15 nt, Human
guguacaugaaagcg

SEQ ID NO: 1256080 - RNA, 17 nt, Human
gucauaacuaaauaaag

SEQ ID NO: 1256081 - RNA, 19 nt, Human
ccaccugccuauauuuuuu

SEQ ID NO: 1256082 - RNA, 23 nt, Human
cuugccaucccucccuccaccuc

SEQ ID NO: 1256083 - RNA, 16 nt, Human
cuugccugcaggcaug

SEQ ID NO: 1256084 - RNA, 15 nt, Human
uaaguauuuauauau

SEQ ID NO: 1256085 - RNA, 17 nt, Human
ccucccuccaccucccu

SEQ ID NO: 1256086 - RNA, 14 nt, Human
uugagaagagaaua

SEQ ID NO: 1256087 - RNA, 22 nt, Human
aagacccaaaaggcagaagcaa

SEQ ID NO: 1256088 - RNA, 20 nt, Human
aaaugaauaucuauuaauau

SEQ ID NO: 1256089 - RNA, 22 nt, Human
agaagcaccaaucaugaauuag

SEQ ID NO: 1256090 - RNA, 20 nt, Human
acagcuucucauccugcagg

SEQ ID NO: 1256091 - RNA, 18 nt, Human
agcugcucaauaaaguac

SEQ ID NO: 1256092 - RNA, 16 nt, Human
ugcuccuggcuggggc

SEQ ID NO: 1256093 - RNA, 22 nt, Human
uaaaauaauuuuuauauuugaa

SEQ ID NO: 1256094 - RNA, 18 nt, Human
agguccacaacacacaga

SEQ ID NO: 1256095 - RNA, 19 nt, Human
accauuuuggcaagcucua

SEQ ID NO: 1256096 - RNA, 20 nt, Human
aaaaaccugagccccaaaag

SEQ ID NO: 1256097 - RNA, 17 nt, Human
auuaauggaauauguaa

SEQ ID NO: 1256098 - RNA, 20 nt, Human
aaucucuauuaggaaauauu

SEQ ID NO: 1256099 - RNA, 12 nt, Human
aauuauuauuua

SEQ ID NO: 1256100 - RNA, 22 nt, Human
gaaaauaugccugcaaucugag

SEQ ID NO: 1256101 - RNA, 16 nt, Human
uaggauguugaaaaag

SEQ ID NO: 1256102 - RNA, 15 nt, Human
caacuuuuguguaau

SEQ ID NO: 1256103 - RNA, 23 nt, Human
agcucugcccauccugccccuga

SEQ ID NO: 1256104 - RNA, 19 nt, Human
cacuuuauauuauuuugaa

SEQ ID NO: 1256105 - RNA, 13 nt, Human
agggaccugcugu

SEQ ID NO: 1256106 - RNA, 21 nt, Human
ucuuuguaagaguggaaccaa

SEQ ID NO: 1256107 - RNA, 18 nt, Human
cacuuuuggcuuguaaag

SEQ ID NO: 1256108 - RNA, 14 nt, Human
guacuccagccugg

SEQ ID NO: 1256109 - RNA, 17 nt, Human
ugguaaaauacuucuug

SEQ ID NO: 1256110 - RNA, 19 nt, Human
uuuauaucaauuuaaaaaa

SEQ ID NO: 1256111 - RNA, 16 nt, Human
gauguggagggggcgc

SEQ ID NO: 1256112 - RNA, 15 nt, Human
uuccugagaccagcc

SEQ ID NO: 1256113 - RNA, 20 nt, Human
cuggccuucggccuccaucc

SEQ ID NO: 1256114 - RNA, 19 nt, Human
uggcgcgcgccaccacgcc

SEQ ID NO: 1256115 - RNA, 15 nt, Human
gaaaugaaagcaggg

SEQ ID NO: 1256116 - RNA, 18 nt, Human
uggugugcuggcuuaaaa

SEQ ID NO: 1256117 - RNA, 22 nt, Human
agugagcagucaggaaagagaa

SEQ ID NO: 1256118 - RNA, 20 nt, Human
agaagaacugaaaucauacu

SEQ ID NO: 1256119 - RNA, 22 nt, Human
gaagugauacuauccaguuacu

SEQ ID NO: 1256120 - RNA, 20 nt, Human
cagcuggccgggagccugau

SEQ ID NO: 1256121 - RNA, 20 nt, Human
cuuauucacaagacccaaaa

SEQ ID NO: 1256122 - RNA, 18 nt, Human
guagccacuucacuuuuu

SEQ ID NO: 1256123 - RNA, 19 nt, Human
acaguuuuccuucucaucu

SEQ ID NO: 1256124 - RNA, 18 nt, Human
auugaaaggcauucucug

SEQ ID NO: 1256125 - RNA, 16 nt, Human
uucucuaggaaauauu

SEQ ID NO: 1256126 - RNA, 14 nt, Human
uggccugcuggaug

SEQ ID NO: 1256127 - RNA, 22 nt, Human
uagaauggaacucaaggaaauc

SEQ ID NO: 1256128 - RNA, 22 nt, Human
auauauaacaaugcuguauuuu

SEQ ID NO: 1256129 - RNA, 14 nt, Human
ugaggucaggaguu

SEQ ID NO: 1256130 - RNA, 19 nt, Human
gagguacugagagugaaca

SEQ ID NO: 1256131 - RNA, 23 nt, Human
ggagggggcgcgugcaggcagca

SEQ ID NO: 1256132 - RNA, 22 nt, Human
acuucauuuaaaauauuuuuau

SEQ ID NO: 1256133 - RNA, 19 nt, Human
gaucucagaaauuguaucu

SEQ ID NO: 1256134 - RNA, 20 nt, Human
ucaaaauggagggaauaaua

SEQ ID NO: 1256135 - RNA, 16 nt, Human
ucaaaaaauaaaaaua

SEQ ID NO: 1256136 - RNA, 17 nt, Human
auggaacucaaggaaau

SEQ ID NO: 1256137 - RNA, 21 nt, Human
ucuauuaggaaauauucugua

SEQ ID NO: 1256138 - RNA, 14 nt, Human
aaaggccugucccu

SEQ ID NO: 1256139 - RNA, 13 nt, Human
aaucauauaauaa

SEQ ID NO: 1256140 - RNA, 17 nt, Human
auuuuacaauugaaaug

SEQ ID NO: 1256141 - RNA, 22 nt, Human
cagcacgggggccaaggaugcc

SEQ ID NO: 1256142 - RNA, 16 nt, Human
gaugaauguuaaauua

SEQ ID NO: 1256143 - RNA, 13 nt, Human
uguauauuuuaua

SEQ ID NO: 1256144 - RNA, 20 nt, Human
acuccagugagacagcucug

SEQ ID NO: 1256145 - RNA, 19 nt, Human
ucaacauggugaaaccccg

SEQ ID NO: 1256146 - RNA, 14 nt, Human
ccugggcugaggca

SEQ ID NO: 1256147 - RNA, 12 nt, Human
caggucucaugg

SEQ ID NO: 1256148 - RNA, 18 nt, Human
ccuggaucucacaagcac

SEQ ID NO: 1256149 - RNA, 23 nt, Human
cacaagaaaugaaagcagggacu

SEQ ID NO: 1256150 - RNA, 17 nt, Human
agacauagaauaguguu

SEQ ID NO: 1256151 - RNA, 21 nt, Human
ccuuuacauccagauagguua

SEQ ID NO: 1256152 - RNA, 13 nt, Human
acauuaaaacaau

SEQ ID NO: 1256153 - RNA, 17 nt, Human
caauacuucauuuaaaa

SEQ ID NO: 1256154 - RNA, 15 nt, Human
ggauuccccuaaccu

SEQ ID NO: 1256155 - RNA, 14 nt, Human
caaacgaaaaacau

SEQ ID NO: 1256156 - RNA, 20 nt, Human
gcagcugccuccccuccucu

SEQ ID NO: 1256157 - RNA, 16 nt, Human
caguguccucaucugu

SEQ ID NO: 1256158 - RNA, 14 nt, Human
uuuucaauauuuau

SEQ ID NO: 1256159 - RNA, 20 nt, Human
acaucucugauacuuuuuuc

SEQ ID NO: 1256160 - RNA, 19 nt, Human
cucugucucaaaaaauaaa

SEQ ID NO: 1256161 - RNA, 11 nt, Human
aacugcuggau

SEQ ID NO: 1256162 - RNA, 19 nt, Human
aauagcauaaguuucuggg

SEQ ID NO: 1256163 - RNA, 20 nt, Human
gcuugcagagaugaggccgc

SEQ ID NO: 1256164 - RNA, 15 nt, Human
cuaauauauaugaau

SEQ ID NO: 1256165 - RNA, 23 nt, Human
ugauggguuucuccagagggaau

SEQ ID NO: 1256166 - RNA, 15 nt, Human
ucuggcuccagcugg

SEQ ID NO: 1256167 - RNA, 20 nt, Human
guccccuauccuacuucccc

SEQ ID NO: 1256168 - RNA, 13 nt, Human
uaugaaauauuau

SEQ ID NO: 1256169 - RNA, 17 nt, Human
augaucauguauuuauu

SEQ ID NO: 1256170 - RNA, 15 nt, Human
uuugguaaaauacuu

SEQ ID NO: 1256171 - RNA, 14 nt, Human
cgcgcgccaccacg

SEQ ID NO: 1256172 - RNA, 14 nt, Human
aaaauacaaaaaaa

SEQ ID NO: 1256173 - RNA, 14 nt, Human
aaagagaacuucca

SEQ ID NO: 1256174 - RNA, 13 nt, Human
auaucuaauauau

SEQ ID NO: 1256175 - RNA, 16 nt, Human
aaaaugugauauguac

SEQ ID NO: 1256176 - RNA, 17 nt, Human
augcagagguccacaac

SEQ ID NO: 1256177 - RNA, 16 nt, Human
uggcugggaguggcau

SEQ ID NO: 1256178 - RNA, 14 nt, Human
acccaaaaggcaga

SEQ ID NO: 1256179 - RNA, 21 nt, Human
accugacagcccaaggguggg

SEQ ID NO: 1256180 - RNA, 18 nt, Human
cccucuggcuccagcugg

SEQ ID NO: 1256181 - RNA, 24 nt, Human
uauuuauaaauauauuuaagauaa

SEQ ID NO: 1256182 - RNA, 17 nt, Human
agaaaggccagcaaauu

SEQ ID NO: 1256183 - RNA, 19 nt, Human
agccuggucaacaugguga

SEQ ID NO: 1256184 - RNA, 21 nt, Human
aaacauuacaguuagagauuu

SEQ ID NO: 1256185 - RNA, 11 nt, Human
aauauuauaau

SEQ ID NO: 1256186 - RNA, 16 nt, Human
uuacaucuuucacauu

SEQ ID NO: 1256187 - RNA, 14 nt, Human
cacaagaaaugaaa

SEQ ID NO: 1256188 - RNA, 16 nt, Human
uguagauaaacucaga

SEQ ID NO: 1256189 - RNA, 20 nt, Human
ggcuuagacccucaugcugc

SEQ ID NO: 1256190 - RNA, 17 nt, Human
ugaccacugcagaagac

SEQ ID NO: 1256191 - RNA, 15 nt, Human
gggcuugaggacuug

SEQ ID NO: 1256192 - RNA, 15 nt, Human
accugggcugaggca

SEQ ID NO: 1256193 - RNA, 16 nt, Human
cccuauccuacuuccc

SEQ ID NO: 1256194 - RNA, 18 nt, Human
aaaugugcaauaugugau

SEQ ID NO: 1256195 - RNA, 21 nt, Human
gugaaauaguucaaagccaag

SEQ ID NO: 1256196 - RNA, 20 nt, Human
uucgugaaguauacuguauu

SEQ ID NO: 1256197 - RNA, 22 nt, Human
cauguauuuauuuuuuuacuuc

SEQ ID NO: 1256198 - RNA, 17 nt, Human
ugugcaauaugugaugu

SEQ ID NO: 1256199 - RNA, 13 nt, Human
gcccucuccuggg

SEQ ID NO: 1256200 - RNA, 11 nt, Human
cuguuuuauaa

SEQ ID NO: 1256201 - RNA, 15 nt, Human
gccuaagugcagccc

SEQ ID NO: 1256202 - RNA, 13 nt, Human
aucaaugaaugaa

SEQ ID NO: 1256203 - RNA, 16 nt, Human
auaucaauuuaaaaaa

SEQ ID NO: 1256204 - RNA, 15 nt, Human
uguuaaaugauuuca

SEQ ID NO: 1256205 - RNA, 19 nt, Human
auuggagcucgugggacag

SEQ ID NO: 1256206 - RNA, 16 nt, Human
cacgggggccaaggau

SEQ ID NO: 1256207 - RNA, 16 nt, Human
uauaauaaauguacau

SEQ ID NO: 1256208 - RNA, 16 nt, Human
ccacuguuaucaaaac

SEQ ID NO: 1256209 - RNA, 17 nt, Human
gcaugucagacagaacu

SEQ ID NO: 1256210 - RNA, 14 nt, Human
uccacaacacacag

SEQ ID NO: 1256211 - RNA, 18 nt, Human
gccccugcacuccagccu

SEQ ID NO: 1256212 - RNA, 15 nt, Human
ccccugagcuugcag

SEQ ID NO: 1256213 - RNA, 22 nt, Human
cugucucacuuaauccuuuguu

SEQ ID NO: 1256214 - RNA, 17 nt, Human
ucgggauuaguacacac

SEQ ID NO: 1256215 - RNA, 16 nt, Human
ucccugccccccagcc

SEQ ID NO: 1256216 - RNA, 16 nt, Human
uaauacuagucuuaua

SEQ ID NO: 1256217 - RNA, 17 nt, Human
caagacccaaaaggcag

SEQ ID NO: 1256218 - RNA, 17 nt, Human
auugagcaccugcaggc

SEQ ID NO: 1256219 - RNA, 22 nt, Human
gccucuaaaaggccugucccug

SEQ ID NO: 1256220 - RNA, 14 nt, Human
gaugcuuguauuuu

SEQ ID NO: 1256221 - RNA, 14 nt, Human
uauuuaaagacaaa

SEQ ID NO: 1256222 - RNA, 23 nt, Human
cuucacuuuuuuucuuuucucug

SEQ ID NO: 1256223 - RNA, 14 nt, Human
acaguaauuuuaag

SEQ ID NO: 1256224 - RNA, 22 nt, Human
acaagcuuuuuuuuuuuuucuu

SEQ ID NO: 1256225 - RNA, 15 nt, Human
uaggaaauauuuauu

SEQ ID NO: 1256226 - RNA, 16 nt, Human
ucugcuuuaauuucau

SEQ ID NO: 1256227 - RNA, 14 nt, Human
cuccagugagacag

SEQ ID NO: 1256228 - RNA, 15 nt, Human
aauugaauucccugc

SEQ ID NO: 1256229 - RNA, 22 nt, Human
guacauuaauuaccuugagcca

SEQ ID NO: 1256230 - RNA, 22 nt, Human
aauuuaaaaaaaaaccugagcc

SEQ ID NO: 1256231 - RNA, 20 nt, Human
augccugcaaucugagccag

SEQ ID NO: 1256232 - RNA, 22 nt, Human
gaaaaugaauaucuauuaauau

SEQ ID NO: 1256233 - RNA, 18 nt, Human
cucuauguucuaagaagu

SEQ ID NO: 1256234 - RNA, 20 nt, Human
uaaaauguaauuaaucuugu

SEQ ID NO: 1256235 - RNA, 15 nt, Human
uccagacacuuuuuu

SEQ ID NO: 1256236 - RNA, 22 nt, Human
uaugcaaccuuuggaugcacuu

SEQ ID NO: 1256237 - RNA, 17 nt, Human
uaaaaaaaaaaaaaaag

SEQ ID NO: 1256238 - RNA, 20 nt, Human
ugaggcuccacuuggucugu

SEQ ID NO: 1256239 - RNA, 18 nt, Human
gaugccccgucccccucu

SEQ ID NO: 1256240 - RNA, 22 nt, Human
uuuauaacucaucauaaaauaa

SEQ ID NO: 1256241 - RNA, 16 nt, Human
guuggaaaaugugcaa

SEQ ID NO: 1256242 - RNA, 21 nt, Human
cagagguccacaacacacaga

SEQ ID NO: 1256243 - RNA, 16 nt, Human
auagaauuaauggaau

SEQ ID NO: 1256244 - RNA, 11 nt, Human
accucccugca

SEQ ID NO: 1256245 - RNA, 19 nt, Human
aaauguaauuaaucuugua

SEQ ID NO: 1256246 - RNA, 21 nt, Human
uugccaugcuggccaggcugg

SEQ ID NO: 1256247 - RNA, 19 nt, Human
acuucagcgguuuauauaa

SEQ ID NO: 1256248 - RNA, 23 nt, Human
ucaauaucuaauauauaugaaua

SEQ ID NO: 1256249 - RNA, 21 nt, Human
uccuucagccugaaagaggaa

SEQ ID NO: 1256250 - RNA, 21 nt, Human
uuaacuagaauuuauucaauu

SEQ ID NO: 1256251 - RNA, 15 nt, Human
uggacucaccucccc

SEQ ID NO: 1256252 - RNA, 14 nt, Human
aagcaacccaaaug

SEQ ID NO: 1256253 - RNA, 18 nt, Human
cagcuuauugucuaguga

SEQ ID NO: 1256254 - RNA, 21 nt, Human
ccauccugccccugagcccau

SEQ ID NO: 1256255 - RNA, 20 nt, Human
uagguucuaaaaauugugau

SEQ ID NO: 1256256 - RNA, 13 nt, Human
uacauguuuucuu

SEQ ID NO: 1256257 - RNA, 23 nt, Human
uuauaaauauauuuaagauaauu

SEQ ID NO: 1256258 - RNA, 15 nt, Human
ggaauuuucuuccaa

SEQ ID NO: 1256259 - RNA, 14 nt, Human
caacaguuuuuuau

SEQ ID NO: 1256260 - RNA, 15 nt, Human
cuuaaaauguaauua

SEQ ID NO: 1256261 - RNA, 15 nt, Human
ccgucccccucuggc

SEQ ID NO: 1256262 - RNA, 20 nt, Human
aguuuuuuuuuaaaaaagaa

SEQ ID NO: 1256263 - RNA, 13 nt, Human
uacagagacagaa

SEQ ID NO: 1256264 - RNA, 18 nt, Human
gagccaacagaagcuucc

SEQ ID NO: 1256265 - RNA, 11 nt, Human
cgaaauguuau

SEQ ID NO: 1256266 - RNA, 13 nt, Human
aggcuagauguau

SEQ ID NO: 1256267 - RNA, 11 nt, Human
uccucugggaa

SEQ ID NO: 1256268 - RNA, 17 nt, Human
augcuggccaggcuggu

SEQ ID NO: 1256269 - RNA, 15 nt, Human
aagauuucuugaguu

SEQ ID NO: 1256270 - RNA, 22 nt, Human
guaaguuuaugcauacaguaau

SEQ ID NO: 1256271 - RNA, 15 nt, Human
acauaagggaggaaa

SEQ ID NO: 1256272 - RNA, 11 nt, Human
acuaaaaauac

SEQ ID NO: 1256273 - RNA, 15 nt, Human
uuaauauuuaacauu

SEQ ID NO: 1256274 - RNA, 14 nt, Human
ucuacuuuuaaguu

SEQ ID NO: 1256275 - RNA, 18 nt, Human
cugaugaauguuaaauua

SEQ ID NO: 1256276 - RNA, 13 nt, Human
agaauuuauucaa

SEQ ID NO: 1256277 - RNA, 18 nt, Human
ucuccgucucccaaagug

SEQ ID NO: 1256278 - RNA, 17 nt, Human
gauuuuuaaauaaagaa

SEQ ID NO: 1256279 - RNA, 17 nt, Human
cuuuagggaccugcugu

SEQ ID NO: 1256280 - RNA, 21 nt, Human
uauuuauaacaaccuaaauuu

SEQ ID NO: 1256281 - RNA, 19 nt, Human
cuguauuuuuaccuuuuuc

SEQ ID NO: 1256282 - RNA, 18 nt, Human
uaauuauuauucuucaua

SEQ ID NO: 1256283 - RNA, 18 nt, Human
gagcgacagugagacucu

SEQ ID NO: 1256284 - RNA, 14 nt, Human
uguuucuuaaaugg

SEQ ID NO: 1256285 - RNA, 11 nt, Human
uucccugccug

SEQ ID NO: 1256286 - RNA, 21 nt, Human
aauuaaguuuuuuuuuaaaaa

SEQ ID NO: 1256287 - RNA, 18 nt, Human
aauuccaccugcaaucaa

SEQ ID NO: 1256288 - RNA, 23 nt, Human
uagacacacaugaaguccaagca

SEQ ID NO: 1256289 - RNA, 21 nt, Human
acucaucauaaaauaaaguau

SEQ ID NO: 1256290 - RNA, 23 nt, Human
auuagggugguauuuagucuauu

SEQ ID NO: 1256291 - RNA, 20 nt, Human
aaauaauuuuuauauuugaa

SEQ ID NO: 1256292 - RNA, 15 nt, Human
ccuguacuccagccu

SEQ ID NO: 1256293 - RNA, 18 nt, Human
ugagcucagcccuggugg

SEQ ID NO: 1256294 - RNA, 22 nt, Human
aaccagggagccccuuugauga

SEQ ID NO: 1256295 - RNA, 11 nt, Human
aauuauuauuu

SEQ ID NO: 1256296 - RNA, 14 nt, Human
acuuggucugugag

SEQ ID NO: 1256297 - RNA, 16 nt, Human
ucuaguacuugggaga

SEQ ID NO: 1256298 - RNA, 17 nt, Human
aaauuccaggaaaaucu

SEQ ID NO: 1256299 - RNA, 17 nt, Human
aaacaaaaaaagcauug

SEQ ID NO: 1256300 - RNA, 22 nt, Human
ugaaacuaagauuuguaauauu

SEQ ID NO: 1256301 - RNA, 15 nt, Human
uagauaggccauggg

SEQ ID NO: 1256302 - RNA, 22 nt, Human
ucuccugggcagcugccucccc

SEQ ID NO: 1256303 - RNA, 13 nt, Human
gccuggcugggag

SEQ ID NO: 1256304 - RNA, 15 nt, Human
ucaaaagguauuuau

SEQ ID NO: 1256305 - RNA, 17 nt, Human
cacgccuguaaucccag

SEQ ID NO: 1256306 - RNA, 22 nt, Human
agugucugaugaauguuaaauu

SEQ ID NO: 1256307 - RNA, 12 nt, Human
auauuauaauuu

SEQ ID NO: 1256308 - RNA, 13 nt, Human
uuuguaauauuuc

SEQ ID NO: 1256309 - RNA, 15 nt, Human
accaaggcugauuaa

SEQ ID NO: 1256310 - RNA, 15 nt, Human
accaaucauuuuaau

SEQ ID NO: 1256311 - RNA, 22 nt, Human
cuaaauaaagcuugcaacaaaa

SEQ ID NO: 1256312 - RNA, 17 nt, Human
auucacaaccacucauu

SEQ ID NO: 1256313 - RNA, 22 nt, Human
ugaagcaaaauuuuuucucuag

SEQ ID NO: 1256314 - RNA, 12 nt, Human
uuuacuuuucca

SEQ ID NO: 1256315 - RNA, 22 nt, Human
gcagagagguagggauggggcu

SEQ ID NO: 1256316 - RNA, 15 nt, Human
gcccacuagacccac

SEQ ID NO: 1256317 - RNA, 16 nt, Human
gaacucaaggaaaucu

SEQ ID NO: 1256318 - RNA, 17 nt, Human
gucucccaaagugcugg

SEQ ID NO: 1256319 - RNA, 18 nt, Human
caugaagauguagaggag

SEQ ID NO: 1256320 - RNA, 20 nt, Human
aauuuaugaguuuuugauag

SEQ ID NO: 1256321 - RNA, 22 nt, Human
gcaaccuccaccuucuggguuc

SEQ ID NO: 1256322 - RNA, 20 nt, Human
ugugcuggcuuaaaauguaa

SEQ ID NO: 1256323 - RNA, 14 nt, Human
acacuaacauauaa

SEQ ID NO: 1256324 - RNA, 11 nt, Human
guuuuaucauu

SEQ ID NO: 1256325 - RNA, 21 nt, Human
auugggaaaggaguagaaaaa

SEQ ID NO: 1256326 - RNA, 13 nt, Human
aagacucugucuc

SEQ ID NO: 1256327 - RNA, 19 nt, Human
aucuguaaaauggagacac

SEQ ID NO: 1256328 - RNA, 12 nt, Human
cuggcugggagu

SEQ ID NO: 1256329 - RNA, 13 nt, Human
ccgggaguggcgc

SEQ ID NO: 1256330 - RNA, 19 nt, Human
cuuccuaauuccacagcug

SEQ ID NO: 1256331 - RNA, 22 nt, Human
aaaaaaccugagccccaaaagg

SEQ ID NO: 1256332 - RNA, 23 nt, Human
aaaugaauaucuauuaauauaug

SEQ ID NO: 1256333 - RNA, 16 nt, Human
ugacuuaaugccacua

SEQ ID NO: 1256334 - RNA, 22 nt, Human
aacuuucuuuucuggaauguaa

SEQ ID NO: 1256335 - RNA, 15 nt, Human
cuccugguuccuagg

SEQ ID NO: 1256336 - RNA, 14 nt, Human
cauguaauugcuug

SEQ ID NO: 1256337 - RNA, 17 nt, Human
uugugaaaaaaaauuuu

SEQ ID NO: 1256338 - RNA, 22 nt, Human
aaggcaaagcacgaaauguuau

SEQ ID NO: 1256339 - RNA, 21 nt, Human
cuggagcuugaaauagugucu

SEQ ID NO: 1256340 - RNA, 18 nt, Human
ccuguaaucauauaauaa

SEQ ID NO: 1256341 - RNA, 19 nt, Human
uacaaaaaaaaaaaaaaau

SEQ ID NO: 1256342 - RNA, 19 nt, Human
uaaauguaucuuauucaca

SEQ ID NO: 1256343 - RNA, 23 nt, Human
auuacaguuagagauuuuuaaau

SEQ ID NO: 1256344 - RNA, 21 nt, Human
ucacuuaauccuuuguuuucu

SEQ ID NO: 1256345 - RNA, 22 nt, Human
ccgggaggcagagguugcagug

SEQ ID NO: 1256346 - RNA, 17 nt, Human
uagaauaguguuggaaa

SEQ ID NO: 1256347 - RNA, 16 nt, Human
agcuugaaaccuucac

SEQ ID NO: 1256348 - RNA, 15 nt, Human
auggaacucaaggaa

SEQ ID NO: 1256349 - RNA, 17 nt, Human
gaggcauccuuccucac

SEQ ID NO: 1256350 - RNA, 15 nt, Human
cugagcauguacuga

SEQ ID NO: 1256351 - RNA, 20 nt, Human
uaagauuuuguuuuuaaacu

SEQ ID NO: 1256352 - RNA, 21 nt, Human
cuucuaaccugaacugauggg

SEQ ID NO: 1256353 - RNA, 18 nt, Human
gccuggucaacaugguga

SEQ ID NO: 1256354 - RNA, 17 nt, Human
acuucauuuaaaauauu

SEQ ID NO: 1256355 - RNA, 20 nt, Human
uauauagauggcgagaaccu

SEQ ID NO: 1256356 - RNA, 18 nt, Human
aguuuaugcauacaguaa

SEQ ID NO: 1256357 - RNA, 19 nt, Human
cuuccagauccuggaaauc

SEQ ID NO: 1256358 - RNA, 23 nt, Human
uacauuguuugucugucuucaua

SEQ ID NO: 1256359 - RNA, 16 nt, Human
uuuccacuacugcuac

SEQ ID NO: 1256360 - RNA, 21 nt, Human
cccccauuguggucacaggaa

SEQ ID NO: 1256361 - RNA, 23 nt, Human
gacuuuuuuuuuuuuuuaaacaa

SEQ ID NO: 1256362 - RNA, 21 nt, Human
cuuuucaaaauuggacuuaaa

SEQ ID NO: 1256363 - RNA, 16 nt, Human
augcuguauuuuaaaa

SEQ ID NO: 1256364 - RNA, 13 nt, Human
ccuccccuccucu

SEQ ID NO: 1256365 - RNA, 17 nt, Human
ucaacccccauuucuau

SEQ ID NO: 1256366 - RNA, 15 nt, Human
gggacaguuccugag

SEQ ID NO: 1256367 - RNA, 14 nt, Human
ugagcucagcccug

SEQ ID NO: 1256368 - RNA, 17 nt, Human
uucuagguucuaaaaau

SEQ ID NO: 1256369 - RNA, 15 nt, Human
uguuuuuaaacugga

SEQ ID NO: 1256370 - RNA, 15 nt, Human
uuugaguguuuuaag

SEQ ID NO: 1256371 - RNA, 14 nt, Human
auuuaugaguuuuu

SEQ ID NO: 1256372 - RNA, 13 nt, Human
cuagaauuuauuc

SEQ ID NO: 1256373 - RNA, 19 nt, Human
aaaauugugaucagaccau

SEQ ID NO: 1256374 - RNA, 14 nt, Human
uccucugcuugcca

SEQ ID NO: 1256375 - RNA, 16 nt, Human
aaggguggguggggug

SEQ ID NO: 1256376 - RNA, 22 nt, Human
gcagagacgggguuugccaugc

SEQ ID NO: 1256377 - RNA, 16 nt, Human
cccacuggacucaccu

SEQ ID NO: 1256378 - RNA, 16 nt, Human
aaacuggaaauaaaag

SEQ ID NO: 1256379 - RNA, 18 nt, Human
agugucaaugcagccccc

SEQ ID NO: 1256380 - RNA, 18 nt, Human
cugccuccccuccucugc

SEQ ID NO: 1256381 - RNA, 13 nt, Human
uguauugcauuaa

SEQ ID NO: 1256382 - RNA, 23 nt, Human
uaggcguggacuuacuauuuauu

SEQ ID NO: 1256383 - RNA, 18 nt, Human
agcaacaucuagcaaaug

SEQ ID NO: 1256384 - RNA, 15 nt, Human
aguauuuauauauuu

SEQ ID NO: 1256385 - RNA, 16 nt, Human
cuggccuucggccucc

SEQ ID NO: 1256386 - RNA, 19 nt, Human
uucuagggaaaugaaagaa

SEQ ID NO: 1256387 - RNA, 19 nt, Human
augaaagcagggacuugaa

SEQ ID NO: 1256388 - RNA, 13 nt, Human
acaguuuuccuuc

SEQ ID NO: 1256389 - RNA, 21 nt, Human
uaauuauaauauacuauauuu

SEQ ID NO: 1256390 - RNA, 22 nt, Human
cugaggcuccacuuggucugug

SEQ ID NO: 1256391 - RNA, 19 nt, Human
uugugccccugcacuccag

SEQ ID NO: 1256392 - RNA, 12 nt, Human
acugaaaucaua

SEQ ID NO: 1256393 - RNA, 14 nt, Human
ucuugucucugggc

SEQ ID NO: 1256394 - RNA, 22 nt, Human
aaagggucucccucuguugcca

SEQ ID NO: 1256395 - RNA, 16 nt, Human
accuguaaucauauaa

SEQ ID NO: 1256396 - RNA, 22 nt, Human
gucucccucuguugccaaggcu

SEQ ID NO: 1256397 - RNA, 11 nt, Human
agguauuuauu

SEQ ID NO: 1256398 - RNA, 19 nt, Human
uacauucugcuuucaucuu

SEQ ID NO: 1256399 - RNA, 16 nt, Human
cuuguauuuuacuuuu

SEQ ID NO: 1256400 - RNA, 19 nt, Human
gagggaauugcagaguacu

SEQ ID NO: 1256401 - RNA, 22 nt, Human
acauuacaguuagagauuuuua

SEQ ID NO: 1256402 - RNA, 12 nt, Human
ucaauauuuauu

SEQ ID NO: 1256403 - RNA, 18 nt, Human
uuucuuaaagaauuuuca

SEQ ID NO: 1256404 - RNA, 18 nt, Human
cagauuugagcucagccc

SEQ ID NO: 1256405 - RNA, 17 nt, Human
gaaguugcagugagcug

SEQ ID NO: 1256406 - RNA, 20 nt, Human
uuuguuauggcuuaaugaca

SEQ ID NO: 1256407 - RNA, 13 nt, Human
cugccuucucaac

SEQ ID NO: 1256408 - RNA, 15 nt, Human
auguuguuauuuaaa

SEQ ID NO: 1256409 - RNA, 18 nt, Human
caaauauuguugacaacu

SEQ ID NO: 1256410 - RNA, 14 nt, Human
cuacaagacacagu

SEQ ID NO: 1256411 - RNA, 14 nt, Human
ugguauguuuucag

SEQ ID NO: 1256412 - RNA, 20 nt, Human
aauuaauggaauauguaaau

SEQ ID NO: 1256413 - RNA, 14 nt, Human
ugcuggagcucugc

SEQ ID NO: 1256414 - RNA, 17 nt, Human
gccccccagcccuccuu

SEQ ID NO: 1256415 - RNA, 17 nt, Human
uguuaucagucauaacu

SEQ ID NO: 1256416 - RNA, 14 nt, Human
auauuaucaugcaa

SEQ ID NO: 1256417 - RNA, 14 nt, Human
cucccuuggggccu

SEQ ID NO: 1256418 - RNA, 13 nt, Human
auuuauuugagac

SEQ ID NO: 1256419 - RNA, 13 nt, Human
aucuacacuccag

SEQ ID NO: 1256420 - RNA, 15 nt, Human
agucugaugagaacu

SEQ ID NO: 1256421 - RNA, 19 nt, Human
uaagcaacaucuagcaaau

SEQ ID NO: 1256422 - RNA, 16 nt, Human
uauaucaauuuaaaaa

SEQ ID NO: 1256423 - RNA, 17 nt, Human
uaaauaaagaauuuuaa

SEQ ID NO: 1256424 - RNA, 15 nt, Human
aaagaaagaaaauca

SEQ ID NO: 1256425 - RNA, 16 nt, Human
cucagcccuggugggc

SEQ ID NO: 1256426 - RNA, 16 nt, Human
cucaguguccucaucu

SEQ ID NO: 1256427 - RNA, 20 nt, Human
auuacauuuguauaaaauaa

SEQ ID NO: 1256428 - RNA, 15 nt, Human
auauaugugaaauaa

SEQ ID NO: 1256429 - RNA, 20 nt, Human
gcuacucuguuccuucacau

SEQ ID NO: 1256430 - RNA, 15 nt, Human
uuaauuuguaguguu

SEQ ID NO: 1256431 - RNA, 15 nt, Human
auacuguauuuuuac

SEQ ID NO: 1256432 - RNA, 21 nt, Human
gcacuguggguagacacacau

SEQ ID NO: 1256433 - RNA, 17 nt, Human
ggaauauguaaauagaa

SEQ ID NO: 1256434 - RNA, 20 nt, Human
ccagcuggccgggagccuga

SEQ ID NO: 1256435 - RNA, 22 nt, Human
ccucuccugggcagcugccucc

SEQ ID NO: 1256436 - RNA, 19 nt, Human
auucugcaagcuuuucaaa

SEQ ID NO: 1256437 - RNA, 12 nt, Human
aaggccuguccc

SEQ ID NO: 1256438 - RNA, 21 nt, Human
ugagggcuugaggacuugggc

SEQ ID NO: 1256439 - RNA, 17 nt, Human
caauuauaucaguccuc

SEQ ID NO: 1256440 - RNA, 17 nt, Human
ucccaaagugcugggaa

SEQ ID NO: 1256441 - RNA, 18 nt, Human
cuaaaaaggcauguaauu

SEQ ID NO: 1256442 - RNA, 13 nt, Human
ggaaguagaggag

SEQ ID NO: 1256443 - RNA, 16 nt, Human
augccccgucccccuc

SEQ ID NO: 1256444 - RNA, 17 nt, Human
aucaauaucuaauauau

SEQ ID NO: 1256445 - RNA, 20 nt, Human
aagggcuguuauaaucuuuc

SEQ ID NO: 1256446 - RNA, 22 nt, Human
aaccaugagaccacuguuauca

SEQ ID NO: 1256447 - RNA, 15 nt, Human
ggcaagcucuaucac

SEQ ID NO: 1256448 - RNA, 17 nt, Human
cacaggcuccaaacugg

SEQ ID NO: 1256449 - RNA, 20 nt, Human
aucaaguccuacaagcuaaa

SEQ ID NO: 1256450 - RNA, 20 nt, Human
auauuuuauaucaauuuaaa

SEQ ID NO: 1256451 - RNA, 16 nt, Human
auccuugaagauuuac

SEQ ID NO: 1256452 - RNA, 21 nt, Human
agagacuuugugaaaaaaaau

SEQ ID NO: 1256453 - RNA, 17 nt, Human
gugacuguacccaaaug

SEQ ID NO: 1256454 - RNA, 14 nt, Human
acuuccucagcugu

SEQ ID NO: 1256455 - RNA, 14 nt, Human
auuuuaaguaauuu

SEQ ID NO: 1256456 - RNA, 13 nt, Human
acuaaaaaacaaa

SEQ ID NO: 1256457 - RNA, 20 nt, Human
uacaucccuuaccugggaaa

SEQ ID NO: 1256458 - RNA, 13 nt, Human
cuugucucugggc

SEQ ID NO: 1256459 - RNA, 17 nt, Human
acaaguccagccuggca

SEQ ID NO: 1256460 - RNA, 19 nt, Human
uagcaagugaauuuuucuc

SEQ ID NO: 1256461 - RNA, 21 nt, Human
uucacaaccacucauucaaaa

SEQ ID NO: 1256462 - RNA, 13 nt, Human
gcucucuggccuu

SEQ ID NO: 1256463 - RNA, 18 nt, Human
acucuuaagaagacugca

SEQ ID NO: 1256464 - RNA, 19 nt, Human
aaccaaauuuguauuuaag

SEQ ID NO: 1256465 - RNA, 19 nt, Human
acuagacaaguccagccug

SEQ ID NO: 1256466 - RNA, 15 nt, Human
ccucauguccacugg

SEQ ID NO: 1256467 - RNA, 19 nt, Human
agcuugaaauagugucuga

SEQ ID NO: 1256468 - RNA, 23 nt, Human
gccaucccucccuccaccucccu

SEQ ID NO: 1256469 - RNA, 13 nt, Human
gcuggagcucugc

SEQ ID NO: 1256470 - RNA, 20 nt, Human
cugaagggcaucaugcaucu

SEQ ID NO: 1256471 - RNA, 22 nt, Human
uugaauaauacaccagagauaa

SEQ ID NO: 1256472 - RNA, 18 nt, Human
aucauuucaaaacucauu

SEQ ID NO: 1256473 - RNA, 15 nt, Human
accacuguuaucaaa

SEQ ID NO: 1256474 - RNA, 21 nt, Human
accacccuugccauggagguu

SEQ ID NO: 1256475 - RNA, 20 nt, Human
cuaauucaaacuaauagaau

SEQ ID NO: 1256476 - RNA, 16 nt, Human
aguauucccuuuugcu

SEQ ID NO: 1256477 - RNA, 15 nt, Human
cugaaagaggaauga

SEQ ID NO: 1256478 - RNA, 21 nt, Human
auuccuuuuucucuccucucc

SEQ ID NO: 1256479 - RNA, 14 nt, Human
aauaucuauuaaua

SEQ ID NO: 1256480 - RNA, 19 nt, Human
acauuuguauaaaauaauu

SEQ ID NO: 1256481 - RNA, 19 nt, Human
uuguuaaaauuaucaauau

SEQ ID NO: 1256482 - RNA, 15 nt, Human
auauuuauuaccucu

SEQ ID NO: 1256483 - RNA, 18 nt, Human
auuuguauaaaauaauuu

SEQ ID NO: 1256484 - RNA, 15 nt, Human
aaggguacacugccu

SEQ ID NO: 1256485 - RNA, 12 nt, Human
caggacagcccu

SEQ ID NO: 1256486 - RNA, 22 nt, Human
aaacauuucaaaagguauuuau

SEQ ID NO: 1256487 - RNA, 19 nt, Human
uguuaugcauaaagucagu

SEQ ID NO: 1256488 - RNA, 17 nt, Human
uuuacuuuguuauuuuu

SEQ ID NO: 1256489 - RNA, 14 nt, Human
aacugcuggauuca

SEQ ID NO: 1256490 - RNA, 13 nt, Human
caguauccaguac

SEQ ID NO: 1256491 - RNA, 11 nt, Human
ugcagugagcc

SEQ ID NO: 1256492 - RNA, 14 nt, Human
gcauucucugaaga

SEQ ID NO: 1256493 - RNA, 22 nt, Human
cugcacugugggcuuuuauugc

SEQ ID NO: 1256494 - RNA, 20 nt, Human
caggaguuccuaaccagccu

SEQ ID NO: 1256495 - RNA, 21 nt, Human
ucuagcaaauguuaugcauaa

SEQ ID NO: 1256496 - RNA, 13 nt, Human
gcgggacacaggc

SEQ ID NO: 1256497 - RNA, 15 nt, Human
accucccccaucucu

SEQ ID NO: 1256498 - RNA, 17 nt, Human
auauuugaaauauugac

SEQ ID NO: 1256499 - RNA, 15 nt, Human
gcagagacgggguuu

SEQ ID NO: 1256500 - RNA, 18 nt, Human
uaugugauguggcaaauc

SEQ ID NO: 1256501 - RNA, 23 nt, Human
cagaaugauuuuacggagauauc

SEQ ID NO: 1256502 - RNA, 19 nt, Human
auaaaauaaaguauauaua

SEQ ID NO: 1256503 - RNA, 14 nt, Human
uuucaauauuuauu

SEQ ID NO: 1256504 - RNA, 19 nt, Human
gaauuuuuuucaucuucuc

SEQ ID NO: 1256505 - RNA, 21 nt, Human
gcccauccugccccugagccc

SEQ ID NO: 1256506 - RNA, 21 nt, Human
guuugacaagguucuucccuu

SEQ ID NO: 1256507 - RNA, 23 nt, Human
auucuuacauguuuucuuugcuu

SEQ ID NO: 1256508 - RNA, 15 nt, Human
cucccugccccccag

SEQ ID NO: 1256509 - RNA, 21 nt, Human
guccccuauccuacuuccccu

SEQ ID NO: 1256510 - RNA, 15 nt, Human
agagcugcccucucc

SEQ ID NO: 1256511 - RNA, 18 nt, Human
aaaaauaaaaauaaaaau

SEQ ID NO: 1256512 - RNA, 17 nt, Human
uaucuuuuuuuuaauaa

SEQ ID NO: 1256513 - RNA, 21 nt, Human
gaaauuccaggaaaaucugca

SEQ ID NO: 1256514 - RNA, 20 nt, Human
auuauuuugaauccagaaau

SEQ ID NO: 1256515 - RNA, 16 nt, Human
gagcucgugggacagu

SEQ ID NO: 1256516 - RNA, 23 nt, Human
aauaugugauguggcaaaucucu

SEQ ID NO: 1256517 - RNA, 23 nt, Human
agacagcuucucauccugcaggc

SEQ ID NO: 1256518 - RNA, 11 nt, Human
cagcaguucag

SEQ ID NO: 1256519 - RNA, 23 nt, Human
uagauguauagguugaugguggu

SEQ ID NO: 1256520 - RNA, 18 nt, Human
uccuaauuccacagcugc

SEQ ID NO: 1256521 - RNA, 15 nt, Human
ucuugagaagagaau

SEQ ID NO: 1256522 - RNA, 17 nt, Human
uuuuaucauuuucaaaa

SEQ ID NO: 1256523 - RNA, 17 nt, Human
auaaaguacaagagcuu

SEQ ID NO: 1256524 - RNA, 12 nt, Human
ccaucccucccu

SEQ ID NO: 1256525 - RNA, 15 nt, Human
gaaauucugcaagcu

SEQ ID NO: 1256526 - RNA, 14 nt, Human
cucauccugcaggc

SEQ ID NO: 1256527 - RNA, 24 nt, Human
aaucugaggccuccucucucaguu

SEQ ID NO: 1256528 - RNA, 12 nt, Human
aaguuucuggga

SEQ ID NO: 1256529 - RNA, 19 nt, Human
cagauccccaagccuggca

SEQ ID NO: 1256530 - RNA, 15 nt, Human
aagugaaaaucuaca

SEQ ID NO: 1256531 - RNA, 13 nt, Human
auaacuggaaacu

SEQ ID NO: 1256532 - RNA, 16 nt, Human
gcuguuuuuauauaug

SEQ ID NO: 1256533 - RNA, 21 nt, Human
auuuuuaaauaaagaauuuua

SEQ ID NO: 1256534 - RNA, 19 nt, Human
acuggacucaccuccccca

SEQ ID NO: 1256535 - RNA, 14 nt, Human
cauuuucaaaaugg

SEQ ID NO: 1256536 - RNA, 21 nt, Human
ccucccuuggggccuaugcag

SEQ ID NO: 1256537 - RNA, 17 nt, Human
uuuccacauucagagcu

SEQ ID NO: 1256538 - RNA, 16 nt, Human
gacaaaaacaaacaaa

SEQ ID NO: 1256539 - RNA, 19 nt, Human
gaucauguauuuauuuuuu

SEQ ID NO: 1256540 - RNA, 18 nt, Human
acagugucuuacagagaa

SEQ ID NO: 1256541 - RNA, 11 nt, Human
ugggcagcugc

SEQ ID NO: 1256542 - RNA, 15 nt, Human
ccacaggaaccacaa

SEQ ID NO: 1256543 - RNA, 12 nt, Human
aucaacaauagu

SEQ ID NO: 1256544 - RNA, 14 nt, Human
auaauuauaauaua

SEQ ID NO: 1256545 - RNA, 14 nt, Human
uuucugcuuuaauu

SEQ ID NO: 1256546 - RNA, 17 nt, Human
ccugagcuugcagagau

SEQ ID NO: 1256547 - RNA, 13 nt, Human
caacucccugccc

SEQ ID NO: 1256548 - RNA, 21 nt, Human
auguacaugaagaagcuaaau

SEQ ID NO: 1256549 - RNA, 16 nt, Human
uuaaauauaauaugca

SEQ ID NO: 1256550 - RNA, 13 nt, Human
augaacuuuccac

SEQ ID NO: 1256551 - RNA, 12 nt, Human
uacaucuuucac

SEQ ID NO: 1256552 - RNA, 19 nt, Human
uccauccugaggcuccacu

SEQ ID NO: 1256553 - RNA, 14 nt, Human
cuuguauuuuacuu

SEQ ID NO: 1256554 - RNA, 20 nt, Human
accucauggaauuggagcuc

SEQ ID NO: 1256555 - RNA, 23 nt, Human
uaguaccaaucauuuuaauuauu

SEQ ID NO: 1256556 - RNA, 20 nt, Human
auauguaccauguacaugaa

SEQ ID NO: 1256557 - RNA, 16 nt, Human
acuacuuuaaaaaaaa

SEQ ID NO: 1256558 - RNA, 12 nt, Human
guauaaauaaaa

SEQ ID NO: 1256559 - RNA, 17 nt, Human
agcauuuauaaauggac

SEQ ID NO: 1256560 - RNA, 18 nt, Human
uuuauggcacuaguauuu

SEQ ID NO: 1256561 - RNA, 20 nt, Human
ugauuuuacaauugaaauga

SEQ ID NO: 1256562 - RNA, 22 nt, Human
cuuaccugggcauucuuguuuc

SEQ ID NO: 1256563 - RNA, 23 nt, Human
uaucaauagaaggauguacauuu

SEQ ID NO: 1256564 - RNA, 21 nt, Human
auguuuacagauccccaagcc

SEQ ID NO: 1256565 - RNA, 17 nt, Human
auguacaugaagaagcu

SEQ ID NO: 1256566 - RNA, 22 nt, Human
gccaucccucccuccaccuccc

SEQ ID NO: 1256567 - RNA, 15 nt, Human
uggcaguuuuccauu

SEQ ID NO: 1256568 - RNA, 14 nt, Human
ccagccagcaguuc

SEQ ID NO: 1256569 - RNA, 11 nt, Human
aauaaauaaau

SEQ ID NO: 1256570 - RNA, 18 nt, Human
auuucaugauuucauuuc

SEQ ID NO: 1256571 - RNA, 12 nt, Human
gccaucccuccc

SEQ ID NO: 1256572 - RNA, 22 nt, Human
aaguaacucauuuguuaaaauu

SEQ ID NO: 1256573 - RNA, 15 nt, Human
uaaaaugagcaaaag

SEQ ID NO: 1256574 - RNA, 21 nt, Human
cagccugggugacagagcaag

SEQ ID NO: 1256575 - RNA, 13 nt, Human
auugcaaggcaaa

SEQ ID NO: 1256576 - RNA, 11 nt, Human
aagccaaaaac

SEQ ID NO: 1256577 - RNA, 23 nt, Human
gcugucuauguggcuguaucuug

SEQ ID NO: 1256578 - RNA, 20 nt, Human
cauagaauaguguuggaaaa

SEQ ID NO: 1256579 - RNA, 12 nt, Human
ccuggcugggag

SEQ ID NO: 1256580 - RNA, 21 nt, Human
gugcuuaucccauagccagga

SEQ ID NO: 1256581 - RNA, 17 nt, Human
ggccaugggacagggag

SEQ ID NO: 1256582 - RNA, 21 nt, Human
ugcccucuccugggcagcugc

SEQ ID NO: 1256583 - RNA, 18 nt, Human
caguucauauguaccaug

SEQ ID NO: 1256584 - RNA, 13 nt, Human
auuacccucuggg

SEQ ID NO: 1256585 - RNA, 20 nt, Human
aauuaccuugagccaguaau

SEQ ID NO: 1256586 - RNA, 22 nt, Human
aaacuggaaauaaaagauugua

SEQ ID NO: 1256587 - RNA, 19 nt, Human
cugcccucuccugggcagc

SEQ ID NO: 1256588 - RNA, 14 nt, Human
ggccaacuaggcag

SEQ ID NO: 1256589 - RNA, 13 nt, Human
uuaggcuauucac

SEQ ID NO: 1256590 - RNA, 15 nt, Human
uuccuucucaucugu

SEQ ID NO: 1256591 - RNA, 22 nt, Human
agaaugagagacacacugaaga

SEQ ID NO: 1256592 - RNA, 22 nt, Human
ugaauuuuuuucaucuucucug

SEQ ID NO: 1256593 - RNA, 16 nt, Human
ccccugcacuccagcc

SEQ ID NO: 1256594 - RNA, 22 nt, Human
accaaucaugaauuaguuuuau

SEQ ID NO: 1256595 - RNA, 21 nt, Human
uauggaaaaaaaggaagaaau

SEQ ID NO: 1256596 - RNA, 13 nt, Human
acuguuugccuuc

SEQ ID NO: 1256597 - RNA, 21 nt, Human
gccuuuucccaacuccagaaa

SEQ ID NO: 1256598 - RNA, 15 nt, Human
ugagcgcccacuaga

SEQ ID NO: 1256599 - RNA, 19 nt, Human
cucuguucugcacacagca

SEQ ID NO: 1256600 - RNA, 17 nt, Human
aauuugguucuaggccg

SEQ ID NO: 1256601 - RNA, 21 nt, Human
aauuuuucucuaacucagaaa

SEQ ID NO: 1256602 - RNA, 22 nt, Human
ccugggcagcugccuccccucc

SEQ ID NO: 1256603 - RNA, 16 nt, Human
agccgagccucaagau

SEQ ID NO: 1256604 - RNA, 16 nt, Human
aguguuggaaaaugug

SEQ ID NO: 1256605 - RNA, 18 nt, Human
uuuuauaucaauuuaaaa

SEQ ID NO: 1256606 - RNA, 15 nt, Human
cccucccuccaccuc

SEQ ID NO: 1256607 - RNA, 13 nt, Human
agaaaugaaagca

SEQ ID NO: 1256608 - RNA, 21 nt, Human
uucacaagugaaaaacaucca

SEQ ID NO: 1256609 - RNA, 18 nt, Human
uaucaaaagaaagaaaau

SEQ ID NO: 1256610 - RNA, 17 nt, Human
uauaagcuguuuuuaua

SEQ ID NO: 1256611 - RNA, 21 nt, Human
gcuaaaguaucuguauugcau

SEQ ID NO: 1256612 - RNA, 16 nt, Human
aauaucuauuaauaua

SEQ ID NO: 1256613 - RNA, 15 nt, Human
cacaagcacuuuccc

SEQ ID NO: 1256614 - RNA, 12 nt, Human
gcugaugcaguu

SEQ ID NO: 1256615 - RNA, 15 nt, Human
uaucaauuuaaaaaa

SEQ ID NO: 1256616 - RNA, 16 nt, Human
ucccuccaccucccug

SEQ ID NO: 1256617 - RNA, 18 nt, Human
gcacuccagccugagcga

SEQ ID NO: 1256618 - RNA, 18 nt, Human
gagccucagucucccucc

SEQ ID NO: 1256619 - RNA, 15 nt, Human
caucauaaaauaaag

SEQ ID NO: 1256620 - RNA, 16 nt, Human
uuucuuaaagaauuuu

SEQ ID NO: 1256621 - RNA, 18 nt, Human
uaauucaaacuaauagaa

SEQ ID NO: 1256622 - RNA, 17 nt, Human
ugacagcccaagggugg

SEQ ID NO: 1256623 - RNA, 23 nt, Human
cuuguaaaguacagacuuuuuuu

SEQ ID NO: 1256624 - RNA, 18 nt, Human
uccugccugcaauauuug

SEQ ID NO: 1256625 - RNA, 20 nt, Human
cucuccugggcagcugccuc

SEQ ID NO: 1256626 - RNA, 17 nt, Human
ucagacauagaauuaac

SEQ ID NO: 1256627 - RNA, 19 nt, Human
aaugaaauggugaaaugca

SEQ ID NO: 1256628 - RNA, 15 nt, Human
uaaaaucuaauucaa

SEQ ID NO: 1256629 - RNA, 18 nt, Human
auauuuuuaugugcaaua

SEQ ID NO: 1256630 - RNA, 18 nt, Human
auuauaagcuguuuuuau

SEQ ID NO: 1256631 - RNA, 21 nt, Human
cucugcuugccaucccucccu

SEQ ID NO: 1256632 - RNA, 15 nt, Human
aaauaaguauuuaua

SEQ ID NO: 1256633 - RNA, 18 nt, Human
aacuagaauuuauucaau

SEQ ID NO: 1256634 - RNA, 13 nt, Human
uuuugcuguggca

SEQ ID NO: 1256635 - RNA, 19 nt, Human
cauauguuuuuguaaguuu

SEQ ID NO: 1256636 - RNA, 12 nt, Human
auagaauauuua

SEQ ID NO: 1256637 - RNA, 12 nt, Human
agaccagccaac

SEQ ID NO: 1256638 - RNA, 11 nt, Human
uacgugcaaua

SEQ ID NO: 1256639 - RNA, 21 nt, Human
ugaauuuuucucuaacucaga

SEQ ID NO: 1256640 - RNA, 21 nt, Human
acucugaagggcaucaugcau

SEQ ID NO: 1256641 - RNA, 17 nt, Human
auucccuuuugcugccu

SEQ ID NO: 1256642 - RNA, 20 nt, Human
uauaacucaucauaaaauaa

SEQ ID NO: 1256643 - RNA, 17 nt, Human
cucguggaacaguuacc

SEQ ID NO: 1256644 - RNA, 16 nt, Human
ucaggugacccugaug

SEQ ID NO: 1256645 - RNA, 18 nt, Human
agugucuuacagagaaaa

SEQ ID NO: 1256646 - RNA, 13 nt, Human
aauaaaaauaaaa

SEQ ID NO: 1256647 - RNA, 19 nt, Human
uuuccugaaaacccuugcc

SEQ ID NO: 1256648 - RNA, 14 nt, Human
ugagaccagccaac

SEQ ID NO: 1256649 - RNA, 22 nt, Human
cauaaauguugacaugggacau

SEQ ID NO: 1256650 - RNA, 13 nt, Human
aucaggcuggcca

SEQ ID NO: 1256651 - RNA, 22 nt, Human
auugacuauuauagaauggaac

SEQ ID NO: 1256652 - RNA, 14 nt, Human
accaggcauccucc

SEQ ID NO: 1256653 - RNA, 14 nt, Human
accugggcauucuu

SEQ ID NO: 1256654 - RNA, 16 nt, Human
uucuggguucaagcga

SEQ ID NO: 1256655 - RNA, 20 nt, Human
ccacauggcuucaccugucc

SEQ ID NO: 1256656 - RNA, 14 nt, Human
uagggaccugcugu

SEQ ID NO: 1256657 - RNA, 22 nt, Human
gaaaggagaaguuaagcaacau

SEQ ID NO: 1256658 - RNA, 12 nt, Human
uucagccugaaa

SEQ ID NO: 1256659 - RNA, 18 nt, Human
ccaagccuggcaagggaa

SEQ ID NO: 1256660 - RNA, 16 nt, Human
uugacaguucauaugu

SEQ ID NO: 1256661 - RNA, 14 nt, Human
aauuauaauauacu

SEQ ID NO: 1256662 - RNA, 16 nt, Human
cuuuaacacagugucu

SEQ ID NO: 1256663 - RNA, 13 nt, Human
auagcauauguuu

SEQ ID NO: 1256664 - RNA, 15 nt, Human
uauauuuuuuaugaa

SEQ ID NO: 1256665 - RNA, 19 nt, Human
cggagccccuugggcaggu

SEQ ID NO: 1256666 - RNA, 15 nt, Human
uauuuauuuuaauaa

SEQ ID NO: 1256667 - RNA, 12 nt, Human
acaugagguacu

SEQ ID NO: 1256668 - RNA, 12 nt, Human
uuuguaauauuu

SEQ ID NO: 1256669 - RNA, 20 nt, Human
agagacacacugaagaagca

SEQ ID NO: 1256670 - RNA, 18 nt, Human
gacuauuauagaauggaa

SEQ ID NO: 1256671 - RNA, 16 nt, Human
uggucugugagaugcu

SEQ ID NO: 1256672 - RNA, 20 nt, Human
acagcccuucuuuccacaga

SEQ ID NO: 1256673 - RNA, 22 nt, Human
uacucugaagggcaucaugcau

SEQ ID NO: 1256674 - RNA, 14 nt, Human
gauuaguacacacu

SEQ ID NO: 1256675 - RNA, 16 nt, Human
caaccuaaauuugguu

SEQ ID NO: 1256676 - RNA, 14 nt, Human
aauaaaaauaaauu

SEQ ID NO: 1256677 - RNA, 12 nt, Human
aucguguccccu

SEQ ID NO: 1256678 - RNA, 16 nt, Human
cuuaaagaauuuucaa

SEQ ID NO: 1256679 - RNA, 20 nt, Human
agcagagacgggguuugcca

SEQ ID NO: 1256680 - RNA, 18 nt, Human
gcaauaaaauggguuuua

SEQ ID NO: 1256681 - RNA, 18 nt, Human
ccuaacugcuacaaauac

SEQ ID NO: 1256682 - RNA, 15 nt, Human
aaaauggguuuuacu

SEQ ID NO: 1256683 - RNA, 18 nt, Human
acggagauaucccaggaa

SEQ ID NO: 1256684 - RNA, 15 nt, Human
agaauaccacaggaa

SEQ ID NO: 1256685 - RNA, 18 nt, Human
acagcuucucauccugca

SEQ ID NO: 1256686 - RNA, 18 nt, Human
uuauauggggaauauauu

SEQ ID NO: 1256687 - RNA, 21 nt, Human
ugcucaauaaaguacaagagc

SEQ ID NO: 1256688 - RNA, 11 nt, Human
cccucccucca

SEQ ID NO: 1256689 - RNA, 22 nt, Human
cuuacuauuuauugcugaauga

SEQ ID NO: 1256690 - RNA, 16 nt, Human
aacaguauccaguacu

SEQ ID NO: 1256691 - RNA, 17 nt, Human
aggguguguaaguagau

SEQ ID NO: 1256692 - RNA, 23 nt, Human
uaggauggcuaguaucaaaagaa

SEQ ID NO: 1256693 - RNA, 22 nt, Human
ccccuuccuaauuccacagcug

SEQ ID NO: 1256694 - RNA, 14 nt, Human
auuauaauauacua

SEQ ID NO: 1256695 - RNA, 18 nt, Human
uuaacuagaauuuauuca

SEQ ID NO: 1256696 - RNA, 18 nt, Human
ucauuauugguugggcug

SEQ ID NO: 1256697 - RNA, 18 nt, Human
aggugacccugaugaaaa

SEQ ID NO: 1256698 - RNA, 23 nt, Human
uacugccuaucagcauuuuacua

SEQ ID NO: 1256699 - RNA, 18 nt, Human
gagugacauguuuacaaa

SEQ ID NO: 1256700 - RNA, 20 nt, Human
cuccacaauagcagacagug

SEQ ID NO: 1256701 - RNA, 20 nt, Human
aagaaauucugcaagcuuuu

SEQ ID NO: 1256702 - RNA, 15 nt, Human
gagauuccugagcca

SEQ ID NO: 1256703 - RNA, 21 nt, Human
uuuuaaguaauuucagaagaa

SEQ ID NO: 1256704 - RNA, 18 nt, Human
agguauuuauugagcacc

SEQ ID NO: 1256705 - RNA, 10 nt, Human
uauaacucau

SEQ ID NO: 1256706 - RNA, 19 nt, Human
acucugucucaguccauga

SEQ ID NO: 1256707 - RNA, 16 nt, Human
aaaggccugucccugc

SEQ ID NO: 1256708 - RNA, 17 nt, Human
aaagcagggacuugaac

SEQ ID NO: 1256709 - RNA, 12 nt, Human
auuuauuaauau

SEQ ID NO: 1256710 - RNA, 19 nt, Human
uauuugcaagacauagaau

SEQ ID NO: 1256711 - RNA, 22 nt, Human
uauuccuuuuucucuccucucc

SEQ ID NO: 1256712 - RNA, 14 nt, Human
uuuuaauuauuauu

SEQ ID NO: 1256713 - RNA, 15 nt, Human
cucgaacugcuggau

SEQ ID NO: 1256714 - RNA, 22 nt, Human
caaggaugccccgucccccucu

SEQ ID NO: 1256715 - RNA, 19 nt, Human
acagugauuaccagggacu

SEQ ID NO: 1256716 - RNA, 21 nt, Human
ugccuguaaucacagcuacuu

SEQ ID NO: 1256717 - RNA, 22 nt, Human
uagcaguugaaacaagaagcca

SEQ ID NO: 1256718 - RNA, 13 nt, Human
gguggguggggca

SEQ ID NO: 1256719 - RNA, 21 nt, Human
agcccuucuuuccacagaagc

SEQ ID NO: 1256720 - RNA, 22 nt, Human
caagacucugucucaaaaaaua

SEQ ID NO: 1256721 - RNA, 22 nt, Human
auagaauauuuauuaccucuga

SEQ ID NO: 1256722 - RNA, 16 nt, Human
uuacauguuuucuuug

SEQ ID NO: 1256723 - RNA, 18 nt, Human
uuacuguaagaaaauauc

SEQ ID NO: 1256724 - RNA, 17 nt, Human
aaugacuaaaaaacaaa

SEQ ID NO: 1256725 - RNA, 13 nt, Human
acagcccuucuuu

SEQ ID NO: 1256726 - RNA, 20 nt, Human
ugcauugagaacugcauaug

SEQ ID NO: 1256727 - RNA, 12 nt, Human
uuuuuaaauaaa

SEQ ID NO: 1256728 - RNA, 13 nt, Human
uaaguauuuauaa

SEQ ID NO: 1256729 - RNA, 17 nt, Human
auguugacaugggacau

SEQ ID NO: 1256730 - RNA, 19 nt, Human
cagcuacuugggaggcuga

SEQ ID NO: 1256731 - RNA, 17 nt, Human
acaaaugcuuaugaaac

SEQ ID NO: 1256732 - RNA, 17 nt, Human
caguucagagcugcccu

SEQ ID NO: 1256733 - RNA, 14 nt, Human
agacaucaacagau

SEQ ID NO: 1256734 - RNA, 16 nt, Human
uccucacaccaggcuu

SEQ ID NO: 1256735 - RNA, 17 nt, Human
acacuaagagagaauga

SEQ ID NO: 1256736 - RNA, 17 nt, Human
ggcuugaggacuugggc

SEQ ID NO: 1256737 - RNA, 21 nt, Human
gaaaaguauguuagugcaaau

SEQ ID NO: 1256738 - RNA, 18 nt, Human
caugaauuaguuuuauau

SEQ ID NO: 1256739 - RNA, 10 nt, Human
auguuuucag

SEQ ID NO: 1256740 - RNA, 19 nt, Human
aaauaugccccauucaaca

SEQ ID NO: 1256741 - RNA, 17 nt, Human
uuucaaaacucauuucc

SEQ ID NO: 1256742 - RNA, 19 nt, Human
uggaaauguuuacagaucc

SEQ ID NO: 1256743 - RNA, 22 nt, Human
uacaugagguacugagagugaa

SEQ ID NO: 1256744 - RNA, 13 nt, Human
aaaugacuaaaaa

SEQ ID NO: 1256745 - RNA, 20 nt, Human
ugcuugccaucccucccucc

SEQ ID NO: 1256746 - RNA, 21 nt, Human
caguucagagcugcccucucc

SEQ ID NO: 1256747 - RNA, 16 nt, Human
cuggaucucacaagca

SEQ ID NO: 1256748 - RNA, 10 nt, Human
acaccaccac

SEQ ID NO: 1256749 - RNA, 19 nt, Human
aucccucccuccaccuccc

SEQ ID NO: 1256750 - RNA, 16 nt, Human
uauuugaauuuuaaau

SEQ ID NO: 1256751 - RNA, 17 nt, Human
gaaugagagacacacug

SEQ ID NO: 1256752 - RNA, 16 nt, Human
aguaagagauuccuga

SEQ ID NO: 1256753 - RNA, 13 nt, Human
uuuuuuacuuccu

SEQ ID NO: 1256754 - RNA, 18 nt, Human
gcaagacauagaauagug

SEQ ID NO: 1256755 - RNA, 19 nt, Human
uaaauuuucccaaaacuga

SEQ ID NO: 1256756 - RNA, 14 nt, Human
uccagauccuggaa

SEQ ID NO: 1256757 - RNA, 18 nt, Human
uggccaggcuggucucga

SEQ ID NO: 1256758 - RNA, 21 nt, Human
cccuauccuacuuccccuucc

SEQ ID NO: 1256759 - RNA, 21 nt, Human
aggguucaccugggcugaggc

SEQ ID NO: 1256760 - RNA, 15 nt, Human
aaauacaaaaauuag

SEQ ID NO: 1256761 - RNA, 22 nt, Human
cugggacaggggagaaccuagg

SEQ ID NO: 1256762 - RNA, 21 nt, Human
ucuccugggcagcugccuccc

SEQ ID NO: 1256763 - RNA, 18 nt, Human
guucaaagccaaguuuau

SEQ ID NO: 1256764 - RNA, 11 nt, Human
uuauauuuauu

SEQ ID NO: 1256765 - RNA, 19 nt, Human
aaugaauggcuaagcaaaa

SEQ ID NO: 1256766 - RNA, 22 nt, Human
aggacaccauuuuggcaagcuc

SEQ ID NO: 1256767 - RNA, 15 nt, Human
gaagauguagaggag

SEQ ID NO: 1256768 - RNA, 23 nt, Human
uugccugcaggcaugagucaguc

SEQ ID NO: 1256769 - RNA, 22 nt, Human
uuaagcacuuuaacacaguguc

SEQ ID NO: 1256770 - RNA, 13 nt, Human
aagauuuguaaua

SEQ ID NO: 1256771 - RNA, 19 nt, Human
aauuuuuauauuugaaaua

SEQ ID NO: 1256772 - RNA, 22 nt, Human
ccuguugaagaugcuuguauuu

SEQ ID NO: 1256773 - RNA, 18 nt, Human
cgccuguaaucccagcac

SEQ ID NO: 1256774 - RNA, 20 nt, Human
uagauaaacucagaaauuua

SEQ ID NO: 1256775 - RNA, 14 nt, Human
uuguaauucuaaau

SEQ ID NO: 1256776 - RNA, 22 nt, Human
acaugagguacugagagugaac

SEQ ID NO: 1256777 - RNA, 16 nt, Human
caugggacagggagga

SEQ ID NO: 1256778 - RNA, 16 nt, Human
aauugacccacaagaa

SEQ ID NO: 1256779 - RNA, 21 nt, Human
cgggguuugccaugcuggcca

SEQ ID NO: 1256780 - RNA, 14 nt, Human
aaaaacauuucaaa

SEQ ID NO: 1256781 - RNA, 12 nt, Human
cauucucugaag

SEQ ID NO: 1256782 - RNA, 22 nt, Human
aagacauaagcaaagacuauga

SEQ ID NO: 1256783 - RNA, 21 nt, Human
uaaauaaauguaucuuauuca

SEQ ID NO: 1256784 - RNA, 21 nt, Human
gagggaauaauaccuaagccu

SEQ ID NO: 1256785 - RNA, 14 nt, Human
cguguccccuaucc

SEQ ID NO: 1256786 - RNA, 14 nt, Human
ugacagcccaaggg

SEQ ID NO: 1256787 - RNA, 20 nt, Human
acaagacccaaaaggcagaa

SEQ ID NO: 1256788 - RNA, 22 nt, Human
uauaagcuguuuuuauauaugu

SEQ ID NO: 1256789 - RNA, 20 nt, Human
uauuagcuuuacuguuuguu

SEQ ID NO: 1256790 - RNA, 22 nt, Human
uuugagacagggaaagggucuc

SEQ ID NO: 1256791 - RNA, 19 nt, Human
ugauuacaaggcuuuaucu

SEQ ID NO: 1256792 - RNA, 21 nt, Human
auaagcaaagacuaugaggaa

SEQ ID NO: 1256793 - RNA, 18 nt, Human
cuuaguguacaugaaagc

SEQ ID NO: 1256794 - RNA, 16 nt, Human
cuuugaugauuaauuc

SEQ ID NO: 1256795 - RNA, 21 nt, Human
uagcaucucaggagauuucau

SEQ ID NO: 1256796 - RNA, 16 nt, Human
aaauuuucccaaaacu

SEQ ID NO: 1256797 - RNA, 19 nt, Human
caacucccugccccccagc

SEQ ID NO: 1256798 - RNA, 15 nt, Human
ggccuccauccugag

SEQ ID NO: 1256799 - RNA, 20 nt, Human
uauauauguauuuauaaaua

SEQ ID NO: 1256800 - RNA, 22 nt, Human
acagagaaaauaaaagcacuua

SEQ ID NO: 1256801 - RNA, 13 nt, Human
gaauguaaucaau

SEQ ID NO: 1256802 - RNA, 21 nt, Human
acuaagauuuguaauauuucu

SEQ ID NO: 1256803 - RNA, 20 nt, Human
gacauuugcucauggaauug

SEQ ID NO: 1256804 - RNA, 18 nt, Human
aacaaugcuguauuuuaa

SEQ ID NO: 1256805 - RNA, 14 nt, Human
auagcaucucagga

SEQ ID NO: 1256806 - RNA, 12 nt, Human
agacucugucuc

SEQ ID NO: 1256807 - RNA, 23 nt, Human
auuaauggaauauguaaauagaa

SEQ ID NO: 1256808 - RNA, 15 nt, Human
uuuaagauaauuaua

SEQ ID NO: 1256809 - RNA, 17 nt, Human
uaauuccacagcugcuc

SEQ ID NO: 1256810 - RNA, 20 nt, Human
aaauguuauuuuuuaauuau

SEQ ID NO: 1256811 - RNA, 13 nt, Human
cagucugaugaga

SEQ ID NO: 1256812 - RNA, 12 nt, Human
cuaagaagugaa

SEQ ID NO: 1256813 - RNA, 10 nt, Human
uguguauuuu

SEQ ID NO: 1256814 - RNA, 22 nt, Human
ucccagccagcaguucagagcu

SEQ ID NO: 1256815 - RNA, 19 nt, Human
cauaagaaaacuaagaaau

SEQ ID NO: 1256816 - RNA, 23 nt, Human
augcuaaucagggaggucauuuu

SEQ ID NO: 1256817 - RNA, 11 nt, Human
ggcacuuggga

SEQ ID NO: 1256818 - RNA, 22 nt, Human
agaaaccuuauuguaccucucu

SEQ ID NO: 1256819 - RNA, 22 nt, Human
aucccagcacuuugggaggcug

SEQ ID NO: 1256820 - RNA, 16 nt, Human
aauaaagaauuuuaaa

SEQ ID NO: 1256821 - RNA, 14 nt, Human
aaauaaaagcacuu

SEQ ID NO: 1256822 - RNA, 17 nt, Human
uagcauaaguuucuggg

SEQ ID NO: 1256823 - RNA, 23 nt, Human
uguaaucccagcuacuugggagg

SEQ ID NO: 1256824 - RNA, 18 nt, Human
agagauuuuuaaauaaag

SEQ ID NO: 1256825 - RNA, 16 nt, Human
accuuauuguaccucu

SEQ ID NO: 1256826 - RNA, 15 nt, Human
acucaucaaucaaau

SEQ ID NO: 1256827 - RNA, 16 nt, Human
ggaugccccguccccc

SEQ ID NO: 1256828 - RNA, 12 nt, Human
aaucaauguuuc

SEQ ID NO: 1256829 - RNA, 13 nt, Human
uaaauaaagaauu

SEQ ID NO: 1256830 - RNA, 19 nt, Human
aggcauccuccacaauagc

SEQ ID NO: 1256831 - RNA, 21 nt, Human
aaaucuauuuauuaauauuua

SEQ ID NO: 1256832 - RNA, 16 nt, Human
cugggucucagugucc

SEQ ID NO: 1256833 - RNA, 23 nt, Human
caccaaggagccaaacauccuac

SEQ ID NO: 1256834 - RNA, 19 nt, Human
caccauuccuucugcccug

SEQ ID NO: 1256835 - RNA, 12 nt, Human
uauucacaagac

SEQ ID NO: 1256836 - RNA, 18 nt, Human
agagaaugagagacacac

SEQ ID NO: 1256837 - RNA, 14 nt, Human
uaucuuguuuuucc

SEQ ID NO: 1256838 - RNA, 14 nt, Human
agucucccucccuu

SEQ ID NO: 1256839 - RNA, 19 nt, Human
gguuccuuccucugagccu

SEQ ID NO: 1256840 - RNA, 16 nt, Human
aagacaaagacaaauu

SEQ ID NO: 1256841 - RNA, 23 nt, Human
aaauuaucaauaucuaauauaua

SEQ ID NO: 1256842 - RNA, 18 nt, Human
ccacuuggucugugagau

SEQ ID NO: 1256843 - RNA, 18 nt, Human
guaauuucagaagaaauu

SEQ ID NO: 1256844 - RNA, 15 nt, Human
uguaacuuaugaacc

SEQ ID NO: 1256845 - RNA, 14 nt, Human
uaacucagaaacau

SEQ ID NO: 1256846 - RNA, 23 nt, Human
aaguauccuucagccugaaagag

SEQ ID NO: 1256847 - RNA, 16 nt, Human
aaagcauuguaacuua

SEQ ID NO: 1256848 - RNA, 20 nt, Human
uauuuauuacuguaagaaaa

SEQ ID NO: 1256849 - RNA, 15 nt, Human
agccugaaagaggaa

SEQ ID NO: 1256850 - RNA, 13 nt, Human
ugggacaguuccu

SEQ ID NO: 1256851 - RNA, 15 nt, Human
uaagauaauuauaau

SEQ ID NO: 1256852 - RNA, 17 nt, Human
cuuuacuguuagucauu

SEQ ID NO: 1256853 - RNA, 15 nt, Human
gugcaggcagcagga

SEQ ID NO: 1256854 - RNA, 13 nt, Human
aaagccaaaaacc

SEQ ID NO: 1256855 - RNA, 15 nt, Human
aaaaaagaaacauuu

SEQ ID NO: 1256856 - RNA, 17 nt, Human
auauauguauuuauaaa

SEQ ID NO: 1256857 - RNA, 20 nt, Human
accuuuugcuguggcaaaug

SEQ ID NO: 1256858 - RNA, 22 nt, Human
aaguuguagguaauauugcaag

SEQ ID NO: 1256859 - RNA, 18 nt, Human
acugagcuucucugugaa

SEQ ID NO: 1256860 - RNA, 17 nt, Human
aagaagccacagaccua

SEQ ID NO: 1256861 - RNA, 17 nt, Human
agugauuaccagggacu

SEQ ID NO: 1256862 - RNA, 16 nt, Human
agugauccgcccaucu

SEQ ID NO: 1256863 - RNA, 10 nt, Human
caacauuaaa

SEQ ID NO: 1256864 - RNA, 20 nt, Human
agcuuauugucuagugaaac

SEQ ID NO: 1256865 - RNA, 15 nt, Human
uauuagccacaaaau

SEQ ID NO: 1256866 - RNA, 22 nt, Human
cucuccugggcagcugccuccc

SEQ ID NO: 1256867 - RNA, 23 nt, Human
gccccugcacuccagccugagcg

SEQ ID NO: 1256868 - RNA, 14 nt, Human
aauaaaguauauau

SEQ ID NO: 1256869 - RNA, 22 nt, Human
gacucugucucaaaaaauaaaa

SEQ ID NO: 1256870 - RNA, 21 nt, Human
gcugagucccaggcugagccu

SEQ ID NO: 1256871 - RNA, 17 nt, Human
uggcgcaaucuuaacuc

SEQ ID NO: 1256872 - RNA, 14 nt, Human
aaugauuaugaauu

SEQ ID NO: 1256873 - RNA, 18 nt, Human
acauguuacaacacggac

SEQ ID NO: 1256874 - RNA, 22 nt, Human
agaaagugacaagcucacagac

SEQ ID NO: 1256875 - RNA, 20 nt, Human
acaguuagagauuuuuaaau

SEQ ID NO: 1256876 - RNA, 20 nt, Human
cccugcacuccagccugagc

SEQ ID NO: 1256877 - RNA, 16 nt, Human
agaaauaaugaaauaa

SEQ ID NO: 1256878 - RNA, 13 nt, Human
gauuguaaaaugg

SEQ ID NO: 1256879 - RNA, 16 nt, Human
cuucggccuccauccu

SEQ ID NO: 1256880 - RNA, 20 nt, Human
ugagagugaacaaauuuaca

SEQ ID NO: 1256881 - RNA, 20 nt, Human
auaagccagacaucaacaga

SEQ ID NO: 1256882 - RNA, 14 nt, Human
ucucuacuaaaaau

SEQ ID NO: 1256883 - RNA, 13 nt, Human
uucuaggccgggc

SEQ ID NO: 1256884 - RNA, 17 nt, Human
uaaaauaaaguauauau

SEQ ID NO: 1256885 - RNA, 18 nt, Human
gacuuugugaaaaaaaau

SEQ ID NO: 1256886 - RNA, 23 nt, Human
ggaugguucccuugaugaagaag

SEQ ID NO: 1256887 - RNA, 17 nt, Human
uuaaggcuucucuuaaa

SEQ ID NO: 1256888 - RNA, 14 nt, Human
auauuuauuaccuc

SEQ ID NO: 1256889 - RNA, 16 nt, Human
aaguugcagugagcug

SEQ ID NO: 1256890 - RNA, 22 nt, Human
ggguuccuuccucugagccuug

SEQ ID NO: 1256891 - RNA, 23 nt, Human
uccaacuaucucauuuccaagca

SEQ ID NO: 1256892 - RNA, 20 nt, Human
gcuggaauugaauucccugc

SEQ ID NO: 1256893 - RNA, 16 nt, Human
auacauguuacaacac

SEQ ID NO: 1256894 - RNA, 15 nt, Human
agccgggcauggugg

SEQ ID NO: 1256895 - RNA, 22 nt, Human
uucuagcuguugagcuguuuuc

SEQ ID NO: 1256896 - RNA, 21 nt, Human
ggggagccaacagaagcuucc

SEQ ID NO: 1256897 - RNA, 18 nt, Human
cuuuuuuuuuuuuuuaaa

SEQ ID NO: 1256898 - RNA, 19 nt, Human
aucucugauacuuuuuuca

SEQ ID NO: 1256899 - RNA, 19 nt, Human
ggcuuuagggaccugcugu

SEQ ID NO: 1256900 - RNA, 16 nt, Human
agugagacagcucugc

SEQ ID NO: 1256901 - RNA, 14 nt, Human
gagagugaacaaau

SEQ ID NO: 1256902 - RNA, 15 nt, Human
auauugacuuuuuau

SEQ ID NO: 1256903 - RNA, 23 nt, Human
gcaauaugugauguggcaaaucu

SEQ ID NO: 1256904 - RNA, 12 nt, Human
cugauuuuccug

SEQ ID NO: 1256905 - RNA, 16 nt, Human
cuuguaauucuaaaug

SEQ ID NO: 1256906 - RNA, 14 nt, Human
auauuuauuuuaau

SEQ ID NO: 1256907 - RNA, 13 nt, Human
ggaaaauguguau

SEQ ID NO: 1256908 - RNA, 15 nt, Human
ucuaugaaauauuau

SEQ ID NO: 1256909 - RNA, 19 nt, Human
auuuacagagacagaaagc

SEQ ID NO: 1256910 - RNA, 23 nt, Human
gaaugagagacacacugaagaag

SEQ ID NO: 1256911 - RNA, 15 nt, Human
agucugauuuuccug

SEQ ID NO: 1256912 - RNA, 16 nt, Human
agggaggacgcucucu

SEQ ID NO: 1256913 - RNA, 21 nt, Human
gccugauuaaaguuaaauaaa

SEQ ID NO: 1256914 - RNA, 18 nt, Human
caagccucauguccacug

SEQ ID NO: 1256915 - RNA, 18 nt, Human
auguuaaaacugggacag

SEQ ID NO: 1256916 - RNA, 18 nt, Human
ucucuaggaaauauuuau

SEQ ID NO: 1256917 - RNA, 15 nt, Human
gccucuuagaugcag

SEQ ID NO: 1256918 - RNA, 20 nt, Human
uuucagaagaaauucugcaa

SEQ ID NO: 1256919 - RNA, 16 nt, Human
uggggauagugaggca

SEQ ID NO: 1256920 - RNA, 18 nt, Human
guuaguauuguccagguc

SEQ ID NO: 1256921 - RNA, 24 nt, Human
uugccaaggcuggagugcaguggc

SEQ ID NO: 1256922 - RNA, 18 nt, Human
cagauagguuaccaguaa

SEQ ID NO: 1256923 - RNA, 16 nt, Human
cugauacuuuuuucau

SEQ ID NO: 1256924 - RNA, 17 nt, Human
gcaaauugucacaggac

SEQ ID NO: 1256925 - RNA, 13 nt, Human
cugcaauaaaaug

SEQ ID NO: 1256926 - RNA, 19 nt, Human
auauuuuuuaugaaacauu

SEQ ID NO: 1256927 - RNA, 16 nt, Human
ugugagaugcuagaac

SEQ ID NO: 1256928 - RNA, 14 nt, Human
cacuaacauauaau

SEQ ID NO: 1256929 - RNA, 23 nt, Human
caagggaguuaggcuauucacaa

SEQ ID NO: 1256930 - RNA, 19 nt, Human
uaaauauauuuaagauaau

SEQ ID NO: 1256931 - RNA, 22 nt, Human
augugcaauaugugauguggca

SEQ ID NO: 1256932 - RNA, 19 nt, Human
uccagccuggcaaggguuc

SEQ ID NO: 1256933 - RNA, 16 nt, Human
uggcaagcucuaucac

SEQ ID NO: 1256934 - RNA, 22 nt, Human
uauuucagauaaucacaauaca

SEQ ID NO: 1256935 - RNA, 23 nt, Human
ucuaccaaaaaucucaauauuuc

SEQ ID NO: 1256936 - RNA, 13 nt, Human
uguuagcaaaaug

SEQ ID NO: 1256937 - RNA, 16 nt, Human
gccucuaaaaggccug

SEQ ID NO: 1256938 - RNA, 20 nt, Human
acaugagguacugagaguga

SEQ ID NO: 1256939 - RNA, 17 nt, Human
ugaaaaaaaauuuuaua

SEQ ID NO: 1256940 - RNA, 16 nt, Human
auaugugaaauaaaag

SEQ ID NO: 1256941 - RNA, 18 nt, Human
gccaucccucccuccacc

SEQ ID NO: 1256942 - RNA, 14 nt, Human
uacuuuguccuuuu

SEQ ID NO: 1256943 - RNA, 22 nt, Human
auacugaauguaaacaaaggaa

SEQ ID NO: 1256944 - RNA, 17 nt, Human
caagaagccacagaccu

SEQ ID NO: 1256945 - RNA, 16 nt, Human
auaauguuacauuauu

SEQ ID NO: 1256946 - RNA, 16 nt, Human
auuuugguaaaauacu

SEQ ID NO: 1256947 - RNA, 22 nt, Human
gccuccccuccucugcuugcca

SEQ ID NO: 1256948 - RNA, 14 nt, Mycobacterium tuberculosis H37Rv
uuugggcgccggug

SEQ ID NO: 1256949 - RNA, 17 nt, Mycobacterium tuberculosis H37Rv
uuuggguucgucgacac

SEQ ID NO: 1256950 - RNA, 23 nt, Mycobacterium tuberculosis H37Rv
uuuggugcagccgcggucguugg

SEQ ID NO: 1256951 - RNA, 18 nt, Mycobacterium tuberculosis H37Rv
uuugcagccuucgacgca

SEQ ID NO: 1256952 - RNA, 14 nt, Mycobacterium tuberculosis H37Rv
uuugcagccuucga

SEQ ID NO: 1256953 - RNA, 17 nt, Mycobacterium tuberculosis H37Rv
uuugccgguucggcgau

SEQ ID NO: 1256954 - RNA, 17 nt, Mycobacterium tuberculosis H37Rv
uuucggcgccgucgccc

SEQ ID NO: 1256955 - RNA, 24 nt, Mycobacterium tuberculosis H37Rv
uuucgaugaugggcgguuccacgc

SEQ ID NO: 1256956 - RNA, 22 nt, Mycobacterium tuberculosis H37Rv
uugugagcaauggcgcgaccga

SEQ ID NO: 1256957 - RNA, 21 nt, Mycobacterium tuberculosis H37Rv
uugucugacccccgaccccga

SEQ ID NO: 1256958 - RNA, 18 nt, Mycobacterium tuberculosis H37Rv
uuguccaggaucgcgugg

SEQ ID NO: 1256959 - RNA, 13 nt, Mycobacterium tuberculosis H37Rv
uuggcgacgaggc

SEQ ID NO: 1256960 - RNA, 15 nt, Mycobacterium tuberculosis H37Rv
uuggcgaagcccgac

SEQ ID NO: 1256961 - RNA, 23 nt, Mycobacterium tuberculosis H37Rv
uuggucaccaccuggugcaaccg

SEQ ID NO: 1256962 - RNA, 21 nt, Mycobacterium tuberculosis H37Rv
uuggggugcuuucgcgucugc

SEQ ID NO: 1256963 - RNA, 14 nt, Mycobacterium tuberculosis H37Rv
uugguccucggcgg

SEQ ID NO: 1256964 - RNA, 20 nt, Mycobacterium tuberculosis H37Rv
uuggucaccugcugcaaccg

SEQ ID NO: 1256965 - RNA, 22 nt, Mycobacterium tuberculosis H37Rv
uuggugcggaccugcgccggug

SEQ ID NO: 1256966 - RNA, 16 nt, Mycobacterium tuberculosis H37Rv
uugguguauucgcgga

SEQ ID NO: 1256967 - RNA, 19 nt, Mycobacterium tuberculosis H37Rv
uugcgggacuagguccgau

SEQ ID NO: 1256968 - RNA, 23 nt, Mycobacterium tuberculosis H37Rv
uugcguccauccgcagcagguga

SEQ ID NO: 1256969 - RNA, 11 nt, Mycobacterium tuberculosis H37Rv
uugcggaucga

SEQ ID NO: 1256970 - RNA, 19 nt, Mycobacterium tuberculosis H37Rv
uugcgcucguugguucagc

SEQ ID NO: 1256971 - RNA, 22 nt, Mycobacterium tuberculosis H37Rv
uugccgacgcuaaguccccgcu

SEQ ID NO: 1256972 - RNA, 18 nt, Mycobacterium tuberculosis H37Rv
uugccgccgaacagcugg

SEQ ID NO: 1256973 - RNA, 16 nt, Mycobacterium tuberculosis H37Rv
uugccgccgaagccga

SEQ ID NO: 1256974 - RNA, 19 nt, Mycobacterium tuberculosis H37Rv
uugccgccggugccgccga

SEQ ID NO: 1256975 - RNA, 20 nt, Mycobacterium tuberculosis H37Rv
uugccgucgugaucggcgaa

SEQ ID NO: 1256976 - RNA, 22 nt, Mycobacterium tuberculosis H37Rv
uugccggcgccuuggucgccgc

SEQ ID NO: 1256977 - RNA, 20 nt, Mycobacterium tuberculosis H37Rv
uugccggcggcgacgucugc

SEQ ID NO: 1256978 - RNA, 17 nt, Mycobacterium tuberculosis H37Rv
uugcuagguucgcgacg

SEQ ID NO: 1256979 - RNA, 13 nt, Mycobacterium tuberculosis H37Rv
uugcucguucacc

SEQ ID NO: 1256980 - RNA, 13 nt, Mycobacterium tuberculosis H37Rv
uuggccagcagcg

SEQ ID NO: 1256981 - RNA, 13 nt, Mycobacterium tuberculosis H37Rv
uuggccagcagca

SEQ ID NO: 1256982 - RNA, 16 nt, Mycobacterium tuberculosis H37Rv
uuggccagaccgcgcg

SEQ ID NO: 1256983 - RNA, 15 nt, Mycobacterium tuberculosis H37Rv
uuggcccagcgguag

SEQ ID NO: 1256984 - RNA, 11 nt, Mycobacterium tuberculosis H37Rv
uuggccaggug

SEQ ID NO: 1256985 - RNA, 14 nt, Mycobacterium tuberculosis H37Rv
uuggcccagcgugu

SEQ ID NO: 1256986 - RNA, 19 nt, Mycobacterium tuberculosis H37Rv
uuggccagccacagccgac

SEQ ID NO: 1256987 - RNA, 21 nt, Mycobacterium tuberculosis H37Rv
uuggccgcgcucaucgcggcg

SEQ ID NO: 1256988 - RNA, 16 nt, Mycobacterium tuberculosis H37Rv
uuggccgcaaggcgug

SEQ ID NO: 1256989 - RNA, 19 nt, Mycobacterium tuberculosis H37Rv
uuggcccgggucuccggcg

SEQ ID NO: 1256990 - RNA, 13 nt, Mycobacterium tuberculosis H37Rv
uuggaucacgcga

SEQ ID NO: 1256991 - RNA, 15 nt, Mycobacterium tuberculosis H37Rv
uuggacugacgucga

SEQ ID NO: 1256992 - RNA, 14 nt, Mycobacterium tuberculosis H37Rv
uuggagaucgccgc

SEQ ID NO: 1256993 - RNA, 22 nt, Mycobacterium tuberculosis H37Rv
uuggcaaugaccccggcguugc

SEQ ID NO: 1256994 - RNA, 18 nt, Mycobacterium tuberculosis H37Rv
uuggcagggccagcggca

SEQ ID NO: 1256995 - RNA, 14 nt, Mycobacterium tuberculosis H37Rv
uuggcagagccgac

SEQ ID NO: 1256996 - RNA, 18 nt, Mycobacterium tuberculosis H37Rv
uugcccgacggcgucuuc

SEQ ID NO: 1256997 - RNA, 15 nt, Mycobacterium tuberculosis H37Rv
uugaugcuucgaacc

SEQ ID NO: 1256998 - RNA, 12 nt, Mycobacterium tuberculosis H37Rv
uugaucggcgag

SEQ ID NO: 1256999 - RNA, 15 nt, Mycobacterium tuberculosis H37Rv
uugacgagccgacca

SEQ ID NO: 1257000 - RNA, 13 nt, Mycobacterium tuberculosis H37Rv
uugacguccaaca

SEQ ID NO: 1257001 - RNA, 20 nt, Mycobacterium tuberculosis H37Rv
uugacgucgagcagcgccac

SEQ ID NO: 1257002 - RNA, 22 nt, Mycobacterium tuberculosis H37Rv
uugagccgggcaaccagcagca

SEQ ID NO: 1257003 - RNA, 16 nt, Mycobacterium tuberculosis H37Rv
uugagcgcggccacca

SEQ ID NO: 1257004 - RNA, 17 nt, Mycobacterium tuberculosis H37Rv
uugagcucagguucagc

SEQ ID NO: 1257005 - RNA, 13 nt, Mycobacterium tuberculosis H37Rv
uugaccagcagcu

SEQ ID NO: 1257006 - RNA, 22 nt, Mycobacterium tuberculosis H37Rv
uugaccgcggucugcgcgucgc

SEQ ID NO: 1257007 - RNA, 14 nt, Mycobacterium tuberculosis H37Rv
uugaccaggccgac

SEQ ID NO: 1257008 - RNA, 15 nt, Mycobacterium tuberculosis H37Rv
uuccuccgacgcgau

SEQ ID NO: 1257009 - RNA, 14 nt, Mycobacterium tuberculosis H37Rv
uuccuccgacgcga

SEQ ID NO: 1257010 - RNA, 16 nt, Mycobacterium tuberculosis H37Rv
uggccgaaagccaggc

SEQ ID NO: 1257011 - RNA, 12 nt, Mycobacterium tuberculosis H37Rv
uggccgacagcc

SEQ ID NO: 1257012 - RNA, 15 nt, Mycobacterium tuberculosis H37Rv
uggccgaagcccgau

SEQ ID NO: 1257013 - RNA, 16 nt, Mycobacterium tuberculosis H37Rv
uggccgccaccgcgac

SEQ ID NO: 1257014 - RNA, 21 nt, Mycobacterium tuberculosis H37Rv
uggccgccagauuggcgcugc

SEQ ID NO: 1257015 - RNA, 18 nt, Mycobacterium tuberculosis H37Rv
uggccgcauuggcgaccg

SEQ ID NO: 1257016 - RNA, 13 nt, Mycobacterium tuberculosis H37Rv
uggccgcagggcc

SEQ ID NO: 1257017 - RNA, 22 nt, Mycobacterium tuberculosis H37Rv
uggccgccgaauccgacgucga

SEQ ID NO: 1257018 - RNA, 19 nt, Mycobacterium tuberculosis H37Rv
uggccgcccagaccgccga

SEQ ID NO: 1257019 - RNA, 22 nt, Mycobacterium tuberculosis H37Rv
uggccgcccagaccgccgacgc

SEQ ID NO: 1257020 - RNA, 22 nt, Mycobacterium tuberculosis H37Rv
uggccugucgaagauccagcgc

SEQ ID NO: 1257021 - RNA, 17 nt, Mycobacterium tuberculosis H37Rv
uggccuugcugcgcgau

SEQ ID NO: 1257022 - RNA, 13 nt, Mycobacterium tuberculosis H37Rv
uggccugcucaac

SEQ ID NO: 1257023 - RNA, 22 nt, Mycobacterium tuberculosis H37Rv
uggccugcggcaggugcgguca

SEQ ID NO: 1257024 - RNA, 17 nt, Mycobacterium tuberculosis H37Rv
uggccgggcuggcgacg

SEQ ID NO: 1257025 - RNA, 22 nt, Mycobacterium tuberculosis H37Rv
uggccgggcuggcgacgacgac

SEQ ID NO: 1257026 - RNA, 13 nt, Mycobacterium tuberculosis H37Rv
uggccgggcggua

SEQ ID NO: 1257027 - RNA, 15 nt, Mycobacterium tuberculosis H37Rv
uggccgggcacgcga

SEQ ID NO: 1257028 - RNA, 15 nt, Mycobacterium tuberculosis H37Rv
uggccggcgauggcc

SEQ ID NO: 1257029 - RNA, 16 nt, Mycobacterium tuberculosis H37Rv
uggccggccaucgccc

SEQ ID NO: 1257030 - RNA, 18 nt, Mycobacterium tuberculosis H37Rv
uggccggccagccauggc

SEQ ID NO: 1257031 - RNA, 12 nt, Mycobacterium tuberculosis H37Rv
uggccgccgcga

SEQ ID NO: 1257032 - RNA, 13 nt, Mycobacterium tuberculosis H37Rv
uggccgccgucga

SEQ ID NO: 1257033 - RNA, 23 nt, Mycobacterium tuberculosis H37Rv
uggccggcaacggcgcgccgacc

SEQ ID NO: 1257034 - RNA, 20 nt, Mycobacterium tuberculosis H37Rv
uggccgcgagguacccaucg

SEQ ID NO: 1257035 - RNA, 13 nt, Mycobacterium tuberculosis H37Rv
uggccgcgaugac

SEQ ID NO: 1257036 - RNA, 16 nt, Mycobacterium tuberculosis H37Rv
uggcgcgaucggugcc

SEQ ID NO: 1257037 - RNA, 22 nt, Mycobacterium tuberculosis H37Rv
uggcgcgaacgucagugccccg

SEQ ID NO: 1257038 - RNA, 21 nt, Mycobacterium tuberculosis H37Rv
uggcgccgaacgccagcagcu

SEQ ID NO: 1257039 - RNA, 21 nt, Mycobacterium tuberculosis H37Rv
uggcgcccgucuccagcacca

SEQ ID NO: 1257040 - RNA, 19 nt, Mycobacterium tuberculosis H37Rv
uggcggcagcaacgacguc

SEQ ID NO: 1257041 - RNA, 18 nt, Mycobacterium tuberculosis H37Rv
uggcggaucgcgagcgcc

SEQ ID NO: 1257042 - RNA, 21 nt, Mycobacterium tuberculosis H37Rv
uggccuucugguucggguugg

SEQ ID NO: 1257043 - RNA, 15 nt, Mycobacterium tuberculosis H37Rv
uggcgaaaucgucga

SEQ ID NO: 1257044 - RNA, 16 nt, Mycobacterium tuberculosis H37Rv
uggcgaacccggucaa

SEQ ID NO: 1257045 - RNA, 13 nt, Mycobacterium tuberculosis H37Rv
uggcgaaccgcag

SEQ ID NO: 1257046 - RNA, 18 nt, Mycobacterium tuberculosis H37Rv
uggcgaaccucaccugac

SEQ ID NO: 1257047 - RNA, 20 nt, Mycobacterium tuberculosis H37Rv
uggcgaacugguagcccgga

SEQ ID NO: 1257048 - RNA, 14 nt, Mycobacterium tuberculosis H37Rv
uggcgaagcccgac

SEQ ID NO: 1257049 - RNA, 13 nt, Mycobacterium tuberculosis H37Rv
uggcgaagaccgc

SEQ ID NO: 1257050 - RNA, 14 nt, Mycobacterium tuberculosis H37Rv
uggcgcaccaccgc

SEQ ID NO: 1257051 - RNA, 15 nt, Mycobacterium tuberculosis H37Rv
uggcgaagucgucga

SEQ ID NO: 1257052 - RNA, 21 nt, Mycobacterium tuberculosis H37Rv
uggcgaagucgucgaggucac

SEQ ID NO: 1257053 - RNA, 20 nt, Mycobacterium tuberculosis H37Rv
uggcgcagcucaccgacgga

SEQ ID NO: 1257054 - RNA, 19 nt, Mycobacterium tuberculosis H37Rv
uggcgcagccugccgauga

SEQ ID NO: 1257055 - RNA, 18 nt, Mycobacterium tuberculosis H37Rv
uggcgccacggcagcgcc

SEQ ID NO: 1257056 - RNA, 18 nt, Mycobacterium tuberculosis H37Rv
ugggugcagcacguccgc

SEQ ID NO: 1257057 - RNA, 14 nt, Mycobacterium tuberculosis H37Rv
ugggugacgguggc

SEQ ID NO: 1257058 - RNA, 21 nt, Mycobacterium tuberculosis H37Rv
uggggugcuuucgcgucugcu

SEQ ID NO: 1257059 - RNA, 22 nt, Mycobacterium tuberculosis H37Rv
ugggugaccucgucgaccggga

SEQ ID NO: 1257060 - RNA, 18 nt, Mycobacterium tuberculosis H37Rv
ugggggcuucugcgucug

SEQ ID NO: 1257061 - RNA, 14 nt, Mycobacterium tuberculosis H37Rv
uggggucguucgcc

SEQ ID NO: 1257062 - RNA, 20 nt, Mycobacterium tuberculosis H37Rv
uggggucgacgcagugcccg

SEQ ID NO: 1257063 - RNA, 13 nt, Mycobacterium tuberculosis H37Rv
uggguggcgucgc

SEQ ID NO: 1257064 - RNA, 16 nt, Mycobacterium tuberculosis H37Rv
uggguguugucgucga

SEQ ID NO: 1257065 - RNA, 16 nt, Mycobacterium tuberculosis H37Rv
ugggugugcugccacc

SEQ ID NO: 1257066 - RNA, 19 nt, Mycobacterium tuberculosis H37Rv
ugggcgucgaccacgcaag

SEQ ID NO: 1257067 - RNA, 22 nt, Mycobacterium tuberculosis H37Rv
ugggcgggcuuggcgucgacgu

SEQ ID NO: 1257068 - RNA, 21 nt, Mycobacterium tuberculosis H37Rv
ugggcggguucggacgagguc

SEQ ID NO: 1257069 - RNA, 17 nt, Mycobacterium tuberculosis H37Rv
ugggcgguagccgacga

SEQ ID NO: 1257070 - RNA, 15 nt, Mycobacterium tuberculosis H37Rv
ugggcgggcuuggcg

SEQ ID NO: 1257071 - RNA, 20 nt, Mycobacterium tuberculosis H37Rv
ugggcgggcaaucaccgccg

SEQ ID NO: 1257072 - RNA, 15 nt, Mycobacterium tuberculosis H37Rv
ugggcgguugaucgc

SEQ ID NO: 1257073 - RNA, 18 nt, Mycobacterium tuberculosis H37Rv
ugggcgguccgcgucugg

SEQ ID NO: 1257074 - RNA, 20 nt, Mycobacterium tuberculosis H37Rv
ugggcgaggugagguugacc

SEQ ID NO: 1257075 - RNA, 20 nt, Mycobacterium tuberculosis H37Rv
ugggcgauucugugucugcu

SEQ ID NO: 1257076 - RNA, 19 nt, Mycobacterium tuberculosis H37Rv
ugggcgauauuggacgcgc

SEQ ID NO: 1257077 - RNA, 19 nt, Mycobacterium tuberculosis H37Rv
ugggcgauuuugcgucugc

SEQ ID NO: 1257078 - RNA, 16 nt, Mycobacterium tuberculosis H37Rv
ugggcgggauggccgc

SEQ ID NO: 1257079 - RNA, 23 nt, Mycobacterium tuberculosis H37Rv
ugggcgagcagacgcagaaucgc

SEQ ID NO: 1257080 - RNA, 14 nt, Mycobacterium tuberculosis H37Rv
ugggcgacggcgau

SEQ ID NO: 1257081 - RNA, 13 nt, Mycobacterium tuberculosis H37Rv
ugggccagcagca

SEQ ID NO: 1257082 - RNA, 22 nt, Mycobacterium tuberculosis H37Rv
ugggcaucaccgacgcgucggc

SEQ ID NO: 1257083 - RNA, 14 nt, Mycobacterium tuberculosis H37Rv
ugggcaucaccgcc

SEQ ID NO: 1257084 - RNA, 13 nt, Mycobacterium tuberculosis H37Rv
ugggcaucaccgc

SEQ ID NO: 1257085 - RNA, 23 nt, Mycobacterium tuberculosis H37Rv
ugggagcccggcggcccgauaga

SEQ ID NO: 1257086 - RNA, 15 nt, Mycobacterium tuberculosis H37Rv
uggcuuucgguaugc

SEQ ID NO: 1257087 - RNA, 14 nt, Mycobacterium tuberculosis H37Rv
ugggaaaucccgac

SEQ ID NO: 1257088 - RNA, 17 nt, Mycobacterium tuberculosis H37Rv
ugggaagugcggugaga

SEQ ID NO: 1257089 - RNA, 14 nt, Mycobacterium tuberculosis H37Rv
uggcugaucccggc

SEQ ID NO: 1257090 - RNA, 18 nt, Mycobacterium tuberculosis H37Rv
uggcugagcccgccgcga

SEQ ID NO: 1257091 - RNA, 15 nt, Mycobacterium tuberculosis H37Rv
uggcguucgucggcu

SEQ ID NO: 1257092 - RNA, 15 nt, Mycobacterium tuberculosis H37Rv
uggcgugccgucgcc

SEQ ID NO: 1257093 - RNA, 13 nt, Mycobacterium tuberculosis H37Rv
uggcgucggcguc

SEQ ID NO: 1257094 - RNA, 19 nt, Mycobacterium tuberculosis H37Rv
uggcguaauugucgauguc

SEQ ID NO: 1257095 - RNA, 12 nt, Mycobacterium tuberculosis H37Rv
uggcguagcaac

SEQ ID NO: 1257096 - RNA, 20 nt, Mycobacterium tuberculosis H37Rv
uggcggccagcgcaccgccg

SEQ ID NO: 1257097 - RNA, 19 nt, Mycobacterium tuberculosis H37Rv
uggcggccgcaaucauguc

SEQ ID NO: 1257098 - RNA, 23 nt, Mycobacterium tuberculosis H37Rv
uggcgucgacaacacgccgucga

SEQ ID NO: 1257099 - RNA, 13 nt, Mycobacterium tuberculosis H37Rv
uggcgucgauguc

SEQ ID NO: 1257100 - RNA, 12 nt, Mycobacterium tuberculosis H37Rv
uggcgucaccgc

SEQ ID NO: 1257101 - RNA, 16 nt, Mycobacterium tuberculosis H37Rv
uggcguauagcaugcc

SEQ ID NO: 1257102 - RNA, 22 nt, Mycobacterium tuberculosis H37Rv
uggcgucgacgucgacggcgau

SEQ ID NO: 1257103 - RNA, 22 nt, Mycobacterium tuberculosis H37Rv
uggcccuccucggugagguagc

SEQ ID NO: 1257104 - RNA, 17 nt, Mycobacterium tuberculosis H37Rv
uggcccguuggcagcac

SEQ ID NO: 1257105 - RNA, 22 nt, Mycobacterium tuberculosis H37Rv
uggcccgggucuccggcgcacc

SEQ ID NO: 1257106 - RNA, 15 nt, Mycobacterium tuberculosis H37Rv
uggcccgcggugacg

SEQ ID NO: 1257107 - RNA, 16 nt, Mycobacterium tuberculosis H37Rv
uggcccgaucgaccgc

SEQ ID NO: 1257108 - RNA, 14 nt, Mycobacterium tuberculosis H37Rv
uggcccgaguuggc

SEQ ID NO: 1257109 - RNA, 14 nt, Mycobacterium tuberculosis H37Rv
uggcccgaccggga

SEQ ID NO: 1257110 - RNA, 18 nt, Mycobacterium tuberculosis H37Rv
uggccccgguggugcugc

SEQ ID NO: 1257111 - RNA, 20 nt, Mycobacterium tuberculosis H37Rv
uggcccgccagaacggcguc

SEQ ID NO: 1257112 - RNA, 19 nt, Mycobacterium tuberculosis H37Rv
uggcccgccacgaugucgu

SEQ ID NO: 1257113 - RNA, 23 nt, Mycobacterium tuberculosis H37Rv
uggcccgcacgaaccggucgaag

SEQ ID NO: 1257114 - RNA, 16 nt, Mycobacterium tuberculosis H37Rv
uggccaucgcgcggac

SEQ ID NO: 1257115 - RNA, 14 nt, Mycobacterium tuberculosis H37Rv
uggccaugccacaa

SEQ ID NO: 1257116 - RNA, 22 nt, Mycobacterium tuberculosis H37Rv
uggccaguccgaaagccgccga

SEQ ID NO: 1257117 - RNA, 16 nt, Mycobacterium tuberculosis H37Rv
uggccaugcaccgaug

SEQ ID NO: 1257118 - RNA, 20 nt, Mycobacterium tuberculosis H37Rv
uggccaucaucgacggugau

SEQ ID NO: 1257119 - RNA, 14 nt, Mycobacterium tuberculosis H37Rv
uggccaucagcucg

SEQ ID NO: 1257120 - RNA, 17 nt, Mycobacterium tuberculosis H37Rv
uggccauguccaccagc

SEQ ID NO: 1257121 - RNA, 13 nt, Mycobacterium tuberculosis H37Rv
uggcccaaccgca

SEQ ID NO: 1257122 - RNA, 16 nt, Mycobacterium tuberculosis H37Rv
uggcccaccgccguug

SEQ ID NO: 1257123 - RNA, 13 nt, Mycobacterium tuberculosis H37Rv
uggcccagcggua

SEQ ID NO: 1257124 - RNA, 18 nt, Mycobacterium tuberculosis H37Rv
uggccagccacagccgac

SEQ ID NO: 1257125 - RNA, 19 nt, Mycobacterium tuberculosis H37Rv
uggccagcagguuggucac

SEQ ID NO: 1257126 - RNA, 16 nt, Mycobacterium tuberculosis H37Rv
uggccagcagccgcga

SEQ ID NO: 1257127 - RNA, 13 nt, Mycobacterium tuberculosis H37Rv
uggccagacccac

SEQ ID NO: 1257128 - RNA, 13 nt, Mycobacterium tuberculosis H37Rv
uggccagcaggcg

SEQ ID NO: 1257129 - RNA, 21 nt, Mycobacterium tuberculosis H37Rv
uggccaccucgggugugguca

SEQ ID NO: 1257130 - RNA, 22 nt, Mycobacterium tuberculosis H37Rv
uggccaccucggguguggucac

SEQ ID NO: 1257131 - RNA, 19 nt, Mycobacterium tuberculosis H37Rv
uggccacggggcugccggu

SEQ ID NO: 1257132 - RNA, 20 nt, Mycobacterium tuberculosis H37Rv
uggccagcaacugccgcacc

SEQ ID NO: 1257133 - RNA, 13 nt, Mycobacterium tuberculosis H37Rv
uggccagcacggu

SEQ ID NO: 1257134 - RNA, 19 nt, Mycobacterium tuberculosis H37Rv
uggccaggucggccaccgu

SEQ ID NO: 1257135 - RNA, 20 nt, Mycobacterium tuberculosis H37Rv
uggccagguggccgcaucgc

SEQ ID NO: 1257136 - RNA, 17 nt, Mycobacterium tuberculosis H37Rv
uggccaggucggccacc

SEQ ID NO: 1257137 - RNA, 13 nt, Mycobacterium tuberculosis H37Rv
uggccagguugcc

SEQ ID NO: 1257138 - RNA, 18 nt, Mycobacterium tuberculosis H37Rv
uggccagcgucgcgauug

SEQ ID NO: 1257139 - RNA, 14 nt, Mycobacterium tuberculosis H37Rv
uggccagcgcguug

SEQ ID NO: 1257140 - RNA, 19 nt, Mycobacterium tuberculosis H37Rv
uggccagcgcggcgucgcc

SEQ ID NO: 1257141 - RNA, 17 nt, Mycobacterium tuberculosis H37Rv
uggccagccacuccucg

SEQ ID NO: 1257142 - RNA, 21 nt, Mycobacterium tuberculosis H37Rv
uggccaauagaagcacgucgu

SEQ ID NO: 1257143 - RNA, 21 nt, Mycobacterium tuberculosis H37Rv
uggccaauccggcggcgacgu

SEQ ID NO: 1257144 - RNA, 19 nt, Mycobacterium tuberculosis H37Rv
uggcaucgaacgcccugac

SEQ ID NO: 1257145 - RNA, 21 nt, Mycobacterium tuberculosis H37Rv
uggccaccgccgaaaaccucg

SEQ ID NO: 1257146 - RNA, 21 nt, Mycobacterium tuberculosis H37Rv
uggcauccaaaaucgccugau

SEQ ID NO: 1257147 - RNA, 17 nt, Mycobacterium tuberculosis H37Rv
uggcaucgcgagccagc

SEQ ID NO: 1257148 - RNA, 19 nt, Mycobacterium tuberculosis H37Rv
uggcauaaccgcugauagc

SEQ ID NO: 1257149 - RNA, 16 nt, Mycobacterium tuberculosis H37Rv
uggcaggugaucccga

SEQ ID NO: 1257150 - RNA, 14 nt, Mycobacterium tuberculosis H37Rv
uggcaccagccggu

SEQ ID NO: 1257151 - RNA, 17 nt, Mycobacterium tuberculosis H37Rv
uggcaccagccggugag

SEQ ID NO: 1257152 - RNA, 21 nt, Mycobacterium tuberculosis H37Rv
uggcacccgcgucgagugccg

SEQ ID NO: 1257153 - RNA, 20 nt, Mycobacterium tuberculosis H37Rv
uggcacccgcgucgagugcc

SEQ ID NO: 1257154 - RNA, 17 nt, Mycobacterium tuberculosis H37Rv
uggcaagggccgacguc

SEQ ID NO: 1257155 - RNA, 15 nt, Mycobacterium tuberculosis H37Rv
uggcaggccagcaug

SEQ ID NO: 1257156 - RNA, 14 nt, Mycobacterium tuberculosis H37Rv
uggcaggccagcau

SEQ ID NO: 1257157 - RNA, 15 nt, Mycobacterium tuberculosis H37Rv
uggcacgggucguca

SEQ ID NO: 1257158 - RNA, 20 nt, Mycobacterium tuberculosis H37Rv
uggcacgugaaagccgacca

SEQ ID NO: 1257159 - RNA, 18 nt, Mycobacterium tuberculosis H37Rv
uggcagcacaggcuggcg

SEQ ID NO: 1257160 - RNA, 20 nt, Mycobacterium tuberculosis H37Rv
uggaccgauuucgccugcgg

SEQ ID NO: 1257161 - RNA, 18 nt, Mycobacterium tuberculosis H37Rv
uggaccacgugaucgacg

SEQ ID NO: 1257162 - RNA, 22 nt, Mycobacterium tuberculosis H37Rv
uggaccaccgccgaagcugcgg

SEQ ID NO: 1257163 - RNA, 22 nt, Mycobacterium tuberculosis H37Rv
uggacaacagcuuggagaucgc

SEQ ID NO: 1257164 - RNA, 23 nt, Mycobacterium tuberculosis H37Rv
uggacagaaucgaccgccgcuac

SEQ ID NO: 1257165 - RNA, 22 nt, Mycobacterium tuberculosis H37Rv
uggacuccggucagcgcggcga

SEQ ID NO: 1257166 - RNA, 21 nt, Mycobacterium tuberculosis H37Rv
uggacgcagagucaacagaua

SEQ ID NO: 1257167 - RNA, 13 nt, Mycobacterium tuberculosis H37Rv
uggacgcgcaugc

SEQ ID NO: 1257168 - RNA, 15 nt, Mycobacterium tuberculosis H37Rv
uggacgccgccggag

SEQ ID NO: 1257169 - RNA, 14 nt, Mycobacterium tuberculosis H37Rv
uggaauacgcugcu

SEQ ID NO: 1257170 - RNA, 17 nt, Mycobacterium tuberculosis H37Rv
uggaacuggacaccgug

SEQ ID NO: 1257171 - RNA, 20 nt, Mycobacterium tuberculosis H37Rv
uggaacuccguccgccguau

SEQ ID NO: 1257172 - RNA, 22 nt, Mycobacterium tuberculosis H37Rv
ugcggggcgauccccagcacca

SEQ ID NO: 1257173 - RNA, 23 nt, Mycobacterium tuberculosis H37Rv
ugcggguagccgucgaucccggu

SEQ ID NO: 1257174 - RNA, 20 nt, Mycobacterium tuberculosis H37Rv
ugcgggggcuuaugcgucug

SEQ ID NO: 1257175 - RNA, 19 nt, Mycobacterium tuberculosis H37Rv
ugcgggggcuuaugcgucu

SEQ ID NO: 1257176 - RNA, 15 nt, Mycobacterium tuberculosis H37Rv
ugcgggggacacguc

SEQ ID NO: 1257177 - RNA, 19 nt, Mycobacterium tuberculosis H37Rv
ugcgggcuuugagcgcccg

SEQ ID NO: 1257178 - RNA, 18 nt, Mycobacterium tuberculosis H37Rv
ugcgggcgaucucgaugu

SEQ ID NO: 1257179 - RNA, 19 nt, Mycobacterium tuberculosis H37Rv
ugcgggcgccccaccggcc

SEQ ID NO: 1257180 - RNA, 13 nt, Mycobacterium tuberculosis H37Rv
uggaggccgccga

SEQ ID NO: 1257181 - RNA, 21 nt, Mycobacterium tuberculosis H37Rv
uggaguauccggcagaccggu

SEQ ID NO: 1257182 - RNA, 15 nt, Mycobacterium tuberculosis H37Rv
uggaguucucaucgc

SEQ ID NO: 1257183 - RNA, 18 nt, Mycobacterium tuberculosis H37Rv
uggagaucacgccgacga

SEQ ID NO: 1257184 - RNA, 23 nt, Mycobacterium tuberculosis H37Rv
uggagcgcgccucgcccagcaag

SEQ ID NO: 1257185 - RNA, 19 nt, Mycobacterium tuberculosis H37Rv
uggaugcgccgcacggcga

SEQ ID NO: 1257186 - RNA, 15 nt, Mycobacterium tuberculosis H37Rv
uggauccagcccgac

SEQ ID NO: 1257187 - RNA, 16 nt, Mycobacterium tuberculosis H37Rv
uggaucagggucauca

SEQ ID NO: 1257188 - RNA, 16 nt, Mycobacterium tuberculosis H37Rv
uggaugggcugcgcgu

SEQ ID NO: 1257189 - RNA, 21 nt, Mycobacterium tuberculosis H37Rv
uggcaaccacguccgcaaccu

SEQ ID NO: 1257190 - RNA, 12 nt, Mycobacterium tuberculosis H37Rv
uggcaaccgcgc

SEQ ID NO: 1257191 - RNA, 15 nt, Mycobacterium tuberculosis H37Rv
ugucgcgaucgcggc

SEQ ID NO: 1257192 - RNA, 14 nt, Mycobacterium tuberculosis H37Rv
ugucgcgcaccgga

SEQ ID NO: 1257193 - RNA, 13 nt, Mycobacterium tuberculosis H37Rv
ugucgcugccgcc

SEQ ID NO: 1257194 - RNA, 13 nt, Mycobacterium tuberculosis H37Rv
ugucgcggugcgg

SEQ ID NO: 1257195 - RNA, 20 nt, Mycobacterium tuberculosis H37Rv
ugugacacaacgaucugcug

SEQ ID NO: 1257196 - RNA, 19 nt, Mycobacterium tuberculosis H37Rv
ugugaaucugacgacgcga

SEQ ID NO: 1257197 - RNA, 17 nt, Mycobacterium tuberculosis H37Rv
ugugaacuggucgacgu

SEQ ID NO: 1257198 - RNA, 22 nt, Mycobacterium tuberculosis H37Rv
ugugaguagcccgcgucgacga

SEQ ID NO: 1257199 - RNA, 23 nt, Mycobacterium tuberculosis H37Rv
ugugagguagucggcgcgucguu

SEQ ID NO: 1257200 - RNA, 18 nt, Mycobacterium tuberculosis H37Rv
uguguccugucgcaccag

SEQ ID NO: 1257201 - RNA, 19 nt, Mycobacterium tuberculosis H37Rv
uguggugugccugcgucuc

SEQ ID NO: 1257202 - RNA, 16 nt, Mycobacterium tuberculosis H37Rv
uguggugcggcgcgau

SEQ ID NO: 1257203 - RNA, 19 nt, Mycobacterium tuberculosis H37Rv
ugugggugaacaccgaggu

SEQ ID NO: 1257204 - RNA, 15 nt, Mycobacterium tuberculosis H37Rv
ugugcaccaucauca

SEQ ID NO: 1257205 - RNA, 19 nt, Mycobacterium tuberculosis H37Rv
ugugcacggcuucggcgag

SEQ ID NO: 1257206 - RNA, 16 nt, Mycobacterium tuberculosis H37Rv
ugugcaucggcgaccg
